United States Patent 10,900,036 (RNA INTERACTOME OF POLYCOMB REPRESSIVE COMPLEX 1 (PRC1)) - sequence listing, part 15

SEQ ID NO: 30400 - DNA, 1162 bp, Mus musculus
agtgtctctgaacctttgttatgtttacagacaccttggccatagctttggctcgctctttgactagctcataacttaatattctgtttaatctaaactctgtcatgtggctggtcacctctgctcagctctcatgaattttcctcctttgtgtccagggatgaatcttcagtgcttggctctatcccagaatcctttctgcttatgggatagatacccttctattcagcactttcctattggccataggggtatttatctatttatttttattggtcggtgatgtagccatacactacacaggaggttctctctacatcccaggttctttaaatggaaagtgatgtttgtgcatgctggtctgagtgctaggggtgattgtgaccacagtgtgtctgcccgtccttggtgttctggacaagatcttgaaccatggctctcaaccttcctaacgctgtgaccctttaacacagttcctcgtgctgtggtgacccctgaccataacattattcttgttgctacttcatactgaaattttggtcctgttatgaatcgtaatgtagtggatatctggtctgtgaccctgaggggctcagtacccacaggctgagaactgctgatctagatccgggatgaaagcattcaaaggttggtgttcaggtagtgtttgcagtttacggcaggagcaagcggaacctcctgcaggtagatgtgaacatcttgagctctgtcgcttcccctcccacgttacaaacaacagactctgggggaatgcaggcacccaccagttgtcaccatttgtctggggtggaggctcaacctgaacgatatgtgtccgagtgttcaccacatgcgtgcagtgcccacagaggccagcagagggcatcagatcccctgggactggagtcacaggtgtttatgttatgatctgtcacatgggtgctggggtcagaacccaggccttctgcaagagcaatagtgatcttaactatgaagccatctctccagccccctaatttcaagtcgcctccctgatcctggaaaattatcccaaactaccaggtttctttttgttgttttcttgagattgggtcttgtattacagcccagactgatctcaagccctcaatgtcctgcctccattctcagagggctgaggctg

SEQ ID NO: 30401 - DNA, 1205 bp, Mus musculus
gccgcaatgggaaactggggcacgcctcactgtggatcgtgggttctgaaagtcagcgtccacctcaagagcatagcttgacatcacgtggggaagcttccggttcctgtactctcagatgtccgggactagcttgttctggttagtacctgtgcttggcttcgatagaggaattgggtcccctggagctacagatagttgcgagccccctgctatgggtgcagggactagaacttacgccatctggacatgtccttagccactgggccgtctccagcatgtgtagtcctttattagtagtggggagtgctcaggaacttgacttttttgttgctagggctcaggccagccagctgagaggacagccacggcctgtcagccaggtcaggaactcacggtctgcctggagttaaagcatttttctttttataaactgaggaacgaattcaagacattcttttcttcaaagaaatggaacaagccaattaagaagcccaaaataaactctgaatggctaatcttgcacagggttcagacagttcctccagcttccacatccacaaaaggctctgtgagcccgcctgtgcttctgcagaccacgggagactctggccctcacggcgctcgcagagacctgtgtggcgacgtggttcttacttaggttagtggcctgcattagtcagtatcactccatctctgtcggaatgagagtgcccactcgtccttgactgcggagagagcctagtgggtagagttagcgtgaggacctgacttcggatcttcaacatcctctgacaagccaggctcagtgatgcttgtccgtaaccccatcactaggggtccgaggcaggaggagcctaggggctctctggctgccaatctatccaactggtgagcttcagattcatttggagacactgtctcaaaacgggggtgggggaggcaagagaagatacctccacacgtatacacacatatccctccagcccccccccccccccgttactatgcctcagtcacatgttggctttgggaggtgcctatcttttgggcctttctcggctatgattctgtctgtgtggctttgtcctgcaggtgagggtggtggtcagtcctgtgctatggtggaaggcctggctgcgagccccaggtcacttgacctgatgtttctgcccttctgggctgctgcctggtcactggagcat

SEQ ID NO: 30402 - DNA, 5033 bp, Mus musculus
gacctgtccagcgaggctgacacatccaccatcgctgactcgcaggacgccaagtgtggtctctcctcttccttcttgcccgaaccccagtctgcgccaagggaccccgctgcaacctctaaatcatcagggaaatctgccccagaacacttgaaaagcccgtcgagggtaaacaaaagctgactagctttcagctctgtaaggttttcatcatgtcctgatctactctcatgtcttgatttgtgttaatgacttcagtcttctgggctttccccacttagatcccgtgaggggggacacccgggtgtaggacctgggcaacctggaaactgtcagccaagagtcacattcagatatgtacacgcaagccagggctacggcttggttgttaagagtgtgtgcctgacatgcaccaggctctcagttttgatgcccagaaaccgtaaaaccaggcacggttgcgcacgcgtacggaaattccaacactggaggtgcaagcagaaggattagaagtcatcttcagctacatggtgagttttaggccagcctggtggagagaaaaagaaaatgtgtgcggacatacaaaatacagtttgcaacatgtcaaggaaccacattggcgaggtcactgcagcccacgatcccggctcattcccgtcctcgagggagaatcctcagagggcaacacaaggcctacctctctgctcactgtgcatttttgtttataaaacggtaatgaccaaggctcgttctgagaacaatgctatgtccagaagggattttccaagagaattgtggggggttttgggtttggagttttttttgttgttttttttttttgttttgttttgtttttttgagggtggggacccgcagaaatgtcaagactttgaacctgattgtcccaagaacagctaggtgatatcatcagaggaaagcacttagggagagtggccccgtctaatcctccatcctggtggggttgggtcctcagctgttggcttcccttcaagcttatgtcacccagtcactgagaaggcactgcgagcctcatctgctgctaacggaggttgtgggcctggggtgtggatcatcctgctgtgaccacacggtaaccctccaggatggctcagtaggaaccatctccacacttgctgagaggaaaggcagcgtcagcaacggatactttcttacaagtccctccccagagccagtctgagaggagagagtctattgaaaagctgctctgatgtttaccagagtcccttcccgtggagagaatagaatattgcttccttgtctcctccggctcccccttgctgtaatgatgggacaaaggaggcttggccacagcacaggtgtgagcacagattagctcaatgaagcaggaggcctgggctctgggttcatatcatgggcctcgactggtgcccatcatgaaaagggtgcttaaggattttttaaattttttttttccttaaggattttgaagagagacaagcagagaggcagaccagcagaaagccttgacttggtatttagccaacgatggtgcacagccctgtgaggtcacatatccatttgggctctgttaatgtgtttaggttttggttttttgagacagggtctcaccatgtacctccgctgtcttggaactttctctgcagaccaggtaggcctcggactcagcagcgatgcatctgcctctgtctctcaagggtttggtttgggtattttggtttttgaagtagactctcaccctgtagttcaagctggcttcaaactcacagcagtcctcctgcctcagccttccaaatgctgagattacaggtataatcccatcatgcctcagacttggttgtttacattttgaagggtaaatggcgcaggcttgtgatctacactcaggagggtgaggcaggtccaccatgagttaaaggccagtctgggccacaaagtgagattctacctcagaagtagtaaccttgccagagatggtgttacctgcttcagatgtctgctgcgagccctctcagaaagcttgctgatgccccaaggctgcttgtaacactgcaggaagacggggtttctatttgaaggctgcctttgctccttggatatcacagaccaactccttccctcccacactccaaacttgccagcctacccctttacctcttgagcagatggagtccttgtggagatgaccacagctccttcctgcagttggctggctcagccagacagctcagtgagaccacaaagtcttcaaggatatgttccggaagtatgcgtatgggggtcctcccacactggttagaaccaacggagtccggatggtttggaggttgcagccaggtcccttggcacagcctgggattcgggcaagaaggaagaagagagaccgccatcctggtgaacgctctgggtgtctccaggatctgggccagttctctcttcattcgtctggggtctttgtgacctctgtctcagaacatttctccctggcatgattttttttttttaaatacatgtatgttattttatagggatttattttcccactactgtcaataccagtcaccttaaaaagcgatcatccacttattcctgaaaccctgtgggtttcttccactcttccctcagccaacaaaagcaaaaaaaaaaaaaaaaaaaaaaaaaaaaggccaagtttaatgacatcgccaagttcaatttcacatggtgggtcaatttctgtgtcaaaataattccttagatttggtaatgataggcttccactgtgtttcttaatcccatctgcaagagcgataggatttttgaaaactttcattttgaaagagtcaggacaggaggatgaactcaggcaggcctctcgctcccagcagactaccttacacctgtttgagaagcactggccaatcagccaacggtgcgaacagcaggggggcggatccccatcttcagaccggaatccctggcgggatcctgttcattccttggctctctctgtaaacacagtgaattggcatttaatggaaaggctactttggaactctccctgctaagctaagacggtggcaactcccatattgtctcaggaaaagttttgttccagctaggcttggtggcacactctcgtgatgccacgcagtggatcactgagtccagagctttgtagacgctgaccaccacccctcccccgccccgccaaaaataaaaaagttagctttgggagctgctccacacctggctattttagctttgtgtgtaatcatagcaagcagaggtagagggatttatgcagcgttgatgactgccattttcactgaatgcccttgttgaactaagagctttctgctcagctggatggcccgggaactttacatagccccccccccccccaaagtctgaaccatgtgggggccttgctctacaccaacacagaaggcttcctgaagtgtaagggagaagatactgggcagaggtgggagcctgatcgaatgaacaaagagccaggtgtctttctcagatcctcacccccatgttttcagtgcagaagccctaccaaccacacacagctcatccatgcggctcagccatgctggtctctccgaggtacccagatagctgcacccctctgctccccttgctcagcagcttgctctagctgaagatcaggcccagcatcctctgcccttgaagagcccagagggttctacaggatggaattaagttctgaaagattaggtgttgacagccagcctgtatttttgtgcacccatctcagggaccaccccggaaagcttgtgaatctcccactcttcaggagccatttctccttagcaagaacaagatcacaagagacatcacacatcacccctttagggagttactttctacctgctggcaaggttggtatgagagttgatttctaaccccaatgggctggctgatacttagcagggctcttgaggcacgttcaaccccttcagggtaaccagagtacctaggaccacttgcctgaccctagctgtgcagtccagaagagccagggaggctcccagtcctccccgtgttggctgcaatgtcactgctggtgagggagactcttggtcccaccttcccatcctaacggctgggttcctgctgatcataagaccagatgaaggtcattggtgttcccctatccaaagccctttgtttttcttactgtggaggtgtgagagtccagtgtgtatggagatatatgtacataagtgtatgaacatagaccttgtgtgtgcattatagatctatatacatgtaagtgtatcctactccatcagacctggtgtgtgctgttccttagcacacactgtggtctccagctttgcaaggaaatcaccctggacccatctgcaggagccaccaggggccatctggagaagggcgatcctttggcagtagacaccacagctcctctttcagtccctatcttagacacagcctctgttgccctggccgttggccttgctgcatgagaagacagctgcttcctcctctaccctgtaattattctttttacaattgagtgccttaataatggtttacaaatactgtgtatttatgcgcaaccgttcagctctcgtctttcgaggctgggtacttttgtctggtcctggtggttaagattagcacgtgagttcctccctacccccatccacttgtgttaatctgctctgcagttgacactgtgggtcctgactactccacagagcctgctagaaactcggctgcttggtccccgcaggccatgcctgcatgcatcagcacacaccgcagcccgaggtagccggtgagggacatgatttggtttgccaggtagcacaggggtggtgcaggaccagtactccctgaaccacagtccaagacctccccttagcccctcaaggtcaccctctagtttatagaggcttgccaccccctaacacccttcacactccctcctcctcttctgcctgtgtcctgagctccttgctgcaaatcatggg

SEQ ID NO: 30403 - DNA, 1234 bp, Mus musculus
ccaagttgttactatcattattaattattatcgtttgtggcagccgtggttggttttatccacttttcttttctttctttcttttttttttttttttaaattcttaggaaccaaaactgaatttaataaacacttggctcaagtttatttcctcatcctgccaggatggtgggacagatagaattaaggacagttgggctgttttgctgtgtctgagggacatggacatcctaggagctctcacctccctttggggcgggggggggggagggacacgacgacagggggacccttttgcctgtgcctttgcatccctcagcagcccattccctgagaaattctcagctttgagttgttttttttgttgttgttgttgttttgtcaaaagaaataaaagtggctaactaaataaagcttacatattgtaaagccccctcctcccctcccccaagatgttacacactgaggcgcaggtcagcagtgcactcaggagcccctgctgttccttaaagacctttcctgccattagacgcctgcagtacagccctgcctacagacctgaaggctttagagttggttgctggaatgtgacccaaccagcttgggagagttaggggctatgggatggggtctgctgctggcgactgtttattcctttggaaacggtgagggatatcctgtctgcctgcgagcttaattgatacagcctctgggagttgacagttgtttctagctactgtgtgtccctcacacacctcgctagcagagcctccaagagggagccatttctgaattgcctttccaccgctacagaacccaagccgccttgcgccctcttgcgctccctcccccccccccccctgtggacaggtcccatcctgagttcctctctccttcctgcctcccaggtctgccctgcaagtgcttcacaaggcctgcgaagtggcccggaggcataactacttcccaggaggagtggcgctcatctgggccacctactatgagagctgcatcagctcggagcagagctgcatcaatgagtggaatgccatgcaggacctggagtccacgcggcccgactcccccgcgctgtttgtggacaagtaggtgctgaggctcctcccacactgatcaacactgctccctctcagggtctggcttccctcacagccccttgactgagaacccccttccagaacaggtttaacctgaacctgtgcctgtgggccagagt

SEQ ID NO: 30404 - DNA, 1209 bp, Mus musculus
tgttgtgcttagttactgtcttgagtgctgtgctcagtaatgctctcccgtgttctgcctaaacactttttttttttttttttttttttttttggtttttcaagacagggtttctctatatagctctggctgtcctggaactcactttgtagaccaggctgggctcaaactcagaaatccgcctgcctctgcctcccgagtgctgggattaaaggcgtgcgccaccacgcccggctcctgccaaactcttgaagaagctctagaaacacgtttggcctgtctttggactgtgtgcatttgagtgatggaaggaagcctctcactttgatcgggaaacatgctatttgtgaagatgccgtgggtggtggtggggagccctgacctgcagaaaacaaagtgatggagagtacagctaccagagccttgccagtcacggtagactgtgtaaagggctcttcatgcctggctttgaggcagcttgtggcccaggtcaaggttccagggccggagacactggctcctgggggcagtaatgggctgctttttgctgcacaggctgtgtgtgtaggaggagagccagtggaatctgcgtgttgggtgcaggcccggaactgggaggagaacttgatgagggtggtggggcccccagagcctttgcagcttcctgtgccctgctcctgtgacccttccctggggtcagaattccttctaccctccacccgtccatcccttcctctctgggcactgggccagggagagcattgagctagctttgtctttaattgcccttaattagcaggatgcttgaagatgttttatagccgagaacttagaactgtgataagaaactgtgtctgtctgtggtcccttctcactaataaaagagaaagtttcctggtttggcactttggggaggcctgacataggatgggggttggtgtctctgtactttgacacctctgtgttccagtgaagtatttgtgtgtggtggtgtaggcctgtcaccccagctctctagagactgaagctctctgaggcctacagagttcaagggcaactggggttacattgcaagaccctgcttaaaaacaaagacagccgtggggggaggggggagaactttcgagcaagcgttgtgcctccaggctggtagcccagggtccagtcagtctgtccagatgagtcagttcttttggacccacagacaag

SEQ ID NO: 30405 - DNA, 1195 bp, Mus musculus
atcagatggggagtttggcacaggctagaccatagcaatgactttggatttttttgttgggttggtttgggtttttgacacagactcttactatgtgtttagcaagaacttggacttaggatcctcttgctcctgagcgctggggtgatggcacccactatgcctggcgatgtggggaatcttaagtcagatgggccttactctgtagcccaggctgtccttgaactcaagcaatccttcctacttcagcctcttagagcgaggactatggaactatgcttttgggggtgggggtggagtgctcccatacgtgccatacgtgctgcccacagctctgagaagccgttattatctttctgcatctcccctcctcttccccctgcaggtgatgctggaatcttccgtgtacctgaccctggctgtctacagtggctgctgcctcctggctggcgtggcctcctgctttctgcccatagagaccaaaggccgagcactgcaggagtccagccaccgggagtggggccaagagatggttggccgagggacaaacagcgcaggtgtccccaggtcggactctggctctcaggagtagtgacccctgggagttgagcttggagcctagagagctggcagagcccagctgggccacttatggtcactgccgacatcaagaacttcccccccacccccgagagggcgatgtggaccgacagggttttgtgtcttcactgtgtttgaccatgttcatcatcgagggtcatgcgccccaggaagatggggcagcattcactccagggggttctctgtggtgggggatgggctgcacatcaccgtggatctgcatggggaagctgctagtgagggagggtcccagggtgctcagagccagctgagcagatgtcacattgctacccagtcatacccttggagagccactgcccaaaggtctccatagatagtctccgcccagacccctgggacgcccgccattttgtccagttatgtttctcctgcaccctggcctcaggaattctttggaattaaggcaagctagctagtgtctggctggagcagctcttctggagcctgagactccctcacccccaccccctgctgctaccttggctgggcccctctagatgcctctccacaacctgcgggggtagaaactggccaatgaaagtgctttggaatt

SEQ ID NO: 30406 - DNA, 1794 bp, Mus musculus
tggctgtgggtgggtgtagacagtagggcagaggtgggagcatgggtgtggggaggagatgggaggggagggggagtactcccaggtaaagaaagggcttccaggggccaggcagtgagactgagcctggtgtgtcacacacatctctggctttgagggggagagcactcccccagtgtgatgtgagcactgggttttgtgaattctgggcatacacacaccttaggtgggcggggcggggagttcagggctggctggaggtgtggtgaccgctttacactctgaccttttacagaagcgtcaccatgtcctgcagacagctcacccctccccgctgtcggtgcacagagggttcctgggatgcagacatttttctaaagccaatgaactgctccagaagtctggcaagaagcccatcaactggaaggagctgtgacccgcccacccgcccacaggccgcatctgtccacagcggtgctttcagctgccgccgcagcttttgctggttaagttctaagttccttgtgtgagtggagaaatgacacggatagatctctataggaccatcatgagccaaccaggacacagaaactgcagctctggcaggcagaacctcttgcctggcactaggtttgaactctccaggcccggccaggtggctgttgagacacacctacttctcagaccagcggacacaccctcggtcccgtgtgctgctctggggtgggaggaaagatctgcacctttggaccagcagtttggtgcctgctgctgtccgctttatcctttagagttagagatttcaaagtgtgtgtgtgtgtgtgtgtgtgtgtgtgtgtgtgtgtgtgtgtgtgtgcttcaaaaggcccttttgtctggaaaggaacccttgggtgttggtgagtcctgagaagtctggcttacaactgaatgagcttcctgatcacaaagggggcggggttctccctgggttcacagtggccgctctccaccctgcgtcttgcctttgcctttgcaggctccgaagttgagcgaagcaggaatgggatagatttgtttttaagtgagggtgggtgggtttcctggtggcggtggagttgtttcctcctctctgcagacagcagactgccgcgcttggtgtgtgtggtgctggggatctaactccaaggtgctgtttcttaggggctgagttcacacaagttgtctttctgcaacactggagaacgttatttttttttacaaggtaggcaggtacagtaatttctttttcatgcttttctgaaagacaatcttcactgagtttacaagctggattccgtgagtccagctggttagagccgtggcctgcctgaccaggctaataaaagatggttgacaattggcggtgtgccgactattcttcagtgtttcacaagcccgagctcctgctgtcaccatggctaccactgattgcaggaagggcgactgtgtccttgcgccctgcttgtagctctctgtggttccacccactgcccgccagcagcttgctgcactgctgccaaggactggttggccagagtaggggatctgctgggacccaaagggacagcttcctgacgaggaaagtcacttctttgggggtgttgttggcttgcccatccatccttgccaacgtctgccctgtcctgtgagcttctagactcttccctgggaatatgaagttcaagtgtgactctgacctgttggtttgctgtttaggcctgggttgctgagttccagcatacaaaacacacagcctttacatttttattgaac

SEQ ID NO: 30407 - DNA, 1218 bp, Mus musculus
taggaatggagaagccatgtatacactgtgtaaatgctcatgtgagaatgacctagcggcacaatctgacttgccttggcctctggccttccggttactgtttttggcagctctctctaccttcctctatcctcaaaccttgtgcctgtagctttgtacttcagctcccagggataggaacagacctagtgaacattccacggtgcctgatctcgctggcaactgagtccagctagggcctgacccagcgtcagtctccaaagctctgcttccggattccaaacactggcgtgaggggcagtagtcagcacttctagatcaccatctagtgagtcgctggtgtagagtgaacttttactgcacactaagggctcacaattaaaataaaccagaatagctttttgctcatggtaaccaagttcagtgtctgtggggcccacagcctggcaggtctggcccagctctctgtcacctgctgtgggagatggaccgtttgacctctctggaggctgagaccccatacctgctgctcagtgctggtaatcagccctccccagagtgcgtgccggccagagggctccacccacagtccctggtcatgtacgcacatcacactcttcctgcctctgcactatgaaaaccatactgggagttttagaagtgctcactcttgtacgagtgtctgcggacatgtgtaaaataaacgttaaactctgcttctactcacgccgccttctggtcttttcgagatcgcctggcccagtcagcagggctactgaggtgcagcaagggcaaggctgccacatcctgcctcagagtctgtccttctctggagggctgagggatgggctggtgttagattggcatcagaggccccgactccccccgggatccgggagcctagcccatccctggcagcatgcgccacgggcagccgggttgagattgtgcctcttgacaagattttctttactcctgggtctcagcagcttgccagaggtacagagtctgccgcccaccctacagtgacttcttggtgtgcgcctaaattgggttccaccagggacaggggaagactctaggttggctctcaggaagcgactagatacagcgccacctgaaacctggctctgccgtagcatgggctccttgatgcggctgttctccaggagctgccgcattggccttgagcgtggataactggaggggtccatgctt

SEQ ID NO: 30408 - DNA, 1593 bp, Mus musculus
ccatggctggtctgtgtgaagctgaggagcagaccctgcccatggaggaagtcggatacccagaatagctttgcaagctctctcccttcactgtcctgggctcacctctcagttacccagagagctggggctttgcttatccctgtcattctcccacccgctcagaccccaactccccacccctgccatgaggaagatgtcactgaggacaggctctgcttgcagccgtgaatccgctggaggccgaagtgtagtcaagtggaggacatccagggagcactgtggactccctgggattgcattgtcagcctaggagctggggagcctgaggccctgctgagatgtagtgtgaggtagtggccatgtgcagccggctaacgttcccaccatgtattttgtggggcacaggttgagttccctgaagcccgcatttatgaggagaccctgaatatcttgctgtacgaggcccaggatggccgaggacctgacaatgccctcctggaggccacgggcggggcagctggacgttctcatcacctggacgaggacgaggagcgggagcgggagcggatcgagcgcgtgaggaggatccatatcaagcgcccagatgaccgggcccacctccaccagtgagcaggccgagcaccctgccttctgccctccctctgctcctgccccgccccctcagaccctgtgcaggctttggggcacctcccacttcccctggagtctgagacacttttgtaacaagccagatgattattttgttatttcttgacaaagtagattgcttctgtgttggcccgggtgtgcaccccttctgaacatgctgtgtctggggtcccacctcccgtgagagcctggagcccagccttctggggccttggaggaaaacgtatgaatgagtttggcgtgtatgtgagaacctttgttgcagtatttatttttatgggtgttgactacctattagggcctcttaggtgacactccctcaaggacttagtttggcagttgggaggaactgcgtagttggcagccggccaccaaggcgtccttgagcagcctggccctggtgtgttctgagcaggcagtctttgctctcctgtgagtctgctctgtgtgcggttttgtacagagccccttgggcacagtggaagggggacgaagtgtgcttctggcctctccctggttctcagcatggcaggcacactccaggctgggagcagaccgattcctggcagttggctgctctctcggctcagtccttttgatgtaccccatccaggaaggggcagccatcgctgctttaagggtctactcctctcttgcatggcttccttttctcatcaagggggtgccttgccctttggttaggaactggggtgaccgcagacactggcaccaggtgaggacaccactgagtttgcagcagtttccctgcagaatagagtgggcatgcagatacctttgggtcttgttgtgttcaggggatgtgtgtgtgactgctggtgggacgtgtgactgtagggcgcaggcgctcacgacaacagtcagttacctcgagtctgctttgcgcagaggagtcgtggctga

SEQ ID NO: 30409 - DNA, 1099 bp, Mus musculus
taagcgagaacagcagcggacagcagcggcccggcccgccactgtccatcactcacagaccacacctcagctgggcggggtggtgggggggcattcacccatgtcataaaatccagcttcatgtcgtgcggttgagtgactttgacacatccacagtgtgcaacgccagtactttatagcatttggccgtgtcggcaaatgaactgtctccctcatcttcccagctgccagcctagaacttgctgcatcttgtaactgatccctccctcactgtgaggtttttagggttcgtgagcactgtagcaccatcaccgtgccgtgcccttacagcaaacgccgttttattgtccctcctcagcacggtctcctgggtcctttgcagcttctgtctgttatagatgcggccgtgaacatgaaagttccggcgtgtgtggacatcagtggccctgtctcttgggtctctgtgactctggttcagttcctggggactgcactgtttgaacattgccacccacaagcagtggatgtttctagagcgcccttggctctcaggagggaacgtgctctgtaaaggagtgacttgagggatggagagagataatgaggtcatcacggacccagaagtcttccttgggcatatgcatccaacggggcctggcagcaaaagccaggagctggcacccagaggccctgcagtcagtgttcttcttaggtgtgggtggagcagatgtgccaccgtgggttaggggcacagctgccctggagaccccactctgccacttacacattctggagcagcagcctctggtacctttctcaggggctcactttcagtagagatagagaaggggccggaagggctctgagagcaggagcaccaggcggatatcagcggggtggccatctctgctcaatttacccaatgctcttctgcagcaattctgacgataacatgttgaaaaacatcgaactgttcgataagctgtccctgcgcttcaacgggcgggtcctgttcattaaggacgtcatcggggacgagatctgctgttggtcattttacggccagggccggaaaatcgctgaagtctgttgtacctcc

SEQ ID NO: 30410 - DNA, 1153 bp, Mus musculus
gacttacgcgaaaagtgatgtggtaattaaagggagcattagcatcttcccaggttatccgagagaggaacgcattgagcccatgccgcagccctgctccctgcctgtgcccggggttctcttctgcacccttctgtgacaggtgggagctggcaagtggctgaactgcttcctgtgtcttcttccctccctcaccccaggcctcctcaagcgtgcgtttcagaagtcggcttcggttcggaacatcctcaggcctgttgggggccgccgtgtcgactccgctgaggtgcggaaggtctgcaacatttgcgtgctctaccagacctcgctgacgaccctcacccagatccgcctgcagatcctcacaggtcaggggccctcggccgctgctcccacttccaaggttgtcaggcagtgtctcctggaacgtgtccatggagccccttcccctggctgccatcctaagtcctgcacagggtgacagggcgtgcagcagtaagtgcacagtactcctccactcactgtcccactctgtctgcgccctggagcgccccaacctcgagtctgcctgcctctgacactgctgctttcttcttgtattcagtaagctatcttagtcttgctctgcgcagtgttggattgctctgtttctgtctatgtttgtaaactgtaagctttctgaactcttgggtgtatgtggttcaggttgcgtaaacagagcacccctgtggaaccagtgggaccgtcaggaagcaagcaggtgtcagtcctgtgctgtttgcttcttcacgggcattcagtttgctcgaggcacacttaagtagcctgacaggatctccagagccccacccaggcagcaggcctctcccagacaggcctcatgtgagactaggagaatggctgatctgctgagagctgttaggtcctgtgcaaagcgtttcacctccctgcatctacaatgtgcctggaacctcgggttaggcatcttagtcactgactagtgtggaccgaaggtgtaccagtctacagcctgtgtccaggccatgcagccctgaaaggcagattggagggtcccccgttgtacctgttgccttgttgcttgcctggggctcactttggagtttctgccgcagtcatctcttgctttcctggt

SEQ ID NO: 30411 - DNA, 1148 bp, Mus musculus
gaaagagagagagagagagagagcaccgtgcatgaggtcctggcttcaagctgtagaggacttgatagctccagacctaggctcacggccaccacagcatctgctcgcccaagcccctcaggtgttgccactgctgtcctcctgagaacagagccacttgtctctaactgcttctgcttaccatgactgtgcagctagagaccgctctacaccgtgctgccacacaccaggatccaaaggacatcttctgatacagagcaagttgaaagccagctcgggctggtggagagcctatgtcagagatatataaaggagacctgtgttgtgggatgtcactctgagtggccctacgagcccctagcttgttcagtgagccattacttgataagctttagttccagagagtggcaccatagagacatgtgatgtgtcctgggcatgtgtgtgggacaagcacctccgctacccctagttctactgaacagcacacggagggagaagagcccagcatggctgcccctctgaccctgccttgtatttgcagtttgtgaccagctgctcccggcccccgctcctaggattcgcctacctcaagcctccgttctccatccgctgtgtggaagtatcagatgaccaggtaactgtggccacgtgttcccttcctttgtgctcagtttctgccatgcccaccacacccccacccttgcctccatggttctcagggcatgacagccagccacccacagagggcactgcagagccaggtcagtgtggctgcagcactgtctgaggaccctccttggtgaaggcctgtgaggtgtgtaattaggacagtctttcatggctgctgatctggccaggttcaagggccaagcagagggtaggaggacggagcaagtctgcttcactcctccctgatgacacgcacacccaggaggctgcctgttgactgcagcttaaaagagaatgccctaggactctgtccagtgaggtagaagcatgaccatgctgttgttcagatgtgggtgccctgggaaagcatgctggtctcagggtgtccctgcctcaccacctctctgcggccggcagccttcaggctgtgttcccatgggtcagacactagatggtcctccacttccaaattttgg

SEQ ID NO: 30412 - DNA, 2002 bp, Mus musculus
gagtgtggccagggtacccacagccctcagaccctctcaatagccatgagacacccaaggttggggatgctacacagtgccctccatgcactggggacagagggctgatgaaaataaccccccagttctgccctgtggggcctgagacctgggcctagtgattacagagcaactcctggagattctgtgaggctttcttctcttgccctctgaggaggacacaaggcctgtgcctgtgagctcctccttccgttctgaaaactcaggtacggcctcgccaagcctctatgcacagcaaagtccctgcctctaccctgtccacagtggcctcttcccaggcaaccaagcccagctcctgccagggaggccactgagcacagtcagggtctctcctatagggatccaggtggtccacaccacagccctccttcccaagtcctcagcaggccacgctgtcagggaacccttgctgtcagcccctggcctgtgcatcagtgtcctagcttgggaaagaaacccatcgttcccctggagaacagcccatttctggagtacccagagcctgctcgctctgggcatctgccccctattcaccttacggagaaccacatgagaccctacctacagtgcccagccgcctgggcagtactttattccagggacttcagagtccgtccttttgcactgacaggccctgggagctgaggatacgtcccacacatctcatctccacaccgcctctgttggcgcttgctcttttgtctgggacctcattctcttttcccacacactgcgctcctgggccctccctttccccatttcccttaagaactttctccagattcaggatgttgaggcagaggcccagggcttagtaacctgctagtagccacttgtctcctgcctcatcaggttcttgtctccctcccaccctgatggaggagtcctggcccctcctccactccgtggagccagcttagggctacagcgctcaaagcaagaaaacgccttccccaaggagcctgcacagtgggaagtggccgtgccctgttctcactttagcaaagatcttgggctggagcatggggtaggcccaggaaagcccctggggttctggaaggtggctccagcttcacgtctgccaaccatgtgtgttcccagcttgcccgcagagccctgtgccccgtgcacagcctgcacaggtaacacagagcctgagagttacagcgggcacacgggagagttagttgtaagcaccgatatcaacttgacccctttgtctttgacctagggctgtctgtcggtcacctagagtctgcttcccggcagttatgtcatagctgctgtttgatgacatctcagcagctcctggtggcgccagaaggaagcaggggtttttgtttttgtaggtaactcgtggactaagacttgtcagggctttattaaatttgtacttgagcacacgacggctctgttctggtttctacacagccccgtgcccagacggtttgggtcacatgaagcacccataggagcgggaagacaagagctgctttgacatcctggccttggagctgagctaggagttgtcacctgtgcccagctttgaagtgacatttcagagaagcatccctagagccagtctccctccgctccctcccacccggcagggtacctggtcaacatgcgtagctttgcagtttatgatgtatgtggcacctaccgaagccagcttgttcgatggggagagaaaccagatatctcaagatggatctaacctgaggtagctcagatgccccagtgtccccactaacagaaaaatactgcagacccccccgccccgagacacataatctcctgcagtgtggtgctcacccacctaaaactaaagcctggctctggctttgtaccttttagaactgaagttgccagcgcaaaaagctagcatgcagcaagcaggatattttgataggccagcaggacctgtgggtgctcgtgaaca

SEQ ID NO: 30413 - DNA, 1198 bp, Mus musculus
tggcacatggctcataggtaccacagtgagcctcagaagccacaagatacaccgcaggagggcctcactccaggggtgggagcgtccgctgagaaccatcccccaaggctgactgccctccctccccaggtctagagcaagccacagtggaggcagccaagcaggccctgaccagctgcgggtttgactgctgggagaccagcatcggcgcacccggagtttccacacactcagctgcagctgtaggggaccctgtccgacaagccctgggcctctgagaccacccgacacaccatcctaccaagaagcctctaagtatctggggctggagttggcctgcaccttctagactctgacctcatccgtgttctgccgtttctgaagccaggcagggattagttgtggggtcttctgagatggcaggctgacacaggaggccttcgccctggagctcctatgggcacatcggcctcacacaaactctctggctcctagccacgcactcttctgtccagccacgatgtcccctaaggaaccacctggccagcagctcgtggctcctggctcctggctcttgccctctctcggagatcatcagctgaggcaaggcatgccgactgcctgtctccgtgtggaaaagctgctgtgggggaaataaaaagaaatagtacaaacaaagccttgggccctgtgggaaggcagggctagtgcacgctgctcctcaacccttccagtgcatccgccctctccctgggagttctctgactgaagaaagacatctgtcttagtcagggtttctattcctgcacaaaatgtcatgaccaagatgtaagttggggaggaaagggtttattcggcttacacttccatactgctatttatcaccaaaggaagtcaggactggaactcaagcaggtcagaaagcaggagctgatgcagaggccatggagggatgtttcttactggcttgcttcccctggcttactcagcttgctttctattgaacccaaaaccaccaacccaggggtggtaccacccacaaggggcccttccccccttgatcactaattgagaaaatgccccacagctggatttcatggaggcatttcctcaaatgaagctcttttctctgtgataactccagccttgacacacaaaaccagccagtacagcatccatcactttgccgtgtagctca

SEQ ID NO: 30414 - DNA, 1116 bp, Mus musculus
gacagcagctggagccccagaccagcaccaggagcctgaaggtagcaggagggtacaggcccctcatcctctggaagcctacatgcgggaggagggtgaaacatacaaagccattcgtttggcagagctggctcaggtccttgagagagtcttggcacctgcctcggtttccctacctgcttctcctaggtggaggctgggctaattcctctggggacgagagtgagtcagtctggcctctggcagttcttcctggcaccattttctatcccttctgccaactgggctggaggctctggcttcttggccctgcacctgcatgcactgtggttaagaagtcccctacccccacccctgtcactgcatgcagcacctatcctgctgccgggggtccggtttctggcagcatctgactacaattagccccatctctctgtccttactaccctgtaatccaggcgctcagcactagccaaggtcttacccagttgtctggctatcctggtaaagtccaagggggagtatgatatgcagaggaggatctcgccactgtttctctccgtctgtccgtctgtccgtccgtccatccatccgtccatccaaccatcaggcctcagttcctgggctgccatctctcctgtggaatcttgcctcaccccaccctacagctcctgtctgtcagtgtggagccttccactcatggttcagacgactgacgaatccagccatgcagagtgggagtttaattgcagacagtttttacggatcatgggcccatctgtgctaccatatgcaaaagggaaaaaaaaccctcttttccctccccccctccctctctgcattgcaatcccaaactaaaccagaaatgctgttatgggtttttggccgaagccagtgtagaaccgtggttcatcgtgggaactttctgggggcatgaacctggcaaggccggtgtatcccagaggggtccaccctgacagtgggcaggatggcagaggcttggccagctgctcccaaccccaccagatcttcttacgagtctgagcctttgcatatgccatgggtgtccttagacaccggctggaggccctctgcatgacctctggctggatttga

SEQ ID NO: 30415 - DNA, 1738 bp, Mus musculus
tgcccagtcttggtcagggatggccctggtgcccagtgtgcaatccttggtccttccccactaacactgtgtctgccttcccccactgcccctcaaggccgccctgtacgcagcaccttacaagtccgacttcctcaaggcactctccaaggggcagaacgtgacagaggaggagtgcctggagaagatccgcctcttcctggtcaactacacggccaccattgacgccatctacgacatgtacaccaagatgaatgcggagcttgactacacagtgtaggcgcccggacacacagccccatgtgggcaccagcaaccccatcactgtgaatcaagctggaatcccccagctcagccagcccagcctggccagcctgggtctgcagggggcagccttagcttgttagaggtcttttgttttcttggttttttgttgtcttggcctattctaatggagcaataagcaccttccattcactcctcggctccccaagctcagccgccaccatccttccagtgtgcttaaaaccaattaacgttgctaactaacgttgctaacgtggaggaattcctagggttttgtcatttcctcccctacctagctcaggaggaactcagctcaggggcgacatacacctcacccagcaaagaagcccggcccatctggcccaggggtgtcttggatgcttgaaggacaatggaagtttgattggaagttcagcgggtgccctactgtggcctctgtttaaaaggcaagctggcaggagcccccctcacggggctcacacatccatctggcataaccagccctgttctcgttctctctctctctctcctctctctctctcctctctgtctcactctctctctctctcttctcaccccccctctgtcttttgtcagataatgttttttgggtttttttttcccctgaaatgtaccagcaagccttttcaaccaactgactaggcgcacacaggtgacccatatgtgactgtatttgcattcttctgcataattattttcttgggggttggctcttccaacctaagaaactgcctctcataagagccctccagctgcggagactcaagacactgccttgctgccttaaccgtccttctggagctgtattttttaaagtattggggtaaacctgccctgaaagaattgatgtatgtttaaaaaaaaaaaaaacccaaaaagcccaatgaggaacaattggtgatttttatgcagaaactaaataatccttaataaataaatctatattttgaaatcacacctgcatgtgtctgtggcgcttgattcttttagtattttcggtgtcaaaggttccagctgggggctgtgagagttaacccggcactcctgggaaggggggacctgcactgatgaaccaactgcctcctcctgactgacaggcctgtgggcacacctgtgctgcctgctcttgactgctaattgatgcaggatgccccgcccaccctgggcgctgccatcccctgacaggaggacctgggctgtgtaggaagctaggagttagtgttcctctgtggtctctgcctcaggttgctgccttgactgcactctatgatggactgtcctgtaaggcaaataaattctcacacacacacacatgccagctgattttggtcagaggtatggctgtagccacaaaaagcaaactagaacagggacccttcagccaaatccttcaagggcctgtcttctggtc

SEQ ID NO: 30416 - DNA, 1140 bp, Mus musculus
ccctgacccggtaattggagcttagcaactgatcggttagaaggctgacctgtgactcctgctctctgtcttttgggtcagctgtgtggctgccctagactccagcgggctgatgtacctccgccgtagaaacctcactggctccctgcacagcctccctcccatgctactgtccccagagtgtccccatgtcagctcctcttgtcactctgcacctcgctcactcaccacacacctccttccttgggtctggctggagtccacatgtccttaaggaattggcttagcaataactccacccagaaagtccttcctcctccctgtgagaaaatcattgtattctttgactcagagtaacttcagtgtccgtggcctgcatcatttatatttacttactttttaatattttgaggcccttctgtctggccttgagcttgtggaacttgtggtactcccctgcctcagcctccagagtgctggggttatcatccacaccatgcttgactgctttcttctcatgttaaaatctgtgactaagtcagaagacataagccctgcccatcctgtacttgtggcaggcattattaattttttaattttatttcattttttcgagacacggtttctctgtgtagccctggctgtcctggaactcactctgtagaccaggctggcctcgaactcagaaatccgcctgcctcctctgcctcccaagtaatcattcacaattctgtgttcttctcttagaacgaccgctcttgatcaattaaagttggttcgtgaggggacacctattttcggtcattgtctaaggaaaagccagggatagaggagcctaaaggaacagtttctgcctcttgtttcttgggttctaatgctggggacgtgttttcttcacttgtgactcttagcacagttaaatcagtgtccttagaatctggccttgcagatgcctgacacttactaagtgtccctgaaatgagtccaaaaaatggttctgtctctcttgatttaatgcttgcgccatggtggggagggaggaacaggggctctttagagtcacagaagcatctgcttcttgaagccaaagaaactgaggccggagaagttagaaagcttcccggggtcagacagccagtg

SEQ ID NO: 30417 - DNA, 2065 bp, Mus musculus
cagccttggtggcaaatcttttaaaactttctggcatgggcctccttcacaaaatttgatcattcggttgtcctagggtgggaacgtgggccttaaagctgtgagaaaggtgcagccaaggggcgagtgacatcaatagagagaggaggcatccgagtgggagtggggctttaaaactgtgagaaaggtgcagccaaggggcgagtgacatcaatagagagaggaggcatccgagtgggaggggggcggtccctggctttacaactggcttactttctgcccactgctgtttccttcagatggctctccccacgttgccctcttattggtccagccggaaacacatggatcttcgccagcgccagcatcagcaggaggaccagtttcgccagcagtgggaacagaacagtcgctatttcaggacctgggacatccacaactcgaaacagatcgaatggagctccaagatctcctaccagcggaggcaagtgtctgtgtgttgtcctgcccactggttcctaccacggttcggggaatgtagcctaggggcttagggactgtggcttgaattatctcctgatgatgctggaaactgtgctgtgctggggagaagtactgtacattttgttttttgttttttgtttttgtttttgtttgtttttttgatttttcgagacagggtttctctgtgtagccctggctgtcctggaactcactctgtagaccaggctggcctcgaactcagaaatccacctggctctgcctcccaagtgctgggattaaaggcgtacgccaccatgcccggcagtactgtacattttaaaagataaaccagaaggcagcgctagtgtcttctcggtaggtgtttagcccccccccccaagaattacatagaaatgtacatcaaactgtgacctggtgtgactgatgtccagggaactccttaacctagcatgcacgcctaccattgtgagaagatgaaggaggagaagaggaagattctggagctccggcgggagaggctcagagagcttctcctggaggaacaggacttgctggctgcggagctggatgagctcaggctgagcatgggcctgcgggagcaaaggctccgcgagcagcaccaggacctgaagtcagcccgagaagaacagaggaagctggtaactaccctagtccggaagcaggttgcagggcggtagcatccccgccggaacggacgagtgcgcctacggggttgttctcgggtgcctgttccgacgagatggtcaggtgactagagcccatggggaaaaccgcctccaaccccccacccccaccccccagagaggaaaggcttatttttagctcgtggtttctgagggtctccagcgattgtaatgaggaaggcatggagcctgtgaccaatggagctcaagttgcgctggctcaggaaacaggatgttaggaagagggttcagagacccaccacagtggactgttgccgccagctagtacctcatccccttaaacgccccctgcctcccctgaacagtgctggaagctagggagcagttgttttcaatgttgcttttgctgttttgaaacggtctcactgtgtagtcctggtttgcctggaactttgtttatagactagcctggcctcagagtcccagagatctgcctgcctctgcctcccacgtgctgggattaaaggtggatcaccggcctggaccagagcaagcctttgaaatgtgagccgtgttgagttgagattcagcacgtaacaatgatctgaacctcatttggtaacctgttagtgccagctggggtgtataaccacgttttgttggccctttgaggatgtagtccaggttggccagcagtggctgtcccacagcagacagaccagaaatcccgcagttgttgagcccatgaggctcagatatctctgcgcttcctgcctggtgctggagtctgggagggtttctgcagaacatctggctttcagtctgtgttaggaccctgaagaagttggaggtcattgtaacctcacgctttcccacctggcctctttgttccctga

SEQ ID NO: 30418 - DNA, 1215 bp, Mus musculus
agggccttttagaaaggggccggccagtgtgagctcaggcatcctctctgacaagcttttctgcgtgctccaaggatgactgctcttcctggcaggctccctggagctggttccagcctgagctggttcccaccatccccagagagagcaggcctctgttggaagcttccgggaagagaactgttagaggtggagtggtgcagtcccgttaagtcacgaagaagaatgctgtccttgagaaatcaaagaacacggggccagtacagcatttccagacgctctcaagaacaccagtcagtcccatgtcctcctcaggctgaaggccctgtgtggaggcctgaggagacagcaggaggggccccacacagtccctcctgagacctggctggggttagagcatactgttcctgtgggcaaatgcgttttgtctcaaagctcgccctggccgtttttgggttttttgcacgtgggtctcatcgcctcgcaggagtgagctctgcatccaatctggctgctctctcccctctctgggattctgccttcccacctgtgtaccccactttctaagatggagaggatgaagacacaattaatggagcaggccctgcctcaagctccgttcccggaaggcactgtggcctcagcaccacggtctttacttgccaaagacgaagtccagtgttgcgtgcactcgggactcttaacggcacagcgcaggggctctgccctgacctcagtgacttccatcatggaatgcagcctgaaagccgcgtgttttcatcctccacagcttcggtgggctcgcagtgcagtttcctttccttctttgtcctagctggctatcacccacgctcttacaaagcaaagtgcagcatagagaaaagagcattgcatacctggtgttaagccccctcgctcctcctcctctggtggcttctcagcatcctgaagttactgtccctgcctgtaaaatccttctggaatctgtgccccactggttatgcaataaatcgtctctttaagtgtgtggtcatgtgccccctctagttggtggatatttccagactaggtgggctggggggttgagatttggtcttttgttatctattgtaaagctaagtgcgggctcccaaaacctggttgtcccagagacaagagagtccccactgaagacattaggtgaccctgtccccatgttaactctgattggaaaat

SEQ ID NO: 30419 - DNA, 1085 bp, Mus musculus
aacagcagcctttgtagagtgggtacgagctggagacgttccttcctgttcaccaaagaaacgggttatgctgacctctttatttcccttcccgtagggctcttgcagcattgccattgtgccagtcccatttccacctcgttccatgccttttacccccagccaagaggatatgtacaggagctattttagattatggctatttgcatcaaattcagatatacaaatgaccacggatgttgccttagccttaaaaaattactaacagttttaagccacctcactccacacactgaggacctgatttgaatctgtaaaggcagtccctttgggagcagcatcctctgggctacaccaaaggcagctaatcctgtccttggaagagcagctagggggcccccctgtggctgggttctcagagcaggcaagctggccacatcactggaagagcccagccagtgtgttctccgcctgctcccacttaggatttccagcctggggagacccagctgcacagcctggcttcatagagaggacaggacgaacttgaaacaagaaagggagctaacttagagcagaggctcttcatccaaaagggaaaaatgatgactccacactgctttttagagttcaaatcaacatctttctggaaaaatatattttttaacagaatctttttattatttttaaaagatataaaactgactcctcccatcagtagcaatacaaggttatgcattttaaccagactttctcaggcctcttttggatacctttagtagttaactatttttgtctaaccctcctgtaaatacctactgcataacagcccaacccctggggaacacagccgagggcaccttgcccctctcacctggcgcaggcatccacccccacaaggctgtgctgatcacacggcaaaacagtaccttttcctctgttctctgtctgtttcctgttatgcttctttggggataggaagagaagccaccattcccaggaatgtctgtttgatacagtcagcgttgccagtaaaatgttctgagacacaaaggattgtgagtttcatttctcatagccatttg

SEQ ID NO: 30420 - DNA, 1178 bp, Mus musculus
cctgatcctcagggctggacctacagcttggggtcagttctcaggcttcgccgctgcacactctgctggtgggcacaggggagcctctctggatttcttggccttcttctttttcttcttttggatcccaagcgacaccgggtccccattgacaacgcctgcctcctttacctgttccagacctggggctgcagccaggtcagcattgtccaccttcttcttggctttctttttcaacttcttcttctcctctgccttggcagggcagtgtatggctgactcctggagaatgtctgaagccgacacagctgcctcccggcaccgctgcagttcctcatcgctgtcctcactgtcaccatggcgagtagtcaggttagctggacgggtctccgagctgcctggttgcctccggaccagatggaggcagccaagtagctcaggctcgagtcagcttctctgctcgtcagtcacatggctgcattaagtacccgaagcctctgacccttagtagtctcatctacaatgagggccctgacagtgtccaaacctcatagagcttcttctcaggagacaaggatgataaaggcgggactctggcccaagatggctgctcttgaaaaccatgggatttccccctcccccccccagaagaccctgtgccttcctgctgggggaatactttgccttattatctcatgatctcttgctccgtctgagcctgactggggttgcttagctattcctcaggctcggccaggagaggctgtgagcacttacctggagctggggggctggcgcttccggcagggtcttggagaggcttccttcttatggcctccggggatggatgtgaagaaaaggcggaagcctaagacaccacaggacagagtcagaagtcagtaaggcagacactggccctaagacaccacaggacagagccagcagtcagtaaggcagacactggccctaagacaccatagggcagagccagcagtcagtaaggcagacactggcccttcccccaggtgctaaggacgcagccagtccttaggtactcccagtctagtggcaaggcttagacctcactgccgtgtgtgtgtgtgtgtgtgtgtgtgtgtgtgtgtgtgtaaactgaagctgatctgaagcaaggcttgcttgccctgctgtggagccag

SEQ ID NO: 30421 - DNA, 1101 bp, Mus musculus
tttctgggatgagcttgacatctatagtgcgatagcagcccccagaatgcacaagtgtaagtcttacactaggtaagactcctcgtgggggatatggagcctgaaccggccagcttctgtaaccaggcaagaggacttccagtgaaggaattgggacaccagctgagccacaaaacctttgacctacaatgtatcctgcctacaagatgtgctggggttaaaagggcacagaacttgtgggagtggccaaaaactgtatgatctaagtagagactcatggcacgagtggaagtccatacccaagactaccttgaaggccaggaaccagctgctagatagcccagaatgctaggacggaaccaaacatactagcagttaaacaatgatgtcaatgaagtgattcctcataaatagaagcctaatatacttgtcatcaaacgggctttatccagcagctgttgggaacaaatgcgagatccacagccaagcatcaggtggatctggagaatcctgtggaaggagaagggtgaggtcataggagtcaggggtcgaggattccacaagaaaacccacagaaccaactaacctaggctcataggagctcacagagtctgaactgacaaccaagtagcctacatgggactaacttgggccctctgcatgtgttatagttgtgtagctcattcttcttgggagaattctaacagtgggagcagggctgtctctgactcttgcctgcttttgatatccatggaggcctattctctcttctgaaaagaaacaggaggagtggattgggaggaaaaactgcattcaggatgtaatgtatgtgagaagaataaacaaaatattaaataaaaataaaataagtatacttgttttgcccgggactggtgatttgtgcgttcctggaaatgcttgagaacaagattttgagtgtgggagcccaggcattagtgggactggagttgagggtgtggtattgtaggacagccattcctccaggtccaggccataagagaggcagctagcaggaagaagacagtttctttagacaatcatgtataaaaactagctacaaaatagaaactagttttagac

SEQ ID NO: 30422 - DNA, 1808 bp, Mus musculus
ccctcaggcctcagggcaggtgtagaggggccccacagacaggccagggcatctgcagtgagcaaggctgatgcgctggcatcctgataggaaggaaggaaaggaggacggaaagactactgcctcttgtttgaccctggacctctactgtgtccctcctgtcccagggtgacttacggaggatgtggtctgagcccttccactccaagtccagcagctcccggttcctggaagtatgatgacgcgggagaggtgaccagagcgctgtcctcaccttcctctctcaccgcgcggttttgttccctctacaagctggcctgactcaggcatgcctgctcacggaactgcagtgtgactggagtgtgtgtctgaggggagcgtttgcagagggcactggagccctgcacagcccttctcttctccgctctgggagagtggacccttccagaaggggcaggccggcccttcgcccggtgctcctccttcctcgtgtttttatggatctgcaccagactgttaacttgtggggagatggcgaagttgacttatttaaaaactacaaacagcaagttgttgttctagaactttgaacactaaatggaagaaaatccattagcagaccgaagtctcttcagtgaaccctccgaaactctgggaccagtttcctctgggggctccatacagagacccagggcagaacttctgccctattttttttcttttttcttttggatttattaaatattttctgtggtgtgaagtgacttattacatccacagacattgaatgacttcttacaacatacacataagaatttgttgtaatgactgtgtccagccgtgttggcagtgagcaggacgcggttggtttatacatacgtacatatatatatatatatacacacacgtgcacatagatatctgtgagtaaacagcgactaagcctgctaaggtcacgccatgcagctgccgggggcttgctgtcatgggagcatgtagaacagtttacctggcttcctcgcacacgctgctgtctcccttgagagtcgcgtgcggttgtaagctgtggatgcgctgaactgatagacttgtgggctgtggggactcctccttttgatcagtgtagcaaattagggatgaaaagtttgaactttttgacccttttctttttacaggcttttccctcgcagtttttagtaaccgcctcttgaaccagtgcatgtattatagcagccggtgtctttgtgctttctgatcatagttatgtactacctgtaaatacatttttctattttatatttttttgtattttttttgacatttcgtttcattggtgcgctgtattttccatgccctcagtcccttagaaaagacaaaacagaaaaaagcaacgcaactctgtccttgctgtgatgatcacagcctcagtttacctgtggtgacagcaggctgtggggacaaatgtcagttgcctctgcaaatggagctgaagtccaggagctggagacagagcaggctgctgctgtgacttcaaaacctggccccgcgctgttgctgtccgtgggctgcacagagcctggcatcaccatcacctcacacttggttagctgctgcctgggtgcgaggcggcaggccctagagtctgttccttcccggggccgctggcatcgtggcctgcctgtccctattcctgcagacattgtgcagagtgcacagcccatcgtgtccatggagcagcgtgccaccaagttgttggttcctctgtcgtcttcagactctgttgaggggtttgaagggttggttttgtc

SEQ ID NO: 30423 - DNA, 1226 bp, Mus musculus
ccagctcacggagccagagctcctgaagctcatgggccaggtaggctaacacacagaagccagagaccatgcctcagcaaggggtggataggaacaaactcgagaaggttatcccctgaactggagagatggcttagtggttaagagcacggactgctcttccagaggactcgagttcaattcccagcaaccacatggtggctcacaaccatctgtaacaggatctgatgccctcttctggtgtgtcagaagacagctatagtgtactcacatacatgaaataaatcttaaaaaaaaagttatcccctgatctccatgtgtgctctgagatgcacgcgcgcgcacacacacactaacatttaacttggtttgacttaaaattaatcctccctctcttccggtctctttggcctcgccggtagaagcaagatgacgaagggaacgtcatcctttggtaagcgtcgcaacaagacgcacacgctgtgccgccgctgtggctccaaggcctaccaccttcagaagtcgacttgtggcaagtgtggctaccctgccaagcgcaagaggaagtataactggagtgccaaggctaagagacgaaacactaccgggactggtcggatgaggcacctaaagattgtctaccgcagattcagacatggattccgtgagggaacaacaccgaaacccaagagggcagctgtcgcagcatccagttcttcttaaggatttcaatcagtcataaaataaatgttctgctttcaaaaaaaaaaaaaattaatcctctgtgatggccagcagttaacattcaacagtttctctctaggctcttgattctctgactattgtagggattcgatcagcactcgcataccagaagtgtgagatggtccgtcctttttcaagacaagatttctctgtgtagccctggctgtcctggaacccactctgtagaccaggctggccttgaatttacagagatccccttgcctccgcttgctgagtgctaggattaaaggcatgcgcactatggttggtcttctcttcctttctaagatattttcccccttttaagtttaggttccaaagtcattgtgaactcgttacgtttactttctccgattaccttatgtgtgtgtgttccggggtctgtggaaacagagtagtggagccactggacctggagatagcaggcatttgtgagcagtcatgtgggaacttggtcctct

SEQ ID NO: 30424 - DNA, 1137 bp, Mus musculus
acccaagtcacagggactttatgcttggcagccagggctctaagctggatgccccgcagcttgaggggtaggtcccgagtctgttgtttctggcaggcaatggcagtgatgctggagccgcttccaccactgcccgggaagagggtgactcatgggtcctcaacggcaccaaagcttggatcaccaactcctgggaggcttccgccacggtggtatttgccagcacagacaggtcccggcagaacaaggtgggccagcagacccctggggtggtccttgcaatttcttggtcttgctggagctgctcctgctgatgagcagtctttctttccccaatggagtttgcactcctacccaaagccagcagagggtacaggggctggagcgggggcggggctggagcttggagcctgcataggcgcagctctgcagactcatcctagcttttggggccttccagggtatcagtgccttcctggttcccatgccaactcctgggctcacgctgggcaagaaggaagacaagctgggcatccgggcctcctccacagctaacctcatctttgaggactgccggatccccaaggagaacctgcttggggagcctgggatgggcttcaaaatagccatggtgagcttggtgacagggcagcaagcacccggggtcgggccctgggcccagcctacagctactgactgggcggtccccacagcaaaccctggacatgggtcgcattggcatcgcctcccaggccctgggcatcgcccaggcctccctggattgtgctgtgaagtatgccgagaaccgcaatgcctttggggcaccgctcaccaagctccaaaatatccaggtaggggcttggaggatggggttttagaagctgggcaccggagtcttggtaggaaagctggcttttggcttgcttatctcacccctaccacaccttaccacctccaccccacccccacctgactcccaccctcacatatcccactcccacccccactcctaccccatccctgaccattgggtgggagagcatcggttgacgggtggggctggattgttgcagttcaagctggcagacatggccctggccctggagagtgcccgcctgctgacctggcgtgctgcca

SEQ ID NO: 30425 - DNA, 3665 bp, Mus musculus
tggtgccccctggcccttgggaagcagaaggcagcaaatctctgtgagttcagagccagccagagtggtacagtgagatccttcctccacaaaccagacaacccagagaggcaggtacagaggggcatgctactctgggtttctgctggaatatccagaggtggcagcaggccaaaagcagggctcactgctgggccggccaggagcgtggaggaaagaagtggtcgtgactgagaagtttgtttcctaggatacggcaagacagatgaggctagggatgactaaagagttgattgcatcctggtgtagaactggactggacgtcacagtccatctggcgccctccaggctccctggattcttttgcactcaagctttgcaaagtgctgctctgtctttggagggatgctgagcggcttccgcctggctgtggggcagactcacagagcttgctcttccctcacagttcgtctgatgattgaaaatccctatgagacgcgctccgacagcttctactttgttgacaacaagctggtgatgcacaacaaggcggactatgcctataatggaggccagtaactgctgcgggagtggacagggaggtcctctgccgccaccacgagcaccgagcaggaattgcagctgtcgcccgtcaacacccacctcgaacctggtccaggaagctgcagctggggcggcggcggcggggttttgtgctccaaggaggtgccagccagcagtttctcttcccagtgtttgttccctgccccctagttcacagaggtattatagtgaagtaaaagattagggtaagcttcccgggatccagataaaagattatttctgtatagtcttagctgtgcactgcttatcccgacaagcctgactgtccaggcacagctttgtctgccagaaggcttgtgctgggctgggctgcaggttcccagcccctgcaggttcctgggtgctttgggcagctgagagcagctcacttctcccccgtcccgtgccactggcacagtctgtcctcgcctatgcagttaggccaactggaagaaacttgaagagggactggggtaggcagagcccgggctaagccactgggttgggaggtggcaccagagtcaaagataaggttttgagggggcttcttactgcctttgagaagccacagccaggcctggggggaccacggtctcagcctggtggcatcttctgttcttgctctagaagccatgagcctccctcctgcttccctggccgtgacttttaccatgtcctgccgtggccctgggcagttctgttcacagaacggtgtctcttgagtttagtgtgcaccctgtgctttgctctcttccttctcagacttcttcggggatttttacgtcagtatttagagcccaggatgctgatagatcgtgataggactggtcggctcccaggctaatgtggctcatgggagaggcacagttggggctttagagagagctgactctgtttccagtgaccctggaagagaggctctgggtggggactgcctctagagcagtctgatgtttaggagtgctttcctctctgtttgcctttctgctaaagtcacatggtcctgccccagactgctgcatgtgtgagtgtttgggaagggcagcataggccgaggttgcctgtcagagcagtccttaggtgcgcctcaggggtcctcagatccccactgactgactcccacctctctggctccctaggttgtccctgtgggcagctctaggacactgtggctggggttcatttgtcactgaatgaagtgctggaagggtgggtgtgcatgaagtgtctctgaggcaccatgtcacctgtaatgtcacctgtaatgagaccagggccccagagtacttgagagaaaggatgtgctttggccgtgtcgctgttggcttctagggtgttagtggttctgggtttggacccaggccctgtaccgggccagcacctgatggtgcagtgatgctgtgctccggaggcttcgggactgggaaacctagttatccttcatgctgcactgcgtttacccactgagatagatgggggcccaggtgccctatggtgggcacctcctgaccattccagtggatctcagaactggagtccattccaactctaggtgccttaagtgtggctctgccccatgtgctgctgggagctgcggggccaatctccctcacctgcatacagacatgagtgtctctctgcctttcctcacgtggctcctctggtgagctttccatgctcttgacaagcctcagagtctttgctctattccagagtctgagaggtgtttggtacccggtgtatcagtaaatactgcctagcgtgtgcttccgagagctgcgtggccttagctcagtagctcacagcctgggacgctcctgttttctggcacgctgtctcctgcctgtcatgctggctttgcttggagagcccacactactggctggagaagggctgcatcccctttcccttcagcctgttctcagagcacactgaggccgggtgctcagtcatcctggtaggatggagcagtctttagcttctgaagggccagcggtccgtgtctgactgcttagggaagcagcttgctgtttgctagagagtttgaaattccaacttttgtgcctgacttgagtaaactggaagtcatactttgtaaataactgaacaagcagaagccgagtcagaagtcaaactgtccaggaacaccagtggctacagtggcttcctgtgatgcagtggaagagggaatcagtgcttgggggtcgggcatgcatgccccatgcccataacagtaatctgagaggatggcagcccctggggacctcgtccccaccctgggctgaacccttcctggtatgaggcaaagttctgctccatctccatccttgccccatgtcttggggatgagctgcccttctgaaccgtaaatacaggaataaagatggccagtacttgggctgacataagctcttgtctcaggttagcccaacgctggctcatatgagcctcctgaagcttctcctggccctgggcatctgatttccagttcctagggacagcattttgctgtgtctggggtgagccatagactcagattctgaaaacatccacattccatgtccagagcaccatagccacagggagtctggacgaggtgggcgcattcttgttcgtgagggatcatggcctttacgatgctgtcactcaagttgtgaaagtccattttccctgtaaatctatttttcacagaaataggaaacatctctgtccttaaaatcctcagtccaaaacaaatcaggtgattctatttgtataagattattttaccacaagagacagtaataaagatttttcacaatatgttcactctgacttgcctcctgattgggcctttgagggcttggagggtgggcagggtcccagtccctttgcttggctgtggcatttctgtttttgttgacttgggtgtcactggtttataactgaggaacagctgagagtcacctgtttcttttttaagtttttctgttgaaggttttcctcagggactaagagttaaacatttatggatggagaacatttatgggatggatgttcccaacagcatacgccccactgcc

SEQ ID NO: 30426 - DNA, 7206 bp, Mus musculus
tccagagtcataatttaagttatgaagcccgagcaggtacatgtctgatgtcttgaggggtctgaagctggtggtgttaacagtgtcttgtcttttactctgggaaggtgtttgatgtccggttgaatggccatgtggtggtgaaggacttggacatctttgaccgtgtcgggcacagcacggcccatgatgaaatcatcccgatgagcatcaggaaggggaagctgagtgtgcggggggaggtgtccaccttcacagggaagctatacatcgagtttgtcaaggtaacggcggctgggcctcctcctgtgggagggaggagaagatgtgctgcctgtggcctgactgtgccttcccttttctaggggtactatgacaatcccaaagtctgtgcactctacatcctggctgggacagtagacggtgagttggaattttaccttctgctccgtgacttgtgctgcagggtatgcttgcggagtgcttgcgatagataatacagctggtcattgtttgggaaatatttaaagccacatcatagggaactcccagtcaaacatacaaggacaaagtatcacatggttctggccacaaagggttaaagtcaggtctgtgttcatccctgcctgttactgtttaatcagcagtcagtctttggcaaaatcttttttttttcctcttgagatcgagtctctctagtcctggctgtcctggaactcactgtgtagaccaagctgttgtcctttactcacagagattctcctgcctcagtctccctagtgcaggcagtaaaggtgtgcacccctacaccctgcctctgggacaaagtggaaactgctctatgagttgggattagtgatgaccccttttggggttccttccccgttatctcactcagttagaattacctgaggactggcaggaaagtcacctctgctgctaagaccgatgacctgaatatgatcccaggaaccacatgatagacagagaactgatcccacaacttgtcctctgacctccaccatggcttgtgtgcatgcatgggcacacacatacgcacacatgcatgcacagtaaatgtactagaattacctgaaatatgtcttaagttccatttgtggtttgggctctagtcctttggagaaaaagacaaaaataagagtccctgtgggggggctggtgagatggctcaacagataagagcacccgactgttcttctgaaggtcctgagttcaattcccagcaaccacatggtggctcacaaccatccctaacaagatctggcgccctcttctggagtgtctgaagacagctacagtgtacttacatataataaataaataaatctttaaaaaaaaaaaaaaaaaaaaaaaaaagagtccctgtgggtttggttaggtgcagctccagtacctgagataacaggtggctccttgaccttggagttcagccttggtcatctcttgctcagggtttagattgctctgctgcagcctcccagctgatttttgcagggaaaacttggtatcctactgggttttctcctccatcttctctctgtgctgtttcccatcttgtcttgaatacatggaaagtcatatctttaatttttttagacttattttatgtgtataagtattttgtctgtatgcgtgtacttgtgcaagtgtgttagtgtgtgtgggttgtgtattcaccacatgtgtagtattctcagaactcagaagagaaactggaagtgcggttatgccatggtggctgtaagccaccagctcggtgctggggaccgagccgaggtcttccaagaggaagagcagccagtgctctcaagcgtggggccataccttctgcccgtcctcttgtcctaacaccttccctcccgcccagtgctgacatggatcttctaggaaggtgacactgtacaccaggctctacttgggttccttaggagttaggacagaggtgtggtgaggctgggaaccagagcctggtagggcagccttcagtatctggatcagaaggaagacgaagactttgaaataagttttaactgtcagatcactgtccctgcctattgtgggcctctgggagctttgaagaagtgagtcaggaaggagagagaaccttcctttggggaaggccctgtattgctttttaggtaaaacctgaatctgactactgttcctgtgtcctgctgtttaggttagagatcatttctacccctccctgtggacctggttagatgacagaggtctctctagtgtggcccatttacggctctgaatgttctcatgtaaatgctctgggtcttagtgtacttaaagggtttttctttttttctattagatgtaccaaagctgcagcctcatccaggattggaaaagaaagaagaggaggaggaggaggaggaatatgatgaggggtctaatctcaaaagacagaccaacaagaacagggtgcagtcaggcccccgcacgcctaacccctatgcctcggacaacagcagcctcatgttccctatcctggtggccttcggagtgttcattccaaccctcttctgcctctgccgcttgtgagaggacaaatggccatcctcagcagggtggagggagtgtgcgagaaaccagacactttggtttctgtaatcttcacagtgtttaggaaaagagaaaacaaatcaaacagcgcacacacacacacacacacacacacacacacacacacacacaaacacagacacacatgtgctcacacacacacggaaagagataagaaaagcagagagagtggggtcaccccaccaacacaggttgcagagtgctcagtcctgctctgcctagctggccccaccccagctctctttctctggggtacttagggagaggatccttcctctccgaggatcctcattatatacctagtaggaaggactctgaactcagagcagtcacacttccttggtttttttaggttagacattaacaaacagcaggaaaatgtcacataacctggaaagaccgcactggagttgggtgtgttctgagtttctgtccagatgtgatttcagcagtcatggtattccaagtgtgtgtgtggaggtagataagtgggacggtaaagacaaaggcgtggaagagaaagtcagcgcttccttcctgggaagcctgtcgtctgggttaatctgttgatgtatcttcattgtcatctctcatcctgatgtgtgccagttagaggactgtctggtatccaagacgactagtgtatgtcaggtcctcaaatcaccaacagcttgttactacaacaaattgttttgattttagtgcctgttgaggacttgatttcttcttgatttttctcttaatctggttcatttgaaatttctcacttcttaaccatagagctaagttattgtcaaaactgggcaggagacaggagattggagtggtctctgctggggtgtctgaccctccaccacctcaccttgttggtacctccctccctgaattcctgagccagcaactcttactggcccctccatagggtcttgctgccagggacagggatgctttccagcctgcagcaacagaacacttgaccttaaaagtctcttctggtctttggattagaaaaggcttatgttagcaacctcagagacttgagccctgctaagtgactgaccactgtttagaatgtccagaatctgatgtccatctgtccctgtgtcttctgtcctctttcagctagtttaggcttatgcctagagtcaccccaaagaactgagactggctgcagcagcccagctgtgtttctcattgatgataatagtaggctctactgccctcccctcccctatccaagtagcagttaagttccatccaaatacgtgggactcaaagactcctagtcagctgtagttctggaggctctgaatgtctaactttagcatcaaagtgtctgtctcagattcccagtaaacacctctgtaggggatgaagtttccatgtcccccatcttccttttggtcaccttcatctgtgtgtcagttaagacacagtgagggacagcccagctgcaataaaagggattttctatgtcagaagcagcaggctttgcttcagcttgagttggagccgtgtgagtctcaggccaggcccttatttctgaatgtgtttgaattttaagtttgccttatcagatatctgagctgtgcgacaagtaagtagctctggggccatgtcttgactggctcctaatggtgactccaggccagcacttggtcatttgagaactgtcttctgtgttctctgtgacttaggctagccctagggtactgaggtggcagctgcatggctgtggcctgaagttgcacttgcaaaggtcctgcttctacaggacgctgaggtacttactaccctggtctcgggaactgcctgcctagggcaacagatgtcctgactaatctggcttctggttcccggtccatccctatttacaaagctatgggccactgtcagcacattaaacaaggtgagggagagtagctgcctccgtgtcaccttgtctgcctgggtctctgaggaaggaggggtcctgctttctcacccagctcacccctttggtgactcagagtccttctcagaaggaaaccctgactcctgggccatttcctaatggtactgtaagccaagtggctcggcttctgcctctgtttccaagcccaccccttcccggagggatagggacgggtgctttcctctctagttgtatctgagcggaaggaacatctttctgtagctaataaaaactaaaagggaagaggaagcagaagggaaggagtgtggcggaggctgggatggattccctaagccaagcctgcccagctaatgagctgtttgacgttgaacttgaaagctttcccctccctctaagatgatgtaggtacttgaggtttgggttaaaggggctgggtggggcacgctttatttttatttttgtattgtgtatgtcaagaatcactccattgttcgtgttgctttttgcactgtttgttccccgctgtgttttgagctagaacaaggagttgcctgggattgggagctgtgggtggtgcaagtcagggagtgggccaggagaggcccgggttttctgtttgagctatactctgacccaggatgttagagcacactgatccagccactagagagaaaggtacaagagcagagcagaggagcaagcaaggacagctgggttgagtctgcaggtccagtgtggtttaggtcagtcaggggccagctggcctctgactgcattgctttaggtcgtattcaaactctcttaaacattgtgccaagaaacgatttgtgggattcatgtcccgaaaccattaaatctattgtttggaaagtctgcagtcctgaggagggcttgctcactggacacccacagatctggccctttgaaaggcagccttcagatgcccatcgtgtgagaggcgctgcctgttgatgaagtgtgtgaccttttctcctgctgagtgggagatcccagggtcccacacgcctcacctcggtgagtgggcagagctgagccgcactgtgtgcctgggagcaggttacaactctggtttgactttcattttgttgagaagcttctgttttaaggaatttctccttcttgtctcattcctgcctttcctgggaagggcctggccctgatctagagtcttagctaaggagctgagaaacagccacagtactcccttctcttcgcgcacagggccctctctcttagagactgctcagctttcgagtccagggaggagtcagcggggagtcagcaggttctctctcctccctgggaactggggaccaacccaccccggcagcacagtgcctttttttctcctgctctgagtcaggtgggcgtcccctctagatccaggtctgggcaggggtctgatggtccactgtgggctgtttccctatccacccccctccttgctggcctactctgacataatacaagtgtcttcttgccttgaggaaccttaatggcattgtggccaccacatgtgactcttctccgtgactctataaagacctagcagagcatgtgagcattctcaaacaagagactaactgatgctcctgctgttaaaaaggcagaactagggaggtgactttaggcctcctgctgtggcctctgaagaaggtgactcttcaggtaagactgatggaggctacaccgacaaaccgcagacacgcaggatctgctcagagattgcagaagagcgtggcctctcttatagggaagatgtaattatggatcaaagagtgctaagaaaattgcgaagaagccttactgcttacaccagagagctcagggcagctttatcttccaggtttatctaaaactatctgtgttgggcttccctgacacgggagaggggcaaggatagacgattgacatggcactgatggtcagttgcccagggaggccgcttactctggatgcagatggctgctgccgatccactctgtctttctcgggctgcttttgcgtcgttgtcctaggtggccagattgtcttgataagagcagatctggggactgatcggattggcaggaaaagaacagagtgcatctcttgggatgggcttctctcggagtgtaaaagcaaggggccaggattgtgctggcagccagggagacagtagtgcctgcggaagttggcagaggaggccttggcatgctcgcatccaggcagtcatgtgtgatgggagcacatagcatcgggagaagcagaactccatcctcacctctattttgagcttagtgctttatttcagtatgaggaaaaacaacaacaaaccgaagtgtgctttccgtcctttcagaggacaactgtcaggaaacagttgaggtgccaggtgggaggggagacttggcaaggagagatgtcgtggcaaaactaggaaaagagacattcttggctcttctctttcctggtgtgccatgatccagggaatgaaaagaaatttgaccctggattagtttctttgtcggcgctgaggaacactgctttttcacaaagttcccccgggatagaatggctgtccagtctaagctcagggcagcctcttcaaccactgttggcccagcctggcttgtgaggaaaccagccctgtccctcagtattgaacttgg

SEQ ID NO: 30427 - DNA, 2240 bp, Mus musculus
tatctggtccttctgggtccctagctgaccttaagcctcaacaatgtccaccacattcttaccccaaagcagaaaaagaccttgaatttttgtacatttatttatttaaaatgtgtgtttgccaagtgtggtggtgcacacctttaatccaagctcttggtgggcagaggcaggcatacgtgtgtgtgcatgtatatgtgtgtatatgggtgtgcatgtatatgcaaatgtgtgtgcatgcacatgtacatgggtatgggtatatgtgtgtgtacatgtgcacaagtgtgtatgtgtgtatgtatgctcaagggtgtgtgtgtgtgtgtgtgtgtgtgtgtgtgtaggccagaagatagctttcagaagttgactctctccttgtaccatctggatcccaggaatcctgatcaggtagtgaggctcagcaggaagtactttgaccaactgcacaatcttgctgagttgcaggatgggctttctttaagcatttgattggttttgctgtcttctgtctccagtttccaaggacagaggcatacaaagccaaggtcgacaaggacctgctatacctgagactggcctgcagggggcaggagtcaccagggctgaataactggatgagtggatgctgcgtttagccctttcagttcgaggcagaggaatgggacaggtttttggtgccagacactgggcggcaccttttgtgatattgttttgttagccacccataagagcccaaaggaggtgttgttagtatctaagggacaacctccagaagtccaaagtgaatcagatcatcgcaattcgtctgactcggcattctatccctggtacgtcgtctttcatatttttaaaaagacttatttttattttatgtgtatgagtgtgttttccccctgtttgtatgtgtaccacatgtgtgcctgatgccttcagagctcagaagtggtacattagatcctctggaactggagttacaaaaggttgtgagcatccccgtgggtgctgggaaccgaccccggggcctctgcaaaaacaacaagcacacacaaccactgaatcattttcccagccactctcagtgggtcttaatgccagctacaggttagagctccccagagagtccacagactctgcacttggccgccctatgcccactgcaccagggatttcagggcagggtccagctgtttctgtgtttctctttcttttctctctctctctctctccctcatttttttttttttggtgtgtgtgtgtgtgtgtgtgtgtgtgtgtgtgtgttttcaagacagggtttctctgtgtagccctggctgtcctagaacacactttgtagaccaggctggcctcgaactcagaagtccgcctgcctctgcctcccaagtgctgggattaaaggcatgcggcaccactgcccgcctgtatttctctttcttagcgttattctggactatagttaaataattgtactcctcactctctcttgcccacctgcgaggatgtaaactcccgttgttgttgttcctcttcattgtttccagagccaagcacagcacccggctcataaatgccgggcaaacgatacttccttcttccacttgaataattacttatcagcgcctattatgtaccacaggctttcctgtatgcgccgtattagccagacagggaaagtcccattttctaacggaggaaactgaagctcaggaatagaaggtgatcacaggcagagctggggctcaaccttagaccccagatccttccccattcatcagaggccattgacccagacccctggaccagcggagtgcttcctctgagttgctttgcatttccgttagcggtctgcccctccccagctctctggcatctttaccctctttcctgccctttagctgttcccacccagtctcctccttttgtgttcggggagtggcttcttccttttcccctcctccaggagtatgggccaagcaaggcatcaagaaactgcctaggcaacaccgttccctggtctgcagcgacacacagcaccagagacatagtgaactagccagcgacctcctttttagcctcctaggaggaagcctgtgccacccactgggcaaggaacccagccatcttctctaatgaaattcctgaccagacatcccaatggacaaaagtccctgggagaggaagcagtctgggcttggtgtctgcgattgcatcaggggccagggagtaggtcaacc

SEQ ID NO: 30428 - DNA, 1140 bp, Mus musculus
agaaaacaatcaatcagtcaaacagacaaaacccctgggagacacagtatatccttaaggtctctatgccccatattaccctaaaactcatattgtcctgactggttttgaattgtaggcaatcctcctgcctcagcctccccaattctgtgattcttggtgtgaagcaagcaccatacccagctggctgatgtacttaggtgccccaagaagggcagggaagaccgaccatcagagcaggggttcctgactcatggctgaggaaagctcttccacagccctctgtcatgtccacgacagactgtagacagtcctgtgaagcgctgtggtgacacttaacgttcttccttctgtcccacttggcagatgctgagggttggcaaagcaaaagcagacgggtggcccaaaactgctccaaagaaaggtgagagcggtcagacggcaagggcagatctggacaacccctctcaatacaagggttacaattttaacactgcccttttcagatgacaatagcttggttcctcccgcccctgtggacagtgatggggagagtgacaattctgaccgtgttcctgtgcccagtttccaaaattccttcagccaagctatcgaagcagccttcatgaaattggacacaccagctacttcagaccccctctctggtaagggcgggaaactcactcaactcagagctcaggcttagccacgtgtgctgccgttcctgcctgggtcagtggcaggtaccaagtgtcagcacggggcttattgtccaccctatgtgaatccttaaggtccagaagtggacttgtgaggaactcttttttattatgtgtgtgtaccatgtgcatgcttgatgttttggagctcgaagggatcaaatctcctgaagtggagctgcccgtgggtgctgggaatcagccctgggccatttcacctgggtgcccacagtactgtgcctccccttgtctaagtgcactctctgtttcccctcagaagacagaggagggaagaaaaggaagagacagaagcagaagctgctgttcagcacctcggtcgtccacaccaagtgacactattgcccaggcgccttctccatcgggtttcctctctgtgcttttgttttgctgctgtaatttt

SEQ ID NO: 30429 - DNA, 1082 bp, Mus musculus
ctgaggagacatgggaagagagtcagaagacagcaaggatgtgagtgctggctggaaggacctggctccctgcttccttccattagagtggtcggcacagcttgctctggtgaccgaggagtgaggatgtgcttcagcttctacaactttgtggccgacacacaccctaactctgaaaaaacagatgtctcaagagaagtttgtgagatagtagctcagttaggcctggctgaccttgaactgcctaccccccagaggtgaaggtacaaaggtttgcacagcatccagtctttggaggggaggatcctgacatatcttaggctactcttactgcctgggcctcctgctgtctggattactgtaaagcagagacagcctgatagtcatttgtctcccaggcccttagagcagctctgaccagctgtgtacatggacctccattgcctttgctttgcagatcccgaggtccacattcccctcgagaacctacagcagtttccggccttcaattcctatacctgtccctctgattctgctttgggtcccaccagcactgagggccatggggccctatccctgtctcctctgagcagaagtccaggctcccatgcaggtaagtagttgatatgtgatggattctactatttagagctctaatttgatttaattttaaaattttatgtgtaagagttttttgcctgtatgtacatatgtgtaccacatccatgcctggtgctctagaggtcagaagagtgtccagtctggaattggagttaatggatgctgggaaccaaactcaagtcagtctgcaagaagcatgagtgctcttagccatgggccttgaccgtcataagcagactctagtgtctgaattcacagctctaaccaacctggcacattgcagtatttaagtgaaagacttttagagttagtcctaagctacattaaattcttaggtttgcttctgacttcttagatcttgtggcttcgtaaagcctgcatcatttttctgacccatctgttctgttttctcttattcccatgtttaatgtttataatgtcctttcataatattgattgta

SEQ ID NO: 30430 - DNA, 1129 bp, Mus musculus
ataactttgaattatgtgatgatgatttacctatgtgaaattttgccattcagtaaatatgcctctattggtacaaaattgtatttattgcatgaaataaatacagaaaaagggtagaaacttaagttagcaggctttggtttccagtgttccggaccagattccctcagcagggctgtccgtctctgtgccttcccttgagcatcactgctggctctcttcatggctcccagtgtgggctgtttgttgtcttggtgtcagcaagtcctctctccctgttctgagtgtgggtctagacagtgagagatagtggtcggctttaggctgttctgttagcaggctgtctactccctgtggcctgagtttggtggatgtcttaatgcaggctgcatgtagggtctggctttctatagagcagtggcagcagcgctatccatttagttctggtgctgggtgtgtgtgtgttgggatcctttgttctcaagtagttgagcttcggttctgtttgtaggatgttcggcagcgtcataggtatctctctcacttgccactcacctgtgagttcagcatctgtgaactggctctgcagcctcctgtggtctctaaggaaaccctagagatgttctcaggtgagaaagccccattgcccttctctgctcagaacccagtgtgggaggtggggcttgagctgtatgctgagacacgcacgggatgcacccatccatctggtctgctgtctcgatggcttagctgtggtcatctagggagagttaacagtggctgatccatctttcttacaacttgaccaacccacagatgacattgagaaaaggaagcgtcagcgccaaaagaaggctcgcgaggagcgtcgccgagagcgcagaattgagatggaggagaacaagagacagggcaggtgtaagttcagagctcacggttgcttactttgccttgtgtgagtctatgtggccccttgcctgcctgtgccctgccagtggtttccattcttcctggggtaagtaagatagtgaaggtgataatgaactgttccatggtagggaagtctctaactgctgactgtctcagatagacctgacctgctcacaggagggcaggggcacattcagga

SEQ ID NO: 30431 - DNA, 1297 bp, Mus musculus
gccttagcaacacttactgaagattttggagtaagtagaattggccaaggaaggagtatctcctgtgtcctctgcatcagggattcttaagctcgagccatgagaatcgctgcttgtccttcagagtgagtctgtttgggtcttcttttttctggtggccttagattcgggaagaagctctgtcaggagtggctggaggcggaggggaggtcactggtgttgtggctgctctggaacacctggtgctgatggctcccctggccacggagtctgctttccaacccaggaaggtcagtgtgcccatcacaacgaagtgacttgtccttcagatcccactgttgtgaaggagagatggtagcttggctgtgtcctcatgactagatctgtcaccttttccaggggtggtactgaacaggagagctcgggtcaacacctggggagcacagctgcctctgctgcattgtttcatgaaacagaacatgggacttcgtgttgacctagggtttgttccagcagggtgtgctggagtatctgtctgcttttgatgatgaagctgcacaagtttgttctctggacccccctggtcctcttgccctccctttggtagaagaggaggaagcagtgtctgagccagaagcctgtgaggacgcagaggtagccgatgacagtctgggagaggggactgttggtcctgagatgagccaggaggagcccatcactaagccaggcttcacccagctcagcagctctccgtgttactacttctaccagggtgagtccccaaggaaaagggagggctgggctgcctcaggtatttgaaggagagggatggcctggcactctgaacagagccttcctgggggtcggctccctgctttccagcagcaagcaggaatggtgggcctggctgggagagagaggtccatgctggaggctggccggggcttgtgtgatagagctcttgtctttagcggaagatggacagcacatgttcctgcaccctgtcaacgtgcgctgccttgtgcgggagtacggcagcctggagcagagcccagagaagatctcagcaaccgtggtagagattgctgggtattccatgtctgaggtgaggttttttggagaaaagaagtatgtgatgttaccatgatctctttcgtgtaggcctcatcggagtgaggctgcaactgttgaggcctcaatgtgctcatttgttgtggttcctttgtttttgagtctgggtctctcttatgtagccctggctgtcctggaactcgctctgtagggcagggtggcctca

SEQ ID NO: 30432 - DNA, 1149 bp, Mus musculus
catttcctcaactgaaggtcctttctctgtgataactccagctgtgtcaagttgacacaaaaccaaccagtacaggtgtataagcaataaaggatctacctacccctctttgaggaagtcataaccaggaatcagagggacagttacccttgattaccttgccggtaggcagacaagcatggtgccagaactcacatgttaataacaaccaccagacagagacagggctgactaggaatggggaggcttttgaagcctcaacatccacgaggctacacctcctaattcttttcaaacagtccaccaaatcggggacattctcattcagactgcacgggcggaagtgttctttactgctgagcgctctctccagccatgtctgctgttaaccagtttggtgaagtgatgagatgcagagagaggcatctgactttgctggccctgagtcaggtctgagagccatgacgctgtgtgtcattgtgtttcagcgcatctgtagccatgaagtgccatcttgcccaatatgcctctatccacctactgcggccaagataacgcgctgtggacacattttctgctgggcatgcatcctgcactatctttcactcagtgagaaaacctggagcaaatgtcccatctgctacagctctgtgcataagaaggatctcaagaggtaagactgcggggtaggtgagaccctgggctgctgtctccccgctctgcttcatccagatgcctttgtctcagtgttgttgccacagagtctcgacagtatgctgtgggggacaccattaccatgcagctgatgaagagagagaagggagtgttggtggccctgcccaaatccaagtgggtgaatgtagaccatcctattaacctaggaggtgagcacgagggggggggactgacccttaatgaacagtgcatgcatcttgataatatcagaatttgcccttggctaagccagttttaacccaccggcatgagaagttgtctgaaaacaagggcagaggatgtggcacaggaccaagtggttgccgagtacacaaaaatcagtaggtgcagctctcagcactggtgacagagcaagaatacaaggaagaaaccagccatggtagtgcacacatgagatctctgcacttgggagac

SEQ ID NO: 30433 - DNA, 1145 bp, Mus musculus
cactcaccgctatgcatgctccttgtgcataagcactgaagttttcaattaattttttgagaaaaggtttttctgtgtagtcctgactgtagccaaggttggcctccaacttaaatccacctgcctgtgtgttccaatgctggggggagggggtggagctgtgggtgtggatttgacatagaggtaaaaggtttgcctagcattcctgagactccaggttcaatagtaaataccaccaataaaagaaggtggaactatggagagtttattggctgagttcctcttggtgctactaggtgactagagaaggctgtgcagggcagggctctcactgtagtgctgctgagcagggcgacgggacagtcgggatgcagatgctaggggagcgtctcctgtcctcactgccacacggcttaggtgaggttcagttctcagccatgaggaaggaagcggagctgtgccgatttctgctgtcagtgggtaaattcttcactctgaaatgctgtcattctttctaggtagcagaggctcagcgggcagagtttagccctgcccagttctctggccctaagaagatcaacctgaaccacttgttaaatttcacctttgaaccacgtggccaggcaggtcactttgaaggcagtgggcatggcggctgggggaagagaaacaagtggggacacaagcctttcaacaaggagctctttctacaggccaagtgagtaccccatagagggcaagggggaccacattgtgaggaggacacctcatctaaccagtcaggggggagcaacacaaaggaaagtgtccttctcttccccctgtcacattttctgagggagaattctcagtgcttgccgtgacttctgggaccaggagtggtgtgtggactcaggctgctgttgagtggactgcgaggaggtcatggatgcagggaggggagagatgagagaggagagtttctgactcccgtgctcatgtgctgagcctagcagaggaagaactgaggtgcaaacaaaagttttcccaggagccctcaggacaggcctccgtaggacagatgagcacgctgactccaagtactgggctgcttccctctgcagctctcacaggtgttgcttaggcttggacttttggagctgggg

SEQ ID NO: 30434 - DNA, 1228 bp, Mus musculus
attgtaggaggccagacacccacacatcttttttttaaaaaaagaaaaaaatccaagcactggcgaggaatatctgtgaattggaagccagactgttgcacacaaagagttcaggtcccgttaggactacaaaatgaaacattgtctcaaaaagaaggaacccgctagggaggcgggaaggaaaagaaacctcgaacagggaagagagaaaaaaagcattggcaggcacaagcggtccctcccctaggacccggatgtaggtaaaagactacacttcccagaatgcaccacgcccgcctggcaactatataaatagtccatccgggttcttggagatgctgtttggcgactcgtcgccattcccggagcagctcggcctcggcccagaggcgagtgtcggtcgctgtgtcggagaccccggtccccggcaccgagacagccagccctctctcctgccccgcggcgggagagcgtgtccggccggccggcggggctcgcgaccctcccgcgcctccctttcccccgcagcctctgccccgccaggcccggcccggacctccgagccccggcctcctcctcctcctcctcctcgtcctcgtcctcctcttcggtcaccgccgcctctgggccccacaaccccaccttgccgcttctccttccattttgagaagctgaggaaggaaacaaggaaaaatgtcgccatgaaggccgagaaccgctgccgccgccgacccccgccggccctgaacgccatgagcctgggtccccgccgcgcccgctccgctccgaccgccgtcgccgccgaggccccctttgatgccgcagagctcccccagcgccgccgccaccgcctccgacatggacaagaacagcggctccaacagctcctccgcctcctcgggcagcagcaaagggcaacagccgccccgctccgcctcggcggggccggccggcgagtctaaacccaagagtggtaagagccggcgggtctgccgggtcacttgggggaggagggacaaacgacccaccttccgcttgcactgacatccagtatttacggttaagccgatctgcgctgcgtggttaatttgggcccttgcattcatattcaaaacagctggctgaagtaggcgctattcttagccccattttgcagatgagggatctgagattttggaaagggttaaggtcatccaggtggcaagcacctcacagaaggcctcaagac

SEQ ID NO: 30435 - DNA, 1174 bp, Mus musculus
tccgggagccagccactcgacccggggctccgccttcagggtgtgtgggcctccgcacgcgtgccgcgcatcgcccgggcaaccgacgctgtgcgcggtgcattgtggtctgcaacaaaacgcgggggaaagatcctgagggaaccattgaatccgctagccaatcgggagaggctggcggtagcggatggccaatagcgacgcgggccgggggcggggccgcgggcgcagggcggggcctagggattaggcggcggcggctggcgtggggcagcttagatgcgccacggcttcggtagcgaccggctgtcttctgctgcttgagcggcgcccgcaccttccctaggagctcgcagcagccggctggcctctgctccacggtgagaccgggctcgggtcctccccgtcccccctacctcgggcctgcggtgcggacctcgggagctgcccctcggaagcgggtgggggcgtcgtcctcaaggggggcgccggtcgggagggcagcgagcgcggcccgcacccgacccctctccctcttccctgcgcttcgtcaccacacaggtaaccatgtgcgaccggaaggcggtgatcaaaaatgcagacatgtcggaagagatgcaacaggactcggtggagtgcgctacccaggcgttggagaagtacaacatcgagaaggatattgcggcccatatcaagaaggtgaggacccggcgccgcgtagttcctactccccgattctgcgtcctctgggcgcctggcagtttccctgtagcactcagggcggctcgggatggatagttctagaaaggacgcaagggtttcgcgttcctctggggaagaccagaccctcaacgccagaagttttttttttttttttaaacccccagctccttgggggaaagcgccacctagcaacggtttccaagatcagggagttgcgagcagttccccctgctgtagaattcctgcgccgaggatccatctgggtgttccgggaggggggggggttgcgcctgcctgcgtgggtgtttccagccgggctaggaggagatcttgccagccttctagtcgggagttagtcgacagttcagggaaagtgggtggcagtggtggtttggggggcttgggtggaggcttggtaaatggcagttttgtagaaagctggcgcaagact

SEQ ID NO: 30436 - DNA, 1860 bp, Mus musculus
gttcccttggctgcacttggcttttttcaaaactctcatgtcttgggaaaaataagttcagcaagaaatacttggtactaataagtttcctaatggataaaacctggaactaggtttggggagtgtcacattgattgtgaagcacagagtggtaaattctcagaggttgaaagcctgtgataggcggatttgtttgcttagttgggagcttttttggtctctggacagttaacttagaccagcttctcacagtggcttaccatatatacttcagtatatttctctggttctctgccccatatgctttgtgacttgggaacccttaagaattaagtgaccacagagcgtagaccaccgtaggcatagccagctctcatagggcatttagcacggctgaggttgtggtcttctcttccattctctgcctaggacttcctccatcaggcagctggcaggacctgaaagatcacatgcgagaagctggggatgtctgttatgcagacgtacagaaggacggaatggggatggttgaatatttgagaaaagaggacatggaatatgctctgcgtaaactggatgacaccaaattccgctctcacgaggtgggttcctgccttccattaagtctaattgaccagcaataatagcgggtcgtacttttttcatttgatgatgtcactctaccttaaagcctgtctagagtgaacagagctacgggggttgctctgcttatagcctccgtttgaaacggagaggacgggtacccacctccgtgtgacagtgaacgttgagggaggtgacaatgccaggcacacagtgagtgccagggctgggctttgctcgtgcctctgggtcttcactcttcccttctgtttgtttggatttcagggtgagacttcctacatccgagtgtatcctgagagaagcaccagctatggctactcacggtcgcggtctgggtccaggggccgcgactcgccataccaaagccggggctcgccacactacttctctcctttcaggccctactgagggggtgggaaggaagggtctcttcagttttttagatgagctgggctactttgtgctcagagtctacattccagattgattagagtcttaggacattttttttcttttctttccttttatttttattttattttattttttttattttaaggaactacataatttcggctagagccaccatactagcagtgacctgttaggctgcagagagaaggtgtgtctgtggttcaggaacaagctgtacatttttcaccctgactatgggacggaaatcagtgctgcatcttcatgggctgctctgctcggagatggggcccgaggggcccgttttgttcagaaatatattttaaatgtttagtaattggcgtgcagttgtctttgattgagtatgtaggtttcatctgataggtactgaccaaagagaaccatcatttgagttgtcatggaagtttgtaaggaacagaaacttcatcactctgccagagtaatggtggcgattgtaaaaaatcagcaccaaaggcagactctgttttttttattttaaaggttggtttttatttacatgtttatgccgcgtgtgtgttagtgcctacagaggccagaaagacagcatcaacccctgtggagctggaattgcaggaggtcatgggtcaccttgagttgaggtgggcaccagagcccgactcagctcaggatgaagaacaggagggtttgtttctttggtttgatgtttttctttctttccattttcttttccagagagggtttctcagaataattctggctctgtagaccaggctagccttgaactcagggatctgttggctt

SEQ ID NO: 30437 - DNA, 1100 bp, Mus musculus
ttccttggaagcaggcttgtggttttctgctagctgggtgttgtccagttgtcttcggatcaattaccaagaaactgtaaatccagtttatactagatagagttcacagtagcaaatgaccacccttgtgagtccaccatgttgacagggtgccccttccccagaatagctactctgctgtggaagaaggaatcttgtttaccatgtctggcaaggaaatattacctgtttgaaaaataagaagaacattagagttgagcctgatgtccagctggctctcctaaactaactggtcacttggatttcacggagaactggaagtaagtattggtgccgtccttcttcctaactctcaagcatcagttaacggttcagagtgaagccagatccctgctgttcagtgcaaggaacagatgcaggtaagagtgaaagacagactaaacctctgtcaggagcaaggtcctgtctgcagtgtgatccgttggtacacatgatgaagtaggaggaactactggccctgccatggcagggttgtaaggatctttagccagccaaggcagacagcatggttagcatagagttccgtcctcccgctcacagggtttattgctgactgctggcagctctgagaactcatgcacaggagacaagaagttctaaactgtgtacagtgagcctggaaatgcaagttgctatatcagggattacaaaccatggctggctggcatacttacaggtatgtttctgctggcctgtgtggcactgttaagtcttatttgaattgattgccaataaagttgaggaaatgccagacagatgtcatatacttaatttcccaagcaaataggcttgggttactctgtatggaggagccagctgtgcctgtagacaggcttccaggcacagagatgtacagtctgctgcgcacaccccttaatcctgcacttctctttcagtgtgactggaccctaaaggtgaatatgactcctggacacttgtcatttacaatgccaccacttgcgtgcagtttgtccttttgcattcagatagtacttgtctccagcaagaatgtctgagccactctgggtatcacatacctg

SEQ ID NO: 30438 - DNA, 1245 bp, Mus musculus
tgagctgccagccgtggatgggtgatagtcacgtgcagaacaacagatgctcttacctgctgagccatccccttcctcggggagctaccttgcgcttgcttgtcttaccatctacttcgaaggagagatggctcagtggtgttagagcactggctgcttctccaggggtcctgagttcaattcccagcaaccacatggcagctcataaccatctgtaatgggatctgaatccttcttttgtgaagacagagtacttatacataattacagaaataaattaaagttacattaaaaaaaataagaaaaagctctgggaaagttgacatttttatgtcagtaaatctatgccagtaaaggcacatttccattttgattttatgtattacctctttcgattctgagcattttctggaaataactaattgacatcttcgctccgcagcccttcccctggggagacggtaaccataccctcttccacaaccctcatgtgaacccacttccgaccggctatgaagatgagtaaagagaacctggcctcccccaggcaacaaagggaccacagcactggttttggacccttactctgtgtggaccacgaaaaccctttggatgctaagctcgtgtctcctttcctcagatggcgaccattactctgatcttccatcccttctgcttgtaagaggagatgccttaaataaataacttaaactcagatggtccgtgagctggacggtacgattttattctcagacactgacattgctttgctgttttgcagtggttcagatctggtttagctgaccgaataccgtttctagctggctccctgctggtttcttgtgcttagcatgggtagagagctaaatgactaagagcagagagaggtagagttaccattgggatgggctccctgacagacagtggatgatcaatagaattgccgctgattaccatctgtaacacatgcgtgacaacttcaaagactgggctgcattgcaggtttcaggtcagtccaggctgcacagaccctgaacaaagtacatgagctttagtcagctcttctcgtcacagcagctcctgttgcaatctacaaaaggagctgagttcttacctttaggaaaagaatttctcaggcagacagcgatggtgcgtgctttaatcccagcacttaggcagaggcaggcagagctccaagatcaaggacagcatggtctacacagcgaattccaggccagccagggc

SEQ ID NO: 30439 - DNA, 1145 bp, Mus musculus
tgcggctcaaacttttgttgaggctgctcccggagcggcgggaacccaacctgagcggtcccctactccagcccggccccggcccttgccttgccgaggccccggtgggcgccaggaaggctctgcgggacccccctccccaatccccggcgagggcaggggtgggggggccggccgcggagagtgcgcgcgggcagctcggcgcgggggcggcggggccgcgccggggtcaccaggggcaaaggacgggggaggagggggaagggctccgggcctgggctggtccgaaggcgagtgtgtggttacagaagggctgcgcgaatacttcggccagttcggggaggtgaaagagtgtctggtgatgcgggaccccctgaccaaaagatccaggtgagtcccggagacctctcctgccaccgcgctcgcccctcccgccgaggccactcgctgtccttgtaaccatctgcctctccctcactaccggcgcaggggtttcggcttcgtcactttcatggaccaggcgggggtggataaagtgctggcgcaatcgcggcacgagctcgactccaaaacagtgagtgaccctcggggtttcgggggtcctttgggagagggaggctgccggaggagagcgatccgggaactctctctcgtggggacagttgcatggagtttgcagagtgagaaagctgtcatgccctgaaagtttgtcagtggagttagggacagagggaggaaaggaaaaaaaaaaatctcaggcctgggataagatgccacacgccccacctccagtgttggtgagggacgcagcaactactactctttctctgtgagtactaatcttggtacttctggctttggggtggagccgggcccctatcctacccccagattgaatgagtcagggctacagttacccacggtggcttctctgaaatctaactactatttgactctgtgacacccccttttccattccagaccaatggcaaagcatcacagagccctcccgctcccccccccccttctccttcccggactttggtcagtgagctccttgcttttgtagaagacacgaaccttctttatccttacagggtatttatgaacagggagctagcttgcaaggaaattggaaatagggg

SEQ ID NO: 30440 - DNA, 1153 bp, Mus musculus
ccatgcgctcctggggtaattaggaccatgtggtcttcctgaaacagggctgggggccacggggaggctgcccgaggttggttggcttgggaggaaggttgatgaggaaactgttggtgttcctttcggtgacacccccgtggtatctttggtgtctcccagaagaagtggtgggatctttcatgctaggcagtgagtctaggcccttggcatgcctcccctgcccccatccttgtaaggttccttagggaaccttccatacgcagaccccagggagggaggcacactagagccagccagagtgtggggcacacagctgcccgtggcaggcctagaggcaggagtccaaggaggagctgggaagggggccttggagaagctggggccaccgagagcttgtcagctgccatcctggcaggaggggaccccaccccccacccccgccacagcccctgctgatgagggggaggccacaggactcagatgcccacttgctccttccttcccctgacagatggtcactcggacgaagaagatcttcgtgggggggctgtctgtgaacaccacggtggaagatgtgaaacactatttcgagcagttcggaaaggtaggtctttcactgtgggtgttcctgggaaagccccagagtatatagatcaggaggaaagagcaggcccagggggtgggtggcaggcagtcagatcaccccacaggtgaggtcagaccaagtcacagtttggggatctggacccatctgtggggccccagactctgggcctcttcaatagagtctctcattacctttctacctttcctctctatttttctcctgctcttcactctccccggggaggaggcacttctgtagccagttcaatccagcgctcccctccccttgccctcttgggagcttgcacctgtccagaccacaggcagctgcaccttccttccaccaacccccccttcctggagaggatgataagaaagcaataaataagaatccttattgcagttgggtaccccccttaagcaggtggggagctggggatggctgctgattcccccaggtattggaaaacaccccagagtctgccccagctcctgagaggtcactagctctcagctcttgggtgtgtcaagatttaatttctgg

SEQ ID NO: 30441 - DNA, 2029 bp, Mus musculus
tctccctggtcgcttttatttatttttggattagccagttgccctacccccacaccagatctgccctctcctccggtctgccccatccctccctgctgccccctttagggcaccccccccccagaaaggcatagctggagggcgggcagagggggcctgctgcagactgaggccccaacccggtttttttgtttgatttttttaattctggcttttccctctttttgctctttacttttttttttttaagaaactgtttttaaactatttctaggtttgtgaatgtgaagccccaggccgcagggggccaggggccaggtgccccccacaccagctgagtgtctgtgggtgtgggttcctggccttctccctcccaaccctggagaggagggcagggctgcggggtaggccaggccgagcccctggagccaccccgtcctgtatcatatgtaaatactgtgaggtgaagccctaccccacccttccctaagacccccttggggtgacagcatttgtctgaccccacagggcaaaagtccctcccccgtccccttctccctgtctctgacccttcttcctcagacaccgttactgtaaggttgcagacctcagctctggccacaggcaggcccatactctcaggccctccccaagttcaaggccttgggcggactcttcccccaagaaaccccctggttaggggagcaaggggccaggggagaggagggcttgcctagagccactgctgggaaggaattggctctccaaaggcccctcctggcccccgcctagatgggaccttcatggtttctgctctgagccccccaacccccacccaggagtgggcatcgggaagcgcttcagcaaggagtagataccaggaaagcaaagggcttctcagggaacccccacatcctcactgaagtttcccaccaggatgatcccgtgaccagagcccttggtaacccccaccccccaccctggagacccttttttttgggggggagacgggggctcagggtgtgaacatgaggtgagacctggcatggcagggctgagtcgtgcctgctgtcagcccctctctgtccttcccgaggctgaggggggcctcaagctcccttccccagcagagccccacccacccacccaccccgccttcaaagccccctttggagagttaactgtccgtgtgaggcgctcactcaaccaataagccccaagaactcaaagcaataatcttcgttactgagatgcgcggctgttagtgtttgttgttggtttttgttttttgggttttttttttttttttggttttttttcggtttttgtttttaataattcctaataaaagagaagctgcatttttattggattttatctttaatttttctacacatctgaggggagcctcaggagactttggcttcctttcttccccccaccccctattccctggaccctctcactccactggacctaactgtgggttcgtggacctggatttacatttctgattcgtttgaggaaaaaaaaatttttttcttttgaagatgttacatggtgttttgaagccagcaagttccaccctcggtgtctttttccctccgcatctgtaacttctttttccaggttttattttgttttaaattcctaataaattatttgaaaataacttgcctttattcatgtgtgtacgtgagtgcaggcacacacacaatattacaaaaatagtgtttataactcatagggccaggtgtggtgtgtgcctgtaatcccagcaatcagggccagagcaaaagaatcaaactccaacctagcagggctccatagtgaaaccctgtctcaaaccaacaggaaaaagccagcaagtggttggccaccacagtcccagaatttggggctgagactggaagctccctgcaaattcgaggtagatctgggccatgtagttccaaaccagccagagctacacaggtcccgactcccactccaaacaaaagccccaaccataaaacattctggggtaagg

SEQ ID NO: 30442 - DNA, 1112 bp, Mus musculus
tggtagatagaaccattcaatgacaccgcccccacgcaaacccaagcattccagacacaaaggcaggagtcatctccaccctgccttcctccccgacttcttacggtgtctaacaggatagttgccccaggtcccttgaagctaggctaaggagccgtgcgaggaggcaggagtatcagaagctcagggtcaggcttcaggttaagatcataccgctgtggcagagcaccaagttccattcccagcattcacgtcggtggctcagaacccctgtaactgactccctcttctggtctgtgtggcgtctgcactctcacatgcacacacaagggagctagtgagatagatcgcgcttaagagcgctggctgtgctgaggttttcatctttgcccgtctattgtaatgcaaagtgcgagcccccaatacctctgaccctgccccaacttatttctgattggtaaataaagatgcagacagccaatagctgggcagaagagacatacgtggggtttaggtgtttaggtttcccactcttggggtcagagaagaaggagaggagaagaggaaggagaggccatctttggttaggaaaaagggaaaacgtcaccacgtgggctgaccaattggagataagagcagtccagatgaaatatagtaagtaataactcggggttatcgataggaaggtagattctaatagcccagagggtaggcagctgcccagcaactatgctgcttgaagcttattgttgtgtgtgttccggagtctaaatggtctaaggtggggtagaaaccttgggcctggggctggcgagatggctcagcgggtaagagcaccaactgcactcccgaacgaactgagttcgaatcccagcaaccacatggtggctcacaaccacccataataagatctgatgttggtgtctgaagacagcaacagtggacttattataatataataaataaatctttgggccagagcaagcgaggccgaccagagcgagcagaggtcctaaaattcaattcccaacaaccacatgaaggctcacaaccatctgtacagctacagtgtactcatatacataaaaataagtaaataaatatctaaaaga

SEQ ID NO: 30443 - DNA, 2001 bp, Mus musculus
aaagtgggccagggagctcagagtttaatgccgaccgagctctattttgggaagatcaggttcttacaatgaatgtgactgtcgtcaacgacgctgacatcatccttaagatagttaacactacctttgatgctattctagactttatatgcgtattttcttgtgtctaaagtcataaacaagaaagcctcgttggaaaaagtggttaacgttaagcccaactttacaccttgacgcgggcggttgcctccgctcctttcccccgccccccccccccccacccgcaggctcggagaccagtctattagcatgttcggtcccataatgctttgcttcatttccgctgcttaaatcttaaataaaaccagcacgcctctccgttctatcacatagagaatgccaagagaatgtccttgctgctctcatttccagggtagcgataatggagggttttcccgtttgctcgaaaccccctttttgaaatagggtcctcgtctgctaggaacgttgcgctggggcgggagttctttagctttgcgcagtggcagtatcgtagccaatgaggtttatccgaggcgcgattattgctaattgaaaacttttcccaataccccgccgtgacgacttgcaatatagtcggcattggcaatttttgacagtctctacggagactgaataattgtggtttaaaaaaagcatgctactttttagagattgttatagaatcctagtttacttttgttaagataatttcatttttcagcttttcctaccgtcttcctatgtgttagttttctatttccttgacaaggtttcctttttctcctgctatactgagaagtctgttatccctggctgcagcaatcctgtctccgcctccggtctcctcaaacttgtatcagtgactggcccaacactcagcaaatcctcctgtctccgcctccggagtgctaggtttacagacctctaaaccaccaccccgaggtcagcctctgcttcggaccgtcacgacacatgtcctttcatcccttctggcttaccctccttctcccgctgcggttgagcctccacccaggccatcgcgatgacgttgactcgatttgcataagagtccccagcatcccaagcgactgccgcgtagtttgcaaaacacggatgttcgggctcgagataacccactggcaagaacgtgtccacgcagataaccgagatggaaccgccgggctccgctcccgtcacgtggaggtcgcgcgtggactgaagctcaccgtgactgaaatgggagtcgtcagccctgggaggctgagcgagcacgcttactcgtcagctttgcgcagtggcagtatcgtagccaatgaggtttatccgaggcgcgattattgctaattgaaaacttttcccaataccccgccatgacgacttgaaatatagtcggcattggcaatttttgacagtctctacggagactgaatattcatgtttaaacattagacttgcattctactttatagttttctgttttatcctgtatttatttaatttcaagtttgcttattctctgcataggctgtaaacattatagcaactgacaaacttgtattacgtctctctgattttccaaatttccttgcggtattgtttagtgtagatgcgcacacacaataaggaaataattttttttttttatctgaaagaacttcacgaacaccagtaccttttgaaattagggtaaaacgaacattgattctggtgatttacattacaactggctttcagaaaccctgaatacttgaagctctgggccggaagcctgagttttttttaaaaaaccttgacagtgcctggctatgtagccctgcttgatccgcctgcctctgcctcccaagtgctgaattaaaggtgtgtttcaccttgagcagcttttttgtttgtttgggttatttttttaagagataaaccggtgagttagctcagtggatagaagtgctcgctatgcaagcc

SEQ ID NO: 30444 - DNA, 1651 bp, Mus musculus
cagccagtgccgccacgcactgctcgcttggggccaatccaccaatggaaactggaacctcaccccctcagcaggcacaggcgcaggacaggactccgggtcggtcctgcctgtctctcgtccctaccacctgctaaaggggcctcctcccccttccgtggctctcctgggctctgtgcacttcatcttccccagaggtggaagctgctgcccagttgtcccgtggatgtccctaagagccagcacctcacactggagcctttgacagtcacctttccacagtgtggtcattgggagggcagagagggtcagctaggggctctttttatccttctccaaacccctactgtattggggacaccgggccccactagacaatgccagcataaagtcacccatgggccatcaaaggcactttgggtgccaccacccagtctcccagagtctgggtgactgccccgtttgtaccggccccggggtctctgagaaagcctcctccagcaataaccttttatatagacacgtgcttcatctctggggacggcgtgaggtgggagtgtcacccgcccacgcctcaacactgtaccaaatttgatagatttctacactgaggttcaacttcgtatggctcaagttgcttttatgtatctccacaagatgattttgaagagatttaaagaactcccccttttgtactctggtctgtccttgccgctgggtcagcccgtggcattggttttggtatggactttgctttgtatgagggggaaatactttgtatctttatgttatttcttagcacaatgagctgggagcggcccttgacgacttctgaaacctcgcagctcccgggactgtttttaaactgctgtattttcaaacccttccctcactgcccaggccaacgggctcttcattaagaactactctaagaatgtccagccctttggacctggagttttgaacctcacgtgtcctgttcccaaggcaggcaaaggggaaagacatatttgggggtctgcttcctgcctaagtaagccatctggaaccagcctctgctccctgtgaaattttttttggcgacaaggagaaacccctgaattttctcagcctcctcattgcttctctggggctcgctcttcttccttctcaggaaagccggtgtctgattttgaccaggaagatggtaaaggatctctggtctccactccactgggcgcatctctccctccctcaaacttcctgtcagctgaccggggctaaggctgttccctttcacaggtggggtttgtgttggggggctggggaagggggtctgagaatgccccaagctggaacaggggagcctggtaggagttggggcagagggacaagatccctattagagtaacgaaaagtcccagagctcccagtccaaaggatgagatgggagcagccagcttggaaatggctggggaaaaaggcgtctggaaaagggattccagacaattccataggctggggacctacaccttacatcagcttcccagtagaggaccagcgtgatggggtcccagacaaggatccccagtcaaggtcagctctggcagtggctgcagacaccggcacttccacccacaggccttactgctctgtttacagtgacctgctc

SEQ ID NO: 30445 - DNA, 3806 bp, Mus musculus
tttccgagacagagacaaagatttttgggtctggtagtaccttttatatttcacaacctaagatcccccgacctctctataatttgttttctgtgctttttaagtctgtctcttccctgatcagagtcactttggtcacccaggcacgccttatttaaaaagtaaagcttaagatttacttgaggcaagtcttccccctatagctctggctggcctcggattagcaattaagccttacctgtctttacaggtgtggcaccacacccagctaaaagttaatttttggctgtgacagtaattttgtgatactcgtaaccagcaaggaagctggatcagataaagacagacgttgggctcgggtggctggctcctagcgagaagtgtcacacctagggtgaagcaatggggaggtagaggtagcagggtttcgggttttgctgggtattttttgtttgttttcctctcaatgtagtttttcctggcttccttcatagcaacttttggatgattatccaaaatgcttcattgtgggagcagacaacgtgggctccaagcagatgcagcagatccgcatgtcgctccgagggaaggccgtggtgctgatgggcaagaacaccatgatgcgcaaggctatcaggggccacctggagaacaacccagctctggagaaactgctgcctcacatccgggggaacgtgggcttcgtgttcaccaaggaggacctcactgagattcgggatatgctgttggccaataaggtaaggggctgggacgatgaatgaggatttggccatttcggggctttcaccgatggagaggcatttcaccgtcgactacctctgttctgtttaggtgccagctgctgctcgggctggtgccatcgccccgtgtgaggtcactgtgccagctcagaacactggtctaggacccgagaagacctccttcttccaggctttgggcatcaccacgaaaatctccagaggcaccattgaaattctggtgagtagatggcctgcagtggtcggtcctttgggctgggcctcctgtgtgtccagatgataactgtcctgctgttctcttcctcagagtgatgtgcagctgataaagactggagacaaggtgggagccagcgaggccacactgctgaacatgctgaacatctcccccttctccttcgggctgatcatccagcaggtgtttgacaacggcagcatttataaccctgaagtgctcgacatcacagagcaggccctgcactctcgctttctggaggtatgtctgcccagctccttcctcccatgctgagtgtgacaacagattcgtgctggcatcttcagttgttccatcttctcatctgcagaaaatagagttgggcaggaggtcatgtgctgggactctaaaggttgttagcctgtgatagcaaaacactgcctgtgggggctgtgtctaatcccagcggaggcaggcaccctcttgtgagtttgaggacagctaggtctcaaacaaaatagaacattgctggtcggtgagattttgagtattgagtcaaggagagatgaatacaatttaatgctaacaatttaaattgttattactctatctttttaaagactgtcccacaccaggcttttgccattaaattgaccttttttgttttttgatttgttttgttttgttttgaggcagggtttctttgtatagccctggctgtcctgggctttgtagactaggctggccttgaactcagaaatcctgcttttgcctcccaagtgctgggtttaaaggtgtgcaccaccactgcccagcttaaggaaaattgtttccttgagtgaataacttactgaaattagacatgcatctatagatttagcattttaatcttaacatttttttgagttatttatatagtttatatttctaactccaaccatgcccacccccactcataattcaagattgggaaaaggtttcattactggtaaatcacatctggaaatggattaatattctaatagtgctcagtaactaggctaacagagtagattttcagaagtcactgtaaggaatattgaacagccaggtctggaggaagggtgagcacaaactgatggctcttggctctgcccaggcttgagactgaactgaggggagctaaaatgtcattcttgtctgcatacagggtgtccgcaacgtggccagtgtgtgtctgcagatcgggtacccaactgttgcctcggtgccacactccatcatcaatgggtacaagcgcgtcctggcattgtctgtggagactgagtacaccttcccacttactgaaaaggtaaggctgtcctttcaggaccacagaggcctgacgggttggcaagtggcagtctgctgagttagtgtattcatgctatgtcacacagtaggtaccttgtgagacaagacagggtttcatgtagccaaagctggtctttttttttttttaagttttattatttatatgagtacactgttgctgtcttcagacactccagaaaggagtatcaaatcccattactggaggttgggagcttagattttcagaattcccagtcactgcttttaaccactgagccatctctccagccccaaagctgatcttaagctgtagttgggtgaccttgaatccaggttggggcttgttactagtaccagtgcttccccactaagccagcaccttaccaactaagctgttaaaccaagctccatgtcctgtttggtattgggtgaaaactgggtggcctttcattcaggctagagtctgccctgagctagtcagatcctttgttaataaaagtggggggaaatgcatattagtggaggcatgcatgctctcattttaaaagactagacccctagagctgggcccaagtgtccagccagcaggctatgctcagaaagaacccctggtgggtaatctcactggaaagctgccacaggacagtcagttcttagcaggaagagtgtaggtggtagaactatgatcatgctgactgccttttctccctcaaggtcaaggccttcctggctgatccatctgcatttgcggctgctgcccctgcagctgctgccaccactgctgcccctgcggctgctgcagcccctgccaaagctgaagcaaaggaagagtcggaggaatcagatgaggatatgggattcggtctcttcgactaatcccgccaaagcaaccaagtcagcctgcttaatttgagaaagatggaaataaaggcttacttctcttaaaactccggtctggatttatttagtttgttcacttaagcaggatgaaaaagcaaaaccgctactgtttactttgtgttggcatctttgtttctaaaattaaagctcctagtgtttttgtgggctttgtttgttttttgagacagtctcttgacttggtgccatagctagtctgggacaaagattttccaggtgtgaattaaaggtgtatgtcatcaagccccaagcctggcctttatattcctatggtagtccatgttggatatatatcatatgtatacataatatatatgtatactaagctcaatggttaagagacctatgagccataccaaatctatatggtttggtatctgggtctgctttctgtatatcactggatgtccaagccattgttcataggtagccttactgctccaaggcagagtgatgcaggtccagagccctgttgcttaaggctgaggcaggggtagaaggctgggtttgagctaggcgtggtttaaggactgaagtctgagagggcctgagatggtgatactgag

SEQ ID NO: 30446 - DNA, 1150 bp, Mus musculus
caggagacactagaagcctggatcatttgagagctctaggtgccaggcgtccatgattgtccctccgccccatgtacctgccctccacaaccagtcccttgggtctctaggtgggctggctttccaggcacatctcatagcctgtggactcctgggcagaaatcggggcattgggttcagtccagctgggattcccactaatagcaggagaggctcaggggccctgcacagggctttaagccctggggacatgtttgttctctctctacaggtgcttcccttggaggctcttgtgacggacgctggggaggtaacggagatgggcaagacctatgtgcctcctcgagttctgcaggaagctctgtgtgtcatctctggggtgccagggctcaagggcgacatccccagcactgagcagctggctcaggagatgctaatcatctcccaccacccgtccttaggtcggtggctgtggaggaggtggggaggtggggaggtagcaccaggcagaaggcttcaagaagcccctcttcttcagtggcagtacagtctggactctggccagcacttcttacaaggatgaagattgaccctgacgccttcatcaccaggcacctggatcagatcatccccaggatcacgacacagagtcccctgaaccaggtaatgggccagggcttcgggattccctttccagggtacaagacgtgagggctcaaagaagcaggaggaggaaaggtacagtgtagcctgccctctagacagagacagatgagtactgctcggggcatagaagggagctcagggccccatggcaggtggtgtctgaggaggtgagtccctgggatgctgttgtcaggtcagctggggcccttaggacaggagaggtactgtctgtctgtcccccttcatgagacttgtctgatctcccagtcactctctctgctttccagtgtgtgagccacattttcttttctttttttttttttttttctcgagacagggtttctctgtatagccttggctgtcctggaactcactttgtagaccaggctggcctcgaactcagaaatcctcctgcctctgcctcccgagtgctgggattaaaggcatgtgccaccacgcccggctgtgagccacattttcaaat

SEQ ID NO: 30447 - DNA, 1984 bp, Mus musculus
cacaggaggcgacactcctgggctttgtcaggaacacctcagagtcttttggggggggggggttggttcaagacagggtttctctgtgtagccctggctgacctggaactcactctgtagaccaggctggcctcgaactcagaatccgcctgcctctgtctctcaagtgctgggattaaaggcatgcgccaccacgcccggctcacacctcagagtcttatgtgttagatttggaattagtgtttggctggtgtatattcagaaatgtttactgtttcctagtgtctcacaacccctacattgacttagggtgtggccccatgtagggctgggaacctcagtttaaggagctatggtttcgacccgaaacagcactatagggttcttgttgatggttgcactgtagagcgggtgtgtcgtaatgactgtggaactagctcactgctcctcaggtgctttgtttgacactggagcagtgagattgggctcagctgtccctgatgtgacgacggctgctcccgcaggtccaggagtctgtggccagctgcctgccacctctcgtgcctgctgtcaaggaggatgctgggggcatgatccagcggctcatgcagcagctgttggagtcggacaagtatgcggagcgcaaaggggcggcatacgggctggcgggcctggtcaagggcctgggcatcctctccctgaagcagcaggagatgatggccgcgctgactgatgctatccaggacaagaagaacttccgaaggcgagagggtgggtcccctgagcccggggctgacggcacaggaagtgggtgcccatgcacgcacgcacgcacgcacgcacgcacgcacgcacacagcagagaaagggagggcaggtgggactcctcccagccctgtccatggtggggctgacctgcacttcgccctttttctgtctggcactgcttgggctgaaccccaggcttcagctattccacgcaggctgctctgctgccgagctgcgccccagcctttcttatttccgtgtttcaggctaaggagtccctaagttaccaagcacagcctacaacttggtgatcctcctgcctcaggttccagagtgcagggatataaacttgttcccctacctgctttatgacttctaacacagcagagagaggcttgcctagtggtactagaaagtgttggaaactcccctgcctcctcctctgtcgccctctgccacatccctgcccaaggactgagacaggcggctgcacttaagtctgtccatgactacggtcgcctgaggaggtcccaggagcctggtggccttagcgttctcagccctcctgtcatcctctccccaggagcgctgtttgccttcgagatgctctgtaccatgctggggaagctcttcgagccttatgtggtccacgtgctgccccatctgttgctgtgctttggggatgggaaccagtacgtgcgcgaggtaagtctgggggcagaatggactgttcccaggcaggcttggtcagggaggggtctaagatgggttccagcccctgctgccagaggcctgtcggtgcctacctgggttaccgctatgaatttctctctggttccctgatgcattgaggattttatttgtgtgtgcatgtgtgctatgtgtatgcctgtgtgagcacataaggagattccaggagctagaagaggttgtcagatgccctctatcccctttcagctgggctggaaactggcaaaccccagctaacccttcatatgggcacacacatgatgtcctggcttattacgtggtcctagtgtccaagcttccgtcctcatgattgctaaatgagttgcttctctgtgtagccctggctgtcctgtagaacaggctggccttgaactctgagatctgcctgcctctgaagtcctgggattaaatgccatcagtgtctggcccagacacgtgctcttaactgctgagccatctctctagt

SEQ ID NO: 30448 - DNA, 1126 bp, Mus musculus
ttttcctattttaagagctattgcaagctggacacagaggcatgtgtctttaatctcagcactctgggttcaaggccagcctggtctacagagtaatttctaggccagccagagctatgtagtgagaccctgtctttaaaaaaagctattgcagtaagtagccctccctctctctctgtatgttggtgttctgactcccaagtttgtgacagggtcagatctgtctgagtcaacgccttgtgttgttacaggacttggctccttacctgcccagtgtgacacctggcctgaaagcttcactcttggaccctgtccctgaggtgagtgtgggcatagcccagtgtctggaaaataccttcctggaaagtgcccccaagtcacgtgtctgtctctcagtcgaagaggagaaggccaggggctccttcctgcttccctgctcctcactgagctgcgtctcctctccctgtctgtccttgcgtatatgacaggtgcgcaccgtgtctgcaaaggctcttggggccatggtgaagggcatgggggagtcgtgctttgaagatttgctgccatggctgatggagactctgacgtacgagcagagctccgtggatcgctcaggcgctgcccaaggtgagaccagaacaagcccagaggccgaatagggaacccccgaggggctttcgggtcccatggctgattccatccttgcccttcagggttggctgaggtaatggccggcttaggagtggagaagttggaaaaactgatgccagagatcgtggccacagccagcaaagtggacatcgcaccccacgtccgcgacggctacatcatgatgttcaactacctgcccatcacctttggggacaagtttaccccttatgtggggcccatcatcccttgtatcctcaaggtaggtaccagtgaccgtgcccaggagggagggagagggaggatgctgctgtcctcccgagctagcttggggccagctgccaggcatccccgcagaggcagcccgggttgaccgccctctctctgcgtgtctaggctctggctgatgagaacgagttcgttcgtgacaccgccctgcgtgccggccagcgggtcatctcgatgtacgctgagacag

SEQ ID NO: 30449 - DNA, 1168 bp, Mus musculus
acacctgcagtaaggcccatggcccattgagagcgcaggtgcttctgtgaagtgtgtttgaagatgcacagttagtgagcacggaccagctggggcggtgggaaggcaaaagcagctgttccagctgggtctgccttaggtgcacggccccgtgaggagcaggacgtggcctagggaaagccagggccaggccaccatagctggagggatccattggggaggagccgcgctgtgtgagatgagctggcagatgagctggcgtgctgggtgaagagaggcagggtcagtggtgcagaagacgtgcctgggctggactgataattcaccttggcctgtccccttcagaccacttccggttcctggccttggtaagcatactgtgtatttacctttaaagaagaattggtataaaggctcagagacaaaattaatcgttctccttaagtcatttgttacaaatgagttcttttgagggagagcagtgggtaagtgtcagtgagcggggcgggggctggctcgctctctgagctgaagagcttcatgttcatgcgtgaggctgacctagtctttcttgtttatgtaagtatttatgacttattttggggacgaggattgtgtgggctaacctctaacttgtggtcctcctccctcagcatggccccagtgctgggccaccgtgcctggtctctaccacactgccttaaagatagggctgtggttttgtttttaaatcatgtataagtgataatgtctgtgtgtgagaagtcaggggaacgtgttgggtcccctggagctgggcaccaaacaagtgaagtgagtcagggctctcagcactgagccacctttcagcctattttgttttgttcactttggtttggtttagacaggacctgtcgcaggctggccttgaactcatggcagtcagccctcctgctctagcccccacacactgtgcgcagtggcaatggtagctttcttttcactatgatttcagtgtcacctgagaaggtggcagctcaggtgaggcctgggtgtgcagagaccaggcgagctgccgcctccctccctccctctctgctgacagatcgcagcgaggacgctgggcgacctcgtccgcaagctcggggagaagatccttcctgagatcatccccatcctggaagaagga

SEQ ID NO: 30450 - DNA, 1192 bp, Mus musculus
gccaactgtcaggctgtgatcctctcagtggaggatgacactgggcaccggatcatcatcgaggatctgttggaagccacgcgcagccctgaagtgggcatgaggcaggcggcggccatcatcctgaacatgtactgctcccgctccaaggccgactacagcagccaccttcgcagcctggtctcgggcttgatccgcctcttcaatgactccagccctgtggttctggaggagagctgggacgctctcaatgccatcaccaaggtgagggctgctgaccagagctgccccacggttgcctggtctgttctcctaggtccaggcatccggtggtgggatgacaggtttgggccaccgtggggggcctaagattgcaggtatttgtaaacatgactcagagggaagctactgctgccattactcggcctcagtactggtgacttgtggccggcctttcttgccctttttgcccatgtcagggaggaagggctgggcctcactggtgctttccccaaccctcacagaagctggacgctggtaaccagctggccctgatcgaagaactccacaaggaaatccgcttcataggcaacgaatgcaaaggggagcacgtgccaggcttctgtcttccaaagagggtgagtggagcctggggcccaggatgcgggccctcagctccaggcgtgcagctgctgccagtgcatctggcctgctcatgtgccggaactggggtaccttcacagtgtgctgctctgtggcgcccccctgtggaccgggctcactgtgcccttggtttaaactctgatgcagtctcagccagagccagtgagtgctacagaggtggcagctgtgcaagtctcctgtcatcagcttgttgggccctttgccctccagtcaggtcacaccctcttggcagtgactctggcccagcctcgtcatgaactccgtggagttggagaggggatggctgctgggaagtgtgctggcctggggtatttgagatgagactctccactctgcttctcctgacagggagtaacctccatccttccagtgctgcgggaaggggtcctcactggcagtcctgagcagaaggaagaagcagccaagggcttgggcttggtgatccgcctgacctcagctgatgccctgaggccctctgtggtcagcatcactggccctctgattcgca

SEQ ID NO: 30451 - DNA, 2274 bp, Mus musculus
gagtgccaagaaggtgttggacgagcccgcccttccccacggtgccctcttccctgccgaggcgcatggacctggtgaggacgctgccagctgagtggactgattaaccagtttgtacatagtgtatattgcattaaccagctgcacaccctcagcctgctctggcttttggctccttcctgccaacctgctgcaacagaccctccccagccctccgtcccagctcgacggcagcttccggaggagccaacctcgtgtcctagccgagtctttggccattcatccctggcccatggagtgcactccacatggctcctaccctacagctgctctgggagctgggaacctggctccacacaggccctgccctctgctggccgctaggccttcagttccttccacagaggaactcagtcctgcccttttggacaacaggtttctcattctgccttctagatgcctctgctacagacccaggagagccatggcttctcacttacccaacatgtttcagttcccgcagaaaggtagtgggacatctgtaaagagacggagctcgcaaggaggagcattttaacaaatacagccaatgaagccaaatcaaatgaactaagttcctcacgattatttccttgagatctgattggctcaatagcaaaagatatgactgtcccacatcgggctcagtatttttagaaaaggtgtatggcttctgttgagtgcagggctaggcgctctcccttccatgggaaaggctggctttgcaccctcatacctgtgtgctcgagggcctcccactggagaaagaaagtctgtaatgtagcaccaggcgcctgtgccagagccaggggttgctgggctctgggaaggcacctcaagctgggaccgactggtggtttttgcattactgacagatgtgtttttagtatgaaggtggtaggaagattttctagccactgggaagaagcggcagtggggtgggggcagccagtattcacctagccacccactagggtgatctgcatttggttactcctcccttccccacacttggtcccccttcccctgaaggatcacgtaactcagaagaactgatttggacacataatgtgttttagattttctttcctaggcgatttccaggcacagtcctgactggacaatcatcacagaatactgcagattttccatgttaacactgtggatgggttttcaatcaataaaactggggctttcttctcacctgtctctccacttgtccaaattgtcaaaagctgtggttctgtgtttctgagcatcaggctgggtttggggaagacacttcagggtcaagcattaggcgactccacatggttccggtgagctgggagttgaggcagagactgtctgcaggcctgccttggctgacccagggcctgttgttctgggcaagtgacatgcttctgaacacatgggaagccaggatgggagtgtttgccaattcaagcaataaaagggtgatctcggagcatcagcccaagttggatgccttcatggcttctggcaccagcctgttaaggcctgggtggtgggtgattttggtgacaacagtgtgcctgtcccgcagtgttacatgcatgagtggggtggggtgggggtaagggtggggataagggtgggagaatcagggctacactggtaccctggtgggcccgatgtgaaactcctgtcaaacaaccaacttttaaatggtttgctaggactatttctgtattgaaagtttctaattatgctttttaaaaaaaaaatactaaaaataaaggttcaagctgccaaatttcctcctagggtctgtctgctctccctcccctgtgctctgggtacccgactcttgctcttggtccagcgcttgtcctcaggtgctgcgcagcttgcccatggagggccctgggacactgtcaggggccaagtctgttctctgtgaaccagtggttcagggtggcgcttcccgtgggcccagagcacgtgtgggaagacgccaggggctgttcgtttcacctgcacacaccagaaggatgcagcttgtgcctgcagtgagctcttcaggctgggctgaagtgtctgccaggctggaggatgtgggccgacactgtcacttttacaagtcgcccttctggggctggtcctggctacaccaacagccagtggtggctttgacacatcctaaggcacattcacagcaaacagccctccacatacccaggaactgaggcacaaggtctgtagaaattcatt

SEQ ID NO: 30452 - DNA, 1140 bp, Mus musculus
caaacatcatgaccaagaagcaagttagggaggaaagggcttatttagcttacacttccacactgctgttcatcaccaaggaagtcaggactggaactcaagcaggtcaggaagcaggagctgatgcagaggccatggagggatgttctttactggcttgcttcccctggcttgctcagcctgctctcttatagaaccaagactaccagcccagagatggcatcacccacaaggggcctttcccccttgatcactaattgagaaaatgccttacagttggacctcatggaggcatttcctcaactgaagctcctttctctgtgataactccagctgtgtcaagttgacacaaaactagccagtacaccccaccaacaaggactttcccagtttttaatgtcaagacgccactgatgggagaccctggactggagcatcctgctgcagcaacagtgggtgccatatttgtgtcagcagcaggagagggctggagctgccaaggttggagctgggggacagccatcttacttcttggatatctgtgggcgtgaaagttttggtttttcataaacatttatgagtaaaaagcctcagccaggttcagtggcacatgcctttaatcccagcacccaggaaggtgatgaggcagccattgagttcaaggccagccaaggctacataccatgtatgcaagaaaaaaatatgataaaactttcaggtgttggaactcggggaccgagatgaagaggaccacaaagaatgcagcctctccatgctcatggatgcatgtggttcaggggagaagcattgaaaatcaagattgctggggtttgggagcagatcggggggtggggtttgggatggggtacgggaacagggacacaccttcttgccttctgctgaaaggtgtcccaatggatatcacctgacagaaaccctccaaatgcagaccagcagagaagtgcagtcatgactctcttgcaaactggaaatgttcctcttttgagtatttctggcctaatgtagttgctcacggattgctgaacacctagccaagggagagtgaggaagagtcgatctatggtggaaaaatctggttcagttgctgaccagaggtggagggagcgcatctctaagtgt

SEQ ID NO: 30453 - DNA, 1165 bp, Mus musculus
tggtgactgtctttttgaagaactgtatgctcctgggcgaagaagcaatggtatttccatcacagctcttggcgaattagcggtaaccaccccccaggccaccaggtggcctagggcccaccccacatccccaacccctcttgacgagtgactgcccccacgcaaccccaccctacccccccaggtcccttttaacccgtgcgtgtgtttatttcagatggagcaggaaatgacccggttacatcgcagagtgtcagaggtggaggctgtgcttagtcagaaggaggtggagctgaaggcctctgagactcagagatccctcctggagcaggaccttgctacctacatcacagaatgcagtgtgagcctcccccaaagcccccttctctcggaggcggcactttcccgtcgtgtgtgtctcatcctgttccatgacagctccatgaggcacgtcacggcccgatggcagagtagagagacaccgagtggaaaggcagagttagcgtgaactaggtgcgaggcggagtcgggctggaaccggcactcagcagacagccagcaccgactgccgagctccgccaatcccagagacaaggatcactgaagccttccgcagagggtctctagtctaggctgtgtcagctttgaggactaaactccccaattcgtgtcagaaaacataatttggatccatccggaataaaatttttttattcccttagaagcagtgtagcccaggagactcggcctctgagatccaagctctgtcattatttccattgcaactccattcttttttttttttttttttttcctttccttcacaagagtagactgtctccttcattgtcttgtggacgttttcattcaggtgttctcgactgtgcccaatgaaacagtcataagaggtggaatcacacatttataaagttttttttcctcacgagggagaggaaatctatagaatgtggctgattaaggataactgctatgtttgccttccagacttggctgcctttcagtggtgggtgaagtttacagctgtgtatttcagctgtctctctcagtgccacggaagcccggggggcggggaggaaactgatggatcataggtgtctaggaggcgggtcaggaggccggtacccaactggactctgaaatgaca

SEQ ID NO: 30454 - DNA, 1149 bp, Mus musculus
ggccgtggcagtggtggtgtcctatgggctgtgtcaaggtctgtctcagtttaagtagatgtcgataccagtcggtcccctctccttgacctgcgttctcctccatgcctaattcttcctgctattaactggatctcacttgagcttggcctatccatttagttcttggttgactggctcttgccatattttctagatagacctcaaggtagagagaaaggagacatctccctgcccctgtgtgggctttaactaatgagttggcaagggagcctgggtttggcatcaggtcagatagctgcgcgttggttcccgttatcatgaaatgtgacccgtcacactacagccttccaaaccaccagttcaagacacatgtccttgccgacagtgagcttttctgatgcgttccccccccacccccattacgcccccaccccacaggtcatcaccgacctggaggagcagctgaaccagctcaccgaggacaacgccgagctcaacaaccaaaacttctacctgtccaaacaactcgatgaggcttccggggccaatgacgagattgtgcagctgcggagtgaggtggaccatctccgccgtgagatcacggagcgggagatgcagctcaccagccagaagcaagtaagagggcaggccgggccctggggttcctggaggacccttaggatttagaagggtctcggagggagggggttctgtctggggggagttccaggaccgggctggctcctacaaaggggctcctggtcagttccagttcatagccaagggttcaatttttaaaaacggcttataaaagtgggcactggggcgggtgtggtggtgcacacctttaatcccagcactcaggaggcagaggcaggtggatttctgagttcaaggccagcctggtctacaaagtgagttccaggacagccagggctatacagagaaaccctgtctcgaaaaacaagcagacaaaaaaaaaaaacaaacaaaaaaagagtgggcactgggactagagatgattgagaagttaaagagctcttactgcttttccagagggtgtgagttcagttcccggccaccctcattgggtagctcaccacagtctgtgacctccagttccaagggattcaacagtatctactg

SEQ ID NO: 30455 - DNA, 1370 bp, Mus musculus
agaaggatttcagcaaaccacactcctccgtccctccgtttccctcctgccttccagttccctgctgacttcaaggacgactgtgtgctcacacaaaacccagcacggttctaccccactgaaactgtgacttcccagatgagcctctccctagggctggacctaaggccaggacattggagagaagccgcagctcaaagctcccagccccttgaggctggcgagttccccttaggtgcagtgcggctcaccccggctccgccctctttagagcccagaattcctggcaaccggatagaaccaaccaactagaggctttacagttggcaagctaactataggccttatctttgcctttaatctcccacaaggcctctcctgctttggattctcctcgactcttaggcgtgcctccaccacgaaggcacaccctaggtaggctgaaaggtagacctgtccccaccaccgcagcaggtgaccgtgtctgtgttttcagcccacacgtccgtccacagtccacgtcgcttcccagattacaacctggcctaaatgcagactccttcctgctctgtctctgacctaagtgctttcttgtttgagacgcctgtgaccctccacatcccgtgccctgctgttgtgttttctgtgttgcttggagtctttgggggtcatgttccctatccccccccctgcccccaccgccacccccacccccagggcagatctgactggctgtttgctgaagttttttgtctcttggtccacaagtatttggaatggtcactgataactggtcttcagtcttggcatctcacttaggacctccacgagaaacgggttccttgagccctgacaagtgtatattgcgtgtctcatctgtgaagtgcttcctgctacatagagctagctcaacagactgtacatatttacaagaaactttatattcgtaaaaaaaaaaaaaaggaaattgaattggtttctacttttttattgtaaaaggtgcatttttcaatacttttgttttcaacggtggtagccgcggacagccgtctccgccggagtggggaactcttctgtgtgaccaccgggacgccagcaggaaataatcgtaacccgaaatcgcagtcaaaagcttctattagcatcaataagattctaggtctccaaaaattacaggcttttcttcattacctttttttattaagaacgaggagaacacatgggcacacatgggcaattccagatccacctgagagggatggctctgttgttgaacaataatgaaataaagcagtggtctcaaaaaaaaaaaaaaaaaaaaaaaaaaaaaaacaatacgttcactcccttctcccttggcatcttttctt

SEQ ID NO: 30456 - DNA, 1179 bp, Mus musculus
cccctgactctggtccttttctccctcttaggatggagtgatggtgctcagtgcaacacaccggtacaagaaaaagtatgtcaccaccctcctctacaagccgatatgagggaatgagaggcagccatggaccacagggatggcaggcggtgctgggctctccgtgtgcatgcacatcctcactcactctgggacatctcacccaccctagtcctccttgaaggtctgtccaggcatagccaaaaatagggatggcacggccgcctgcagccccagcatcgcagtgcacgaggctttgtgctctacgcatcatcccctctgctggccagagatgtctacagccagacccgaacctggggagcagggacagaagccacacagaagtcctcatcatcgtttgcctccgtgaggccgctggcctgtccctggtgaggcctggctggggaggaaagcagtgttgggtcttgcctgtccttctgaatcaaagcagtagattgtagatcctatggaaattcagtgtctgatttccggatgcagctttgcaatcgtttcccgacactgtgtgcactaagacctctttaaccagagtggctggctggccactcctacgtaaggcaataagtcaccaggatgagactagagatcatgtgactacactcagcaataatcactctcaagacagacttcaaaccccactgccatttctccattaagccagatgatcctgaggaccgaccactgcagaaagtcggctacaccttatttcagttgcaatgttggccacattaccatggcaacctggtcgaagcacccaccctccttttagttccagcatgtgctcctcagctggggacctgcatctctagtgagcagagagtatcacggtggttgctgttgcttgttccaaaagaagagctcggaaccctacagcagactgctgggtttccagcaggggagcaggaatgaacctatcttatactccatctggtttccatggtgacatcacagctgtgcccattgggacaaggtcctgtcacctgtcagcagaggcaggcacagtatttggttaagcctgagttttgggtaccttttgttactgttttcaaaaccctgacttgctcttatcttgatgtacaagtttcaataaagctttgtaaaaattactggagtaacttttga

SEQ ID NO: 30457 - DNA, 1125 bp, Mus musculus
cctggaattaaaggtgtccactaccatccctggcagggtagagtagtttttatcctagcagcacacgaaaaagacagagtggtagaaggccactcaatgttcacctctggcctatgtgtatgtacacacacacacacacacacacacacacacaggcacgcacacacgcataaacacatgcacaaacacatgctcacacatgcacaaatgcacacacacatgcaggcatgcatgtgcacacacaaacatatgcacacacatctatacacacaaccttatacaagcaaaacataaatgtaatttaaatttaaaaagagtggaagaatcctttcgagcctctgtctccttgtttgcagaacagcaaaaagccagtgcgtgggggccgtgggggccgtggaggctgtggggaccgtgggggctgtggagctggaaccagataatccattccacactgtgtagaagggagcaacctatcagtcagtggtgcgtctgtgagtctgtctgtctgtcctcagggctccgttctctcctctcacttctcattttatcagaaggtatcctgatgtcaacctctgccttccacatgtgcccatgcacagcatgaatgtacacgtgtgcacacatacatgccatttctttatgtgcatcgcagttaaccattcatctgtccctgaatctatactctacctgttcattcatccatccacccattcattcattcattcatccatccacccattcatgcatgcattcattcatccacccactcattcatctgcccattcattcattcattcattcattcatctatccacccatccagttatccatctctctacgcatccacttatccacccacccatctgcctatactactacctatttatccatctctttatccattcatttattcatctgtatgtactcaggaatgtcatatgccaatataaataattacattacgcaggcaaaacacatggcactaggttgtcgaatttacaaaagctcacaaatgatagcttgttctcctaagatctgattgccgcacccaaatgccacaccttgaattcttccttgggaagatgtcaaacatccaggttagatttattatccagggctttcggg

SEQ ID NO: 30458 - DNA, 1195 bp, Mus musculus
cacggcatggagcagtgagatcagctgaagacacttctaacaatatgactgtctggagagggtggtcccaggtggccctcccctcccccaccaggctccctacctccgctcactgtccaatgtggactcttgttttctctcccagactcttgtcaccattccccttccccgaaagccctggataataaatctaacctggatgtttgacatcttcccaaggaagaattcaaggtgtggcatttgggtgcggcaatcagatcttaggagaacaagctatcatttgtgagcttttgtaaattcgacaacctagtgccatgtgttttgcctgcgtaatgtaattatttatattggcatatgacattcctgagtacatacagatgaataaatgaatggataaagagatggataaataggtagtagtataggcagatgggtgggtggataagtggatgcgtagagagatggataactggatgggtggatagatgaatgaatgaatgaatgaatgaatgggcagatgaatgagtgggtggatgaatgaatgcatgcatgaatgggtggatggatgaatgaatgaatgaatgggtggatggatgaatgaacaggtagagtatagattcagggacagatgaatggttaactgcgatgcacataaagaaatggcatgtatgtgtgcacacgtgtacattcatgctgtgcatgggcacatgtggaaggcagaggttgacatcaggataccttctgataaaatgagaagtgagaggagagaacggagccctgaggacagacagacagactcacagacgcaccactgactgataggttgctcccttctacacagtgtggaatggattatctggttccagctccacagcccccacggtccccacagcctccacggcccccacggcccccacgcactggctttttgctgttctgcaaacaaggagacagaggctcgaaaggattcttccactctttttaaatttaaattacatttatgttttgcttgtataaggttgtgtgtatagatgtgtgtgcatatgtttgtgtgtgcacatgcatgcctgcatgtgtgtgtgcatttgtgcatgtgtgagcatgtgtttgtgcatgtgtttatgcgtgtgtgcgtgcctgtgtgtgtgtgtgtgtgtgtgtgtgtgtgtacatacacataggccagaggtgaaca

SEQ ID NO: 30459 - DNA, 1186 bp, Mus musculus
gaaagccaaaagccctgtggtcctgaaagacaccacggaacaccaaggcctcctattggttagcctgcagccaggcttcagaagggcggctgcttagacactgtgcagaagggtggagaggggctccctcctccagttggattttaaacattgcctaatttgattactcaagggaaaagcaagcagaatcgactcaaatgagcttctctcttaattattcagaactctctattgtgtaatcaaatataaagtcttacaaaaggcttggcggcacatcccacttctcaccccaggccggcccccattctggagtctgtgtcttatgtcatggttgtgaacttctagacatccaaccggtcctgcctcaggggcaaaagagtccctctccttattggtgacagccagcgctactcacaagaagccagctttaagttaagttcatccaaccattcttgtcccctgtgtccgaatactttgatccacagccatcatgcgggcagactctgacaagcctgggcactgtgggtgccatcccccaacccctgccatcaaagtcactctgatcacctcatctcctcaaatccctgctctgttcaggctgagagccagccaagtacatcacaggtctcacgcacccgaaactatcctgcagagaaaatgaggtttaaaaaaaatggatgtacggataatgaaatttatgaacaaataggaatatagatgggtgggggtatgaagggtaagtgtgggagagcggaagaatggatggggtgtggttgggtggagtggatggataatggatggataggtggatggatggatggatggatggatggatggatggatggatgggtgggtgggtgggtgggtggaaagataggtagacaaacagtaaatggatggatggatagataagatagataatgaaagaatagagggatggaaattttgataagccaattgattgattgtactggtagtcagatcgcacagtgagattccccacttgtgaaccaatgaagacccagggtcccataaccattaaattcaaaatctaaaggctctaaaaattcagctttttcataactcatttggctacaaaataagacccgaaaccaaaatgaaccaaactgaaacttgatgtggaataccaattttagagtcttttttcctttcactgagtgtaaat

SEQ ID NO: 30460 - DNA, 1220 bp, Mus musculus
agctttagctatatgaaaaacaatcagtggtaagaccttctgttttgctctcccaggctccctgcagaagtggatccagccactgtatttgcctcgctttctccagagggcctgctcatcatcgaggctccccaggtccctccgtactcaccctttggagagagcagcttcaacaacgagcttcctcaagacaaccaggaagtcacctgttcctaagacgtcagccttggtccttcttcgctcccatccccagccccagggactctctgatttgagggtacactactttagcagcactcagatttaaggcaactcagatgttgggggatgggagggagaaccgaacgaccgtccctggatgatgtagtaatagatttctccacagggtgacgcaatgggtcagccttgcttggttgcgttaggtcaaaggattgggaggtttttcttcatcttatctgggtgaagacgtctcgcagtctacagttgcaaaacaagcaaatggggactgaagatttcatgttaaatttttaccttgcagttaatgcaagagttgcttttctctggggaccttcccatcacccagatccctgctctggaccctccttctacgtggcttggttgatgggactcattggctcacctcagtgtgtttctaaactctttgtctagaagaggttatgggcaggtcttatatccccatatgggatttatccttcaccacacaacacagtgccttttttttgcagcatgaccccatggctctcaaaccatcaccaccaagaactctgggagcccctcagttaattctctggctaaggtccccctttattgtgtcccctgtgtccaagtcacatttttacagagagctgtcttggagcagctccgcaaggaaccaagcaaaggccagacagcctgcacgcaggctagtggcattgtgtgtgtgtttgaggggtggggaggatgtgtgtgtctttgttgtgtgaattgtgctgttgtttagagggaaaataacggtgaataataatgatgataataaaggagctgatgttcttagcatgttgtgcttcatttagcgagaaactaaatgttctaccactaaggtatacaccatcaagatgctacgacttcaagtaatgaaacctgcgtgagtagtgggctaggcggtataaatgctttcagccaactccaccagacatttaaatgtgcctgcagagttgttt

SEQ ID NO: 30461 - DNA, 1836 bp, Mus musculus
ctgcaaaccttgccttaggccatttaatttctcaagccatggaaagctagggaggagaggtactgtgagtggagcacctgaagtgccccccacaggactgttgtgggtgaagtagctcatagaacacccccactggggctgaaggttaagtgagggaatttccttggggcaagggaaatatttttaaattgctttgaaaaactcttgctccagattgcatatattttgggggttgaaaaataccatcaccaagtccagagtcctgatggctgaggcagaagtggagctggcgctattagaggtgtgggtgctccacagcggccctccacacgacacggccacacccacgccgtgcggagtccgtatcactcaccctctctggtcttgtccccatagatctgggtgaggaagaccagcgacagcaccaagatgcggatctacgtgggccagctgcagcgtgggctcttcgtgatccgccggcggtcagcggcttgactttctacgagcttcctcctcccttgaccccttctctggagtggtttttatttttgttttgttttcttcttaatagaaaattcttaacttaccgggactagctccttggcctgggacatggggagcactgtggagtcttcagggcgctcacatggccgccacctccatctctgtgccgctctctcctgcctcggcctcttccagaactcagtcaccagagagactcttgctttcggagtagaggggttcacccaccttccttgaattcctctcttgtctcgttttgtttatacttgatccttttttcagacctcctttgagtttgaagggaagctcgttttaacaattatctttaggcctttgaagagcagcaggtatgctttcccgcctaatctgctgggcagattgtgtgcctgcctgccgagttgggcccggaagcatggggcagggttctcctggctccactttcttggagaaataaatgatatagaacatctatctgccttgggcttctactccaatgactgcgtgagtgtcttcaccctggacactgcagccaacggatggggctgggggtgggggagaggggtggcatgtccctaacatgctaagtcactgctctgagcagtttccagcgaacacgattcatttaggtatgcccgtccttgttcagggtggaagaagtgggaattccagaggtctccgtctgtaactcctctggctcccagtggctacaaggatctcatcacgtgccctactgtgatgtgggttctcccttccccatagctgcggtggcaaggtgggtgcctcgctcttgcagctggacccactgcagtactggaccgctcaatatcgaagaacctccagcctcccccgaggtttgtcccacgttagtgacaaggagagctctgtcatgctgcagctgccaagtctgcgtgctgcttgagccccagcgaagccacctgccatggccctcttgctccctgggcctcttattggagaaatgactggtgtggctgagcaggagattccttctgctctagccgccacaggccacgagagaagaagcggatccgagcgactgtcaccatctcggggcaatcagtaggctgtccacaccttgttttgctgtgggtgtggggagccacaggaagtcgtgtgcctccacggaagactgtacagaatcactttgtttatggccgctctcccattggattcttaagaaaacaggataaacaatgtttattcactaagttgccacgtggtctgtttcttctctgccttctactgtcctccaccccacagtcaccacaggtactgcgggatccccacactgtaagc

SEQ ID NO: 30462 - DNA, 1178 bp, Mus musculus
tcccactacagcggtggttctcagccatcctcaggctgcaaccctatcacacagttccttgtggcggccccaaccataatattattctagtacatcataactgtaattttgctcctgttaggaatcgtcatgtaaatatctgatatacaggatatctgatgcgcctcccctgtggggtttgtgacccatggtggagaaccactgctctgtcccactgctctgtcgtaaggacccagtaaagtggagggacacctttctgactagagcagactcaaaccatgccaggttgacccacataggaaagatggtgtaagagcatttatagcactgtggggttttccaagaaaacttattttgggggtgaagaggaggcagggctcactctccaggggagtggccatatcatacagcaaaaagcaacccatccaagaactgttctaaaagaaagaaaaggagaaggaagcaatcggtggctccatcagggagactgggaagggcaagaagctagggaaggaggctgggaaatcccagaagggtcaaaagaagagacaggcgggaggatccctgggcagcgagcttgctggacattgaattgaaatcgaaccaaggagaagtgtcgaaccaaggagtagtagtccctgtgaaactcagaaacgccacgtcctttttaaaggaaaaaaaaaatgattgtaacttgtggacagctcttttggggatcgggacgaagcgaaactcggggcttaaaaactttgtgtgtgcatgtgtctgtccgactctctccctttttgaatgatcctttaaaaaaaaaaaaacgcttagcttctcagctggagggagtcccagcaccctggggtcattcacaaagtttgaagatgtgtgtgtgtgtgtgtgtgtgtgtgtgagagagagagagagagagagagaaagagagagagagagggggggttggtatataggaatgacaattgacaatacatgaacaacctacctcatgagtgtgtaaaggagctgagaaaatgagatggttttgaggatggcagtgccccctgccccaggtcagcaacatctggaggcttggaagccacagtgtcccggggcgccctctgctttgccgtgcgtgggaagcctctggtccacgcacacacggtgacctggagctctgcccccccccgcccccc

SEQ ID NO: 30463 - DNA, 1489 bp, Mus musculus
tccaagaagtggggttacaggtgtgcaccactacactgatttatgctgtgctgtgagggaaaaccaggctgaagatttgtgaatgttaggcaagagcggtcccaagcggagcgcacccctattcccacccccacctgcacccccaccctgactgactggctggctggtacttgcctcccctgcaggtctccaccgctatgtctggctggtgtacgagcaggaacagccgctgagctgcgacgagcccattctcagcaacaagtctggagacaatcgcggcaagttcaaggtggagaccttccgcaagaagtataacctgggagccccggtggcgggcacgtgctaccaagccgagtgggatgactatgtgcccaagctgtacgagcagctgtcagggaagtaggggtgctgcacaggggcccccacagccttgttaagttgtgtaaagcatgctcttccccccgcccccttgctaccctctcattgggagttcttagctgtgctaggatagaggtttagggtgtcttccctcttgctgccagccgtcacgattctggatagtcccatcccaggttctgtttgattgagtttaggttccgtctggggaggggtctaatgttctgatggagtcattctgttgttgatataaaaaaagcaactctgaaaaaggaagcactccgccaggatcaggtctagaggagagctggagctggtggtgtctgtgagtggttgaacaaggaaactgtccagaaccgggcacagtggggtctttaagggccctgtcccccaactgagacaactcaagactcccatcttagctgagccctgactgtccagatcaggtggctgcgtaggtatcaagtgtctaaagaacagtgctgctgtggagagagaccctcttaagccccttgcttctcagtggggtaggcaaaagtcacctgagctgccgagtgtgttgatcctccttgtcaagtacaaataaaaaggcattgcattcagacctgcgggtatttccttcctgtgtctggctttgggcagggtgaaagccctctgaggtaagctggctgtgatctgctggccacagggaggtgctgtcgtttcttcctccagaggtctgtagtgcaggagagcagtgctcacaaaggagtcaggtggggtggtgcaggcctttgggccagcacttgggaggcagaggcaggtggatttgtgagtttttggccagcctggtctacatagggcgatcctgtctcaaaacaacaacagccgggcgtggtggcgcacgcctttaatctcagcacttgggaggcagtggcaggtggatttctaagttcgaggccagcctggtctacaaagtgagttccaggacagccaggactattcagagaaaccctgtcttgaaaaaccaaaaaccaaaaaaaccccaaacaaacaacaacaacaaaagccaggctcccaggctttaggaaggcctggaaatggtggattgggc

SEQ ID NO: 30464 - DNA, 1439 bp, Mus musculus
ggtcctgtcctcactgaagcacttatgcaggaaagccctccgaagtttcctgacaacgtatcaagtcctagcactgccaatccccaagaagatgaaagagttcctcacatacaggactttctagcagtgccggctcccccacctcctgcagcagcagcagtacaagggactggctaggatggagtcaggcagctcacactggaccagtgtggaccttccttcctcccatggcatgtgcaagtaggtctgcgtgaccccacttctgtggtgccggccttacctcgtcttcatccgtggtgagcagccttcgtcagtctagttgtgttgaagccaagtgcagttgtggatgttgctggggtaataaaggcaagcgggctccagagcctctctggtggcggccaagccacactcccttaactgggaagtacctgccacgtagggcatttctgctgcctatttccagccagcggctgcatggtttgaagttcctccgttgtggtcagaggaactctggtgtttggttccctgctcagctgcgcgtggactgggctgagctcctcaccatacactagtgccggcttttgtttcctgtaaacagtggttgcatgtgtaggaagtaacaagcgagtattcagatcatacgaggaggcgttcctcggtgcatgacggtcagatggccatttatcagcatatttatttgtattttctcagcagatagtaaggtacaactgtgttttctcaattgtctcgaagaaccagagttcttaagtggcccagttgtggagccaagtctaagtcgtgtggagtcagtgctgacatcactggcttgtgctgtctgtcacatgtgtttgtctctgctgcttgacctcatgggatgtaccctccagttcaactgcccaaaacagacagccccttccaagcaccgttctttgacagcggtagcagctacctattcaagacgcctcacacaaaatctgccttagaaagttaatatattttaaattattttaaaagaaactcaacatcttattctttggcctttcttaattgatgctttatggaggcagtgttaacattgtacagtgtatgcatagaggagtctcctctatttgaagaacaatgcaaaatgaggctttcattgaagggagaaaagagaaaaaaagaaaaaaaaaacctgtctctgttctttttttctctctctcattaagaagcaaaacaaaacgtttaaaccaaacataaaaggagtgcagtagctgggcagtgatggcgcacgcctttaatcccagcacttgggaggcagaggcaggcggatttctgggtttgaggccagcctggtctacagagtgagttccaggacaaccagggctacagagaaaccctgtctcaggggaaaaattttttttaaaatggaaagcaggacactggtggcaactcttcca

SEQ ID NO: 30465 - DNA, 1522 bp, Mus musculus
tagagggccgagtgcaactcagaacctgctggtgctgggtttctaatccggcctcggcagcttcaaccaagagaatgttggggagaagaacgttggaggacacagacggcagtgctaaccagggtgggtctgtccgctccagtgcctccatggcaggccatagcagctcccacattctcacccttataggcagggcctgggtgctttatactcaacttgggtttgttattcccaggtacagactttctgttggcaccagtgagaagatacagctgagctccctcatcgccgcttttcaagtcaccagagacctgatagttgcagaggcctagaagctctgaggcctggcccctgggtgactggaggacagaggacatgctgccctgggccactggataaacccagtcacagaagtctctctgcaggcatttaggtactgctctctgtggctgtttggagcagggatggacagggcaactttaatccataatgatcgacactgcttgtctttataggggaaactaccctgtcccgtggtgagggctgcttcaaagtctttactatcagtcactgggatgacaaattggctgcagctgagttgcgtcctgtcttccaactctaaatgggtgctagtaggtttctaatcaaatattttattacaaaatttcaaaatcagtcttttgcccaaagtgctgacatgcctataacctcaggacccaggaggctgaggcagaattgccaggcagctgcaggtcagcctagtgagacagactctgtctcaggaacaatgcagtggcctttcccacttttagaaggcttgccagcaggttccaaattctattgtgaaaataggaaagaaactacaacagtttgccttcagactgcacacctcacttgttggggggaatggggcactgcagacgttcctgccgcactgctgggctgtgtttttaccaagtccttcacaggaagaataaagcgtgtgttcagagtttaaccgtgctgggctgtctacctgcatgtctgtgtcacactgtgtcacagggaactccttagagactattccttctaggccttcagactgttgttaccttgggaccagacttcccttgggccggatgaggggcactggagggcacccggtgcaccatgggtaaaatgcatctcagggaggtgctttcagtgtgtgctgtcaaagggagaaactgactttcttgtccatggagagcttgctcccaagtttcaagctgagtgaaggcagcatcccagccatgtggaagagttgccaccagtgtcctgctttccattttaaaaaaaatttttcccctgagacagggtttctctgtagccctggttgtcctggaactcactctgtagaccaggctggcctcaaacccagaaatccgcctgcctctgcctcccaagtgctgggattaaaggcgtgcgccatcactgcccagctactgcactccttttatgtttggtttaaacgttttgttttgcttcttaatgagagagagaa

SEQ ID NO: 30466 - DNA, 1144 bp, Mus musculus
tgctgtagtgttcacagcagagggcagcccttccagtgcacagagttcaagattccttcccactgtgcttggcctgtgccttgtcactgcggcagggcagctgctgacagcccctgggccctcctcctgcagagtaccaatatggcctttgggaaggtgacagaggagactgtctacacctgcaccggacacccactcaagacggacattgccaatatactggactggatgctcaatcaggacttcaccactgcctacaaaagtatccttttgggcaactgctgctaggtttagggctcagggtggccagaagcccaggctgcagccagcacctatacctcccaggtgacaggtgtcatccccaggcagagtgcccttctcctcctcaatggctgtccggagcttccccgttcacagtctaagcggactcactgccttgttgtgcagtgagatgagaagctacaggcggctgtgttaccctctgagctgtctgctctgccaaggcggggctatcccttttagaaaagcatgttgaggatcacatggggcgagttagaatggggcctgctgctactgtcctgggatgaagagcccaactgccaggtcgccactaggggctggtgtggaagcctccctgcagcaggttctggaatgcttcccctccccttagctgctcctccccagacatcatggagctgaagactctgaagggcttggcgctgcatgacatcctgacagaggttcacttgtttgtacacagaggtaactatgtggagccgggaggaggcacagctttgggatagctacagagtgtgacatctttgcctcagagcagaaacgggaagacagtgactgacccttaatcttgagcagttctgaatggctctgtccaaaatctttgtaatatctgtaactgatagggttagtggaaatgagcccgtggaggctgtactgtacatttcattctcattacaagcttcccacaccagggattgaacccagggccttgcgcatgggagacatgtggtctaccactgggctgtctccactgagcttatttctggggtccgtacccaggactgatgcatcctagacattcagcagactccagcctctaagtcacattctaagatgcatcccacaa

SEQ ID NO: 30467 - DNA, 1098 bp, Mus musculus
cagctccctcagctcctggctagaaggctggagatcagttggatatcctctctcctttttgaaaacgcccctaagtagtttatccaaaaaaaaaaaaaaaaaacgaagcaaggtggccatctggggtgagtcgatactgccctctgctggttgtttctagttcaagcccacagccagcaacaagcaacaaagtgtcttagaataggactggttttgtttacctcacctatgaggttggcagtagctcccaacccatttcacaagaggaggtttgaccattacgctctcagctattcctgcagccatggtccccaagaagtttagcctatgggagaagagagggtttccctacatatccccagagaaatcaggtgactttttcccggagatgggggtgggggatgtttaggtcccactatgatgcaagcagccatgacccacattctgttgctgcctcgtttatgcagaaggtctgattccagatcgtacctaagcaagacaatgctccaagactgtaccaagccaagctctgataagcttccatcttccatggctggtagactgaactgtcccagaatcactagcttgaggtagaggaggggagggcagagtcacggattcttaagctaagtgggcaagacctggtaccgggtctgtggtagagagtaaagaccaagggagtagagagatcccagccctgggaggagaaggaagttgggtcaggcctcggtacaaagggaaaacactgaattggccccaaaacacaggagcaagcgtgtggatttccattgcagagcccctgtttcaggatgcaagagttttccagcccaaggcaaaatggaagattgctgacccaaccacaaacccatccctgcggagtctctctctctctctctctctctctctctctctctctctctctctctctctctctctctctctctctctctcacacacacacacacactcacacacacacacacacacacacacatacacacacagcctttcactggaagccatgggcttccaggttaagttcagccaagggacccaatgcagacatccttcgtggacagggttcagccttgggaggcc

SEQ ID NO: 30468 - DNA, 1495 bp, Mus musculus
tctgttttctatttacaagtctgacatcttaatccccactgccaaaatgctccgaaatctaaaacgtgttgagcaccaacaggataccacaagtaaaaactttagttagttcatctacaaaagtattcaaaagaatacatagactggacacgaagctcaaaggtagagttcgcctagcatgcatacgaagcctggatcccatatcccagcagggcaaaccaattgcctcaggctatctgtgtaaggtgtctatgtgaaacctaaatgaatttcatgattagaggtgctcccacctgccaaataatcccgccacaaatatgcaaatattgcaaaatcaaaaataattctgaaattattctgaaacacttcttgtcacaagaatttcagcaaagtacagtcaacctatcagagagacaagggtgatgccccggtgagtgtgtctcagctgtgtttatgaatttgtttggttcacacatatctgagtggtatggataactgggcatctctaacccagggcaatcagtaagaactaataacctgtgtctcctagacgagtcaggatgggaactgacctctaggagattctagtcaggagcccactaacctgggccgtcatgtttagagctgaaggagtcttcatagcccaggctgtcctgggtattgcaggatgctgattgaacagcacctgtgacctttcctgctccatgccactagcaacctcctgccatgtgtggcagtcacaaaggtcatcagaatggagtgagtgctccctgggaaggcaggcaggaccttcaaccattggaccaagaagtcattgcttatgggtctcaggggccatcaaactgtctacctgatgctgtggtttctgcttagagatctggaggagggcagcggagcctgcctcggttcagtgatggtttttcttacctgcttcaagccgagatctgaaagctttgtggaagatgatcaagcaaagctcccaagccaaagggtagcagagggtggctacgtggtttttaggtagatgttcccaggtgccctctcttgagctgggtctgaggttatccctgtccccatgccccctctgtgccccgagctctgtctccccactcttgctgttgtgttgtccttgtgaatgtatggctgacccactccaggccaagcagcttaacagcaggcttgctgttaagtcccaagtccgtcatggggtcaggttacacccagaggtgttttcactgtggggttccagggaggctggggagaatgggcagagcccagggttccatctcaccacctataagttgtcagaaactcggatgcccctccacccacctctggcatctctatgctgctaatctctgccacgtgtcccgtgtgctccagtgcccgtgcccgtcaccgcccctccacgccctccgtgaggttgtccaggctgtgttctctcgcatgcttctcttctatataaccctcatcttctcattttatgggattcaac

SEQ ID NO: 30469 - DNA, 1154 bp, Mus musculus
agtgggtgctacctggtcctcagacaagcagtcccataagtaaaactacccactgggccaatggcacatctgtcctgtgttgctgtagtgagcggagctttagggggccgcctgccagccttgcccacccgcctgcctgccgcatgtgtatcctcacaccacaccgctcgctccaaatgagcgctccctcttccattgcccttcaccagccccaggatgatgggatgaggcagttactagaagggcaggaagcttgaagctcttgcagctgaaaaggttcctgcccagcctgtgcctcaccaggcagaaccagtcagaggcgggtccagacttacatttggaaacttaactcctcagagcttctgcccgcggttgggggattttacacctgctcattcaaaggtgagaaccgcccgccccacgaggactcacacccttgcaccccagtactaagcagcctcggagcatggtgggagtctccattgctgggtttctgcttcgatttcctttttcctgtagagaaacgtcaaagctgagaaagatggcttccctccctgacctgactgtaaataatgtacttagactgtttttaaatgtgtttcttcacgaaggcttcgtttggctgagggagcctatatcactcgtgtaagttggtatttgggcactttatatttttctaaaaatgtgttttggatcctgtactctaataaatcataagtttctttttaaaaatttttccaaaagttttctccattttcaaaaaccctgttataaaaagtagaactttcacaatgttaaaatactaaatatttggttatagcaacttctcttctaatgaatgccaagggtcttttttttttcttttcttttctttttctttttcttttgtacaacaattaataaacgaacttgccgagagaaaccatgccagtgacctgcccgctttcattcagtagcaagagaggaggaagcagggtttctctcctgaacaaggtggaaggaaaaaaaagaaatagccgaccttagctttcctttaacatttgacaattgtcttgctgagtgcagactttctgggccctgggaacggctggaagtgtccgggctgtcggttgaggatgcctttttgtctcccaaaggagaacagcacatccaag

SEQ ID NO: 30470 - DNA, 1200 bp, Mus musculus
gttgataattatagggccaccttacctgtaggagctgttctgtcctgtacatgtgctatgaaggagacagccatccttcctgcagagggaaagggtcattgcacagggatagggtcagtctccaagcctagccggtggtgtctcttcctgacaaacgcagccatagctcacccactctgccttcagagtgtcatggacaaatccacacatagtggccaggagacccagtcagagctcttcagaatccccacagaccaggcacctaacacacctgcacagaggccaccaggtctcaggagacaaagttcctctcccagggaataccagctcaaaaaacaagtgggctggcaaactccacattgggtctgccgagagcaagaaaaaagaggggggtgggggagctccatggggtggatcccaggctggcagcaggaaggtgctggaaggcctgagagggtgtgcagtgccctccccgagccctggtggtctcctcctgtgtgctgggatggagtctagtgggtttgtggcatgatctcagatcttggcattgaggcctctccccatgcacaagtgcccaggggagctcacctccctcttgctgggctggcgccccctgctggcctggtcttgctgtgtcctcactcgagcattcccagtcctaagctgtccactggagacatttctgtcagagaaattggctgtgcggtcagctcctttctgggcttcgcagccatgaaaggccactgaagagcagaggtgactagagtagtttcaagcatacatgcccttctagcccccaatccctgccccctacccccacagagcatctgtcctcgctggctcctgccactgcacctgctcccagggtgggggacaggctggctccctgtgctgcctctgaagccagaagacaccaggacacagccctgggagccaggggtggtcacacatctgcagcttgccttttgccttaagcggccacttctgctctgttattaaaggttctacactgatgagcgtgtgtgctgctcctgtaaggactcgtttgaagtcttcctctgccctgtgtagtctggtttatttcccccggctgggggtgcaggggcacaacatgacatgtgcacacagactaggctgtccatgcaggcgacatgctgctcctgaagctcagacagcagttcccatggcagagtctagggt

SEQ ID NO: 30471 - DNA, 1193 bp, Mus musculus
tttaacttctgaactgtgcttatgggaagtgtactttgcaccctgaagccagtgtggtagcctctatgtagccctgtgatggctccctgtctccactcacccctgaccctggtccacaatcactgtcacagttgggcagttcttgtccccgtggtccatctgcacctgcgtgtgagcaggtagagatctgcacgtcgtcccatggtccactgtcaacttgtcctgtggtggcctcatgtggtgcagttaattacgacatcccaccccatccagtcattcacatccatggagtctcatttccctgtcagcctaatgatcactccttaactgggcattcctcctccctcgggctgctgaagacttcttgcgtgctcccatgtttaaagtggcatcctcccatatgtatgctttactctgatcagtgttcactagcactaacccagggcgtcaccaggacctccattcagtgtgatgcccctgcctccacgcttcccactgttggccatgccgtctcataaagttcgtggtcagggtcggtgtcttcattctggaagatggatggttgtttgtgagcaggagcgtagtattcacgtcctcactgcccctgcactgtgaatgaaggcggcagcctcaccccttccacagccgcccagctctgtctaaaaggtcggtgattctgcacggcaggggtgatagtggtctgtggtagaaggctgcccaggcttctgaaacagaagctctgggcctgtcttgtgctgctgatgcagcctgtggctggtagcctgacttcaccaggcaggcaggcaggcaggcaggcaggcaggcaggctctcagttttccttagcttagcagtcactgaaggtatggtgggtccaacggtagctggaatgtgaggctatagtcatgctgcatctgcagtcaggagagagggatacatgcaagagccagactccttccctggccactcacccagcagcagtgttgaattttggacactgaactaaaaaaaagaaaaagaaaaaggaagaaaagaaaaaagaaacaaagacaagcagaaaacctggacagatctcaagacgccgggacccgggaggtgataaacagagggaagaaagggagttcgggacttaataaaacaccgtctgtagaaaggaagttagctctccttagctctggccgctgctccccaagg

SEQ ID NO: 30472 - DNA, 1099 bp, Mus musculus
tgggggagaaggtgctgttggagtgtggctcagtgtgagccgccatgtcatggtgtctgcagtatgcttccctcagctcctgtaagcttttcagctaagcccagatcagaagccagtgacttgttgcttctgttccttaaaacaggtgtgtgtgctagtgttcagttgagctgtgtggtgaaagctggctagctgactgctgcccatccgtctgtctcttgcttttgcccaggaactctttgctttccccctcttggtcttttgtcacttgattggccgtgtccctctactttcagtggcctgcaactgcccaagccattggctgcaaagcattttctggggacaaagggaagtgcactcctcaatggtggcacagtggaaagtggataatgtcccctgacgtctgggactgacaccctgtgtttcttccccctcagatcctggtgtacagcctggaagcagagcgctgcctctcgaagctgggcaatgcacttggagactttacctgtgtcaacatccgggatagccctcccaacctcatggtcagcggcaacatggacaggaggtaggtcagggctgaagtgccatcaacttggccctgagctgtgagtgcctcgtgcttccgccttgcccgcaggcccagccccatcctctgcacttggagcagcctcacattaggtaatggttggacctgctgcgcatccactcggctgctgaagcaccccaggaccattccctctgcaggcagttggtggctggtccagagagatgacttggaatatcttctgtcccctgctgcaggatttgtttggcactgaaaagctcactttccaacattaaaaacaataacctaagggacgggctgtgttcatcacaatagggctgtctgccaaaagaggccaagactgtatttcagagtgctgtgtgtccccctggtgacaggaaagagacttgatgggaacagattccagtttgtatttcgctgattagtggccttctctttaacacgttggctgagggagtcagtttccccggcacacaggcccgtgccagcctttctcactgcaggattaaagtgtttgaaagacccttccggtcc

SEQ ID NO: 30473 - DNA, 1148 bp, Mus musculus
ggctacctggggaaccggtccctggccagctctgctgggcgtgaccagtagagtgggcgtgaccaggaaagtgcacacctcctcagtctgctgtcaaaaggctcttttctccactttaaatctatgccttatatttttctaaataacccagtttaaaaaaaaaaatgcaaccgagaactcagtgctgaggcctcctgcttttatctgccagaactgaactcagcaaagaaaaataaagagccgagcttgtctggcagggaagtagcagccagcaggccgtgcccctccctcacccaaccagaattacgtagagggtcccagaatgatctggaagccaccctctgcttgtatttcgtccatttcctagcaaagaaatgagtccttgcacgcctcacatttccagagaagatgtgtgccatggtaggacttggtggtgtcagcctctttaaagacacactgtccagatcacagtggggacatgctgaccctggagagacccagtgcaagggtgaggggtgggagaaaaacctcttcttttctgttttgtttttgagcctggcttggcctgttagctaatgatagctccctggaggatttgaactccaaacacaggggggggtttggcatctctggtgattttcatttcaatgaagctgtgttactgagagagccaagcagccctgaccctccttgatgggacttttcagccaagtcctctgtaaatactctcctgtagtaatggaaaccacgtatttatcaaatccgggtcttggcacgcacacagttcattttagtgcgcttctccattgccccgggtttgatggggttgtttttaaaaaatgcctgtgttttgttttgttttgttttgtttttctatgagatctgacttcttgacggacatttgtattaggatattgaagcatgctggctgtgtctttattgtctcactgtctctgccatggtgttacttggactgcatgaggtaatgggacgacagcctttctgttggtggtgttattgaaaaaaaagaagaaaaaaagagaaaaaaaaaaaaaaccaacttccacagtgtgtgaagcgctggcatgatcactccctttatcctgctttccctggctgccaagacgcattgattttgactcgcttct

SEQ ID NO: 30474 - DNA, 1194 bp, Mus musculus
cctgcctcactctcttgagtgctaggaatctgggtgcaaaccaccacacctgggctgagcgtccacttgtcattatagcccgcataagaggctaggggtgtaatgtggtagagcgcgtgcccacatcaaatcaatcaatcaattatccccatctaatatatacagtgcatgtagcttgggcctgccagatctgacttctactcctcctctcttctcaccatactttctccctcccccctcccttcgtagaccagcttccttggggactttgcattctccttctcaagtccttcacatttcctgtcccctctgcctgtggcagccaccccactgttcccatgactgtttccatcccaggtactggcaggtaggcagagagacagacacacagggagactcatctctctccttcctaactgtggccagccacttgcagctcctgtagccatctcttcctgccacaatggaccacatcttccaactgtgagcaaataaacccttcttgccttaaggctgttcttctcaggtctttggtcacagcactgtctaaggtggccactgcatacgagtagctggcaggggtcgtctgcttgacgctctgatggagaaacataaaagagttgtcataagaactctgcaaggccccttgtcaagggaagccacaccacagggcagatgccacccaggccttgaatcatcatcaaagctggacttcagtcctggttcctcatttagttcagggaacctcggctactcacccagtgctcagctttctgctctctgtgctggtcacatgtatcccgttatatgctgaagacagagtcaggtgtctgtcatgctgccacagtggaccagggtgagccagagcatggtgaggttggctctgccagtctgactgctctgagggacccatcattaggttgcctgctgtctccctgagggccagggaggagaaagccactgccaccaccagcagctactgctaagtggggctacttagcaatgcctctaaagctaagtgtcctcttgtgtccccaagccggcccctaaaataacagcctgcagtgtatatctcagaacttttcatgtattcagtcctaacccatactacatctgcatgagggtgtatatgcattttttagttttaatttttttaaagttatacttatttagtgtgtgtatgcacgtacaccg

SEQ ID NO: 30475 - DNA, 1099 bp, Mus musculus
gtgtactgtgtaagaacagtggtctggaacctgtgaacagcatcctgacctcctcacagcagcttaggcgtccatgaacttggataaactcgtctttctggctttggcttctcattgtccatatcaatgagagtgactgctaacacaagtattggtcccacatcctgcctttgaccttcgggacatcccagcactgaggtaaacatgaccagagccctatctcttaactgctcactgtggactttattcttcacaggggagggtaggtaccagccattgggacccaggttgtactcaaagcgacttttctgaagcatccagagatagagcaaagctggacagatgttctcttcatcttctctgattttcttgggtaccgtttgcttgtcatgcctgcacctgtggagattgctgttgtggtccgatcgtaagttctgggacgcacagagctgtgtgagtgcagattcccttcacacagcgctgaggtgctcagtggcctgcagccgagatgcccagagcatgtcagatttcccaagcaggacctctctagacatctctcagcatgtgctgctgtctcttacgaggtagaaaccctgaacacaagcttccagaattaaattgaaccctttagttcctggtctcaaaggatacccacagctgtgatgggaagttctgccacactttgtttaaatgtatactttatattattcattcataaataaaaatggaatcccgctacatgctgttttacagtgccgggtttctggctggttgactttatccggttagagccaactcctcccagagcttatgttcagatggccctgcctggcgaagtgacacccaggagaggttacagccctttgtaatggctctttctcttccactgattttacccaatggggaaagaagtctttttgtttatcacagataggtccaggcattttccaaggccagagctgagctgcatccagcatctctggggactggctgcattgtccccgaaatgctgacaaatcaagggtagtccatatctcttgggcatattgttgattctgcaaaaaatcaggagagcagatataaaagaaaaaaaggcccg

SEQ ID NO: 30476 - DNA, 1168 bp, Mus musculus
gtcgccaccgccgccctcgggcctcccgcgcgggcctcgcgcccctggtgcccgggagccgccgccgccgccgcccggcccggcccgctccgacatgccccgctctggcggccgggctcgcggaggaccatgaccgccgcggcgaactgggtagcgaacggggcgagcctggaggattgtcactccaacctcttctcgctggtgagtggcggggcgggggggagcccgggttggggggcgcgacctccccgccgcgcaactttctcctcccggagccctggcggcgtcggcgagcgcggcgcccggcgtggacgtgcgtggggaagtcggggcgctgcggacgccggggcgcgctcggagcgcccacctccgtggcaatcacaccccctcccctccccttccccccttattttctttttttttcttttttctcctccttccccgaaatgtggaaggcttttctgccttgtgcagccgccggcgcgggtgagctgcaggctcgtcctctctctctctctctctcccgatcggatcggctgctctcccactcgccggcgtctgccttctgattttttctttctctcttcctctgtttctccgtttttttcccttttttttccttttaatatttccacaatgacacctgcgatttcgcccgaaaacagttgatggaaggcgatggtgtcagggaaaaggactctggcagccggagctcgctcgcgccgttgtaaacacggacagccgcccgcctctcggggtttactacgccggagagcgggagagccattgctcggagcccacggaaggtggaggaagctgctgctcctcgctctcctccgctgcctttaaaaactgttttctctgctttaacaaggaacacacacacacacacacacacacacacacgagcaacaagctgggcggtttgataacatcgcttttatctgccttcgcctctcctctctcccgctctcgcctctgataattgacaacttttgctttggaagtgcatcgcctgccttaatctcgaaccatttagggtgtcaattgttcttctggaagcctggcaccgggcgacggcggctcgattcgtcgaaattaaaaatgtatagagctccagcaactctttcctggcggtggcagtgacatttggtggtaaatgccatct

SEQ ID NO: 30477 - DNA, 1383 bp, Mus musculus
ttacttgttttatttatttataaaagtatttaaaagtttttttagtatgtacaagagttttacttgcatgtatgtgtgttaaccaggtctgtcctgtgcccatagacatgaagaagaaggcactggcttctggggtcagagttaagaggggttgtgagccactgtgtgatgctgggaatccaactgtggtcccctccaagagcgctggtgctcttagctgctgactgatcaatctctttgcccttatttggttttaaaataagtgtaatttgtgaactgaacagcaagtaataattgaagataatatttaaaaatatgggtacctaataaatggtcaggagaataaaagtttttcagcagcacataatgattgcgagcttgtttcattttggtatttaatatgatgtttgtcccgacagccttctgatgtgtgctcttcctttgaagagaccttgtggtgtgaagtttaatacaaatgcctattttatcagctttcccttcctataggaatttgcttttagtggtctgtaagtaaaaggaaaaatcaaaactattgcaaattttttgtcgttttccaggctgaactcacaggaatcaaatggcgtaggtacaattttggagggcacggggactgtggacccataatttcagccccagcccaagatgatccaatcctgttaagtttcatccgctgtctgcaagccaacctgctgtgtgtatggcgtcgtgatgtcaagccagattgcaaagagctctggatattctggtggggagatgaacccaacctagtgggagtaatacatcatgaactgcagggtaaggattttgtttttctttaaaaaatatttgcatatgttttttgaacaattgtaaattttggaatttatatttaggagttgcttaaaacagatcccaagcaggcagtggacagtgtgtttgtcagaagaatagcctcactcccccacctccgccccccacatttctctttccttaaactctcttgttcttccttagtcatgctgaaaattagaaccttgtaagatcaccttaagtccattcttttatcatttacagacagagtcaacatatagccttaaacttgaagcactccttctggctcagcctcttgccaactggggtacaggggttcaccaccctgtccttctggcctctgaaatcattactgttagagtactgtgtacccagtgggcagtgtctgggaggagacaaggctctgaccctgcttttttgttttgtttttgtttttgttttgtgttttggctttttcgagacagggtttctctatatatccctggctgtcctgtaactcactttgtagaccaggctggccttgaactcagaaatccgcctgtctctgcctcc

SEQ ID NO: 30478 - DNA, 1145 bp, Mus musculus
tcagaaggaagagagccagcagcccagttaggagagtggaaacagagagcttcagaactgggctctaaacacatgaagagttttcctttcttagccacaagaagcccagcttaaacctacagggaacacagcagcagcagcagcagcagcagcagcagcaggtgctgaggaaggtgtaagggctggatcactggtgtgtaggtgcagggcctataaaacgctgcgctcaccccattacgagctgttgagttcctaagagtaaatgtttatctgcagtgcagtccagcagctgtaatgtggtcttttatcccagaatgatgaaagcctccacctcagtgtgcagtagcagaataagggcagccaccagtgaattgtgatggtcttcagcaggccaaagcaaaaccaagtgtgtgtccttccagtgggaggcagggttttaaaacaggaatacactctccatatgcacacacagtaggttatataaattatcttcaggagtttgggaggaataaaaagtgagtcccaaaagcttcatgctgtgggatccatttatgggacattcttgaaatgacaaaatgcagacacagggaagagaccattgtcagcgttaggaggacacaggaaggaagttggtatggtgtggtactgagcgcatgcacgctacaccagagccgctgctcctgctatggcattggccccattctgcaagtagcagagaggacctggatctgtcacttttgtgcatgtgcgcgtgaaccagtgattttctagataattaataaacgtgaatgaccaccttttactaggttgaggatcatttttctatttcacttcttggcatcaagaggttttgtttttgttttttgtttgtttttgtttttttctgtataaacttgaaactcagatctgtatctgttccttgacttgttgaaatttgagaatcttggaacactgtagcttttaactctagtttagcaactcctctcccctcttacctttctcaagattttgctgtgtagaccaggatggccctgaatttatttcttcctatcccagcctcctgaatgctggggttccggggtctgtggcaggcctgcctcttgttgctgtttttatctgctccggagccgctctcacacacaggg

SEQ ID NO: 30479 - DNA, 1099 bp, Mus musculus
tcattgctcatgagggaattgctttctttccagatgttttgaggcttatcttgcatgcttagacataagcaaagcttactgtgggcagcagaagtctgacttactaaggctggaattccctgagggtgtggggtgctgtggtttgagctgtggttggcgggtaattgtggaggtctgcttgggacatggatgcccttactttgtggacagttgaaacgcaccctcaacttagctttccctttatatgtgtgctttctgagagtttggataaaatttacctaattataaaaatgtagtaacagctagttctgagagcattctgttaattctttgaaattttcatccagtgtgtgtgattgtctctactgatggattgcactgctgatggcctgtgagaaggtagctcatcataggttatgtgcagagggtggctctcctcaggctgcaggcatggagatcctcagtttctgtcttcacagaaccactgagaagatgggtgcccgctctgcccacgtgcccttgcctttgaagcagatgggccccttaatgttctggtgtcccacctcttcctcaccgatgcctgtcagtctccttctgggtccatttccttgtctacacttagttctttggtctttgtcctcttcctcttaatccatacattttcatcttgagccattttttctatgactctaactgaactttaaggctatctaatgctttccattcctttcagaatcctccaaagtcagctttccttgttgtcttccctccttgctaattcactacaggcattcattcaccctccctccctccctccctccctccctccctcccctttctaaatcttctaactgcactctcactgtgtggacacagaggccctgtaccgtgggctgtcattcaacttgtgttccttgatttccgtgatgctgtccccaagttcctccaatgtctttgccttattgcttttatttttggcagggtctcatgtagtctcgtctcagacttggtggctgaggatggccttgacctcctggtctcctttttcctaagggctaggtacatgtgtgtgccacactcagcaatagaatgatcttgg

SEQ ID NO: 30480 - DNA, 1099 bp, Mus musculus
aatctatgagataaacattttcattttctgtttcctatttaatgaaaataggatatttgtcattatagagaatgatcccaggaaatcatctgggatgcatatatggccaaagcgtctctgtcccagtgtcataatgcccagcagtttgttggggctgtagcctgctatatacactgcagtttgccagcatgcctttcttagtgttagtggctatgaggaaacgcaggagccaatgctgtcccctgactgaagcattcttagatattgagtgttgaaaaggagctgccgagaacatttccagacctgctgagcagagggaaatgtccaaggaacaactgctatgaagttcaagctgtgtgtggcaaggggtttgagctaagtagcttttgctttgttttgttttttgacagggtcttatatattccagcatggccttggctttgaattcccgaacctccagcctccatgtcccgagtgctggcattgcaggggtgcccagccatgcctaggttggtggtactgggaattgaaggagtaggccagcacttgcccactctgcttcgtccccagccttctcacttgtggtttgtcagaatcagaaagggagaccaatacttgatgactgagaaacaactgttgactgatgagaaagaaaatgcgctttaaaatgctttaaaagcctcaatatagttgattgaaaaaaatcagccttcaaagattatcttcagtctgtggatctaattagctgggtgtaagtgataagcgataaatccgaagtctcgcattgtgatttagaaattgattagctgatagagcacaggcacagggaaggggactgagttctgagagtgcagaggggcagcagtgaggttgccactaacactgttagctgccatttatgtgtgtgcaggcatcagggtacatcattacatgttcattgctctctgccttcacagtgctcaggagccttgcaaacagagaggctagagcgggctaacctggaggtcatactgtatggggaactgggtatagcaactggaaaagttcagctgagatagataaataggtgggtaggtaaattagattttagatttttgag

SEQ ID NO: 30481 - DNA, 1188 bp, Mus musculus
tgtagctcctgtaggcagcaatcacacccttacatgatgtggaggaagcaagccaccctactggccacaggcagtgcagacgtgtagagcctgggaaggagaaggtcagtcctgacgcgatgcgtagggcagccagaggcagcagcaggtgagcgccagagaagtaagatcaggtgtcttggacaaactaaagctagagtgggaagctgagacaggagtggaagaacactgtcagtcaggggctgaccacctaaacggcgctggtcacctgcctccctccctcatggccacggtcaccttgggctattcctgacaaggctcacatggctgtagccatgattgctgtagccagtgcactgattattttattcctggaaatgatgaatgcttccttctggctttttcaactctgctgtagatttacttttgcagttatgttgttcgtaaggtggcttcctgttgctctgtcagaaggattcatagtatctatttttctgaaggccatgcataaaagtttacaaaagattgaaattccagtcagcaagacaaaggagttcccatacaaacgctcatcattagatctgtgactgtacattttgacctttgccgatagaatttcttcatgtcctctcccccctctccctccccctccccttttctctcctcagaaagatttctctgtgtctcttgccatgtagcttaggcagtcctgggactcagggatgaaagggtgtgccaccatacctgggtttagaatactttttcatcaaagaagcaatgggaagatagtacattaagaaatatttgtgtctacagcatttaatagatctgacacttctatgtttaaggcatcattgatctgagccaattgtctttgaaaatagacttcttcatgaagacattaaacacactccttttagtagccaactcccttcactgactttggttgttgtaaacctggttaagaagtttaggcagacttccttgggattctccataggtctagttttcttatagcagttaggtgatccccgtcaggagtgagacagtgctgagttcccacgaggggagacttctgtgtactcattctgaccctcagaattgagatctaataggtctcattgggaagaagaagcagcacatcacataatctcgggtggggcagcctgaggccatgtgactaggaag

SEQ ID NO: 30482 - DNA, 1197 bp, Mus musculus
gttggagtcaccatatggtagctgggaattgaactcaggacctctggaagagcagtctttgctcttaacccctgagccatctctccagaccagtggttttacatgttattgttactgataagttacactctgaagactatggtagctaggactatttggttatttctctgtgcttcagactcaatattatatttatctggcatagaacagaagatgcttagtttggacataatcctgcctcgtaagttgccaagtacaacaagccctttttttttttttttttttttttgtattaaaaagtgctctcagtgttttacactcagtgttttacactcagtgttttacaatgtggcttttctgcttggaacagaaaagcaaagcctttgctgcgtctggagtcgacaaagatccgcgttttcaccctcacctgactgactcatccgttggattagttagtaactcagcctgtaccttctgcccatgagctaaatgaacatgtggccattcctgggcatcacagggcgttccagccacatggacaccacgtggacaccagaacccaagagtgctcaagccactggccagacctgtaaccagcctgctgttctgtgtacttgattatctctgtgtgactgcgggtccctaacaccatgctgggctggctatactgcatgctcagcacagacacacccccaccccagtactttcagtttgcaggcgattgactgatggcgtgcaggtatgctcatgccttttctggcctcagccgtgtagtcatcctaacataggcatttgaaaggcacttgtcgttgtatagacaaatatgtttcccttgtctacagttagactttacctttcttttttttgagtctagagcatgttatcaagatttttaaaaaattggctgtcagccaaattttaaagctttcttttcaggaacaaaagaatttgagtttttctgtatttcttgatagcaatggctgagtgtgtggaacatgctgctaaaacattttacttcatgtggagaagtgttatttttgtaacctcagtcagcttagactaacacaacatccaggaactgcagctatgtagcagaaggatagagcatcttcttggcactggaagggactttaaatgctggatcaggccaagcatctacttgtcttggactcagttttaaaaattctgttgtggggc

SEQ ID NO: 30483 - DNA, 1208 bp, Mus musculus
gttggtccatggcatagattacttcaaaggaaatataaatgttcagcgtttataaaattataagtccaggaaacaatttaatactctagcaagagttaatttttttagcactatctggattctttaaaaaagtctcatctagatagacttccagtcaaacaacctttgtatacttttcagatacttttgggaattgcctagatattactttatggtatctttgttactttttaatagaagttgctcagaattaatctttgagacttgggaagttgtcctaagagtatcagaagtgacttgccctttgaaggctggagaggccggtgggcctgcatggccccctgagccccctgaaccctgttttctctgctggcattcctgccttcccctgaggacagcatttactaccccctttctgttccctgtgaggctgaggtgaaacctttgaattagctcattaaccttgcatagaaaaatgtgtcaacgtttctttttatttggatgtcctttttactggttcttttttttttcttttttcttgtttcttttcagttgtggaagaaggactctgggaaaatggcctttcctatgaatgtaggacgctgctcttcaaagcaatccacaatctgttagaaaggtaagaaaggggcgcccagagtccccgtgggctttagacacggggtcatctgcaatgtgagagctatgcttttatatttccttttgttttatatttccagagaagcttaggcagcccagagacccctgcatcccctcctggagaagcttaggcagcacagagaaccctgcatcccctcccagtctgaacatgcttcttattcagtctttagtttcaatgtccattttttactctttgaaaatgaaggagccattcctaaggtcaagacgaccctctccagtaagcacaggaccacagaagtgacaaaacaatctcctgtaacccttgctgacattgagatgctgtgggtttgacagttatgtttctcgcaccgagttgaggagctaatccatgacagtgcatgataattcatcgtttagttacacagctcttcagatctgggagagtcctttctctgtaacgttcttgcagatgctgcccttgatgatgagtggggccttagcttggctcctcagtttgaggcagtctcttgtgattctattaagcttattctttttaataggaatggcac

SEQ ID NO: 30484 - DNA, 1179 bp, Mus musculus
cctcatatcccacactttgggttgctgttcatgtgttttgtttggctgaatttattacacagtcagaggatggatttggtaccaaggatgtcactacaccaggtcattccacgccggtgcctgatgggaaaaatgccatgtctattttcagttctgctactaaaacaggtgtgtacattgttactccctcacttggactgttgctaaagtaaaatgcaaagggaattcctctcaagttcagattatgttcctagtgctatagcagtaatttgatcacaactttaatagtttttttttggattgtttttggttcatttcaaagctgataagcatatctggaaataattgtgtctaaatttaagtaggacatagggaattcccagcagaccttgtccactgaggtccagtccatgtccttccctgtctccctccctcagctaggagcctgctcaccctgtccttgcctcctctctcacagatgtccggcaggacagcgctgctggcagagccggctctgggagccttacccaggtgacagatttggcaccttccctgcacgacttagacaacatctttgataactctgatgaagacgagcttggggtgagtctgctgtagtggcacccgtgagacccaccatgtttggtttcttgtaggttcctcttagttggcttcactgaactcgggactctccttctaggaactacatggtttcaaaaggctcttgtttggaacctctgagtgccttttactagtgctgttctgtgttgtacattattattctccatagttgtaaatattaaaatcctccacatttattttaataaaccctcctaatattatggaaatacattttccttagaggaggtttttcttgaccttctaaccgagcggcaagtttgtggtcacagtgctgtgctgggaagtggagtgtagacgcaggattgcagggggagggggaattagaagtcttcggaagctacctgagctaagaaccaggaagttcatgcgctcatccttttgtcatctctgtcccttgggcaaacatttgcactcgctgtctctagggatactacagcggaataagacacattcttttcaaagaacttagttcatttattttattttattttttcattttcttaatcttcctttccatctattttacataaacttttc

SEQ ID NO: 30485 - DNA, 1204 bp, Mus musculus
aatcttgctgttaagatgcacttttaattttgtttttagcagttgcagacttgcaaaggatgttccccacccctccgtcattggaacagcaccctgcattttctcctgtgatgaactataaagatggagtaagttcagagacagtgactgcactgggcatgatggagagtcccgtggtcagcatggtccccacacacctcacggagtttaggatggaagtggaagatggcttaggaagccccaagccagaggagataaaggtaataaccagtttgggcttccccagggctggggtgcttttcagtgggccacacacacgagtgcataaggaccattgaaactggagcttgtcagtagaagtcactccatcaacagctttggcatcagatttttctttttacttattagagagaactattgaattacagtcggttctgtgcctgggttttatgaagcaccgagccaccgtggctggctctagtttgccagcattaagccaaccccatttcattgtcacaggacttttcctatgtgcacaaagtgccgcagttccagcctttcgtgggatcctccatgtttgctccactgaagacgctgccgagccattgcctgctgcctctgaagacacctgacgcctgtctgttccggccctcatgggcggtccctcctaagatggaacagctgcccatgccccctgcagcctcttctattagagacggctacaagtatgtgtgggactctacctaccccttaccatatgtgatagcacctcactgttttctcagactcgtcccggggccacagtggctcagtctctgagaccacttgctcgcttagtttccttttgaccatgttgtcttgtgcgggtctgtgtgtttatttttaaatgtttcttctgtgtgtgtgtgtgtgtgtgtgtgtgtgtgtgtgtgtgtatgtatgtgtgtgtgtttgtgcgcacttgcatgtttgtatacaaattaagattagagagctgtgtgtgattctaagctggtgtttgccatagaatctacacttgattgaagttgttgatgtttgtgggtagtgggaggagctttgatttgtaaggtaatggtttcagtgtgggactttacaattaggtaaagcagtaacaggttgaggtgtggttggggaaagtaaaggtagacatggctggtaacttggttgtctcgacctgccggag

SEQ ID NO: 30486 - DNA, 1544 bp, Mus musculus
ttttttctttgtttttgaagagaaaattgcagatattcagtgcagggctatggggtggggtgtgcagggagcttctgtacactcccccccccccaaagctactttgtatctgttgcagtaacgtgcctagtgtcgggagccttgcagacccagactatctgaacacaccacagatgaacacacctgtgacactcaacagcgccgcccctgccagcaacagtggagctggagttctcccatctccagctacccctcggttctctgtccccacaccacgaacccccaggactccaagaactcccagaggtgggggcactgctagtggccaagggtctgtgaaatatgacagcacagatcaggggtcaccagcttccaccccctctaccacaaggccccttaactctgtggagcctgccaccatgcagccaattcctgaggcccacagtctctatgtcaccctcattctgtcagattctgtgatgaatgtcttcaaggacaggaactttgacagctgttgcatttgtgcctgcaacatgaacatcaaaggggcagatgtcgggctgtacatccccgattcctccaaggaggaccagtaccgctgcacctgtgggtttagtgcgatcgtgaaccgtaaacttggctacaactcggggctcttcctcgaagatgagctggatatttttggcaagaattctgacatcggccaagctgcagaaagacgcctgatgatgtgccagtcctccggccagtccaccttgcttcctcaggtggagggtgcccggaaagccccagagccccccgtaagcctcctcctcctccttcagaatcagcacacgcagcccttcgcttctctcagcttcctggattacatctcctccgccaatcgccatgcactcccctgtgtgagctggacttatgaccgtgtgcaggcagataacaatgattactggacagagtgcttcaacgcattggaacaggggaggcaatatgtggataatcccacaggcgggaaagtggacgaggctctggtgagaagtgccaccgtacattgttggccgcacagcaacggtaggtgtcccagagtacagacttcagtagaagttatcttgctgtacatggtggccaaggaaccagaagtgagtgagggctgggctgtctcttctgccttgagtgggctgtgtcctctgtcttgggaattgggctgccttctgcttaagcttttgaggacaagtaactgccccctgagactttgccattccatcccatcacaaacaagtggtgcttgtggcagcttgtggccaagtgtgtaaaactggtggtcagtgttctgcctatagggatccagtcatcctatggtgtgcagttgccatggtatcccttcccttctggaaactggccacccatgtcctgagtgttgtctccttctggtttctcaatgtgctccatatcagtgaccacatatgactttgctgtggttacaggggcacattccaggggtttgagctattttaaattgtcaatcagcccatagtctagctgagcag

SEQ ID NO: 30487 - DNA, 1320 bp, Mus musculus
gaacatccatgtgcactgtatgtgactgtggatgatccatgtgcactgtatgtgactggatgcatgttcgtggtgcactgtcaaaactgtgggcatatgcacagctaaaggatccagttctcagtgacatcagaaaaggaggcttgttaaaagtgatttcttttctgtttcttcctgtaagccaaatgtagaattgactagctgttctatgtgcactcagctgtttgtgtaggagtttgtattcatatatggtggcagtatttaaggtgtccaggggacactgctagggtcactaagatgatttttgtcttccttcagcaccttatttagccactctgcagctcgacagtggcctgctgatgccacctaagcaccagagcccaccagcagaagcacagggacaagccacgcctgggaatgctgggtctttaccttcgaattcaggctcaggagcacctccagctggcagtgcattcaatcccacctccagcagctctgcaaaccccacaacaagtagttcatctgcctcctctgggccgccaggctcctcagctgcctctgctccaggcatcactcagatgaacactacctcttcttcaggattcggtggtggtgttggagggcagaaccccagtgcggggggcagctctacagatcgaaccccagggaatgtggcttgtggagacactgagcctgggcagagctgcacccagtcctcacaggatggacaagacaggtgtgtttgtgtctcacaaccaagttaagcttccacttggtcacacagtggggcttctgcttggtcacacagtagggcttctgcttggttatacccctttactctacctcacacacactttctttcagaattcagtcaaatgcttctctgtccttgctaataagaagtgacaagtggcgctccgagggcctgttaagagagagtcaatcagcgtgcttatgactgagttcattaagtggtagtgtttgttataaaacctttgtgtgcactgttaataaaggatcagagaaaacgcccatttcagactaacacagatacaagtactctgtttaaacacactcgagtccagacatgcttgcagtattgggaatttggggatatttgcatagccagcatcctttgcctgaaaatgagaaacccaagaccctgagttgtgagtgtcacatagcaacttttggcttttgtactgctgtctgtctcctgtctcatctgtgaaatgttgagcctgatgtgtgacacgtggctgatgcattggatcatagcccggggactggtgggctctgtgattgatttgttccatagag

SEQ ID NO: 30488 - DNA, 3126 bp, Mus musculus
caatatgatcagtatattctcattttggcatctagccaacatgaaacagttttcattcagtggcttcctgatcctggaggccctgaggtggccatgctggtgtgcagggacgcagggtgggccacgtgggccccacacaccccaagcctgtggcccagaagctgacctctgtgctctccctggcaggtttgtgctggagcagtacaacgccctatcctggctcacgtgcaatccagccacccaggaccgcacttcctgccttcccgtccacttcgtggtgctcacgcagctgtacaatgccatcatgaacatgctctaaccgggaagggaagcgcttgccctctgcctcagctcctcctgcagccttggccagggagcctgctccactctgcaaatgcccggccttttttagagcactccctataccccgcactgtgacgccttctgagcaggctcatgctcctcctgcagtgttcattgccacagtgacttcttgacgtgtctcacgaggacctggaaatttccataagcagtgacttgagccaatgtgtgatatgtgcagcctgcagtccccgggaagtggcggctgttggtggctgaagaggcaaggagaagagacaccgtccttttgcacaagagcctgctctcagcctctgtttagtaccaggctgtccagccctctgaatgcaatcctctagccaatggtggatgcctgggggtctcccatacttcataacctgggatgtgtcacaactaagagccagctccaggacaggatctagtgctggggcctctgcctcccccgcctgtcaggagggttttagttgatggcacacctgtgtagacacaggaggtctggggacagctgcattctgtttatttatttttcattttgttgtaagtttttttgcgactttgttttttctaatcttgaggaccaggtacagtagctgaagcccactgagacccaccgtaggattctctgagtacatacctctgtcctagaagccaagaaaggagtgagaagaagcggggaggccacctagtggtagactcggtcagacagtctgtggctgcagcctgtgtaggttgcacccctatatgaagatggtcaggctcagccccgagctggaggcaaggaccttcatcacttctctatacagtcacatggaaataccttttctagagaattcttacagaaagccaggtctctcctttcattagatcaaaagggactcgtgtacatatcacaaccaaagtgtttgctcacgaaaccagttacaaacacagtgaattttttctggaccataggaatattgtttcaaagaaatagtgcaactcaaccgttacatcagtacttgaagctgagcctctatgtgggactttaaaaaaaaaaaaaaaagcctttttaaagcattcgcagctgattgaagtattcttgactccctgtcccagaccttagggttgactttgaaaccctgtttctagcccttatgtcgtatgtttctgtctgtgggtggtgggtgtagaccggcttcccagagcctcctgacaggcccggcactgagcccggctcccgtgggagagtcatgcaaactaagttcttccaagagactttcatgtcctggttattaacaaagaaaaggaaaaaaatgtaataattgatatggttttgtaaaagtatttttcttgagataatctaacgtttaaaacattatattaacatgtggtggggatgtgaaagcagagaaataacttgtacatgggtgactgttctctgtctcaccaactgggggggttgctttccaatgtatagcttaaaaaatctgatatatcaaaccgtttgtatctaacgtgtacagtgtaaaattgacttaaaatatcgcagtgctattttttcttatcagcgaggaaatcctcaaggccttttgaagagcgtaagatgacggagatgtaaacttgtataaagtcacctcggggaggacgggctgtaaactagatatttgtaatctttaccacttgggattgcttcctctcagagttcaccagaactttgaatttctctctctctctctcttttttaaatgggctgtttttactgcaggggcttttcttccctagaaacccaactctacgcagaaaaagtgaaaaggaaaaaaaaaacacaaaaaaaaccagaaaaaaaagctataaaaagttttaaaagaaggcagcaaagggtagtttccatctggtgtcttttatttaagttttttaagttaagaaaagctggtgacatatttatacgtttttgtgcaaaaaataaatgaatggcaatagatttaaagaaatcttattatgtacttctgtgtgcaaaagtctgtataatatttcccctaaatatgcattattttacctgtgagttttttacagaattaatctgaaatgtacaagccctggatttgctacagagtgagaagttattttattttattttttttttattttttattttgagaaaactgcagaaatcagaactcctaccatggtttgaaaagggaggcgggaggggaggcgggagggctggtccggcatgcctgtatgtatctctcaagagccttttttttaaaatgtaaaagctgtacatttttgggaagttctgattttctttttctttttttttttctttttgtttccttttaccttcaagcattttgcagtgcgcttcttttatatctagcagacaattggaaagaaatacaaaacctatgtgacgttcatttaagaaccacagcccagtgctggttcaatacactaaagactttgataaaagagaatcaatggcaaaggtctccattttaaatgtcattcatatataccttgtggatgagagctatatacttttacacacttttttagaggaataaattattgaattactgaaacctcgagtggctcttttcccctcccaccccctctctgtactgagatcaccccgctccagtctgcacatgcgtcacagacggatctactgctctggcctatagagtgcacgtggggattgcatcacccaccaccccagtggctgttccagcattcccaggtcgggtcccagatgccaccagcaccaagagcctcttaggtgct

SEQ ID NO: 30489 - DNA, 1789 bp, Mus musculus
caggctgcgttacagcccctattccatccccgtcccagtgccggatagcagcagtttgctggccacagctttaccatcaatggcttccgccgcggggcccctagacggcaaagcggccgccctggcagccagcccagcctcggtggctgtggactcggggtcggaactgaacagccgctcgtccacgctgtcctctggctcagtgtccttgtcacccaaactctgctccgagaaggaggcggctaccagcgaactgcagagtatccagcggctggtcagtggcttggaagccaagccagacaggtcttgcagcgggtccccttaaaaacaagaaaaacaaaatcgccccctcccccaaggtctctccattccagtttggtcaaatctgccagtgcactttgttagatgtaaaataaaccacgggccttccacatggggtgacccccgccctgtccctttcagttttgtctgggagggagcactaaagcctttccagagactatgctagataccacaggccctgccaccatgggctgtgtaaccaggctgctgttgctttgaaacgcgggactgagggggcgggaggagtggtggcaaacaggcttttgtgtctagagcgacttttgtgcaggctggtatggaagtcggggctgaagaacaaggtagccaggccagccaggagcgcgggtctttgagagacttcaccggaatctttcccccttcgtgtgtttagtggaaacatcccccctcctaaacaaactaacaaaaccaatatggaggtggggggagatgaagtcctgtggaactgtctatgaagactgaaactcaccaattgctgagtactttcgttggggcagagagaagaggggccttaccttgccccatctatattaaaggaatcctgtctttttttgtttgtttgtttttaaatattgtgatgttttaagagccgatgctggcttcttttttgcatgttacagttttctgggtttattttgcccccccccccttttatggaaaaacaacggaagtcccattatcctcaaccttgctcaaggcggcaaccaggaggaagtggggtaaaaggggcagctatgggcatgaaaccaaccgagttgatttttatctgagcgcttgtagagggcttcgtgtgcctgttggaccattagttcttttaactgtatatgcaataacaaggttttaaaagataataataaagaggaaacacgactattggacaaagtatttatgtaattatttgatatctcttgtaaataggtggaatatgactgctcagaaagttaaactttaatttattgaattgtacatagctggatgtaaataggagcgtgtctgtcaggttttattcttgttttgccttttgggtcttatttccaggtcaggagatggctaatccacactagcaagcctaggcatctttattcacatctccatgctttcaagtagagctggctgcaaagtttttttttttttttctgatggagggggtgggatcgggagtactcctaactattttcaccaaaattggggaggtaatggcccttccgggctccacttgaaattccctaaactcttgacacccccagaggggttgagattgttgtgtgagtagggggggggggggaacggccttgcggaggccaccatagaaccgtcctaatttttcatagactctggcatcttactaacccatgtgaggttttcattgttcatctttatggtgttttggattggtgtactgagagggacttggttcaaacgaccatga

SEQ ID NO: 30490 - DNA, 1147 bp, Mus musculus
tgatgccccttctagatggcgagaaggtgggaagcctgcagctctgagctcacatatgtgggcagggcatatgtgtatggctcagagtgctcagcccaaggtctgagctcgggtctgtgactccacagctacttaggaacaccgtctaagtgtggtcgccaggcctctgttccaggcacaggctgagcatgacagactcatttccatgggtgtttttggggtggacatcactatcccaggcctggccccacacatggtgagctcccctcatatctgagacacacagaccggagccagtggagaaagtgatttcacaatggggctggggctctgtaaagaggaaagcaatagagactagctgagtcctctgtaacagggaccctggggaatgcttgtgctgtgacctcatagggatccaggagatgaagaatgagcaggcgcagcatgtgcaaaggtcctgtggcaggctctggtttggcagatttggcagtcagcaaagaggccggagcagttggtgtgagctaagcagagagaagccagggatgaggcgtgagcagctgacaagcccagtggggaaggggcaggagcaggtcggggaccagcaaggaggtcacttggtcagttggtgaccagtgatagtatcccaacctgtggatgaggtcatgggcacatgtacttcagaacagcccagtgctgggttcaggagtgtgtgcatgcacgtgtaccatgtatatgtgtatgcggatgcaggagtgtatgcttcatgcctgtgcgctgtgcttggtctcattaaacatggttgtcttaggcttccagtgctgtggagagacaccatgaccatgccaactcatataaaggaaaacattttattggggctgccttagaggtttagtccgttaccattaccatcatgatgggaaatgtagcagtgtgcaggcagacatgctgttagagaaggagctatgagttctagagagttctacatcttgatactgaggtagcaggaagctgagccacattgggcatagtttatgcatatgaaacctcaaagcccaccccagcagtgacatacttcttcccacaaggccacacctcctaacagtgccatgccctgtggggccatgggggccattttctttcaaaccac

SEQ ID NO: 30491 - DNA, 1696 bp, Mus musculus
tgggaggcaggtgagcggcatccatgggaggctggactgcccagagccgtgtttgttctcttcccgggctcatcccccgtttgctcgctccttgcgctcaccccacacacctctgcctcccccactcactgctgaaccctctcggggtcttttctcctctctgccatctgccacagaacccccgaagaaaaagcggtctgcagtgttggatgggatcctggagcagctggaagatgaggacaacagtgacggcgagcaggctctccagctgtgagctggcactgccagggtgcatggctccagggccccggggctggatagtgcgatacaggaagtctccatgggtcaggaccaaaggagtcaaaagctcgcggcaagtatgggatgtgagaacaactttgctgcagactctgcaccagtgctgagcagctgctgacctggcacctgcttgtgagatggttccatgaggagctcaggcctggcatcctcctgtggcatggctggccagactctgggatgagtgacagggtgcacagccactgtagagctcagccctggccagccaggctcctgcagccctgtctccccctcaacaggactgctggccagtagacagagctggggactctacctcatcatcggggccccttccttgtccctgtgatgcagccaggttctgagccctgctgtcaggttcacaggctgaactgcgccagcaccactgacggactctacagctcaagcggaggccctgggagtcgcacggaggcctcacccgcaccagaggcttcaaaggcgagtctttggctgggtaccctagcacagcctctctccatggactcggacacaccgtcaaccagaggaggacatggcactagtcagggaggaaggccagagcccttcaaccactgtccagccccagcactacctctcaagcaagaagcttaagacctgtgtcattttgagtggctgttcagtgcaggtgactggcatggctgcctcggccagccatgccaacttcactcatccaaccaggaagacgtggggagacactactaccacctcagagctgttgtcaccgagggctgaagaggcaccagacaggactctgagcaccaggctttccaactttatgtgagagtcttggcctatgaactttttgccttccagatttgcctggatcccacaccaggttcccaaagatggggccacgccctctcaggggtgctgagaactaagcaataaacggcagagcctagaattgcccctccctctaccctgatgtcactctgtcactctgatgacaccctgcaccatggtgatgcacagaggggtggagatgatgcttgccacacacccgtactggaccatggggatcgctgtgggtcattagaaaccgacccactcactcagggtgcacccacccatcatcacacctcagccaggatggcccagggcagaaagttgtagtctgatgccagcgtagactccccagagcaggctccacacctgtgccacttggcatgggacccaagacctgtgctccaccaggttggcctctaaaccctagagcccagcaggtgacttctgagtcccccagcctcctgagcacaggtccccagtacccatgccagctaggcaaggtcactgtgcactcgtaatctcagatcttatggggacaaacaggtccttggat

SEQ ID NO: 30492 - DNA, 2605 bp, Mus musculus
ccatcccttccttcccatccaggtacaatgatttcctccatgaccctctgtcattgtgtgaagcctgcaacccaaagcctaatgcggagaatgccatctctgcccgctctgacctcaaccccgccaatggctcctacccatttcaggccctgcatcagcgcgcccatggtggcattgatgtgaaggtcggccacctaagccagttgtcacatgccccggggaaggatggatgggacaggtgcagggtcagaggtcagacctgggctgaagctgggtcagtttaaggggatatcactttggggtcagcttcagaatggtgttttgaagaaaagtcgtggtgagagttgggccctaccagctgagtgtgtgctctctgacccccccaggtgaccagctttaccctggccaagtacatgagcatgctggcggccagtggccccacgtgggaccagtgtcctccgttccagtggagcaaatcgccattccacagcatgctgcacatgggccagcccgacctctggatgttctcacccatcagggtgccatgggactgagagagagtccgcctccgcctagctgccttcattttgtgtggccagtgggtcatacacctgccgtccacccctcgggcttctgtcttcactagactctggtcctagcggcttccttcgcaaggacacaacccagtgggctcagagttgcctctgtctctgagccctctgccccttcatggctcatcctccctgtccctgtcaccagcaggctggggcttatgcttggctgtgggcctggtgggatccggggcacacattctcctagtgctggtccctcagcatatgtgtgaactgacaggggacattatggttgtcactgctggcctgtgggcccatcgcctcaggaggcagccctgtgcccttctgggcagctcttctaagtgcaggagcttgagaacaaaaccaaagtttctggctgcttgtagctggagggccttgagtcttctttcagcaggaggaatggaccgtcaccccacacttctacccctactcccagccaagcctgcccctggcctcctggtaggtgtctctggctgtgtgctccggtcagcgaagcccaggctgtgcttctgttaaacaagccttgtggggcggcaccacaccctgtctgtccatggctgtctccttccatctgtcctttctctagtccacgtacctactgttcacctgcatcaccagccccctgcccgtccatcccctctcctgtccaccctaccgtcttttcactcagtcagcggtccacacacctacccgtccacttgcctgccttttcatctgaacgtcctcacctctcacccacccatccacctgcccgtccgtcagtctgtccacccagaactgcacatcccttttcattttggttttgctctgtaactcagtgtggccttgaacttgaatgccttgtagtccacagtcatcctctggttattgtatctgctggccgccttcaccctcacatgctgggtttccatgtacaggccgccgtgccttgattctgcttttcatcagcccactcatctctctgtccatttatccctgttagtccttctgctcagcatctgtctcaagtgctgtattctgggtcctagcctggcccaacctgctgaccactaagaccctaaatcctagacccagagacccacatgaaaccaagtcccctgtgtggggcccagagagctcacagcctgtgaaccagaggccctaagatgtgtgggtagctttacccgagccagtccgggcctgccatgtgttctgagtttcgttggtagtcaggggttggtttcctgtcaggttcactccaccttccctgctctgcagatgcctgcacggggttggttttccagacaccagggtggggccgctggtgtctcaggatggccttgtcctgtccctaaggacttcatattagcatgtggtggccttgcctgtgcatctcccagctgctttgcgaccccaccctagatccctgtgtggcttagctctggtcctctctcctgacttacggatgtgtgggttccaccagtcaatccactgggagacccaagaccccagaggggagcaccacttctctgagagccagggacgatgtggctgggtgtagagggagactgaacaaggcaaggaagctaacgcctgtctgcccggcactcagaagatgaggcaggaggatctccagtttgagaccagcctgggctgcacatagaccctcatgtcaagaacaaacaaagctcaaaagatctttgctctataaatatatatttattttttatttacaatggaaaagtgcacattataaacacaggtaaaggagggtggggccattgtcaagtgtatcccaccccactagggggtgccggtgacccctctgagggaggccagggcagcagcagatatcactcgggcagcccgttcaggcccagctgcaccttgagtgcctgcagctgcgccaggcttatgttgctgccgccacacacgatgacaaccagcgaggccagtggggtttgcagccggccttcatcctgcagcctgcacaccacgcggctgtacacagc

SEQ ID NO: 30493 - DNA, 1146 bp, Mus musculus
gaagcaagaggatggtcactagctcaagggcagcctgggctacctcatgaattcccaggctagcctgactcaacaaacaactaaaaatcactgggattatagcccagtggtagagtgcttgcctagcatatataagtcgctggggtccatctttgatgtcccacccaaaaaaggagaaaaaaaaaattccgaaagtctgagttcctagttcttgcaagtgaatatttctcatacagtctggctcgttccctaagcttcttgcagacctgatgtccgggtgaggggcagatctcggagtcacctatgggttgtgggtgtggtgctccagaacaggaagcacgtgatgcaggcccaggagggctacggaatggaatggggtttctaaatgggtggatagggacttggcttagctgggaaaggtctctgggcccctcctcctgaggccatgcatatgctaaaatcccctcctcttaccctaccctgcaggcactagagcagccagcccgtgagcagagagggctctggtcaggcctcaaggggcccatggcaagcagatggctggctctgctctgggctcctgtcttcctctgtgtggctctgatactggagacggcgtctgggaccggagacccatccacaaaagcccatggacacatccagttttcagctggaagtgtcaaccagactgccatggcggatgtgagtacctggtcggggcaggaaggcgagtcgggttgggggcgtgtctgttgtagtcccagctaatcattacaaccctgggatctacaggaatcctcagataaagttagagatttcagagaactgtgagctgtgtggccagtaacagtgtgtggggaggctgtgcgtttccgcagtggtcggtggtctgtgacaaacttattctgtgaaccagtcatcttggagccaggctttaaaggaaaggaggaaagcctctttgacgggacagacatgtgggggaaaggctaggaacaagtgcaaaggcctggtggcaggttctagcttagtgtgttcccgaacagcgaggaggctggaagggctgatcagtatgtataaggtttaaccgggtgggtggaaaggtgatgttggcctgattataaaaggctttgtggggctggtgagatggct

SEQ ID NO: 30494 - DNA, 1151 bp, Mus musculus
tcctaggagcgtgagaacagaacgcagccattgtcatcaaagactaccgtgagggggtggggttgggcagaggggtgaacagtggcttgcctggccctggaatcccacatgtgagcttgggaagtgaaggcaggtgtgatctctgagttcgaggccagcctggtctacttagcaagttccaggacagccagggctacacagtagagccaaaaaagaaggggcctagaagagaggagggatggtggaagctacggagtgtctgtttgtctgtcctggtcccagcagactctgccccatgtggacccttcaatgtggtcttagtttccttagcagactcgtgcccgatgtttgaagctcccaaccctgtgcctggagtattcggccattgcggaggtttttctctctatgaatgctccttataagggacgttccttgctacgcaaactgcagagatgagatcgactcagggtctcctgatttctgtagagcaagagatagaccaaaagtactcacggagagaaaagggaacacttctctaaggctgtgtgtgcttcaaaatagagggctggagggatggctcagcggttaagagcactgactgctcttctagaggtcctgagttcaaatcccagcaaccacgtggtgactcacaaccatctgtaatgggatctggtgccctcttctggtgtgtctgaagacagcaactatgtactcatacataaaataaatctttttttttgaaagaaagaaagaaagaaagaaagaaagaaagaaagaaagaaagaaagagagaaagaaagaaagaaagaaagagaaagagagagagagaagaaagaaagaaaggaaggaaggaaggaagaaagaaagaaagaaagaaagaaagaaagaagaaagaaagaaagagaaagagagagagagaagaaagaaaggaagaaagaaagaaagaaagaaagaaagaaagaaagaaagaaagaaagaagaaaggaagaaagaaagacggtagtaatggaacaggaagagggagatggtgggaggggctagggacaggagatgtgtgtgtgtgtgtgtgtgtgtgtgtgtgtgtgtgtgtgtgtgtgttggttttttgagacagggtttctctgtgtagtgctggctgttctggaactcac

SEQ ID NO: 30495 - DNA, 1197 bp, Mus musculus
tggacgctgatagagacagtaccacgtggcagaccccatagctgtgtaccaaggacccaacactcccttcatggtgcacatggcccagaaggctcccagggtggggactaaacaactcctgttctccccacagctggagccagacggattactggtgtgggtgctggccagtgccctgggcctcagcttgatcttctccctggtctccgtgccgcttcagtgtttccagctcagcaaggcttacggcctctgcctcctcctcttctacatctgtttccttgttgtggtcctgctcacagagtttggggtgattcacctgaagaaggcgtgactgaagctgcttggcctagaggtgtgggggcgattctgctagcctcctgagggggaggtgtggggagggggaccctctgtggtccccgtggatctcctgagaagatagtcactggcagagctctgcatgggtgagaaggtcctgactgccggcacctaacagccttagtgtggggatctggaggctggctttgctggggacaatcccgggtaggaatgatgggatctaaatgacaccggaggctctggggggagggcagcctttcagtcagcccccatgcctgctgggctctgggcagccctgcagttccctctctggctcttccactctctgtggggtcctgcgtacctacagggtggcctgaaaacagactccacacgtggaaacaagactgggtttctcagcttccgtgtcaagtcagccagaggaaagaggtcgagttgacagcagcaggcactgcccttcctagttggtggctgccatgttggactgtggatctaaacacttctagagctttgtggtccaaactctggctctcccgtctgcaaaacaggagccagcctgggctctgtgcctacctcaaggggagctgggggttggggggactgaccctccccagggaggtcttacaagtagtgtgaccagtcttttgtttgtttgtttggttggttgttttttggagacagggtttctctgtgtagccctggctgtcctggaactcactctgtagaccaggctggccttgaactcagaaatctgcctgcctttgcctcccaagtgctgggactaaaggtgtgtgccaccactgtccagcttgtgaccagccttttaaaagtgccactcactccctgactgccttcagctgt

SEQ ID NO: 30496 - DNA, 1146 bp, Mus musculus
gtaggcctggctctgcctctgctgctcccctcccccccaagcagaggttcttccgctctccctcccttccccccccacctgtgtgtccctcacactggctgggagagctggagagttggcaagcgagcgaaccaccctcagcagcgcccgcctcttccctaggagtggtacgaggagcatgcccgggaacaggagcagcagaagctcaggggcagcgtgcccggccctgcagcccagcagccccctggcagtcgccagcgctcccagactgtcacctagctgggtttcgtcaagccagcctcttctatgcaataacaccatagtattatgtactaggacgtatgggaaccatgtgtgtatgtagacacactcatatatatgcacatatttacacagagacagaaaagagactatagccagggtccgttccagccacctcgctctgtcttcctgagctccagaaataaccagcttaggctggaggcccaggcctggcggagctctcgtcctaccatggaaaactctggaagccctctgctcaagaagccccttaaataggctatctcgtctcagcaatgccggctttccccggggagggatggggggagcttgaccgcctccctactgcggcctccagcttcgtccctacctgaaccccagccaacacaggtgtctgtgtctggtatgaggatcaaaaccactaggaagaaaccccacaccctgcaggatgacatctatcaatgacaaaagtgttagaaggttcccttgagggagacagaagagcttactctctcaggctcccagtcctttcttgttgctggaaccctaccacaactcccccacccccacccccgggaacccccacccccacccccggcaggatccctccatgcaggagaaagccaaccagaggccctgggaatttgacttgctcaggggagttcatttgaactggtgctgaaggcagcccccctcaccaaccacactttcacactgcctcctccaagattctcataagctaggtgggtaggggtggcgagtcaggtcaggtgacttgtgggagttcttttgaggccaccatagtatatggtggcagagcgatggagccctgctgtgttgtccacaaggggctgaaggtgggcaggg

SEQ ID NO: 30497 - DNA, 1131 bp, Mus musculus
ggaggccaccagagggcagcaatagcgcgcccatgagcctgggtggggcttttcccacacgctgacatcagaagacactggtgaactgtcaatgccgttgtgagggtgcagaccctgtcagcacacccaagttggttttggcctgtcttgctttctgttccagtcatctgcagtaactcctagtggacctggatttttgggggggtgaatttccagtttgtgccatgcctgacacctaagtataaagctagcgtgttagcagggtggcgtgcccttggccttctctgtacattcacacctgtgtgacccgcagttagatgcttgcatctggagagtgccagcagcctggaaggctgggggaggggctgcctagccactgtctcgccccagtaggcacacctgggcactgttgagggcacgggtgcctgagtctcatttacccggcatgttaacggcgccttcctcccccgagcgtcggagactaaaatagtaacttggagagagcggttggtgttcacaggcttcctgtgtctcaggctcgttcctcaatggtacattaaccacgtagtcctgtgaggcacagagagactgagtaattggcccatggtcacacaggatccagcagccttgcagagctaggaagttaggtaggagctgctttgatgctgacgcagggagcagtgttcagacccagagtgcccgagcctgggcccagcctccagcccttgctccttcctgcaagcttcccccaccctcaccgcctttcctctgcacagttgctgatgggccagggtgtgagttgcgcccacatctatagtgccttggaccagacggcccgcaagatcaacttggccaagttcacacacaacaaatgttccaccctcatcgtgactgacctggccgcccggggcctggacatcccactgctggacaacgtcatcaactacagcttccctgccaagggcaagctcttcctgcaccgagtgggtgaggcgcctagctgcactgggggccttgggggcgggcggggggaggggtgctgtaccgtgctggcagctgggaatttggggaaactgaggccttaagtaatgtcccttgggtgggttctgacaggcagcctcagctcccaga

SEQ ID NO: 30498 - DNA, 1247 bp, Mus musculus
cttccttaacgaggctttcagctaccagaagtggaagcagaagcagaaaattgatgaccgggactccgaggaagaagggccatccaaccagcgaggccctgggccccgcagaggtggaaagcgaggtcgtagtcaaggtgggcagggcaggtggtatggtgtgaacaggaagaaagccaggcatggtgaggcacagggatgagcacgggcccaaggctgagctccccccaaatccctgtgttgacaggcacatcccagccccgagcttccagtgtacccgcaggccgcatgcgctcggaactcaagaccaaggagcaaatcctcaagcagcgccggcaagctcagaagcagcgcttcctgcagcgagggggcctgaagcagctttcagcacgcaaccgacgccgagcccaggagctgcgccagggcgcctttggccggggtgctccctccaggaagggcaagatgaggaaaaggatgtgaggagccagacgcagccctggggcttcctggtagccccgggtgtggacgtcagggactatgtccatgtgctgttggaagatccttccacaggcgctgctctgtgaggagtagtgccatatggccacagagcaacagctgcttttgactgggacattgggtgacctctgaaaggatgcataggagtctagctatgcaaagcaggcagacccaagtcctgaccctgcaagtcacagcggcttctggttccacaccttcaggattcagagatcagggccgtgtggatgcctctgacccagcattgagttttaatgtaataaactttactgcctctagtagaccaggagtgtggcttcctcaggatgtttttggaaggtgtctcagctgttgttgaggctgagagcaggtggccatgcctgcgtgtccctcctggtcactgagatgaggaaaatgagtcacccaaggcagctcaggactgctgcggggcagagaaaggctgtggtggcattgcccttcttcacatggaagagagaaagcagcctgcgccaaccctcgtgtcttcattctgctggtggctttttccacctcttgcttgaggtcctgggtgtgtgtgtgtgaagcatcctccagtagccagaccccagtgcaggtcaggcacacattggggactaccccgttgggcccgaagagcagatggtaccaataatcccctgccgctcagatccactgtacatagcaagtgcacatcctggagtgcactgggctccatc

SEQ ID NO: 30499 - DNA, 1311 bp, Mus musculus
cagaagcgctaaggggatctggctggtggctgtggggggggtgatgggagtccaccaggccagctggctccaacctgtggcttccggcaagagcagcagagataggaccaccagcaagggcgacttccctatggaaaacgatggcgctttgcccttcacaccacacacaaacgcacacgtgtcctgttgcacgcacgcactcacgcacgtacaccacgtgcctctccacttctcccagcttggggagaaagagacagaaaggcccccatgacatgtcctgtggaaatacctgtgtctccattacatctgtataggctcgtccctttcccaggacttgagtcaagcacgggatagtgggggggactctgtaaggcttcaaggggtcgctctgcccctgggcctcaaccccttaacccacgtcagcgctgccacctgcccactgagcactgcaaagccaatggggtagaaaccccaggttattaagtagcttttcgcaggccactggggacgaggctatcttaactttgtgcttgtgtctatctttcccgggaccctgacttcttcttcttcctgtgtccatctcttgacctctgtctatcccaggcaaagacatcgtccttgcctctgtaccggcttctcccccactaaaccgctccggacatttgagacccacttctggcttcaggagcgaggggaggaggccttgttcaggctatacacgcatcaagctgagcaggcagcaaagcgttaaacttctccctgcttgaaagtgggcggtgggcggctgatcgtctcaggccaaccagaggcccgttgcccaggcaactcaccagctccgcctctgaggattggctgctgggatggaagtcagccaagctttaaagggacgccagcaattgctcttttggaaaaaaaaaaaaaatctaccagtcccactgtgggtggagaaataaatggtctttctccttgtcaggcctttttctgccaagagagggtgctgggtgactgtgctcctctggaacaccgggaagacaatagcaaacggaggaccacggtggggcgggggtgggggtggggtggggtgggggagcagtgcatgggtcttgtaactgcccagtcatgcagcatcaagagaagtagacaggattctcttgcgtgcagccctccaggagaatgaggaagacctgggagacaccatatcagctcaccgaggccaccctaccctggagcaaggagcaggggaagaggctctggcagctcaagtggacccaagcctgtgggagatgccccagttccaggcgacccttgctg

SEQ ID NO: 30500 - DNA, 1150 bp, Mus musculus
tgtgaaggatataattttagtgggggagaaaatgaatacttgatttaatcttgttgaagcgctggtaattaattggagcataatgtaaaatatgctaattggaacgcaatgtaaaatatgctaattggatcatattgtaaaataagttaaatgtcatataaaattagcttagttttcaactaacccatcttctcactcccacttgcaaggccctttctcttctgtgggctcggtctagtccctgcctcctcaaccatgtctgtctatctctccgtctttgtctgtatgttcctctcatgtgtttcattagggttgctcactggagcatgggcaccttaccagagtctgcatccctgaagaaaatccctctccctcccacatcggccatgaactgcatataaatcctcctgaaggtatgagacccttccacagcaggatgacaatgggctccaaggtcccatgtgggtatagcacaactgctgtgagtttatgtgtgcaactgataagcctggctccgagattacctcttcactccctgccttctctagatcttcaattctttgtgcccctttgtctctgatgttgcctgagtcttggaaggtgttatgtagacaccccatttcttcgtctcctctttttatatattgttttggcttttgggggaagtcccttggagttccatatgaattttaggatatgtttgtgcacttctgcgagagaactcactgggattgtgagaggacctctatctgtgtgctgacaggtcatttttagcaggatggagtcttccacccatgagctgcatggatctctgcggggacccttcagcatctgcagctttctggatgctgtgacaaaataccagtctggccgagaggtggtggtgcacacctttgatcccagcactcaggaggcagatgcatgtggatctctatgagttcaaggccagcctggtctacagagtgagtttcaggacagccagggctacacagagaaaccaaaacaaaaaaacaaaacaatcccccgccccccccccccatgtaccaggcatgtctaggaggaggaggaggaagaagagaggagagaggggaagaggaggaggaggaaggaggaagaggaggaagaggaggagggggaagaggaggagggg

SEQ ID NO: 30501 - DNA, 1129 bp, Mus musculus
aacaatatctacctctcttaatgtcccaggacaaactaagctgcatttctcccttccctgagaagccaaagcttccctgattgagcttagctgctcacaggagaggggttacaggcctttgaagctgccacactagaagatctgcacccagctagatgggtgcagatggcttccctggggctgcataaagagaacccctcccctcatctttcctcctgtatcctctagcccctctcagagatcctgtgcaatcagggcagaatagcatgcagctggttgaaaccacttgctaaataactcaggtgagggtcccataaccttcccagcccacctcccttccaagagtgaagataacagtcaacaagcccagctgtgatgttcattgataagcaggctctggtggactcctaaagatggtgccagtgtggctcagtgaatagccctgcataacattttacacacaccaaatgctggttgatatctcttgctggctgcccagggagccttcaccccagggctttaactgcacagagacatgaggtctaagcccttcgcatccccaagtaaggctgagccttttttctgcctgtgcttgctctgatgcattgaggatcatgcctggccactgtgcaacttttaagcagagccgtgcaacatcccagggagttgacttctatgtaaacaccttcatccatttctgatgtatgctttgaggtggctcaggctgggctagcccagcccagacagaaatcctaggcatgtgattagaggatcagaacccttctggcccttcttcaggggagagatggggctgaaggtggggttcaaatctcatgccgagtgatggaacccgacatccctaggtgctaaggccccaccaaattctctggataaggaagttccaggaatctttactgataaacatcccaatgtatcaacaaggtagactctgacctccatgggacagaagatcctgggtcagtcccctccctggggactctgcagttggctgttcatttatatgcttcataataaatggtttctttgtgtagccctgactgtcctggaactcactctgtagactaggctggcttcgaactcagaaatctgccggcctctgcctcccaag

SEQ ID NO: 30502 - DNA, 1826 bp, Mus musculus
caagttcatagaggattacctccttcccgacaccacctttggtgctgatgtcaaatcagccgtcaatgtcgtgtgtgatttcctgaaggagagatgcttccaaggtgctgcccacccagtgagggtctccaaggtggtgaaggtgagccctcctctgcctgagctgactgaatggggtgggaggggaatctcagaagccagacagccctgatccctcctcttcaattctgagcacagctggcgatgggttctccccccaggccccatgtctgtattgtagaaggagactcagctacagtttatgttccccagtcccaggctacgaccatttcagagtcatagaaactgaagcccagaacagtaaagcagtttgctggagagtggcaggtcaaaggatccaacctttgcactgctgtgtgacatagggtaaattaactaccttctccatgtccagtattcccagtccacaccccaagatggcaaggtcacatagactaagtcaaatgtgacatggaggacagaacagcactcacatgctgcatggctggattgaaggaccctctctgggctcgatttgcatttcatgacaatgatacctaactcacaggctctgtgaaggagtcagaaacaaagttttttcttttctgccttgttgtgtttagttgattgtatttttatatttttagttgtgagtgggggctctgtatgcattagtgcaggttaggtcaggattgaagagagggtgtcatatcccctagagctgtagttacataggtgactctgagctggcctacttgggtgctgggaactaaactgaggtcatccgcaggaatatcaaccacttttaactactgacccacctctccatctgcagatgtgacaatttgtaatgccctctctcaacagtggctggtgctcaggtgtgttagtgatgattctcagcattttatttagggaggctcttctcagtataaattcttcttttgaaaatattcgttttctagatgttgatcacttttattacttttcagttgctctatgattctatatgctattccatagtacactgtgttatagtgtaacactattccttgctcatttcctttagatctctcccttcccccgctcccatacacacttccctcccccccccccccacacacacactgacatacacaaatatagactccacagatgaacatggatgtttgtccttctgaatctggcttatcttctgtaccaggaggagactctgagctggcctatatttcctacatagatcctgatgtcactcttcagggctaactagtattccactacacatgtggcagctttatatatccatccatccatccatccaatcatccatccttcacccttagtggtggactctagtacagcatctggactgcccagcacggctctccctgtcccttgtcattctcctccttgtctttcagggtggctcctcaggcaaaggcaccacactcaagggcaggtcagacgctgacctggtggtgttccttaacaatctcaccagctttgaggatcagttaaaccgacggggagagttcatcaaggaaattaagaaacagctgtacgaggttcagcatgagagacgttttagagtcaagtttgaggtccagagttcatggtggcccaacgcccggtctctgagcttcaagctgagcgccccccatctgcatcaggaggtggagtttgatgtgcttccagcctttgatgtcctgggtaagccagcctgccagagagcctcagctcatctttctgcatgccttcatcctcccttccagttccacctctgtgtg

SEQ ID NO: 30503 - DNA, 1161 bp, Mus musculus
agttcctattttagagtccaccttccccttaggccattgtaaatgcgtgtgtatgggtgtaactcagctatactcttagaagccaggtgtgaggtttttactctcctagggcaagggctttcacacccaagtagtggttctaactagggagttccttactagctaaccatctcatgaataatgcaatactctaaaaccacagcccatctacttcctaaaccattgtaaattcctgtatatgggtgcaacttggcttttattctaaatggtattgtagtaccagaggctattctgaatgtcactgaataggcaacactcttattgaattccaagcccatggtcttgctcaaggacgttttaggattgttggaacactggcagaaggctttagctatgtcagaattcaatcttaaaaggcacttataataggataatactgaaagagagcatgtggatccatacactagattaactcggaaatggaaaattaatgtatgggttagagagaacgccagactccaggagtaagtttccgtgaaactcttctgcctcagtgagtagcttccaagcctcttggcttgtcaagctgacttaataatttaatgaccagagtgtgtggcacatagttgacacttgcatattagagcatctgactgccatgttgtgcagcatcatgcttgctccagactggatctgacaagatccctttgccctaagcatggtgctcatccctgctcttccctagggatgtcctatggtgctgacttaccatccaccctgggcagggaagtggcagggtttgacaacagacactttggggtgccaagccctgtcttcaactttgaccttctgtcgaggtcagacactcccttctctccagtgcccaccctctcggtaagtagcatatgcccaccaagggcacgcactactctgtccaccatggtcccacagggttctgttccccaggaagcctcttcatctacactcctggtttcaacactgaaactggattcaggtcagtaattgggggagggatccactctgacagccactgccctcctcccaaatcaaccctcagggttccttcaaatggcgcatcttcatggccaacttcactagccttagatgtacgtggacacacacctttgggtgcctgtgtga

SEQ ID NO: 30504 - DNA, 1190 bp, Mus musculus
tgcaggcccatgacccagtgagggagggccccacctggcatcagactccgtgcttctgatgcctgccagccatgtttgactcctgtccaatcacagccagccttcctcaacagattcagaaggagaggaaagaacacacgcttggtgtccatctgtccacctgttggaaggttctgtctgacaaagtctgatcaacaataaaccacagcaggtgccgtcatggtgtgtgaactctgaggagtgggccatacaagaacagtgcaggtgtgtgagcgtgtgtgtgcccatgcacatgcgtgtgtgtcttcacggttcaactagatgcatttagtgagcacttactacatatgctacatgattcagatgttcagcagtggttagagcaaagcctaactgctaggctttttgatgcaagttggattgggatccttccaggtctcttcttatacatacacacaagagaggaacccttggtttcttctgcccatgaccccaagacaagattctagccctgccctatctgacacattagcggttctctggctacacatggacatggaacactgagattgtggcctgtgctctcagggtgcccttgagtggctacaacatgcaggctgggggaccatagatatgatgaaaataaaaggtacctggaatttttgacacatgtaactttgaaacagggtcattggtatcaacgatcagctttatcacatttagttaaatcacaatgattgtggcttcctttctgagacatgaattcatgatgtgatacatgcagtcctggaactcacaggaatcctcctgcctcagtctctcacttggttttggaatcaccccccccccacacacacacacacccttcctcacagagacctaatggtcccatccatcagtgttgtgaaccatctggtcatttctcagactcaaaggactcatgtgtgtactcgcctcatgcacacctgctcactagaattcaaggcattgtgaaggaccaccagctctcaaagccttctcctggcactaatacccactctctgaataactctgtgtgtgtgtgcgcgtgtgcttgtttgtgtgtcctcccagcccatgttcactcagtttttactcagtgtccctcacaaagaggagtgccagcataccgggtgtaagaagattcatgtccctgtgctgtgtcctttatc

SEQ ID NO: 30505 - DNA, 1099 bp, Mus musculus
acacacacacacactgacatacacaaatatagactccacagatgaacatggatgtttgtccttctgaatctggcttatcttctgtaccaggaggagactctgagctggcctatatttcctacatagatcctgatgtcactcttcagggctaactagtattccactacacatgtggcagctttatatatccatccacccatccatccatccatccatctatcacccttagtggtggactctagttcagcatctggactgcccagcacggctctccctgtcccttgtcattctcctccttgtctttcagggtggctcctcaggcaaaggcaccacactcaagggcaagtcagacgctgacctggtggtgttccttaacaatctcaccagctttgaggatcagttaaaccgacggggagagttcatcaaggaaattaagaaacagctgtacgaggttcagcatgagagacgttttagagtcaagtttgaggtccagagttcatggtggcccaacgcccggtctctgagcttcaagctgagcgccccccatctgcatcaggaggtggagtttgatgtgctgccagcctttgatgtcctgggtaagcctgcctgccagagagcctcagctcatctttctgcatgccttcatcctcccttccagttccacctctgtgtgtgtgcacatgtgtgttgcataggtgttcacatgtatgtgggtgtgatcctgagtcatggttaacacagctctagagtaattcatctctattttcttaaatatttttaatttaaatgcatttcatacatcaaacatattaatactgttgattattttgagaatcaaataatacataaaatttgttcaacttttatattcatatcctttcatgccctaaaatattagtgaatatttaatactatctgtaactgaggatcctatatctaatgttggatactaagttgattcaaaacatgcaaaatattccttgggagttaagcatagtaaaagagcataaattatttaaaatgggtcattaagaaatatattcaaaagcccttatatgataccactgacatagtaagagagtatttgaaaggcattata

SEQ ID NO: 30506 - DNA, 1115 bp, Mus musculus
ctcgggaaatggaaactgaaaatctacttcccatttcagctaggctgggagacccaggaagctccagacttagcatggagcacggactcaggagcatcccagcctggacgctggacaagttcatagaggattacctccttcccgacaccacctttggtgctgatgtcaaatcagccgtcaatgtcgtgtgtgatttcctgaaggagagatgcttccaaggtgctgcccacccagtgagggtctccaaggtggtgaaggtgagccctcctctgcctgagctgactgaatggggtgggaggggactctcagaagccagacagccctgatccctcctcttcaattctgatcacagctggcgatgggttcttcccccaaggacccacgtctgttttggagaaggagcctcagctacagtttgtgttccccagtcccaggctaagaccatttcagagtcagggaaactgaagcccaggatggcagagcattcttggagagtggctggtcagggttgggagccatgggggtggggcagatccaagctttgaactgctgtgtgacttagggtaactacactaccttctccatgtccagtgtgcccagtccacgccccaggatggcagggtcacatggactaagtcaaatgtgacacagaggacagaccaggacatcatatgctgcatgactggattgatggaccctctctggacttggttctgggtctgtcgcatcgcatttcatgacaatggtacctaactcacaggctctgtgaagggtgcagaagcaaagttgttttcttttctttctttttgtttttagttgattgtatttttatattttcagttgtgagtggggctctgtatgcattactgcaggttaggtcaggattgaagagagggcgtcagatcccttagagatgcagttacataggtgactctgagctggcctacttgggtgctgggaactaaactgaggtcatccgcaggaatatcaaccacttttaactactgacccacctctccatctgcagatgtgacaatttgtaatgccctctctcaacagtggctggtgctcaggtgtgttagtgatgattctcagcattttatttagggaggttc

SEQ ID NO: 30507 - DNA, 3218 bp, Mus musculus
acagatctgattttttttttctttctctctctttggggaatcatgggccccttgtaagaagaaaggatttagggagattccggcacagcctccccaaaagccagccgtctgtaacccactgttcatcttgctgctctgcacagggctcccagggccctggctggagactgcttagggtcatcatcatcacagaggctcactgtttagttccagggaccagtaggccaggctgcaggcttgcacctggtgagggccttctggctgtgctacactggacgggagagcaccaagtggggaatcacttttatggcacaagttcactgcaccctcaagacccaggtatcccttatcatctcactgtccacacagtgacattgggaggtctttgtgctccctgcagacacatgtcagggcacttttaaaacagattgacccagccaaggacagttcacttttggtggcttcttttgtttagtgaaacggtcattcagccactgaatgagagggtcaggaggtagacagtcatggctgaaagaaaggccctgggaactggtgtgtgaagtctttcttctgaagatgactccttggctgcaggtgtggacagagaagctgttctgggcaaagtgaccatgttgtctctgtactggagtattagtaagatcccggggtgagcggtatttggtcctcacttgttcctgaccaccccattcccgttcttcagtgcagcacatctgatctgggttgcatgagcccccactgtcctgtaagggtcacttgggaggttggcaacatggtcagaaccctgggtgtctgcttcagggaggtgtttccctgtctcttctcctgggtgtctgagtagccttacgagcagggtggctggacccttatgtgtcccccagggtgaaagccagaagtggccaggtcttcttcaggcgcaggcctggagtgaccatgatgacttcttccgtggctgctgtgagagaatcaggctcagcccaaggtgtgaagtcctatgctctggggccaccagtcagacagccccagcccgtggcatagaagcaagtggctgtagttagcaagagcccaggctgcttatagtatctggtgtaaactgtgtgtcggatgggaaatgtacagcaggtcttctagaagcttccgagccccgcacgtgtgctgcagcgcccacctgaggacctggtgtggtcgggttggtggtgtgtacgtgggagcccatccctgaagcaccgctggggtgggaaggcgatgcttcccgggccttggctgagtatgaagagcggcagtcctggctaggcctcctatcagttccagtcagccgtgtctgccctaaccaaacagcaggatttgctaatgttctgccgtaagtgccttctccagagatgtccctctgcccagtgttgatccttgagagcacgtttcagcgagagcttccagatgtgatgctcgtgaccaagcaaccgcacagtctccacttgattcttcttgcttccattcctgaaaggaagaattggacctgccctgcagctgccctgtctggggcctcctgctccctggcagcctgaggtagttggggagcacaggggccaccattttcttagagcatgtgcatcgatcctggccccttctccaactgaattcgattgcttcagagcacagcatggcctggtgggaatgtggagactgctgtcttctccgagagtttgtaatgagatcagttcagcattcacagccaggatcccagatcctactctctatagcacattgtcacaatgaactgtgttgggttggtggtaatgtctagactctggacttggagggcaaagtttctcaccagcacacagaggttagctgagctgctgatctctcaagctaacatttctacttgcagcttgagatcctggaacagagacctgcccttggccccctgtgttcggtacagcaagtgttttcctttggattccccccagaagccagccagctgtcattccaatagggcaacaggaatccctaggtgtcccagatctgtcagtgttatggaaggtggttgcagggtctcagctgtgtgctgtgcggtgcggtgtctgggaagatgaggtatgggaggtgtggatttgagacagcgagagtggaagttgcacaggtggctcatgagcaggtcagaggcacagggccagcatcgagcaggctgcatgtgacccgagtctcccctcactgctgagcctttaaatcagaagtataggatttttctatttggggagggggtggggtggggcattgtctagcacatggtattggtttctagaaagctatacttgagagtcgtaatgcttgtcacatgggtgtgcagccttcctgaggccccaggttgcctctgccattgcagctggtgcctttctaatggaagactggggttaggaagtggtgctgtcagcagctcagaggtgctcagtgttgtttctaggggttttggtgggagtccaagaatataagccttgtttctgggacaggactggggcagatgcgctcgggaaggaagcacaggcagaagtgtgggctcgttctacattgtcctagtttcagacgcctgtctcagggtctgtgctagcccactgctttgttgaaccctttccctttcttggaaggaagctcccgagtagagctcactgcatccccagtcactagcagctgttgctcttgtggggtgttgagggcacaggaagcagagagcagttcctgttggtgctgtagaacctggctgtgcatccaagtagttttcacaactcctcttcctaaacctcaatcatgggattaataatatacctgtttatttatgacctaattgtgactctgattaataaaagctggtgggaaaggcccatccaagaagccgatggccagactcacacttagctttcccacagcgtatgaagcatccatcaggcagagtattaaagaaatataatattttactgatagacctgtcctttaaaaggaacgtgtttttgggtgtcatcattttggtgtgaatcatgtaagggttggctgtttgctgtttaatacactttagtgtcaagagacgcactcagctgactttttgcccacgcatatcatgtagtctggatttttaagcgacattaacagaatagtttgtgtagagaaacctcaagtttccccagctgtgccatgagtgtatctgcata

SEQ ID NO: 30508 - DNA, 1148 bp, Mus musculus
acctctcctgagtgaaactacactggaaagaactagaaactcgtggaaagcagcccagcctgaagtcccaccctacacttgtgatgggtgatagtgaggccttctcctggctgctgttgcgcatccccttggaggagtaggaagtgcacgtgtggtgcgtgaaaagtgatgcgatgcctactgacaggacaggaggaacgtgagcacagagcatttccaactaccttcccttgcttgtcagtgcttccatggtagagtgttgtcatgccgtgtgggtggggaatggaagactggtttcttaacttgtcttctgcatttctagtttgttttggttttgttgtccttgttaagctgcacttctttctctttctccggttttagaatgctagaagaaaaggaagagccaggcttcctcactggcttaaagatccccgccccatgggctgctgggaagaccgtggaaacagtacaccctgtcagagacaactataagtttaaggagactgttcatatcccaggagctcgctgcctgtacctacgatttgacaccagatgttcgtcacagtacgactatgacaaagtaagcaggagccagttgtcactgctgcctcgacttagctgcttcttattttcctttgcattgctctccatgcctcacccatttctgcctcggggccctctctggagactccctcaggtagtgctttggctggtgttgactgaggaagttgaagagccttacctctgtgtctgactgcagtgctgtaggcgtgcagacattgtcactctaagcacccatgagcttgattgtagacagaggacttcctgtggctctgctgccttctgccttccctcttgacagttgtgtaggtgtgtggtggctgttgatctggaatggtctcactgccctcttctggaggcttcttatgtgtcctgtggaagaaggtggcttttagaagggttcagataggcctgagtctggcttgctttttcttcttcgctattatttcagacacctacatagattttgaggacttaacgacttaatgaccattcagaaagggcagggttttcttctgttgctgttgagttggagtcctgaggaaaggctgaggaaaggacacacagaccagcgctgcgcatgctgt

SEQ ID NO: 30509 - DNA, 1199 bp, Mus musculus
attacactacgtagatttagaggttcagaaaaaaaagacatatctggcaagaatcttttgtcttggcacacttcttttatttcttgggtcacttaattagtagcttagaactgttaagtgttcatgagctcattcttcgaatgctcttacaatatataaagtgctcagttgtttagatcgctggctgctcttccagaggacccacgctcagtttgaggcacccgtatggtggctcacaactgtctgtaactccagttcagcagacatacatacacagtgcacagataaacatggagatataaaacatgaataattatattgaaaatagattattacttggtctgttactgagatgactcatcagcttttggcctgctattctgtgttaacaaacctggtctcgaatgacatcactgtgacaggaaaagcgtcctgggtgatgattgtacatggcagcacccttaacacaaaagcttccctgatacccagaggcttcctgacccttcacaaaggctgtcagtgtggtccatccctctctgctgttcaccaggagtgaagagaagtgcctggtccgaagtggcctcgtgcagctcatggaccgactctgcagcctgagcagccagaccgagtccagctccagtgagaagcagacaaagaagcagaaggtggccaccatggcctgggctgccttccaggtgttggctaaccgctgtgtggagtgggagaaagaggaaggtgagcagccttctacttcctttccactccccatgggtgtgagggtgtgaggggaggtgtttattaaactaatcatctggtggcctttgctggctggcgagttcaggcgactctgccctgtagggatgatgctggctggtcatttccatataagtgttcttatggcgctaacagtctccatgtaaatacttctgagaaataactgtgcctttgtagtttaaagagaatattttcaaattctattttcagtgggcaatccaaagttaaaagttagctaaaggactcaagagttgagtcagtggttaagtgtacctgttgcttttacagaggccccaggttcgattcccagcacccacattttgactcactatatatgtaactccagtccaaggggacctaaaagcctcttctcctctccgtgggcaccaggcacacacatgatacacacacatacgtgcaaggga

SEQ ID NO: 30510 - DNA, 1098 bp, Mus musculus
tgcctttaatcccagcacttgggaggcagaagcaggtaaatttctgagttcgagtgagttccaggacaacccctgtctcagaaaaaacaacaacaaaaaaaaacaaaaacaaaaaaaaaacaaaaaaaccacagatatgtatattatgattcataacaatagcaactttactgttatgaagcatcagtgaaaataatgttgtggttagggtcaccacaccatgaggaactgtattaaaggtgctcagcactagggaggttgagaaccactgccttaaggcagtgatcgctctgaaggagtggggtgagccgtgaagccagggctggaccggccagctggggggatgtgcagtcacagctctcccttgcctcactggtggtccttgacccagcagttgggagaacaaggatatctacgccgcagccatccggagcctgcggctgcgtgagctacagaacatggagtgcgtgacagccgtgcgtgctggcctgggctccatcatccccctgcagttgctcaccaccctcagcccactggagatggaattgcgtacctgtggcctcccatacatcaacctggagttcctgaaggtaggcagcccttcaggtctgtctcagcactccgccctcaccacggctgcctgttctctggtccatctgcagcccctgtcccaccctgcctgggatcaggccaggcctgctcacacctgggcctttcttccccaggcccacaccatgtaccaggtggggctgatggagacagaccagcacatcgagcttttctggggggcactggagatgttcacccaggaggaactgtgcaagttcatcaagttcgcctgcaaccaggagcgcatccccttcacctgcccttgtaaggacgggggccctgacacagcccatgtgccaccgtaccccatgaagattgcccctccagatggcacagcaggtattgcccttcccagctcctgttggaggtggaacccttaggtcctcatggagatcagtgaccaagacccaggtcaggactctgctgtacaaggaggcttggtgagcactgtggccatgcagccccgatgctttgtcaacatttaaaagc

SEQ ID NO: 30511 - DNA, 1852 bp, Mus musculus
cacaaagtatcctgttctctctacagagtgtctccacagatgtgtgagagtcctcagtcctgccctcctgccctgagctggcatctctcccagaggcagcttccgcagggcccctccttccatcttgaagtggttgagccagtgctcaaacgttcaagagacacaagggaactcatgtgttaatcttcctgctttaccgtgtgttcctggccttggttttgtttttgtttttttttttttttttagaagtcccacagaggccccccctgtctcctcccatcaggcagccctatctgccacctgtctcttctgggcccctgggctgagtcatctgcggacacctcaggagcagacacccaggggctactccaggccttagctcacagacaggttgggtacggcctgatggctggagttgacagacagtggagctcaaggggtagcgctgagtgggcctctctacagctgactgcacaggaaagcacatgactcaagcctaccccactctgtgctcagagcctggccctcctcactacagtgctgtaaggagcccagggaagggttacaacccgtgtctaaagactgtctgaggtgctctgcccaatcagggctgcatcagtgacccaggcagagactgcaggggagtcctctgtgccctggctggcctgcccaacaccctttacacccaatgtgtgtgtgtgccagggctgagcttccttgcaggctcgcccactaccccagtgcatttgtgccccaaataagtctttgtccaagaacagcacatgccaactgtcggacactgtcacttgggcctccccagttgtcacagaatggcaacgctgtagctattgtatgatattgtgtacacagaagttctgaggagcgtgaggagggtacgctcctctctccacggcacctggcctgcttggaaggcgcgcaagctttagggctggcacgccagcacccatctcctccctgttacgcttaggaaatgcattgaggaccattacagaaaacaccccacccaaccccacctgaggaagtgatacaccccagctcagtgtgccagccacaccagtcactgggctgtatggaagtggtgcccagagcaagccctgctctcactgaagatggtggccgctgcttgggaccaccccagcggcctcaagaatcctgactccgttcgttctccagaaggcaggagcctctgaattttaaagtgggttttcattccagtaccttcaaatccgtggttcccctcaattctctgcccttgagaggacttgggattctgtcagctacctccccaggagggttctggaagcatctgttggcccattccttgattagatgacagctgtgagtgagatatctgctgctaactcagctgcttctcctagagagcacactgaggtccagacagatcccaaccttggccctgaacaatgtgtgctgtaaagttacttgatgtatatttattataattatttatgattgcattaacagacttcccattcagtctgatgctatttacactatgctgtgtaaaggaagctcactacaggaaaaagtcacaccaataaataaccttcatctgactgactgacctaagagtctgtggtcacctcctctgactgactgacctaagagagtgtggtcacctcctctgactgacggacctaagagagtgtggtcacctcctctgactgatggacctaagagagtgtggtcacctcctctgactgactgacctaagagtctgtggtcacctcctctgactgacggacctaagagagtgtggtcacctcctctgactgatggacctaagagtgtgtggtcacctcctctgact

SEQ ID NO: 30512 - DNA, 1107 bp, Mus musculus
ctcttcaagggccaccctctggagtcacgtgtcatctgactccaccttctttagaggacgcaggttgtctcaatgttctgagctacattgatgatgtacttgctacatctctaccgtttaactcttctaagcaatttttgacttctgctttaaaatctcatcatcattcttaactcatcagtgcttcagagatgtgtcacttgagcctcccaggcctggctgagtatacacacacacacacacacacacacacacacacacacacacccgaagcccagtatgaatcatcaataattaccaaaattcattgctagagagtagttttgtatttcggaagctgattttgtgagatagtagtgtgtattctacaagtgagtttattttcttgcaggagcagggtaatgcgatgttgtctttcctacgattggattttattctaagacatgaaaccaacctaccaccttttatatttttgattttagagaagttgacaagtgaaattcagagtcgggaaaacaaatgcatggccatgtacaagaagctgagcaagtggccggagtgcaacgccctttcccgacgcctccttctgaaaaagtgagtcggtgccattgctcgagagccatgagcctgtgaaggcttctgggcttctatactgatgctggcatgtgtcgtgagaggtctgggcatatttgagatgtttgcagtgtgatttattttgggataaggtttaatggttccttggcagtgatggctgaattgggtcttgaggatgagcaccgtatcatactggcctccaccccagcctctacttagaatttactgggaagtgtttcgttaggtttttgattattttgaaaagcctcagcgtctcacaatctctacattgccttcttgggacggggggacggggggacggggggggtggatgtacacggagggcatgattagaaattcagttgcagtcacggttcctcaggcagctttgttacatcgtgggtttaatcctgtgtgcatcatctgatctgattttagctcagatgactggcagttctatctgacttatttcgattctgtctttcgactgattgaggaagcctggacgccgcc

SEQ ID NO: 30513 - DNA, 1538 bp, Mus musculus
tggctttctcacatctgcttgcccttacttgctggctccctggggctataacactgccaccccaaagccctgctgggacagatgcaagcccagccctctgagcatgtgaggcaggtgcacatgctctcttgctaagccacacttctggcccttgagttttcttttgtgtctttgagatacggtctgtgtagctagctctggctgtcttggaactctatagactggcctggtttagaactcagggagatctatcagcctagcctcttcctctggtgttggcagtccttgactttttttgctcagtctcctgctgcttcctgcaggaggggctgcagcgtgacatacgcggccactgttcgcctgttgctgctgctgtccataatagcatactgccgtttcttaagatcagtctgacttgtgcttcctcccagctccttagaaggggaagtacactgctctgcagaagatgctgtgaagtttatagaggacaggataacagaggcatcacaaagctctcgacatgtccgaggcccacacctagctaagctggagctcatcaggcgcttgcggagccaaggctgtaatgacgaatacaagctgggtaagaaaccttaggtggtggtgagccctgagaagctgagaccacccccaaatcttgagtgcaggcctcattatcaatatgcttaatatgcttattacctgaacatagctgccaaagatggttgatttacaacatccatctgctgaccgtggtcggcttggctttttatattcctgtctgtttagtccattgggtccttgctgacctagtttaacgagaaatttccagtctcaccatttttaaatttctcagacagtgtgaatgttctctgcttttgcttttttaagaatggatctcactcagtagcggaagcagccttggaactccgcctttctggtgtgagctccctcacgtagctttactttttaggaggtgggagggtggcctggaggtgccctgtaactgaggagaactttaatctgcctctccctcccgaatgccggaattgcaggtgtgcccaccacacctaacccgtacttttttcttttattgtaatttttattttattttttgagatggtgcgctgtggttaaagttgtatgccactgttcctggcttcagacaaagttaaattaaataaaacagatccttttcgatcaagtgtgtcactctagacattgcctcagtctgtgggtaattgagtgccctcctctttaaggtgaccctgaagagttaatgttccagtatttcaagaagttcggggataagccatgctgcttcacagacctgaaggtgttcgttgacctcttgcctgccgcccagtgcacacaagtacgtggctggcccttggttctgctcgtgcctgaagtgtctgcttgcatgctagttcgggggtggggggtggggggcagtacagtaactgagctgcggccatagtgcttggcattgtcacatcctgtcagtcaggtctaaaaccagcagagagccacactcacga

SEQ ID NO: 30514 - DNA, 2431 bp, Mus musculus
gtatgaggcaaaagcaggtgtaggagacccaggagcaggacccttccctcagtggcaggttccttgtgccatcccacagaaccgggatggacccacagaggctcaagggagatgtggctgagtacgtgccaccacagggcaccacacatgaccacaggtgctcagttttggcttcacagccccagcagccaagacatccccagccccgctcctgggagagctcagcctcagggcagtgaggaagtccaagttctgcccactttgaggaagaaatctgagcacagcccaccgtgagcttcgtaaactgctgagactgagccccgctggtcttctgggaaaggtggaaaagctgttggaagaggttgtacgtggtgtgtgcaggcgagtctgatatttgtgtcgtcattaagtcaccttgtgcagctgattgatgagtcacacacagatacacatatgcataaatatgcttggaaacagatttactactctagtgcttttaaggggggctttgggatggaaggattaaatatgggtttaacctaggtttttaagttttaggttgaaaaaggtatgttttataatgggcctgatgttggtgtcctgttgacacttaagaactgcatcagggtgtattcatgttgttcacctaaggttggtggcctgttccctaagcctccagcttaagaggctggtctgcgagaagatgaaaactgctcttgattatgtcatgccgagctccgacagcgctttccgtgactgttttgtgtctgaatctcctctctcacttctgttcttgttccctgtcactttattcctgagagtaactgtaaggtgaaaagatgacttggtgaggactggtctttcccatggactgctccagcagcacaccattgcattctttatcgtaactgtctgggattcacaaatcagcatagtggttaactaatttacttgtaaggaaatgtgtgcaaactactttcttacttgtaggatgtgctggagcctacatcatggttgcatcagagtatcacgtgctccatccccaaaaaaagggcctttttgaataagatgggttgaagaccctgattttgacttgccttgaacaccaccttgtggtactgttctgtagttgtggcctgtttcccatgggactgggtgggcgtttgcttgcactgccctggctcctggaataatgtttcttgggatattcaaattgtgctgtgtgttcacggtcacagatgctctaaatcaagctctgtcagctgaccatggtccgtatggactgcatgggctggctatggccctcaggcatagctccttcctctaatggtctatcctgtcagtctcctgctctaacatgtagggcctccactggtcttgttgacaaataatgtcatggtggggttacacttcctctgttacttgctgattttcttactaaatgtagcatttcaatcagatctaattcttacattttgagataactgtaaaaagagtgaaattatgaaatggccaatatcttttatcagtctattcttttggaagctgtcatgcactatacattgtgtacagttaaaagtatatatatatatatattcttactgagtgaacgcctcctctccccacgcctgtatgtcactagcatctaaggagaatgctcaaggcccagtgctgctgctgctgtggtttatatgggttttgttctgttttgtttttgtgtggtaaattgatatttaaaaacaacaaaaaccacgactactgtttacagactgaaaaaaaacaatcactgctttttatactactgagatcctaagtcaagactttgcaaagcaggaatcgggttcaagttacttctttgctgtggacggatagtcctctgtagtatctccacatgatggagagtgcacaaacctaggtgtgctgccatcaattttgtatattttcataattttaattgttcgaaattgcattatattttgcaatcaccacattcaatctgtatatgtctttcatttcaactttttcaatacaaaaagggattcaatttatctgcaggtttgttgagactcttcctacttttttatgtgatttattggtatgggaaatcttctcttgagaactaagtgcaggcagaaaatcagctttaactggacaggctaatttacataaatgtttttattttaagttggcacttttcctggttcgtttttgttcagtcttaaaagttagagcttccaaaacagtgtatctcatctcagttctgtactagccctaaatatgggctagcacgggacactcctatagatccagctttaattaattacacattatttggggttgtgcacagcacattatgttctgggggggtaagaggagggatacagctttattcattcaactctagcttctctgtatcccacaaacattgcat

SEQ ID NO: 30515 - DNA, 1338 bp, Mus musculus
gctgaacatggagctgagtgagaagtacaagctggacaaggagagctacccagtcttctacctattccgggatggggacttggagaaccctgtgctgtacaatggggcagttaaggttggagccatccagcgctggctaaaggggcagggggtctacctgggcatgcctgggtgcctgcctgcatacgatgccctggcaggcgagttcatcaaggcctccagcatagaggcccgacaggccatcttgaaacagggacaggatggcctcctaagtgtgaaggaaacagagaagaagtgggctagccaatacctgaagatcatggggaagatcctggaccaaggtgaggactttccagcctctgagatggcccggatcggtaagctgatagagaacaagatgagtgacagcaagaaagaagagctacagaagagcttaaacatcctgacggccttccggaagaaggaggctgagaaggaggagctgtgaccaagcacaagggttccccagggtttgccaggggcaggaaaggagagatctacctgccagctgtgggacccctgtgggtggaaggggcagtggagcaatgcaggcctgagccagaagtctgtgccccgagtgtgcctggacattgatgctgctgagatcatacttaggacaccccctgagccagtctgtggagagcctgtgtgctcagtcaagatggctggtgagatgccccccgcaggagttggtgctatagaggtagggactactgccaggtccttgatgagtgtaattctgatcaaataaaaagtctgttttggttagatggttttctttttagataatacttttagcctgtgatcagagttcagttttgagtgtaagctgctgttgtgcactctattctgcaagacccttccttgtacgaggcacagccttacgtttccatggccgcccatgtatggtgagatacagggtgcagtctatactctgaccttatgtgaacaagcaacagggcatcatgtttcctatctctatagagcaagcaaattcttttactaatgtactgtctttagaatttatgcaccgaaagccaatgcggtgacatctctgttttgagcactagtggggtaggcacaaggattaggagtcaaggtcagcttcagtgatctgaggaccagcctgtgctacataagactgtgtcaaaagcaaagtcacatgagcattcattccagttccaacatgtaaaatataagttactctcccacaaaaatcacttgctataaactcccagcttttgatccgccagatggggactggaactcctcagcagatacaagtgtgctcgacatagt

SEQ ID NO: 30516 - DNA, 1175 bp, Mus musculus
cctcctgcgacatgggaggccacattgcctaagtgtccccgcgggcctgaccagagctgcaaccgggggtctacaagggcaggacagcgactaccagtgacaaacagctgactaaccgagggaggcggcgggtctcttgagaccgcaggaccgcccagcgcagggaaggaagggacgccgccacgtcttcttccgaggcgagagagagggcaacgaggggaagggtcgaagcggcgcctcccgcgagaacgcagcggaacacggcctagccgagtgtcgccaagtgcgcgtgcgcgtgcgcgtgcgcgtgcgcggcaggcccgtcccgtcccgcgaccccgcccgctcgccgctccgcctacgacgcatgcgcagccgctccctctctctgccccgcccctccgcggcccctcccttccaccccggaggcggccggagcatctcgctctggcggtggccgcttgcgttcatgcgcgccgccggcaggacggccctccccgtgacgtgaccgcccactcggagcgctccgcctgtagcttgcctgtctctcccgctcccaccatccggcgtgatggccgccgccgccggggtgtctggcgctgcttctctctccccactgctgtccgtgctcctgggcctgctgctcctctttgctccgcacggcggcagcggcctacacacgaagggtgcccttcccttggacacagtcactttctacaaggtaatgagggcggcgggcgacggggatcgtgcgcaggtgcagatagacgcccgtggcagcgcgagcccacggggacgttgggcccggaggggtggcagcagcaggcagtccttggggaccatccctacacgccccaccatcctataggcccagtgtcgacagagcaggggcgcaccctgaccacccggcatccttgcaaccccggtactcgctacatctgtttttttacaaaaagctaccaaagcgcagtcaaagggaaccaagtgtcccttttcctttatcaactggggaaaaagacaatgataggaaagatccaatccacgagtcacaagtggaagaccggagggcggggcgaggtctacgctcctaggctctcggatggggtggagatggccgagagaactgggttagcatgccagtctgctcctcggaggatggattgtagcgttcttgg

SEQ ID NO: 30517 - DNA, 1161 bp, Mus musculus
cacagcatgctttatatttcccttcgtctgagatcacctttttattgccaagtaacaaatgtggacactagctgccaaagtcaggctcagtgacacaccacacccagcacttacttgggaagcttaggttggcaagtcatgtgagttcaagatgaacatgggtaacagcaaaaatagcaaagtgcagcaggcaaggcagccttggactgatagcagtctctgcatgcaggcggtggttgcggggatccagcaggcgcacgccgagcagctggcaaacatgaggatccaggacctcaaggtcagcctcaaacccctgcactctgtcaacaaccccattctcaggaagaggaagctgctggggtgagtgagcgcatttctttgatcgtcttcatggcaggcgtggctgatggtgagtgctgagagctcagtggggagtctgccttcatctgctttctgcagaaagtgtggacatttaaattacccaggagttggacacattctgtagttatttttctgaataccctggtgtcgtgatttggagctgggttctgaggtcttaccttgctcttgtctttcccacatttgtaaagcaccaagccaaaggacggtatttatatacacgaccatgagaatggaactgaggactcaaatgttgccttggaaaagcttcgagatgtcattgcccagtgtatcctcccccaggctggtaaaggtcatgccacttactaatgttctgcgtgtgtgtgtgtgtgtgtgtgtgtgtgtgtgtgtgtgtgcgcgacaagaggattagattagcttgtgatttgttttttaagtacattatataaatgagtccacattactaggaaatacagacactgtgagcagatacatggtaagttctgtatctttggtctcctttgatgctctaggttaggcttaactgccagtgccagattgtggcccgtgattttctgtcgtcttagtctcacaatgaagtcacaaagtagagagtgaagaatggagatgtggacagggtccaaggatagcgtagaggccatcagcaccatttccagaacctttacagtgacacactgtgtctcttgttctgtgagtgtaaaaagaacactgcacaagctcatgactagccctgctgtggcttctgtcccggccttatgc

SEQ ID NO: 30518 - DNA, 1099 bp, Mus musculus
aggtggctcacagtcacagtagtctataactctagctctaagggatctgacaccttcttctgcctccatagcgcacacgtaattaaaatcaaataggtaagacaaggggaaacacaccattaagctaagctcttaggaagcagaggcctggaactctgtgaattcaaggccagcttggtctacaaggagagttacaagccagcctggactacatagtgatacttgtctcaaaaaaacaaaacagaatccatcatatctttgcaaagcctatcaatttgtatccagtgctcagagataattgctacttattcaaaccaccatcaccacataagatggtaagttgggttttatatatttaataatttttgttaaaaaattggacacttggtaacatagtaactctggactttcactcttcccggtatttgtagctgcctagaattaaagggaagtttattttccttgtgcatgctaatgtcagatcagggctgttgttcttggcctctgagtaagttagcttctgatgtgggctgagactatccagtgatttgaactcctgaggcttttaccccctgccattcaacccctgtggttctggagtcctttctgaatggagttgacttgcaaagtcacttctggccttagattttccctggcttctcattctctccagtccatttatcagttttgtggagagctcactttggccttattctatggctctgtgtagcagtttgccctctaaacccatatagtctgcattcctggccaggactcttctctgagctcagcacagctgccccttctctcacacatttacctggtctcacctgccctgccccccttttcttccctgccccctagagcaccagcattgttacctttcacacaagctctgggagtttaaagctccctgtattctaaaacgaccccaaacaaccccactaactgttttgggggggttggatggaggatggaagctggaggagccaggctgtgtgctggcttttgacctcacttctagtgggtataaaaaacagacagttctcagtttgtttatactgtttgacaattgacactgtctcactgtgtagctctg

SEQ ID NO: 30519 - DNA, 1199 bp, Mus musculus
tgtccgacgctgacagtaagttccgggggctgcagcgaggcctcggctccagtgggattggtttggggcctgtgtggtctgacattgacctctctccatagtagctacctgttctgtcattagggccagcctgagccctgtactgcccacgcacaggcccctaggccaccatacctcagcacgtcctctctacgagacacttcctttcctctgtctctttctttaaaaaaatatatatatatatttatttatttactttatgtacactgtggctcacactgtagctgtacagatggttgtgagccaccatgtggttgctgggatttaaactcaggaacttcggaagagcagtcagtgctattaaccgctaagccatctctccagcccctccactgtctttcacagttgacagtcttcagcaagggaagagggttctgtttcattctggccaggaattggcctccagcaggcactaacccctgatcttgtgaacagggtttgtgggtgagcattactggtagttaacatctcctcgtgtcacctctctctctctctctctctctctcccatcccacagtggactgggctgtggagcaggcccactttgccctgttcttcaaccagggccagtgctgctgcgcaggctcccggaccttcgtgcaggagaatgtgtatgacgaattcgtggaacgcagcgtggctcgggccaagtctcgggtggtggggaaccccttcgacagccggacggagcaggggcctcaggtaagtcaggcagctgctgctgagcctggagtccaaagccagtgtgccaaagcagaaaggaccggatggcttagccttggtggggctgggttcaagtgtctcctctgctgggtactgcctgtgtatcctgttaggggagaccccagctcctgtcttgagtcctattatttcttattcttcatagaccatggaaggagaatggccaccaaacctgctaaggagccactcccttaatagcctatgttttttgtgttttcattttgcgaatctctgaatttaaagaaacaccggggtatgacgtgccttgcctagtggtaaaggatgtggtgtctctctttggcattatgcttctgaccatggccattttctctttgactcttgctccttaaaagacctgcgtctcccttccagctacctctggctgtaggttctcagcc

SEQ ID NO: 30520 - DNA, 1173 bp, Mus musculus
tacagcattagcctacacaggagcctgttcccatagcaacattacccatttcctatggtgggtggccatgatgcatgtggcttgctgtgctatccggcctcttatgcaggggtcctagacccaggcaagagctgccctaccaggtagtggagccaggtattctgtcccgggttctttgatgcccttgttgctggcggcctgaggatgcccaggtctagctttggtccagttgcccgcagcactgtatccagcatccaccccgacagtcagtttggctttctgttgtcctcctagctcctcatcctgtttttctttcctctgccttctctgcaggctgcagctttagagatggccatgattaaaatggtcgtcccttccatggccaatcaagtaattgaccgcgctattcaggtgagcagccctggactggcctcccgctgtgcctgctaccttcttttccaaactgagctagtcccctccccctcaagctccccagctcccaccccagccctcccggaacagtatgtcccttgttcagtgcattctacttgcaagtagtgagacagctgttgtcagctgttttgagcatgcattcactcttagaactccggctttcttctgttttccaccccatgtcttccaggcctttggagcagcgggcctcagcagtgactaccccctggctcagttctttggctgggcccaaaccctgcgcttaggtgatgaccagctgaaggtggctaagatggaactgaagaatcagtccaggctgcaggagccagcagcacgcagagtgtagatgctgagtttggcatggcctgcaatgtgtggtcctcacatcctatccagcagctcagtctgcgacagtcactgtgacctgagcctcctggggtctcttcaagaagatgtttctggagagactgagctcaagctttaggcgtggaggaaggggatttgggtgcctgggtagctgttcttgagttcttcagatttgacctgtgacccccgccccttcctctgggctgtaggaatctgggcaccttggactctgatgtctccagaggccattaggctcctcctttgtgcttctaggaaagcagggggcgtggtgcacagcaaatgcccctgggatgaagccactgtgtgaccactgatgtgcccacgtcacagaat

SEQ ID NO: 30521 - DNA, 1174 bp, Mus musculus
gtgcattcttcttgcattagggggcctcaggcctaagggaggcctgttcctgttcacacccagtgccgactctgtggggtacacatcctgacacttggtcccacacagaactttctcagtagtggaagcaaaccatggagaatgggcttggtgagcagggcatccaaaggatgacaatatggccctatgtgaagtctgggacacatagtgacacagaggacctcagtcaagacagcagtcgccagctgttttgagcagcctgccacttttagaactcagactttcttgtttttccactcttgtgtctccaggcctttggagcagcgggcctcagcagtgactaccccctggctcagttctttggctgggcccgagccctgcgcttcgctgatggccctgatgaagtacaccagctgacagtggctaagatggaactgaagaatcagtccaggatgcaggaaccagcagtgcccagagtgtagatgctgagtttggcatggtctgctatgtgtggtcctcacatcctatccagcaactcagtctgggacagttactgtgacctgaacctcctagggtcttttcaagaagatattctctggggtctcttcagagacctgcctgcctctgctttccacgtgctggaattaaatacatttgcaactatatcctgttctgagctagattttttcttttctttttcttttttttcttttttttttttttttttttttttggttttttcgagactgggtttctctgtgtagccctggcaggcagccctggaactcactttgtagaccaggctggcctcaaactcagaaatcctcctgcctctgcctcccgagtgctggaattaaaggcatgcgccaccatgcccggcctgagccagattttctaaacaggcttatagtcatgagtatgtgtgtgcctaccaaggccagaagaaggtgttagatcctctggagctggggttctaagtgcctgtgaatagcccaatgtgggtcctcgaacctaccctgggtcttctgcaagagcagccagtgcacttaactgctgagctgctcttctctccagacacacacatgaaacgctgcccctcagagcagttgaccttcatctcctgaatctcctgcctccacctcccaagtgttagcattacagatgtgacagcatg

SEQ ID NO: 30522 - DNA, 1488 bp, Mus musculus
gcctcccagaggcccagctgccttcaggagaggagcccactgcccactgcagaaggtctttcctgccatccctccctcccttctcctgcagagtagaagagagagctgcttgcatgtcatagagaaagggctaggttgtaaaccaagcacaggcttgtcttcagcagcctggcttggggcaaatggagtatacccagtttagggaagacagtgacagctctctttatttctgatgactccatccgaaatgtgcctgtcaataagaaaagccttcctggctccttctcagctcaggtaactgagagtgtcctccatccagcaggattcaaggggcaagcctagctagccatcgagaggcctctgacaagctgactgacttgtgttgctggggtcagtggatactgactgtttacaggcagggccgcatgttcaggtcgcagctagagggagcttgggcagatttcagttactcttttatgatcgtttcaaaggctgcttctccagaaactggcttcagcagagcctcttccaaacagccatacaatatttaatatgaccaacagaggggctgtgtgcctctctttagagccaggaacatcaggtaacttgtaacagattaattgaacagacttgaggggacaccatgttgggatttagcttctaaaagagcctgggcagttgacagctgtgtgtagtaaggacagtttaattttttgctttatcatcagccaaaggtttaaaatgtcacactttagggacttttttttttttttttccgactgactggacctcgtcctttgaccggaatgtctgacatgtcaccacgttgcctgtgttgctgatcaccgtccagttcagtggaatgtgctgtagcatttcctaaaaccccacctgtgactgcagagtgagagtgctcagactcggacctctgtagccggctcttcctcagggcaggccagcactgcagatcctccggcccgagccacacaggcggctggggctggggctggggctggggcagagccgcctcttccagagcttctattttatctagaacgcgttacacactgttacagtcttaccggctcagccctgcttgtcttgcacatctgaccttgcagaagctggggtgggtggtagcatgctaattaagagaatcagaagtagtttccagagctggctccccttttcatcacaacccacccagcagccctgctgcccagaggagagtagcagtgcttcaccacacaggttgggggaaatgcctgggaaggctgtggccagtggaagcagccgacgggcagaggtttccaaactacttgaaggtcttttaaaaatgttccaggaaaacaaaaatcaagatgtgtaaataaaatgttattttaaaaggtcaaagagttacgtttgagtctgaaattacccaggacggaagctgttagtatattcttcagaacagagatggagccttcaccacactcccttggccaa

SEQ ID NO: 30523 - DNA, 1193 bp, Mus musculus
ccctgcagctgttgtaatcccctcttcccagcgtatcaatcctgctgactccatccttgggcagtgctagttcaaaggagtcttaaatgccttccaaccctggaaagagggattactacataatagtcatttccaggacaaagttgggtaatttttttttttttgtaggtttgttgattagtttgtttttctggtattgatggtatttctgaggattgaacccagggcctcatgtatggtgattgaggtagaggaaggaagggagggagggagggagggagggagggagggagggagggagggagggagggagggagggagggagggagggagggagggagggagaagagagcatttaagttgcccagggtagccttacactctgcatgtgttccaagaagcctggagctcatgctgcagtcaccgagtgtagtgttctttcagtttgtgctgtgttgtgaatggtgtctgttctctcagcacagaggtgtcctgtcatctctcattgtgataactgttacagggaaactgaggccgaaggatcaggagttcaagtcagaagcacaaggtcatcttgagctacatgacaccctttacccacctcccctggacccccatctttgcgcaccacatgccttctgtagctacttcctacctgtgttgctgccatagataaccatggtgtagtcccaaattcagtcagggcactgtgatgtggtgaaacttctttcatccatctttgctttccagcaaagctttacttcattggacttgtggattgtcctgaagtagaatttgcatgagctggaatggaagtacagacatgctcctcagtgcctttttaaaggctgtctccaaagataagagtgtgttctatgctagggcattgtcaacgtacgggatttcatacttgtttccctagctggtattttacagttaacctagaggagattctctcccttcacagaggtgaaagtgaggataaacttgttctgtgtataaatggagaacctcgtgcatttccacaggttctgcgtcttaagctgctgtgacaggaatatcaactgtttgtgtcttctaaggctcaacttagaaagtcctgggaaagtagccatccctgcctatgtgattgctatatcctcatactgctgtgctgctactgaacaaatggaggtgctagacaaagacacgaa

SEQ ID NO: 30524 - DNA, 3185 bp, Mus musculus
acacatgcagacacctctacacgggagcacacacgcgagccttagagcagggtggcaggcaggccttcagtggctctcactctgagggactgcactaggattgttggtttgcgggttagcagtgtcccagctgttgcctggttgcctctgtctgctgtgattcctgagcttggaccttgggctgtggtgcaggagaactcaggctctagagtagcccagaccgtctggggcttcccttccttccttcctcccttccttcccccagtgtaaaggctgagcttgaaagctgtggttgctgagagagccagggcagcctgggccatggagaggccctctctgtagctgttaacgtaaggtggctggatcagatgtctgctacttttgatcacagttccctgaggtgggtctcacttagaagagttcctgaatgattctatttcctgtctcagtgtgccagtgaggctctggcgaggtgtgagctaacgctgctgtgtagttgggtctcttgcagaaggctagcttgttcctgtccttcccccagagctgagagtgtagaatatgctcctgttggctggcggcagtggggagggtagccagtgtggtcagtgtgctttggtggagtgagacttaagagaatcagggtcctctaagtgtccagcagaggctgtgaatttatgtgtaagatgagctcatcccaaacctcactcatgtatttgcataagagagtaagaggctaacagggaaagcagagagccatgggcctgtttgaaggtgtgaaccagtgcttcgctggggtgatggtctagagcaatgcacaggatgggaggcaggaagccgcctcttcctgctctgcccactccctgcagagccaaggttgagattaccgaccaggtagctaacatcacctttctaacttaaatttgctgccatttggtactgggttgacccagcttcagatcactctgtcatctcagtggagccagtgactcagcctttgctccgtcagttaagcttttaaagtgaggggcctaagtgctgcttcaccctacttttggggaacccactacaactggggaagggcggaagaggagagactcaggaagctgctgagggtgctggggaggcagtccccttacaggcccttgtcagttgctttctgactggaaaagggcattgatatatctttggccatgcaccatagcaagctaagaaagtgcccttcccaccccaatagcggctgcttttggtgaagaccttgccttgtgtggtatctgagcagacgagttggggactaggaggcaacttccccatcttagccctgctggatctacctcaaggttacccaagaagtccatcttgctccttcaagagccctagtccaatgaaaggaatagctgacttgttgtttaagaaggagatgttgcctgtatgcgtaaaagagctctctgtttcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccttatatgacgcacccttcaggtgaggcgtgtgtgtgcaggggccgccggggcaccccgagcgttctgctcgcagaggtagaatggcaggcaggaccagtgcttcaggctgcaaacctgactagcgaggcccatccaagtgtgcacaggagggatcgtgacggtcaggaaacatcaggctctgtgtgtgttctgctggttcagggttggcttgagaagcagcagcctcattctgggtagccgatgcatgccgaggactcagttggccttcctggttatgtatgtatgataggctggacagggcagcgtggtccgtcctgagtcctttataggctgatgtggggggtttatgcccatggccaagtttgatcgtagcttggaggagagcactggtgaacacgtgctgtgtgcggactggtctgagtgtagtgttagccccagcctgtgccctgacacaggacgcccatgatgtctcgtactgatggctgctgtgacgacacctgtcttccctgtgacttggaaagcagtggtgcttggctagtgtagtgggagggggtgtgaaggcctgctccacaagcagcaagtccaggacttgtatctgaagtggtttacgtctgactggtttgtttctcctcacccccttccctccccaaccctaccttggctgcagttgggggagaggggcagcattaaccctccagtcttactcactagcacaggagtagttgacagtcgtgtgctgcggacactaggctggcgggcagtggtgcctgtgttgtttaaatagccacttttcttttttacagtacaagcccaccaccaacagcagttgtaaggctgccctggaggaaccgaaaggccaaatcccctcctcccttctcctgcttctgccaaccggaagcacagaaaactagaacttcattgattttgttttttaaaagatacactgatttaacatctgataggaatgctaacagctcacttgcagtggaggatgttttggaccgagtagaggcatgtagggacttgtggctgttccataattccatgtgctgttgcagggtcctgcaagtacccagctctgcttgctgaaactggaagttatttattttttaatggcccttgagagtcatgaacacatcagctagcaacagaagtaacaagagtgattcttgctgctattaccgctttaaaaaaaaaaaatcaagacttggaacgcccttttactaaacttgacagaagttcagtaaattcttaccgccaaactgacggattattatttataaatcaagtttgatgaggcgatcactgtctacagtggttcaacttttaagttaagggaaaacttttactttgtagataatataaaataaaaactaaaaaaaaaaattaaaaaataaaaaaagttttaaaaactgatacccagttagtgtgtgtttatgttgactcctgctgctgtgggaggtagaccccagggaagacaggctggttgtgctgctccaatctctgaggaggtgctgaccaaatgacttttcttcttcacctttagttctggctcaaggtatctagaaaaagtcaagactg

SEQ ID NO: 30525 - DNA, 2195 bp, Mus musculus
tgaatggaaccattttcctcccctccagagaactataggctgctgtcagccttccccagctcagatgtgccccgcttccaacacacacaaggctgtcacaggcttcctgtcagccagagctagcccccggctttctcccactgtttacagatgtagttcttgtgcacaggtgccactagctggtaccctaggcctagtccccaacccaaaaggaggtggggctacaggcccagagctggcagtggaaactgacagagctgatgacagacttcttaccaggcagggtcatcgggaagcacaaaacactaacagtccctggattctcacatggtgtccttccctgtagcttcagatctgtggcaagtcctcatgggttccatgccacaggcgatggatgcttcatgatcctgctcctactcttagctttacgacagaagctctgccagagggacaagcttaaagatcaaaattgatttaaacattttacctcagagtacttttttttgttttgttttaaaggattcaggtttccatttaatattaaagcttattcactgcactgccctactaggacccccctgtcactctgaagtcgggggcagcgaagcacccctggttcgcttaccctgagccaagctagcatgctagtgtccttgtctgctccctcaggacagttgcctgctgtggggtagccactgtcctccctaatgtagagaatgaagtgtgtcaccctttcagggaaaaccaggcagcttgcagagaggagggtggcaagggacattccactccagtgccttatgcattaacaaaaaggactctgggttacagcagctttacagaggctgggaggtacaggtgggcgaagggcttgaggtcatctttataccctctacccctgaggttggctcctctgtgagccaaaaaaggagctggcactgtgttgtgtagaagctctgtcccaggtggcagcagggtccccatccatacaatctctccatccagacagtgccaatactgtgattgttcctaagggacaggatcacagggagtgggtagtgcttgcagcagcagtggctttagagaaccacaacttaactcctagacatgttccagggcaaacattccgctgccctgctgaagccagcagtactgacctcctcctctggttactctgtactctgcaggggtgtgggctttggggagggaagcagctgcacctcctcttgaacactccccattgtgttcacggaccgaggtgggtccaacacaggtgcagattcgtgttccatctttaaggtaacttgctttccttcactgcatagaaggtatgaaccaaagatataagcaatatccaaccagtggtccagattcgcctctaatctacataggatgggtgcacagctgtatcccttcacctggcagaagctaaactaacttcaaacttggggcacttgtttcccctgggccttcagaagagagacttgcccgacgctgtaaaccagcacctccacccccactgtggacagcttcctttcaagaagtgtctaagataacagaaaacataaggcaaaaaggtattctcgtgactgtgggacagagtgacaacactaagccaacacctttcctttctgctagagtaggtccagttggctgaaggggacgggcaggtttgcgaagctccaggccagatgccctcccagtgtgttggcaccaggcaccgttcccaccccagcagtctttactggccaccactggctcgacagtccccgtacccttgcttccttctcctgagtactcaactacaaactaaaagtcaccagcaccaaagagttgggtcaactaacctgccttgactttaccagcaatccatatggctttatctgtataaatcttctgcctctgatcatttctggatggtgtaggagaaaggaatagggatcattacaatctcgggccacacaacactatctttacctaagtttcttaaagtaaggcttcaccccttccctgagggctcagtctcttgtttaatattaccttggtgcaaacaccaagtgataaactgtcacccactgcctcctagtgaagacacatctaatggccagtgtgtggccggaataagcagcattgtcaccacagaaacagggaatctcatcttctatcattacagcagaaggtatttggcaaatcttcgt

SEQ ID NO: 30526 - DNA, 1184 bp, Mus musculus
ttctgcttcgtctcacatactagattttataggccactcagcctgacttatttttttcctatgcagtgtgtgcatacatacagaccaaagcacacgtgaggaggttagagggtagttgggcgtctttgtgtggattctggggatcaatctcaggtcaggcttgcaaagcagattttctactgactaaatcatctcaccagcttccctttctccctcttttaattatttttttaaattttctgtatgtattttgtttgtgtgcatgtgcgcgcacatgcatgcaccgtacgcatgtcttacccttatgaatgtctgaaaagggcattgggtccttgggtattggagttgcagatagttgttagctgtcacatatgggtgctggaaatggagcccagtttatctccaagaacatcaagcactcttagcggctgaaccatcacttcactcccccagcacccccttttcttgttggtttttttttttttttttttgtctttgtttttcgagacagggtttctctgtatactctgtatacagagtttctctggaactcactttgtagaccaggctggtctcgaactcagaaatccgccttccgagtgtgggattaaaggcgtgcaccaccacgcccggcttcagcaccccctttttaaatgagacagtttcattatgtagcccaggctggtctctgtctcaactatccagagtactgggattaaaaactttttaccacccctgtcttctcatagtttcttaatagtttttaagttctgagactgggtagcattgtgttagcaaaggctggcctggattttcagagatctatctgcctctgtctcctgagtgctggcattcaaagctgaactaccatgtttggcctggtttattcttttctgttgaacttaacagagtaagccactgtttaaacacgttgagaatgactggctgggtggtatatgtatttgtttctaacttatggacttgcttgacggaagccacaggatctgctcaggatgcgtatagttctcaatcagaggacgctggcattggggttgtgatgatttcaaaacctttaaatctagagatagctcagccggttttggctcttgcccttaatcctgaagtcctgatttgatcctctggattgacatgagattcaggagagaaccagactttgagggttg

SEQ ID NO: 30527 - DNA, 1148 bp, Mus musculus
ttgcccacgtagaggagatcagtgttgtcatgcatgacagcagcagtgccccagcgaggtgggagggtagtgggagacagtggggagagccatgcacttttgctgttggggggaaaaaggagttgttgaggagtttctttagcttgcatgttttgtagaaaataattcagtttgcaagaaagtgttcagtgtggcgagtactaagtttgtttggtttgagatctttttctacatgtttttaaaataccttgaaggtagtctttcaccaaggaatgacttaaatttgttttttatttgttgaaaaaaaaggtctcatcactatgtagatcaggctggccttggactcagatctgcctacctggggctagatgtatgcttggccttggcagtggctgcttaggtaaggttgtggtcagacagcaagggctgctgactcgccccttctgtgcagctcttagctccaaatcacattgtaattcatctagggctttgtcctgtccttttattacttattttttaattgagatggagtttcctgtgcctcggctggccaggagggtctgtgtagatgaggaccttgaactcccgatcctcttggtacacagcccagttttaatgctggggcagaaccccagggcttggtgcattacgagccttgagggtgctaccaaccctgtggaggcttttctatccctcagtacatctccttggcttccttctgtcatgctgtcttgcttgttgctagactgtggaaagttactgctgcctagagaggtgctagggctgcagactaccagcagcagcagtagactaccagcagcagcagtaacctgattaagctcagggtttatgaactttggggtttgttgtcagtgagatttttagtgaaatttctctgtgtgctgatgttagtgatgttccaggtaagtgcagtatctacagaacagcctttgttgttagctgccagccgacctaaataaatgtcccttttctaggtacacacaagagcctcattgggaacagcaggctgacccagcaatagtaagagccagagaataaggttagatggacaggtcctgggtgttaattgtgggaaagtcatattgcttgatactgagagctaaagtagatcttgccaatttggcagc

SEQ ID NO: 30528 - DNA, 1128 bp, Mus musculus
gagcagtagggcgactgtctgcgttctcacaggtaaaagaagatacaacattaagctgtggaaaacgttcacagactgttttaactgcttgccgatagcagccatcgtggacgagaagatattctgctgtcatggaggtatgtgacatggaggtgttgccttcacctaggcagctctaccccttctgaaaagtcagctgggcacggtgaccctggccaggccactgtggtgccaaggcttcttcacagtgatacagcccggtcatttggatcaagtgtgaggaagcaggggttataggttgggaagagaacgagactttaaatacaggacgagccctagtgccctcttctcagccatgtgtctgcctgaaccctgactgtgctcttcccaaaagctctgctccgttcctcagctgttctgtgtgtgaggtaataaaggcattgcaaagatgtggaggtttgggggtgattggaaatgaagcagctatccaaaaacccacataatgtattaaggcgtagtctctatgccctcttggatcgggtacttagagaacaagactgttagatctgttgagtgacatttggtggtccatggaccacaggctcggaaggagctgcctcacagctgagcattgtcgtgcctgtgcccggccattgcatctggtgatggtggcaccctctgtgttcccttcctgccttctattgggagaagtgtggattcagtggttgggtgttgcggggctctgtgttgaggtgactgtctctgaccagcacaccaacagcagtacagtacatttcgtgcattgtttcccccaaaaccaagttaaaaacccacaggtttcaccgcagcatggcagtgccagcctcctcagcaggaggggctggccacatgctcaggccaatgctgtctgcacttcagggggtttcctttctcgttgaataggtttatcaccagatcttcaatctatggagcagattcggcgaattatgagaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctcc

SEQ ID NO: 30529 - DNA, 1157 bp, Mus musculus
gtcagcttgcccaggtagacctgtctgtcgggccctcctccatttgattactgctggcacttgctggttatagcagcaagccaagcacttcattctcaagagagcattttgttttgaacctctgttccctttgtggacagctctgatgatggtgttaagctgtacaccctggcaggttatcctgtctgaggagaaagtgtacaattgatctttttttaatttagtataagtcatgaataatgtaaatgcctgttttctttaggatataaagagagccttagagtgcgtgagtctctacatgtaattgtcataaatgcattctgttgatacaaaccactgtgaacaattttttttccagtttgtttgaaagggactgctttccctcattgtcttgtcatgtacaaactagtgtctgcagctgtggcagcaggagtgacctgcctgccgccagccctgcccagactatctgaagcacactccttcccactgcacatttaataatgattaaagccattcttttcaatgtctgtgattccttcctaaagccaaagtttctgttggactgtatggcacgccctggggatgaggtggccagggcatcgaggctgcgtgcacaggccgcctccctccgtggggcctcagaagcaggttattttaactagcaatagtggtatagtgctgagtaagctattaatgatggaagttaatgacactttgtacagttcccatatagtctattcactgagtgatctttttacagttggatcaggcctgaacccgtccattcagaaagcttcaaattatagaaacaacactgtcctatacgagtgaccgataatgctttctttggctacattctttattctgcggtgacattgaggcttataaatcaaaaggaactaacttgccgtccaccggtttatacagaactcacagtatctatgacttttttaaactacgacctgttaaatgaatctgtttgcacagatgcccgtgtacaatgccatgtgctgagaatggtttcagacttattaaatgcaagcttgttaacttgttcgtgtctttctgtcagcagcggccccacgaatcctttcctgtctttccatatgcagtccttttgggaggggcctgggtcttggctaagtagcctggcagga

SEQ ID NO: 30530 - DNA, 1099 bp, Mus musculus
tctgtgaggctattgtcctattgctgtgaacaaggaagctaagcacagagctggaccgtagagcatcaaagtggccgagcccctggggttcagatcatgctgctgagtgtgtgacactgctaagctgtttcgggattgggtgcaggactgtgctcatgccagcaaagtccctgtcccagtggcacaggcagagccatgtagctcactccgggtctctggctcctaaccaggggttttatctttcagtctgacttgcatctcttacggtcttctcacctggcttccttcagggagacctgctagatgacaatatgtatgttttcagggctgtatgactctcagaaagattaatttacccagtgcctccccagagtaagagtgagcaggttgcctgtgtcatcttcttacggttcttgttaacaatctcagaggactggctgctggcaggccatacttgggcatgctccatttgtttctcggtgagctgtgtgttcttctggtggaggcaggtgcaatttttgctgtagtcagccaggccggagactgtgggccttgtacagcagtggttgcacgcggtgcttgctggctgctggcaaggtggggcttgtcctcctgtgcaccagtctctggaaagtgaacaggttgatctttgagccacttgcaaaaattggtcctatggcctcattgtcatcagtctccagaaagtgcttcatggctacagcagagggcagcctggttttggaggctgggtatgtccctgtctgaaacatcagtaaatttagtgaagtgtcagctgcaggaaccttgttccaacgactaagtagtaagacccagtaacctgctgtggggcctggcactcgtgtctacaggaggaggaacatggtgcaccttgcttaccgtgctcccacaccccttgtcctcagcacctcggggttctcgggtgtggggcaaacctggatggagctgagtgctgacgggcagcagcccgggggagacagtgagcggatgcccatgttgtttgtaggtagcagcacagcctgcatcgtggtgctggacagaagtagccaccgcttgcacacagcgaacctgggtgactcgg

SEQ ID NO: 30531 - DNA, 2570 bp, Mus musculus
attcctgatcctccccacactggagcttgcagctttgactctccagtctggagcatcagcagagcaaacccacagagctcttgtcttcagtgcttacgtgagccacatctctgattgacttttccttcaagcacactgataagtgtcatctgtgttttaggtggaaagccagatgacatcaccgtcctcctctcaatagtggctgagtacacggactgatgggccacactggtgactcctgcctttcccctgtctcccgacttctccctgccacatgtgctgatcctgctggcaggaccacatttctttgccactgatctcagtggccaatgatggatgctctggcccatgtttgagacccatcaagatccttgttgagaaccactgctgtcacccgctagcccgtacccactggtgacccactgagagaaaaagcgaggtgacctctcccttctcctggaggttttcaaagtcttttacttttcaaaagcagttgaagttttgaaaagaagtaatgttggtaaagtgaactcaaaatgtcagtgtgttaaagggatgttaacattcaacaagtagtaaatagcggcacctcggccaaaaaacacgcggatcatcccaggagaagccctgtgtcccccaggcgcaggctctgcgaggactgctggggctttgtgttttctgtttgccaggagcccacagtcctgctctatcctgtgctgggtcatgacatcccaaccccagcagcggacggttttggtcacaaattggaagaaaatttttgttctatggatgcagatattttgtgctttttaaaagatgcttaattgtgcccctgtgactgcagctgtggcagtctgttgatttgtccaggtcacaggctagaggcctggcccacaggagagggacaggggaaggagactccttaccaaaatctagtaatggaaataccacgcaaaatttcagaactcctcaaagcctgggaatcaaatgctgtagctgaagtcgtccgtgctgcctgtaagatgccacgggccttccagggctagagtgtgcagctgcagcttgggatggggttggctgtggacagcctgctccttccctcaggagcctcccacccttagagcatgccccacctgcgctgtgtcctcaaggtgatggtgtggtggctgcagctcccagagcccacaggaaagctagtggtgacctgacattcacagtgaccgcagctgagtgtggggccctgagtccagcttaatgtttacagttccaatagccatttgcagtaggtaacgttccttctcagatttccccattacctgcgagcgcaaacttatttttaaggtttatgtacaattgactgctgtaaagatatatatatatttttgggtccgttcttttccttcattaacttggtggtagaaaagccgtatatacttagaaacccttaagttaaagccgtgtttctgtgcaagtcagatgacgctggtgtgaagatggtgtgagcagccgtgcagcccttcctctgcaggagacactggctccctggttactgcattgaacttgtgtttgaggttacctcaacttgtttttaaaaggttttgtctgtctgtgcgtttgtatatttgagtagctgtctctgttttatttaaactgtttaccatgtaccatgtacatgtcagtgctctcagtgcatcatgcttgtaacaggcattcattcatgagaatgagttactcatttgtaagctcttcagtaatttatctactattcctaaattggcataatgttagattcctattttgaatcacctttaattacatgtcagaatgccttaactcccctaacctgacaacactgagttagttctctggtatggagggagactggataaggagatgtcgcactctgttgatcctggggcgtgaggggcacgtggtgggtatttattttgcacaaactctttgcagtgtctgtgtttaaaacagtaaggttgcatccagatggggtgtgtgactctaggactgaggacttcagctcttctgtgtggtttgtaattagttcttggtcagaggtgttgtagccttacaatctggatatattttgcattaattttccaatgccgacatttaattcctgctaagagcagagctggtcaagtcactggcttttttctgctctcatttagcccatcaaccaatgtttgtaaaagtagattggtgtgttttatacaacttacttttagtcaactcacttttctgagcagtgattgtaagaaacagacaggcagtatggctgttctagtaaactgaaaaccacgaggcagacgtcaggattcagtgacagttcctcaggcctggcgtgtggactggtgacatcgtatattccatttgcttctccctgtcctttttgttacacacttaattttataactgtcgagaggtcaggcagagcaaacgctgctcacactcactgaggccaggggctccatcacacacccctcgccaggtctgatctggaacctggtgtgcgcgtgagttgtattttaaatcaagcaatgtaagcactcatattt

SEQ ID NO: 30532 - DNA, 1153 bp, Mus musculus
ctgcaaatactattctgtgtaaatattttccagtttcctggtttaatcaagaaaaactttctggaataaccaacaattacatgtacacgcacacatttacaaagttataaactataaatttataaactaaaaggagaaataatatatttgccagactcggggctggagagatgcctcagtggcagtttaagagcactgcctgctttcccaggatggggttcaattcccagcatccacatggcagctatactgtctataactccagccccataagttccaggacctttacacagacagacatgcaggcaaagcaccaatgcacataaaataaagataatttaaaattcagttttatgttgcaagtaaaattttaattgttctagctagaaacaagcatacattacacattaacacagaaatatatcagacgaaggcggctattataaatttctcaacaaccaaaataacataccgttactactagtactatcccatacatggtccactcttccctgtgcactcagcatgtggatgttagctgatggctgagcttggtgtggaggactagaccgtcaggctggcgtgagctgggccttgttcttggatggacatggactgcatgcacttattcagcagatcctcctcctgtgtttcttcactcgggcatgactgagaatcattagaaggaactacagggaagataagtgtttataatgcattctggaaataaaattctttaattttattactattattttatgtgtatgggtgttttgcctgcatgtatgactatgtactgtgttggtgtgcctggtgcccacagatggcagaagagggcatcagatctcttggaactagagtggtagatgctgggaattgaatacagagcagccagtgctcttaactgctgagccatctcttcagcctcattcacatattttttgagacggtgttgatatgtcataccagtctggcctcaactcccagagctccacctgcctgtgcaccgtgagtgtggggatgaaaggtgtgcaccaccacacatgcttgggaataaaatgctcaacactacttcagaatagcccagcttagaaagcttttagcaggcaaaatcccctactgttttcaacttagttaccctccacttcccagt

SEQ ID NO: 30533 - DNA, 1239 bp, Mus musculus
catcctttgagaaagaagaccactgagctgttttctatagtctcaggggtctctgcaaccaccaaggccagctttatgccagtctgtgcaagataaagcagttcagttcaacacagcacaactcaggacatggtgttggttcacactccagagtcttaccttgagtcgtttatttcaggcatatgtaagcacagcaccatttgggaaaatgtttcctggtgataaataactcagccccatgtacacagcaaagcttaagatgtgactacatcaacactctgcaaagtagaagatagtataggtactataggttaactgaggaaaaaaggctcgagggtcgttccttgacaagggtctggaggagcatttggtgttgcctggcagcacagatgatgcagtggcactagacttaatcagaggttaaatatatacatctctccttagaagagacgagcccatgtatctgacattcctggctttcccagtgtttgtctgtgaacacaggtctgcatgcctcctacgctagacagtcaatagcccccattctgtctttcagcatccagagctcaccttgggccagaagcgttacctgtgcagcgttgctaagatctgtaactccagctacctgaggaccttgatgaagaggcagtacatgcacatatttcatcacgggtcacagaagacaggcaggtgtacctccatctggtttcttgtcaggtcttaggagaagtgagagcatcttctaagaggtgatttgtgttccaggtgtgctcactcaccacagaggccatatgagctctcgctactcacagaaacagcattccccctgtactgcatggagacaccatctggagagagaggactctctgagcattgcagctggagcacctgaaatgatcatacattccctttggcgacccctgagacacaaagaagggtctgtctggttgttgagtttaagaaggaaaaaaaaaaaatgtacccagttctgtgtgaaaggatcctcttgagagtaaaattccatttcctagtacatccacgccactgaactcagatgagggaggctacttcctcttcactgcagtgagtgggatatgacactcaagggtgcttgagtttccgtgacagggtatatatagcccaggtatttctcaaacgcagggtagtctcttgccacatgctagcagtacagggatgccaccacaccaagtattccacttttttcccacagtataactg

SEQ ID NO: 30534 - DNA, 1105 bp, Mus musculus
tagtgagaccctgtcttgacaaaacaaaacaagaaggagaacattaataaaatgaagtaaaattagtagaagacagtggtaaagtgtaatttttttattttttggtttttcgagacagggttcctctgtgtagcactggctgtcctggaacgcactctgtagaccaggttggcctcgaactcagaaatccacctgcctctgcctcccaagtgctgggattaaaggcgtgtaccaccatgcccggctctgatatatatatatattttttttttatgatggggtttgaggtactgcctacctctgttttccgtgtctagtttagtgtgagcggagggctacgcttatccaccagctgacagaacgtctcagaatccaccagttggttctcttgagtcaggcgctggctccccgtaagccgacgccagcccttttctcccacagttggtcctcgccttgtctcctggtgacacttgttttctctcttccctgggctggcccctgcaggcataccactcttctctcatggacccggacaccaagctcatcggtaacatggccctgttgcccctccgaagccagttcaaaggacccgcccctcgcgagagtaagtctctgggttcttttgttgggttccaagcagacctgctgacttgagagcagggaagagcttagcttgagtcactcttccttggcttcctgtcacacttgaccaggagcagcctgttgcgctccacaggaaactggttcaaactcctccaggatgtttacgtgagctgaaaggaaatgtgggctgtggggcgtggccccgttggtagagacatggcttggcctgcatgagacccccaagttccattgagagccaggggatgtggtacacacctgaaatcctagcacttaggaggaggcggccggaagatctggagttcaaagtcgttctcagctagctccaggccaacctgggctactgaaactctgtctcaaaaaaaaaaaaaaaaaaggaattgtgttgaattctggccacagtccccacaggcactgtcagttatttcagactaactgaatggcaggtccccagccttcttctgacagcattgtgtgggcatag

SEQ ID NO: 30535 - DNA, 1196 bp, Mus musculus
taacaacaacccgtgagttggagaggcggggaggtggcggtcccgggagccggggttggcggtggcggggggacggtgtggtcccgcggagggctgcgcgggatccggcctcggtggcctcggagttctggctccttccagaacgacgaagtcccctgagtcccggggacccagtccaccgagtgtcagccgtgggggtgccaccccagcggagggaggggaccccactttccgagactgagagcatcggtggcgggcgcggtggcgcctttttttaatttaaaaggaaccctggcagtctaatgtaaggcccgacattgccgccggggagtgactggttttgtgtggttgtgtttacaaacaggggtctcctgtagcccaggctagcctgccccaggctgtgtgtgtgtgtgtgtgtagtcaaggaagaccttgaccttcttaccctcctgcctacgcctcccagaagctggggggggggggttaactggtgttttacacccccaccatgctctcagtgtgcgtgtggaccttggggatcgaaccagggatttcaggcgtgctaggcaaaacactaccgatggagtgacagttctatctagccgggtttactgcgtctcaaaggaagcccgggacagttgtaggcttgaattgcctgtaagggccttgcttaaaaatttccccatcattgctcactcttcgacgtggctccgcaagtcaacctagtcattccttttctctaatttctcctcctgcccgagcgctctcagagcaagcattggcaccggtggcttcactttagaaccgctgcctgagccgggcagtggtggcgcatgcctttagtcccagcacttgggaggcagaggcaggcggatttctgagttcgaggccagcctggtgtacagagtgagttccaggacagccagggctacacagagaaaccttgtctcaaaacaaaacaaaacaaaaaaaaatgctaaggaaatgtgtttattacagggaggtccagtaggtcgaccaagatcacaccctggagaacatagaggagcgagtggatctgtctatgattggagatagtttgtatttcagtccaccactgtctagtgcttccaaagaacattacagtagccttctactccgtgcagacatttgcatttggcgtggctgaggctagtctagtgagacagccaaagggc

SEQ ID NO: 30536 - DNA, 1128 bp, Mus musculus
cttgagaccggttctcccacagcttagatctttagagcctgtctttataaacagccctctggcggcttctctaagctcccagctttcccttctttgggtaaatccctagcagcctgttgccgagcgtggagtgatccttcttggaactttccagcgggctggccagatgtctgctctataagaatatggtagcccaggctggaccagtcccctttgtgtcctattccagttgtaccatctccctatgcatactcattcttttttttttttttttaattttattatttatcacatgtaagtacattgtagctgtcttcagacactccagaagaaggcggtcaggtctctttacagatggttgtgagccaccatgtggttgctgggaattgaactcaggaccttcagaagagcagtcagtgctcttaaccactgagccatctcttcagctcccacatacttgaggtatgtagggttacaaatgaggttggggttacaaatgaggaccctgtttgaagtggcagccattcctcaccggtgctgggagctgctggtgactgttttctcaggcctgaggtcgcaggatgatacttccttgtgcccagctctgccttggaagaactcattcccccaaggtggtgctaaagtcagaccaccttgcctaaaggctgaggggtggctcctggatatgtttctgtggaggagggcatgtgaggctccttcgtcctttctggtctctgccagggccttccgttctccatgcctatggccctctgttctgagtgtcagcacatccctggggacctaggctagagcatgtggctggtcctttgggctcgagcctcccatggacatgattgacctctatctgtaggccaggcctgctttggggaaggctcggatctccttgctgctgcctttagccagactcaaggcctgcagaagctgagttttacaacaactcataccaacccctcagcacaaagggctgcctctgtgagctcgcacacagcagggttttgcctcaggacttgagtgggaaccagagagagcaagaatggccattacccctcgtgccattagagggcagattggacctgctacctccaagctcaaagccacggaggaccc

SEQ ID NO: 30537 - DNA, 1181 bp, Mus musculus
agcattgagggtcagtacagacccagcacccgtgacacagcactaggccctcaacagtgggtgtgctagtcaaggcctcaccatggagcctctcacatccttgtctttttaaatacaaggaggaaactttgcctttcttggcaagacctgaaactgagggggaggggggaatgacggaagaagacaacaatcctagccagaagacaggtgattacactccagagtcaagtaaacagatttcttgtaactgagcagagaagtaccctctaatggcattgtagggatggatatgcgctctcaccactctggaggaggttgtctatccccagactccacttttttaagtctcatgccgtggtctaaatctcaaaagctgttcctgcctcccaagtgctggaattaaaggcctgcatcatgcctagcttcagatctatttttaagggcccaacccaacaacacgctgcagttcccaaatatgtccagacaagaagaatccattttagttttttaggtagagcctcatggcccaggctgtggcccaaacagcatatagctgaacctgcccttcaactgttcctgctgcctccacctcctcccaagtgggcccgccatgcctggcttcccacttcactattacaaagactggaaataatggctgctaccaataaacaagatccagagcaggttctcagtcgttctgatgctgggacgcttttatcatagttgctcgtgtggtgaccccaaccatgaaattaatgttactgttgttcataaactgattttcctagtgtaacaaatatctgatatgcagggcagtcttaaaagactcctgtcaaagagtcattcaacacccctcatgggtcaaagtctacaggttgggaacacactgattagaatatccaaaccatggaaaaaatcgaagtgagtgatgcgcattctgcccaaaatagctccgtacagaaggctggttccacctttctggagctgtacaagatccaccagcctctacctcctgagtgctggaattaacagcatacatcaccactgcctggccaaaatctcttttaaaggaaacaaaaataaatcaattccttgtctcaaaggttgtaagcaaaggactccaagatacaggcagcagattacaaaggctgggggtttaggaggtgagaaccatcaagtca

SEQ ID NO: 30538 - DNA, 1162 bp, Mus musculus
gaggtcagaggacaagtttgtggatggagctggttctcccatgggttctaggagtcaagcccaggactccagactcatcttaagggaaaggcctttacctgctgagccatcttggccctggatgctgtcaaaaagctgtcctattacaggagctgacaggactcatttgaagcttatctctgccaagtaaggccagaatagcagtttaagggagaattcaggatcctttcaggtctacttctgtctcccgtcacagtcactttgcatctgaacagtcacacaactcccgaggctagtcacgtgtagacttctagtctgagctgaaaaggcctgatttctgctgaaggtcactgtgacacgcattctgcttccctccaggttaactacaaaaccagtctcccagggaggcctcagtgcccgtccccaccctcctgtaaatcagccacagctctgctgagggtttatcgtagaatagatttatttacctgaaatcatgtctgtgcaatacctgttaccagcacagaaactgacctctatttacagactacagtcaaacatgcgctgtgagaagctgtgagcaactgaactgacgctgagcactttattacgataaatgcacacaatacttgtattgcaccaacatctgtctactgcttctgacttcattaaataagttacaataatacagtgtggaacagctggctgcacacctaaacaactgaagttaggactggaggcctatgttgtaaccattcagcagctgtagtgttttaaatgaatttataaataagcaaactgtacagggcccattagaaagcatgtttcaatgtcactgtagagcaatctggccacttacaactgaaggcatgcattacaattatcatacagttagagaggctatgacattttgcagagaaatgtggagacttggctgatggcttctgttcttggataaggtttcagaacctccttctcgcagcaaagaaaccaacttctctggagaggctctctgatttgttatgctaaattgtacatttgttattattttgattgaacagctaaaaccccactggtaatacacatttcctccacatcacacagtgagttggggactgtttctatttttcttttccccaacctcagtcatgcagagggctggtag

SEQ ID NO: 30539 - DNA, 1639 bp, Mus musculus
ctgaggatgcccccctgggagaatatctggctcgtgggctccatctgcttgtccatgtcacttcacttcttgatcctctacgtggaacctttgccggtgagtcatgatggaccccgggcggggtctggggtagttcctttcaggcagggccagaagcttgacccagccttgtttgtctcagctcattttccagatcacaccgctgaatctgacccagtggctgatggtgctgaaaatctccttgcctgtgatcctcatggatgagacgctcaagtttgtggcccgaaactacctggaacaacccggtaaagagtgtgtgcagcctgccaccaaatcttcctgctccctgtcggcatgcaccgatggcatttcctggccgtttgtgctgctcattatgcccctggtggtctgggtctacagcacagacactaactttagcgatatgttctggtcttgactgacagcgctacatacagaagatgtttaacttaatcaattaattttttattgtttaaagcaactgtctatttctgctgaattttcacatgaacatattggctggtgaaggaggtttcatatctagattttgttttgctttttctgactccagtgggacaagattttcctttttttatacacataattaaagtgtccattgacgtgtacagagaactaacactattttatgcagatatttttttgtagatgaaaaagcatgtacagtgttctgtttaatactcatacttgtacaaagatagttgagccagcagacattgtcagcaaattaattggcagcagacttaggaaatgaatgtgtgtggtttttaaaagaaaaaaaactaaatagcatgtattgtgtcttttgcatgattctctggatttaatttggtatcacagtctaatttttattcataagccaatttttctgcactgagcagagtcctgctacctcagtcagtatttttggtttgccacttcctgcaccctcagcctctgtcacccccagcccaccccagcctgctcggcttcttctgtaggtctgatggttctgtttacatccgtcttcacgagaggtttgcctgtctcgcttgtgcagaaaacattgctccagatccaatcgactgggtttctgtcccttcgcctagtttttaaggttatttatttaaatgtctaatgtattttattgtaacagacattgttttgccaacattgcctattcaatggcacttcacaatctagtttaaaagaaaaataaaacattttaaatggacagagaaaaataactgtcttgttcttaatggccttgaattacgtataatcagttcaaatttctgagcttctcagcttagagccttagtttcctgttctgagaagagtcctgttctgccgcatagtaggattttatttataatgtataggcacgatctgtcatgtgatatacattactcaagtttctgctggcccgttgtatgtaggttggtgtaagggcaagtgtgtgtttatgtgtgtgtatgttttgtaaaatctgtaaatagcacatgaccaaatgaacatattgtatagaaatatttttatttgactatggcactaaccaccaccaccatgactgatgaacgtttgcgcatgttcaaggtcagtc

SEQ ID NO: 30540 - DNA, 1135 bp, Mus musculus
caaagcctaatggaaaccaagttactaatggatatttaaaaaaaattaagtattggtaaaaggctgagagatttcatttccacttcttccttagaccagaattttatatcagggatggaagctactaaacagaagggacagctttgctgtggcactgacactgccagcctctgagtgttcattctttaacactttgttctgttcctgtggtcaatctctcaaattccataatacaggccagacatagaaacacatggaagcagaatgctgctacactacaggtttcaggactgtagctaggaaaaccttgtttgaaccaagggcaagcagaaagagaaaatgacaaactcacagttgtagcaagagtgagctgccaggacactcgggtaggggtaagctgtttgagctcatgtggctctctcactttagaccaacctgactttcgtcggctgtgtgggcatgctggatcctcccaggattgaagtagcctcttctgtgaagctgtgccggcaagcaggcatccgggtcatcatgatcactggagacaacaaaggcaccgctgtggccatctgtcgccgcattggcatctttgggcaggatgaggatgtgacatcaaaggcttttacagggcgagagtttgatgaattaagcccttcagcccagagagatgcctgcttaaatgcccgctgttttgctcgagttgaaccttcccacaagtctaagattgttgagttccttcagtcctttgatgagatcacagctatggtaagattttagctagacttacacgacacaacagtgtacgtgtgcctataatcctggcacttagactgaggcaagcctgtgctacctagtgagatcttgtgcctaaaaacaaaaccaaatgaaaaaggcatgttcttaacctgtaagcaatacttagtgtgattatgtgtctgaggtgtgtaaatgaccttaaattatgtggccccaccacaaatggctctcaggttttgagtgttggtataaggcaatataagcagatgtccagtctccttagttctacctttctgtgatatgactctttaagcttgcatggctgtttttgtattttcttggtaaagtatttgacacagctactgctctgtcccgtttc

SEQ ID NO: 30541 - DNA, 1210 bp, Mus musculus
actgatgcaccctttaaaggaccagagttccagctacaagtctttctgagagtgagggtgaggactgtactttttttttttttttaagatttatttatgtatgtgagtacactgtcactctcttcagacaacaccagaaaagggcaacggatcctcccattacagatggttgtgagccaccacgtggtcgctgggatttgaactcagaacctttggaagagcagccagtgctcttaaccgctgagccatgtctccagccccaggactgtacttttaaacaccaattgccatgtatcctcgagcacagtctggagctgaaagggttgttttggtggtgtagtgaagagtgataaccaagagaaccttttacaagttaaatagtggggttattgatttgctttctttttcaaaggtcattagaataataaacagtgacctgaaatggtcaaggactttaaatgaataaacatcttaatatctgggtttggtgtctcatggttacaccgtcttttctcacatgaaccggggaggacaagctattctgctgacattgacttcttttgacaatgcaggcaaagggtgtgtatgagaaagttggagaagctaccgagactgctctcacgtgcctggtggagaagatgaatgtatttgatactgagctgaaggggctttctaaaatagagcgtgcaaacgcctgcaactcggtcagtattgagctcagcacagtatgctgctcttcttcattacactgttggtttaactgttgttcttcggcattagtttcctgatggtcacagtcaggtacgatggtctctcatgcctatatttctagagctcacgatgcaaataccaggagaattgccacaaattgtagaacagaactcattagacagacgaccaaatcacattttaaaaaacggaccaaaacaaaacaaaaatagcccagcaatcattagtaccttgacataggtgtatcataagggctctaccaagggagctatccctagtcctgagaatacccagccctcctgcctgcatctcagtgtctttctctgtgcctctccagtagcataaagaaaataattgtatgcttttaacattagagctgtcccttgccctaattgtcatttgacaccccatttgtttaactcgggtgaaaaaaactgttgagtgttcattctcacttttttctttttgtttggttagttgg

SEQ ID NO: 30542 - DNA, 1058 bp, Mus musculus
gggctttgctggttagtaggagcacttaaccacagcagcaagtagatcgctctagtgagaatgattgctgccctatccagttaaggtggaatagggcgagaatactcacgtttcacatctgacttcactgacctcagtagtggtactggagtagaaattctgaaacagcctacaaggctgattatccacgcttagctgtgacaaaagtggagtgagaaacaaagataaaagaatccatagtgctgagagctgcatagaatttgaaattacaaaagtgagagtactgccgagcccagagcagatctgtaggcaggttccctgtgtggagagccgtcctgtcccagggagtgagcaggtgctctgtggagtccaggcagtatccacatcaggatttaaggtgggatgtgctggtgccctcatgacccattttcctcttctccctagggtacaaacattgctgctgggaaagctatgggagtggtggtggcaactggagttaatactgagatcggcaagatccgggatgaaatggtggcaacagaacaggagagaacacccctacagcagaagctagacgagtttggggagcagctttccaaagttatctccctcatttgcattgcagtctggatcatcaacattgggcatttcaatgacccagttcatggtggctcctggatcaggggtgccatctactactttaagattgccgtggccctggctgttgccgcaatccctgagggtctgcctgctgtcatcaccacctgcttagctcttggaactcgtaggatggcaaagaaaaatgctatcgttcgaagtctgccttctgtggagacccttggttgtacttctgttatctgctcagataagacaggcacacttaccacaaaccagatgtccgtgtgcagggtgagtaaggggcgttctctgtgattcttgcctgcagtctgtgggtggtcatcccacgtggtggaggagagaaaatgctcctcaaagttatcctctgacctctgcatgtagttccgacacacacaaatacgtggtaaaaattaataatc

SEQ ID NO: 30543 - DNA, 1230 bp, Mus musculus
gcataaaagcatgtgccgccactctcggcttcatatactgccggagatcgaccccagactttgcatgctaagtaagcactctgtcagctgaactccattcccagcccaactgaatgctatactaaacataggtcagacaaatcactgtatctttggctcttccaggaatatttcaggatgttatttcaacattactttttatttttaaaattacactttttgtagtcctgacattctctccattactctgacattaatctccattactaagttttcctagtttgcctgttttggatcggttgagccctttgttctttctcccatgttggaaatggctatgaactttcttgcttgtttatgactgggtctcactgtgttgctcatcccgcaaactggatgtgtagcacacggtggccgtgaacttggaacttgacttgcctcagttcctgtgtgttgggattataggtatatgttaccacaactgctcacattggcagtgataaaacagtgggaatggggtgctgtgggattggctatgccgcagatagcgttaaccatcctgtctcataacctgcataggtgaatctgtctccgtcatcaagcatactgaccctgtccctgacccccgagctgttaatcaagacaaaaagaacatgctcttttctgtgagtacttttatcagatgttgggggtaaggtttcctgggggttgaaccaagggcctcagctaagagtgtacttttatttggagatagtccctgtcttaattagggtttctattgctgtgaagagacaccatcaccatggcaacttttataaaggaaaatgttttataaaggaaaattaagggtagcttacagttcagaggtttagtctgttattatcatggcaggaagcctggtggtatgcaggcagacaaggtgctggagaggtagctggaaaaagttctacatccagatcttgaggaagtgggaagagagagtgagcctcaagaccccacctgttcccaataatgccactccttatgagtatatgggggcgttttcattcaaaccaccaacatcccaaagttctgagtcttttctttttactggccactctcagtggccagacgtaaaaaaataatcagttattccaaagataattattctttggtatgtgtgtcagctgtcagaaaaaaagaaaaaagaaagaaacatagctgggggagtgatttgctgaaggcactggc

SEQ ID NO: 30544 - DNA, 1171 bp, Mus musculus
tctgcctcctatactgggttaaatttaaggtatatatcaccttgtttagcctagctttttactgtataaataagtttgtaaatgtttgtattaaaataccaattgttgggctgagagatatctcagtggttaagagcacttgctgctcttctagaggtcctgagttcaattcccagcacccatgtgggtgacttacaaccatctgtaatggaatctggtgacctctcctggtatctgtaaagacagagcattcatatataaaataaacaaataagtaaataaataatttttttttcttcgagacagggtttctctgtgtagccctggctgtcctggaactcactctgtaaaccaggctggtctcaaactcagaaatccacctgcctttgcctcccaagtgctgggattaaaggtgtgcaccaccacgccaggcttaacatgctttttaatattaagattataagttttaatttctaatctagaaatatttaaaccagacagcctagtttaccatacttggcttttctttatacaggaaagaaatgctgaaaatgcaatagaagctcttaaggaatatgagcctgaaatgggcaaagtgtatcgacaggacagaaagagtgtgcaacgaattaaagctaaagacatagttcctggtgatatagtggaaattgctggtgagttgaattcagttttatttattcctagattatgtatttaacgttcttttctcaaggttcagattatatttaactctttgtgtttagatatttttttgtttttcaattttatgcctatgagttatttgcctgctcaggactgtctgtgcactgtgcatatgcctggtgcctgcagaatccaaaagagggcattggattccttggaactggagtaaactgacatgtgagctctgggatttgaactttggtctacctgaagatcagtcagtgctcttatccactgagccatttctctagccctggttttgttttgttttgtttgtttgttttttttaatgtatattttaaaatacacttttcatatatttaaaaataaaattttgtgacaagtgggtctctattttgtcccttctacctttccactctgtattcctccttcccttcctcccccttccgccttttaattttattgcttgttggtttttcctgtgctt

SEQ ID NO: 30545 - DNA, 1786 bp, Mus musculus
ttcagacccatgacttaaactgcaggagacgactgcccagtcagccccgaggaccactctgctgccttaagtcattacatttgggagaggcgggttgacacacagcaataggcaactgggacaagagatgctgactgaggcccagagtcactacaaaatataacagctacttctattgggcagctgtaagaggtcacattaaccagactagaagccatcaaatctaactgcatacaagttacagtctgacctgccttgctctcctatggttccaagtcactagtactgtgagaaaccggttggtaaaagctgcctctgtgcctttcacgtcccggactgtacagccaacgagtccgaggcaatctgaatgctcctttagaaagtagcccaagctgccaggagaggcgtcaacccatgctcagaaggccgactctaggccagcctgagctacatcgcaagaccatgtctttattttttatttttgtaagatttattttatgtttgagtgttttgcctgcaccatgtgtgtgcctggtgccggtggaggtcagaagagagtgttggaccccctggaactggaactgcaggtggttgggagccaccatggtggtgttgggaagtgaacttgagtcctccgcaatagcaacaagggctcttaactactgagccatctctccaccttcaaaaccacgtcttaaaatcataatcttgataattagaaaagggagggggaagagaggctagggagatggttctgtgggttagagcattttctcctcaggcatgaggactgacctacgttgggatcacagcagccacataaagtctggatgtggcctgtcatgatggcttggcaggggtaggggtgggaaaagagcttgctttgcaatctgatgaccttgaaagccatggtgaaactggagagccatgttctctgacttccacatgaaccacacacatactcacacacatacacacatataaatcatacatgcacactagtaataaataaaatagatgtaatttttaagggaagccagtgcccttcatcgttttctacaaccactaaacatggaagagggaacctttacaggtttggggtcctgcctcgggatttcattttgatagttttctttttcttctagacctagatacttgtttctcacagaacagagactttgagtattatgagatgctttgactgactctaagacttgccattttaaggcgtctaagatcaagaagccatgctctcaatggagagggtggggctgaggcaccttcatgaaggaggcccatgctcacaagcctgacggatgacctcagacggatgacctcagacggatgacctcagacggatgacctcagacggatgacctcagacggatgacctcagttccatcctcgggacccacacagtggagagagcactgacttccacatgcaagcatggcatgtgtccacccccagtctcccagtaaatgaatttaagtccattttcactgtatttttgtttgtttttggttttgttattctttttcaagactggaaagccctggctgtcctggaattcacgtgtagaccaggctggccttgaactcagagattccacctgcctctgcctcccgagtgctgggattaaagggtgtagcaccaccaccaggctcggagatatttttttaaagtagactgtatttgacttcagagttgagctttttactccaagcattctatggaagagctacaggcttccctccctgtagcctcccagtctctacacctttat

SEQ ID NO: 30546 - DNA, 1802 bp, Mus musculus
cagggacacagaagcaaacaggaagttaaaggggggcttccagactggtttccagtgctttggtagtggctgtcttgccagtcagtcatggggcccagacaaccgacttctggcctgtgcggaggccaggccctcctggcttccttccgtatggtttgttaagctctttactgtggtctagccgctatccctgctgtcacataagcagttaggatccaggtacagactgcagtgtggggagggtctgtgtgaccaaggacttcctgtcacttttccctttttaaaattgaaggagaaacagcccagtagctccaccctttctggccacagatggcattccgttagtttgcaatagccaccttatggttaaagccaacaggtcatacagcttggtcccagctcgtctgcctggacgctgagcggcctgcccgagtagggtaggcgtgatacagagctctgcagaattcttgtgtttacacaacccctctgggcaatgccgtggtttctctcgacaggatgtcttaagattgtcggcaatcacgcagccaccagctgctcaggaagaaggaatcgagaggtctgcatgggtaactttttttcttaaagaaacaccaaagaaagctgtggaaaggagtgactccccccccccccgtccccctccccccacccccatcctgcccagctgccgtggaaagtgtaagaggtccagccataactagagcattagagcacaaataattgtttttcaaaagtatcattagtgaggagaggagccgggcagagtggcttttctctgtgggcagatgggctgcccacaattccttccatggctggttcacccgtgattcgcgtgtaagcagcttggccttgaaagcacaagcctcgttcctctctttctgtctttattgcctccccccatgcgtctcataggctcccagaacaccttacagagccccttgttctcccttggggctgcataggccacctcccagggtctggcctttccaggggacagaatccttatccttgaacctttctaggcgcaggataacatctgtgcaagttgacaccaggttaggcctgcaactctcgcccatcctccagggggcgcactttacattgccaaccacagcctccattggctcccaaggtgctagggaagattgttggtttctgtcttctccagctctgtgggttcgagtttcgtgggacttgggacttttatatttggtgaccagtgccctccgcttctgtttgactccccgtgacctctctactatgcatttccctttttatcaggtgtataaagttaaatactgtgtatttatcacttacaagaacatgaacttaaaaaagatgagctttcggttgtttttccacaggtgatcaagcttctgtgtaaacttgaaataaacagacagcaaaatggtgcaaagcccgggcctctcgggggttctttggttggtacctggtcctttgcagcgtttctgcttacactggtattccttcccttaacgttgacagcaagtcagatgcccagagctcacagctcatcccccacccccaccccgccatgtaaactgctcctgggtgagccagcagcccaaaggttgaagtgtgaaggaggtaaggggcggactctgtgaggttggctaggtaagcagctgggagtggctgtcatcacaggagacatgtcccgaggccgggcattgtttgaacaggctccaagccttactctctgccatcagagggggacaggaggcgaaatctgaaaagtcccaatccttgtttcagaaatatgg

SEQ ID NO: 30547 - DNA, 1149 bp, Mus musculus
cctttgttgtctaaggggacaaagaaaaaaaaaaggacttgactccatgtcgtcgactttggccgctggctggccggaccggcgggtgtgaggagttgcaaaccgaaaccaacatgcattttgggacaattgctttttaaaatgtttttaatgccaaaaacaaacaaacaaacaaaaacccgccccctccattgtgaattcagaaccatgtcagatgtaccaggtgaatgtgtgtggggtttgagctgcgtggagaatcacgtggggcgagtcctgccggctggggctacactgggggggggggggcggattagaaggatcggtgtgacccacgtacaaaccccatgcctgggcgccttccaggatcatggaaagacagggctagccctcagtagctgcagggaacttccatgtcatttatttgtaatgaggactttttaagtgtgtgtgtgtgttttttttaatgggtataattatagtcaggaaaactacaagggcttgcagttgaaatgctcgaggggtactttgcacccctgaatgcgagcattcctcagctgtggtggtagaggtctgtctggaggctgaacacacttcatgttagctgctccaactgggtttctgagattgtcagctaagctaattctctttgtaaattggcaaaaaaaaaaaaaaaaaaaacaaccaaaaacaaaaaaaaaaaaaacccaacaacttcaggttggaatctgctctttcatgtacattacatggcttacagctcaagagatgtttccaagtctctgactagccagaactccggagaggttcacaagttccaaaggttggagcttccaggatgggtgtccctctgtgcggctgtgtgacagggaccgagagccggtgagacctgtgcctgtatattagcagctgcgtttgtttattgcctgtgtattctagagactgtaaactttctttccttttccagaatgtctggtcggtacaatgaaacatcagtttccctgtgggccacttaggcaagacttgtcactcagcttaggagcaaagctgtagtgtgatatcagtgacatcagggtgccattgtagagcaaagtgtcaaaccccagagtgttcctcagggcaaagggctttcgggtttttttttgttgttgt

SEQ ID NO: 30548 - DNA, 1865 bp, Mus musculus
tctcaataatgtttagattactttaactgtctagttctctcttcctgtggtgttggggatggaactgggaagtgagagtccccacaggctttcaccaccatgcctgtaaagacagacttgaaagctgggctaggcaggacatgcctgtaatctcatcacttgagagatagatgttggagaactgctgcacatatgaggccagcctaggctacatagtgagttacagtccagcctaggttacaatagtaagaccttgtcataaataaaacaaaccccatcccaaataaaacaatagaagtcaaagctttccatgctacaaatggccactctctcctgcatctgttgaaatcatactgcttttacgtgtattctctggggaggtgttctgcgggatgagatggcctgtgccatggagaaaatgcccagaacacaagcccatcttggcaatgggcacaggccatgcgtgtgtacagtgggcacaggccatgcgtgtgtacagtggtctgctgtttctctttcagctcatccttggaatcccggaacaggccttaacccttctccacatggctatcgagcccatcctagccgacggggctgtcctggacaaaggtcgtgccatgttcttagtgtccaagtgccaagtggcttcggcagcgtcctatgacccagtgaagaaagcggaaggtaggagctgtgtggagagtgccgggcttgcctgtcggttgcatttgctgctgaatcagctcaccagcccgagcgttctacgttttagttttaatttttaaaaaaaaaaaaaaagtgagacgaagctttccatagtatggtgggctttttttcttcatattttaaagagaatataagaatatctgatatatggtatatatcataatatatactagctgaatctagatttcaagttttgaaaactggaatgttaactggatttccccccccaccccacccccagctctggaagctgccattcagaacctcagtgaagccaagaactactttgcacaagtcgactgcagagagcgcatcagggatgttgcttacttccaggccaggctgtaccacgctcttggcaagacccaggagaggaaccattgtgccatgatcttccggcagctgcaccaggagttgcccgcccatggggtgcccttgattaaccacctctagccaggactccctgcttgatggtgtgcatttaggggtgggtcattacatgctatcttgtcaataaactgttctgatcagtttgtctgaagtgggtttttttttatttttctgggttgaattgtcagtatctttgttaagaactgtgtatctaggggctggagagatggcttagcagttaagagcactaactgttcttctaaaggacctgggttcaattcctagcaccctcatgacagctcacagctgtctgtaactcctgttccagggactctgacaccctcaggcagacataaaagcagtcaaaacaccgatgtacataaaattaaaataaattatttaaaaataaaacctgtgcatcctcttaaatctgcttacagagggttggtggctcagggccttaatcccagcacttgggagaggtagaggcaggctgctctcttcaagagctgtgtggtctccatagagaggttaaggccagccagtgctacactgtgagatcctgtttcaaagaataagatttgagagctggggagacagcaaaagtgtggatttccagatcctacctaaaaatatgtctgctgacagctaccccagccctcaggaggcagaggtgagtttgctcatgcaagctgcctagcaggagtagcagaatcagcgggctccaaagactccgacaaatggaaggt

SEQ ID NO: 30549 - DNA, 1390 bp, Mus musculus
ataatttttaatagttttatatctgctatactttcacttgtgtattaattaataatttactttcagctttagttgaaaaagtcaagggtgtgatttgttgttttctgtttaggaaataagaaaatagataattgatacttttttctttctttctctttttctctctctctttttctctctttctctctttcaaagatttattaatgtatatgagtacactatagctgccctcagacactccagaagagggcatcagatcccattacagatggttgtgagccaccatgtggttgctgggatttgaactcaggacctctagaagagcagtcagtgctcttaaccgctgagccatctctccaggcgtctttttatttattttctctgatttagaagttagcagtcatgctgaggagatatatccttgatcccaaatggctacagttgaaaggcttgcagacctctgtgtaaccattactgtttgttttggttgtttcaggaaagcagtcgtactgcaggctcagaaccaaatgacagaggcacacaagctactacagaagttgctgacgtactgtcagaagctaaagaacacagaaatggtcatcaggtaagcagtctgtcggggtgccgcgggggctggaaggcgggccttctcatcccaccctcctctctgttcagtgtcctcctatcggtggcagagctgtactggcgatcttcgtccccgaccatcgccatgcctgtgctcctggaagctctggccctctccaaagaataccgattgcagtacttggcctccgaaactgtgctcaacttggcttatgcccaggtaagccaatgtgggtcccccccgccccgctaagggggactgtggggatgagggtgtgctatgtttatggggtgcatgtggaagccagagtcagtcttggctgccattccttggaggctgtccaccttattttgagtttctcttactgtgtgtgtatatgtatgtgtgtgtgtgtatattatatatctatatattataagattatatatatatacacacacacacacacacacacacacacagtctctactgggacctgtgcttgtcctttagggtggactggccaaccactctaaccatcgagccctctgatccccatgtctcttgcaagcccatcacagggcttacaggctcctgtcattgtccagctctttatgcgcttgcttgggaatcaaactgaggttctgtggtttgcatgcatggcagggatgttaacaactgcgccatctccacagacctcaagcatctgcttcccacaggcagtcaccacacctaggctttctatgtggttctaggggtgtgaacctctggccttgtgtggcaaactccacactgatccattgagcc

SEQ ID NO: 30550 - DNA, 1146 bp, Mus musculus
tcagactcatactggactgtatggaacatttgaggcctgcgatacctgagaccctgtctcaaaattagaaaccaagcccagcctcagtctgtatactgtttaagggtgagtattagaaaggtttgggaatcgtgaatgggaatagcaggcaacaaattgaatgcttagtatgaaaaacaggagggaaatggaatttgacaagaatggccagagacttgaagacctttatcagggtaaagtacagtgtgagctggaaggcaggcgtggagctgctttgtgttttgtgtttgtttttggcaatggccttggacccttcatccccctacctcagtttcccaagtgctggaattataaatgtttgccaccaccaaatgtgggcttctctttgctttttgcaaaaaaagcaaaatgcttgtagcattaaataaatcaataaataacctccaacacatatatgtaaattgtaaggatgtttgcaacaatcatgtgaatatttttttgtatttaatttttctttagttatggatgctgtgtgatcaaaaaatacagtttgacagagcaatgaatgatggcaaattccatttggctgattcacttgttacaggaatcacagcgcttaatggcatagaaggtgtatacaggtaagaaccctggacagctgtcagcactcagaggaagaggtaggcaggcagtctgaggccagcctggtctacagagtgagttgcaggaaagccagggccctgcctcaaacagagaaacaaataaatataaacttaagatctcactgggcagtggtggtgcacgcctgtaatcccagcacttggggggcagaggcaggtggatctctgagttcgaggccagcctggtctacagagtgagttccaggacagccagagctatacagagaaaccctgtctcggagaataaacaaacaaacaaataaacaaactaggtttgtgtgtgtgtgtgtgtgtgtgtgtgtgtgtgtgtgtgtgtgttggtgttgttcacctgtgcttgttcacctctactcaggtcaggccagctggcctcgggttcttgcagactccccttctcccatctctctgctaggattgcagatgctgtgctgccatccagctttgcatgtgctctggggatccacat

SEQ ID NO: 30551 - DNA, 1099 bp, Mus musculus
gtgtcccaggggctcctcaaacttttttttaaagatttattttattaatatatgtaagtacactgtagctgtcttcagacactccagaagagggagtcagatcttgttactgatggttgtgagccaccatgtggttgctgggatttgaactttggaccttcagaagagcagtcgggtgctcttacccactgagccatctcaccagcccttttttttttttttttttttttttttttggtttttcgagacagggtttctctgtataaccctggctgtcctggaactcactttgtagaccaggctggccttgaactcagaaatcctcctgcctctgcctcccaagtgctggcattaaaggcatgtgccaccactgcccggcccaaactctttactaaatgtgccacttaactatggtatcaggagaaaagatagacactaaagaaatttcagcaccattctgtatgtaagcacagaaggcagaggtaggacggtagagttctaaaccagctctgaggccagagggcaccatgggtgtcattctgtaggtgctgtctacattgccttctgagacagggtttctcactggcctgggccagcaagccatgaagatccgcctctttgtgtttctttagttctaggattacaagctcacgttaccacaaccagtttttcatttcttaatgttcttgggattaaattcataactgcagaggacatactaagcccttctccaaggttgtcggcccctttcttgtcctgactgaccgaccgaccgaccgaccgaccgaccgacaatcctcctgtactatttccttctaagactcaaggggaagtgactgcagtgtgtatgtacaaaatctctttactcagtctgaagtttggacagcccatctcagtaccgcccttgctctctgacagatatgaaaacagtggacaggattggcctgtaaaaattatggaagcaaaatgatcatctgctgttgtatttcagtgtttttgcttcaaataaaagcttaattgtgcaatcgttctgcatagttcacacttgatggaatgattagagcaaattgaaaagccttaactaagggactggagaggt

SEQ ID NO: 30552 - DNA, 2469 bp, Mus musculus
cttacagtaatgtttgttcagtctgtgcattacctgtgtgctttcttctgggaaaggaaagaaacacatggactgaattgaagtggctctttatagactgataaagatactctagctgtggatttaaacggcttgtttagatgggcttcttaccctcgaggagaatcccagacagaagctaagaagagaacttgttgctcatgacaggcgtccttccctttatgtcctgttacctaatatgcaagcactgtttgctctattatctcattgtaatccttaccacggttctctatgataggtttgatgcccattttacagatgaggaagctgaggcttagctaagaagctaagtgactggccctaagtcacacagtaagtagcagaggcagtgtctaagtccaggttacctaatgctgaaggtctggctctttgccatgtaccctctgcttctctttcagccctagcgtttcaggaacatagctctcatgggtcagggctgaggtcaggtcataggttctttaagtagagctgtcactgtgcatgtgctgaaatgtgaaatccaccacatttctgaagagcaaaacaaattctgtcatgtaatctctatcttgggtcgtgggtatatctgtccccttagtacctcgcctccctgggaatacagtcccttgttcaacagagagcttttgctgggaagacggccaacaaactgatggatgccctaaaggactctgacctcctgcactggaaacacagcctgtcagaacttatcgatatcagcattgcacagaaaacggccatctggaggctgtacggccgcaggtaggtctccaggcagcctgccagagccacggaggtgtggagcctttagagagaagcaggcgctatggaaatggtcaccgaggggttagagaaaacgcttcaccatctggagacattttgtagtctgcatgaacttgagcagagtcttccccatgttcacagttcactgtccccggctgctctgtgtttaaccaaccgctgggtgatctctcctctggttcgcacatttcctctctagctcatgggtatacttgagcagtgaccagctggcactcacacctcaatcacctgaccctgagctaagagccccccttcctgttcgcatgctgcatggcctccttgtgcaagtccagtgcccctccccacagctgcttgtgtagacgaggttgcttctctggacagctgcagccactgtctgttttccactcagccacctgcagtttggaagtaaacttctgaactagactttcccttggagcccagtcttaatctcacacatcccctagacaacctgctgtttctaggaattccgtaatgaagggagcgcctctttaccagtcttgtttttgtatttcagataattttttggcacggtgtgctctgaaacagctgccgacactggccactgcctgcattgccagagcagccggtgccaggatggcatcgggtctgaatttacccgtgaaacctaattagcatcctgtgacctcagggaacatcgagggtggggaggtgggggtggggatctgggtgccaagtgctcccagctatgttgaccttctctacatttccttggggcctcctcggcctgagggctggagagctggcatggggaggagttgcttccacacatccagagccgcaagggttaattttcttgcctctccactgaggataactgtagggcatggctcaggggcagcctgggtctgctgcctttataaagggggacctgtcccctcctctcctcacccagcaccatggcactgcaacaagcccagatgttgctgagcatgaacagcctggagtcgctgaatgcgggtgtgcagcagaacaatactgagtcctttgccgtcgctctctgccatcttgcagagctccatgcagaacaggtaggtcggttgtgttagtgtgtgctctgttgctatggcagcactgcggaggaaagcagcttggaaggaagcccatgctccatggtctctaccgaggcctgcgctctcgttggcccatcatggccacaccttcagggtggagcatgggggcctgaagtgcttctggggcactggggctctgctatttccttcctcgtgcttgagagaagcactgggtatgtctcagtgggcctggttggtgtaggttgctgaagaatgaaatcccccatggagatagtttgaatatgccacatttgtcaaacactgggtgttttgacatcggtgaagggaacatgagcttgactactggttttcaagaagcggaataggttgggtatggtggtgcacccgaggacagcctggtctacatagtgaggtcccagacagccagggctatcctggctggagagaccctgtcacaaaaacaaaaaccaaatggtaaactaaaggagatggaaacttaatgcagcagagatgtttgtgtgtgtgtggagaggag

SEQ ID NO: 30553 - DNA, 1115 bp, Mus musculus
taattgttgattctatccatgtgaactagcaatgtgcaggacaggacaggagatgaacacattatgagtctggagagttcacagtgttgagtgttcaagtgacagttcacgtatagtctatcaggtgctgtaggaagggagagtgcagaggactcacagggagcatgggtggcctttgagaccttgctgagcctcagtgatagacagtgaagtataaattataaactggggcctgccggggtttgctgggtctggaaggagcttgtgggtgagaagtgcaggcctggaggctcgtgtccaagggaggggaactctgtgtgctggcgtgaacatggtcagcgtgtttggaaaggtgctcaggctgatgaggctgcagtcgggcaagattagtcatgttgtcccctctgggttgactgattctaatgtgctgttgttttaatttcaggccgctttgttgaagaatgatgagactaaagccctcaccccagcttccttgcagaaggaattgaacaacctgttgaaatttaatcctgattttgctgaagctgtgagttttgttcagaatttgttcctaaatttcaaggaagggacggtgatgttcagtgtatcagcgagccacacagattttaggttctaacaggaatcacgttggcaagataacagcagggcccagactgcagggctcccccaccgtccctgggccagaggccctgctactgtattctctcactcatccttggtatggcttttgacaggagatggtagactgatggatataaacatttgagggctaaaaagttcttttcctttcttccttttgtgaatgttttcaaacaaatttttaaattcagtaccctattagctctgttcctctgtgagtttcttaatgtaatcttcagatgatatttgacttgacatcagattttattcatggcaaaacagctccattttgtttcccagtaactgagacatccatgttagaagagtgcgttagttctgtgcttcaaagcaaaaggacaagagttaacttagtagctaattttcattggacatttagaacaattaacttctaacttgtacatgaatcaggttctcattaattcagtgttccttaa

SEQ ID NO: 30554 - DNA, 2247 bp, Mus musculus
ctcttgtgcacaaggcctgggttccatgcccagcactttaaactagacatagtggtccacagctgtaacccatgcctttgggggctagaggcaggaagaacagaagttcaaagtcctcctgggctacaaagcagttcggaagttagctgggatacatgggggaaccaaagttatgattattagaggggttgttctaagagcttttatttagatgtttttttaatggattgcattagaagttaggttcatgtattcttcccccatgtgtataatttcctatgcaattacctctcttttagttgttttagataattccatttttactttgacgaatgttatacagttaagttagcaatgtgtgatactcttgaggaatatggggatgacattttaaatggattgtaaagtttgtcttagagccccagctttaaacaaaccttgaaatcccctttaaagcagacttgtctataattcaggactatggaatgtgcagggtgtgcagcgagccttcctaaaccatgcatcccgattttctcattcagaatcaagctcatggctgaaggcgaactgaaggatatggaacaattttttgatgacctttcagattctttttctggaactgaaccagaggttcacaaaacgagtgtagtaggtatggaacttctccggagagcagggagcgttcccattgaagtgagcggcgttctgaggggcatctgtcctgacttgggtgtacagaagcaagcagactagggtgctggctgtgtgcggtttgtattcactgccttcctgtttcgttctctattcgaccgtaacctgtggggaggcagctctgttctcctggagtagttagcctgggcctggggtctttagggtcgctcagctcttttcacagtcctgcggaccacttgactgggttgtgccaactgtaagtggggtcaccagccacacttaggaagcgaggtgagtggagaccgctcttaagctttagtgttgaagcgcgtgtgcacgtgacatttctttgatgcttttgtactaactgtgtcccgtgggcccccccacccccacactctgttgcatggtcatttttatgttagtcgacatcagttggttattgatctcctgtccccaggtcatggatgtacaaggtagacatagccttgcctctgacagagacaggtgtgctggaaggagggatggcagatgttcaaagggaaatcagtaaataagataacataattacacctcagcttttgactagactcacatacaataactatggtagcttcagagagtttgaatagccgtgaggaaaatggaggcctgaagggctagaggtgggagaggcctgagacctgaatggagggagagcatgcgggaagagcactggaggaggagggacagcacctctgattcctctgaggggaatggggctggaagttgttgtgagtcttgggctatcagctaatgctttctccttgtctgtggtcttatcttgtaggtctgttcctgcgccacatgatcttggcctacagtaagctttctttcagtcaagtgtttaagctgtacactgccctccagcagtacttccagaacggggagaaaaagacggtggaagatgctgatatggaccgagaggatggagagaaacagatggagaaggaagagctcgacgtgtccgtgaggtaactcgggtttcctgtcaggctcttcttccagtcacttggcttaactaaagtgtcccacttcattctggtctaaacatatgagctggccgtcccttttctgttcctggggattccggaggttggatcacaggttacaactaaggtttcatgtcctgtggcttcagattgactgggaggcatgggtaggcagtccacaggaggaaggagatggagggcagggcatggattcaatgactccctttctttgggcttcttggggtggctgaagggacacagtttctgtcagatgattttctacacttctgggaatggagtaaccaggaagaagtgttgatgggcctaagtataaaggccattgttacctgccttaggaatcatctttcctggtggcttccctgagccctgctcccgtctttgtactctactcaaattctaagtttgtgcagtttcattcctgtggtgtcagctaccctaataagcaatagcatctggggcttcctaaagcacagccgttcaggtctctctagaagatgccttaaaattagcttacaatgtcatg

SEQ ID NO: 30555 - DNA, 1121 bp, Mus musculus
tccatggaagccagaagcagcactggacccctgtctggagtgacagagtaggccaccaccatgtgggtgctgagaattaaccctgtactctacaagagcagccactgatttttaactacagagtcatctccccagccccaaacatttttatttttaatgattttttgagacagggtctgacagggacctgagaacctttggcttagctgcctgagtactgggatcacaggcatgcactgccatgccagctaaggatatcaggaaaaataaaacttacatgacttttggttttcttcattctctttgtacagccggttgactttctctaccagctcccatttttcacaacagccagaatagttgacaaaattccgagccaggatctccttcagctggcgcacactcatcccttctacctcttcaaggcttgagaggtcagacagggaagctcttgctttctttttagagagccccgggttctgaaatcagagtatctgttaccttgttcccacaagcccaaactacctggcctactttgctccctgtggccctagataccctccccagacttctgagctgcctgaagtgcgttttactacatctgccctagaggaacctctctttgctggcctagagcaaggcccacatcttcccttcccgccataagcatttatcagggaaagcacttttacctgttcctcctcctcttgttcgtcgtcgtcatcttcatcatcgtcgtcatcatcatcgtcgtcgtcatcatcatctgtgtttgctgaagctatttcactttgtacctatatatacatgacagatccaattatattagtgatcaagtttttctaattaccaaccacatagtgagaccatgccttaaaaaaaataaataaaagaataactagggctggagagatggctcagcagttagggcaacttactgctctggcagacgccctaggttcagttcccagcacctacgtggcagatcacagccatctttaactccaatctaggaggacacacacaatgcccccttctgaactccacagacatgctagagcacacatgaatttgacatgcctaccaggacacgtccatgcaaacattcacatacacgaaat

SEQ ID NO: 30556 - DNA, 1188 bp, Mus musculus
gcagtaagttgccctaactgctgagccatctctccagccctagttattcttttatttattttttttaaggcatggtctcactatgtggttggtaattagaaaaacttgatcactaatataattggatctgtcatgtatatataggtacaaagtgaaatagcttcagcaaacacagatgatgatgacgacgacgatgatgatgacgacgatgatgaagatgacgacgacgaacaagaggaggaggaacaggtaaaagtgctttccctgataaatgcttatggcgggaagggaagatgtgggccttgctctaggccagcaaagagaggttcctctagggcagatgtagtaaaacgcacttcaggcagctcagaagtctggggagggtatctagggccacagggagcaaagtaggccaggtagtttgggcttgtgggaacaaggtaacagatactctgatttcagaacccggggctctctaaaaagaaagcaagagcttccctgtctgacctctcaagccttgaagaggtagaagggatgagtgtgcgccagctgaaggagatcctggctcggaattttgtcaactattctggctgttgtgaaaaatgggagctggtagagaaagtcaaccggctgtacaaagagaatgaagaaaaccaaaagtcatgtaagttttatttttcctgatatccttagctggcatggcagtgcatgcctgtgatcccagtactcaggcagctaagccaaaggttctcaggtccctgtcagaccctgtctcaaaaaatcattaaaaataaaaatgtttggggctggggagatgactctgtagttaaaaatcagtggctgctcttgtagagtacagggttaattctcagcacccacatggtggtggcctactctgtcactccagacaggggtccagtgctgcttctggcttccatggacaccaggaatttcagaggtgcatgtaggcaaaacacccttaacacataaagttaaatgaatagattgaaataaatgaatagattttttaaagaaaagcattatacctctttagtgactgagtcagttatggaagcctatttatagagctgctaaatatttcattacttgacatgggctgtgaggcaactattgtcaggtgaactagataaacaattgctgagtatagattccttgcttataacaata

SEQ ID NO: 30557 - DNA, 1127 bp, Mus musculus
ccctgaacttatcggaagatgtacgggaagttttggcaactttgtggctgagtgtgtttttctagaggaaaaggtccttaggttctccagagacccttccatcccttgggtgttgtttgttctcttgctccttaccctcaatacataaacaaacccagaaccttccctgtaacctgcaggatgtgttcctgggcccacattattggccataggtagctttttgtaggtggcatgtccattatgcttgagtgattggaagctgggtatgacttttcatgtcaccttggctgtgttgatcatcagagtgcaattttaatatgtttaaacaaacaaacaaacaaaaaacccttacagggataaatgatataggtattctttgtggtaggtaagtgggaaacccagacccattttctcacctacagctttgggaattgaactcaggtcattgaacatagtagataggccctcttctattgagccacccagtcttccccttttaaaattacattcaatctgtgtgtacacacatgtgtggatctacatgtgccttggcatgtgtgagggggtcggaggacaatctgtaggagtgggttttctcgggatcaaactcaggatattagacttagtggcaagtgtcttcagccactaagccatcttgcctgctccctctgcccccacccccctgtctcccgagtgctgggattaaaggtgtgcgccaccacgcccggcccagcccggcttctaatttttaatttcatctttacttattactattttctttttattttgagacagagtcacactaagtttctcagattgtccttcaactcactgtgtaggccaggcatgcctttaagttttgatcttcctacctaagcctcccaggtagctgtgagcccaccagacctgtaaaactatcttaattgtagaaacttttagctacattttcttgttttttcttcccttggctactgttgactgtagaaacttcctttttcttttcagagcaggtttactctgtgttgccctgactgtcctgtaactgacagacctagatctgcctgcctctgcttcctgaacactggggctaaagcttgtgccacaaccaaacagtaaaacccaactgc

SEQ ID NO: 30558 - DNA, 1175 bp, Mus musculus
tagtaggctttggtccatctgggttgacgttcctcttaacctctttttccaatttgactatatatatctccgtccatcctgtggtccagtgcctttgacaggacgcaactatctctgagctgtttcttttgttttggctcctgagactgtttattattatagtgagttccgggatggcacttgtagcagttttcctgcctcggcctcccaagttctggcacttaaggtgtgaaccttcacacccagcttgcccctgggcttatgagcacattttgaggcactgttccttctgaaggagactgctatattaggaagggacctgcacttctgtagccaggtaattctcttcgtatgggtcaagctgggaatagctttttctgaagcagttagcaagagaaattctccccaagttttcatttacactttagagtcccccctccccctcccacaccggtcttctaggcagacagtagtgcagaaactgatgtcagctcagatactttgcattttggggataccttaggctgtggctcagtgctctctgcctcccctctccttcccaccactttttttttttcctatccattttgtcagccccgggcttctgcgtacctgagaagagtagatgtccttaaggacttttgtgaaagaatctgtgacttctaagctcgccagccccaggcttcagctcttctcttccgagtttcccctccctgttccttatccttctagcaggatgtgttcagcaccctcttgaggatggtgctggagtcctgacatggagatatcaagtatacttggccacctgtaaatcagaagaccgcaaggagggaggccttgttggggagcagttgttccactgatgaaattgggaaaaaagctgctacaaccctcctcggagttctggttacccccagactgtcagccaggcctgagcagtatcaggcttatagacttattctactagatggacccccccagtgatactgggttaactatctgtcctacacctttcatcagccacttaggtctcccccagtgtcctcagcctatggactagccaggaaatgatggacagagagcaactttatcatgagaccctttgcttgctcattgctgttgtgcacattggctgtgggatgtcccgtacagaacactatcaggaaatccctcta

SEQ ID NO: 30559 - DNA, 1208 bp, Mus musculus
caggctagtcaccaacttgctgatgtctgtccagatgtttcttggccctgggacattgttcctccaggggcataatgccagactcctctagagtgaagaaggctggaagatctagccactaggtgagtcaaagaatttctttatggcccgagccaaaacagaaggaccatggaagttgggtctgtatatgatatagttaaaaagttctaaattgcccgccccccaggcctccgcagtacaagctgtcatggcggccaggctgttaagcttgtatggtcgatgcctgtcagcagcgggggtgatgagagggctccaggctgccctcgttcgctgggagtcctccagggctgtaatcgccctatccggtgtggagaaaaagcggcaacgagaaccgaccatgcagtggcaggaggacccagaacccgaggacgaaaacgtctacgcaaagaaccctgactttcatggttatgatagtgaccctgtggtggacatctggaatatgcgagctgtcttcttctttggtttttccatcgtcctggtctttgggaccaccttcgtggcttatgtgcctgattataggatgcaagagtgggcccgccgggaagctgagagagacttgtgaaataccgagaagtcaatggccttcccatcatggaatccaactacttctatcccagcaagatccagttaccagaagatgactaatggcttaccgagcagggcctaagaagcattactcatccgctgcttgttatttacctggttcctcagaacaccttattaaaggaattgaaagtaaaaaaaaaaaaagttctaaattagctagacattcatgcctgtgattccagtacttgggaggtggcagaaggctcaagagttcaatgttggaatgggcttagcagtgcaagccttgaatcccagcactcagaaggcagtggcaggccaattctgagtttaaagctagcggtctatatagcaagttccatgacaaataggactacatagtaaaaccagcaagcttgcctaaaatggggcttttttttttttaagatttatttatttatttattatatgtaagtacactgtagctgtcttcagacactccagaagagggcgtcagatcttgttacagatggttgtgagccaccatgtggttgctgggatttgaacttcagaccttcggaagagcagtcgggtgctcttaccca

SEQ ID NO: 30560 - DNA, 1127 bp, Mus musculus
agtcagcaccctggctgccggtcagtggtagccatgggcagcaacatctcaggggccagcagcatcaccgggagcagggccaaggccccggtccccggcggacatgaggaatgtgaaggccacctgcgcgcgcagtattaacctgtcccagctccctatttataacatatttaatatcgggtcttccctgcttccctggaatccgaggcctgccttccctggagctctgtgtaatggccgtgggcaggcctgtgtctgtctttcagggaggggccagaagcctcagggaacccctctcttcctactcctatcatttgaatccctcactggggtttagatgtgcctcactcgagttggctttagccgacctgctactttactgtgtcccaggcaccgggaggaatgaaactttgagcatcctgtggagcctcccctgtcctgggccaccacctcttctgtaagcctcccacagccccaccttctgcggtggacaaatatttaagttctcagagaacctacctgtgttgtctcttgccttggtctccggaaccgcaggcctgctggccactgggggaaagagatgcagcctccttgggacctccatgtggcagggtgttaaggacgcggacggcctccaccagagggcgcccagcctctgggttgttggagttctggcggactcttgggtgcctgaaccctccagccaccttcatagacttgctgagagtccttggcataggagccaggccctccttgtgactggaacttcagccattcggaggtcacccattcccttcctctcttcatctcagaggttcttttttgtacgggaaggggaggagtggaagggtctaagtgggctcagcccagggtgtgaccctgtgaggtccaggaagcagcaagagtggaggggcaaacaggtccagtttgagtgttctgtccctgcccagcctgctcagacccaatgtcacggctggccgcctcagacacgtttcatttggtcctcacaggacttactttaaaattctttagttatgtgataaaaatgagaactcgcctcctccatggtgagattcgacataatccagatttctgtttaccttgcaaaaactgggaaggcctggcaa

SEQ ID NO: 30561 - DNA, 1528 bp, Mus musculus
cacctggccccgagcccaagtttggaatatgacctttttagactctctgcaaccgaggtgggtcggaggacccgccatccccgctctccacggcccccagtgttttctcggattgttccgtgccaatgggaaccaggagggaaagttgaacaaaaaccttcagagctattaaattgtcgcgtgatggaggagggtcttgctgtgtccgggctagtcctagtgacaggttaggaccctaggtatatccctttgtaccaacgttcgctggttttccgcctggcttccagaaatcactaagcccatcctctgcttgttccctggagctgttaagtagctgagacttggagcggtcaggctgcctaaccaggtagataagatagcctggcttcacccctctgctagagtctttatctcccccctcttatccgttccatctgcatttggatagctcaataattgatttatggggcctctgaataggggagtggtggccttagcctcccccacccaaatttgtactttgtccttaaaggctgcagtctgttctcctctgcccccctggatctgagctttagtctctgcagtgaccacctgacagctccctgaggggggtttgaggcaagaacccacagaagcaatttcttgctttcctctgctctctaggaattcctggacaatggagagtgccccaggccccctgaacatcttgctgatgagggagtaaagccaccctgggtgggtgtgagtgcgcgcgcgcgcgcctatctcctcagctggcccggcccgacctctgaggaggctctcaccagcagctggctagattcctggttatttttagttacagatccagccccaccatcaccaccagagttgagtccaaatccaacactctaggccgggtagtgctgggactttgccagcctcctgctgaggtagggctgggtgagtaggcaggctggaacgggtggggtggccgtgtgctgtctgaaccctccccagagctggtcgcttttggtcatttcctccctgcagacttgctcttcctccacacaggtctgggggagtttgtgggaagccaggagccctctcttggttatatgtagtagaacaagttttttttcttagaagtgaattctccccttggcaaactgcagccagccagcctcctgggtcgagagccaagccaaaagatgtctgagagaagaaacctggggtcctgcaaaggtaagtgggtcccagcccactctcaatccccctctctctgtgtgattgctattccacactggagtcacctgctctgtgcttctgaggaacctcacctctggcacatcaatggaaattgtccttccctttttatttatttttatttattttttattttttgccaccctcactggccactaagagatagccctagctcctcctctcctgcctggttttgacaggactcactccattgagtcctgtctcgtctctttgcagccctcctcctccccccccccccccttcagccagcacttaggccctc

SEQ ID NO: 30562 - DNA, 1153 bp, Mus musculus
gacctggacatggagcccgagccccctcctatgctctccttgcccttgcagccgccattgccgccccctcgactgctccggccacccagcccaccgcctgagcctgagaccccagagccccccaaacctcccgtccccctggagcctcccccagaagaccaccctccacgtaccccaggcctctgtggcagtctggccaagtcacagagcacagagacagtgccagccaccccaggcggggagcccccactgtcagggagcagcagtggcctgtccctgagctccccgcaggtgcctggcagcccgttctcctatccatccccgtcccccggcttgagcagtgggggacttccacggacacctggtcgggacttcagcttcacacctactttccctgagcccagtggacccttgcttctgcctgtctgtcccctcccaaccggtcggcgagatgagcgtaccggccccctggcctccccagtgctcctggaaactggcctgcccctcccacttcccctgcccctgcccttacctctggcattgcctgtcccggttctgagggcccagcctcggccacctccccagctgcctcccctactgcccgctaccctagctccctgcccaacccccatcaagaggaagccaggccggccccggagatccccaccgtccatgctgtccttggatgggcctttggtccggccaccgccaggacctgcccttgggagggaccttctcctcctgccaggccagccaccggcccccattttccccagcgcacatgaccctcgggctgtgaccttggacttccggaacacggggatcccggcccccccaccgcccctcccaccccagcctcccccacctccacccccaccacccgttgaatccaccaagctacccttcaaggagctggacaaccagtggccctctgaagctatccccccaggacctcgccgagatgaggtcactgaagagtacgtggacctggccaaggtgcggggaccgtggcggcggccacccaagaagcggcacgaagacctggtggccccatcggcctcacctgaaccctcaccaccccagcctctcttccggccccgctcagagtttgaggagatgaccatcttgtacgacatctggaacggtggcatcg

SEQ ID NO: 30563 - DNA, 1889 bp, Mus musculus
ccctgggggagccaagctggtcccagacaggaacttcctccttggggactcccagctgccctacctactcccccccccacccccccaatccttgggttcaatgtttactttctcattcggatgccagcaacgatggagcctcccagggtgtccccagtgcggtgggggcgctgggaagggtgtttccactctcggcagccttggccctgcccaggtgtagagggtgccagggccctgagggcctcccccaagccctgccattacgggtttgtccgaccgtacgcatgtgacattttttgttgttgataagcttcgccccattaccctaacccccacacccatgtcaccctgctggaggcccccacccaggaggccagggcgtatttatttccatagcgagcaggttgtttctcctagagaaaggaagatggtcttggaaatgatattaaaattcagatctccatcttggacagctcctgcccccaccccaccccatcctcttcagggttaatttccatgaatttttttttttctcgtgtataaaatcaaactgaagggaagaaaattattattttggcgttccgaaccaatccctgtagatagactgccataacagactacttttttcttgggaactttgtttcttgtagaaacaagtgggaagactttttttttccttctctcatttctttgtacttaaaaaaaaaaaaaaaaaaaaaaaaagcaaaccaacaacaacaaaaagacacacacagtaacagcaagtcccatccacccccccaaccccccagaaagcaaagcagacatgtaaatatttctggaccgtgactgttgtgacccagagtcctcaccaagatgaagtgctccgggtgggactgacctcacccgtggaccaggtggcaggagcctcttggtacctcagcttgtgtcaagctttcttatcatgtaaattctgtacaaagaattgttttttccctttctctctctctctctctctttctctctctctctctctctctctctctctctctctctctctctctgtcgttggtggttttgttgtggtttttctctttttttttttccccttttttaattttccacaggccctctgtgtttgagactgtgcccacaggccctctgtgtttgagactgtgcccacaggcccgtctgaaggttgagaggattatttcgattggcaattaagacacaaggggcacctggtgggcacagcgcccacctactcttccatatgcagttgtctgcataattgtgcaaatgagaaaaaaaagatttatttttcacaagaagaaatgtgtagcgtgtagagatggcttaatttgagttcctcgggcaggccggctcgctgggggctttcttcatcttccctactgacccccatcacaaagggatgaagatgcccagatgccagggaagggctgcttggtccctggcagggcctcactgagccccgtcacgggatccgcatgcattaaccttgacttgagtttagggtgaggtgttgagctaacccttccccaagcccctggcttctccacccccacccccagcatcccaggaagggtatgcaatactcctgatctgtgggcccatttttctttgaaagcttttgttttcattgagtagatctcttgcttttgaagggtcaggggtttctgatttttttttttcctccctctccctgcccctgcaaagaagagaaccaataaattttagggttgtctgtgcgtatagactctgtcatctgtatgtaacttgtttttgaagagaaatgtttccgttgtgggtgtgtcttgctgtaaatatttgttcatacttttgtgaattcaatactatgtaccattgtattatagtaacttttataaagc

SEQ ID NO: 30564 - DNA, 1099 bp, Mus musculus
aggtgagaatcagtttctacaagctgtcctctgacgtgtgcacaatggcacgtacatacctacacacatgggcatgcatgcacacacacataccgcacatatacaccacacacacgctacatagaataaataaaatataatttagaagctaaaataaataaaaataagagtcttgaaaacatgatttgagaacacttggtcatgagtgtctctttctaggggttatagtatcagtctttcaagtaaaaagtacaaaaatcttccagttgccctggggcttggtctccccgccctgttggtgaggaaccacatgcttcaccagcagggtgtgtgatgtcctgttttcctggctggctgcagcttatgagttttgttagtaacagccaggcctctacagggtcaggcccttaccttcacatctcttcatccctacagctgccttctcaggccaaccgcagaaggtgatcatgacatcagctcctctgaagagagaagggattctagcatctactgtgtccccatccaatgtggtcattgcttctgctgccatcaccagggtaagagagctggcctaggcagtcctctagtgtcttctcatctccctacagtggccaatgtagctgttctgctctgctctacatcagtggtacaagatctctctgctgtgtctccacaggcttctggagtcacggagttcctcagccacagcacgagcagccagcctagccccgtctctcgactcttttctccaagtacagtgcaagactccctggtgaagggcgagcaggtctcactgcatgggggtagtccccaggtccctgccacgggctctagtgagtattcacccaagtggggcagtcagggcctcgtgggaaataagcagattgttctgggttgaggaggccattcccaggctcccataagcaagcctgagcctacagaacctaccatctgctcatagcacagtctggggaaatgcttactgggaagccggatagtggtagccacaccagcagaaagggaaaagaaggtggcaggcatgtcacagcatgggtagctaggacgctcaagacaccacactcagaagaccaggcttggg

SEQ ID NO: 30565 - DNA, 3448 bp, Mus musculus
gccaccaggctagctggtaaagtgctgtgctcagatttgaaccagtggagtttggagggcggcacgcgcctgaaggttcaagtgtcccaatgtgttacagatggtagagacatggaaaggctaggggaaggggggaacctgaccctcatccttctctttgctgcctctgagatgctgcaggtggtgaggtgttctctgcagcactcagggagcccggtaaagggtacctcccggaagaatgtggtttttttttatcctgctgtgacacctagagcaggcagcaggctttttctcctgaccctgcctcaccgtgctgcctgtcctgagaagaccacatgaaagaggggagcccaggatgtcccctgaatttctgatccatttggaagttcctgctgatgcctaagcctgccctggactaggcagttggaggacaaaaaaagggtaggggctgctggccttgtcagcggttctgctgggaccctctaaccggttgctcactccttgtctaatttctgtcctgtatgggaatagtatggtggccctccctcagctttcccccaaaacgtgtttacaggttgagggaagaacacaaggcatgtaggctgggccttggcactcccaccagcacccctccttttcccaaggacaaggtgaaattgttcttcagaaggtgaaggccactgtggtaagaaggaaaaaaatgaaaccgctgctgtgagagggtcgtgaagcccagcccttcctccactcacaccacacgccacaggccacaggccacaacatggctgtgcaggactttggctctctctccccttataggggagtaaccctgtttttacaactctccggggtataagatttggccttttgcttttctggcctacctctcctttttgctgagttaatttcatcctgttttctcagatgtttaaggctgttgttagtttgtgtgaaactggggctagggaggggggcggtggggggagagagagagagagagagaatgtgtttgtgtgtgtgtgtgtgtgtgtgtgtgtgtgtgtgtgtgtgtgctggcaggctctttcaggtgcatgtctgttttggttttgagagtgtccccatttcctttctcttggtgctcacctttgccatggctgcgaggccacagtgctttgaaatctcctctaggaatgatctatctaccttggagattttcttgttttgaaatcttgcctgatgaatctgcccaatcagagggccctgaccttgacttctgtcctggataccaaggtcacattaggaatagccaaggctgctctacttggggtctccaatgggcgctgaccacactgtttgactggggtttgtttacagttattttcatccccattcctgtccccactcacacagaagaaacttcaaaatggtggcactgtggagaatatgaatatcggccaaaatggagaaaccacaaagctacctgggaaatctctgcaagtgtttctgtgaaatctgaataagccatcagtgcgtgttctgcccgttctttcactatgagtgggcactgcagaggcagggtagctctggctaaagtgctatgcgcttttaacggaaggctatgcaccagctgtcagaagaggaggctgggagtgctccagtggtttacacagcacaggggaagcgcggcagcttcgggacttgatgttgacacactggctcttgtagaagaggctggaagtggtcagccagcatggattctcatgtggcccagtcatgaaccctggatcttgtctgtgtgctgtcacctgtgccccctcccccagacatacatagagatctgtcctctagggttctatgccctaggaatgatgtccacttagattcttaggggacatggtacccattttctggtagagttcagtggcaggtggcaccaggcctgccagtggccagcagcctctcttgggtgtgttggatactgtggctgctggatcgcctggcctcagggtcagctgctttcacttgctagctcttgtcttccttccacaatgtcaggaatctctgtctgttcatcctaccctggctcctcaagggtctctgtctcactagggcctcctgagagaaactgggtgtgtgtgcgcctctctctctttgctttcctgggagatagacatgtcttctttttagataaacagatacagggcatggtggaagtccaccattgtgtggaagttggttttttcagtgtcaccttgtggtcttgttggcaaggtatgtggacacaggaactgtcccctagaatgcctgtgtttcagagaagttcaactttgggcttcagaggacccgttctgggtctgtgcaagtgtaagaggaaagtggcagttacattgctgtggaagagtatgaaggcacagggcttgtgggaaatatgtcccacacacctcggccaggatctactcagcagattttgtgatcttaaggaagctggtgggaaaagccttaggaaacagctcccaccccttgtcgcttcaaatgtgggcaagagcaggtcaagctaccacctctttctgaggaatgggcctctgctcactagataggacagtctgcttgtcagagcttgcaagactcaaccttctggaaggaaaagggaactttccacagtgaatgttaacgtgtgtgtgcatgcgcacttgctcaagcctgtgtgtgtgcatgcgtgtgtttacttggtggaattttatttttgtaaaattcctttccagttatttagtagaattcacctacatctcactgtcaaactttggttccaccattataaccctaggcatagtgaaattggaactcctttgagattcccgaacaggatctggcattctcttgaaagctgagattgtgtaagggcaggcaggagacactgactatataactatttcctagtttacatcctgcaggttaaaaggactcatggcctcggctaggctatgtccctcttggggggagtccagtacccctcctctaggcaccttgtcacctgaatcttcaccccatgaagggaaagcaggcttcttggcttgctctgtagcaccccagcatgttctccttcaagttcttcaagtttcagcttctgtgcacaggctaagtgtatgttgtgtgctttggtgatggtctggggctcctttgaggaggcagctatacctggggtagggtggctttcatttataccagagatccctgaggctgctcgcctgagcctggtcctcttgaagcctgctgtcgacaagcacgttttccaccagctgtacccaacactacaatgcatttttaaaactatatttgcatctaagacaataaaatcttatttttttttggaaaggttgttctgtgtgaccttcaatgctgaccattgagtagtgggaggggtgaagtaatgagatcagaaccaggtgatgtcctggctggctggttc

SEQ ID NO: 30566 - DNA, 1179 bp, Mus musculus
gtagtaggatgatttgtttttcacgagacagggtttctctgtgtcaagtcctggctagcctggaactcatctacctgcctcctgagtgctaggattaaagacatgtgccactgccaccacccagctgagtagagtgttgaacagaccctccactctgaccacatcaagcttccagttaccctcctccctcagagccaagtgctgtgactgtaggcaggaaccaccattcccagcaggcttgacttttttggagtcagtgctatgtaattgtattttgtaccaaactgcagaaaaatgagaacactgaaaacctgagaaggaagagatggtgagcatggaagtgttgttggaggagcagctcacacgtggtgggtagtttccagtagtgctgagaactgacccagccaggagcctccccgggatcctccaccatgactgggaaaaaaatctcttcagaaatattaaactgtgggccgaaactttcagagaaaaatcttaaatcctgtaagatactagaaggactaagtagaaccagactgtagtagttggtttaccctgcaaacgtaggtgctggaaagctcccacctgtctccacttccggaagtacaattcatgagtaaagtttgaaaggagaaacttgggaaagttagatttaaagtagtagcttgggagtgagtcatggagagctgccgaggggtgatagggcctggggccatgtaccataggaagaggggcagagaaaacatggcaggtgtggttgaagcagaaaatgaaataaactccaagcagtggttgtgcacacctttcatctcaacactggagaggcaaaggcaggaggatctctgagttcaaggctagcctggtctacagacctagttctaggacagccagggctacatagaaaaacctgtcttgaaaaaccaaaaaaagaaagaaagaaaaaatacagactaaaggtttgagaagctagtatcgtgcctgagttcaagccacagcacttctgtaaaagctaggcatggtgtcacactcttgtaaatcctaaagagctgaacgcctgggggacaaacccaaggttcacacatgcacaagatacaaagtaaaacataggaacaaggtcaccaggactcataagaaaaaactactaagtaacagcctgtgccagaagaataattctaagac

SEQ ID NO: 30567 - DNA, 2052 bp, Mus musculus
aggactgtggttttctgttgaattggaagccagcattgtccagtgtgtgcactttcctgcaaagcacatttgtgtctccagtctctaccgagttattcttaaggcgagctttgtttccttctgaacaactaagaggttcgaaggggcttcttggcataatgacatttctgctctctgcgttagccatgactgtgcaggtctctgcccagaagggactgatcaagagtgagctgagcgccaggcagcctcttccagctaaccttccaaaggcacttctgagcgtgcatgttggtaactcctggactcaccagggtaggcgctcctgccgggacttctgttttcctccatgtcctccatgggcagttcttctgttctttcaatatcatgaagctctgtctccgtggtaactgccacacacagctctctagccctctagctgtactcaactctgcacaccccctttccctgaaaatactcaggtggtcagtgcacttcggtcagtgtcagtcacaagagacaagcagcaccagtgctcagggagtggagcacggccggaagcagagcaggcatggcctcctgatcatctcagcatctgaaggagctaagagcaccaagtgggggaccacgttgatggctttcctgtcatcactcaagactccagaaaagctagcctgtctcagccggtcctggtccttgcccaggtgcagtttctatggttaatattttcttcttgtttttctcatgtagaatcaggagcaatacactgcacattataagtaaccagagttgggtatttaaaagaaaaaaacctaggaatgtaggatggcaaagatgatatttgcttctcgtggcgttaattcagtattgggagagtcaggcggtgtggggggcattcccaaatgggaaatcattcttaacttagaagactctttttcagattcttgttactccagggagactagttttacctttgagccccagcaatgggtagtttcagctgccaggggctgcaatccaccttgtcctcagtgttttccactctagggattcaggacaagtctgtccacgtctccttggcgtgggtgtttgtccagtgaacagacactcagttctaatctcatgtgtctgcatttgtttctgagtctatatttgctttctcagagcatagcaaggtcaactcctaaaaatgtacccagcagaagacctttttgaaaaaccacacacttgcttcctctgtattcacacacaaagtggtggtatcatacattatgccctgtgatgtaagtccccttagtgctcaaagctgcctttgtctcttaagagcgtgcactgagaaaggctgtgggaacggaaggcttattctcagacagggtggtttgtttaccccatgtctggacttgtcctgagtctgaggaccactctgctgcactgcccgtcctgattaaagacgtctctgtagatgctattttctgtctcaatttacacattctttcatcaccttaaatctaagaactgggtactctaatggattgatagagaccaagagagacgtggtcaagggaagattaaatcgggacatgtgtggagaaccaggaaggcctccatgtgagctctgttccactcgagctctgcttgcactagaggtgggttgtgattatcagggcgtgctggtctgctctgttctccgttgtacatagaaggtagctacaaggacacagtggcatgtctttaccgccaccaccaggagctaaggcagaaagattgagaactcaaggccagctgggctaaacagtgagaccttgtacaaaaaaagctatgggggagagggatttgtttagctgtgtagtctgctgcttagcatgctcacagccctaagcttactcctcagcaacacagagagaaaaagaaagaggccctgccggcctgaccctaggaggaagtgtttgttttctgcagacttgaattccagcaaaaatacatctgttgtcgagtcagggtcttcctgtgtagcccagactggcctggagttaagtcctgcttcaaactagtaat

SEQ ID NO: 30568 - DNA, 1176 bp, Mus musculus
gcttgaaatgctgtgtagaccaggctggccttgaacatacagctttccttgcctctcctcctgagttctgagattaaagatacatgccaccagaactggtctacaaaagagaaccattttgactttttctgtttcatgtttttcatctttatcttttgcctgtctcaagtgggaggtcatgtagctcgggatggcccaggactcctgtcccagccaccattttgacttgtaaatggatggtgattgtaaaacagttgatgatggaggtggtggtccacagaagccggctttgtctccacaggagtgctacctggaaggcgaccagaccagcctgtaccacgcagccaaggggctgatgaccctgcaggcgctgtatggaactatcccccagatctttgggaaaggagagtgtgctcgggtaagaaccctgtcttctggctttatccaaaataggggtcaaagggtgaccttgggagacacagccaatccctttacttcatgtgcacgcaggctgcgaccccgttacccctgcttctgtctttgagggtttcatctcctccctgcagttcacaggtcactcaccacatggtcggtactcacagggcttgggaacatgcccatcgagagatgttcccagaggtgaccgaggtcacaagtgtctctttcacagtctgcttagagacaggctgttcatatctgtgtacttgtttggtggctttgccttttaaatgtattctgatcatggtgtagatgtgtaatgtgacttatgtaagtttcatcggggccagagtcacagagctcttagctgtgagtcctgtgtgaatgaatggttttttgagacatagtttccctgtatagccctagctatcctggaacttctttcatataccagaatggtctcaaacttagagatttgccgcctctgcctcttgagtgctgggatcaaaggtgtgcgccaccacagcccagctttcagtaaaacaaaacacaaggtttagtattgatctgtggacaaaagctgtggccaggggctggagagatggctcagtgattaagaacacttcctgctcttccagagaacccaagttcagttctcagctacaaccacctgtaattccagactcgggcatatgatgccctcttaaaaccaagttggtcactgcactcatatgcaca

SEQ ID NO: 30569 - DNA, 1179 bp, Mus musculus
ggaattgcaagaatagaagcatgtctaacacatctgtacagagtgcatcctttcattctcacccacctatcaaaggcttgccatgtgcttgctatgtatcaaatatacttcatgctatgtagtatgggacacagatgttttagccatgcctgtgatcccagagcctgggaggttgaggcagggcagaccctataaattttaagtgagcctgggccacagagtgagagccctgtgtgaggaaagtatggggcaggagagaaggcgtggaagttaagaggacaggctgctctttcagaggacacaggacgactcaggaccatatctgtaactccagttctctctcacagagctgacggcttcttctgccctccctgggcaccaggcatgcatgtgttgtactgacatccatgtaggcacagacactcacacacatgaaaatgataataaatctttaggaaaagaaagatgccaaaatgcaaatagaaattcctcatctttcctcctctttattttacatagtgaggaacttcaagatgcactgggtgtgacagacaagagtcttccccctttcatctaccggatgcgccagctgggctacccaccgggctggctcaaggaggctgaactggagaattctggacttgcactctatgatggaaacggtatagtctgtcaggacagagacgtcagcctccaggtccctgtcttccccctcccgtcgtctttgtgtcgtgcccccctgcacccccagctaattaagatgattagccaggcctttaagccagtgttcaggagggagaagcaggctgatctcagtttgaagccagctcggtctctaatgacagggatggctggcctgtttaatgtgttttggggtaactaaaatcatgatgactttttgtgttttaaaaggaaggaactaaagcttcattgaacatatggaattatcaggtattttagctggatagggtggtacacatttggtatcccagcactcagtaggctgaggtaggagggttgatagtttgaggccagcctgcctaagctatatagcaagaccctatctttagaaaaaagaatagaagaaatagtatcaggtaggggatagggaagcagctcggtgggtgaaggtggtttttatgcaacggggcagcgagaaggacagaagtgtctcaagag

SEQ ID NO: 30570 - DNA, 1244 bp, Mus musculus
catgtggttgctgggatttgaactcaggacttcggaagagcagtcggagctcttaacctctgtgctatctctccagcccaaggctttgtactttattagtcactttgaaacaagaacaacagtaacgaaagtcaaaattgaggcaagagtagatgaaaatggggtcgtcatttaaatgtagttctgccctttcatgaagccatgactttacagttgaaacagggtcctgcatgagatgaaataaaacccttagacatctccctttccctttcaggtgcaaagtcatttcagctgatcgacaacctgctttttgtgctggatactgatgtacgtttctgagactgctttagtggttcatttactactacctttttttttttcttttgttctttgagcctttgtgctatgaagtcagctcccagtctcccactgagctacgccttccacctgataatacatttaggtggtagacaaggacgttagctgggtgcgtgactatctgtgtgctgtgcttcgtctcagcgtgcaccaagaaacgaagcctgacgtttgccttctaaatcatagatgtctaaatgggtgtctttcctgtagaatgtgctgagcttgtgggatgcttacactctcactcctgtgtggaactggccctctcttcccgtagagcagtttgttctcacgacagaagcggattctccctcatctgttacctggtatgttgggggtctagttagtagtgatttccatagccccaagtgtctgtctgggttggttcagatcatttactacgtcttgtgttcgaaaccacatctgagtctgtctggcagaggaaggaccgattctttatttgccagtttctatttggcacaaatagatactataatgtgagcgtctatggaatgatggtagaaacagaatctgtgatgtgtacatgtgaaacagagtccacggtcttctctgaatgtgttttgacctttctgtgagaatatcactttatttaagttcatacttagaaacatgcatggtgggctggagagatggctcagtggttaagagcactgactgctcttctgaaggtcctgagttcaaatagcagctacatggtggctcacaaccatccataacgagatctgactccctcttctggagtgtctgaagacagctacagtgtacttacattgaataagtgaataaatctttttttttttttttttttggtttttttttttattttgttttgttttgtt

SEQ ID NO: 30571 - DNA, 1281 bp, Mus musculus
gctaatacggatgcctaccacgtcagactctacatcttgcaaagtttaacatcagaggggcatttcttcaagtagtggacattccatttgtgacgcagttagctttatggcacatagacgttcataatttgagccatggatgttcatgtgtacttgacaggtcaaactatgaaggacccaatgtcaaatccaactttctccatgtatgccttaggttgaatttgtttccaagttaataacttttacgggcttagacattcacactcatctctgttttattttatgcttagtcatatttaaatccagaatttaatagtctactagacagataaatgagatgcatgaatataaaaatatataaaggaaaggagatggcaaactatttataactttattatattactaacatttcaaagtttattagttgcttataaattgtatagttaaaaaaatgtctgttctctattaatcagaagattgcaacatatcacaggttggctaatgttactggagttttcaacacagttgctattgtggaaggttttctgcattaattaaaaagttggtaaaacctggcttttacctcagcgtgtcagatgtagagaacacgtgctctcagtgtgtgagtggcagtggctgtgcactcgcattcgtgacagctgcgcattcgtgacagctgcgcattcgtgacagctgctcagcctgaacagctgtgcaatgcggtgagctccagtcatggttcattctttcttcagagctttagtagtttggaagtttgactgactggcacattctatcattgtcagaacttaaataattcagttaaaaatttttaaaacatgatttgaggccgggtggtggtgcacgcctttaatcccagcacttgggaggcagaggcaggccaatttctgagttcgaggccagcctggtctacagagtgagttccaggacaaccagggctacacagagaaaccctgtctcaaaaaaaaaaaacaaaaaacaaaacatgatttgatatttagggcttttcttttttaaaaaatgagaagcaagtaaggaattgtaaagatttgggacttctttgtggcattgtgacaataaataagccaatgtgaaaggaaaaaaacaaaacaaaacaaaaagatacaattgaacagcagatgaagttttatcttaatttctatgaagactcggctgggtctcttgagtatgtgttagtaatgaacatataagtataaggcagagataaagcgaagcattacactaagttccactcccgct

SEQ ID NO: 30572 - DNA, 1229 bp, Mus musculus
gtgtgtcagaagctctgtcagatgttggctgacgatgtcccaatggtggccccaggaggactcagccttccttctgagatccatgacctcgcatgccacgctgtcaccatctgcagtccaggtgacaggacagacaaacctctcatgttctctggtccattgtatcgctgtgttccaccgctatctcttgataactgcgttccggaaaccacacgagagacagctctccttacgctaggcattataattaacaactgagtgtggttgcctcctcaaatgcttgcagttaggtggctgagagccaggaggatcatcgaccctgggctagcctagactacatagccagaccttgtcagtcaggaagtccattaacaatgtcattccttatattgatggcatttgcttctgtgtgatcctggtgtccatgacatgtgatcatgtgatcccacatgaatctttttcaaggcatgcttaagcacagacaggaactgtgtttccaatagtcaaagctatgtggtgaatctaagtggttgttaaagcagtctgacgacactttccactttcagattatttgctggatgttttagaactaagtaaatacactttaaccgctgtggagctttgcagacaatgccagatggatgactgtggaatgctgatgaaggtaagccacctctgagttctatttccataaacagcacagctgctggcccagtgtctggccctgcagatcacttgcacagttcatagaaatgcggaattcatcacttgccttggtagccagcatttgcttctttgtgggtagcactgcttttccatttcaatcctctaggagaagccgggtttggtggcgcacgcctttaatcccagcactcgggagacagaggcaggcaggatttctgagttcaaggctagcctggtctacaaagtgagttccaggacagccagggctacacagagaaaccctgtcttgaaaaaccaaacaaacaaacaatcctctaggagctaacaaaaggatagaggagaaagggggtgatatcatcatgagactacttaacaaaccgagagaccaacagcaaacaacaacccaatgcatctctctgggccctagcagtcattctaccctctgaaagttaccagaagtccaaatgttacacagttgaagaaactatctgccagtgtcaaaatcacacccctcctagagcaggaggcaaatcatagtcagctgc

SEQ ID NO: 30573 - DNA, 1196 bp, Mus musculus
tctgttaagagtttaatcaaagtaatattttataagtcaccatccagaacagaatgttagaataccgttttcccttagtactcacagaattggttccaggctgcctctcccctcagagataccagtatctctgggtgctagaatccttttgtatccaaaactaacatttacacgtaacccacgtacatttctcacacttccaacagctccagcttttactgaataagtttgatccaacattggtcaggtctgtagccatagactgaggattcagagttgtgtgtaaacatcgaaagtgttgggctcttgtgctggctcagtggtttagagcatttgccactcttcaggcactgaactacatgatgcagctgcaagggtctgtaactcctgctccagggcatccaacacttctctctcccaggtacatatacaggcctacgtataattaattaataaaaacattttttgttttttcaagctgttgggctctcaacctgacccctgactcagcttgggtaaggtggtatgtgctacagtgcacctaacactgtcttttccatacgtttgccgttaggccgctcttggaactcacaaggatccctatgaagagtggtcctttagtgacttcttcagtgaagatggaattgttctcgagtcccaggtggtgctgcctgtcatctatgaattgatctcatcagtgatgccccctgcaggtagatcacacttggttcattattttctacatgtttttactctatgcacgctggagctctagaggctgagaaccagaactgcatcccataaggtccgtttatacacttaaggacccaagtgcaaaggaacacctgcggcatattatttcatttaggcaagggaaaacccagctctcaattaagtcatggtatttgatgtcagggcaggggttgcccctagggatggtgggtaagatgcttttctgttgctgtagtaagatagcatgacaaaaagcaacttatggaagaaaggggttgctttggcttacagttccagagggtaaagcgtctaccatggtagtagaacaaggaagccaagagctcacatgttccaaagcaacagtgaagcaccgagaacaaactggaaacggtgctttaacatccaaagcctgcctccatagctagccccctccagcaaggctacctgctgacactccccaaaca

SEQ ID NO: 30574 - DNA, 1212 bp, Mus musculus
aactattttgaagaatttgtatggaactgcccaagtcttatcctatgagcaagatggcaccttgattcctcttaatgtgatatctgcagtgttcatagatcatgctttaggagacagcaatagattagggaaaactcgaaatggattttgttttgactgtgtgtgtgtatgtgtgtgtgtgtgtgtgtgtgtgcgtgtgtgtgttttcaggcacacgcacgtgccaccacgtacatgtggaggtcagagttggttttctccttccaccatgtggttccctgtgttggaactccggttggcagcagacatggtggcaggtgccactgaccctagcagagactgtgaagattgggaaatgcatgcggtgcagatgttgcagacacagcggcccttataggtctcttgctcctttccacacaggcgctgaatcttctgagacacttgaagtcatacagaaggatctccccgccagtggaccacgaataccagtacgcgctggagcacatgatcactctgccaccggctgctcacactagactgccctttcacctaatactgtttggcacagcacagaacttctggaaaattctctgtacgttcattaacttgtgatgagtttcgctaagtggccgacgaattcttttctcactggcatgcccttctgcttccccctccagcctcagagctcagcgaagagtcgctgccaaccctgctcttaatcgcgaagctgatgaaggtaatgggtagagcatcccgagagggctctttgtatctcagtcaagcctcagcctggaccggggatctgacaccacttcctgcctcactgtctctctcctcttttctgaagttctccctagatactctctatgtgtctaccgccaaacacttgtttgaaaaaaacctgaagccaaagctcctgaagtcggcacaagccaggtcctccaccctgatgagcaaggaagtggataagctcatgcagacgctggagtcgtacctcctgtccatcgtcaaccccgagtgggctgtcgccattgccatcagcctcacccaggaagtcccagaaggtctgccagccctctgctctcgggactcgggtgctcgctgacagctttctttgggttctattccctttttgcagatagatctggggaatctctctggggtcttgtacatgctaggcaaccgttctgccctgtatgttgtttctcactg

SEQ ID NO: 30575 - DNA, 1148 bp, Mus musculus
catggttgcttagcatctgtctcatcacccccgcccttcagcccggtacccagcaaggagaagaaagcccacagttgcatgtgattcgtgtttaagggtataaataaagtggggcaggcctgcagtcactaaagatggagtctgtctccctagagagttttacagtcaggcttcctttccgtttcgaacgctgttacaggatgagacgtgtgaaaaggccaaagccttgcagaagaagctctgcctccaggtccggctctcaggaacggaagccgtgctcatagcccacaagctgaacgatcaggaatatttaagagtgatagggaagccagcgcacctcatcgtgagcctctacgaacatcccagcataagcgaaaggctttgtaccacatctggcaaagattatcccggtgaggaagagacagtagtgtctggtccagaaaaggtgctgtcttgattcccagttgtcttcagccaaaagcttgagtttccctgttgtacttttttatcttcattgtcttagatatccatacagccgctaaagaaatagccgaagtcaatgaagttaatttggaaaaaatctgggacatgttgttggagaaatggctgtgcccctcaacggtgcccagtgaggtgagtgagcaagcaagcaagccagcactcacagcccgggttcctgctgagataggagctgagtgtgttctacacaagacaaccctgcaaagaaggacagactaacctcccttcctccctcccagacagcagctctctgtgtccctcagacagcttgcatagttatcctagtatctcggcctgtccagtgccgagagccaagtgccgagagcatagcctgccctgcacacctgactcaggctctaagatcacctgttacctggcgactgttaatcaatgagactgttagttaatgaggcagtttgtccttcctttctgttactctgtggctattgtaccctccagcccctgacttcagacgcattctcatataagactttttacttggattcatgtggttaactttttactttgagttaatttaaaatgaaacagtgcgggaatattcctgtacacctccgttagttattaatctccctccatatttactttattctctctaactttttactcat

SEQ ID NO: 30576 - DNA, 1101 bp, Mus musculus
gaatttctgaattcgaggccagcctggtctacgaagtgagttccaggacagccagggctacacagagaaaccctgccccaaaaaaccaaaaaaacaaaacaaaacaaaaaacccaatcattgggcctttgagatggctcagcaggtacatgattgttttacagtcttgagttgaaacgcatgacccacattgtagaagtaacaaaccaactcctgaaagtgggccatggcacagctacctgtatatatacatactaaacagagatcaagcagggcatggtgcctgagacctgcagaaaggaaagttgttgcaagattgaggtcagcttgggctacagagtaaaaccctatcttaaaaaaaaaaaagcagagcatacctttagtaccagcacccaagaggcagaggcaggcagatctctaatttgaggccttgctgtctgtctgtctgtctgtctgtctatctatctatctatctacctatctacctatctacctacctacctatgattttatgtgtatgaatgggtgtttgcttatgtgtctgtccatgtaccacttgagtgtctggcaatcacagagccagaaggcattgaatcctttgtctggccaagaactcagtgtactctcggctggcctctgcttcccaactgctggtgttaaaggtgtaaacaaccaccctctgctagatttcagggggggggaaaggtcatgtagcccaggttgtccttgaacttgctgtctagatgatgatgatgatgacagtgaccttgaacttctgatcatcttattctgcctgctaagtgctggcttcagttgtgtgccaccgtttccagtttatgaagtattaagggtcaatcaagcccagggtttcttgggttagagaaacaataaacagatatacagtcctaaaccttatgtatgtcacctctaaggtgacttttgaaagggtgtatgtgtgactgtagagctcaggacagccgttgatagttaattttcccagtgttgaggagtgcagtaattgaactcaggtaatcaggcttagactgactgcaagtgtctgtgcctgccagtagttctgttccccgtccctcgcctttttgag

SEQ ID NO: 30577 - DNA, 1216 bp, Mus musculus
gtgtgcagggcaggccagcccagtaacctcccactcctgccatgctgggtgctctcatggttcaaagccacaggcagagtttgcacttggctgctgtgaggtgtgcagaggccaggcgaactgtggcccggggtgcgaggccagtgtgagccctcagccctccccacacacctcaagccgcgtcacggtttctgtgaagaagaaaaaaagatactcaatgtttttactacacttgtaattttcctgttttatatttcaaaagaaaacttttttgacactctcaagaccattcagggaaactttttttaaaatgcagatactgttttgagctggtttaaaaaatgcagatttattgagtgccgcttcctgtcgggcaagcagtgcacggtcacatctgccagtgcccgtgctgtgccttagcttcactggtgccaggactcggagcccgcggcgtgccagccgcagctgccctatggagccgaagaccagctaggtagggcctggcgggcctcgtcactttgtgatgggtcaggagtggtccatcttcctccaccccggataatctcaggagcaatgctgcaggtgctggcgtaggcatgggaggggtttggggacagcccgccccacagggttggcagtggccgctccctcctctctgggatgtcatctgcaggtgccacatgtgcagagttcccagggcccggctggggaggggcagccccacacctgttcccagaagagggctgcgagcctgttggtagaacttagaaccccaccttcaccctgccagctggctacagcccaaggtaacacagtcaaggcagcgctgattagtgagcctgccccagctgggccaccggcagggccatcagcctttgtccccaagttggactgttttcctctccatggatttggactctgtaccctactggaaccactctgtaaagagacaaagctgtatgtgccacttcagtacctctgccaccaggaacgcccactgccagtctcgggccgcagccacatgggagctccgggtggatgcagtaaaggggccgccaggctgaccttgccaggccatagctggcactggggctgtaaagctgtagaactcttaataaattgagaattattaatttcagtttgctgtgtttctctcattgaccctgcactgctttaactgggcatgtctgtgaccacaggtgactgtgcccgctgt

SEQ ID NO: 30578 - DNA, 1180 bp, Mus musculus
agtgagtcaaatagtctgactccagcctcaccatcctccccctggaaacctagaggttggtttgtttgtttggttttctttttgagacagggtttctctgtgtagccctggctgtcctggaactcactctgtagaccagactggcttcaaactcaaagattcacctggttctgcctcccgagtgctgggattaaagggcgtgcttccttacctggcttaaaactggagcttgttagaggaagaaaaaggcaaataaatgtagcaggactcttgattttatttatttatttatttacttatttattttgagtcaaaatgtccttctaccatggatggaaatggggaggactgaccgcacctgagaagactacatagtgaagttactcagcagtagagtgtgtcgagctttaaaaacggggaagctactggaaaaccaaaatatctggtttgcacacccggtgtcctagttaggagcggtgttttccaaagggatgggtgggactccgacattgggtttttactttattttttcggttgtgaaagtttccctcccctggcccgttgtgtcacgcatttgtttattttgggttggtgtcaagagagaaagaggagtctgtgaaccatcctgaactatccactccttatgtgaaagtgttacggagctttgctttggggctttggaatgataggctgcggtggagggtggagtggacttggctgctgtcgttgctgtgtaactgtaggcagcttacagcacctctctgaacagctcttgggaagggcaggatgatgcttcgtagagatgacaagggtcggatgagatggtgacttttaaacaccgaacacagtttatggttagtgttcagtaaagagtaattgctggagctgggcggtagctctgttggcaaggtgcctactggagaagcaggaagacctgagttcaacccccagagcccacataaaaagccaggaatggtgccacacagctgtcatccgtttgtctcccccaggacagggagataggaggctccgtaaggcacactggtcagccagcctagcctagcgggggagctgcagagaccctgtcccagaaaacaaggtggactggacctggtcctgcatgctcgctctgatatgcatgttgcgttgtgtgtacccctgtgtatgactgatgagctgg

SEQ ID NO: 30579 - DNA, 1132 bp, Mus musculus
ttgcgcaagggcagcttcggcctacctggccagagtgacttccttcgctctcggaatcacctgctccgcaccatctcggcccagcccagtgggcccagccatcggcacgatcggacacagacccagatggacagcgagcagcggggccagcgcagcatgagcgtggcagccagctgctggggccgagccatggcaggccggcttgaaccaggggcagccacgggacccaagtaggacactctcaggaggcgctgtggtctccatggtgctaggccagggcaccggccctcctgggaggcctggcctgggcacacacgtcagtggctggggacatgcacagacatggcctgagagcgacccagggccccttggaagacatggccatgccaacacagccctcccagccttgcctgatgccctaggctctaaggagcccagctggttatgggatctggcaggatgtccagcccatgatggaagaggagccaggatcggccgcctagcccagcctgggaggcattcctgggcatcttgctccgtgttgatctctcagcctcctggtgccaggcgtgggtctgggccctgcctgccacctctctgtccactggcgccccttcccatttggtagcggctccaatgggtccagtccacttcttgttgactccagttctcaactgtccaacctcactggttttgcactagtttttgagagtggagacccgttaccatctcctggctccagacatgttgacatgcatgaaaatccagtctctgctgacccaggccagggcctgtcaccacacagagtagtccagtgtgggaaatcttcacgcaagcaggagagaaaggccatatcgtaatttctgctgcctgcccggtctgttgacaccacggcagcccagtggcagtcccagactgctacccacccgtccacctgccccacccagagctcagtgcagtcccggaactgatgtcactccgggctgtgagcacagcacaggtgtgaggccagccacgtgcacagctggctcttggtagcccaccttgggcagctggacctggagaagcctggcctccaccgacgctcccgcctgctcaggggcgggcgggggggggggtccccatgtcatgg

SEQ ID NO: 30580 - DNA, 1288 bp, Mus musculus
tctgcttctcttgcaggcatcattcatgcccggagcctggttcgggagtgcttggctgaaacggaacggaatgccaggtcctagcccctggctggtctgaaggcccatctcactaccccgtggagatgagaggctttgtgcaaaatggcagtcatttttctaccacagtcattaagctctgaacccacactcaaaagattgggaggacattttgcagtaactgacgatgtgcattttaagtagttaggaatgacccagctctttttttctttccaaacatttgaaagatgtttgtgaagccacttcacagcaagctattgtttgtccccaaataccagtgtcccctctaacctgcctttggatacgcatcaccccagctgacttcctttccctgagctcacctgcctccgaggagttgagtgcaaaccacagcgcctttgctcagtagctggcccgcctgtgtacagtgtagaccctgcttcatggagcttctctgcctaagcgtttgcatgactgagtgcttggaagtcaatctttaaaatgcacaggttacacatgcagaagaaagagccatctacccaacctcccaagcaccctgcagatgtccatcctgaggctgtagatctcagttctgtgtttactgtgagcccatcacaacatctggaagaaagcgactgaaactgttgcatctttgtatttattacttgatgtaataaagcttattttcattaacattttgtattacgatgtggaatctttgaggtcttaagtgcttgtttttctttggggaaggacagagtcttgctatagtgactctggctttgaactcacaatctgtcttggtttcctgattgttgtggtcaccactggagctcctgagggagacatgtgagggacatgtctgctatctggcccagaggcacctatgtgatactactagttggtgaaccacagctgctccctgccatcacaggtaggtgatactccaagaatttccttttgctgggtattgtggcttactcccagaacttgggagacagaggcagggaagctcacatccttggtgccataccaggactatgtagtgaggcattgcctttaaaaatttttttttgccaggcagtggtgcccgtgtcacacctttaatcccagcacttgggaggcagaggcaggtggatttctgagtttgaggccagcctggtcctacagagtgagttccaggacagccagggctacacagagaaacttgaaaaacccaaaaaaccatatatatgtatttcatactgtg

SEQ ID NO: 30581 - DNA, 3303 bp, Mus musculus
ccagacatttggctgtgagcagaccaccccaagtagtctgatgccccaacagatgccaagtagtggggaccaggagggataaggcctttgggaggagttgggggtagaagttggttatggtcgctgtgtgttaaaaatcccacccgcgttggcacttccaagttggaggtcttgtgtccaaatgttgattccagaactccagaaaccctcagagggacctggaaaagctctggacgtgtgttttaaaccacttctctgctctttggggtttggaaaaggttgagatttagggtgccagcctgggagagttgaaacgctagcacgtgggcacaaagaccccccccccccaagagcatgcagtcactgtatcttttcaaatggtttcactccctttgggtgacaggatttgtcgtcagatatgatttttgcctctcagtcttcttggtcagtgtttgggatggaagggcagtaggttgcgttgccagccctagggagaccagagacgtaggcttgatctgggctagtttcccgtgtgtcttacactggggaccttttggggtgtgggtcccagtgcagaccgcccctgggactctgaagccctgttctgggcttgctagcacctgtattcagctgtagttattttgccaatggggaatgccaggatgcgtgcgggggtctccaggtgttcggcattttggtgggggcccgcccgcttgccggtattactttgcagaaagcccttctctcccctgccatctgcatccaagatggactctcacagtggctcctccgccttccctgtcatcatctctcacgccctccaggcctgcctcctgctcactgagttgccaagctgcggcctggccggcagtggcagtggcggagttagacaaagcccccgccttcccccgcccgagagccccccccccccagggcgccccaagtggcgggaaggccgccagctccccaggcccaggccgctctttgtctggcatgggggcggggagctgagcctggccccaggagcttcctggcctctgccaagccctctcagctctctcacactgcgctcattgtctgagatgctccacaccggctgagctgacgtggaaccgcctccctggcctccttcagcccaggtgccggtgtcttccggaagaagggggcatgatgggcggaggagcccccttccaccctgaatccctcccggggggtgggggagacagacaccttccctaatactgcatatggtgctggctttgacgcaaagtcaggtttatctccactcctccggggtggtggaaaataggcttgaggtcctccaccagtatggggggtacttctcattctttctgtatccccactcctctaagggcattcccaaagcctttaacccttccattgggaaatatggcctcaaacaagtagagaaactgaggcctggaagagccttggctggtcctacagccaagtggcactgctgggacagacccccaagtcctggagaaaagatgtgacagggaggcgagaattagtgagaagccaggggagcacagatggtgtccctggggagtcaaggaaggtcaggctactatctccatggggccggaatcacccaaaggcttccagtgctctgtcatggcactctgtcccttcagcccctatcccctaccctatccgagcccaggaagggcttggcaacctgtaatgggaagggttaaaacccacctccaggcctctgaaggagccatctctgatggggtgccaaatgggttttggcacagtggtgaagctagggttgctcaagttgggtggcaggtccttagtctgctctgctcaggagccacatgcataccgggtgcctaagcctgggcacactctgcctttcagtgccatgtccacccttggacagagagaggggctggggttgccagtttgctgctgagccacttctgtgcagtgtggctcaccctgcagccaggcccgaggattcacggctcctcccagctccagccagcccagctcctgaacttacttcctcctgcccctcccctcgcccacaccaagtgagcagctggtgacttggccagcctggtaccagctgtccatccctggggccaagtctgcagagccgctgtgtgtgtgagagacagtttggctctgggggcggtggtcaggcagctgccgaggaagactaggtaaattctccatggttactgctgtttgtaattcgaaggacatcctctacccgcctaatggccacttggttgccattatgggtctgcatgctgcagccaggggcctcctcattgcatatctccgatgtgacattctgcgctgggctctgggccctggctttgttctgactgctgcacctggatggtgtcctcaagtgctacagtccatctgtggggtcttaagccccacttcttggagtgtagagccgctgagtgtgtgtgtgtgtgtgtgtgtgtgtgtgtgtgtgtgtgtgtgtgtgtgtttgtgtgtgtgtgtaggcaagacttctttctttggaggggatgagaagccctgagaggctgagaggcttgtctaaggcacagagactgttcctggctttgtgggggcagcacgtgtttctcttaaggttctgtgcctttgtggggtttccttgatgtattttttttccagcagaggtgggtgcataggagtgcatgggtggctctgcgtaagaaattctagcctaggttagaccaaccttggtagttgccagtcacagatgtagccttgcttctcagcctcaagtgagtaggagctgggatggtgccagcaagaattagtctggacacagctatcagtttcacttctggtagtggtctctcttgggagttctgtgggtgggctagggtgagctgtcttttgaggtactaggtgtgtgtggagtggctgctctttctgcccttgtttgcattcatctagattagtggtgtctgggccatttccattagaggttgtgctgaggtctctgctgtaaaacaaaagttcacaggtgggacctgcgcgtgtgtgtgtgtgtgtgtgtgtgtgtgtgtgtgtaacagtgaggaccttttgtagtacccagtacactttggtacagatatccaagtctggggcacctctaacttctccctctttcttgctgcaggaagtgtccactcaccctctactagcatggcgacctcctcccaatatcgccagctgctgagtgactatgggcctccatcgctaggctacacccaggtatgctagtgccagtgacgggagggccaaatgggcagctgg

SEQ ID NO: 30582 - DNA, 2339 bp, Mus musculus
cctgttcatttggggttttttgctccccctattcctttccctcctatttattctttttagactcctacctggggcatcttagtactttttttttttttttttaatttaggaaactgtggaaaagttcttagctgagtaaatagttttgtgtttaagatttcttctttgcctcacagctgtgggggtcttgttacccacatcgccaacacacactgctgtgctgtcatggggtgcatctaagcaccaccccttatcctgtcaccaggtgacttgttatgctcatttttgttctctggaagctatagtgagcctgatggctttcatatttgaaaaaagaagaaagaaaagaaaatgtctccctgaacttccttaagctcctctagcatcttcagtcagtcagatgcagctcctcagaagcctgactcattcttgctttcagttgaggctgctccagtccctcagctcctgctgtttgccggatgggaaacccttgcaggtagacagtagctcatagcctggctgcacgttacagtgtgtataaggagttggatatctctgaccccacaggtgacagtcagagatttactttacaacaaacgtccgtaatctgttttctatactgctggtcaaaaatatttataggaggacaagagatgagcttatagtacctgacaggagacagttgtcatccaagtgatgacaagagtcctactgtggaagctaccacgagcacacaaggcaggttcagttttgggggctcatttctggctggataagctataagcagagatgctgagctctggagaattggtgttggtgcctaccctcacccaggacacaggagtggagtttattcacaggccattacaccctcaaaaaaatgtcctctgtaattctcaggaaagatttcaattaacattcagattggtagatctgatgacatgttgaaaattgtctacatttggctgtctttgtaagttagtagtcaagaatgagggtctgtcaccgattgttccctcagaaatttcctcctcacaccaacttccttcctctggtccctgagatataggtgacctgtggcctgcaacagcagccaactatgtactatctagggagatgtgacagagcacagttaggccaggaaatctacagcaaacagttaattatgatgtacacccatttcatgcagagcaagaggagatggaatggaggctgctttttgcactggaggctccctcaggactgagtcagcatgccagtctcctggggagagttagtgtggcctttctgattctggcctcttaacccagaccccactcaggcgtctagtaggagcttgctgctgttgcagtgactggggcactgaagaggtaaagaagcttgaaccattcctggctccactttgtgggactgaggggccttttccttttcttctttaacatagcacagtacagcctcgccactaaactagtcaccctgttcatagtttttactgaatttgcaaactactcttacttcctctcataaccacctttatcatcaaccacgaggggtgggagaggtgcaccgtgtctctgcaataaacttgtgccgggttctacctccttgtgcaaagggtattttatacacgggctctgggcttccttcttgatctgacatggtgcatctggagacatctgaaggagtccaaataccttttgaagcaaagtcagatgtaaagtctggggggcttctgtcttcagttcccttttgtactgctgcgctgcataggactgtccatctgaatgaagagtgcacgctgttcccccgatgccacgttgctgccttcagcctctcccaggaacctgctcccaagtgtccagaatgcagtgctgccatcattttgatatgtaactttcaaatccagtctcatgcaatacaagtgtgtcagcttcactgagcagggttcatttgcccacaagtagaaatgctcgatcctcacatggaaagtactctatgtatttaggtttttgttgtggttttgttttttcatttttgtttggattttgtttctgtttttgtaaagttcttaaataaaattaaacaaatgcactttgagttgtggtgttgtggtttggatttgaaacatctgctgccctgtgtcattaacctcactcaccttaaggttccttggcaagggttgacgttgctatgttggcactttgtttaaaatgggctctctagatggctggataggtgtaggctggtgatgggtacttgccttagattgtgctcagaaagcactgtgggatgggtgggtgtctcccacagattgacctctgcacatgtagtaaactcaa

SEQ ID NO: 30583 - DNA, 9524 bp, Mus musculus
aaaaaatttttttttctttaacctttgaggtttctctgctatggtttcatgtacaaaggacagaagtattcagtgaacacttgggattattctgacagtttctaaagtctctgtggatgagaagggagttacaaagtcatatgttgccagaagctgttggcagttgatggctgcaggaaagaggctcatctgataagttgtgcccactccagtagatagtcccacgctcatacacattagattagtgcaaggcatggagttgggaaggggaatgttttaaattggctctgggggtctagtggaagatggggtgatgatagtaaaatgcacattcatacatatgtgaaattctcagtctcagccaggccaatggcagtggtcagccctgagtcatacatacaagtgacatgtaagactgtgtgtgtgtgagcacgatgtacaaaatagaagccctgaatttgagagaagttggaggcctgcagagagagacaaaggaaatgaaagggagaaaggatatattaaaaaaaaaatctatactgggtggtggctcacacctttagttccagtacttgagagacagaggcatgcaatctttaaattcaaggctagccaggaccacaaggagaaaaagttctgtaaacaaataaatggatatacaagaagacttgtgtggatacaagcataggagctcacattgtaggttgaggtaggaataccctgagttcaaagctaccatgagatagatagatagatagatagataggtaggtaggtaggtaggtaggtaggtagataagatcgatcgattgatatagatatagatatagggaggtccagcctaggtgggaggtctcaaaaaaaaaataaagcaagagcaaacacttttatgactcttagtttagtcagagttaacagagtagcctcccctcacattaaagcctggacttgcggttatatacttacatacctagctggtatatcttttgtactgaatttgctgctgtggtattatgatagagtatttttaattatgtaggatcaaattcttatgttttctgttcttttaatagataagaaacaacaaaaaaactgcaatcttagttaaagaagtaaaccctaagaagaaactatttttaatttaccgaccaaacactgggaagcaactcaaattagaaatttatgctgacctgaaaaagaaatataagaaggtattttctcacttatgtactatgtcaatgcttgcttcatgataggaagctgtgtcttcaaagttcctgggctcaagggtgatgatttcttgtataatagcaagggtttttttttgttttgttttgtttttaagatttatttattgcatttatgagtacactgtagctgtcttcagacacaccagaaaagggcattagatcccattgcagatgggtgttgggatttgaagtcaggacctctgtaagagcaaggagccctcaacctctgagccatatctaaccctagcaagtttttttatacactgctgttgcagttttaaggttactgcccattgatacacgatacgcatgtgatcttcaatacccaagacctgcaacagtttagttaggcaccgtcagtccttccaaccagcttttgatttgccatgagtatgctgcatattttcatccagaaaatggtcaatgcttttcccaacattacttgtgtaccttctgaaaagggttgtcttaactttttgggcactcttatttggaagtaactattcaactagttctctgcaaaggtcaatccatgaggggctttggatacctttcttggtgttatttccattctgctacacatgggggggctggactttctgatgaagatgatgttgtcgtccatgttgactgcctctggtgttagtgactaggtcagctatccagttgttgcaatatggttttcctttgtctttgcaggtagtttctgatgacgccctggtacactggctggatcagtataactcctctgcagacacctgtactcacgcatactggttagtgcttcttgtagcctcacttatttctttacctgtaattaaaatgttttctattttggggggtgagggtgctgagtttccttgtttgtgatcctattgcttctacctcctaagttcaataatggtcggtagacctgagccacaatgcttgtttaagaacattttctttctctctctctctctctctctctctctctctctctctctctctccctctccctctctccctctccccctctctctccctttctctccctctctctccccctcccttcccctccccctctctcttttttttggtttttcgagacaggatttctctgtatagccctggctgtcctgtaactcactttgtagaccaggctggcctggaactcaaaaatctgcctgcctctgcatccaaagtgctgggatcaaaggtgtgcgccaccactgccgggcctcacattttcatttttttttttttaagatttatttacgtattatatataagtacattgtagctgtcttcagacacaccagaagagggcatcagatctaattacagatgtgtaattgaactcaggacctctggaaaagcagtcagtgctcttaactgctgagccatctctccatcccacattttctttttttttttttttttttttccattttttattaggtatttagctcatttacatttccaatgctataccaaaagtcccccttacccacccacccccactcccctacccacccactcccccccacattttcattctgtatgaatatgtgattgtgagtaaataaacaaattgcctcttgttaggcacagtttactttatcagaattttatgtagagacttgccgtggtagtcagtacctataatcctacacttagcacttccagatcatcctaatctatttagggattgaagtccagcctaggctacattgaaaccctgacttatcgccttaattcctatccctctggtaaaacttgcatccactccttttctcttcctcattttcctcctcacttcctctgtgtgtgtgagtctgtgtgtgtgtttgtgtgagcgcgtgtgagcccgtgtgcttgcatctgtttttcttttgctttctctttggctttaaaaacaaacaaaccttactgcttgggcttgatgactcatgtctacagcctcatcacttgggaacattcagacctgaggtcagagtgtgcaagaccaggcctcaaaacaaacaaatgaaaaagaaaggagctggagagctgggcatggaggcacacacctttaatttcagcactcagcaagctgatctctgagttccaaaacatcctggtctgtagagtgagttccaggacagctggggaaaccctgtcttaaactaaaaggcgggggtgggagctgaagagatggttcagtggttaggggtgtcttctgctcctttaggaaatccaggttcaattcctggcatccatgttaagtgactcagctacctgaacctgagactagctctagtggaccccatgccttctactgatataccccacatgagttactgacatccaacctcagaaggttatgtgtacatgtgtgagcatactttgatgatactgttttggggcacgcttgggcaggtcagaggacagctctgttagggtccaccttatgtagattccaggaatcaagttagatctttgggcagctagttcatattttggaagagccacctacacacctggtttgtttttcttgtattaaatttatgttgctttggtgatgactcagatgtctgtcaatgaattggcaaacatttgagtagtactatgaccttttgtttctcagtttacatttctctgtggtttgtttgctccagttatccagcatttcccactagtcatacttgaagcagcccatagcttagtgacacagcatccactgtgatttcacagcaagcactaccacagtgaagcacagggtattgaagtgtcaaaagtgaatagatagtaagtagcaccagcagcccagtgtacaaggagaccgtctccatccatttggaaaggataacccaggaatcccaaaggattttctaggaaaagtcaaatttttcttcttgaaatatggctagactctacagatattcacgtatgtagcgtgtttctatacattttttctcctcaatgttttctaggcgtggcaattgcaaaaaagcaagtttaggattggtatgtgagattggtctccgctgccgcacgtactatgtactgtgtggctcagtactgagcgtctggacaaaagtggaaggtgttctggcctctgtcagcggcacaaatgtgaaaatgcagatagtgcggctaaggaccgaagatgggcagcggattgtaggtaagttttggttgtggggaaagaatcacatcctacccagtattatttttcacttctaacatcagagatctcttgtctcacatgtgttctagtagtgagcacagaacatgctactcattctacaagattcagaggggctggtgagatggctcagtgggtaagagcacccgactgctcttccgtaggtccagagttcaaatcccagcaaccacatggtggctcacaaccatctgtaacaagatctgacaccctcttctggagtgtctgaagacagcgctacagtgtacttacatataataaataaatcttaaaaaaaaaaaaaaaaagaaatgtttacaagattcagagcctgggttttggctttagacttatttatctgaggtatctggctgcctctcttaaaggagatgattataagcaggcaccatggtagccagtggtatttgacccttgtagtggacattgtgatttgacagtaattaccctatgaatgtctctgggctgctgtctactccttgtgcttattatcctttgctcctctgtgttcttgaaacaacctattccttttccaggctttgagtcctgcagaagctaggacagcaggctagctcagacagtgtgtggtcagctccagatgaactagttgttacactgctccttgctgataacctgtagtggggagaccaataaatctccttgctgcttagtgaactttatttgtactcaggttgtggttgtaaaattttcatataagaccgggcatggtggtgcacgcctttaatcccagcagttgggaggcagaggcgggcagatttctgagttcgaggccagcctggtctacaaagtgagttccaggacagccagggctaaaagagaaaccctgtctccaaaaaaaaaaaagtttcatataagtgagtttctagctgctggcttttaaaaaaagaaaaagggcacttagttgctacattgagttcagatccttcacaggccataactgaagttctgcagctgggacctggacctctaattgcccttacagtctgtgtgtccgtctctactgtttctgtttaccctctgtcttagtcactttgcatcttactgagtggtagaaggaaggggtgatatctgtgaagtttatgaagctgatgcctgtagtttggaaagtgctgtactgcacaccaagttccttcatcaggagatgctgttgcaccagattcatgtgttcatgtgtgtgcatgtgcacatgcatgccgagacatctcctaggaacagcttgagttcaatgcgggctgcctatctggtttctgagggaacttgatttacagttctctgtgaaggtatgatgtacaatggtttctactggacggttctacttcattgtattttgggtttgtttttttttttttttttttttttctaattacaggtttgatcattccagcaaattgtgtgtctcctcttgtaaatctcctgtcaacttcagaccagtctcagcagctcgcagtgcaacaaaaacagctgtggcaacagcatcacccacagagcatcaccaacttgagcaacctgtgaggagcagcggcgtgcacaggcggtgctgagtgctgtgagagcatactacttgcataaaaatcagggacagtttccaaagaatcctttttatttttaacttcagttgtgctctctagttaacttgggggggtaaggacaaacctggaaaaaggcagcaaagctgatggcgcaaacagagtagaggggacacgtgtctttcctccagcttccttgaggctgcctgtgcgcttttactttggtgagcagagcggatgtgtctgtgtgtgtgcgtgtatgtgtcagtctgtctgtgagtttgttacatgctacaaggccacagttggttgaaaaggcttggaacttcccagactggctttccctttcctttctacagtgctcagggtaacacagtacatccttgtccttactgtgggagttccccggatgcatgggtttcaagtctaaatactgagtatgtatattggtttcttttccaacttacacaatgtttcctacagcatgaagtgaagggttgcgtgccatgcattcaggttcatttgtagcttttgttgacgatgcatgtctttgaaagcatgtgtaatcaagattcccacagaagtcacatggagagaaacattggagatgtctggcattgggtactgcatttctagtgttgatacctgggtgttgcttctaaccctcagccctgcccgctccccctggcccaagtttcttgttgaagtagtaagtacatacttttttgtgagaaagctctttaaaagttcattttaatatgttaatagtattcctaatttgtgctgcaaaaatggctatgagccttatcatataagttccattttccttaacttaagcatagttttaggaagacatatgattggcttctgtcttgcacacaatcttttttacttcattatctgaatctgctttgtcattcaaaccagaaaccgtacttgagttgtaaactagacagtgagaaaacacttggcttctgctgtatgttgttgtcatcgttacccagtaacttgaatattgtttaatgtgctgtaagacattatagagattatctccagctgtttaaaatggtaatgtacaaatgtgaatagacacttatctataacatgggtaagttttgttttgcctataatagatgtttataaaaaaattcagtgaggggacaattggtctttttggtttttttttttctcccaatcctctccttcccccattttttttctatcttcttctttttttttttttttttgcttgcacaggttgcactattgaaaaattgagattgtataaatctggtttaaaactacaagataacaaaatcttgtagatgttgaataaaaaagttattatactaacgaagtggactcttgtttaggccctccctggggactccaggcataggatagctggcctctgttacttggagttgccttagccttccaggtagccttagagtctgactgagccccttcctgaagtctgtggaggtcttagggatggggtaactgatggtacttttgaatgtttttcaagttgaattgttttctttgtagctttttaatcttctcaaagagctgggtgaggtgtgtttagtggcagagacttgatggagcgcttgggctctcattctctcaagtttctaggatttagtttgctgtaaaactgcattggatttatttattcttagtgcctcaaagaacaaatggtgaatggtttctgttcttgggcacattttgcccagtggatgcaacttttatcctcattccttgtatctcaggcagtgatcagcaagcagtccccctttgtggcccctgagaatagaatgggtcctcctttacctagcctctgagcttctgtgtttgaagtagcagactgttcagcttccttgggcatggtaaagtaaaagcctgaggaagagctgtgtaactgaacttgctttcttcaggaaaccaagtcacagaggatgaggaatgagaacgattctgtgtcctaaggtgccagccccctcgttctgtgtgtggatatgtgtttatgcaggtcctgctttatctggtgtttccaaagcagcacctgcaggatttctctagtcttcttagtgaacaggtcattcatggtgatgacgctgtgacacttgctcctggagcagatgaggatctgggtgtccttttcatcaaagaacgtttcattgcgttttaatgttgagtgaggaaaagtccacagataccaggcatctgacaaccctttcaaaacagaattaaaggtaggtagtgtggtgggacagacagaaagctggtcagcctttacccactgttggggggtgtgagacatctggaattggtgcccagcctctctgcactctgcccctacaaaagtcactcgttggcagtcatgtctttttcagccactgtcatgtaaagtaggttcagtttcctgcagggtctgagtgccacacatgcacccaggacctcacttaactctgtctccctagcctctgagatgccttctcccacttgagcggtgcagctctgagcagcagacccgagtgttggttccatcagtgttttcagagtttacagtagtttgtgctgaaaatcactcctaggttccagctgctcaaatatacttgctggagaggaaggccatgttcctcccctagcaacctctgtgctgcaggcttgccctctcttgttccagtcagattgttggtggtggtgcagtcagaaaagcagtgaaagtatttctataaatgcaagttggtgagaaagctaggcaggctaagcagtttgctctctttactactaaattgcaggtctgctttcagtgtcttctttttttctgtgtgtatagactagcaagaacttgtatccaaagcactgtagatgctataggtatgtacatacgtgtatttattcttactcagcacttaaaccttttgagttgcaacagtaaatcttgtaatttgctctgtgtgtgtagagagaagttataaactacccagctccagaggaattaagcattttggagccacagtttggctgtagcctttttatttgctggtttctgtactatgtcatcagaacaacttctgagataggagagaaggggtaggaggacctaccatttacagtttgtcacaggagggagccccatcctgtcctcttccatattagcactagggccactgtgacttgcatttgaaagcaggtgaagaggtatttatcctatgagaccttacccagggatcctggtcttaaagaaggacccttgtgggctcttgcacttcctaggaatggagcttcagaaaagctgctattaagccaggatccacacattgaatgttcagttagttggggcatctctacggcaacagaaactgttgtgatggtttgtttgttaagagtcagtcctgtgggtgtgggctctggtgaacaacatacacaacacaggcactttggccctctagtgctgaagtgaaccaagcattccatgtcatggctgcagctgagtagacagaaattctttgcatgaaaatccctcacaaggctagct

SEQ ID NO: 30584 - DNA, 1113 bp, Mus musculus
tctctgtgtagccctggctgtcctggcactcactttgtagaccaggctggccttgtagactctgcctgcctctgcctcccaagtgctgggattaaaggcgtgcgccaccacgcccggcttatttgtatatctttgttggagaccacacatattcctctctctgtctctttggtctttcagttcttaggattgaaaatggttttgggcctactatatcagatgtctagcactcagttgtaccactcactaaacctatctattataaaagtcccatcaagcctgtcattgctggaacatgtgcaatggcattttgcctgaatgtatgtttgtgtaaaggtcctcagatcctcggttatgagtggccttgaggcactgaattaaacactgccttgtcctttggaagagcgaccagtgttcttgattgcagagccatctctcccagcctctgtatgttaaaccttcatgctacatcaacagctccttgagttatttggattgtgaagatttttgataaatttgttttcttacagacgttcggcaaggactgataggagtgggcttgattaatgtagaggatcgctcaggaattcttactcttgataaaggtaatgtcacactgtatgtgcatgtaacttagattagtggagccttccttatgcttttgtacactaaagaaaccccaactcgcgtggatgactttggagaaatctggttctctttccactttgcttttgagacactctgtttctatggctgtactgactactctaagccagttggcctttgagtttctgggtgagtttcctgtgtctgtctcctctcctaatatagaatttatttttctttttaatttttaatgtaattattcattatatatacagtgttctgcctgcatgtattcttgcaagtcagaaggcaccagacctcattatagatgtctatgcgtcacaatgtggttgctggaaattgaacacaggacctttggaaatgtggctagtgctcttaacctctggtccatctctccagcccccactatagaatttcttgaattaaagacaggagcccctggatctagcttttttacatggtggatttagtgaccacattcatcag

SEQ ID NO: 30585 - DNA, 2433 bp, Mus musculus
agttgtttatgatttcctgaaattcccccgtagagcatagttcttgtctctgtggatcctttcctaaattttgttaagaaagaaattttgctgaagtgaatgccaccttgagcgaatgtctcagaattttcagtttaagggaaaggaagagagacaaggcagagatgtcttcatctatgtatggaatcttaagacccttgtaggttgctattctataaatcacactcctgccctgtgatatgttccttagctcttccttccagatagtgtttgatgaatgtcacaaagcaaaaaacttatgtcctgttggttcttcaaagccaaccaagacaggcttggctgttttagagcttcagaacaaattgccaaaagccagagttgtttatgccagtgccactggtaagtatatatttaatcagaaatatatttgcatgttactttagcagctataatatttttgaatgtttactaggtgcttctgaaccacgcaacatggcctacatgaaccgtcttggaatatggggtgagggaactccattcagagaatttagtgattttatccaagctgtggaacgcaggtaaggaggctcgtggcactgttctgccagggctgtttgttagtgtgtacaaatcctgctttgtgtatcgatagttactgtgtgttttaattttgttcagaggtgttggtgccatggaaatcgttgctatggatatgaagcttagaggaatgtacattgcacggcagctgagctttactggagtgaccttcaaaattgaggaagttcttctttctcaaagctatgtgaaaatgtataacaaagcagtcaagctggtgagaaatgttgtcagtgttgtgcctgataattgtttttaatgaatattatccattgaaaaattacaacatagaagaacattttaggctgtaaaacaacagatgatcacagttgcttatttgaccatattttctgtgttgttattctttgttaattcatattcaattcagaatgaactcacaattacagtgtaataatatcctaaagtgacagctttctgtagtgtatttttgaaacatttatgtatgagcatcctaaaagttgtccaggcattggcccaagtgactgcagattattttggtgaaggaatcacttttagtttttgtgaagatgagggtctttctgtgtcattgtggctggtctggaatttcctatgctatgtagaccagcctggccttgaacttacagagtttctcatacctcctgagtgatggatctatgccaaacatgtttagcttaagggatcacttttaagtaacaatattcaaagatatttgtaaaatgttgtctgtgttttcagtgggttatcgctagagagcgatttcaacaagctgcagatttgattgatgctgagcagagaatgaagaaatcgatgtggggtcagttctggtctgctcaccagaggttttttaagtacctgtgtatagcatccaaagtgaaaagggtggtgcagctggctcgggaagagatcaagaacgggaaggtaagttggaggacatctggtttagttagtctgtgctagtctttgtggaatgaggtcttttacttggaatagtctttggacgtaggaggcagggcttttctgtgtagcactgttaaaatttaccctgtagaccaggctggcctcaagctcagagatggaccttcctctgattcctgtgtgctgggattaaatgtgcataccactactgtttgactattatagtcttttgtttgtttgtttgttttttgtttttgtggttttgtttttgtttttgagacaaggtcttattacatagctctggctatcctggactcaaaatgtagaccaggctggacatgaatgcacagaatcttgggattaaaggctaaaggtttgcatcactatgcccaactctggaatagtcttttaaatggatgttactagaaatactattacagtaagattttatgttaataatttattttatcattggtttagttttgagacagtattgttctgtaacatagattggtttggtatttggtgcgttgtgtaggatcaactcatagcagtcttcctgccttagtatcacaagtagtaggatttgctaccattacttgctttgtattaaagagtgtgagatatccttaaaaataaattctaaaccagacagtggtactgcatgccttttctcccagcactggggaggtagaattcgatttatcccgtgtgttccaggacagtcaggtataaacagagaaaacctgtctgaaaaagcaaacaacaaaaaaacaaaaagtaccaggtagtgtgtgtgtatagttctagcacatgagagatagacactagaggatcgcaagctccaggccggctgtggctgtgtgtatcagcatttgaattgggcctcagtgatgactg

SEQ ID NO: 30586 - DNA, 1099 bp, Mus musculus
tggcaggatagaaggaaaaagtttagttcctatatgtagagaatattcatggtagggttcactcttggatcaaattgcatcaaggagaaatgatgacactttttcagggtggttttaattgagtgggagtttatttattaaagcatggccagcttacatcagtggctgcttttatgagaaaataacatacattttcccaatttatctcctttttagcaacatgaaacattcctacctaatggagaccgtgctggcttcttaataggcgatggtgctggtgtgggtaaaggccggacaatagcagggatcatatatgaaaactatttgttgagtagaaaaagagcattgtggtaagttccatggctgactgatgagcttatcaggatgaatttaaatgaattttttttgtagtgtcaagacctgactttatttcttagttctatctaaaagtaaaattaaagtttaatttggttaattttttttgacaggtttagtgtatcaaatgacttaaaatatgatgctgaaagagatttaagggatattggagcaaaaaacattttggtccattcgttaaataaggtatggaagtttccttgttcagtggggctatcaatcaatgcatactgacttacgtgtaagaatgagagtaattttgagggagagttggggaattgggtttgttacaaggattaagtgagtttctccacataacacatgccaaaccatggaggtgttagtggcagacaatgtgggcatggtccctgatataatcgtgttgtcatcttggtctccagtgctatattgtcttagtttctagagtgctttctttgcctgtattagaaaagtagtgcacctgtcaccatagtcaacacatttgtgcggcctagaaacaatcattctgatttataaatagttttatgaactttaggtgttagtccaacaatggagttaaatggctttgcttatgttaatgtggaagcaagaaaatgtgtgtctatatttaaaacacattttaatatgattagaattttaatgcttgggctggacagatgactctggttgagagcactggctgctcttccagaggtcctgagttaaa

SEQ ID NO: 30587 - DNA, 1183 bp, Mus musculus
cctcccggtggcacccaagaggagcggaccttcttcccgacagcccgcggacctcaaccggtggggcgggggtggggtggggtggggaggagaaacgttattctcgcgaggtctcggcgagcgaccgcggaagtggcggacacgtgactgtcctaggccgcctttgccttgccccctcccccttctcggaaacccggccccctcgcccttcgcccaccccggagccgcgggaatggaccgtttgggttccggcatcccccttggatcccatctccggtaccaggctagcgggacacggcggagtcccggtttgggtgccgaaggcagagaggggggcggtcaagatggggaggtgtgggggggggaatccgcttccttcatctaggaaggaggcggggcggagacgggaggggaagggatgggggtgggtgggatgggggagtcacgtgattcgggtcgcgcgctgcgtgcgcgcggcgcctgacccgtcgccccgccccctcttcctgcggggcggggggtcggggggaggggcttcaagatggcggcggggaggtaggcagagccagacgccgcttctgccgccgccgccgccgcctccgctcctgtcgcctccggctcctcacccgttcgcggacccggagaagctatccttgggtcggccccggcggggaaagtaagtcccttctcttggtccttttcttcccctcacgttcatcctcccggacagcctcccactccccacaccacggctcctcagggtccgtgtggggccgtctgtggggggtggcggggaggcggccactctatggccgtccgcgcctcgctcgccccgctgctctgtttcctcctgctgtccgccccgttggttccggcgttctcagccagccagccagccagcgccggccctgacggagtcccgctgtccggagccggagagcggctccgaggccggctcccgccgactccactggagatcggggatcgccttcctcgccctctcttctcttcatggacccgggacgggtggtgaaaccgaggcggacaccctgctagattccgccggctcacagtgctcacgggtcgcggagcgggaggggatggcaccaggacgcccttcctggacctcgctcacgggcgggtggggtgcgtgggacacgtgggtcgggacacctttttacgc

SEQ ID NO: 30588 - DNA, 3369 bp, Mus musculus
aagttattggtggatcccaggtggttcaggacactgggccttgcttgtccctcaataagcagagaaccttatggaccagagttcccagtgtcaccatttcctagctttgtggccttggacacatggctgcctttctaagcctcatttttctcatttgcaaaatggtgtttgcccacttagcaggtttcagctgggagcctgacgtaagagaactttgaatgggcatagagcagctctttgtggtatggactgggaaaaacctgagactaaacccagaacacacagtaaaggctctgaagccatcctcagttcaagtgggttttattttattgaggtccagtcagtaaaattagcaaaaagtgtagtccaagcctcttgaaagacactgtgcctcttgacacctgtcataatattgaacccatgctgtcttgtccctccctgacagattgatctaattgatggcaaaggcaggggtgtgatcgctaccaagcagttctccaggggagactttgtggtagaataccatggggacctcattgaaatcactgatgccaagaagcgggaggctctgtacgcacaggacccctccactggctgctacatgtactattttcagtatctgagcaaaacctactggtgagtacacactgtgactttttaactctttgggtacaggaaaggcagacaactgggtgcccagggccattcctgagtctgtgatcagtttctttacctgtcacagttaggtcacctctggctggcatcaaactcatcctccccctgcctcagcctcctgagtgctgggattgccaatgtaaagcgccatgtccggagagctctccttctcctccctgttagctgtgggatggagctgtccttcagcaggagtgtgcatcccctagacacctgctccagccaagcccctttccctctgggcatttgtccaaagagctctgtgcaatggtagctgctccttcctggttgaggtcaggggagccgatttttatagttactccctcgtctccgtagagagttctttggggcctctctggcttttaaagtagcctctgggattaacctgtcttccaagtgaggcatgccagccaagttagagcctctttatcagtgtgatcccctctcattctcccacctcaccagcgtggatgccactcaagaaacgaaccgcctagggagactcatcaatcacagtaagtgtgggaactgccagaccaaactgcacgacatcgacggcgtgcctcacctcatcctcatcgcctcccgagacatcgcagctggggaggagctcctgtacgactatggggaccgaagcaaggcctccatcgaagcctacccctggctgaagcactaaccacgtggcctccctgcctccctgccaccctgcctccttcaaaggacaaagtgccctcaaagggaaatgaatttttttttacacacacacacgcacacacacacacatacacacacactcacactcactcttagctaattacttcaaatgtttttaaaaagtatattaaagatgccttttcatgtagtatttaaatatctgttacaggtttccaaggtggacttgaacagatggccttatattaccaaaacttttatattctagttgtttttgtacctttttgcatacaagctgaacgtttgtgcttcccgcgcagtgtaagactcggcacaggttttagagaatggagttgaacatgaactaggaagccgggctctgcccaagatgaaagccaggactcccccacaccccacgtccaaggacaggccggtgtgagggcgctgcccccccacgcacagcctggacgggatgtctccaagctcttgttctcctcagcatcctgacaggcgtacacactgtcgtgtatgaatattttttagcaaaagtttcacagtaagctagtcttcccctctgctttctccaaagcttactgagcccggggctgggaggcccggccaggaacagacctcttccacaggcttacggcttttccaggcaccttgaagcatcagggtggacagtcagattagaggcgggccgggaaaagcactgttctcctgctcaagaagggcaggtctcctgaaactgcattaattctttatagaaatgtgaacactgaatttattttaaaaaataataaaaacaaaacattttaaaaaaatcaaaaaaagaaaaaatggaaaaaaaaacccacagaaaacaacttaacgtgtatataggttttgaagggagtgaaatgaatgcggttttcttttcttctggggtttattttttttctttttggcttggctggttggtttgtgtagagaagatttgagatggtactctattctaatcaaaagtgaggttttgtagtgggaccagaaattactaagcccacaccccctccctaaccccaattctgctgcatgggaagttctccacctgctgccaaggcagagctcctggtctcccatgaagatgctgtcagctgtcagtctagcaccccggagcatcaggcaccagacgtgcttggcactagggtacctggcagccggcagagaaccaggatgatgcttcggttttgacctgtgagagcaagagtaggtggcttccttctccctccctggggaggactcaccattcaccttcagtccaggggcctggggttcaggagccaggtataagaccctaccctcgtcccctacacccccatctcccaggctcatgatggtgctacctacgaaagtctcccccgcaccctctgctagcccagtcagtggtcagacttggaggaggatccgacaggagggtgtaactgtgagataaaaatgtcttggttgtacctgtttgtggcttagctttgtatttaaatagcaaacaaacaaaaaaaaaggaaataaacttgaaacttatttgtcatcttaagaataaagcaaaaaaattaaaatatttattgccaggcaaggccacctatgtgttgttgttgttaataaagtggaggtggaataaggggaaagaataactgattcaccctatagaggttcttgctgcccagcctgactacccaggtttgctccctgggacccacacacatgaagagagtgggttctgagtccctgaggagtgaactttgaggtctgtcctggggagtcagaatgcaagcacgtttagaagttggcttctgattaacctatggggtagtttcagagggttcttgggaaggttagggtatataggacctctgggtaatgggcaacgtgtaatatataccctaaatgttagctgctataattgtcttaaagtctcaggtatcccaggctggcttgaaataactgataattcctggtgctggcatcaca

SEQ ID NO: 30589 - DNA, 1403 bp, Mus musculus
ggtcctttggtccttcttcgaagctcttgttctagttgccatgacattgggacagatctactacctgaagagattttttgaagtccggagggttgtttaaaaggccttttcctgttgatcccaaattcatgatttacttgtttaccaaacaccttggtcataataatgtcattagtttatacatttttattttctgaacgttcatgacttatgtttctttgtgattagtaggtgttggggaaaacctgtttaagagagttagagtgaaaatttgacatttgattggcctataattcttacttgaaaggagccccattatataggcccttccaagaatccagaggctgttaatgctgtatgggactatggtctttattatgtttttacctttggttttcataataaaatgcagttcatccaggaagtagcccacagcctgacaatacttgttaactaactgcattctagtagtcccttggttcatcatcagaggctcattttgttattacagcaacagcaatctgaatcttgaccctgtggccccgcctcagggtggagagtcctgatggggcctgttaccagggtgggcactcatgctttctcttgagctcgatttaaagactcatcaaaactcttccccctaaagttttatattgaaccttagaactgaatcacctctaattgaattgaacaagcagccaataacttagccgttctttgaatccagtttcccaggtgttggaacagactgctgtcctgtgtgctgcagagtctgtcccttgttggcacttaggaagatccagtttctccctcactggaagtctgcacttctcaagcagaaggattaagcctctggggttgcttgcagtgataggcagccactgatgtctttttagtcagtggcctttgggccctggtcttcagtgtcagcactagggtttgtttgtcctctggggtcttttttggcacatgtcagttttgtttatataaaatgaagagactgtctctctgatgatgggtttaatgaaaggcactctgctttgggtgtgggcggtccaggattatgtggtaactattgtctgttagttacctggatattttatttttctttttggatcttgcaaggggaaaactacaagtaacaagttttataaatttaatttaaattgttacaggttttcatgttcaggacaaataatttttcaaccttcgatgatatccttgcagcagtttgttggtaaggtgactttcacctagggcagctgttgcatgccaattttttttttttgtgtgtgtgtgtgaaaacacttcagaattgaattaaaagatgtaaatttaaaattggttgtgtatctaatatgcccaggttcagtaaataaacaattctttttaaaaacagtatt

SEQ ID NO: 30590 - DNA, 1371 bp, Mus musculus
ctttccactcaaccaggaggacgtcccagataagtttaaggtaagttttatgtatttgacaggggtctttgactatacccagaaagttgctcccttcccattgctgtttcctgcagcttttccggtgtagagatgggagctggagctgggcacaatctcacttacatagcaccctgctgagagcctggcagaaccccagtttcttcatcccatctctgcttttacaaaccatgtgaccttggccaggcacttccattgtggcctcctctctcctgtgagatgggaaggtatcctggacatgctgtccctgccagcctgctacacagccagtgtcctgacccaggggtagtcccggcaagagctcacttacaactcaagccagggcctcagcagtgcagagcctggatacaaggccaatccagctaaccacgttctttcctcctcagtacaaggcagacactctgaagtctgtgcagactgggcaggatctcaaagaggaacacccatgggtggactacacctccccatccctcatcaccctgctgtttacggacctgggtgtgttgacgccatctgctgtaagcgatgagctcatcaagctgtacctatgagccgagtcgctcctgccaacatgcaggaagcacgcgctgtgcaggatgagcagcctctccacgccagccagccaggggctgaaactgaatccaacatcagacgtcctgaagaatccgtggacttctgctctgtcacatctgaagcctgtttccagttctggaagcaagctgaggtgcccttatggttttcggaaactcggtctcaggaaggacaactgagattacatctgcagtcctgaggaaagacggcacacgagcagagacccccttctcataccacactcagacggctgagtacaaaccttatggtgcctcacaagacagcaaacactggctgactacgtctggcttcggggctccctcccctcagcagcccaagccagacaggagaaataccaatgcaggagccattcatgtgccactgcgcacagaatgttgtctatagaaaatgggagtttactttaaacatggttagaacccaaacagctttttaaagttaaatgtggaaacaaatcaataaattatatgaacaatttagatacggtattgcctctctaagttgacagatcagaaacagtgcaagcacaattaggcagaacccattaacaagaaaaggcctagcagcacttctcggggtagttcttcctggttttaataaaccaccgccagagcctgttctgaaatactctcaaccccaatctgaccccagcctgtggccccagaacacgggaggctaaggcaggaggatcagtctgaaatc

SEQ ID NO: 30591 - DNA, 1250 bp, Mus musculus
cttttaacagttttctgcaatttcagccccatctgcaccacgtgcgagtgagtatcttcgtaggcgctgggtgggagtgggttcctgagctccagagcctgagggtcccttctctgtcattccaggacagcttttaagatctccctccctcctgtgctgaaggccaagaagaagaaacagaaggtgtccctgtgaccagcgccacaggcttccccagctcgtcccacaggctgactctgtagggagcatggaggaattctttgaaacactgctcttgccctgtgcttccagggtgtgaagctgcagaggacccacacctccgatttctctgggaagggggacaggtgtacttatttgttgttgtagggtagcagttgcctggcagatgctaagctgttgctgttttgttgtcgctttgattttggtgctgggttttgaagcccagccttgcaggagccaggccggcagccccgcactgagctgcagtcagctccctgggactctctgttcagatgatcctctgtcagcgcttatggcggatgctgggtcttctgcacttcaggattggtagtgtgtgaagttggatgccatttgggaagatgaccagcattgggtcacggcagcagtcataacagagcatcttagttgctcatggtacactgctagaaccttgaacctgggaggctgagacaggaaagttttgggttcagatcctgcctgggatgtgtagaagatcctggctttttttttttttttaaagaacattttacttaaaataaattgtttcctttaactatactcaactgtaacctgagctaaaggcacaagccttcagtctcagcactcagggagcagagacaggtgtatctctgagtttgaggccagcctggtctacagagggagttcaaaccaaccagggttgcatcttgccaccttttttacaaaaatataaaaactagtaacattaacattggagaacttttgaatactagacatgtaaatgagaaacatttgtaatctcaacaataaaaatcctatttttatatttactaattttccttagagtgtttttctaactatttgcattgagtagtttttcttaaaattactaagagctgtgggatggtggtggtgcacaactttagtcccagcactctgtgagatcaaggccagagctggtctacagtacaagtcctaggacagcacagagaaaccctgctcttccagaagatccaggttcaattcccagc

SEQ ID NO: 30592 - DNA, 1194 bp, Mus musculus
  misc_feature (872)..(1194): n is a, c, g, or t
tagaggtcatttgggctgttagccatctctggtcttggttgtgagagcctgcaggagcccttggcgatacagatggtggaaggtcatttaaactattagccacctccagtcctggttgtggggtcttgatatggcctggcccaatagatactgcagatcaccaggctgttagccacccccattcctagccttctggatggaaaagtaggttgtgtgtcctttcctttgagagcatgatcctgtatgctcaacattcctggcttccctagcgatctgcgggcacacggaccttcaagctcttaacaactgccttttgttgtctttcaggggagccccagtctcagtgtgtggccaaaggcctgatgctgctgtcactcctcatgctggccatcctcctcaggcacccctgggtcaggatgtgcaaagcccgggactcagctgccatctaccattaagtttcctggaagactcagggcatccactcagcggctcctcatcggcccttgcgcctctctgaaacctgtcagtttgagacaggtctctccacatatccctggcttgcttctaagctcacagagatctgcctgtctctgcctctggagtgctggattaaaggcatgttccaccatgcctggactctctgaaccattttaataaacagaatgtctatttttgtagaaatccctagtgttaagtgaacgtgagccaaatatctagatgtttagagtggctccggattatcactctcgattctagctggttgcaggggaatcgagggtgtcctaagtgtcagagacttaagcccagcacggatttctaatcatggggttttatgtttgaccagacttgattgatgcaagcaggtaagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30593 - DNA, 2666 bp, Mus musculus
gttattttttaaagtgtaagattggaggagagaagccagctgaacagctagctaaaaatggtcttagatacttgattccttttcaacttaaaaaaaaagaaacatgaagttattccatcgcaagaagatgtcagataatattttccaacagctcaagttaggcatagtgttttcagacattactgctgggtcatcagcaggtccccgctcccactgcctgctccagaatgtatgtgagttctcccaaaatgctcgcaggattgccgggaggggcagcgtgacagcctgatcttcttttaataatcggagacaatgtgacaaagtggcacagcgatggctctcctgcttgcatattttttaaagacgcttgtccttcatccttgtgttagaccagtcacggcagttgtgcgttctgaaggatgactgtcctgagccttaaaacccaggggagacaggaaaagccgtgtgtatttttatagcaaagaacagatgaagatattttaccacagagactgcttctactggacaatagtatagttttttactttggcactaattctgaataaaggtctgatggccagtttgatttcccaagctgttcaggttagctgaaaactgattcttactaacctgttaatttattacattcatgtaagatcacctgtcctcagctttgagtgaagttggctcaatcccattgaacacttagatccatgtcacagtcttagaaattatcctcactttcacattttacgttaagcgagtttagctaagtatttcagaaagcaatctgaggctggggtgtggcctgattgtttccatcccccgaaccacttcacccaggtgtggtggcatctgactggtattccaaggacttagaaggtggaggcaggaggatcaggaagttcagggtttcctttggctatgtggtaagtttgaggccagcctgggctatgtaataaccctaaagagagaaaggaatctaacatgtctctggcctcttaaaattctgagttccacgctattgcagagaccttttggtgcctcagccctccagaaccatgtggtagagtgtgggtccctttccttaaaagccaagcctctggcagccagaatttcacagcttcttgggtcctgtaagagctgcatgctgagaggcatggactgcttgtgcctcagctggagagtaacatcagatcgctccagcccctgtggggtccacactgacggcagcgaggctccagctaggatgccgagcctgccggcagctgggtaagctggtgccgcccagtgtagacctgctcttacctgtatcatgtgtcacccccatgtcactcttgttactgtgcccccagggtctttggtcaccacagagatagctgcttccagggacaggaaccaaacagtttctgccatatgtactgtccctgttggcagttgtgatggggcctcttttataactggcatctcttacctgggtacagaacacagagcaagagtaacttctcagttgaagcctgtcacagttaaatagaatgtccttgcataaatggaagtcactgtttcatgagccctctggaaatataattggtagcgtcctctcaggggatgcagctctttggtggtgtcacatgttcctcttcctagaacaacatcaatggagccacgtcacatagacttatgctggtgggaaggcccgatgtgatgtggccagtagaggcatgcaaagggctttgagctcctgcacgctccctcctccataggacctgggacagactccttttcccccagatcctcccctggcctcagttctggaatgggtctctatgcttcaagatatttaatgccaccgacgcaggccttggccttgccatcctcttgccttagtctctcagctggcactacaggtatgcaatgctggccatgggtgtaatgacattcaggcccactgctccgtctgcaggagtgtagtaaggcacagaccgtccactggtaacttacagggctggcacatcaagctgtgatttagagtttgaacaagttttggaaaataaaaacaaaaccagctccaaggtcacatttttctacggagggaggaagtctgggtatgcatacatgccacactatccagatgggccttaggaactcttgtggtgttgtgaagaggcagtttgcccaccagcagaccactgctctaatacatcaagaaatcctcagaccgtgcaactccacaggatgattcgtcaaggctgtgttctggagctgggacctggggcggaaactacgggagccagccagagccgcactgtactgatagacgcatggaaggactagtctgcctgacagtattgaactcccttttgctagtgacaaaataaatgtatatttttgagatgccagtgtctagttttcttgtgatcctgttccctaagcccctacgccagaaagagctagtcctttcttagggcctgtcgagtgtcctcacagtgcctgatggctgaagccagtcttgcctgcctgacctggtttgcttctgttgctatggtaaaacaccatccaaaaccaacttgggagggaagagtttattttatcctaggttacactccatcattaaggggagaagcacacagcaggaactgaagcggagacttggagaaacagtgttg

SEQ ID NO: 30594 - DNA, 2689 bp, Mus musculus
ttcagcaatagttctaacctctgcatgcaccagagagtccacactggggagaagcccttcaaatgtgaagagtgtgggaaagccttcaggcatacctccagcctctgcatgcatcaaagagtccacactggagagaagccctataaatgttatgagtgtgggaaggccttcagtcagagctccagcctctgcatccaccagagagtgcacacaggggagaagccctataggtgttgtgggtgtgggaaggccttcagtcagagttccagcctctgcatccaccagagagtgcacacaggggagaagccttttaagtgtgatgagtgtggcaaggccttcagccagagtacaagcctttgcatccatcagagagtacacaccaaggagaggaaccatctcaaaatatcagttatataaaatgttttgctaagaattaaaaatcttaaacaaacccgtaagtgccactaggaaggaaacctcaaatccacctacactgaacccaggaacatctacagcagtccccagaaaaacattctttctgaggaggtttaggtgaagttgtgtttgtgaactcggagttcttctctgtatttgcccaggatggagcactctgtccctgtcacaggtgtggtgattcctgagactggcaacatgccacagagttgaaataatactcagaactcaggagccttgcccagccgctcagtcacctgcctgctgtgcttccgggcagtgccaggcactcccttgtggggctcatgctccttctacctaccggtcagtgcattcagaagtggacagctcccggaaggccgagttctggtattgctgaggttgccctgacatagctttccatgtatcctgttatttctgaatccaccttacctcatgtcctcagagtacctataaacacttaccccttcctagatggcattaaactccattctagatgttaggaaagttgtaacatgcacactcactcagccgatcaggaatcattggcagatgcacatgccctggaactttcccttagttttgtgaactctgctaatcactgtgtctctaagttagacttattttctagtggcttcaacacatgttccaacttgaatttttttcttttcttctttaagtagctgaatgtatatatcagggaggaagaagcaagcaaaactgagcttgccttcttcaagagtgaccctttcgggctccttttttaggtggtgggattgagtccctactagctcggaaggccttgagagggctgatggggaagtcactgaggatgaatctgtcatctcaggcaataatgtgtaggtgtcaccatgagtcacatacagttctttttaggcatgagtgtgtattactgatccaacatcttcattcattcactgagtatttattgaacgcctcctaggtgtcggacatgtactgggtgctgggaatgccactggatcatgaagttcacctctggaggagacaggataaaagtggttaacacattaataacgtagtttgcggtagtgattaagtgctatgagaaactagggtggtatgtagaggggggtggggggccaggtagcaagggtcagggactctgcgctgaaggtgctggggtcaggtgaagggagcagtgacaggacacagcacaggtgctgctggctctggggacgagatggaggtgctggaggtagtgtgtggggaggggaggtgctgagccatgagcttagtggctagcatttatagacctgttgtgtttgttttgtttcttactgactgatagtaaaactcatggaagaactcaagagatgtcgagaccaaaagtccccagtgacaccaacacaaagctcgcagttccgtttccttctcgttcctattctccgtcctccacatgcagtcctttgctcaggaagtctttggggaaactaatgacctgcaaatttgaagtgggtgactggcttggtggcttctgctagccatctaaggctggataaggaacttcccagatgattagaagtacaagacttgctttgttttgttttctttggtttttgtgtttttttggagtttggctggaagaggtttctgtaaacctgaagccttggtgcatagagggctttgtggaagcacatagtcagcggctggggttgaagagtgagtgtcaccatgccttttagtggagacctgcaggcaagcctttggcccactgatcactgcctttccccctccaccgagggctattggctgacaaagccccttcctggcctcacaaccaccacagtgatttcctgtagtgtcttacacttccatgtcaccacagcgtggagcattagagaaaagcctggatagacttttagttgatagagagccagttgaaatatcatcaatagaattttagtttagggaaaactggtttgatttctagctttattactattaggtatgtaagcttgggcaaatcgcttaaccttcaggtctagctttctcacagaatgaggacactggactaaatgattgcccagtttccagctagtcctagagttctatatttctacatagttgaattattttatcatgcggttgctggggaatacaactaacacttttgaagctactaattttatgtcaagctttaaagtccataattgttatcttcagaaatattatttgacctacagtatgtttaaat

SEQ ID NO: 30595 - DNA, 1485 bp, Mus musculus
ctttgattatgaggctacaggcaggtgtcatggcctccccgcccccacctggccttgcggcaggcagcgggcccctagctggtccccaccacgcctgggatgaggagcccaagccactgctgtgttcacagtatgagacactctcggacagcgagtgaccacggattgggggggagcggtgccaggtccccgcacaaggcagaagcagcccagcatggagcagacagctgctgactcccgagactgaggaaggagcccctgagtctgcctgcgcgtccatccgtccgtccgtccactcatctgtccatccagagctggcatcctgcctgtctaaagccttaactaagactcccaccccgggctggccctgcgcagtgaccttacactcaggggatgtttacctggtgctcgagaggggagtggacaggaggggagggacagcgggccaggagggggggggacagcaatcgtgtgtcagtcgcactcgtgcatctggggcagcggggacccaccacaggctgaccaggcacctccatgccaccgcctcgccccttaccgcatttggaaccaaagtctaagctgaactctcgcgtggtcctgcccctccctctgcccccagcccgcttgcgctctggacagacagacgttcccagcttatcctgccctaatgctgtcatcatcgcagtctccaaaggccacccagcccacaagactgggagcccatcagaccaggtgggtgcacaaggggccaggcctggcctggggcacggatgcttgcaggaactggaccgtttcccggcctgttgctgtggcaacgggagggaaggcacgtgtaaatggtgttggcttacagggtatatttttgataccttcaatgagttaattcagacgtctcacacaaggaaggactcgcccgtgtttctgccgctgtgctttggtctctacctactgtttcagaggcacgtgccagccaaggcggtggccccaccatacgcaggacttgggggtcaggggctccggcacacggcactgtgcccttcccccccacccccttccttgggcaaaatggacttgatgcgtattctgtggccgctctctgtgcacggcggcattctgtcatttacacatgttgttccaattagaaagcaaatatactcaagtgacaacgtttctactctgcttctcactgggcagcaggcagccacaggagtcaaggggagtgttccttaaagtcagcactgagcagtgaacattgacccctaagtacagtgccaccagagggcatcctgcatgcacacgtatgaggaagccaccaggtacttgtgtcgtcgataccttgctggatgttcacaccggtgggggacccattggtcattcacaccagtggtcatcgtacaggggtgttcacacttgttggggaagccagccagtacctgtattatacggtgactatgtggaggtgttcatacccgtggaaaagggtcc

SEQ ID NO: 30596 - DNA, 1209 bp, Mus musculus
tcctatatatgccaactcagctaggggtctgatgtcccacgcccatttagcagataggaaaactgaggcatagagaagtgagttaccatcccataccatgcacacatacttaccctggctgggcctgaggctcggggcatgagagaagctggggccctacctaggcttaggagcggagtgaggcatcttgtatgagtttgattttagaagcacgggtatagacagtgaggttctggcatgggtgcctcagtgtggtggcacacactctactcaggtgagatagctctggccaggctgaggcaggaggattgtgaacttcaaggcagtctgggatgtactgcaagaacccgactcaaaaatcaacaaaagcttacaagtctttaggttatctcagaagatcgtagtagcccactggggtctccatacctcagctgcagagtggccatttacagggaaatgtgcagggccccgctgtggacagtggggtctcctcatcatcgggtagaacttcaccctcagctaggacgctatctccatcaggtccccagaacccagcaaaacatcggtcctgggcagcagcgaggatgccattgagcctgtgtccccaccagagggcatgactgagccaggacatgctcggagcactgcgtacccactgctgtatcgagacggggaacagggcgagcccaggtacccatagcacaaatccgcgcttagagatggtggtgtcagttccatgtacacccaaggcctcggccctcccatatggaggccattaatccctcacagctcagcgggctgatagaccttcaggggccttcagttgcagcaccctgtgtctggcatcctggtgcctggcatccctgtgtctgggatctcagcctgagccatgccctgttttatcacttgctggtgatctgggaatgaactaagttgaaccagactgggtgggggtggacatggacttcagggagggtgtgacctgcacctgtccagttccctggggattcttgtgtcagatctagcaataaggcattgctgggggcaattcacagcgtacctgggatgggaaccagctggtccttagcacctcacggtagctcaagtggtgagctccctgttgctaaaggtcacaatgcccagcctgctgaccctggtgtctcctgctccctgcaggatgggctctaagtctccaggcaacaccagcca

SEQ ID NO: 30597 - DNA, 1186 bp, Mus musculus
cttctaggctgggactcaggatactgtccctgccctggagcacacctgagctctcagtgagctgtgagacttcctgggggaaagctgaccaccttccacagccacaccaccaccacaggggcccagggagagtaaagtgaagtacaccagcaggccccagcagcctgagctgctttctgtaaaccctgcgtgttcacagccagccctacaggcctctctaggagagctctgctgctcactgctgctgtgcctgagccagttcggcttggagttggcgaggagacttgcagccttacctcactttcagagtagggccatggtgctttctagtagatctggatcttggtaagcccccaccccacccccaacccctagcccccatccccccacccccaacccccaagttcagtctccatattgcaaggggtgttttgttagaaccatgacccgggggccaggtacacagtgtttgatgcagcctgtgctgggctgagatggttagatgcaggaaccagcagggccctgattccctgctgctctggcgctggtgagaagaaaggcatatcgctcatgagccatgtggatggtatgtgtgactcgaagcaggcaagccttagggatgcttattgctcttagtgtagagaggaagcctgaacacagggaggagccagggaggacaaaggccctggggcctctgagcttaggcctctgagtttacggttggtgcttctcaaaggactggagctgggaggccagtgaccagtggggtttttgtcttgggtcctgtgaaggccagagatcaacactttttttttttgttactgtctctaattgcatgcctgagtttgagtatgtgaacatgagtgctggtgtctgtagaggaacaaggttcaggtgggttgtcatccacctggcatggcttctgttctctgtaagagcagtgcacccctgagccacctctctgcctcctttatgtatgcatgtcacatttttgtgccgtgtccacagaggcctgaggaaggaggccagaagagggcatccggtcttctggtgttgagccaccttatgggttctggggaccaaacctgggtctctgctctttaccacagagccatctctctagctctagggtactgttctagctttaagcctgcctggagataatggagaaaccgagggacatggt

SEQ ID NO: 30598 - DNA, 1100 bp, Mus musculus
ggtggcaggcactgggcactctcagctcttgattgtcccgtagggcttccctcagcctcagcctggcctcagcattggcctgtctttctcttccccccaggtttatgcagcaccctaagaactttggcctgattgcctcattcctggagagaaaggtgagtgccatccctggctggcagagctgggcactaaaccggcttgccatccactccttagggccgatgtctgggctgggtggagcgcttgcccctcctctgtctctctggccagctccatcctttttcctgcctccacctccttcctcagggggaaagccaggcaggccccaccctggatggggaggagcctcaaggcttcaggcccaggccacccaggaaagctgtagggactggcatcacacagccatttgcccagcacactgggttgggcgccggttctaagagttttgccacgttccaactgaggccttgtggccaggaatggcctgcatccaggtctgtgtgtggagtaatctcctgggcccttgtcatgggtaatatgggttttctgacaactctagataccactacttccggtgtgtggctaacatgtctatcattctgaacaaaccttcatgcagaattgatatttgaacccaacctgttccctaaaccagagcctgaaagcactctcctctggctctgtctctcgtcggtaaggagttacattgtccccagagggcagttagctggctttcacttacataccaggctagcctacagtacatgaacaacccgtggtgggcaggtggcagggttggctgtgtgctggagttggtcctgtaggcccagcacctcagactaccagggcccacccttgtgggctgtagttggtgtctagaccctcaacagtgggatgtccagcctgcctggccccctgccctgagtctgcccagggatgctggcagctggtgggaggtgggacccgggatctagacagccgttctcaaagaccgtgatcattcctcactgttccagtgggctgatacggtctggagagatgggaccctctgggatctgggacctgaagaaccagtgttgggaaccagttatagcctacct

SEQ ID NO: 30599 - DNA, 1176 bp, Mus musculus
ctccttcccgctcagctcagccaccccgctctgtcttcactcagaccccagggctgaggccattccctgggagcccttggtgctccccagagagaagcctgcctcgcttttttctgcggggccaagtgtgcaggagaccagtcagccacgttcctacccagcacaggccgacagacagagatgtctgcttcctcccctggccaggccccctctctccctgtgagcaacatcccactgtctttagacagtggttgtcaacggatcctagctccactgtgggccagatgcacacacctccccagtagatgggacagactgcagcaggccacgcggtggtttgatctagtcagagactgtcccgtctcagacagtaccacacctccccctcggaagctgcttgttgggcctttgtgctattgcctggggctatggagcatgtaggacgtttctgaggtcttgggaccctgttgcttgtctgcaaggtctgggacagtcccagctctcagctggtatctgacgttagctggtgtcctctgctgtctctggcctctggtctctgagtgttctctttcttctccctggtcctctgggtgggagccaagaggcctaggctggactggtggagtgtgttttggggccctctagccgtagccccccatcttccctcagctggagtccaatactctgggggctgttgttcaagacacagacacagggagctccgggtcagaggttaagtacactgtggccggtatcagggcctagaacatatccaaggtgttatatgaccgagtctcctgtcctgtggctgatagaggcgtgaattttgaaatgatccccttggatatacacagggcatgtgtctatgctctgggccaattgggagataaacagcaggcagcttggtggttaaatggggagggggacttccttatcctgcagaggagggcagaaccttcctttccaatgtctgctaggttttggactcttagatttggggagtgtggctgcaccagagaccagggatgaggaactgcctagaaagcggatactccctggggacatcttttctgggccacaagagctctacagagccatgctgcccaggacaacttcctgcaagtggtggggcctggcctgatctcctgtgcagtatcctgcagtgtcggtagccgg

SEQ ID NO: 30600 - DNA, 1221 bp, Mus musculus
tgggtgtcctcaacgttctctgtccaaccacaggaccgtagcctggcaggcaagctggagcctgtgtcacctcccagtcccccgcacgctgaccctgagctagagctggcgccatctcgactgtccaaggaggagctgatccagaacatggaccgcgtggaccgtgagatcaccatggtagagcagcagatctccaagctgaagaagaagcaggtgagtagtgagggcgggcagaagaccggccccacgtcctcaggtgcctggagccacacaatttcctggtggttggtgtgtgtgtgtgtgtgtgtgtgtgtgtgtgtgtgtttaatgttttgcttctggaagcctctgggccgggcccatcaggctcatatatctgcacggtcaacagagagtcctgagcttcaggggaccaaggcttcccgggagaggcaccatgagctgcccaaggcagagaaagagcctttggttgttcttgcataaaagctgaatggggagccgggagctgggcactgagggcttccaagatggtggcccagaatcccagagtgaggctgggccctggtgcggtcagattggccgtgccagaccagtggagctctcacatctccagtcctccaggcctggcttgggggctgggctggagccactgttacatgcatggatgttgatcaagtctggaggccaagtgacttgagctgctgttattagttttctttttctccttttatttttttcctcttaacctaaatttctttcttgaatgttatcttaaaaaataatttatatatatatatatatatatatatatatatatatatatatatatacacacacacacacacacatacatatatataaaagtataaaaataagattatataataatataaaaataaatgaatgagagagatggttcggtggttaaggacatgtattgttcttacagactacccaggttcagttcccatcacccacatctgacagcttacaactccttgtaactccacctccaggggacagccctaacctcatgtacatgcacatatgcagatgtacacacatgtatgtgatgtaaatatgttgtaataataaaaatatttttaagaaaataaaatatacttgtttgcctgtgcgcatgtggatactccctttgtaggagttggttctctccagctttgtgctttgtcagcctgtggtgggttaacgccaccaccattt

SEQ ID NO: 30601 - DNA, 1225 bp, Mus musculus
tccagtggttctcaacctctgagtcatggcccctttgggggcctgaatgctcctcagggggacctgagttgaacctctaggacctgtatagaaagctggcatggacacgtgaacctccagtggttctcaacctgtgagtcatgacccctttgggggcctgaatgctcctctgttacataacagtaacataaattactgttatgtagcaatgaaataattttattggggtaggggtccactacaacatgaggtattaaagggacacagcctaagaaaggttgaaaaccactgctctaatcccagtgtttcggaggcagagccagggttcctgggacttgctggtcagctagcctaacctgattggaagggcctgtgccatggtgtgaggacgcccccttcaaaaaacaaaaaccagggttagacaggatctgaccagcgcttgagatgtcctctgacctccactggcctgtgtacacattcacccacacttagacaaaactgagtcagatcgagccagctggcccagccgcagagccaggcctggctggcaaaggcctgtgtagctgctcactgcccccgctcatgtgcttcctctgtgcctgccatgttgaccttggctgctgctcctcctgtgttcttccaccccagggcctttgcacactctctctgcccgaggtgctttccgctggggcatctctacctttgcttccacattgcctgacccgagggctctttcctggtttgtcagtacctaacaccttcacctggctgagtgagggtgtaatgtgctaggccttgtctgtgctgacctctacagtatgaggctgtctctctcgctgcagtgtgtcaccccactacacctcaagttcttgaatggtgaggctggtacctgccctggtactgctggggatctgagtctcccatctgtcttcatgtctgatacctttgtctggactgcagtgcccgagaccaggcgcactctcctctgaggctgtgactgctctgggcctctgtgcagcagtcctaggtaccagcgagtctcagcgtctggatttgtcaagcaggcagctgccttcaactgtatggcatgcacgtgggtggatgttgtccttgcattcactggcctgcccctgcctggcccttggggacaggtgtgcacactggtgtgatagctgtggcttctgtgccagaagtccactctgccctagtgtcagagctggttggg

SEQ ID NO: 30602 - DNA, 1502 bp, Mus musculus
ttttaaacatgtgggcagacatttaagccattcctagtttctttgtgcggcggtgttatctacccactccggactctgcccccttcactgtaacaggccagtctccctggcctcagttttcccatctctaaagggagaggttggaaccaagagacctacatgactgaggagtccccgtgtctatagagtggcatctctgggttcatggcagacagggctggatgtgtcaggaagtggtttctgtgctggtgggatgtgcggtgggactaggggaggtaggcagggcagggctaggtgacaggcttgtgactcagcttccttttttctccacagggtcctgaagacactataagccccccaaacctgatagcttggtcagaccagccacccagtccctacaccccgcttcttgaggactctctcagcggacagcccaccagtgccatggcctgagcccccagatgtcacacctgtccgcacgcacggcacatggatgcccacgcatgtgcaaaaacaactcagggaccagggacagacctgctgccaagtgagcctgatgggccacaggtgtgctcttctaaatggcctgtgagccaggctgtgggaactctagctgctgtcagcccctcctgtaggagctggccctgcccaggctcctgacttccctcaggaagtctttctgtctttctccatcagtctgaaagccttagttcccacagaggacggatctgtcactcctaggggctgggcatatgtcggcctcttgtgccaaggccaggcaagcagctccaggtcctgaccagtttgcacacacactctggagctgtatctggcgctttttctatcgtctctgctatgtcactgaattaaccactgtacgtggcagaggtggcaggcccctcagggtccttatttttcaggcatggggtcaaagctagaggtatgggccgtctacacccccccgccccccggcatctagtgtacctcaccagagggtattcggaggcccagcatcctgcaaccgaccccttttttctactggaagagaaattttatcatcttttgaaaggaagtcatgactgaagcaataaaccttttcactgattcaacaacactggcttctgtgactgttttctgggcagggctgggtctccagaatccaggccacatcagtaggtgttcccatgactgccagcgagtctcctggtgtgaggccagcaccggccactagccatgtttccacctcaaggctaatgtggtatgtggcttggatgcaccaggacaggctagctctgtcctttctctgtcccgtggaaccttctgggccttccagcagtctgtgtccaagatcagaacatccttgtgaccccaagtgacaagcctgcagcgtctgggggagggctggaagggagggtctaacttttgtcccaagttcaagcaggggttctacctggcatctctgagagtaaaaccatgttttgcccttaagggacccactagga

SEQ ID NO: 30603 - DNA, 1064 bp, Mus musculus
ggccggaagagggcatagggacctggagttagacggagttgtgagccactgaatggatgctgagacttgaacctgggtcctgccagtgttctcaaccacaattccctgggtttactttatgtttagctttgtgtaacgtacagagtgagactgagagtcctcctgcccccattccctgcttgcccggcagaaacatggtggtaggagtccagccttggggctggagagatgtcttagcagttaagagcactgacggctcttccagaggtcctgagttcaattcccagcaaccacatggtggctcacaaccatctctaatgggatctgatgccctcttctggagtgtctgaaaacactaaagtgtacttatgcaaataaaataaataattctttgaacgaaaggacccacatgctggtcactcctcagcatcgcagatcacatgcctgggaaccactgaggaagaggtggactctgggcttcatggtgaaaactaagtccgggaattgctggactcagctaggcttctgtacacacacacaccctgggactcctgcatgccagaaaacactctttcactgaattacatcccagccctcttcactttttaggtctcactagattacccaggctgcccttaatctctctgtagcccatcatggccttgaacatgcgccacttgatctgactcatctgggctcttgaaaccggaggccaaagtgggctggccacgggcttgagttcctgaggtcagcagccaaacattgatttgctccactgcctcaaatactctttagaaatctttatagatttatggagaggtgtcagagacgcaagcaaatctttgttctctgtccccggtgcattcagtactgtccgctcctggcagtatctgtcacggtaaggaaccaaagtctagtgcagcgttattgccacaactgcagcttctcagcacgagatgccgcccgctcacgcctcacgcccggctcccgtggctgtgatgggttgttttgttttgtttttttcttttaatctttgtttcttgttggtgttgtgagttttggga

SEQ ID NO: 30604 - DNA, 1120 bp, Mus musculus
aatatctcattggtgctgtcccttccattcctgtgatgtcagagacccactcacgtgtacccctgagctacaatgtctccaaaagcagtctgtgtgcctggcttgacattcagactccgcttccactcctaaattcatatggtgttaattttcctttccactttcatctcccatgattccctgctgcacctccagacctggaggggtgggggtggggggttgaaaatcacgtccaagctctcacctcttgctacactcccacccggaatgcctttcccttgccgggtagcagctgctctctcccttcctccacccacccacccacccacccccaacactgtaatcggccactctggctccatccacccttcccaggtcctgtgtgtgctcagcttggtccccagtgttagcatccctgcatccctggcaccgaggcaggccaacgtgacgctcccgtcttctaacgcctctcttcccctcctccaggtgcgcctctgtttctctcccacccccacttttacaacgccgaccctgtgttgtcagaagctgttcttggtctgaaccctaacccaaaggagcattccttgttcctagacatccatccggtaagctccgtgtcctgctagtggctggggcccattcccagagattgccactggccgctgggcacccgccccgctccccccaattccccaggacagagcgggttccaactgaggcaggggagttcagttccttccacagcggctgctcctagaacttcaagtcatcaaagtcttactttaccccaattccagagttcagtgatatcattaccttttttattggggcctataaaaagatataagatagtaaattaattaagacctatcagccgggacgtctccttcaccagagacagatacccttgacagtgtcaagacactaaagacatcatcgtgggccagtgtctcacagagaaatcagggggaggaatttgtcctctgttaacttctctctgcctctggtcactgtaagatgtgtccagtccagggttcctgccctacgtgacgccctgaaggcattccgtgaagaactcttttttgttttactgggtggggatggaagcctgggttttgaa

SEQ ID NO: 30605 - DNA, 1185 bp, Mus musculus
tcttcccgtgtcactcgggtgcccttgctctctcgccagctcgtattgcaccagatgtcaatcaaactcaaatgaaatgcttcctctgatcctgatcagatcctcccagacactctccctgatcttccgtcccctctggctctccagccgctctctggtacactctctcttatgccttcctgttgcctgctcatggctgtcgatgttatttactgaaccctcccctgcttgtctcctccttggactgcaaaccctgtggccatgtcccagtaggatattgggagtcaaacttctaaggcccctacacagacgtgggatccagggcttgcctgcggacaggaagtttcactcacaactgcacctccgccttcccctccttgtaccagcaaaaatcccagggcttggttgaactggtccagctctgacctagtcattaggctgtgttaattggccaggctgggtcccacacaccgcaggggcagcaacaggcccacatcacacagaactctgctgtcaggaacagaatttcagctgtgaaagagaatctaagtgtagttgtgtctgtagcttgttcttttgttttgttttgttttgttttccggagacagtgggtttaagtatgcgtgtgcgtgtcgcacacgcgtggagggaggtataaacaggtgcatcgatggatggagaccggaagtgagtgtcttccttcatcactctttgtttgtttgtttgtttgtttattgatgcagatttttcaatcactaatcctggatcttgggaggtccagggatccacctgtctctgcctcccagttacagatgtggcgctgctgggaacccgaattcgggtcctcacacttgcacaggaggctcttaactgactaaactgttttcccagcccctaaagcttgccccttgtaaatcgggtgagaacaagaaaggggaagaggaacagggattcgagtgatagggaacacggccatgtgaccaacaaccccacaaagaggcaactcttaccacacccaacatctccccttcctgctcctcctgcccactggcctgacttttggtctctcggctctctgcctggcattactgtttacatagatggagtcacaactgttctttctccctcgatccctgatgcctcccatgatggctctcatgattatatggtaaatctgcaagatag

SEQ ID NO: 30606 - DNA, 1187 bp, Mus musculus
tctaccaccccatgtgatgaggtccaaggccagtaccaccactccagactaattttaatcgttcagacaaaagtttggtgttcttttgggggaaggagagttgaggcaggattacactgtctctggctgaccttccagttagagatctgcccacctcagtgtccccagtgctgaggtcagcgataggcatgggctcagacttagttttgcagtagtaacttgctatattaccattctgaaactgaatccgggactgctgtggtttcataacctcccagaggtcaggcttttctgcaaactgttcaaatagacagaaattgactttcagctgttggtatactgaagtctccatcctgtaaatttggtaatacaaaaagactcaccatgccgaggtttcttaactttgttagtcaacaatcttattttcttgatggtttttcggggtggggggattggattcaagacagaatctgtgtagatagaccttgctatttagacttatagcatccagttgacaaatgttgatgccatcccacaaatatttgtgtcattcctgacctgtgaattgttttgtatattttgtgacagacgatgcagatctttgtgaaaaccttaactggtaagaccatcaccctggaggtcgagcccagtgacaccattgagaatgtcaaggcaaagatccaggacaaggagggcatcccccctgaccagcagaggctgatctttgcaggcaagcagctggaagatggccgcaccctgtcagactacaacatccagaaagagtccaccctgcacctggtccttcgcctcagaggtggcatgcagatctttgtgaagaccctgacaggcaagaccatcaccctggaggtcgagcccagtgacaccatagagaatgtcaaggcaaagatccaggacaaggagggcatcccccctgaccagcagaggctgatctttgcaggcaagcagctggaagatggccgcaccctgtcagactacaacatccagaaagagtccaccctgcacctggtccttcgcctcagaggtgggatgcagatctttgtgaagaccctgacaggcaagaccatcaccctggaggtcgagcccagtgacaccatagagaatgtcaaggcaaagatccaggacaaggagggcatcccccctgaccagcagaggctgatctttgcagg

SEQ ID NO: 30607 - DNA, 1208 bp, Mus musculus
aaaaccctttgtcattttccttgttaggagatttgcacagtcatccaccctgtcactgtgccaaaacagtgagggctgggcatagtgacccgccggggatgaggggattgaggaggcgaggtcaccaatgggatcccagtgtgacaggagccaaagccctgggtccccctagcgcggaaagaaaacagggggggtggggggtggtggcctgactaggggcgccaggccgcgaagccgcagggcgcctgcgccaaggcccgctccggcctcagtgatcccagccgtgttttcgtgccgatcgtctcacgcgcgctgatccctccgcggagtcgcccgaggtcacagccctgccctcccacacaaagcccctcaatctctggacgccaccgtgaaacaactccgtgagagaggtaccttgatagttttagcctgtcgctttcgctgccgagactggacccggcgttacaaagtagtccctgaccgcattgcccgcggagggaccgcgcggaagggggggggcggggcttcggtgactatataaagagacgccgggcgtgccgcagctagttccgtggagactgcgagttccgtctgctgtgtgaggactgccgccaccaccgctggtgaggagaaagccgccgcacccggtcggggacgggaggctggaggcgagacggggcgagaggcagccccgcggcccagacgtttggtttccgtggcccgcgcggaccgcggctgccccgaggcagaggactgggcggcaagatggcggccagatggaagcctgagggggaagacgcggggctctgacgcgcaggacgaggttgggggaggaaaaaggcccgcgaggccgctgccctccggttaagccggggacgtcggagactgtggggtggggactgaattagggttgcgcgccgtaggagcctctgctgtgagagccgtggatattgggctggcccgagaggtcgattggcccggcgttcgtccgttcgtttgctgaaagacggaagtgcgatcgagaccggaagggggttgggcggcggttcagcctgcctggcctgccgccccctgtgacgtcgcgggttgcgtggcctcctaatggatagtgacgtcactatcttgactttagctttccctcggttgtaggacagggtttgggtctcggcctccggtagcctctccagagtaaacaggaaccggaaatt

SEQ ID NO: 30608 - DNA, 1196 bp, Mus musculus
ttacagaccagattccatccacaggtacaaggccagtctcccaacgtaggccctttaaaaaaaaaaaaagttggagatgccggggattgaacccggggcctcatacatgcaaagcatgcgctctaccactgagctacatcccctgatggagagacttactttccggaatagataacagaaatgaaccgcttgctgttctaaggtttggggtttttgtttttgtttttgtttttttccgatcttgatttatgatgttggtgtcatgtgctgaagcctcgggagaaaggaaagggggagaggaacagagagaaggaacgtagaagagggaaggaaccgtgcgcccgtcactatctgtgtctttctttcttttgttttttttttttttgttttggtttggttttccgaggcaggatttctctgtgtatgccctggctatcctggaactcactctgtagaccaggctgaccttgaactcatatctgtgtctttctatagcagcttgtcaagaaacagtttagcacagcttgtcctcgttagtatagtggtgagtatccccgcctgtcacgcgggagaccggggttcgattccccgacggggaggctaacagtggtttttgcgttagcacttttaggaaatgatggatgtgtgtaggaagctctgaaaagacccttaccgtgcctaaacacaatctgctttcaacaactttatagagaccccttggtctcacttaggaaacaagtctgaccctggttatctttcaaacgcgaactccaaaaaccgcaaccctgctgcctaaccaggcagcctctgccgagaggcccctccctccttttcttcccatttttcttaaccatcttactcaatttttgccccgaagatcggtttttatcttctttctttatttttaaaagccaaataaaagcacgcgttgagaaagcatatatcagttgcccatgtctcgccagggttttggtttttaaattcctggttaaccttgtaaccccagcaggccttcatgtcccccacttccattttggtttggttttgtgttttgagacaagacttttatgcatccaaactgatttttttttaaagattcatattattttatgtacagcagtgttttgcctgcttgtgtgtatgtgcactatgggtgtgcctactgctggtagatgtcagtagaaggatggctgtga

SEQ ID NO: 30609 - DNA, 1160 bp, Mus musculus
gcccacaaggctgattctcgtgattccctgctggctgcatggaagaagaaccccaaatgtgagtgtgactcagcgggggtcaggggacattgctcagtggaaggacctaaccaaaccatgggcctgtggcggtacgtccaaccatgcaagccccgggccttgcgctctaaccctgcctgcctcttcccacagacctgctggctgagtactgcgagtggctcccaaaggctatgcacagcgatgttgagaagaactggccccctaccactgacagttgaccacacacccagctgcacagtcaactggctcctaggctgttaccaggagccacgctgtggccctgacagcccttttctgcccaattcagaagcaagctcacagctacactgaccaggagtgcccttctttgtgactgttataagagcagacatggtttgtcttccacattcctactgtctaagacggactcttcaggtgacattagaccctgcagatgcacagagcaacactgaaacaggaaagtggacccttctcccagagccctgtctggcctcatagcatcttggacagcaggtgtactgcagacttctgtgacccagtgactttcctgaaaggttaaccccagatgagggatgatcaccccagagctttgctccacatagatggagactggtttccggggtcctgctttggcatcagtagacagcaagttctgtctttagtgggccttggctggtaaggatcacaaatgcaaggccaacctgagctacacagcaagactgtcttctatttgtttggttttttttttttttttttttttggtttttggagacagggtttctctgtgtagccctggctgtcctggaactcactctgtagaccaggctggcctcgaactcagaaatctgcctgcctctgcctcccaagtgctgggattaaaggtgtgtaccaccactgcctggctatttgtttgtttttcaagacagggtttctctgtgtaaccctggccgtcctggaactaggcctgtagaccaggctggcctcaaacttagagatccccctgccactgtctgccttaagtactgggattgaaggtgtgtgtcaccaccacctagcaagactctgtctccaacagttttgttgagagtaaatgttggtga

SEQ ID NO: 30610 - DNA, 1378 bp, Mus musculus
caggccatggtacgtggaagtcctggagacctgcactctgctgttgccagcttcacaaactctttggacttaagggtcactagcatgaaatgaatgtaaaaatctatttcgcctgatgtggctgggagccacaggcgggggtggggggcgggtacaggggggcgaggtctggggtcacactggtccagccctgttccacagcagagtcctggtggattacaattctagaggcttgcaatgttgagtgtgtgtctgttatgatttacaacacagggtctgcctgagaggatcctggagcacaaagcacaaatagagccataggtgcttgctgaagtagggagatgtgctgtctgaagctgaggggccagcaagagagggcctccccaggcaccctgatagctggatgcagtgtcagtggcttcttggtggcatgtaccctctttattcatttaaggtgggccaggcagcttgtaaaaactgtgtacataactcacaacagccttgtgagatgaccccatgctcatatccgacttatttgtttgtttatttatttatatgcttagttggacagaattgtcactatgtaatcctggcaggcctggaattgctatgtagaccaggctgtctttgaactcacagagatccatttgtctctgtctctagaatactgggaataaaggtgtgtaccaccacacctaactcatacctaaatttttagaatttctttagattcattttattttatgtgcatgagtgtttatatatgagtaccatgtgcatgcttggtgcctagggaggtcagaggagggagtcagaccctctggaactggaattagagatggttgtgaactgctgtgtgggtgctaggaatcaaacccaggtcctctaagaacaagtgctattcactgctcagccactatccagccccccatacctaattattaattaggaatggggcagagaaggtcgttgtttagtggccttccctcgtacggcactgtgtcgtacatggcttggttcacacccaggttgcctgagcccatggtgttggcatgtcctcaggccttgccccagatcaacctggacaattactctgtgctgccagccggcgaaggtgatgaggacagggaggcagagatggacgatgaagaggaggccctgggctctgacctagatctggacctgggtgacagtgaggcaaatgaaggtgcggcctgcagagctatgcgcttgggttcgttgctctctggtgtcagcacaggtctgctgagccctattgcatgagaggccctgttggccactgggaccagaagaatctaagtcctgtcctcacacatgggaccaaaaacattctagcacctactgggatgtgagttaa

SEQ ID NO: 30611 - DNA, 1093 bp, Mus musculus
ccagtcagttggtcctttgagagccaactggccaaggaagcatcttgagagcacacactcccagataccctgaccaagagccagcagaactctaggggaagtggtaggtgcagtgcagccagattgtggtgtgtgtgtgtgtgtgtgtgtgtgtgtgtgtgtgtgtgtgtgtgtgtgtgagagagagagagagagagagagagagagagacagacagacagacagacagacagacagacagacagacagacacgggctttccgcattctccatggtggtggaccagctatcaacccttgttcgtcacttggctacagactgtccccaaggcagctcctggttttcctgtccagtcctctcccgagctcacacttcagtacctgagtggcttttgggaggacagtggattgattggttgattccttactgtcttctcgtctctgcagttactgtccaggctgaccgagcggttcgtgcagggagtggacatgttcttagagacgttatggaaagtttggatggagctcttagaagtccttgggcttgacggtaggtacggggatggttgtgcaaggtgtttgggttgcgagcttttgttttggggggctgtctcactatgtggggagtctccgtgtccttagctgagagaacaccagagggctgagggtatggagcaccatggggaggaaggagcattttacttttaagagctgaacctgtggtctgtgaaacttcaaaagctgtgtgggtacccggtggtggcgcacaccttcaaacccagcacttgggaggcagagacaggcggatctctgtgagttggaggccagcctggtctacagagtgaggttcagaatagccagggctattaaacaaccctctcttgaacccacccccccatctcaccccccaaaaaatactgtgcagacaatggaggtagagcctgcagtgatggtgacctgggccacctggagcctctggaagccagaagagggcagaagaggctcccgagagtcctcacacaggtatgctgtatgcagggctgtgtgtttcagcatgccagaggtagagtcagtagagaggaaagtcactttgg

SEQ ID NO: 30612 - DNA, 1198 bp, Mus musculus
atgtatgcagaacctaagggtctgtctgacattgccctgtctctggagttacagatggttgttgggactcaaactaggtccttgcaagagcagccagtgcttttaaccactgagtcatttctccagtcccataaaaggtgtttttgtgtgtgtggggggggggggggaggggttcgagacagggtttctctgtgtagccctggctgtcctggaactcactctgtagaccaggctggcctggaactcagaaatccgccttcctctgcctcccaagtgtgtgccactactacccagccataaaaggtgttctcaactcatgaggatactaatagtcctgagagaccacctgtgcccctcaagtatttgctttattttgctttcgttgtgtcgggttgtgaccggagcctatgggtccggccccagagctcagctgtccttcctgctttccgagaaggtcccgaccacgtgggaataactggccctgtcctcttttgcagtgtccaacctgtcacagtacttcagcccagcctcagtgtccaacagccccacccgggccctggtgctggttggtgtggttctcctggcctactggttcttgtctctgaccttgggcttcaccttcagcctcctccacctggtgtttggccgcttcttctggctcgtgcgtgtcatcctgttctccatgtcctgcgtgtatatcctacataagtacgagggcgagccagagcacgcagtgctaccgctctgcgtcgtggtggccatctacttcatgacggggcccatgggctactggcggggcagccccggtggcctttgcagccccagtgtggaggagaagctggaacacctggagaaccaggtgaggttgcttaacatccgcctcaacagggtgctcgagaaccttgaccgctccaaggacaagtgaaggtcagctgcctagccgtccaaccagctagtgatgtcaaaagacagaagaagaagagaagagccggcaaccccaccaaatcccaaccctcccaataaactgagcaaaaacgccacgcctggtatttcccactgtgtgtcgaccttaggagccactggaggagagagcactttcgtagatcaccagtgggaaagcagtttttaaacaacggatataccccctgttagctgtgtagtcggataactttacctgtgcatagaacataatgttgat

SEQ ID NO: 30613 - DNA, 1112 bp, Mus musculus
tggggtccagggcattgcttgttaatagctaaacccctgggtgcagagacctctctgccagcttctgtggaaagagagctggcttttgtgggatgtcactagggtcgcccgtgaggactgtggagccactgagtcccaacttgagcttggagggggacccagctgatggcagctctggtgccgtatgtctgtgaagttctgtctttggttacaggtatctgtcacacagatttgggtctttgaggatgtggccgagagagacctctgttctcgaggtgacaggcagtatgggactctcattttcttgaatttcattcccttctggaaccggtactggggaaatctctccacagacattggaaatccacaacttgtgatgtgaaacattccgattttgttgtttagatgctctaggcatatctactcgcggcacagggtggaagtagccgagaaggggcaccttggctgttaatatctttccttccagatgtctggtcatatcatactaaaagattacttttcagatgttggctagggggcagtcactctctgtaaagctaaaccttcttgccttggctcctctcagtggccacttgagatgttgtaggtcgattcctatacagtccactgtagctaagactgcaactccacccagtattcaggaggcagaggcaggaggattgctgctatttgaaggccagccaggtcttaagtggtctatttcaggtcagccagggttacatagcgagaccaaaagccaggtatggtagcacaagagagcagaggcaggcacatcggagtttaaagccagtctggtctatgtagtgagttccaggacaggcagttttaatacactgagaccttgtctcaaaacaatagcaacaaaaaaggtaaaaatctgcaatatttttttccagtctgaccaaatgtagactctaaagccagttttatagttgaatatatataatgtgtatatacatatatatgctatatatattcatgtattatttgtatatatacactatatatatacatacacaagatgccttcattttaatttttacatctagttattatgattttttgagacagggtctcatgtatttaagact

SEQ ID NO: 30614 - DNA, 1872 bp, Mus musculus
cacgtggtcctgtcactccggcctgctcacagatggctcggaaacagcgtgaccaggaagcccgatgtgctttgcaaacccaggactcagtctccagatagataggaaggtgctgagttcaaagccatcctggtctacgtggcaagaccctgtctcagcaaactaacccaacatgttcaagagtcagcacgagaatctttaacaaagctcctctgcatcttgtgcttggtaggcagcctgaagcacttcccttcttcacaagccctgttgctttggtctgttctgagacagggtctcaatctagcccaggctggcctcgaacctagagatctgctcgcctctgcctcccaagtaccaggcttaaagttgtgcaccaccatgcccagaaagccagcattggtgagcctggtgcgcacctggagctacaaggaatttccaaggcgaccctctcagcctctttaccttcaagtcctgggctcctgagctctgcccccagcatgaaagctgctttcaaagcaacctgtgataattctgtaatgtttttgagtttgaccatttatgtacttgggctttgggctcctcacctgtgaattgtagatttctattttgcgggttttaacccaatacccttgtcactggctggcatcagcaagcttcggcctttttgcttccttctgtgttttgctctttggtggtccttccatagctaggacagacacggagaacctgtctttcagtcctgatggcacaaacagcacattgttgctgccaccgggacagctacggcagccagtggcatgcccgactctccgcccgatgtctctgcggatttcaagcttatgctgttgtgtcagtttcctgtctgcatctgtgataaatctctaaatatcctgtaattaaattaatttctagtgacagtgatcaatgtgcagttaaatcccccaagaggtaattatttccctgtttttagctgcagattaaaaaaaaaaaacaccaatgacttcttcacagttgagtttctgttttgtgtctcagcttaggaaattttaaatagtatttagtttgacacagtagaaagaaagccattccgtgtgaacatagtggggtgtgtgcacacacgcacatgcgcaaacattaattgggaagctgattctacgaatatcttatatagggaaaaaaaagcgtcaggcttagtatttttttgcaaagtgatggatacattcctcttatttattaatcactggcttgatgttagaggtctttgtagatcgactttaagaattggattaaaatattgtgaacattgcggcttaataaatgtttactgtggtgatgttcagactcctggatggatttctttactttggtgaggcacttgaggcaacctccagaattagagagtcattttatggctttggtttatttctttatcttaatgtgtatgactgcttggcctgcgtgagtgtatgtatactttgtgtgtccctggtgcccttgatggtcagagtccctggaaacggagttacagatgtttatgagccgccatatgggtgctgggaagtgaacccgggtcatctacatgaatagcaagtgcttttaaatattgagccatctctcctgcactaaagattaatttaaaaaaaaaaaaaagggctggagaggtggctcagcggttaagagcactgactgctcttctgaaggtccctagttcaaatcctagcagccacatggtggcttgcaaccaccccaccccccaacccccgtaatgaggtctggtgccctcttctggagtgtctgaagacagctacagtgtacttgcatataataaataaataaatcttaaaaaaagattaagttatctgtatgtgtatg

SEQ ID NO: 30615 - DNA, 1090 bp, Mus musculus
tgtcacatgcctagtgtctgtcccagtctgacaggggtcaattttctctcatctttatcaagttgtttttttttttttttttttacttagtcagaagtgttgctaggggaagggtcagctccttgggcttggcataagactaaatgatcttgcgtgaggattttagttcaaggcccagccttatgctgttgccatgtgactttaggtaagttgctcagcctctctggctgtttctgcactgcctgccaagtgggactgatgataacacctacttcagggttattgttgggttgagctgggcatttgtgtatgtgtgtgtacacgtgtgtgtgtgtgtgtgtgtgtgtgtgtgtgtgtgcctcagaacaacccattggcacaggaattacgtggacttctccgtcaaggtcctaggttggaaatcagtgcagctctcaatatggtggctgtctagttctcacagtagcttcctggagcatctctagggggaccggatctgaggtctccgaacccacagtcacttccgacacacacacattcagcacagtgctcatgtcgggtttgggcgttgaataccttttgcttcttcctcccctgggttcctccccccacccccaatggtgcagttcagtcggaggcattgactcagcggcccgccagcctctctcttgctcttaggagcactggcatcaacccctcatgcacccgctcctcagacccaggcagatgctggggctgcagccttgagtggtagagacaagctccctgctctcatgaggttgatattttggggcctggggggggggtgaccttagtgctaggaagaagaaagaagatagtctaagaggaggaaggaagatagtctaagaggctgaggggaccggctttagtcagctgcccagtgaagggtgagggcctgctttctctctctttctgagaactcacctcactccttggctcctgtccctggaatcagtcatcctgctggccttggcacttggcatcagcatttgtttgttctttctttctttctttctttctttcttaatacttttattaggtattttcctcatttacatttccaatgcta

SEQ ID NO: 30616 - DNA, 1207 bp, Mus musculus
tgccaggaggatgttgactttaggaggacctgtggtgtctttgccagcggtttcacgtggtgtctttgccagctatttcacgtagtgtctgtgccaactgtttcacgtggtgtccatgctgactgtgtccacgccagctgtttcacgtggtgtccatgccagctgctgtcctgtggtcagctgtttctgacccaggtctgcgtgcctgggctgagcctgggctgctctcctggctcactcttcagggtgaatgcgtaaactcacgtctgctttaaagtgtgtcctctccacaaaggcttttgaggtatcaactcatcttcccagagagaaaagtgtgggttgctcagggcccatcactttggtccatggcccagagagctgaggtgagacctgtgtgcccttttccacttccggtgccacttccctgcctaatggcgcttccggtgccctttcccatacctgactccgggactgtctgggatcaacaagactttgcttagaccgaaactccatgagtgcctcccggccctaggatcttctgtggggttggatgagctagttggggcccatggagtccctgtgggaggttctaacaaggtggccctgggtgctgttctgctagggtccctcaggaaatggctagagtaaggagacagaaaggcctttggtatgagactgcccacccgaggtccagagcctgggatgggtctgggatgggcacccacagtgcactctgggcattgagaggatgggcacccacggtgcactctgggcattgagaggatgggcacccacggtgcactctgggcattgagaggatgggcacccacggtgcactctgggcattgagaggatgggcacccacggtgcactctgggcattgagaggatgggcacccacggtgcactctgggcattgagaggatgggcacccacggtgcactctgggcattgagaggatgggcacccacggtgcactctgggcattgagaggatgggcacccacggtgcactctgggcattgagaggatgggcacccacggtgcactctgggcattgagaggatgggcacccacggtgcactctgggcattgagaggatgggcacccacggtgcactctgggcattgaggatgggcacccacggtgcactctgggcattgaggatgggcacccacggtgcactctgggcattgagaggatgggcac

SEQ ID NO: 30617 - DNA, 1099 bp, Mus musculus
gaggctaggccactgatcttgagtcccagggccaacctgggtggcctgcgcgatgcctgggaaagagttttgacggtttagccgcctgggggtgggaaggcagagagcctgaggtacacactatgggtgtgtgcgtgactgtgcacatgtgtgggtgagcgcgtgagtgagtagcctggccctcctgacacctctctggtcagacacaggtctgttttgacaactgtctcgcatctgcagaaagcagatggctagggacgatctgtcagagggaatggcacctgaggcaaggaccatgtggcccctccagagcacctgcacacgtgcctggtgaggtgcacagcattggagacacccctgtgctcatgtggttttgacccaggcatagagttgtgtggcatggttccgtggacagtgtcagcactgccttggctgtcgtcaccagcgggttccctcaggtgtctgtaggtgccgtggcatgtgttcgaagccaccgcatagctgggtttatggatctttttggaagcgaatatggaggagaagccagagtcagggctgctctgccgtctctggtttaaacactcctttctgtgttctctgtgtctgccccacagtacacactcaatggcaagaaagtggaggtggccgtgaagcaggtgatggctgggaggactgtggagcaccggggggccttctccaaccccgagaccctcgacctgtaccgggacatccctgagctgcaggacttctgagccagcagctcgcactccatccagctgtgcatgtgatggaacttagggacactttagagacaacagctgctccaggtggccctggcactgcacactccacaggctcaggaacagctttcctctttcggagtcattggtgggggccaggtctcccgagctccaggatgtgcctggccttcggagaccctaagcatacactgaggcttgtctcggccctgctgctataggtcagcacacagccttgcaggggcagggctggtgacatttggtgacagcacactggaggagcgatgtggccttcagcctcatgagcccgctgttgtatctcgctctatgaaggtgaagtc

SEQ ID NO: 30618 - DNA, 1059 bp, Mus musculus
tgtttatcataatggtgtaactagaaaagcagatactagactagtatgcctcatggtgaactaactgagccattgtcagctctcaaaaaatgggatttttaaaggcccaaagcctgaagcacatgcaggaggtcactgatgtcaaagggctgacctctgaacctctcaaggagactttttcttattcctctgctctcattttatacatgtccaggctggaaacgtggcagccgtgcctccggtagccatgatgggacagctaagatgttctccctgcctctcccacccccagcactgcaatgtgcttacaaacagggctgggcatgcaggtcctatgctatatcccccagaagtatgttcgcttgcttttgtgtttagaatggctcctgggaatggaaggtactgactaaagaaggaagctggaacatacaggcattgcatgaacttggctgacatatgctactgccaagagctctctggttagctggctgtttctggaaaggctggagcagagctggtagtcccaaaacacctgtgcagagcagcagatttaccaatacgtttcagatcctttttatgagccatttaaagtcctatcttccatcacagaaataatgggaactcatttctgaaagtgaggtccctccctggaagcaaggacacacaaagcagactgcctcctcttggtttaggtggggccttgggttagcctgtaatttagcaggaaattaccaagggtgatacaagtaagcattgcttgtgattgacaggctttcaatgcgggtggggctcagagggcagaggagctgactatggtcctgaagatgtctccactgccctcttagacatactcagtgaattagcttctgtgcacattcacggtgttgttgtgttaggacaccatcagtttaaatcaaagttgagtggcaggttctgatggaaagctcccttttaacatatatgcagacacatatatacagacatatatgcagacacatatatacagacacagatatgcacgtgtacccacatctgtgcgtgtggataccaaggtgtcac

SEQ ID NO: 30619 - DNA, 1199 bp, Mus musculus
tgttgcctgcgtgtatactgcatgcatacaagtctccatggaggatagaagagggtatcagatctcttagaactggagttacacatggttgtgagcctccatgagggttctgggaatagaaccctggtcctttgcaagagcatccagtgctcttaaatactgagctctctctccagccccctgagattttgagaaaggattgaacactgcagcaatcctctggctaccgcctgttgaattctagaatttcaggtgtgagacaccatgtctgtcttgtgacagaacttacgaatatcttacaagtgagagtgccacttttccttgacgtgtttaaagagctctcatgaggatgagtggctacacccaatgctgacttctccaaccacgtgtgtttccaaggacagtcctcctgatagtgctcacaccccagtgggatccatgcatactgggaagctggctcagggtgacatagatgatcttctaagagtgacctccttttctctaggtctggaatttgcatactcagctgcccccaagtccatgcagagcgccatcatgggactcttcttcttcttctctggcattgggtcctttgtgggctcaggactgttggccctggtgtctctcaaggccattgggtggatgagcagtcatacagattttggtgagatttgatgtctggaggggtgggaaaccagagtgcttgctgtgggttgtgtgaaaattcagtctgtcccaagaggcctctagcccaacccctgctgaatctagcttagcacttcctgagagctgggtgagaagcgagacctgcgtgtcagctcctgtgtcagcctgctcttatgttttggttcctgactgtgttgggtttcagattttggaagggtgggtagtgctttgtcagtgaacactgctgctcctggaggaggcttctggttgttgatctgggcagctctgcagtgctgtgtgtgatccagggactacaacatcctttgccttttagataagtacatgttccctatgcagaagtctgtactgtgagcatttgcgcagcttggtggcatttaatctgcttttattgcatagctttgggaaagtcaggaatttttttctagaaattgtgggattcccagggccttgaattggattcctttgaatcttggggtaatgctcagaagcccgaaacccccttccccaacctc

SEQ ID NO: 30620 - DNA, 1195 bp, Mus musculus
aagaagtgttgctacttgagagttctggagttctcagaggtgttcatcaaactttcaagaccagactcctggccttggcctctgttccactagtatatattacctctgtcatttaagcctaggtgtggtggtttgcatgaagtggccctcataagcctcatatctttggttggatacttggtccctagttggtgactggaggaagtatgggtaggcattttatcttaaattgtaactgctgctctagtcagcagtctgtcttgccatgatgaacttgaactgtgagcccaaaataaacccacccttctctaagtggccttggtcatggcatctctcacaataaaggaaaagtaagctacaccctgggtcatagtagtacataagttgtacctgtgactgtacatccctaccttgagcggtttgagctttctgatgtgcactgggttcttgtgagccatcatgtggttgttggaaatttgaattcaggatctctgctcgctccagcctaaagatttattatatctaagaacactgtagctgtcctcagacacaccagaagagggcgtcagatctcgttactaacggttgtgagccaccatatggttgctgggatttgaactcgggatctttggaagagctgtcagtgctcttaaccgctgagccatctctccagcccccccgtacactgggttctttagactttccactcacagccccttttcatctgagaactaagtgactctgagataaaaataaataaatattaactgatgtcaaccaagtcagatttattttaaaacagtccttttaccatttattaaagatgaaatccagtttgtgtagtaatgagatgcatgtttataaaacttgataacagtccaaagacagtaactccatctttgaaagctgaagtgtgatgggtggtagggaaatagcctaatggttctttgaaattaagccattatgcttctataagaacagaaaaacattctctcagctcatagcatgttggcctcaaatgaagccagggtgtgccaggcagcatttgttggtgtcatgaagcatgtcactgtgtgaagtgtaaagttgcaggtggtacttgtacagggtcaggactgccaggaacatcttgggtccactgcacatttgattctgagttaagttttgatccttgtgcactcagaaacctgtcact

SEQ ID NO: 30621 - DNA, 1172 bp, Mus musculus
ttacagatggttgtgagccaccatgtggttgctgggatttgaactccggaccttcggaagagcagtcgggtgctcttacccactgagccatctcaccagccccgtgcattggtattttgcttgcaagtatgtctgggtaagagtgtcagatcttggagtcacagagagttgtgagctgccatgtgggtgctgggaattgaacccgggtcctctggaagagcggtcagtgctcttaaccaccaagccatctctccaaccctttcttacatagagcaagcaaaggacaacaacaaaatacaaagagaatttctcttccccaaagtagtcatagaaatctgagccctctttcccagaaaacaaccataaaacctgaaaattctacccccattcttttgaaactgacactctctgcttgcagcataagaactgactttcctagacaaacgtcacgtctccggggctgggaagatagctcagtgaagaagagtgcttgttgccaaagcatatggatctgagttcaaatcccaccacccatattaaaaagaggggttcaggtatagagaaaaaaaaaagactcaaaagcacacagtttttgcagcagctatgtctagaggctcacagccactggtaagccagatcccagggatccaacactcccttctggcctcctgggaatctgtgctcacaccatccccacatagacacatacaagtgcacaaaatttatatatatatatatatatctccaagcacagtaggatatacctttaatcacagcacttgggaaggcagaggcaggtggttctctgaatttgaggccagcctggaatacagaatgagttccaggacagccagggctacacagaggaaccctatcttgaagaacaaaacactaaagtttctatgaggctgagtaattagaatttagtgattctgagtcctttcattggcttggtgaggactggtggtcatgaatcagggcatcacagtgtgacaaggcagctaatctgcccgagtcagggttgggcatgaggctggaaataagggcaaggtttttgtcacaaaaggccaagaacagccataaaatgaaggtagtgttagctgtaggatggcaggtaagagggactgaacctgtgtcccatgcgttttagaagcaatgggggctgttggtag

SEQ ID NO: 30622 - DNA, 1322 bp, Mus musculus
cgggaggcagaggcaggaggatttctgagttcgaggccagcctggtctacaaagtgagttccaggacagccagagctacacagagaaaccctgtctcgaaaaaccaaaaaagaagaaaaaaaaaatgagtggggctgtgaacagggctgaaacagctgcgctacctctgctctgtcctcttcagggctgcaggggtgcggctgatccgagagatgtgccaggaagatctgcatgcagtggtgaagagctgctttgcgctggtcaacagctccgtctccgagggcatgtcagctgccatcttggaggtaactgcagctcgaatgcccaggatgtggtaccattctttctcttctccaatttttaaaaaggatttatttaaaaattttaagtgacacgtatatatatatatacacgtgtgtctgtgtggtcgtacatacaagtgagtgcagttgccggtggataccagatgagggcgtctagataccttggagcaagtatgaatttgcatcaattgctctagaagtgcatgacacgatcttgtgtcatctttgtgtccggcaaagaagcctgtgttctgtgataactgtcagccttggtcgggtgctcagccccagccactggggtggtttgtcgcccccagaaactaacttttaaaccagagtagagaaggtgcccaattgttcttccatacacattcccctctctgctcctatttcttaagaaaaggccaagggcctgaagtttgctgaatggttttctgagcagcacaccctgctttctctgtgtcgtaactgctgtggcactcggctggcctcctaggaaaggcagctgctagcaattccgatgctcttgaagcgtcgtcgctgtggccttcctttgagaaggcaaaataacctttgcgagaccggctctgaaagaagttgattttagggggagtggtcagcgtgtctcttcagaatcccttcagatggccagcgtgttaatcgcggaacacacgcccatccactgggccaggaagtgaacttttgacctttccgaatctgctttcgggagcaggcaagtacaaatgaccgttggctaaaatacacgcttttcgcagaaaaaaaaaaacgtgtcaagagcaaatgtcagccagatgcacagtaacccggtgattattgctaaaagcccgccaggcctttcccactcaagcataccatggatttgcaatactaacaccccctcaagcccccgcccagtagaattaccttaaaggagggagatggagagatggctcagttagttcagagcttgctgtgctgagtccaatgcccaggacccac

SEQ ID NO: 30623 - DNA, 1194 bp, Mus musculus
agccagggggaagctctgcttgcagactttaaccaagcagggctctcatccacttctcaattgctacagaaaaatgcatgtcaaattgtcaaaggcgacagaattttccgtatgcccggagaagcgtatcagttttacggttcatgagactaaggaattaattcaattggtttgggaagggcagacagaattaataaacatcaaagggctgctccaaggctgtgctttgcaaaagggagctgttttgaaagtgggctttgttgagacctgcatccttttttgggacctgcaagccctaaggatttcagcaagccccacgaggggggcgagagccaagacctgatcatctatgttaatgggagtgccgaggcgtggctaatcccaacagtgcggagtgcaaaagtcaccttctgtttggcccctgaagacattatgttctcttttccccccttcagcagacacaacttcttaattatgtttttcttaagctaatgtaaaaatgaatttgcatgtctgcagcctacactaattgaaggagggaggatgctatgaagattactttgggagacgcagctaaatcaattcagggctgaagcagccatgaggtagcctgggccactcgccaagaggacatgtgggcagccatctttcccttctttgggctggggtttctgtgtgggagaagccaatattctttgctactttctgaacctggactacctctgtccttgcgccagaaaaagtgaaagtcagatgaaggtcttggatcttgaagaaaaggaaagcactctttagactcccattcataatctacatttttgaggcaggcaatccataatagtttgagagtgcccctcacaggcacgtgttatttgaacatcacccagaaggtggcactgtttggtgggggaagttatggaacttctaggaggcggagccttagtggagaaaagggagagggctttggggtcttattgcttcaccctgtgagctttcagcttgttgcagctgctggctgccaggtctctctcaccattatgaactctccctctggtactgtaagcccaagtaaactttttcatgtatacattgccttgatcatggaatttcgtcacaacgcaagaagtaacaaaaataaaacacatgtaaaatttagccatccaagatggctccatttaagctacgcttatagcc

SEQ ID NO: 30624 - DNA, 1195 bp, Mus musculus
tgatcatgacttaaattgacccacttattctgatctacattctgccatgtggctggttacccatgcttagataccttgtatctgtttactcacatcttcctgggcaaatctcctgtgcctcactttatcccagaattctttctggcttccaaatgtcctgccttctattctaccctttcctgtaggccctgtgacctctcccactgtaattctctaacttatttctgggaaaagaagtagacggaacctaatttttcctgatctggagtttattgtttataacctaggagggctacaaccttattttttcatatagtaatttgccaccacaaaggttcattcattcttttactctaggtcccttcttgatatgcacatgtgtccacctacattctgcgaccttccctcccttgtccctgtgatggtccctctgtattgtttgcctgtgtttgacctgtgatatcgtgagtccctccctcttcactccattttctaatcaaccgtatcacacctcgattggtgcatataactctgtaatcacactgtataaattgtttattaaaatgttctagagttttgtaaggagatgctgacctattgttggatgcattggtggggagaagaagggaaacagaactaaaaggatgcaggagggagacaggtcagaacatgacagaagataaataagtggaaattgagatgtgtagataagtattagaaagatgattgataggtgatagataagatggtagataatagatagatagatagatagatagatagatagatagatagatagatagattggtagatgataggtagatgacagacaggtgtatggatgaatagatagatgattgataatgataatgatagacaggtgatgatagatgattatgatgagataaatgatagataggtaggtaggtagatagatagatagatagatagatagatagatagatagatagatagatgatatatatgcacaggtgaaagatagaccctcatccctagtgagttccctgagctaaagacaggctcagttgaacagctggcatccttcagcctttgctacagttgcaagctttcttttgcctgcagcctaagtgtcagctctgggcaggctccttgtcagtgtgcctagaagtttgtctcctgccctcatcgtggtgcttttcagtgttggagcata

SEQ ID NO: 30625 - DNA, 1157 bp, Mus musculus
ccacctatgagcccattaatgaatgaatggatacagaaaagtggctgaacaaaatgaaaaacgtttcatccttaagaaaaggggaagacatgcctcctgcatcacctctgatgaccccaagggacattatgttaaatgaaataaaccaggtacagaaagtaatactatagcatcctgtgcagactctgggtatacagataatgaagtcatgaaaaagaaaacagaatggcgattttcaagaactggggtggggagccaggatggttgaaaatgtaaatcacatacggaatcagttctagacatatcttgaccactgagtcacccctcagcctgaggaccctctgaggtttagcaaatcccactgttggcttgaaatctgctgagagtagatctctggtatttctgttatgtgcaagtgtacacacacacacacacacacacacacacacacacacacacaaaaccagcttctttgttacaaactcgtatacccagggcatatgaaaacacatcacacattttaaatctacatcattctttgtcagccattactttagcaaagctggaagacacgacacggcttctgaacgagggggaatcagaccctctctcgttgctgagcagggagtgactttgccgtgaagttaacaatgatcatcacagcctctcggcttcttcacaggtccctccttcacgtagcacatagcaactgataacttacaatgtgctagatactctgaaattataatgagcccggagccacttcttccctcacaaagaaatctacataatgaaggctataaccacaaagcctgctacacactaatcagagaaaggtatacagcaacaggcattagaaagaaggccctggcatcctgccttatgcctagaggttcagagggtccttggggtgagggatgacacagtagggatgactcagtgggagtcatcccagcaagcgaggtcctcccccgacttcttctgtctttttaataaagcatagccgtgaggtgtgcctatgggtggacgtgggttgtgctcccgctcaggggtgtgatgaagtattgtgatttcatttagatgcccttgttctgaatagccgtggagtgggttacattgtgaattcatggccagctaagatgttagttatgataagt

SEQ ID NO: 30626 - DNA, 1149 bp, Mus musculus
cttagcatctacttcccatacgttgacttgattcaaaggagaaacactggacagttcagaattgcatcatgggtccaaaagtgaggctgtgggtagctaccgatgtgctctccagagtctacaagtcgggtgtctcaggatcactaacacctgccctcggttcctcccaacagtgacggaaggccgagggatcctggagagcattcagcggttctcactactgcctacctacctcccggtcacctaccatatcaacaatgcggatgtctccttcttcctgaaggaggccaaccaggacatcatgcgcaactccagcctgcagtcgcgggtcgagtccttcctgatctacaaatctaggcgactgccggtgctcaacgccagctacgggcccttctcactcgagcaggtagtgccccaggatttgatgttgccttccaacccatttggattcactaacacattctccctcaactggaggctgaaggcctacatcctgcaggagaaagtctacctgagccatcccaaagtgcaggtgctcttccacatcgtgggtcgagactgggatgaccacagggacgagaacttgccttgcctgcgggtctttgcgttcagagagactcgagaggttcgaggcagctgccgtttgggtggagccctgggactgtgcgtggcccagctggagatgctgccgggctggttcagtccaccatcagtggtatctgggcgcaggaggcccacggagcagccagaggggaatcccgtggaactgtattatgctgtacagccaggggatgagcgaggcgactgtgccaaggaggattcgaggaagagcggtggtactccagcaggccacaatgatgttgatgaatccagtccccctttgcatagaattgggagcgtcttccttcgggagacccccagcagtccacctttgaaggaactgcgtttggatagcaatgtggctgttcattatgtccctaagactgtgcggcaaggagatgtactcaccttccctatctctgtctccaggaactgcacggaggatcgcttcacactgaggtgagcaggttcacattctgtctattgcaaccccagcgatccagccgggctgctgtggaactgtctgcagatgttcatgtgctgtgttcc

SEQ ID NO: 30627 - DNA, 1146 bp, Mus musculus
aggggggaaactgaggcatgggtggtcatcacagcttggtaaggctgtgtaacaccaatggagaacaatggctttcatgtggataaagaatgctgtcatcctgacttcccccaaaagacctctctgaactccctctgccaccagttggccttgcttactgtaggccaaacttctgatcagctgatcacaaaatatagcccactaatggctgaaggcaccatattgggttttgcaggttctctgggcactggaagcttcctctgctcctggacatttctagccacagtgtgctctcattctgacgtaagtcccagcatccctggctcacctgtgcccctgtgcctggacccgaaccacagggtaggattgccccaaatcatcagatactgtgtcattgctttcatagtagggggcgacctcatctagggccagctctttgctctttgcttcatttcagcagaggcacctgttcctaaggacccaccagaccgtggttcaggttccatcaccatctgtgtgtctcacctacagcatcttggcattctgagtctgaggaaggtgctctggcccaccctgtgccagggtggtgaccacagaggagttcgtcccatccaaatgaattatcgacacgagttagctctctgttgctgtgacaacgtgcccgagagaatcagcttagagaagagcttttgctgtaactcaggctgtcagggtttgggctttggctttacttgaccctgttgcttttgggcagtgcatcaaggcagagaacacgtactagtgagaaagaggttcagctcgtggtgggcaggaggcaggcagaaaggaaagggacagaaacaggatacacatttcaaggggacatctctctctaaataccctaagtcaagtttccatcccctcccattcagctatggcccccaccgatggctcgctcctctcatgcattcagagcccttatgattcaattaccccccaaaggccctacctcttactcttgccacactggggactaagctttcagcatgctcatctttggagacatcactactactctgttgatctcacagcagatgtgattatcagtcttgcaagacctcagcaagaatgggcctatccatctcttgccatggtgaggagaagggc

SEQ ID NO: 30628 - DNA, 1184 bp, Mus musculus
ggcagctgtatgttatccaggaaggactggagagcacgggctgtaccttagtcttcttggtactttactacttcggcatggccagctctttatggtgggtggtcctcaccctcacttggttcctggctgctggaaagaagtggggccatgaggccattgaagccaacagcagctactttcacctggcagcttgggccatcccggctgtgaagactatcttgatcttggtgatgcgcagggtggcaggggatgagctcactggtgtgtgttatgtgggcagcatggatgtcaatgctctgaccggcttcgtgctggtcccgctggcttgctacctagtcatcggcacttccttcatcctgtccggctttgtggctttattccacatccggagggtgatgaaaacgggtggggagaacacggacaagctggagaagctcatggtacgcataggggtcttctccctcctctacactgtgccggccacctgtgtgattgcctgctatttttatgaacgcctcaacatggactactggaagatgctggccacccagcacaagtgtaagatgaacaatcagaccaagacacctgactgcctgatgaccacctccatccctgccgtggaggtcttcatggtcaaagtgtccatgctgctggtggtgggcatcaccagtggggtgtgggtctggacttccaagaccctgcagtcctggcaacacgtatgcagccgggggctaaagagaaaaagccggaggaaaccagccagtgtggtcaccagtgcagggatctacaaaaaagcccagcacccccaaaaacctcaccttgggaagtatgaactgcccgcccagccttcagcctgcgtgtgaaggcagagctggctgcaagaacaggacattcggagcccaaatgggcagcttttcttggttggctggttgttggtaaatcaaagtaaaaagaatatgtatatatatatacatgtatgtgtatgcatgtgcatatatatgcatatatttacacatacatgaagtctaccttgaggttcagaacagctgaatgtaaagggttctgttcagtttgttgcctccctgaagggtcgctcattaaggagggagcctcttgtgtaactaatttgtggtaaagtagttgattcaaccgccctccagaaaacttttgtttaggcctcaagc

SEQ ID NO: 30629 - DNA, 1099 bp, Mus musculus
catctgtaagttaagttccttaatctattaacatctaaactccctttctaagctagacactgccttgtgaaggacaatgggccagccccgggcaagcatgaacactgccttacagcccctcagggcccttctatagtgccttctggtgaccctgactaggaagtgtgagggtctgaagagccttgaacgttagctcacggaggggacaagcagtcacatgccgcactcatgttactcttccttgttcatgtgagctgatggagtctcaaggcaaggcgacagtgacgatggagcaaacttggtgctcactaaactcaagagaatggtcccgggtacatagccactcctggatggcacctgaaggaccaggtcctcagcccaacacccacgagtgcccagagttcctaagaaaccatgaagtgtgggataaagctgtgcactggtttacacttgtgaatagatggcccagcgaccaagtatgtgaaggataccatgactagtgaactctgccaactgctgactgtgatgagtgctcactctaccccagcctcacttggtgggatatgatgtagccatgccgggtcagaacaccaagtgtgagcaagtgctactgaactatctaaaaaccatgatcctttcagtggtgagtgtgccacactgtcacctcctcacacctcctggtctgacaccccatgtgccgagagctactgcagcaggctgggctgtgggtcctggtctagagttagcctgtagtgcagccactcctggctgatagctcacccttcctaactgggagctcacccttcctgcctggaagctcacacttcctgtctgggagctcacccttcttgcctgggagctcacacttcctgtctgggagctcacacttccttcctgggagctcacacttcctgcctgggagctcacccttcctgcctgggagctcacacttcctgcctgggagctctgaagatgaacctgggcctttgcagctcaccctctctgcatcagtcagtgccatcggatttagctgcagagaccatgcgtaccacccaggctcccaccacccacagccaggtgtccctccagtccagcctga

SEQ ID NO: 30630 - DNA, 2470 bp, Mus musculus
cctttttcttttaaaacagtactatgacatttctgccaaaagtaactacaactttgaaaagcctttcctctggcttgccagaaagctcattggagatcctaacttggagtttgttgccatgcctgctcttgccccacctgaggtggtcatggacccagctttggcagcacagtacgagcatgatttagaggtatttgttctttttttacagtgttttgttttcgtgtgtgtgtgtgcactttgcctagtttctgcagaggttggcattggatctgcccagacatgtggggtgctaggaatcaagctccggtcattagaagagctggctgtgcgcacttaaccagtcctggtggtgctcggcctgacttggtaatggtagttctgatctgcactgttttgtttttgtttgttgctccaggttgctcagacgactgctctcccagatgaggatgatgacctgtgagaaagtgaagctggagccctgcgtcagaagtctagttttataggcaactgtcctgtgatgtcagcggtgcagcgcgtgtgccaccttatttagctaagcagatcgtgtacttcattgggatgctgaaggagatgaatgggcttcgagtgaatgtggcagttaaacataccttcattttttggacttgcatatttagctgtttggaacagagttgtttcctttctgaatttcaaagataagactgctgcagtcccatcgcaatatccagtggggaaatcttgtttgttactgtcattcccattcttttcgtttagaatcagaataaagttgtatttcaaataatctaaacaagtgaatcatcccttgcttattaaagccactaacacgagggagcttgtgccatattatagtttaaaatgcttctgctattacctgaggtctattcagttatgttctccttgtgcctaccttcataaacatttagattgtctgtgactcagctaggatgatatctgccctacctgcatttagccaggtagtttaacctaagagaagaccttgtgtaaaactaaagatttaagtatgtacgcatcagatgtttaaggattgcagttgacaatttctgtaacctaggccttcagaagttagaactgcagttgacggacggaagcttgagggttttctgagatggactacatttcttcatttccatgtctaatgttggttctctaagatgtcctctgctttcaaatattggctcctatattgagtggtagtctcaggaggtagaggcaggaggatctcttgagtttgcccccaaccttagtctacagagcaagttccaggactgagagacctgtctcaaaaaattcatggtaggctgttacagtattacagcagctgatcttttttttctcccacggggtttatataggttgtgcaggagaggaaatgctagggctactgccactgaggagtagggtgggcttctctgatgtgatagtgttagttgagacttaggtgtgtgatcccggcacaactgtgttgctcagatgtatttacagcaagccattccgtgtgctctgctggtccagtctaccaaagttcctagaagggtggataccttcacatagttgttggtgtttgttttgttttgtttttttctccccaaagaaggtagatgacttaaatacagtggggaaggtggaaggaactcatactgtgcattctagcttcagcagactgattgcaagactcaaatttgatgtatgtgctatgctatgatcaggtgaagaccctctcccctgactgggatgaaacctcatttagatgtcttgaattaatacattgtgtgtaaacctggtatagaatgtagaacctttatgactttctgatttttgtaacagttaaatgtgggagctgcttacgtgtgtttaaccagagtgcagagatttacattatttattggaagaacttaaatatatatcatttctgctttgcctcagttttctgagtcatctctagtatttgctgtaggagttgtgaataacattttttttttaagatttgaagtttgatctgccaaatagcgagttctctccagtttttacaagtaggggaaatctcccccctcccttaaaaaagcatccttgaatagatggctccttactaatcatttattacccagcagttatggctgattgaagcagtgtcaccaacagagaagctggggtctggcatttgagaaacagctttattctgtgggctttggatttaaaaaaattttttttatgtataggatacactagctgtcttcagacacaccagaagagggcatctgatcctattacagatggttatgagccaccatgtggttgctgggaattgaactctagaagagcagtcagtgcacttatcagttgagctatctctagcccccatttttttgtttttaatcagtttataacctgattgaaaccctcacttcctctcacgtcagagaaggtg

SEQ ID NO: 30631 - DNA, 1521 bp, Mus musculus
ggcagcggtaaagtacatcttgatctcgtcaggagtcagtgcccgttcccagatgatgaattcatcaaaagctccgttttcgtaacgcttggtctggtcctgctctgaccctatgaccaggttgacgtggggatccccgtaggtgtgtgacactttcccgctggggtccgaggtgctcagagtcccattgacgtagaccttcaggccctccttggatttccacgtgaacaggacgtgagtccagtaaggacctgggggagagtaaagatatatcctgagcatagccaataagttctatgtgagcttcccacattcctagtacatcttcccttcatgtgataattgatcacccttgaccttagtgaatccaactatggattatagaataacctgattccccttagtcctttggatcacatgatctttgcttccacccccaaattccaaaagccttttaagaaaccctttattactttaacacagtggcagaaatgtaaacacatacaatcaaaggtaataaaagacttgtttagccttttccggtcgcagcgctgcgcggtgtggagctcgtgcttgtgctcggagctatgccgtccaagggtccgctgcagtccgtgcaggtcttcggacgcaagaaaacagccacggctgtggcccactgcaaacggggaaatgggctcatcaaggtgaacggacgtcccctggagatgatcgagccgcgcacgctgcagtacaagttactggagcctgttttgcttctgggcaaggagcgatttgctggtgtggatattcgggtccgtgtgaagggtggtggacatgtggcccaaatttatgccatccgacagtccatctcaaaggccctggtagcttattaccaaaaatatgtggatgaagcctccaagaaggagatcaaagatatcctcatccaatacgatcggaccctgcttgtagctgacccccgtcgctgcgaatccaaaaagtttggaggtcctggtgcccgtgcccgataccagaaatcctaccgataagcccatctcaaggatcggggtttacctttgtaataaacatcctaggattttaacgttaaaaaaaaaaaaaaaaaaaaaaagacttgtttaaaaggccctacccaagcacccaccaatcagactccaaccctagttgaaaatctcagtatggtccagaactagccgaggatatcccccatcacaacccctggcagtccccgctattacaatagtcagggaaagaggcacaagggctgagagggacagaataaaattatctttgttattaataataaaagcaactcctgaaatgcacatgcgatagtcacatgattggtgggtaaaggctaagggacagaagtcaaagttgtcttctagattgacagtaatgaacatagggagtgtgtgtatagacgtacatacccacacagtcatgagaatcataagtgcatgtgtgcgtgagtgcgtgtgcatgctcatgtgtgcacgagcatgcatgcacacacatacatac

SEQ ID NO: 30632 - DNA, 1159 bp, Mus musculus
actgggaggggtccaggagctttcccaaggggaccaagctaaggtagtgactctgcctctctcggtcccagaaagctttctgtgaccccaccagcgcaccactcacttcccagttttaatacctgccattagagttagccagtgagttgttgcacttggggggccgaggggtgccattgctcccactgatcatgcctgttcattgtgccctcagctccggggaaggcgtctggtccagccagggctgtgcactcacagaaggaaatctcacttattcagtgtgccactgcacacacctcaccaacttcgccatcctcatgcaagtggtcccactgaaggtgagtgccactgtagaccccacagggtcctcagatcacagccccatcaccatccttgacacacagatctagactagctacaaagttacctcgtatctgggagatggctggacgcattgctatatccgggagacggccgaatacattgttaaagtctttgaaaggcaagctgggggagtctgacatgaattggttcacatagaaacctatattggttaagggagcttaacgggacatgggacccagatcacaagcctaggaccataaaggggaagctgtgagctgccctgggatgctgctctagagttgcaggacaagcacaccaagagccagaagagaaggtaccttggctagtgatgctgcccttggaggtaacttattagtggacagttgagcaagtgagcatccaaggtgctggttgggaacccaagtgtcacaaagaccactcagagggaaggcacaggtgcatccccagcctccctgtggaagacaggagttctcatgccattagggacacttcaaatgacaccagggtggagcgtcttcctctgggtcctccacatgctggaccattgaactgagagatattttgcttttctttggtctacctgggagggtctactgagcagtgcaaaggggcccatactttccagagagcggccactcatgcctggcattcgtctcaagagaggtccaatctacaaagtcaaaaagggaagagaaaatcagaagaaggaaatccagactcatttatatcataaatctgtcaccagtcagtattggtgacaccaaatttagacagcctgtgggtgtcttcgtgg

SEQ ID NO: 30633 - DNA, 1642 bp, Mus musculus
tggtgagggcagcagtgatgtagccctccttccctggtgtggtgggcacttctgtcctctgtggacaccagagtgcagagtagcccatggtgaccactaagaccggacctcccttgttatcgtatgcacagagcaacatcccagcaagcctgcattaaatgacatgtaaagatggggctagaggacatagcctcagccttgaaggagactcacagtcctgagggctactcaatgtcttatggttctccagagggtccacagaggtggtagccgagccatgtaggggaatgaagccagcaccaattggaatgtacatcttcacgtaaggggacactaattgagccaccacccaccctagctgtacagccagttctggactctccgcctttgcccgtttggagtcgcccactatcccttgtatggatctttgtgaagacagtctaaaggagccacttcatgggacccgatgctgtctattctctgcaagttgttccttgatggacctaaagtcagccttagaatattcttttcaaacacgagcctctctactgtccatgacctccttgggggctgagcttccctgctgggtgtccccctgtacctgtatgtcctggctttctgggagtgttgctacccctagggtctgtgttctcattatttagacgtgcctcctccgtaagagccaacaggcatcagacagcttagacattggatgtccctcatgtgacagaccagaccagccacattgcagaggctgatttcctcccagtaaggggtggggggcacaccaagtctctgctgctggccagggtgaccactgtaagctttgggtttggtgtgagtggacagaaatagactcagccctgggaagtacagtcattgtgacaacaaggtccacatggagatggagatccccgaggactaaggagcaggctgtgaagggccaaccagtgtgacaaggagcttaagtgtctgtgacatgcacagcctagatggccagtctggccccaatactggaaaactctcacttcccatgagatccctaacagccctgagccccttcttattcccatgccttacttggctttaggatatgtttccgctcagatcttttcagcttaaatgttctctgttcttttctccactgtaatgaagtagagccaaggcctggcatagccaggcaagcactccacactgagccacaccccagcccctaagtgacaatttcctacaggcgtccagaagccacaaggctataaggccagactttgctctggctaagccaggactgaaatctattagccaaatgggaccctctgacctaccctcctgcagcccctttggccagtgcaggctgaggccatgctgagactctgtatctggtgacaagtcctgttctaaagaatgtgggtggtctctgctcagcatctcatccttcctcaaaccaaacaccggtgacccagggtcccacctgccctgctgagctcctagtagtgagaacactgtatccctcccatgcacgctggactcccactaaagcaaggcagaccaggccagtcctttattcccagtgggattctcagtttctggcttttttttttaatactcgctcttatgtagctgatatatcaagggaagtcaa

SEQ ID NO: 30634 - DNA, 1213 bp, Mus musculus
cctgtggaattaataaatgatatgagtgcgcatgagtgctaatcttagttcaacatctaaagtggatccacttatacaaaataagggaaagcagtgcccatgtccagggttgtggatggtaaaggctcgacaccaaggaagcctgtcctccaagcacccattctcaaggaccagcccagcttagctttccaggtctgggaatactcagatgcagcttcacaaaggagccagttctgggtcctcccccgctctcagcctagacaaccttccctctaggagatactcagggaagacccaggacagggctctcatcctcgaaccccacactctcagcctagggtctcctagggagaccatcctaggacaactgccactggccctcagcatggtgtctgtggtggcttgaatagaaatggcccccacaggctcacatatttgaatgcttggtcataggaggtggcactattaggaggtgtggccttgttggagtaggggtggtcttcttggaggaagtgggctttgaggtctaagaagctcaagtttggtcagcatgtctcaatcacttcccactgcctaccggttcaatccagatgtagaactttcagctccttctccagcaccatgtttgcctgcatgccaccatgcttccccaacatgacgataatggactaagcctctgaaactgtaagccagcctcaactaaatgttgtcaactaagagttgctatgctcatggtgtctcttcacagcaatagaaacccaaactacgtcagtgctcattcaccggctgattaagggaggggacttgctcagttctggtgtcttcagggccttcccgtgtctactgcttagtcaggctgactgcaccactctgccagggctgcagtggtgacagcttgacagcaaataccaacatctcaagccagcagctccgagaacatgggaaaaaggacaaggtcacaagacaggagggcctgtggtcaccactcagcacaagaccctaggaggaagccgaagccacaggtctgatggctcctgctctgtgaggggacaaagcttcctttttctgatggagacctgacctctgagggctccagttgttctttcagagctgtgagggatcagcaaccatctactcatctccagatacagaccgtggccatccgtgtcaacaccaagttctcaggcccattttctcttccctctcttctcca

SEQ ID NO: 30635 - DNA, 1153 bp, Mus musculus
ggagcacaatggagagtgatcagaatatctgtcctaaggttcggtgtcaggcctcattgctattctgaggctaagcatcgtgtgagtgttgtgtgaaagagccaccttcagcaaagaaggctcagcctgtgctgtggtgccctgctgcagactgcattcctcatgtgaagtgagatgcctgcggagtggggtctggtactgaagatggagcttccatatttgagggtgaacaatctatatatatatatatatgctagttcctctgcacatctgtctctacactggtcaatacagatgtggcattttgatgtaataaagtgacaagactataaaaatcagttacttgccagacgtggtggcacaggcctttataatcttagcatttgggaggcagaggcaggtagatctcagatttcaggtgagcctggactaacagactgagaccttattattattttttttttaaatcaacttatgaaccttgtgagcatatcctagaaaacctgggctggaacttagaccatttcttaaatgatggaattgatgatgttgaggggctggctgcatgttccatgtcctgccacctagcccacagcagcagtcacctagccgcattctggaggttactgctggtgcatgtgcaagcttggggaggggtccaggtgcagagcctgcctgtcccgtgccctgtgcaaccccagggaaagctcatgaaggacctaatcagtggcagcaggaggccctgccaagcaggctgcttgtactccagagagggagtgctgtgctcgtacctactcccaccgtatgttgcctgcttttctgcctgttgcctgcttttctggttttgtttttgtttttctaagtgtgtattcatagagttagggagggagggaggtgtatgtatatgtgtttgttcttgtgcgtgcgtgtgtgtgtgtgtgtgtgtgtgtgtgtgtgtgtgtgtatgtgtgtgtttgaagctgtctgtgtacatgtgtgaatgttgggttccttcctggattgaattactctccaccttactttttttgagacaagattgctcactgatttaactagaccggttggccagtaagccctgggggtcctgtatttacctcccaggcacaagtcacagtacccagcttttacatgg

SEQ ID NO: 30636 - DNA, 1187 bp, Mus musculus
ctggggcagtacgaggggggggggaggggggtcacacagcatctaccttgaagctttccataaaccttactattaaatcttctaggcacaaatgagaactcttccatgtatagtattgaatgactacttcaaactacatttctcaagaaaggccagagagattttgtcttttgagacaaactcactctaacctaggccagtctagaatttactttgtagtctaagcaggcttcaaactcaaagcagttttcttctctctgcctcccacatgcttcaatagcaggtttgatccagctcacacagaaggggatttttatatatgtccactgaaaggtcttctttcctcagagacaagaactatccacccagagcgttgtgttctcggttgacgtctacacattcacttttctgtttccaggacactggtgtcatgccctgtcctctgctggttggtggtagaactctgcccatattggaagggaagcctccagaaaggccttcaaacagatgcagagatccaccaagagaagaagaaagagagaaaaagaagaagaagcacaaaaaacggtctcggacaaggtcccgctctcccaagtaccactcgtcttccaagcccaggtctagatcccactcaaaagcaaagcactccctgcccagtgcctaccggacagtgcggcggtcaaggtgggtgtgccggcactcaagccttcttgctcccatccgccctacacactgagccacttcctgctaccctataaagccagcagaatttaaaatgagcacaggctagagtgtgtgtgggggaatgtgtgtgtcttgcagatccaaagatctttttaaaagaacattgttgagacttttcagagctcacctgtcactgcaggttaaatgattcatttatgcttcttatctctgcatagcttacttagacctcactcttcactcaaggtggaaacaagaggatctccagttcaaggccagtctaagctacactggggttgtagctcagtcagtacatcctgctgttgagcatgaggacttgagtgaagaagccaagcatgctggtgcctgcctctaatcctagcataggggaggtgggcacagaggggctcattgtctagccagcccagcctactgagcaaaaatccaggccagtgaggaaccttgtctcataaaatcaggtgaac

SEQ ID NO: 30637 - DNA, 1108 bp, Mus musculus
cattatttataacactttacatcttagtgtctacaggtccaaggaacaaaaccctactacttagtctaattctcagttaaaagacaaaatgaagctgaaatttttctggccattatttcgtctcaatttgaccttcagtgaaaatgttttacagtgtcaaggctggttattctcaaagcccccaaacgtttcggtggctgagggaggatcagaaaagaggcttttggttctatctggttaaataacacaggtactttacctcgggagataagtccatcgctagtgtttggttttacagtttagatagaataccaagacaaggcttgctgcagagtaagtgatttacacagcactcttagctgctgtctgtccacacaacaccgagagctggaacgggcccttggaaggcacagtccctggctgcatggcaggcctcagcctcaatcctctttatgggatagggtcatgttgcccactgcaggccctgcagcgctctcgttcccaggatggaagcagctggaaagccatggttatggaaggggaagtagccatgcctatgctccgggcacccagaccgaggcaggagaagtaagcatgtcttgtgccagcctgccgtacatactaagacagaaaaacaccaagtagaaggttgcagttgtggctgaagcaagagagcaggctccatattactatgagctgttgacattctaaccatagtgaagaaagtgctggtgatgctgtcattatcttgtctttagccatcctttcaggtagaggaacccattaccatggtaacatctacaataggccttccttgccagacttatttttcaggcctgacacagcctaagtggtcatttttaaatgactgccagctcaaagtaaaatgctgcagttgttggcatcctcctgtggtagcatactgcaactgaaatgcctaatcttccctatactaagtggctctggtcccacataaaatgcaggacagtctgattttcgtttactgtgtgatgtgctcgtaggacagaagctttgcttactccatatgtctaaactgtaggtggctttggatctgcaaaggcaagttctccacaataaaactcttcag

SEQ ID NO: 30638 - DNA, 1487 bp, Mus musculus
cgttgcaccttgccgggctgcccaagcccagctgtcacaaccccaggatgccttgtctgcacctgagcggctctgatggcatctgcacgtgggctgatgaggggcaaacaggggttcctcgtggtatccgtaggggccaccatgcctgtttcacaagtaagagagttgatgccccgatgggggaacagggtgggagaaaggcacctacccagaagtctgatccactgccgtttgcagcagccagcgccgtatctgctgggataggggaccagtcacactcaggatctgcccacagattcccagatgctggccaggggccttgctccaaccaccaggagcacagccacctctccccgtcctagataggttagccatggaggctgtgtcctgttatctccctctctttggccaggagagcattgtgggtctccctcgggtgctgttgatgggggtggggggcgcccatagagatatttcttcatctgtcagtacccattgcttcagcaagatgcccccatatagttctggcctgagaccctgcagcttggactcacagctgtcccctccccagctgcagaagggcttctaacacctggaataaaggtgggcgttcagtttagggaaggaggatggttgggggagcccagggtgatagcaagggggagctgcagggataagtgtcagggtcctcggggagtcatgacaatgttaccgcctaacttggagatgtaggagctgtgcacggattgcttctctgggtgacaaacctccatggtccagaaaggggctgaggttgaacccaagatgggttaatgagctccagaaaggaacagccaagttcaaaggttctgggacaagacgggcctgaggaacagggccacccaggtaggcgtggctgtagggtaagcagtttctgtcattgggcacgagatgaaaattagtgatcacacgcacatacccccctccccaactggcccggtcccatctcaggtaagaaaggcttctgtctaccccaggccaggtttgagtgttgtcaggatgagtgagcagctagcggggcctaagtttctaccctccatttcccaagcctggccacaccctagacccacctgtcagactaggcaggacagagtcaggggtaggggcatctgaggtttccctgtcttggaagccaccctactctgccctcatatcaaagcacgctcctatgatgtcccatgttgtccaccagcctgcaggacacagatgtcctatacagcaacagggaagggtccaaaaatctttgtcacatagcactgaaagccaggcccgcaggctggagctgtctagatgctggtgtcacactcattttaaaacccaaactcttaataaaaattttgtacactggacaggttgacagctcagtggtaaggttttggggttgatctcctcctgtacaactcccccaccaccacccccaaaattctctgtacctctggtcttgggct

SEQ ID NO: 30639 - DNA, 1274 bp, Mus musculus
ccccaggtttccccctattttcctaaaggccagaatctttcttactgaatttccagattttttttttaatgttatggccattggattacatgtatctattgtgtatttcttgagagggggctttctgtctctgtttttatctctgtgtgttcaggaaacctccgttttacaatcccagtttccacaaaggaaactcccttgtccttggcaacaagtgggggcaagccatggggcatgcgtagaattacagtaagtgcttcttcttcttcttcgggaaaacaccaaatggcggatgacgccggtgcaacgggagggcccggaggacccgggggcccaggattaggaggccgcggcggcttccgcggaggattcggcagcggtcttaggggccgtggtcgtggccgaggccgtggccgtggtcgaggccgtggggctcgtggaggtaaagctgaagacaaggagtggatccccgtcaccaagctgggccgcctggttaaggacatgaagatcaagtccttggaggagatctacctgttctccctgcccattaaggagtctgagatcattgatttcttcctgggtgagtctctaaaggatgaggttctgaaaatcatgccagtgcagaagcagactcgggctggccagccgaccaggttcaaggctttcgtcgctattggggactacaatggtcacgttggtcttggtgttaagtgctccaaggaggttgccactgccatccgaggggctatcatcttggccaggctttccatcgtccctgtgcggagaggctactgggggaacaagattggcaagccccacactgttccatgcaaggtgacaggccgctgtggctctgtgctggtgcgtctcatccctgcccccagaggcactggcattgtctctgctcctgtgcccaagaagctcctgatgatggccggtatagatgactgctacacttcagccagaggctgcactgccaccctgggcaactttgctaaggccacctttgatgccatctccaagacttacagctacctgacccccgacctctggaaagagactgtcttcaccaagtctccttatcaggaattcacggatcatcttgtgaaaacccacaccagagtctctgttcagaggacccaggctccagctgtggctaccacataagggtttttatatgagaaaaataaaagaattaagtctgctgaaaaaaaaaaaagaattacagtaagtactctgtactcttatctgaaaagataaactcccacatcttt

SEQ ID NO: 30640 - DNA, 1125 bp, Mus musculus
ccagagccacatgtgtgggtcttatcaatacccacgggaggaatcgggtccatgtccacccaagccaaggttaaaagcccactcatctacggatgagaaaatcatttgatcacctcagttaagcgttgccttatttaacttaatcaataggggggagagagattggagacgtactattgaaagggcaagcccttcactgcctcccacccaaataaaaaagccaattggccttgtactacaagagccggtcgaactccttctccctgtttcccacctatcatccaaaaaagcggaaaaatatcaacttagtgttattatagtgtatttcacatttgttcagtcaaacttagccagagttccaacgccctacttaaaattcaactagaaagttacctaccaagtactaattagcattataaagtcagagcctacagctccaggcttttcagttagttgttcactaagataagaaaggacagtcttagccttatacagtttaccataagaaaagttaaggaatcccatgaaagcaagttttttctttagccctagattccaggcagaactattgagcacagataattttcccccctcaggccagcgttttctttttttaaattttgttaataaaagggaggagatgtagtctcccctcccctagcctgaaacctgcttgctcaggggtggagcttcctgctcattcgttctgccacgcccactgttggaacctgcggagccacacacgtacacctttctactggaccagagattattcggcgggaatcgggtcccctcccccttccttcataactagtgtcgcaacaataaaatttgagccttgatcagagtaactgtcttggctacattcttttctctcgctacctagcccctcttctcttccaggtttccaaaatgcctttccaggctagaacccaggttgtggtctgctggccggacacaacatgttgggaagcatcaaggtgttttaaagtgtttttcattgcaattctcatttgtatgtgacaacattccgtgaaatgacagagtccttcagtataatgtatgcaagaccaggtagcagaatgtccctggtcttagatttccaaagccccattatgacttcac

SEQ ID NO: 30641 - DNA, 1131 bp, Mus musculus
tgtttttctgtgtgtgtgtgtgtgtgtgtgtgtgtgtgtgtgtgttctttttgcatcacagatcccagatgggagttactgatctgccactctccttccctccacagtactttaataaacggaaaacctactttgctcacgatgcccttcagcagtgcagcgtcggggacatcgtgctcctcagagctttgcccgtcccacgatcgaagcatgtgaagcacgaactggctgagatcatcttcaaagtcggccgagttatcgaccccgtcaccggaaagccctgtgcaggaactgcctacctagagagccccctcagcgaacctcgggaggagctcaaggtctcctgaacccaggaaaggaggagccagaggcatttctgtctgtgtgttttgctcaatggttttcattactgtttctcctgtgacattaaaagtagtcagcaaagtaaagagcttagtgctccatacagggttgcatcctttttcagattctctgaactgaaggtactgattactctgtatgcctaaggatgcggcatcattttgtgagctctctgtcctggatcgtatgtattgtctcattgttcattgcctcccccaaagaaatcttggactgagcacctttgttttgaaagaagaaaaccttttgataatgacataaaaggctaaacttagttttggcagcttgatttttcaaaatttattgtgtgtgtgtccacaatgcctgtgtgggcacacctgtgccaccacacacacactgtggcagccagaggacagctttgtggagtccggtctcctttcactcttacgtggttcccagtaacacacctgtacccactgagccatcctattgacactgagttttaatgattcatattcaaagtaaattggcctgttttgttgtgttttgggagacaaggtttctctgtgtagccttgactgtcctggaacttgctctgtagaccaggccggcctccatatcaaaggcctagcctctgcctctgaagtactgggatttaaggtgtgtgccaccactgctgactagtaaatttaaattttttcccccttatttcaccaacttgcaaggagaaatgttttaaatgctgtaaagactcttactgtagaaactttg

SEQ ID NO: 30642 - DNA, 1208 bp, Mus musculus
ataaaatctcactcagagcagacgaggggctgggtgggggtcggggtataggatcaggaaaagactgtggcagtagggtaccaagcgtcccaagaggagggaaatggcccttcacaaatctgccggcttttcctggggcgcgcctaggcttggtgcagtcaagatttgattactcccatcgtcatctaagccacagtttctcaccccaccccccccccttgccaacatgactgtctctgtcttgctttcatcaaggcagacagccattgaaacaggcgcctcatctgagtcgcttcaagacacctgccaaccagctgtcttcccgatcatggtcccctctgggtctgaataatctattgtcgtctgaagactaggggagacaagcattcagactacttcagacagttatgagacctgtatataatcaagtaaacaaaactttagaaaaaaatgcttttaaaaaaattatataaatgagggctttgcctgcttgtatgcctgtgtaccacttgcgggcctggtgcccatgaaggccaaaagagggcctcagagcccctgaagctggagttacagaaggctgtaagctgtcgtgtgggtgctagacattgaaccctgaacctctggaagagcagccagtgctcttaaccactgaaccatctatctcttctctaactcaaattcaacaacaacaacaacaacaaaaatctgtgtctaaaacacttaaagccagacgtgagggtgcacacctttaatcctagcattcaagaggcagaggctgctggatctctgagttgagtttaaaggcagcctggtctacacagcaagttccaggccatgcccagaacaacatagtgagaccatatctcatagaacaacaaaaccaagttgggcatagtactaggggatacatacgtgttatggagtgccacaaatttgaagccagcctgttctatataaggaaacccagggtatccaaagatgcataatcagactgtctttgaaaaaaaaagttattgccgggcggtggtcgtgcacgcctttaatcccagcacttgggaggtagaggcaggcggatttctgagttcgaggccagcctggtctacagagtgagttccaagacagccagggctaaacagagaaaccctgtctcggaaaaaaaaaaaaagttatacaaattaaattttaaaaaaatttttatttatatgagt

SEQ ID NO: 30643 - DNA, 1829 bp, Mus musculus
ctcagtttctgtaacatccttgttgatggagttgggatttctggctcggttgctcagactctgcgcttcctaacagcacacgcgtttctggtctgagcaggcgcagtgtccgtctctgcccggtgggcttgggaaggccagggcagtaaccttccgcttcttttcagtcccactcattcaggaaatggagtccaggatcatgatcccgctcaagacctccccgctccagtgacgctgccgtgtgcctacgcagattacagtgacgaatacgtgtcatgatttcatctcacccagtcaccgagtggaaagcaagccgaggtgtaaactgctgtacatagcttgtaagatctctttcctttaaaattgaataatcaagaacgggaactcaggagggttgaactaccagaagcggtgcagcctcagctcaccaaccgctccttagcctccggcccttcaggaaaacaggatcatttgaagccaggtgtggtagcttagcactcagggagctgaggcaggagaattacaataagtcctaggccaatctgggctacatagagagtttcagaccagcttggaccttgtgagaccctgtctcaataaccaaaattaaagtttgaattctctctgagtaaaatcccagctatgaaaaagaatcagctactatttcttgctattaaaaaaaaaatctgttttacaattacagatttttttttttttttttacaaatttccttccttcaggaagaaatacaaatgaagtcacgtttcctgagcagtttttctgagtctcaaactaggaacaaattctgagtgtaccaatggctgcgaatgctatgattttgtgacttctggtcagtcggtcagcaggccgggatgtatcattaccctgagcgagctggaagggtggtcaccctgcacctagccagccatgcaggctccatcaggcaccgtgtccccaggggtgggcatgaaccagtgcgccacatgtgattttgaaataaacacctcaactagcactaattttatttgcaatatttttctataaaacaagtagctcttggaaaagaggttttcttttctaagccgccgttcgtgacctctgacctctggttctattttggtaagctcccagcagacacttccaagtcttgtaccaagggcagtgcacactaggtctaagttggcataaaccttcatattctgtctgtctctgtttggttttgtttttaatatagtgtgccaattttgtgactgtaatcatgtgaaagccccattgaaccgaagaattatgtctgccctacaaattgatttgtgtaaaataaagtataactaaatctcctatcagatgtctaatttttacatgcgaatgattttctccaagaacatactaaagtaaataaaagcctcttacttttcatgtgttgcacgattgagacctttttgttggttcgtttacttagctcgtttgacatttttgaacgcagggtgtaagtatgtagtggagggcagcctctaactaaatcctgcctccaccaggcatcgctaggtgacatgcacgtacagtacaggagctctcgggaccactctgttgtttatgttggggggggcggagcacgggagccacagtgtgcatggaaatccagacaacttagagtcagcttcttccatgcacatccctgagatccaactcagacagccagggttgtccacaggcgccgttccccactgagccactttgtttgctcttgaggtcttttgctctgagcttgtgctgcggaggacttgtactggggccatgaactcaggaggaagatagggcgtagagcagaa

SEQ ID NO: 30644 - DNA, 1099 bp, Mus musculus
aatgcctacatcctcacttgcaacgtgtccttagagtatgagaaaacgtgagtgtatggccctcttcagggtggaggaaggtgacattctttttccccactgtgaggacagtaatgcaaacatgggggcttgggttatgtggagcccactggtacagcacttggttggaatgtgtttagcctgatataagccccttaaaaaaactaagataacatggaaatctcctttgtcttttattttttttaatagagaagtgaattctgggtttttttacaagagtgcagaagagagagaaaaactagtaaaggctgaaagaaaattcattgaagatagagttaaaaaaatcatagagctgaaaaagaaagtctgtggtgactcagataaaggatttgtcgttattaatcaaaaggtaagaacttaaaattgtgaattagtcttattcctttttaaggtgaaggctgctgagaaatgtttgtctttattcaggggattgaccccttttccttagatgcccttgcgaaagaagggatcgtagctctgcgcagagccaagaggagaaacatggagaggtgagtgaggccaactgagagtttgcacgggagttagaattattctcttcgtacttctgcttgctttttcattttactagcatgtatgaattgaacagaatcattgggttgggtttttttttcccccccttatacaggcatttcatacacattccctgtgtgtagctctggttcccttctgtccctcttactgctggctcttgtttgcagatagtctgttcttagctgggcgtaaatcccagcatttggggagcagacgccagatgagtttgaggctagcctgctttacaaagctaattccaggacagtcagggctgttacacaaagaaactgtctttccccccccccccccaaaaatgacctagattacatagactcttggttttattgtaactatctgtaaatttaaaagtctaccttttaagttttttgtgtatattcaggcttgtgcttggattttacataaaatccaaggacagcttacagtgtgtcctaccctgtggatccagggattaagctcaggttgacag

SEQ ID NO: 30645 - DNA, 1708 bp, Mus musculus
ggtaaacctaggtgggggaagatgggtgacaggaggatcttggtaccagtgctgtgggaaaagcagaaagcttatgtgagtaacctaatagaagacatttgggaatgagagaagtcaaaagtgcatgtgttgtgcgtcaacagcagtgtgtcctgagcagagtgtgcagcagtctgctaagcagtgagcactgactgtaaggcattgctaagagtgtttggagaagtcttggttactaatggaagagtactgttcctttgtatttaaagtccctgaggttgacctgatgcagcctgtgatcctttcagaactgaggcaacaggaccgcagcctggatgctgtcttgcgctgtagtatagaaaattcttatcttttgaaaaggaaaaaaaaatatggtctcaattggcccatgttttctgttttagaattggtagggttcataaaatatatgaaaaaagcctttggtgctcttggttatttgcaggtgagccgatggtggctgcagagatgggtgtgtgggataactactgtgtgaagaagcagctgctacactcctggtgagtgtacacgatcatggcggctcgcgggcgggcggcagacacagcagtttgggttgatagctcatctgtcctctcttcctccttttcagtactgtgatcgccaccaacattctcctggtcgacgagatcatgcgagctgggatgtcctctctgaagggttgaggcctgcctgtgatactacaggatgttggggggaatggttatttttgtccaagcttcaagtgatttggaaaaaaattttctcttcctgattggagaaaagaaacgggacatttgacacctattcaaattatactgtaaaattttattttatttttgccttgagtatctgaagacactcaaagcagctctttttcaacccactgaacaagatgttttagctacaccgatacaaaaattacataagataagcatgttgtctacccttgttccgtaagtgttctttgaaagtttgtaatggttttctcctaaataaggcatggtgacacatgcctgtaagcctagccctttggaaatagtccggaatttctatgccaactcaggctacaggagaccccaggtcgaaagaataatttgttgtggatgtatttgaaattatccagccaactccctgttaaacatgtaagatccttgccagtgtaaaacacatctgggtaatttatgggtttcataatgtctaataaatacttaaagagtgaagctactggatcattcacacttgaaatgactgaaaatgcttcagaaaagctaataaagccaagttactccgtggaggctggaaggtcagaactctgccacccaacttccagacatgggaacacaagaggctgagagagttacacatttaacagccaaaaggacggttgttgaagaataagggtttgggtgaaacaagattttttaggctattttctatcttggttttgcatcatacctgtaacagcttatctctttggttttcatgtacttgattttatgtgtgatacttggggagaggggctggctccgtattccacagtgagtgagtgaacagctcaactgaatagaggaaaatatctgggtggagagttggctcagctacgtactactggttctcacagacaggcagttagtgcccagcaccgtgggcaacttctagccagctgaga

SEQ ID NO: 30646 - DNA, 1215 bp, Mus musculus
aagcattcaggccattctcattcagaccactacagctcctctcttctcgacagatccccacccccagcagtatgcacctctcttccttctccatccaggatgggaaacactccagactcagcctcagacaacctgggcttccgctgcgcctccagtgcaggccgaccgaaggaggacctgtgagcagccagaccgagatctccgaagcaccctctcagcactgtacctccgtgaccatgttccagaggcagctggctaccaagctcatgcgtctgagggtggccttttgagcccctcccctctgacagacacaaagaacactcggactgcaagaagggactgcagtagcctggaagatgaggacctggatgaccaaggctgggagctgggctgtctcttaagtgcagtattaaggacaaaggaaccaaaccctccagtgtccaaaagatgacattttttaaactctctccctttttgctttctccctggctggttcagctttcacttctgggaaattctgcagaaggaaaatgcttcctttgtgaggtgtgccaaagccttgctgccagaacctagcctcgctggcctctgaaacgagatactcaatatgtggcaaggctggtctcgaactctcgatcctcctacctcagcttcctgggtcctgctgggattacacaccacgcccactatttaaaagccccagtaaagcaaatgatttatgaagtgaagatgtgcattgtgggagaaccaaagtcagtgcccctctaggaagacaaatgccagaaccttctctgagagttagctaatcatgtagggccttctgtgtatcctgcagacatgtccctgaagaagaactggatcttatgaggtcaataaatccttttttttttttaagatttatttatttattatatgtaagtacactgtagctgtcttcagacacaccagaagagggcatcagatctcgttacggatggttgtgagccaccatgtggttgctgggacttgaacactggacctttggaagagcagtcgggtactcttacccactgagccatcacaccagcccgaggtcaataaattcttatgtatatcaggaagcacaatataattgttgtttgagatagggtttcatgtagcccaggctagcctcaagctccttgtgtagccacaaatgaccttgaactcctgctttcacttcctcaaatatccata

SEQ ID NO: 30647 - DNA, 1287 bp, Mus musculus
aatccactcaggaaacaagaaaaccctgtctctcaaaaaagctaaagttcatgaagttctctgcctgatagaactgatatcagaccgtcccacaacagggaagacccaggcctgaggccgatcctcaacctgagaactcccagacagaatgctgtggacgaactggtccacgaaatatctatttccaggacagggttgttaggtaggcactacactgccgtgcccatcgaggaaaccctccccttagcttctgacagagggttagtaatagaattgagagagacagagataagatacttgtcttaattcatagcttcttgttggtttaacatctaccaaattggctaaccctctgcttcgggccgttgtagacacatgcaccgtgtcttagttatggcaaagatagaatggaggtttgattggatgaaccctgaaatggtggtgttgggtgtcttctaacttaaacttgtctttttttttttttttaataggtttaatgtaatcaagaaattcaagctgaagagatgtaacattggttctgtataattgatagtacaagtgtggacccttatatttctaacagttcattgctttggaatggccgtgaaagagatctaactgtggatgcttactgaggcttgtatgtagtgttggttactggggaagtgtttggcctccttggactgtgttgtgattgtgagttaaaaaaaataaattggttattctgaagtgtgtggtagcgtccttattgtgtgtgcctggtgaacatagtagcatcctaagagaagccattctctatgcctgtcattcgtctagtccagaggtgctcagccttcctagtgctctggccttttaatacagttcctcatcaaaaacacagctttctgatctggaggcatcgaatctaggaaaagcttaggcccaggtaaagtggtacatgcttttaatcccaggagacagagatatatatatatatattttttaactttgatcacatgctaattgtgatgtgtcagggagctggtgtgatactcagctgcagcaggcttgtctagtattcaccaggcttgagtcctgtcttcagccatgccaacaaaccaagtagctaagtaagtggtaagcaggtagacattactgagacctccgatggccacgtgacactgcgtgtctgcatggaggcagcgtacgcaagccgttgggtctccctatatagtccagatctgtgtaaatggcctatcctgcctcagcctcccaagtgctgggattagaggcttgtgccaccatacc

SEQ ID NO: 30648 - DNA, 1233 bp, Mus musculus
gggcctatcctcaatatcaacttctttctccctacacaatcttttatgccagggttattgcttcatatttgatgatttctgaatgtctgacctggaaaaaagtggcttttaatactactttaagaccactcttctaactccctctgcagtattcactgcaattcctgtgaattgtttatggtaggtaagtctggctttggttagtgtttttgttttgttttgttttttaaattgggttttatgcaatatcatatcactatgtagtcctttctggcctcaagttgtggtcttcttgcctcagcctcctgagcgctagaatttataggcatgcacccccaagccttgctatggcagggtttatggatgggtatggaaacaaaggaaacagttaaagactgaggcttattggagggctgtgcatcattagaatgaggggagggggaccaggggctagagagatggctcagaagctcttccagaggccctgagttcaattcccagcaaccacatggtggctcacaaccatctataatagggtccagtgcccgattctgttgtgtctgaagtcagagcacttctgtacattaaaaacaaacaacaaaaaaaaactcaaccaaaaacaaaaccccagaacagtgggtctgtagcagaggcaggtggatctctgagtttgaagtcatcctggtccacaaaaaagagttctaggacaaccagactacacaaagaaactgtgtcaaaataaataaaacaataacaattaaaatacccagaacaggtcatcttaacattggaaaggaattaacttctggttatttttctggttatgtatatagtaaaaaggatagacttgattttttaaaaaactaattgattacattctaaagtttgtttttcttctctgtgctgttgctaagtgaagaaatccaaggcactaaggcactatgaaggagagagttcagtattagacatgaaagtggagcaaatgtcaggagaaaggagggaactcattgcttggacattacaaagagggtgcattgggctgagtaagacaaaggctttagatgtgaaccgaaggcatcaccatttgacttgcaatattctatctagcaagagcagaaaaactagggctgaatctaaccccctggcttagtttccagaaggaaaactgttgtggtgccaagacatcctgacaaaagtgacttaagggagaaagggtttattctagcttatagt

SEQ ID NO: 30649 - DNA, 4312 bp, Mus musculus
ttgttttttgttttttaattcacaacagacactttccctcagaatcttaaactgattttttaaaatattgtaaattagaaggggccctagctatttcctgtgtcggtcttcattttaaatctggatacaaaaaaggatacaccgagccaatcaaagacaagctttaactttaccttgaagatgtttctgagataataaaatgtagccctagcccccagtcctcaactaaagtgagcagccattgctagtaattctttaatgtgtataaattcaatttcaggtataacaaatgtgatcatgaacatgaaaatattttagaatagatactgtattaaatattgccatgtttacaatatgtaatatgtttttagccgatggatttaaacctgtagattcaattagagtccatttgtgtgatatttgtaaataaaggtagaaacattgggatccacccctgcagaacttactgtacagtttagttgaagtgtagaaaggaattgtcagctcatcgtgactgatacatagtgaagaaagtacaggcaaacagaacatcttgggaaatgcgctgacagccctggtgcagtgttgacagcagaaacagggtggttgattcccttccatctcccactcagagaggaagaaacagtctgaacacccagctcaagtctgactagtcagaactggatggattggaactctacaggatgtcacgtgactagacctttcatttcaaggctctcaggacactgatgtgggaagtggatgtagtctttggagaaaaaccactatggcgtttctgggcaatgcctcttaaacagtagctgagctctcaacacatgtgttcccttgattccagtgccagtcagctcagcagtattatgactgaagcaggcacaagccaagtgctctgaggtcggtccatagtgtttccccttcttgtttcttcttgcactaaggatggtcagtaagtgtttcagaatcacatactgaatttgtaaaccttaggactatcgggagaaactgtttgctgactcagaagaaacacaaacgtagaaagacctggaagagaaacatggaagctttgtcccactccagtagccacacagaagcagtgagaagaaacccagaggtgatctaagtacacaccccagtggcatggcgactgtgtttctctggttagcatcttacaggagatgttaaaagtgccttctgtcttaaaatctcaaaccaaatcattctgtgggtagaactggggcagaagtatccctccttcccttccttaccacgaagcagagaacttgaacttgcattctaccaggaaggtctgtgcggccattttattccttgggtggagaagtggcagtgttttttttatgatttggttaatatgctaaaaaataggcaactagacagggtactctgagacagcaatggttgagtggtttacgactttcagtcgaaactgatgcaccataggatttctggcctggggcaggtataaaatgggaattgtaatgttcctttaggaggctctaaccagttccttaaaagaccgcttaattccaatttcatcaaaggttgtgtttccccgtgaatgtgaacatttctgtgactatcttactgtgtatgcattgctgttgtcttctgaagtagttagagaacgtctagaaagtactgaatggtctttgtggtcaaccaagtcctcgttcgagaactgtacagtgagctcatctcatagccctgtgtccaggtctcccaaggcagtggaatggctactcgctaagacttctgctgcttacatatcaaggctctgctaaacatgtcccttgggccccatttccaaatgaccttttctgtcttctatcactcagcagagtggagttaaagcttgtcttgacattgcagatgtctccaacccttactcaagaaaatgtgagagggttccctccaccagacccctcaaggcttccctttgctttcctaagtcttgggagtaccaccattactgattgtatgaattgcttgtttgtttgtttgtttgttacattcctgtgacctaataggatgaatacccctttctcactgagcgttaacaggtgctgttggaaataacagcatttgccgaacagtgtgctcatgcttgcctgcagtcccatcacttgggatataaatgcaggaggatcaggaattcaaggtcatccttgactacatagcaaaatagagaccagcattagctacaggagaccctagctttttaaaaaaaaattttttttttttttgctaaaatatatgttctctataagtgagcctgttgtgttttatttggtagttttgccctgagggaatccagtcttcttctctaccatctattaaaccttatagaacgggggagaaaaacactgtgttataaaactgctaatattgttatgactgtttcagacagagtatttaaacactgaagaagcagggtttggctgggcctggtgacacacaccttgagtctcactcagtacttggggagcagaggcaggtggatttctgagttctaggccaccctagcctagataaggagctccaggacaaccagggttatatagtgaaaccctgactcaaaaagcctacccacaaaataataacactgctagttgatttaacaataaatacggaagggcagaccagggggaaaatgattcctgcagtaattctgggcttcatgctttcgaagtgattcataacagtggaagcctcacttcagattttcgggaggaagagaaagtctggctaggtgtgctccagagcctgtggttggcttatgggatttcccttgatcctttcccacagctagttttgtcagggagggtaaacttctggtacaactcaggtttaactagttgcactagctatattccaagaattattttttgcttcatctgtatagcctctccttcagctcttttgttgtggttgttgttttgttttgtttttaaagagacagataatctttctctgtagcctaggctgtcctagagctcagtacatagcccaggctggcttcaaacttgacattcctcctgccttagcctcccaagtgctcagattcatatacagaaggaatgttgaaaagcatttgagttttttcaagtaaagagacaagttctgggggctggggagataggtggcttagcagttaagaacacttgtaaaggacccaggtttggcgccaaccacccacatgtctgcttaacctttagctgcaactccaattcctggggatctgaccccctctcatggctcctgaaggccctgcatgcatatggtgtatagacatatatgcaggcaaaacacccacatagatatgaaagtatttcgtttgctacaaaagatccttgtacctatgaggtagaggacaataaaattaatattgttgcttttttgttttatttataattatattcaaaagactaaaaatgcagccaggcatggtagtacatgcctataaacccagcacttgggaagtagaggcaggaagaccagaagttcattcaggggcaatctgggctattttgagaccatgtttctagaaaagcaaaaactcaaaacacaaaaactgctcagcagttacttgctaagctctagttggtgccaccagttgattctggtggatactggcaggtggtgggtgacctgaccttaaaagtcagtaaaatgtcagtaaaatgtcagcagagtcccccactgttctgtccaggaacttgtttggggctgtgaacttccccgacttcttccagtgcgtatacatcagtgaagccacccctctccaccttttagcattttaggcagtatgtgtatgaatcctattttgtgagaacaaccttgtcataaagaacagggtaggaatccaggcaatgtgatcaggccctcccttcccccttttaaaccgattggcccaggagaggtgaagtgttatgaggctgtactaagataatagcatagataataggtgtctatgacctgtgaagtgtggtccatctaaaatactactcctgcttcgaaagctcctgagtaagccttcatgtaagaaggagttcaccggggagattccctctttaatatagatagaaatattctttatcagagatttaggatagcattttgctaactggtaaataaaaacagatgtacatatgtaagaatgtttatttgttgcacataacttttttggtataaaataaatgtagacattacctgtggatattgtgctgccatcgttcttacttcagtgtggagtcttcagaaatgaagccggaggaaa

SEQ ID NO: 30650 - DNA, 1388 bp, Mus musculus
actaacacacacacacacacacatacacacacacacacatatacacatacacacacgcacatacacgcacacacacacacacacacatatacacatacacacacgaacatacacacatattctctctctctctctctctctctctctctctctctctcatgtggtgtttgggatggaagggacctgaacatgcagacagtcactctactaacaacaaagctacctgtcagcttatttttccacactttttttttttgtttttgttttttttttgggacagggtttctctgtgtagccctggctgtcctggaactcactctgtagcccaggctggcctcaaactcagaaatccgcctgcctctgcctcccgagcgctgggattaaaggtgtgcgccaccacacccggctccctgtgccttttaatatatggtctactatatagtcagagttgggaaactggacctcttcttccttttacagctagcacttagaaaggagaggcaacagatacataacaagccagcaataggcttcagatgagagtgcctgttggctggctgtgaggtgggagggagctctaggtgaagtgttcgttgacttcgatgccttctgttttctggtatcaaagggtagcttttcagaacatgaattgatggcatgctgcttttaagcttagaaaagtttagcaattctgttcgtcactccgtccctaagtcaggtgtgtggcaattaataggcactgctcacttgtttggtgtgtgcttgtgtgtgcttttaaggaaagagtgtcaatagatcattttgttctgtgtattcagaactctgttttccaaaatgcctgtttacttctgttgagctgactcagcaaactttgcagggtaaatttcaaatggcaagtcagcttcagttcactaaggagttgctcaagggcactgaataaccacccacctaccgcacagactccacagtctttaaaattcactcggacccagggtcgtgctccttaggagtgggggcaggaggagcacaaggccgagggcagccgcagctgcagagcaggttccaggccagcctgtgagtctgtcacagtgagagcctgtctcaaaaacacactgaaaaggcccaatctgtactgaggcgatcctgcctccaccgccctgtccccttctgcgctggcttgagttgtccggcagtgacttggaatggccaaggtcacgtttctcaatcacgaaagcagagagccgtgggatttggaaatgacattacctgtgactcagatagagccattggccctgaagagatctcccaggagccgtgttcctctgagagcgcagcgagtgtaactcaatttggggcagaaacaggaagcctgtgagctgctttcatga

SEQ ID NO: 30651 - DNA, 1374 bp, Mus musculus
cctgcagcaccgcgctcaactggcttgttcttgctcacatttgtggctattctgttcttatggtcgtgaagcatccagcttgcttcagcggctttcgggctggtttgtcccctgggaatgtgacggtgatctgtgcttttccaccaggtgccgatccccttgccacagtcgagtctccatggcctgaccgtgtcttgacaataattttgagcaaaatctatgtctaataagaagataaccacatcaagatggttgggaagctgaagcagaacttactcttggcgtgtctggtgattagttctgtgaccgtgttttacctgggccagcatgccatggagtgccatcaccgaatagaggaacgtagccagccagcccgactggagaaccccaaggcgactgtgcgagctggcctcgacatcaaagccaacaaaacattcacctatcacaaagatatgcctttaatattcatcgggggtgtgcctcggagcggcaccacactcatgagggctatgctggacgcacatcctgacatccgctgtggagaggaaaccagggtcatccctcgaatcctggccctgaagcagatgtggtcccggtccagtaaagagaagatccgcttggatgaggcgggtgtcacagatgaagtgctagattctgccatgcaagccttccttctggaggtcattgttaaacatggggagccggcaccttatttatgtaacaaagatccgtttgccctgaaatccttgacttaccttgctaggttatttcccaatgccaaatttctcctgatggtccgagatggccgggcgtcagtacattcaatgatttctcggaaagttactatagctggctttgacctgaacagctaccgggactgtctgaccaagtggaaccgggccatagaaaccatgtacaaccagtgtatggaagttggttataagaaatgcatgttggttcactatgaacagctcgtcttacaccctgaacggtggatgagaacgctcttaaagttcctccatattccatggaaccattccgttttgcaccatgaagaaatgatcgggaaagctgggggagtttctctgtcaaagtgagtaaatgtagtgttttctctctctctctctctctctctctctctccttccttccttctttcctttcttcctttcttttttgaaccctgcattcagctgatgaagatatggacctgtgccacttatggctgctcttgccagcacttgggaggcaggagcaaacttctgtgaattcaaagccaaccaggtctatgaagtgttacgtgctagtcagggctacacagagaggacctgactcaaaaaaaaaaaaagacaaggcatgacaagacgtacacccg

SEQ ID NO: 30652 - DNA, 1106 bp, Mus musculus
taatcccagcactttggaggtggatcaggagttaaagggcagggtctgctacatggagcggtagagactgtgtctgttagggttttattgctgtgatgagacaccatgaccaggaggaagttggaggaaagggttcgaacatttggcttgtccgtccaggctgctcttcttcatagacggaagctgctccacagctgagacgttttctcaattgagcttccctccttcacgtgactttagtttatgtcaagtatgacatgaagctacccataacacaaacccaactgggctgcctgagaccctatctcaaaagcacaccaaacccagggaagtggtgggaaaaaaatggctcagcggctaagggcgagtccggcttttgcaaagggagagccctagtttggttccttagcacccatgtctagccgttcacaaccatcggtaactccaaggatcaattatgtgtggttttaatgtcacaaatttcaattaccacaaattagactcacctgactaggtagggagcctcacccgaactgttctctttgccctgattgatgtgggaagacacccccccacaccccccgccagtgaaggtggcaccatctaataggagctcagatacagaaagtttgtgaggagggagactttctgcttgcatggcctgggtggctttgctctgttgttgctgattccttagatgatagcagagccagggatccaagctttcattggggaatagaccaggagcgctccgggaagcttctagcttcaggcactctgaattaccgaagcactctcctcgtaggatgagtgctggttgttaccctccagcgagagacagctactgagcactcatcctcaaggaccaagtaacctacctggttctcagcttcctgggtgtgaattggctgctgttactattttaacacttacttaaattcagacacacacaacacatgcacacacacaacacacagcaggaccctgacttaaacaggatctgctacctctgatccctataggcacctgcactcagatgaacacacacacacacacatacacacttacaaataaaaatatatagggctggagagagctcagcagtt

SEQ ID NO: 30653 - DNA, 1220 bp, Mus musculus
actatgcccctcatgcctgtccctccgaggcttgtgcctggtggttgtctgtcctcatgcccctgggctgcaggagcccactcaccccctggcacaaacaaggactgaggcgggagatacaggagaggcagctctgatccctgcctgtaaccacgtgctgtgtgttttcctagggacgactgctgccttgtctacagaagggaaatctcgggaacggctgtctgctgcgacaaggagtgtctgtgcccatcgctcctgttcacctgccagcctcctgtccccagggggggtgtcacacacccgggcctccccaagtgatggctcttgagcccaggaacatgcatggccctcaggatgaggagcccagcagggacacagttctgtcacagctcctcttgtccttgtctttccttcccaggttccagtctttaatttcaaggaaaggagagtttgaagttggcattctgttaacaaaatcaggcagtctcattccgaataggttctatgtacacgttccgatgttttgtagaacactcgtgcctgttgaaacgtatcgatgtggataatagtaaataccttaattatttaaataattcattgtattgtttcagagacgtttggaaattactgtatacatttacaacctaatgacttttgtattttatttttcaaaataaaagcttaaatgtgaagcactcaatggtcccgttttcagtgctgtcattgagagcacagacctgagacagtgctaaaccgactcctgtgggctgtgctatagctgccccgccccctcccccggaacagtccccgcccccccccaacagtccccgctcgctttccctgccctgttgcctcccttactctcactccctttcttccctctgtgtctgtgtgtgcgcgggcgtgcgtgtgtgcttgtgtgtgtgtgtgtgtgtgcgcgtgcgtgtgtgggttcacgtgtgtgtgtgtgcacgtgggtgtatgcgcgtgggtgtgtgtgcgtgtgtggccataggttgatgtccggtatcttatgtcaccctctaccatattttttgagacaaggtctctcagtgaacctggagcttgtgttttgggctggctgctagactagctggccagcagccctaggaatctgcctgcgcttcctctccagcattggggttgcagaggctagcacagccggcatgcctggcgtttttttacacaggcgctgggat

SEQ ID NO: 30654 - DNA, 1726 bp, Mus musculus
gaggattttgaccggtacatgtctggccagacatcccccaggaagcaggagtctgagagttggcccccggaggcctgcttaggtgtgaagcaaatgtataagaacttggacctcctgtctcagttgaatgaacggcaagaaaggatcatgaacgaagccaagaaacttgaaaaagacttaatagactggacagacgggattgccaaggaagttcaagacattgttgagaaatacccactggagattaagcccccgaaccaacccttagcagccatcgactctgagaatgtggagaacgacaagctccctccccctctgcagcctcaggtgtacgcagggtgacggccctgtttatttggggctggtttctgggagctgctgcgttccactgttcaggtccggaatatgaactgactgcttaaagtttcaaagtgtttttaggtacagatttagggattggttattctcttttttcttctctagcggggaagcttagtaaataataatgtactatttatttgagctggtggagtaggtttgtgtgaattctgtgtcgctcttttatgtcctgcctgatttcccatgggcttcctctgtgtagacactgttgttggttttgggcaaacactgccttttaaaggataaaacagatgctataaagtctatgttgaaatgaattctatgttcccacactcccccagtgtgaaataattttgtaattgtaaagatagaagataatgttaataagtaaatatgtaaaattgtaaatatgtaaaaaaaaaacacatagggctggggaggggtgtctcagcgtgcatggcatttcatgagctgatgttttttttttttttttaggtgaaaatgaaatttattgaatgtttgcctttagcgccattttatatggtttgtcccactaaaaagaatctaaagaatttgagctttaacaggacattggcactaactgccctaacttgagattctttctggtacatgtgaagaagttgtaacgccaacttttaggtcacatacagaattattctgggaccctggggtggtggctcagtcagtaaagtgctctccatactgatgtgaggacctgagctccctgtccggccccgggtgaaaagctgggcatggtgacactcacttgggacagctctgctgggagccagagttcctggggcagggggcatcgctgtcaatgagacacctcgtgtaagcaaacaaatcaagatggacggctcctgagaaatgatagccaaggatgccctctggcctccacatggccacatatgtgcctgtgtacctctacatacatgtgtagcacacacacatgaacacacagttgctgattagtacagttgacttggaactgtgcttgcagcttcctttccctgtttatccaataaacttcccccacagtgctgtggggctattgccttttttatctgattggttttgttttgtttctgggtctttggggacgggctgttgctgtgtaacccaggtagccctcaaacttgtgatcttcctatctcagcctccctcccgatgttgggattaggggtctcttaccaccacactcagctccttcacacaaatcatcccagaattctgtgatacaaagatgtgctcttagatgggagttgtagggaatgaatgaggcttctggaagttgatgggggaacttctcaaagcgtgaagcaagcagatgccttgcgctctt

SEQ ID NO: 30655 - DNA, 1102 bp, Mus musculus
tccgaggtgaggtagtttccttaaagtcttattaattccctcactccccaaaggtactagatgctgatagtcagcatgacctcgcagtattgttctcggtcccagtggctccctagttgactcagttgtctgcttgctctcttctaggtggctctggctgacgcctaatcctacagctccccattttctgagagaccaagaaccatgatcattgcctgctgaatcggccagggcctggccactctgtgaatacatgatcttgcaatgttgggttattccagccaaagacatttcaagtgcctgtaactgatttgtccatatttataaacactgatctggaaattggtcctgtgatgcacgtgctttgccctggatgcacctgaactcgtccccctcgtcgaggggcaggagggcatggacatgggcttcttcacggagagccagggcgtgtggggatcttgccagagctgagctgagcagctcgtgttccagcgccagtggggccgaggtttgctgtggttcttgtttcagactggcgtgctgagtgctggaagctgtttgcacctttgtcaggacactgcgtttcagaagccactgttccctctggtggcttttacatgtcggtggctggcataccatatagtaacagcagtaattctgtctcagtgtgcttgcaaggaaacttttcttataaagagaaaaaaaagttacaatttactactgccctagttaggacagacatgcttgtctctcctaggtaaaaggtcaggtccccgagtcatttctgtagtgaagagcagagttccgtgtctacactggcaactaggaactggggtgctctgctcccgtttgctcctgggaggggcgttctcctggcttgagaagtagctgtgtagtgaaggcacagggttgtgtgggtgactaacttcacacggcagaagagatgttgctctaatgctcacaaacagggcttgctcttttttttatttttagaggaaatacattttctttttaatttttttttttttgcattcatttctatacatcacacatctccaggagaatgcacattataggtatgtaatgtggaaccgacactggg

SEQ ID NO: 30656 - DNA, 1265 bp, Mus musculus
ctagtcaaaactggaaggattttccttaggacaggtgtgaccttctggtccctctgtcccattgccctctcgtattccatttaaaaaagtcattcatgatcctttccacccgctctctgtattttcaatgtttttctctcagcgccttgccttaacaatccccagacagtgttctctcaagcagtgttccagacttgttgggtgtgaagataaatgcatgtaagagcagccctttggaggctgaggcaggagaatctcaagttcagggccagcctgggccacatactgataccctgtctctcaaagggagaaaaattacttaggtatgtcagcacttttgtcctgtaactgtagatctgtctcaattgaagttaactcactatattcggaaacttactggcctagagaattttatcccaggcattcttagatggaaaacaatacttttgttttttcttctaaattgaagcttgttaaaataatcactgtagttatgtggtacactagtatttcttaaagcagaggtgagttgcggataaggtggataatatgtgactttagtctagtcttctctgagactttgagacccttggcttggctggtataagtgtgtcatccggaccaccaaacttcagattaagctgttactgagtgagacacgagaagaatggtgttcgctggtctgtcggctgtgttcctcttagtcatccttgtgttaatgacaggcagtggctgggatctgtagagggtgggaaggaggaccatcacaagacctagggagaggaagtccccaaaatgcttgggacatgacccatcctgaggccagatacatactttaaaattcagatattcaccgtagcaggtagacagatggaggatggctggggaagggagttgtgggctgaagtttaggggactgcagacacatctgggcccagtcctcagctgttccttgctggtatacctcagaagtggaatgtcagagtgggctactagagacctctgaccccagcagcactggcttgccctcatatgtggggtgtagtcacgtcagtgacttcctgggaattgcttgtttcagatcatattgatctctttccttttgtctctcaccgtatggtatgacttgaatcagttttgattctatgtgtaagttctcatcgtttggaacctggtatttctgttgtgttcttggcagtgcataggaacccagcctcctgtgttttgaccctcctgcaggcactgtgggactcgagggcagcaga

SEQ ID NO: 30657 - DNA, 1414 bp, Mus musculus
aagtgtaaaaagagattgcttcgtgagctgacggttcatatatgcaaaagagaaagacaaaagctttacttgtacagatgtaaataggtaaagagtaagtaacataatacataaatacttcctcaaatgtgctatttacaagtctaatatcagtgaacccggccctcggaggaggaggccgcgttcccatctgctaaacccttcaactatgcaatgaacacgagggcttttccccgaagcccggttaactcaaaggagccttttcaaatccatttacaacatacttaaggtcatattttccctgaacaagcgcttacctgagatgttacacaactgctttccttttggtttggtttttgtttttcaaatgaagaaacacctttctttttttcttttcttttttcttttcttattttaatctgaaacccaggctggaactttgcgtctgaagttgctgcttgtggtcttctggggagaaatggggaaaggtccaccccctagaaagtgtagctaagaaccggaagtagctttgcccagggaagatgggattgctctgccaataatcaggggcaggtgggctgtgtctgccagcacaaaccggtcaccagaatttctggtcacctttgatggcgtaatgttgcaggcaacttcaagtgggcaccgtgcctccgcagcaacccatgtcctggctcatgacacggaggacacacttcctcgttccacagtatgatttaaggacactcacacgggtcctgaaagaaagctgtctgggttttctcaggcgttggatacattgccacagtaactgaagaaggtacccggagcccagtgtgaatcgtttatattccaataagaaatgggaaacctgggcagagctgagctgagcaggtagatctagtaagagccatcagaaattaccgagggcgaaagaaggcagagagagagagagagagagagagagagagagagagagagagagagaacatgcatgcacgcgctcttgtgtgcacttgtgtgtgtgtgtgtgtgtgttgtattttcttcagtcttaatgtcttcatgacacttttataaggacattaaccctcttgtctacatatttggagagaatatgactttactagccgagaaaatacactatatcttgtctactggcctgtaaaatacatgtaagaaataaaaattagccccatttggtcctctagtatattaaagtgctatctgacattgttatcctgttttttgttttgttttattttcaaaaaaaaaaaaaagtgtaaactacagaccattgtttctaaaagcagagagatctattttagtagtcaacagaaggtttagttgtgaattccgattttgtggacaccagatgtgtgcggtgttttgttttctttctttcgttttaatttttttt

SEQ ID NO: 30658 - DNA, 1143 bp, Mus musculus
gaggctgccatcccctctgccagctgccatgtgccctggagtttgtactcagcagtatggagagttttgtcacagctgcttgccagctagagaagtttcgtaacaacgtactttggtgttcttttgcttctcctttgttcttatttatggtgtatgtctttctgtggtgtgtgtgcctgtgtgtttgcacctgcaagctcccgtgctgaagcttgaacaggacatcaaatgccctgtgctagcactctcttccttagggccttcagacaggctttctcactgaagctccggtcaggctggcagccagcaagtctcagacataaagcgccaaatttttttatgtatggaaaggcaatttattcattacacttacacattcataaattctattcctgcagcctcatttttctcaaaaataactttattgagacatggtttgcataccataaaattgaccttcgaagttcatcttcctgtctctgtctcctacaatgccaggcttgctaacaagtggatcccaagccagctttgtatatgggcacgggatttgaactcaggtcatcatgcaagggcactttcgtactgagccatctcttgagccttaggattagatagactattctgtcttttgatattggaggctctgaggcccatggtagaacctaagagtttacatttgtgaggtatacaaccagtcctaagtgcgacttgtcaggatgcagtattaattaaaattctgcacagcaaagctcaacccagcaaatggtccagtgcacatgctgccatgggtaatgacagggtcctctgactcctcctctcccttctcctcagacagactgcctttaaaatattgttatgtgttagatggatggtctgaggagtcttcaaactccttcaaaacaaaattttgtgtatggaaagaaaactcattccatatatttacactttcataataaattctacccctgaaatattattttcctggaaaatagctttattgaaagatggctcagatgccataaagttcgccttttaaaaacacacagttgaatgactgttagtatattcagacatttagtagctcagatgactgtcactgctacttactgcctgccatttccatcagtgacaaggaaacactct

SEQ ID NO: 30659 - DNA, 1235 bp, Mus musculus
gattgctgacatacactgtaatatcgtgtgaataattgatggaaggtttgctcaagacaagctttttccttttgatttgaggatctgggggccagggagcgggtagaggaggaggactgggaggttcggtaaggaggggccagaacagatgagcagacccaagtgtgtggggagtgaggcatggtggatgttaaatgcctctctgctggtgtagtccactgcgttggggatttcagggcgtttgtacaatacagccttattaatgactattctgtcaagagagctcccaattaaattgagtttggcttattcctccctcttggtttcttcatatgtgcggatatgaagtctctccaacaggagtattagataacaagggtgggtgctttcttgcccttggtgtttttttttttttttttaattttgtggagccagaggatagtttggttttaatgacttcttgttctactgaggatttgcttgtttgtgaatgcaagacctagcatcctctccttctgtccccccacccccaactgtctgctcccctccagctcttacccttgtctagagaagatggaactcctatcagtcggcagccatcgttgtcgtgggagtgtttttgctggacagctaagagtctagaatatcacctaattaaggcctgggggagaacccactccctctcagcaacgggccttccttcttattacaaaagcggtaaatgataggaagaactgggagttagaacaagggaactgaagccacgatgaggtcactgtggtttttgcttcctcttcgtccttaattctattgccagtgaacgtgattgcagtcataggggttgtctagagctcaggtgttttcccctgctcactgttacctcctgagtgctctcctttgtaaacattctaaattcaaataatcgaagggttttcgaagggttgttgaggtgtgtgcaccagccatctaggacctcactcctctctttacgttaaaataaagccttgagggagtctgagtagatggctcagtgtctaagcacacattctgctcttgcaggagggggattctgtccccagtgcccacgtcaggtgtttcaccaccgcctctaactctggatctggtgaccccttctgggcttctctgtcacctgctctcccatcagtaacacacacacacacacacttataataaaacatttttttaaagtatactttatgttttaaaatcaactc

SEQ ID NO: 30660 - DNA, 1205 bp, Mus musculus
ctataattacaagatgttgtgatgtaggtgcttagaagatggtggaaccaggatccaggtcccataatctaaaaaggccttattgtcaggcaaggcttcagggtacagctgtggacctggcacacctatgaccagtcagagacctgttaggatcctggaggacaggtggtctgctgcccattcaacacattttgcaagtggaatcatgggatatttgactcgctgtatttgactactttggcttgtatttctctcagtttaaaatgttgtgctatgggtctgcactgccatcatagcttatcatttgcatattatcagctacttttaaaatggttccactttacatccctgccagtgtcctctctacttttctagtatcttcaccagcacttgctatttacatttgattgtagccattcttgtgagtgtcttttggaatctttttgtggttctaattaggtgtgtgtggtggacggtacatttacccataagtacagttgtccatggaagcaggaggggagctgtatcccctagagctggagttacaaattgtgagctgttcaatatgagtgatacgggctgaacaccagacttgtgggagaagagtgggtgcctctaaccactgacccatctcatcagcctttttgtgccttttaatctggttctttgatcagaatcaaaagttaattttcaagctaagacataaaatagcccattttgagtattttgacagaagatggagatgcagatgttaaggtatcatgagcagaagggtaacaggaggtgaaaggctggaattgccaatggtgccagagcctgtgaggtctgtaatgctgccccatcttgctacagacaatattctggttgctcattcattctaattcctcctcttagcctttggtaccactacatttacctttaaaaaaaataccaatgttcaggacttacttttggccaactgaatcaaagcagttaaagaccagtatttgtaattttaaagtctctgcactcctcacatgattcgcttcacagtgagggtcgaaaggcactgtggtaaataattcagcaggattaaatagcagaatgaatttattgatcatctgcgacactcagataaccatctgcctttcattttgaccgtaagcattcctgatacacacctgctaactgaacttgatctaataagcacgaagcgtactctcaga

SEQ ID NO: 30661 - DNA, 1170 bp, Mus musculus
caatgccagggtcctggaagtccattgactagccagctttggctatccatccttcatggtcccattagagacaaagtggtgacaagcagaaaggggaaatgtaatcaatataaacacattgggaagagagccaaagaagattctgtgacaccccccaaacctatctttggggtcctaacatgaagtttgggttcacatagagaataagaggtatacgtgagctattaagcagggttggccaaagggtggtctgcccatcactcacccatcattgtctctgctccgctctcctgtgcagtggtctgacaagctgtcagactgtgtgaagtctcttcctgggagacaagttccttctttgaatgcatcaggcttcagccctgtcctttcttccttggggaattccattccttggaggctgtctcaatagtcttgacagacaaaaggagaaggacacgtgtgtcttttgaaggatgtcttcactccaggcaagacagttccgatgaagaaagtattctatctgcatctcataatccatctcagtgattattcatgaccactgagaaacttagtgaccccgagcaacggaacttttccatttctgtacattttagttaattgaaactttggttagacccatgtggctcgtgactactgtatgggacatgggggatggggtaggtttcttgtaatccctcatcccaactgcatggccaccatgcctatcattctttgttccctcttgaatttgttttttgtgcgctatggacatcagcctgattttgtactatccatacatcacatgtattccagcaagctaatgctttattataaatgtggaattgagagatctggaaatgtctcagtagataagagtgcttgccatgcaaatttgagaaactgagttcagataaccagcacccatgcaagtctaatggcctgcctttaaccacaggattaaagaggtggggataatgaatccttagcacaagttgactagatagccactctgaattgttttgctctgatttcatagagactctgcctcagtctataaggcaaagaggaactgaggaagagagtggacattggacccaaatattctcatgcatccacacacgtacatttaccctcacacattaggacatgcatgcacacaaacacatataataa

SEQ ID NO: 30662 - DNA, 1149 bp, Mus musculus
tgtgcttcatactcctaatgactgtcctacagtccttgaataggaaacaaagcaaacaagaaccatagccttctctacttgagactgtgggtaataaatcatggtgacttgggaataatggctgttttcaagtaggtgacaactgtctatcagggcttgtaaactgtcaccttggtgtggtgttataaagcaaaatgacctcaattcaaaaagctgcctcagattttcaaggaacacttgaaaaacataggaaaacccacaggaaggcccatcagccctggtttgtgcagcactcttaatatttcctgtattgatcacagctcataaactcttatcaaggctgagctctgtgattgttctaagtgtacatcagaaggaaatcagaacataaaacacagctagcattactgttgcgcctcaagaacttacctcagttatatacagatttccaccatgcaaagtatcattcatttccatttttaataaagaggaattctattttaaatattatgtatatcagtacatgtgtctcgttacctgaagaggccagaagaagatgttggattctccagagctggagtgacacagttgtgaacatcttttgtgggtgttgggaactgagtttaagtcctctgtaatggaagtaagtatgcttaactactaagccatctctctagatcctttattccaattgcaatccccagtgagggtatcttccttttacatgtaggtagagggtcctacagtagtcgcaatactcgtgatacatgtagaattgctaaggaaaattagggccatcaccatcaccgtgctgacgacatcacaggaagttagcatctcaactctaaacccttttcttgatgtagcatctcacccatcccaggctggcctggaacttgctgtgtagctccaggtgaccttcagtttctgatcgtccctctcccttgagtgctggattgcaggcatgtacagaaccacatttggtgtatgtgggactaaaagtcaaacctagagcttcatgtatgctacgcaggggctctaccaactgagctgcatacccagtcctttttacttttagagaaattttgaaatacgtgtttaagaacattgcaagacaactgtattgtgttggttttattatctcctggg

SEQ ID NO: 30663 - DNA, 1169 bp, Mus musculus
acacacacacacaaaacaatattatgagaactgaagagatgtctcacaggttaggaacacttattgctcttgcctgatactgtctggttaccagcatgcacctcatgtagcctatgactacctataatttcagctctatccaaagccctcagtacacattgactcaacacatgcacccacttccccatgcaaacccacacacttagatatagttgaaaatagaaataaatagtaaaaaaagaagaaaagaaatagcttagcaaagtagaattgggttgactatattatatttctggaagaaggcagatagggttttggtttcaatagtaaatgtttcccaaaatgctcaatgcattgaaccctgggtcacatgctatttgtgctattttggaaggttctagaagctttaggagccgaacatagctagaagaagtaaatcgtgtctagatgtatacttgggactcctgtgtgcttatgcctgccttttgcttctttgtctctgtccctctccttcttgtctgcctgaaaggagctgctccttccacacactggagctaatgtgatgcacaagctcactccagacctagatatatggtcaagtgtgtgaacttctgtaacagccagtccaagaaaacccttcttctcttaagttactctcctgaaatgtttgatcaaaacagtttactcatgagagtagtatacacaggccagtttgcagagcagttcttagcatgctcaaagccccgagttccagccctcagaccctcaatactgatatgttgtcacatgcctaggatcccaacggttgggaggttgaggcatgaggttcacaagctccaaaccatcgtcagttacgtagagggttcactgccaacctgggctccatgatacctcatctgaaaacagaacgacctaactggtcggagtactgacagacaagaagtgcttgatgcagtcagggggagccagtgagtggaaaggagatgaggaggaagtgaatttactgacctgttaaataaatgagacacgtgaaaccaaagcacacttgactgcattggtttttcttacaacccaagaaaaacataacaaataatagagaaatagtggccttaagtttaagtttgtagatgttaatatcacataagtattacataagttgatatgaacta

SEQ ID NO: 30664 - DNA, 1163 bp, Mus musculus
acaaggaagaactgttttgttttgttttgttttgttttgtttcgtttttaaacactgtcccttgcttcagtatccctcctccctccagaaccttctgtttgctcccctgtcctatagtggagattttagtaaactaaggtgaaaacccagaagttgtccttgttcatgaaactgatactgtagtccatgcatcacggagtctgtatttgcatgcaggtgaggtatgtgttgttacctgcagttgcccattcttgggctaatccaagagtgcttgcatttgcctctcagttcttcagctgtatctgtctcactttgctgaagggctttgaagaaacctttgtttttgatccggtgatatttgtttatgtcttcctggttttgtgttccaaagatgtctgcttaggtctgtcagttttccaatctatgcagaagatttgagagatgggaacagcagtgaagagcactatttacataagcagattgcaaaggattctcaaagtaggcaaaatagagaaggattggaacaaactttgcacgtttgggggaggctttgaataccatgagtattacacacacatactctctctctctctctctctctctctctctcacacacacacacacacacacacacacacacactccctccctctctctctctctctctctctctctctctctctctcattgcatacgcataccctgctcagctcatattctaaatataaatgaaattataggcaacttggaatcaatttgctgggtttttctttcccttttggcaagcgtactgaaacttgttggagtgtgtataaggttttcttttttgttttttaaacgtcagctcactgaatacattttctgttttgatttaaacagttctggatctctttccttctgagacatgcagtcaaaatttcactctgaaatatgtgtgatgaagtccgaagcggcagaatgattcatgtgactagccgtgtgaccttgggcagggtgtttgatatttctgtttctacttcaccacccgccaaatagagttgtgaatattcaaccaaatgacataattaatgtgcacagagtagaactgttaatagtaagcaataaaatgtacctttgaggtttttttctaaattcattcttcttgtttttaattatgtgaatgt

SEQ ID NO: 30665 - DNA, 1120 bp, Mus musculus
gatacctgataagcctatgctacctgtcggtttgtatacaatatgtgtgtgtacatatgcaggccaaagaacaacccgtgcttccccaagctccattccctttgtatccttaagcaaagtttctcagtagcctgggactcacaaaatatactgggctatccggctcatgaatccctagaatctacttgtccctgcatccccagatcagaacatactttatgtggatattcaggatcaagttcaagtccttctgctttcaagggaagtactttgacaactgaggcatctctatataccaattgttattatttttgcattttgaaattttatacaaaaaactaaatatattttcaaagaatatttactatattttaattttgctataaaagtatataactacaagactatttaaatcgtgtaaaaatgatttgctttgtggttgtttttttttgtttgtttaaccagaacatctgtagacttaatcgatcgatttaaattttgagaattcatacgattttgtttctgaggtcattgtataatacttggtattccttctgacatagaatatccacagtagtgacagcttgttaggacattgtccttagcatctgagtggatttaatactgaatgcagcttatcagaagaaaggcagtcaaactgagaaagtgattaagtcagccactgggcatcctgtcacatctttgcctgacaagctttcttaccaaagcagaggtgcttaagtagccacagagaagtgacacacatgtcagggggagatccaagccatcactccctttgccttgggcatgtgcactttctgaagaagtgggattctcagcccgagacctttcagtaagcagtgataatccacaaggattgaggcagtcatcctggactagagagttcctttcagcgctgagacatctgactgccgttcacatctgaatggcttccacgtctttttctaaagcatcgggggctaaagctaagtcctatacccttttaagtatgtggccaacttaacccggggtctatcaaggcttcagggtgattagagtagttgtgtaggcaagagagggaggacatatctcagggacgggggttgggaatcgacaggct

SEQ ID NO: 30666 - DNA, 1153 bp, Mus musculus
agtgacacttttaaaacacaaaattaaaaaaagggacagacagttgctttcatatataagacattccttgagaacacacaaactgtatgcagaatggtaggtgcttgttgtggctttaattttttttttttaaattacattttccttttcgaagagacaggttggaactagtgagctgaacccttctctgagctataagttccctaaacagctgtagagaattaatttcagagctagctgagatttaatctacactttctgctcagtgtcatggaaaatggccagtgtctaccagctatggaatgttagaaaaatcagatgaacattgggttttttttgaatgttttcctagtagaaaaagcatgaaaaaccctttagtgaactggatttttacagtgtacctacatagtgagtatctgtgatgtatttgtgggtttctttttatgggtgacgtgtaggttgttaggttcttgtttctagtagaactgaagcacactgtattcaacaccaagcttcattttctctgtgaggggtgaagtgtttcaagcagtctgtgacatctgtctgtctgtcctctctgtctgttttccatcctgtcacttcctttcccttccttcaccatcccttcaactctctgtccagaggaagcctgtggctagagcaggtaagaagtgttctctctctatttgagatcccgtttaataacatatatacatatgtatgtgcatagacatatttctatcaataacattttttaaagagaaaaactttttgaggtttttttttttttttggagaaaatatattttctattttcaggcttttagaatttacctgcactgtgaccatttctcttagggtggtgtagtcaaaacatcaaaacaagttaggttagtgtcttgtttaagtatttaaagagctagggcaggtgacacatgcctctaatccagtacttagaaggctgagacaggaggatcaccatcttgggttatggagtgagttacaaatctgcctcagctggcttcatagcaagacatcaaaaacaaaaataccattcctcccaagtaaagcagaagtcaaatccccccaagttatcttctatagtgttaaattatttcataattggtaacttaatggcaagaggttagtacagt

SEQ ID NO: 30667 - DNA, 1138 bp, Mus musculus
tttggctcatggtaaaaacttgttcctctttctttaaatatcctgaatatccttacccacttgtctagatgtgcctttgagaatctccagcagagaccttgggcttgcttcatcagcgcgcacgcatacacacagaatgaagcctttcctaaatgactttcatcttcagctgtagatgaatgcagagtgacctctgctctgccccaagagcctgaccttcttgtcactttgtgtagcattaattttctaatgtgttctggtcagtgtgtaagatttttttgtgtttgctattggcttagatttgatatttccattggttaaaatatgtatgcctatactgtgagcagggagaaacagactaataaaaacccctgaaccagtgtggcatatataattaatattactagaaaatctagctcatggtttattcctatgaatttaaaagtatttggagttatattattcacttttctgaccagtgagtagcaggaggaggctgtaacattgtgtgtgtgtgtgtgtgtatgtgtgtgtgtgtgtgtgtgtgtgtgtgtgtattgtttttcaagcctttcctgacatgtgactctcctgggaggtagattaaagatcatcaggaggctgcagagatgactcagtgattcagtgtttgctttctgcttttccagaggtctgaatttggtttccagcacccatattgcgagaatcacagctttcttgtaactccagcttcagggcatctgacaccttccttgccttcacattcacttgcacacacgtggcatatgcacattcacatacatacatataagtaaaatgaaattaagtcttgagagtccgtgttactagacatcatccacagttttaggaagcctgtatggtgcttgagaatttacatttctagtgtgtccccaggaaaagtaccattgctgctctgtggtctttgctgagatccaccacttaatctttgtctaggaaaagcgaacaggattgaaaatgctccccttttcacagaaacatgggctgctccaagcaattattgaataaatatttatattttgcatgcatttttctaatgtgttctggtcagtgtgtaagattttttttttctttgctgttgccttagctttgatatttc

SEQ ID NO: 30668 - DNA, 1148 bp, Mus musculus
aatgctaggtcttcattttttttttccttcttgtttcccagtgccatctagatctccccatcttctattgacgacttccagtgtgtgtgtgtgtgtgtgtgtgtgtgtgtgtatgtgtgtaagccactgccagggcatacaggtagatttaaaggaaaaattactttcacttttatttcctgctactaagtactggttctaaacactgagactttgggtctggctgggagagagatccagtgaggcagaggttatcttgatgttttgaatgctctccaggtgattttggggggcaaacatggttgggaagcagtgtgctagaggaacaaagagcagggcactaatcaacctctttaggtttccctaagtagtggaagtgtggctttgttgttctgtactcgggcactcagtggacaggattatctaaaagaagtcattatagttgcagggccaaccctcagggttgaaagtagattgaaattcattatttaacaaggtgcccttactatttatagttggagtgtaggtatggcagtgagagataaaattacttttttttcttgctttgaaaaaagacaaatgtctttgaaattaagcataaatggggtttgaagtatatgctgttttatacagcaagaatgccttgctctactgaaccagtttgggtgtttcctgaaatgagtttgcctttcatgggagggaaagtggttgcttgtgctacacatataccatctggttaattatccttaatatactgacactgaatatattgttaggtggacaatacagaggagatactatatctaattttttaagtttcatacaagttttcaaagaatttttttagatttattttatatgcatgagtgttccacctgcatgcaaaaacaggtacaccatgtcaattcctggtgcccacgaatcagaaaagggcattgggtccccggtactggagttacccttggtgtgaacaaccatgtaggggcttggaatcaaacccagatcaagcaacaagtatttttttttatggggtatttatttcatttacatttccaatgctatcccaaaagtcccccacatgctcccctactccctaccccacccacccactcccacttcttggccctggcattcccctgtactggggc

SEQ ID NO: 30669 - DNA, 1186 bp, Mus musculus
taagtcgtggatggtgtttttgtttttattttgttttatttcatttcattttataaatgttcttttcaggtgagcttctgtgctgagtttagcaatcagcagttagaacctaccaatcaccccctgttttcctggagtgctttctctgagatcctagactgttgttatcccatagcaaactcttggggtgaggcgggcagtgatactgacgaattgctttctcaaggtggttacaattccacaatgctgtcaggttctcaagctaaaggccctcctgtggaaatgtgaagaacttagaggcctctattcttcaggcacaggaaaagcagttgcctctaagaggaagccaggactaagggtctgggggctgtgttcttataacttcagcctctggtgagattgtccagaacttttctaagggaatctagtatggttccttggctatctacagcctcttgaattgacttctgggtgttgtagatgggaccacagagggcaaaatcataacatctgctctatttgtgtctcaacataaagttgatggtaactgcggttcctcttattgggtttttgttaggagttggacagagatgatgatgaaaccggcttcttgcctaaccagattgcctcatgtgcggacaagctttgcttgaagttggcttggacttttcagaggctcaattgtggccttcataaggctgtgcctggggttgtatttccaattcctctcaacttttgtccctgtggaagggaggaagtggagttgtgatagatatattgccagatagcacacaatagcacaaagaacgagacagacgtggcgcaagccattcacagagacagatttatgctctgtgctgccctaaaccgtagatccatctatttcaaagaaacaacctgctcactgtattatatttcagacagacacagctttgagatgttgacttctcctgtttagctcttgccagcaacgctgcacattttgctgcagtcaattacttttgtggggacaggaaagtttatttggcaaagccaatcttgtgtctagattagaagtggaaagatgaagatagtatttggctgagctgtcgccttggtgacgtatatatgtgtggagttttgtcttgctgctccttagccaactgcattatcagccatagaagtattacacttatttcgccattag

SEQ ID NO: 30670 - DNA, 1164 bp, Mus musculus
atgcctagattgaccgctaagcaactgagctcgattcttcttgtttcagtttgtttttttatttcttaaaaaaatttaaacaattaatttattgtgtgtgtacgtatgtatgggtcttggttgcatgcatggatgacagaacactccttgaagggattgggactctccttctactctatgggtcctaggaattaaactcaggttgatgacttggcagcaggcactgtgagcctgtgagcctctggcacttttgtttgttttcagtttgagttggtcatagtaacttttataagactcttaattagctggccttcttgccttagccccttaaagtagctgcaattctagacctgaaccgctatgcctttcttgttaaagaaaattgttcctagtaataataaaagatattggggtgccttgtttgctatatgtgacttttaagtgttgtgtaggtgatggaaacataattgcttcctgaggggtctgccatttattacatgggtcaaggatgctcaaggatgctcttaagcctgactttttatgtgttctcagggtctctggtggtagtgataacctctgaagcagggtgctctgtcccaatggcatgccgagctggacaactggctgcgtgggatatactttgtgctgtagggatattgagcagcatcctggctcatttaacactgtagcagctcctactgtgtcaaccacaaatccatccagaccttgccgtgagggcaagattaccttggctgagaattattgccgtagactgtaggggatggtctgaaatcagaagtctgtcatgaatcctaagggtcagcgtctgcattcagatggtttgaccctttaaaaacatccctcaaagcaatgactagagcatatgtagtttgttgaaattcctgtgcaatctgtaagtacctttttagcctcagctcacattgaaaaggaaggtatgagattttcttatgttagaaatgaggttagtagtaaaatgtagaaatttcccatgtttctcccaagcctcacattttatgatattagttgtaacaggcatctttatagaattatagatcttaagagctgaaagtttagggctgcaagatggcttagcagacttaaaaagggggagacttttaatgtgagcctgacagtgtgagttca

SEQ ID NO: 30671 - DNA, 1194 bp, Mus musculus
agtaggtaaatagtaaagagtaggttagacttggggtaggcaactggaaccttagttgcttaccctttttgtttctttcactgggacttcttgagttttgcagccatgttttgtgtgtgtgtgtgtgtgtgtgtgtgtgtgtgtgtgcatattcagtagtgtagttttctgtaagttgtcaatggagattccaccctgtggggcagcttttcatgacacacccattctgtggtggcactcaacagatgcactgctagtttttctatcaggagtcacttatggcatacttctgtggtgtggctctcaaaagttgtccaggaggcttctcactactgaaaatacctttctttcagttgtagataacctcagtaaatgcagtggctcaccaagctggattgtcagtgcctttgtttaaaatgatccatactggtaatttcagattatttacagaattgatttaagaaagtgatgagacccaacttggctcttctatgcctgttgaggacacagtttattgcagtaaaaagagcatagttttccagtagtgctgtctcagggtctagactttcaattccaatcaaacccactgatcatactcctgggttactgttatctgggcaaataacaccactgatagtgagtgacctctggttactctgcatcctgaagagagagtgcttacgtgggttttcaggggagagggttttgagtgatgtctatacagttcaaagttcagagctgcttcttgtaaatttatctttatctttttaactactcagttgtgggtgttgtttagttcacaatcaccacatgttttgttattctggttgtttttgtcaccatgactcaaacctcaacatacctgggaagagggaatcttaatggagaaaatgcctctctaagattggcctgtaggcaagtctgtggggggtattgccttgattagtgattgatgtgggagggtacagacagaccatttggacagggcaggtagtcttgggttgtataagaaaacaggctgagcaatccaggaggaacagcagagctccatgatttttgcctcagtttccacctgcattttcctgccttgaattcctgtcctgacttcctcttgtgatagactgtaatatggaaatgtaagcaaaatgaatgcttttctccttaagttgctttaggctatggtatttattgcag

SEQ ID NO: 30672 - DNA, 1178 bp, Mus musculus
ctctggatgccttcattttatttgggagggggggcactgatccagaggagggattgggtttttttgttgttgttgttgttgttgggttttgtttttggttttggtttttggttttgttaacagtggctccctccctcagggttaccccaaaacctttgtctggtaaacccatctgtcccagcctgcctccctcccaagtcccttctccatagaaagctatagacctggcatcttacctgacttttgttgttattgttgtattgttttcttgaggcagggtctctttagatagccctggctatcctggaactctctttgtagaccaggctggccttgaattgataggactctacccgcctctgcctcccgagtgctgggattaaaggtgtgtgccatcacacctaagtttttttttaatattattattaatattattattcctgcaagcttaggaatctcaggttctcttccctgctctcttcctaggactgactccataaggacccagaccaccacacatactcccacggttgtgtgtccagaaagggctgggcctggcttctgccggccaaccttttaagggaccgcactgctgttcagctgcagtgggtccttggaggaagctagctctgtttctgtgttctgtgggtagatcagcatggtgtggtgtcttcagttctgggggatgtgacagtccctctactagtagaggccctctactctcgtgttttttagcactgtctgctctcttttcagcatcttctggttttatgaatatgaaggatgactccaccccctgctaacccagcctcagaggggacccaagtgtcacaccactccgaagtcagggttccctagaggatttcttttgtgtttttctgcagtgctgaggaatgtaggcagggcctcctgcgtgagaggcaagtactccacagagccactcccagatcctcgcagcagagtctctcggctcacagggagggtaggagattgggctgttaagaaggtaaagttttaggaaccgcagtcaggaaccccctgggttgggctaccaagtcccgaactctgggggtactctatcaggaaagcgcacttcaggagttgctcagtggatagggtgttcccatagcattattcccagcactcgggagatgaaagcagtcagatcacaagttaag

SEQ ID NO: 30673 - DNA, 1157 bp, Mus musculus
cacactcacagaaggcaaagaaccttctaagaggaggggctgagggtgaggctcaatgggtagtttgcttgcctaacacatacaaagcctgagagtctgtctccaataccacgtaaaccaggtgtggtactacatgtgtgtaaacccagcatttgggaggtagaggcaggaggatcagaagttcatgatcagcttcagctacacagggaattggaggctagcctgggttctgtgaatcgtgtgacccccattccctcctgcagggctccagagcctggctggccttccctcaccgtgtccgtggcttctcttccaggtgacgatgcccggtgagcctgtggatgtggcgtgtggagtggatcacatggtgactctagccaagtcattcatctgaaaggccctctgggcccagcctgggagccacaccacagcagcagcttggcagaggcagggggtggccaccagcagagcttctgagggtactgggagagggccagggcctctggggtgcaggatgcttgctgtgtgtcctcagtggggacattctactagaggtgtgtggacaaagcccttcccccgctgaggttcctgctgctggcctcagctcaggatggctacagttggcttgccgtgtttctgaggagcaccagggcgtgaagaccttgggtggccaggcagattccttttccaggtaacacatggtagcatctggggatgtgtcttgtctgagacactattcttagagaaagttcactgctcatgacacatttgatattaagagtttagagacatgacaaggcactcagaagaacttgtagtcccctgtcacaggaggataaagttggcctcagctcagcaagaagccagctgactgcctgcagctagggcctctggtcagctgtcatcccaggagtcccgcagaaggacagtccaggagcccaggatgccttggcttgagactcttgatggagctgccagtgggagccagcctcccgctcaggcctacagtatcccagccttggaacttcctcactgcctggctttgaacagcccagaagcccctgaagaaagactctgcgggccaagtgcttgtgggctgagggccgtggaatcttggctgaagggctggccttggagtaggaggcctcagaaactgg

SEQ ID NO: 30674 - DNA, 1860 bp, Mus musculus
agaccctgtctgtcttggggtggggtagggtaatacagaggtagtattccttaaagggacatgtttgttttgagtctgtatgccaaggttgcctcctctctggctgacctctttaggccggtcacaagcccagccccatcagttgctgacttgccaccaagaggtgggctgcagtgacccgcaagtgaggagactgcagtctgctgtgatgggctttgcctggcagccttggtgatgtgcctgaccgtgtcagatcacaggcttaggccttgccgtctttcacaagtgcacttgggcctgcatgtctgtcagatggaacagggtgtgtgacaggaggttgtcatgcccctgccatctgactcacccactgcctgcgtgtttgttctctctgcagttcgtccagtgtccagcgtgcgtggtggagaagagctttgggacccgttcctgccagctctgtaatatacttgtataacagaaataccttctatacaaaccttcttttctacttttagatagaaatgtctactttctcagcagttctgtgaattgagctacacagcgtgatgagatgcgcgtgcctggtggcttgggaacgcactagaagggtcttgcagcagtgctgaaagaggcgggaatggcagggacgactcgtagggtttcttatgcatcgggcagagccttgggctgtggtgcgtgttcccgtcagtgagatattcctacagggcatcttggcttccgcagcaaaggaagtccctgtgctagtcagtgctttagtttttctattgaagaccagttccgtggtcttgcactcggctgcccctcctgccaggggagggctgctgtctgtgtgtgtgactaagcctcttcccaagctccatcacgattcctttgtcctcactgccattcagagcaaagccggccagctcgcctgaccgccagtgagcagccagtgcatccgtgcagtgcagctggagaggctagcctcagagcctcgctccggttactttacagcaagtagatttctgggtgtgtcctaaaggtcagaggtcaggtctgcatgcttgagcaggtggaggatttgcccctccccaactgggacccacagtggcctcaggggctctgggccgcagctctgggtctgggtcgagtcaggctgggctgtgtgtctgcctggttggttagtctctaaccacctgtctggcctctgcgccagggtggggagtgaggacattggtgtcccgccctatgtgggggctcacagacgatgataaggtaacagctctcagcagttaggcacgtgagggcacggttctcggtagtcaccacaatgttcacaatgggaaattatatcacacggtagcagagataggcattttatgtgttccttatattttacctcaaattgtagatatagggtaataaataaaatccatccatgcctttcacatgcaaactcattcttttcctgctgtcttcgtgagcgcctggggaggcgggacgggtgtgggctggtaggatgttcacctcagtccctcacagatgggacacccgtattcctggtgtttctcaagaagtcactggtttgtggagctggagctgtgcccagcccccaccggcctacatcttacgtgcgttggagacagaggagaactctgaggacacagccacagcacaggggagtccctgagtccctgctggaggatgtggaagatgatgcccgcccaggctgcggccagggatcccctggtaacatgatgcacaggagagtcagtcatcgggcagaagcctcctcggctgagatccgtcaggcagtactcagtgacagggcacagaggagaaggggcagctcacccgctgctc

SEQ ID NO: 30675 - DNA, 1157 bp, Mus musculus
tagcgtttgatctgtgattggtggtgaggctggggttaggcctgtcacgaggttagagtgtaaatctttcagcttgtgtgggcgtgttcaagaccttccttctgggatgagtgacggagtcttggccaggtagtggagttttactccattgagagcaggggtccctctctcccacaggcagcctgttttaaagtgaccttcatctgttcagacagagcaaggtgaggtagccacgtttcttccctccctcttaccttttcccatagagctgattgatttttgcaggtcagttgggtctgtctgtctgtctgcttgcctgtcagttgctgaaactgtgccatggtttgggttgcagatgacctcgttgagcatccacctaatgaacgtttgccctttcagagtctttaaagtgtgtgaggccttgagtgcacagtgccctggagctgtgacacaccggagcctgtcacttgttttgtaggcatttctctggaaatggccgctgtgacagtgaaggaggagtcagaagaccctgattactatcagtataacattcaaggtaacgatgttccctgcagtctctgttcctgacactctgtggcagttaaagctctctgagcacgttcacactctgccatgctgcctgctcctggttcccatttcagtcgggaggacgtgagctggagctcatcttcacctgtacggttgtctgggtcatcttagtgatttcatcttggcatggtagcacatgcttgtattctcagcactcgggaggccacggccagccagagccatgtacatacatacatacatacatacatacatacatacatacatacatacacagggaaacgccgcctcaaacagacaggcgctttagtggctacttcagtgtctctgattttttaattttccacaaagttctggattgcccttgcccggtagacttgattttccttaaagtaataagccttattggacatggagtcttttacaaatacctggaataatttgttatggtcctttagtgagcagagagctgtgtacatttatggctgagtgtcagtgaaactcattaaaaaaaccaacacccaacctagtgcacatgcattgaagtgaaggcactttcatgccatcactcctgggaatcgaacttggtt

SEQ ID NO: 30676 - DNA, 1174 bp, Mus musculus
ctatgttggggtgggaatggggtaggaggttgtgtgcctgtgcctgctccaaggccagaggaggccatccactgtcttctactctaactcttcctttgaggcagggtctctcagaattcaggcctcgagcttgaaagctcactgatctgtctcttgtttctgcttccctccgagctgggctgcaggtaatggcaggcttggttcacttgtgatgggaattctgagatacaagctctgatgctcaggattgtggggcagatggttaaccactgagctagctctctcaagctcccttgctggggttgcagttgttgtttcctcatggggatgatgctgaacgtttctttcatgaacttgccagtgtgtgtgtgtgtgtgtgtgtgtgtgtgtgtgtgtgtgagagagagagagagagagacagagagggagcagagtatgcatatgtggcatggtgtgcctgttggcatcagataacctcatgtgctggtctgagcatgtggctactgcagaagctgggctgtctgaccttcgagggcccaggaattctctgccttccatcttgctgtagagagctggtttacagacatgcaccaccttggcccgcctcacttgggtcctgggagttcagactgcagttctaggctgtgtggcaagtgtttgacccagggagccactttcccagatcctgttttctctcttaacctgtgcttactgttttgttttttttccattgttgaaagttctgcctatattttggatataagtcagaaatatggtcttgcagatgtttcttatggcctctgcttggttttatattgtctttgaatcttaaacaaattttagtttctgtattttcaaggttgtggatttttaaaaaaggttttaaaacattttttaaaaaaaatatttatttatttattttatggatataagtactctgtagctgtcttcagacacaccagaagagagcatcagaacccattacagatggttgtgagccaccatgtggttgctgggaattgaactcagggacctctggaagagcagtcagtgctcttaaccactgagccatgtctccagctcccatttcaaaacgttttttactctttaattatcatttttttccttcctttctccctctctccctccctcctccctccctccctctctcctt

SEQ ID NO: 30677 - DNA, 1210 bp, Mus musculus
tcctaatgcagagttaacaatcatagcagggaagggaagattacagcactcggtaatgtgaaaaaggaggtagaagaagaaagggaagggagatgcagccggccaggacactgcggcaggtgtccctaactcctgacctagccctgtgtaatttgagtttgctgcatgagaagagccaggatctagcactaggtagcttccaggatgcttggcctggagtagcaggatgtgggctccagtaggccgggcagggactctctctgtatccagcgtttgcttagccgccctggcctccaccctggtcccctacttaggttcgtgtaacttctgtgtgccttaataatggccacgaagcttaagagtgctgccctgctgcctggctgtgccagggaagcttcaggggcctctgtgaaaaggtgaaagtttctcatcaactcagaatgaaagtccgactacaggaggagcagctctgtcattctggcaattgaactgatgaaggaggaggtggaaacccacaccgtgtgtttgtggctctaacaaatgccaatgccatgggcacagtgtgggacaggggcctggtgtagatggagaaggcactgagctgccggtggaggacatgaccctgggccctggtgcatggctgtggtggccaggccaggtgtctgtcaccccagtaaggactgctgcagaggtgacaggcactggctatgttttgtgcacagtggtggaagtgtgtcagagcaagcttgccacccacccaaggccagtcttcatttccatgacaatgagtaagtgtcctaagggtgagtacaaggagaacatcccacttggctgtcaccacagagccttgtgataattgctgtgtttgcctcactgagcctggtttacaatgaaactttgtcctaggtgtgtgaacaggaacaaaccaggatctgcagggttgggccctgtccccagtgatggtgacgagaaggatgagcctggccagcttttccatccctttgtcatgagcgcacggcacggctgcctttgccttatgagaactgtccagtttgcagtgggctggtgctgatcacagcttgtcctgggtgatctattgtggctagcctctgaaattggctaggctcctgagaaatagatggtctttgccgtaggatcacagtagaagcactggcaagtttgatgcctgagccttttggatatgcttgtg

SEQ ID NO: 30678 - DNA, 1145 bp, Mus musculus
tctgtatctgcctctctggtgatgggattacaatttcacactatcgttcataacttttaatcgagggggtgggggagaggtagggaaaagaattgtttgtgagtgcaattcctttagagaccagaagatgtcaccagatcccctgctgctggagtttcagttttgagctgcctggcacaggccctgagaactgaactcaggtcctctcaaagaacagtgagcattctaaaccactgagccatctctccagccctaagccttgctttaaaaaaaaaaaaagaattactacatagtgtgtgtatgtgtgtgtgtgtgtgtatgtatacacccaggtcttcaaccttagaggcaggaaggtgtttttaccatctgagctacttggctggcttcaggccctgcttttacagaggatgtggggctcagatcttatgtttccaagctaaacactttacccactcagcttttgtctgttgtggttattgctgctgtgttttggggggggggggattctttatctgtttgtttcacctgcacgtgtttatgcgcaccatgtgtgcctggtgtctgtggaggccagagaactagagatgtaggtggttgtaagccacaatgaatgctgggaaccgaaccttgttcttttgcaagagcaaccatcgctcttgaaccactgagccatctctctacccccaccccaagcccagtttcttcttttttaaaaaaatatttatttatctatttatgtatttaatgtattcgagtacactgtggctgtcttcagacacaccagaagagggcatcagatcccattacagatgattagagccaccatgtggttgctgagaattgaactcaggggctctggaaaaacagtcggtactcttaacctctgagcccttaatctctccagtcccccagtttcttccttgaaaaagaaaaaggttcttttttgtgaagtagaccaggccaacctggaacttggtggagtttagctgagaatcatctggttttttgtttttggtttgtttttggtttttggtttggtttggtttggtttttcgagacagggtttctctgtgtagccctggctgtcctagaactcactttgtagaccaggctggcctcgaactcagaaatgtgccttcctc

SEQ ID NO: 30679 - DNA, 1148 bp, Mus musculus
ctctccgactgcttcaggccttttggtatccagatgtgtgtgtgagctcccagagctccgggaagagcaaggaacccttggtctctcagaggaagaacaggaagccacgttcatgccctgagcttaattcagacacccaacttagtctacccttactggcttgtttgtttgtttcattttattttaatttgtttgtttgtttgtttggagagaaggtttccctgtgtagttctggctggaacttaatacgtagaccaggctggcctcaaacttatcagacccgcctgcctttgcctcccttgtgctgggatcaaaggctcgcaacaccactgctggctgttttagtttgggggtcctttgttttgttttctgggttgttgtttgtttgtttttgtttttgttttgtttttaagacatgcatggtctgtgtactgtgtagcccaggatgaccttgaatttctgagtcttctttttccaccgggattacaggtctgcatttctgtgctctacattctccatggcttcctaagttatgtcagacgggttggctaaaatagttggttttgtgacgtttccacacattcagatcaggcactctgatcctagtgtctgagtgtctgtctgtctgtctgtctgtctgtctgtctctctctctctctctctctctcacacacacacacacacacacacacacacacacaccatttatacactcatccccctgtcccagtttcatcctgtcacccctgtgataaacacaacgactgaagggaagcaactttggggcagggaaaaggtttatttccacttctgggtcccagtccctccttgaggaaagctggcaggaactctgcagatatcttggaggaatgctgctcactaactcactctctgcctcagcccttgctagtgctgggctttcttacacagcccaggaccacgcccattgagggcaccacccacagtgggctgagcatccgtttacaggattcctcacagacacgtccataggccagtctcctgtgggcagttcgctcctcagagggccccactttgttgttaagccctgtggtggtagcagcacacacagcctcccaaatgctgggattacaggtgggtgggtacctccatgcctgtccttcttggcc

SEQ ID NO: 30680 - DNA, 1178 bp, Mus musculus
tgcttgcggctaagcctcttgctctggaacccacatgatggaaggagagaaccgactcttgcaagttgtcctctgacctccacactcaggctgtggcccttagccatgactcccaataaataaatagtgaaccttctaaagtgtttgaaaaaggatgctgggccaggttgtggtggcactcagaaggcagtttgaggttagccttgtatatagagtgacttataggatagccagggctacccagagaaaccctgtgtgtgtgtatttgtgtgtgtgtgtgtttgtgtgtgtgtagctgggggacactgttctttaatgcctacatttggggagcaagacaaatctttgagcttgaggctaacctggtctacatagtgagttctgagtcagccagggctacatagtgagactttgtctaaaaacgttgaaagaagcacacgcagccaacagtgttagatggactgtggccaacaccgtatccactgtgacttgtcccttgcattcacccttgttcttacccttccagcggaagccctgggcctggaccacatggtccctgtgccctataggaagattgcctgtgaccccgaggctgtggaaattgtgggtattccagacaagatccccttcaagcgaccctgtacttacggagtgccgaagctgaagaggattctggaggagcgacacagcattcacttcattatcaagaggtgtgaattggctccgttctatgaaagaaaggcttcctagaatccctcagtgaggagctgggggcgtggctcagtggtagagcccctgcctagaatcccccagtgaggggctgggggcatggctcagtggtagagcccttgcctataatcccccagtgaggggctgggggcatggctcagtggtagagcccctgactagaatcccccagggaggggctgggggcgtggctcagtggtagagcccctgactagaatcccccagggaggggctgggggcgtggctcagtggtagagcccctgcctagaatccctcagggaggggctgggggtgtggctcagtggtagagcccctgcctagaatcccccagggaggggctgggggtgtggctcagtggtagagcccctgcctagagtcccccagggaggggctgggggcgtggctcagtggtagagcccctgcctagaatc

SEQ ID NO: 30681 - DNA, 1176 bp, Mus musculus
tactccgccatatttctaatccagctccacttgttctgcccatcccaacccagccctgcttcatctagccctgcctagcctacccactttagctcagccctgcccagttcactctccttcagctatgccctgcctcactcagcctatccaaaaccagtttacccctgcccagcagtgccctacccaggtctgccctgcccttcccccacccagccccaagcctagccttgctcactatgcccagctcctgcactgtgggtaacccccatccccgaaccaaacaagaaccccaagacatggctgtccccattccagcccttttccagcccccaactccccggcatgtgtgtccctatccagtcgcctgtcttggacagccacatcttaccatcttcccacctgtattctgcctcctgattattctagaaccatagttatattcccaaaagataagcctgaggttaaaatggagcctgccatcacctgtgaagttttgtctaccagcctggcacataggccttcctgttgtctccctccagccctcagatgtacatagtggggctctatgtacgggctggtgtcgttcactctatagagtatgcatctggagaaatgagggacccagagcccctctccaaaggggagtcacctcacattgcctggctcccaatgtacctagccaaaccccagccagtactgagcctcactgttcactctctgacaggtgaggctatgggcagggccaccgtggtacctttgccctatgagaggctgctcagggagccggggctactggcggtgcaggggctgcccgagggcctggccttccggaggccagcagagtatgaccccaaggcactcatggccatattggagcacagtcaccgaattcggtttaagctcaggaggtgagtaagccctgtcctggtttcatttccttttgctgtgttaaaaataccttgacaaaagcccattaagggagaaaaagtttatttggctcccattcctgggttataatccatcactgtaggaaggtcaagttgacaggaatctgaagcagctattcacattacctccacagtcacaagccaaaagcagtgaattcaggcacgcctgccagccctcagcttgctctctctattcttagacaattcagaatccactgcctagggaatc

SEQ ID NO: 30682 - DNA, 1139 bp, Mus musculus
gtgtccctgcacatgtaaacaatgtgtggaagtcagttgtctctttccgccatgttgaatcccggggattccactcagacagtcaggcatctctgccaacaaggacgccatcttgcctgtccaggccttctgtcttgagatccactctgtgtagcctcgggtagcctgcacctcacagtcctcctgcctcaacctcttgagtgctaggattataagtgtacaccaccacactggtgtttcacatcccttctggtggcctaccatacttgttttgggctggttccctccctcccctgcccttcccttgcctgccctgccctccctttccgtccgtcctctcctctcccatcttctggacccctaatttgcttatcatatttcatgcttcctgtttttcatcccttaatactaagtaaaaaaaaagtcagtttttactttacctggcttatttattgattaaaagtcaattttttaaaattagtgttctgtatgtgtgtgtgtgttcacatccgtgcacgtgccatggttgatgcatgcgcagatcagaggtcagtcttcaggagttggttgtctccttccatgcaaatcccatggatgcaacctggcattcttggtggcatacaccttcacccatgagccatcctgccagccctgtttttgccttacctttgtgctcctgacatatctgagcctggggcttctcgtggctcctatataaataaagcaggcagcttcccaagtacctcaccgggactatgctggagacaggagggtcctgtaagccgagctagctagattttggatagccccacaggccagctcccttccgtctcccggggcctctggctcagagtccctgcttctctcctaagtagattaggacctgggccaggaggagtcagaagagtctggaacaagctggaggtcaagaatgccagctactgctgcctgcctggccctgatctgatttgggtctgggcagctgggaggctgggactggcccaagggctcagaggacgatctggcagccatagccgtcgggctcccaggctaacggatgtcttggctgtgagggaatacagttatccagcagtcgttccccccccccccccagcaccccatcagtggtgacttaggat

SEQ ID NO: 30683 - DNA, 1296 bp, Mus musculus
gtgtgtgtgtgtgtgtgtgtgtctgtgtgtgtgaattgctatatatccaaagctaggtggaattcttagtacatcttaggttacagtgggccttgctatgtagcccaagctagcctggagcttgcagcaatctttctgccttttttcttgagtgttgagataacaccttgagacattttccatggcaatgggaatcctttgcctgcatgtgtgtatgctcacaacatgtgtgcctggtgccttcagaagtcaaaagaaggtatcttatcccctggaactggagttgcagatagttgggagccaccatgtgggaacggggaacagaacccaggtcctctgtaagaaaaacaggtgctcctgaccaccaagtcctctgagctactccatccatcaaggctgcctggcttgtttcttcctttaggctctggtgaacgctgctgcagtgaacataggtgtgtaggtctcggtgagactgtcgttatcttcctggaatatcagggttgtgagccttgtgcagacccaagaagatggccgtcagacctttatccagcatttagtgtcagtgcatactgctcatgactgtagacagagatctgtgctatgtgttcattgcagaacccggtacagcgaagacccagccaccttgtcatcaagggcagctcacaacacagcctttgggctccctgattaccaactagaaacgggctgggtccgttatgaaatgcgccacgggacaaacttgtggtgctgagactcaaactcaggacctccagaattctaggcaaatattctaccaccaagctgcatctctaacaaaccaattaattatttgagacagagtctctctttgtagctcaggctgatgcacaacttgctatgtagccgaggacagccttgaacatctgtttctcctgcctccatcccagcgatagaaatgtaggcccgtgccaccgtgtctggtttctgtggtactgaggaggaaacctgggttgtccaacacccctcctcagccccgcaggcattgctggagatcccctgaggtagccaggcacagtggtggcacacacctttaatcccagcattggagaggtagaggcaggctggcagagaaatcctgtctccacccacccccaaatcaatcaattaatcaatccctcaggcctaggcagatgtgactgggacgcaggcccgtggactgtgacattctctcccagctatgggtaaaacacagacggcgttctgaaatccagggccctgggcaattccttcccctctgggcagctcataggacaggaa

SEQ ID NO: 30684 - DNA, 1139 bp, Mus musculus
caggggaccctgggttccattcacagcaccacataaaccaggtgtagtgtcatatacctgtgaccccagccctggtaagggggaggcaggaggatcaggagttcagggccatcctccactgcattgcaagttgggaggctaacccgggctagttgaaaccctgtctcaagcaagcagtcaatcaaagctgtttgacttagcactgctgcgcctgtctggtttgttgatgtgtacactgggggtgcacacaacacaggaattggccaacagcgcttttctctcagtgttttgtggttgtcccttgatgtgtgagtacctgttgtatagcagacactgttgttggtgccatctatccgcagtggtcagaatgagaagggaggtcggttgggaccaccatctctaccacatcaagcttttgggtcagaccaccacactgctttcccatcagatggaatgtaggagaaactggccatgaggtgctttgaggtggtcacctgaatttctaaccagtgtctgggcccgtgaaaagggagtggagtccaggcgccccactggacgtgggtcttcaactcggcgtgtaggaggcttcaggaagcaaggtcctcttaaccctgggtggtgcgtgtctcattaaaccatgcttttcttcctaaagaaggaagctccgtggagcccaccatgactctcacagcctctaccgtccactctgttgacctctcaagtccctgtccccctagggttttggtgtcctcacatctttcctgacctttgacctgccattccgaggctctcagtggccagtcttttacctgcctaactccaccttcttgttctttctatacctcggccgctttctcatccatcccttgttctccgcgataccccccatagctctccagcccagggccctgcccggaggccccttagccttgggcatccaatcagaggctcagcttctccccttctgccttctttctttcccagggtattggtatccctgtgaatgtttgagttgggtgtctcaggaccccgtgtacccctaaaccaccgtcctgacgtcttcctgtctgctttaggcttggcatcatcctcgcttctcttctcaggcagctttacatgagccatgacccctcagtcct

SEQ ID NO: 30685 - DNA, 1347 bp, Mus musculus
catagtgaggccttatttcagaacagcaacagcagaaacaacctcctggaggtggaggcaggagcatcaagagctcaaggctgccctctagtacatagggagtttgaaagcagtctggactctgagactaacagacggggccttagctccaggtttgctccgcaagcttggaacgtgcttttatagcatgagccaaacttgagtgaagccaggtcccgcctgtcaccctgcattgtgaggtcctcgtatctgctttgaacccgccactagttaagctggttaggaacaacgagtcccgcttacccacctgctgctcttctcggcttgtctttcaggagattggatacactcacatgaaagtggcggaaggagtgaactccctgctgcagatggctgggctcctggccaggctgtgtcagaagaccatggctccagtggccagctgacttgagacggcctccactgatggaactaggagagtctttgttgtgggagatgtgcctcagctagaacatgctcactttgtttttcttctgtgaaaatagtctcttgtaccccaggctgaccttgaactcccgatcctgccgagtgctggggttggaggtgtgtgtcatgtgtgctttctgcggtactacagatggaacccaggactcgtgcgtgtcagacgagcactgccagctgggctacagtgagatactgagctctggaagtgacacacctctgctcttctgtgtgaattcaagccctggacatggggcatgctgggaaagctctgacctcctcagtcttgtagccgataaagcctttggatgttcgtcttgctatgcttaattgcttgcggccttggggaaaaccagcgtctttctcctgcctgttgaaccccaatattagaaagggtgccctggggccagtgagactgcagcagtgtcggccacacacccggcctcctgagttccatccccagaacccacaagcaggtggaagagaactgactccacaaacattctctggggagcccgcctttaatcccagcacttgggaggcagaggcaggtgctgtctgagttcaaggccagcctagtctacagagtgagttccaggacagccagggctacacagagaaaccctgtctcgaaacaaacaaaaagtagtcttttgggtcctgtatacatgtacagataataagtaaaattataaaaatctttaaaatttaaagaaatgaagccaggcacagtagcatacaccataattttttttaaacaatgatttgtttatgagtgatttttttgttgttgtttttattgttttgcctgcatgtatacctgctcactgaacacatgcagtgcct

SEQ ID NO: 30686 - DNA, 2228 bp, Mus musculus
cagcttaaacctcggacagtggcaacgcccctcaatcaagtagccaaccccaactcagccatctttgggggagccaggcccagagaggaagtggttcagaaggagcaagaatgagcttaggttgggagggaatggggcgtgggggagctggagcaagaccacggcctggtggcagccggtcgccctacaggccccattcccgcctggcactgtcctccttacagcggaaacacagagcttgtgagtgcatgtcagctgttaacaagtggtttctagtacattcttggctttgctatatctatctagtgcctgttttgtgctttctttctgttttctttctctcccctctcactcctgccctctccccgcccttcccacgtggtgtggatgttggtcacgtgtggaaggtgggctgaggtgcttcatcctttgctttctttctttcctttacacgccctggccacactccgggcgtgctgtcctctgctttttctcagagcttctctccaacctgcatgtcgagttctgtgttgctgtggcttctgggaaagagctagagccactagctaggtggctggtggtgacttgttggtgtccagctgggatgagcatgcagaattgatgcaccttggggtagaacaaagaaactgcctgctgctcctgagaggctgctgtgtttggggtctatcacccgccccagcagcctgatcagccgtagcaggctcctgtcagacagtgaggccagatgggtgcaggggagtctggaccttctgcactggtggcgacctgggtggcagtggccatgtggctttgctcctgctcgctcttaagaccaagtggaagctcattccctgctcttcctgggccatggaggccgcttgggggtgcaacccgctgcagctcaatccgcttcctgcagctgaggcctgtaggaagcaggggtggtgctggagctgcaccgggcagctgtgctttgcactgagtctgcgctctttcccttgtgtctgtctgatccagggcgcttagcccaagaggctgctcgccaccacagctcaaggcctagagtctggcactttctctgatcagttacccagctgttgagaccctcagtacctaggtgtctagaaacctctaggtgtgctgcttcctctgtggggcagacccctgctcccgcagacagtatggagcactcacttgagagagagcaaaggggatcaaccaggtttggcttttggcttgaacagttgtgtgtgaacaatggaaaaggattggcacccagtctccgtctgctccaattggagcagtaggggtcagccagccactagagccttggggaaaggggctgagaggtgtgcagcttgcttggtagccagcagcttcctgccagcctaccccttggctcgggattgtctttgttgcaaggtctcggcaatttacagaactctcactccttccctcgcctgccatcttctctgcttctgagataagaaccatttgtgtaacaccaatacctaacttaagacagacatgcattgcgtggttgtaatcaaagctgatgctttcagatgatgtaatccatctccaatgcggaaaagacaggcccgtccatccacattgctgggcacccagctgactgtaagaatggaattccaaacacttaacacattcagttctatgacagaaagtgagtctatggatatggtattttgtgaatgatcttttaaataaaagagaaccttacataacacttatgcttgtctttctggccacttgggagctgtgaaccttggggtgctacagagaagcatttacaaggagttaggctggcgtgttgaccatggtcctgctgcgcacactgccactgagtatgttgtgtgacctagtttgcagaatcctgatcttggaacctctaaagaagaaactggaggtaggctagtcatctcggcactaggacatgtgtttactgtgtaagcatttccagcatccatgtaaaacgtcatgtgtacccataatcccagcacccgggaaatggagacagaaagatacctggacttgcttgccagccagtctagccacatgtatgagctctggtaagaggagggcttcgagaagctagagatggttcagtagttgagggcaccagtttctcttccagagaacccagattcaattcccagcatctacatggcagttggcaagcatttgtaactccagcccaggaggttggg

SEQ ID NO: 30687 - DNA, 2227 bp, Mus musculus
cagctctgcagtggtcccggaaaggctttacaattgaagtaaaagcatcttaaggctgtgggcaaggttggctctgtggctgagcacttcccttagtaatatacatgaggttcttcatccccagccctgcaagaagggaagtgagtaactgtaagaagaaataagttccagtgcccattgagttagcattctctacctgatggaatagagctaacagcttgcaatgtggcttagctggtacagtgcttgcccagcacggtcactgctttggattctgtccctggcattacataaaccaggcctggtggtatgtgcctacaatcccagcatttgggagatggaggcaacaggatcagaagttctggttatccttagttacttagcaagtttgagggccagcctgggttacaaaagattttggggggtggagggttctgggatctactgtaacccaaatgggacaccaccaactgtggtgcttagtgatactaatgagattccgacaggcctagagtccaggatgactgtatgaggtggcttctgtttttttcttccagggttctgctatgtagaatttgatgaggtggattccctgaaggaggctctgacttatgacggtgcagtaagtgccctcaacttcccttgcccagacaaccatgtgttcctgttgatatataaactgtcttttccttgtcctcagctcttgggtgaccggtcacttcgtgtggacattgcagaaggcagaaaacaagataaaggtggctttggattcaggaaaggtggacctgatgacagaggtgattagctgtcttaacactgaacggaacttgctgtgtgcacactgcttgccacccctgtgcatcatttactgagcattggtccctgagagcttgggttttgtcctgtttctgaagtgacttggggtttctattgtgatgaaacaccgtgactacaagcagctcagaggaaaaggcttatttggcttaaacttcactgcactgctcaccattgaaggacgtctgggcaggaacctggaggcaggagctgatgcagaggccatggagggtgctgcttactgacttgcttcccatggcttgcgctcagcctgctttctgattgaaccacaaaccactagcccagggatggccccatccacattaattgctaatgaagagaatgccctatagcccagtcttatgggggcatttttgtagttgaggttccctcctctcgtgactctgacttgttgacatgaaagtgtccagcacagacaacaacatggcctcgtcctagataggggtctcttgctgtgtgtgaggaaaggcatcttgaggaagagagctacagtccatcatctagggaaggaggctaaggcaggatctgaggcagaggacactgaccggggaatgctgctccctggccgacatgctcagtccgcttccttagacagcccaggctcgcctgccctcaggtggcattacttacacactgtttcctgggccctcaagagaatgttcccttagatgtgctcacaggggacacattagtcaggccaggttctcaatcaaggttccctcttgttaaattattacgcttgtgtcatgaaaacagagtaatgagcacagccctcaacttgatctctttgtgtgtgtgtatcctcaggaatgggtggctctcgagaatctagaggtggatgggattcccgggatgacttcaactctggtatcagtatttaacattccactcttccctcgtcccttgtttctcaggatgttcaacctagacaggctttgaattccttccaccagtgagactctccacaaggtctccagccatacgcttcgcttcaggattggtagagaggccggccaggcccctcttcctgctttcccctgagcctgttgctggggctgtagctaggacaactcttgtgtttcatatgtggtacagaaagaattagaagtgtttgtagaagtaacacagcaaagaggctccaggagtgcccaggtccctcagtggtgtggaccctggcggctggtattcctcttgaagggcgtggagctctggttccttcacttcagggtagataggctctgctttagcatcccctcttcagccaacccagggtgttcagaggatgtctgcatcagtagagatgaggggcacaggcatgcaaatgccaagtcctctagcaaccagaaatgaacttattcatgaaagtacagta

SEQ ID NO: 30688 - DNA, 2226 bp, Mus musculus
gctgccagtcaactgagccacagccccggtgcctcggggctcttggatcttaatagaaccatgctttccctgcctgtctgtcacagtgcctagtcctgcatccctgctgatccttgctctctgtttaggtcgtagttatgatgaaaaggtggacgtgttttcctttggaattgtcctctgtgaggtaagtcacatagccgcccttgtgcccagacccagtggctcctctccactctctccaaccctcccatgctccagcctggatgtccacagggtcctcaggcccttagaacatggctccccaaagcagagcacagcatcagtggggtatagtttagtccctggctattcctatctgaactgtcctcagagcatttggcaggcttccagaacccccaagctcaggggtcctacactaaccagtgggctctgtactgaacagattatcgggcgtgtgaatgcagaccctgactatctgccccgcactatggactttggcctcaatgtaaggggtttcctggaccgctactgtccaccaaactgtcccccaagtttcttccccatcactgtgcgctgctgtgacctggatcctgaaaagaggtgagttgggtgggtcagggggctagcctgaagcagccttgggatgggtaggtctttgggaaagccagactcactgtcccctgatactaacctgtctatcaccccagaccctcttttgtaaagctggaacaatggctagaaacacttcgcatgcacttgtctggtcacctgccactgggcccacaactggaacaactggagcggggcttctgggagacctaccggcggggcgagagctcactgcctgcccaccccgaggtccctgactgagctcagcgggccccaccatctgcatccctacctttggagacgataccctcaccagatttctcagcaggggtggcctaggcctggagccctcagccagggccgtggtgcccacacccatcccccagacccaggccctgacctgccttttcccctcatgcagggtgccccccagcctctctctgcctctggcccccaagtcaccaggctgcacacacacgtggtcggtcacattgccctgccttacctcccaggggccaacccctcactggtcttgcatgagctagagggttgggaagctgggctcattccacgcattgcctgcagccatctgcacactgcacctgctggcagctcctccccagcaaggctgggctagaaggcagctttagaagtgagcccctctaatgccaagggagcggctctgtgcccaggaacccaaggggaggctaggatccccttggggaaatccaggtagcatcaggtattgacagggatctgaatcccaaagcagagagagaggtccaaccccgtgtggccaggcagtggcccctcactcttgcttagtgtccatctcatttcttgatcaaagccactttagtgagaaataggtaccagtcctcaggacgagccaggatccctcaggggagagggcagacgatgcctgggatccagctgacaggagggtccagcccgcactacagaggctgggcagagggaaggaggcagccacccaccagcaccccagccctccagggtcatctcagcacccaggcctctccccatggctggggcagccccgccccctccctgggtgcatctgccctctgagttctttctgtgtgatctattttttaagaagagtttgtattattttttcataacggctgcagcagcagctgctgggggtttagggggatggttttgttttgttgttttgttttggtttaggtgggtgggggtgggagggccatgtcttcactccgcttcagttgaccatctagggcatattaaactgtgaagctttcccagtgcactttgaatatggaagagaatttgagcagacccccgcgggaccaagactgaaagaggcaaggtctccttgcctcggcccagtgatcatgacaggaatgaacccaaactcagaacaataaaatcaattctgtgctccccacgcggggcttgcatcctcgtgtgtgtgtctgagagctccaacggagcaagcaagaagagagagcgagctgggcgtagtggcgcacgcctttaatcccagcacttgggaagcagagcaggcgatttctgagtttgagaccagcctggtctacatagtgagttccaggacagccagggctacacaga

SEQ ID NO: 30689 - DNA, 1188 bp, Mus musculus
gcctccatcacttgtttttggttttctgagcctgctaggtaggtgctctaccactgagccacgcccccagcccctccatgggggattctaggcaggggctgtaatgctccaatttcttgctgggaaattctaagccagaattctattgagccatactctaatcccttactggaagattctaagataactatgaaaccatgcttcgagccccttacaagggacttgggggtatactaggcaagctttctacctctgactcacacctctagcccctcactggaatctccagaagttttaggcagctccatttgcaaagagctgggacagacggaggtaccctcctccacacaggtccctggtatctggggtgtattctctgtgccctctatgggattatatggaaaggatcccaaatagaaccaaacagagagacgaccaggtctcagcctgccttatgaaatttccagaataggaacgtggtggtggccgactttgggctggctcgactcatgatcgatgaaaagaatcagtctgaagacttacgcagccttaagaagccggaccgcaagaagcggtacacagtggtgggcaacccctactggatggcgccagagatgatcaatggtgagtggttgctccaggagtcccagggggaggagcagcagctaccccacaagctgcctctctgccggtttacttccctaggatcctgtatccccttctcttgtttccctccagttgacaagggtcagctagggttttctgggcttgtggccgcctccctccagcctccacctcatctttacattaccacactcctttgtttagtctcgggtgggtgttgggtgtggttttcacactgtgtgcctgcacacacgcacatcaggagacaccttgtaggaggaagttgtttgccctcatgtgggtcctagggctgaactccaaaatcgtcacctagcgggcccttttctcatttagcacaggctagcctccaactcactatttagccaaggatgaccttgtgctcctgtcctcctgcctctggctgcagagtgttagttaggattgtaggagtgagccaccccgtgctgagtctgtggggtgctgggatagaacccagggcttctctgtgtcaggtaagcacactggccagggtgctgggattgtgagcacgccagctcctctgcc

SEQ ID NO: 30690 - DNA, 2064 bp, Mus musculus
ggctgagcgatggcgtctatgggactacaggtcctgggaatctccttggcagtcctgggctggctggggatcatcctgagttgtgcgctccccatgtggcgggtgaccgccttcatcggcagcaacatcgtcacggcacagaccagctgggagggcctctggatgaactgcgtggtgcagagcacaggtcagatgcagtgcaagatgtacgactcgatgctcgccctgccgcaggacctgcaggccgcccgagcccttatggtcatcagcatcatcgtgggtgctctggggatgcttctctcagtggtagggggcaagtgcaccaactgcatggaggacgagaccgtcaaggccaagatcatgatcaccgccggagccgtgttcatcgtggcaagcatgctgattatggtgcccgtgtcctggaccgctcacaacgtcatccgcgacttctacaaccctatggtggcttccgggcagaagagggaaatgggggcctcgctttacgtcggctgggcggcctccgggctgctgctcctgggaggaggcctcctctgctgcagttgcccacctcgtagcaacgacaagccctactcggccaagtactccgccgcccgctctgtccccgccagcaactatgtgtaaggtgggccactctgtccacattgcctttgttatctttttttcggattgagctcataacagcctgtggcccctcacattctccaggacctgccctgctatgggccactaactgcttgctggggacaggcaaacccggactgtgcaaagttactagcccgtagctcttgggctgctccacatggctccttacggccggcaagaatggatgtaaaaatatcttgctgcttacatccaaattgctggtggatatggggctgaaggcagaagcagctgggaagggcagtagaggcgcaagctgggtcctgctggccggggtagctcagctgtgactttggactctggagtggatgtcctcatgttagcaaacgtccactgtcctttctctatccccctcactcagcctacacgttactccagcgctactcttgccattacgccccgtgtttccgagcacagctggtcctaccccaagtcatggtgtgctgagtgactgactgaggggccattgagagccggtgggctctgccatggaacccttccgttgattagcaatgactgtgcttgacccacccacctaccctactaatgaatttctgtagagtggatggacgggtttgagggaagaagggtggaggtggattaaactggtttggggagggctggggacctagaagcagcccagtgtgtccccaccccttttccgcactgtcttgctaatgttctgatcactgtgcgccccctccctcttcagaaggaccctgggcctcttgagttggcccctctgagttccctccctttgcccatttcaaggacaccggccagtctgcggaaggaaggtacggggggggggggggggggtgatggcattgtaccagggagtctcctggactcccctgccttctctgtggtttcttgttttgtaatttaaggtctgttcacagctgtaattattattattttctacaataaatggcacctgcatacaggaaaggtttgggctgttctctatctgtggatgggactgggctggaggggcggctaagggttcacaggagaccttgatgttctaataagatgaagtggtggagctgttggtggagagtgtgcctggcacgccagaggccccgtgtcccacactcatccccaaatgaaggtcaccccccaccccccacccccacacacactaagctgtaggttcaaggctagcctggtctacaggaagccctgtctcagaaagtgattcaggagttctcactgtaaaaatgagaacttcctctatcctggaggaccatgggctttgagacctttatttgcttttttttttttagatacagtataaagcccagactaacatcaaactcaatgcaattctcctgcctcagttttgatgagattaccatgatgacaatctcttcatttgtt

SEQ ID NO: 30691 - DNA, 1123 bp, Mus musculus
caagagggggtgtatcagtaggggaggctggaatgttgtcttctgttgtcaggtgagatggtagggaacctggggttggcttagtctcatctagtatgcactgggacctggcctccatctgcatccctgagagagaagagttaaggcgatgtcaggcggtgctgatgctgcctagtttcatagcccaataggtagataggagcaggtaagaggacctcggcagctctctcctgtgtggcataggtaagggattctgtagtaacagaactaagtctgctctagttgcctcactcatttctagttgggttgagaaatgggtccctggaccagatattggaaatgaacagaattggttgtttctgatacttcctcagggtgcagctgctgagactggctgcagcctgaattctgccatggtgactttccaggcctcgggagtgggaaaggcctagttagagagcgctttcgattctgaccaacgagggctgaggatatctccagcttttgtccttttcttgtccctcttgtccctctgtccattccctgactcctctctccagctggagctgatcacaacccaggccacgagggcaggcttcactggcggcgtggtggtagacttccccaacagtgccaaagcaaagaagtaagtgccgggactggtgatggctcagtgggggaagtgcttgctttgcaaggatgagggcttgagtcccttttccagcactcaagctaaaaagccaggtgtggtgcttgcttgtaatcccagtgactgggaagtgaggataggcagatctctgggaaatcgctggccggccagcctagcctacttggtgagctctcagatagtgagacaccctgtcaaggaatggggtgggcagtgacttgaggaatgacagctgaggctgacctctgccttcatgtgtatgcacatacacagcaggcgctgggacgaagagctgtctccatagctctgggccctttcaggctgctgagtagacagaggaatgctgggtaggtgagcagggccataaaaggtgtaagacaaagactctgtgctgctaggcctgtgagccaggcttcctactgcccccttgtttcaggttctacctctgtctgtttt

SEQ ID NO: 30692 - DNA, 2047 bp, Mus musculus
tctccttctaccactgctgctacatgcagatggcctgcagcatctgcagctctcccactcttctgttaccatcccggtcttagccactgtcccgtagtatatggatagtacctctgtttccaaccacattacttcaagtcagttttctacatagtttagcctgctttgggaaaacaaaaatggtattttggatcatgccatttccaaaaggcttccttctctctacacttggaattaaaccacaaactctctttgtggcctgcgtagtgttgtgaaatttagccactcctgtgatctttctttgcaatggtccaatcccattcttcctattctttgctaacccaggcatttggcaggctctgggtgtgggctggtccctcttgtgctgcaagcatttttcctttctgttggcagacttgtcagtgcgattcagtccttgtaagtttcactggaaaacagttgccacctcaccaactccctccgaagtagccatttccaccaatcctgtccctcctggtgccctgccgcttttccttttgtatgaattggtgctttctgaagccatcttgtctggctatgtgtttactgcagtgtcagagaagggcagtgagtgggggttaagagtgggaattaggcccgtcacctggttgtgctatggaaggaaacggtagagactgcactgggctggtggccgtgtgtcctgggtgcacagtgggagggagccgctactgactgataagccgcagaagttgccagttgcagagaagttagatgctggcactgtactttgcaaggaggcatccttgtggactgcaccaaaccctgacgggggagggcgcagctcatcagtctcattggtgctgaaggattcttccttacttttccttttgcagtcctgggaatggaagccagggtcaggtagacaaatagctctgctggtgagccatgcctcaacccctcactgggagatgctagacgaagactctcctcagccacagccctagccctcactggacaaatgctttgcctccaagcctctttgcagcagtttgtgaaattgctgaagaatgcgttggaacagaacccttgttggtctgctttgctctgggtcccgagtcaactagccaggacaaagtaagctctcaataaatgggactctgactagaagtaatgaccaagcttttgatatactttgttttctgcactccgctctctattgtggattcaggtttctgataagatcagccatattgaagaccatgtggccacacacggatttgggcttctgactacacagctgtgcctcaggcttgtgtgtgcgtgtgggggtctggtgggcatctgctctggttgtcggaaagcatctgaaaatgcgttctcttgcttctgcactcgtgtcttgagaagtaactggtgccgtggctgcacagggaaggcagtgaaccctagcaagaatgctgagctgctgaagtcagaagtctgttcccaaactggccaattcactggcctgtggcctggagtcctgtaatcacagaggctgccagagttcgtctccccacttgtggaatgggaataaatgttgttctgttaccgcgcatggtgattctttgcttgtgtacatgcttatgggttacactgggggttagatatgtgctcttgccccaaacccatttttttttgtgtgtgtatttgagaaaaagactcactttgttgtcttggctggcctggaatttatagaaatccacctgtcttggcttcctgagtgcttggttttaaggcatgtgccaccatacacaggtcctttcgcctgtgttttgagctaatgtttcactaagttgcttttgatcttgagattctctagcgtgtcaggcctacatctgcatgcctgggagctgtgagttctgaatgagttgggagcactacaaaaggtcattgcacagactgcccaggggtaggctagagctgttcgtgttgccctaggaaaggtgtctggctagtactacaggctgccaagcttttctgatcctcgagagtagaggcggcattg

SEQ ID NO: 30693 - DNA, 1139 bp, Mus musculus
gaactgacagaaccgtaaatcacaaaacctggcattaactttttacccactgaagatgggaaggagcagaaaggtacattgatggttctggtggccatttatttcctagagaacacagaagtttgacacttagaagtttcatttttccgtctttttttttttttttttttttttgagggagcgcttcatgtagcaccggctggcctcgaactcagagaggctggacactgcattcccgatcctgtctgtctgtctgcctgtctctctgtctctcaatctctctctctctctctctctctctctctctctctctctctctctggtacgtgaaactggtgttttagaatacaaagtcagcatttccaatcattactttaagatttcttgaccaagcatagcctcttagttaaaagttgtagtacttcccccccccccccccccgcccccggtagggggaatgttgaatcttttaaggcttatttgttttttaaaaagctaagtttccttaccaaacttgcctgtcctgctatctttaccaccccttttcctttggaaagattaggtaagagcaggaaggattcaagtgaagtatttcagtttgctcttggcctttgcctctttcctgctttgttttttgttgtttcatttttaattgtcttgtaacctaggttgatgtctaaggtaggtgttggaagctaagtgtgacgttttccttcctaacttcccaagtgatggaattgccgatcacctgtgtagatttaataaaatgttctgaatatttaggatacttttactccccttcctttcctcaatatttggggaatttaccgtagggccctgcactattagtaagctccatcctgggccctctggttttttattttgagtcagggcatcattaaaattgctgagactggctgggaactcaccatgtggcttaggcaggccttgaacttttggttctcctgctttagcctccctagtatctgggattaatagacctcaggaccagccagtacagcttcagcccttctagcatcagttctgaaaggcagtgtccacctacagagattattttccaccttttaattttgtctgtatagatgtttccctgcctatgtgtctatggagcactgtgt

SEQ ID NO: 30694 - DNA, 1146 bp, Mus musculus
ccctaaattgtccaattttcagaaagtaaatgcactttttaaagagcaggctgcaaagatgttcaggttggtaacatctttgttacaaagttgcacacaagcctgaagacctagttccattgctcacctaagtaaggaggtggagacagggggtttgacagaaccagtgtctagctctgggctccagtgagagactcagtatgctgatgtggaaagctgtcaaatacagcaactaatgtcagcctctagcctccatgtgcatacagagaagcagcagggggtgctgggatgtacctgtgattctaccacttggggggcaggggcaggaggagctccccggattctaggccactgtgtgctatacactgaatccttgtcttgaaagaaagacaaaggagctggagtggtgctccacgctcacaagtgcttgcagctgttctagaggatccgtgttgggcagctaggactccagctctaggggatccagattctcgggcacacatgggcgtgaataaggagagggagaagtgctgtgctgcgctgtgctgcgctgccaacagtgctgtgtgcgcctgtctttgcaggtgaggatgacaagctgatcctgtgtgacgagtgtaataaagccttccacctgttctgtctgaggccggccctttatgaagtaccagatggcgagtggcagtgtccagcttgccagcctcctactgccagacgcaattcccgtggcaggtgagaagtttttaaaagtaagctgggggctggagatctggttaatattcacttggcatgtaaaaaggcctcgatttgatccctagcactgcagaagtcaggcatggtgctacaagtctgttatcccaaacactaggaaggtggaggcaggaggatcagtagcactgggtcatccttggctacaaaacagttcaaagactttctgggctgtgtgagaccattagataacttcgttggaaaattagtttcagttactcaaaactgagcgtttctaaggagttaaagcttattagggtgcaaagcttggtcatttatggtacagatacaggagcttaggtgctatatgactctggtttagggtgtgactgtgcgcgcgcgcgcgtgtgtgtgtatagttttaattgtatctctctc

SEQ ID NO: 30695 - DNA, 1083 bp, Mus musculus
aagccctcaaggggtgtgggggaggcaggaaagctgggaggatttaaaggagaagtaactggagcatccagaaatgcctgtcatgccaagcttgggcttctcctgcagttccccatggggcctttttccagcaaaggcaagctcttggggagcatcatgctagcctgatgagccctgcccagaaaagctcgcagcagaagtaggtctccccctgagagttggagaagcctaggcatggattctgtgagctctgccctgctctcctcctctccctcctcctcctgcctcattacagcagtgccaagccccctggcctcaaagagggtgctgtaccccacagtaggaaggagcgtcatctggccacgctgggtgaggtgtggatcttttgaatttatatttatacacagtcctatttctttacgtccgcactgtctcttcctcctcctccctctcaggtgacagtatcagcgagtgccatacagaattccgtgttcaccagcatcttgggacagtgtgggctctgagttgatcgtggcagagtagagggacattttctggagctgttcctgaggactctccattgtgcagcccttccccgccctcacccagctcactgcctcataaaagacaaagcaaactaaggcacttcccatagactggggtcctgcttccaatcatgctatgacctaggctttaatggctctggccagaggggtgttggagcccagcccacccacaaaccagacaagcccttagggagccagaaaaagagcaggaagaagttaaaatgtttaattttttaaattgacttttgtagttattaaagttgcttgtttccgcagtgatattgtataaagaacatcttgtaaaatacttgtcatcttgctttggcacatgtacagtacagtttctatgatatgtgttcgctttactaccctcaaagaggccagcgggcagcaggatctcgggttggcaccatctctgccctggcggcactctacctacctgtgggtgcctgttcctccagggcccactctgcagacctagagctccttccgagggcttctagcggagtgtcagcat

SEQ ID NO: 30696 - DNA, 2233 bp, Mus musculus
gttaggctggagaactgaaaaaacatctgtacatattgtcctcttgctgccccagcgcttgtttagtgtgtaacctaggcagcctccccctttccttggcaccatctctgctggcacctacttggatccctaatacacatgaggtggggttgggggaaacggaatgtccctaagctttgcctgcttggtttggccataagaagtggttctcttcctctgattccttcagggtctctccctatttcttgctgctttgtccttcaccggtcctctgtgagattcattccttttaaatggcagtgaatcttgctttgccttggagaccccagtgggcacggttccgcctcttctgcccagtctgtttatctccagccctctgctgatatagcctcgaaagggttggtggctcaagactgttagcctggcagagccaggggagggagacgtttgctccaggaagacctggggcaggtagaccagaccgcccaccactgcttctcgctgcctcttcacctgcccactaccccccgggccagtttgcctcttcgggattgtattttccaagccttgtactatgttggtctgatgttaatgtgtgttgctccttgaatcgagtttggaggaagaattgaattgtatgtgtggcggcatgttggtaatgccggacttaatgtcacctgggccctcctgggcctagctaattgaatgctgaaagtggcaccgcgtgacagccacagtgctgactcctgaattctcaatagtgttttgacttaagggctggcagcccaggggatggagcctgttgggagcaaagacttccctctgttgatcctccccacgtaacccacccaggccagggcagcttctgcctgtgtttggagttctacattaatgaactacacttaatatagtccttagttgtattctcaaaaggttcctacctagcctgtctttctttccaaaaccataccatacccttcagccccagagcctggctgccatgtccatcctctttgggagaagtatgaatgcgtgtgtctaaattaaaagaaaaaaatatttaaacattttttaacaaaataaaatttatttttgtatttaagctaaattgcctttaaaattccttcaagcttggttcactgaggtggttaagtataaatgctattgaatagtagaattagctgtatagttatgcctgtgtgaaggaggggctcacagctgtccccagcagctcccctaagggggcagagctccttctagacatgtcgtataagtgtgattcttcttttataaacagtgtgatgtagctgtccctggtccccttccctttgtgactgggattgaatgttttatggcaggggttaggctgggttgtgtggagctggagaagagcttgacctcaggtcccaaatgcctgtgaggatggggatgggtgggggtctgaacacgaagcctctacctgtgcctcaggtaaggaaggggcctccctgcaattcagtctgagctaattacctcagctccacagcaggcctgtatccagggcccctgcggaggcatcctggagtagcctcggtgtgtgagcacatttgtccgtgctcacgctggacagggacagggaggctggggcttcccaccacagactgagttcctgtgagtgtagctgagatttttagtatgaatgtgagattgttcttgcttatgtcattaaaaataaaactgtgatctgtcatagatgtgagtttgccctttatttgtgaagcgaagaactcgtgactggtaggactgggcccagtgagggacacagagtgccaggacatcatcttcccttcccagaagagcagggttcccacagtaagcatggttctgctggctgtggggcactcagtgcctatgtgcttggctgcatgctggcaccaactgctgctttgcgtcttctctttctctttgggacttggctgagaggttctggatccattgcatcggtctgtggggctgggctggaagaagaggccagaggttagcagatgtgctagcacacaccttagctcaggaggcagaggcggatctaaaaaggttggggccagcctggtctacctagatagtaagttctaggtcaaccagggttacacagatactgcctcaaacaataacaaaagcctgagctcctcactcacgttggtaccacctctgcacgttcaaacacagcaatgaagaagccaccagtgagcgtggt

SEQ ID NO: 30697 - DNA, 1169 bp, Mus musculus
ttttattttgttttagacggggagggtctcactaagtagcccaggttgacttagaactcgggatcctcctgccttcacctcccaaatgccgggattacaggcgcgtgccacccatctccgttctgtgccttgatttctaacatcactcctctgcagtccaggagcgtcagggaaacctccagcgtcaaaaaccgggctgtacttttcttcttttctttctttctttttttttttttttaagttttgctgttttgagacaggctttatgtctccatgtcgcgctggaactgtctttgtgaaccaggctggactcaaactcacggaactcctcttgcctccgcctcccgcgttctgagaggcaaggcgtgcaccgatccgcctacctaagctgtaatttttcaaactagggctctcgcgccgtgctccgcacgcggcggcggtttcccctttccacccggcgcgccgcgtcgacgacagtgacgtcggcggcggcgcgcggcgcggtgtaccctgggatatttaagtccgctccgcggcgcggagccgcgatgtctccggcggctgcggcggctgacggaggcgagcggcggcggcccccgttgggcggacgggaaggccggagccgggcccgcggctacggaggaccggcgggtgctgcggccctcggcctagcgctgctcggcctcgcgctctacctggtgcccgcggcggccgcgctggcctggctggccgtgggggcgagcgcggcctggtggggcctgagccgagaaccccgcggcccgagggccctgtcgtccttcgtgcgcgacgcgcgccgtcacccgcggccagctctcaccgcttcaccgcctccggccaagtcaccagtcaacggtagcctctgcgaaccccgcagcccgctgggaggccccgacccggctgagctcttactcatgggcagctacctgggcaagcccggcccgcccgagcctgccctccggcaggacccaagggagaggccggggcgccgcccacccgcacgctccccgcctccggcctcggcggtccagcgagtccaccacgtctaccccgcgctccccaccccgcttttgcgaccctcccggaggccgccccaccggtaagccccggcgatcttcccagggtggggtctctgcggccgcggatttgac

SEQ ID NO: 30698 - DNA, 1251 bp, Mus musculus
gggtgtagctagatcctcaagggagctgaggggctggagaggtagctcagcagttagtactccccgctcttacagaggacccccaaatcagctcccagcacccacatgtgaccacgaccgccttcaactccagcctcaagggatccaatggcatctgctgcatgcgttcatgcagaagtgcccacatacttttagagaaaataactcctgaaaaaaaaaataactttaaaggcagaaaattgacaaaataatgacttagggtggggtgaggaagaaactcaaatccagctgtgacttatatttagataatgcagtttcctggtgcctccaaggctaagcataagtgtgtgcataggagatctacttctgtggggttaggtcatagctcaaaaaggaatttaaatagttatgccaggtttgtcaatgcacaactataatcccagcatttgggaatccgaggcaggaggaatgtgagttcaggtctagcctgggctatatactaagaccttgtctcaaaaacaaagatcaggctctaatttaactggcttattgcagtactgtccccagcactatcctcagattcctgttttgccctgggagaatcaaacacatgcagggcaccctgtctcagaactggtgtggtaagtcagggtcacaagtgtttatcattctggtcacattagggtgctatggcctctcatcatcggaggtattggtcctcatcctgtgtctgggggagtttttacttcttggtcagtgacttagttgtagaagggtccctggcactgtttgaccctgaattttaatgctgaccaatgtgttactcccggttgcctttccatatctctggagaccttgctagaaaagcaagtctatgggcgcaacattaacctgccaataagagtggccctgccctctgccgtcttggatcatctgtagtagccttccaaccagagtgggctttgctttctctctcccatctttgatcatcttccaagttggcttccaacaaggatgagctctgctcggtcgatcttcatcttggatcccctacattggccttccaaagagaggggctttgccctctttccacctttcaggttctcagagaccacactgtaacattggaaactaccatgacagcacttgccaggcattcacagtgacgcagaagagctatttgactcccaggtccagcccaaacccacgaccagcaaagcagtaatggagtgcttcccctcccaggagcca

SEQ ID NO: 30699 - DNA, 1188 bp, Mus musculus
ccccagagcgaacttcctgtgccatgtcatttgggtcacctcctgtcaaacctagacaaggccccaagagggacaaatataaaggaaccggaagtggttccttctccgtctgcctgcttctgcatcctactgaaccagaaagcaatggttccgtgtgctacttacccaataggcccactggatcaggaaacgagcttggctcggtttaagactctttatatttattactaacaatctttatgcagcacatgccccagagatgcttggagcaatcaggaccaagggtaactaaacaggcgtgccctccgctatcaatctccacagatcatcatagagctaacgtgccatccctgggcatttccaggcttggattccaaagcaggcaggttccttaaagcactgaggagcagggcagaggagaaaggggaccactggctctagcacagtccccatcaccacccacccactctggctcccatgcagacaggatggggacagggggcaccacgcctagccacaagcagggacagcactttgcaactccctaatggacccctgatctaagtgaccttgtgggccaggggggtggtggcttctttatctgtagtaacacataggtggcagccagcaagcacttctttgagcctgtccccatggggcagagctcagcttcgctgggtgatgggttgtgagactagtgcttgatcactgtgaatcaacctcctccttcctgccccactcacccccactctgtccccggtgggcactccaaaacctcccagagacccagatgatggctgtgacatgtgacctccacactgggctgaaggagttttctgcagtagaaacgggcccattctggtgccagaacaatgttttttgggtccaaggaccagaacactcgatggatgagtggcattgttggctcatttgtgccaatgcagctggtccatgtgttcactgccagtcagcttttcctacggtggccatagagtccttgtctctagagtcactctcatatgtcccattgagatgacatcaaacacagcaatagatgggggttttctgaataaatgacgaacccatatgaaaagccactatcatttttaaaaaaccaataaaatctgcctggggagtgaaacagtgaaaagccccagctcgaggtaaggcagcagcacagaagggtcc

SEQ ID NO: 30700 - DNA, 1521 bp, Mus musculus
tgccagtggccagaaactggcctcctggcctcctggccacatgcccagcctacctccataccagcctgcgtccggcctgtgctatgtgcagaaccactttggtcctaaccccaatgcctccagtgtgtacccagcttctgcagggacctcccagggggtacagcctccctcccctatcagctgtcctggcactgtgtattcaggggccctgggtaccccaggggctacaggctccaaggagtcttccaaggtagccatgccctaaccagtctgcagaggcggcttccaccttgttggacagaggaaggttctgagaatgtaggaattatttattgaagccagggcatgccggcctgtcattccagctgcttgggggttaaggccaataggtaaaaggtcaaggtctgtctgggctccagagtacgtccaaggcaagcctaggatatgtattaacaaaaccctgtctcagaatgaataacaatgactggggctctgtggtagaatgcttacttagcataattaaggccctgagtcctcagctccacaaaacaaaaaagaattactaattagatacctctgtgtgccagctctgaagagtactttgataaatgtccctgtatctgtgttgtttcacctcaaggcagctctagaaagtagaaactggatggtaagacaggcctgtaatctcagctatgatcaaggtcagccccagctacagagcgggttttaggctagccccccgggcaggtatatcatggggtcttgaggctcctgggcttcttggttcctaatccagtgtcaagaaggtgcggttatcggctgccagggactcttgccgtcctacccatcctgccctgctcagtgcccatgggtccttacttgtgtctggtgtgactgtaccaggtagtccttgtaacatcgtcttccccgcagccatggctgatgggacttctgcctgactggtgacctgcagcagcaggctggtgatccgccctgtgagtcacctctgtataaaaaccagcctccaacctgccagtggtgtgtggcatactgtgttcagtcccgggcaagcgtgacaccaaaaagctgtgaggagccagaatcacatccagtctgtgctcagtggtctgcagtgaggacctgatggggtgggtggggacagcgaagtcaagagttgataaacccagagatgggtacagcaagtgaatgagagactgtctcataaaagaattttctttttagtaaaaataagctgagcatggtggcacatgcctttaatcttatcatgtaggaggcagagacaatggatctgagtttgaagccagcctggtctatgtactgagttccaggatatccaaggctacaaagtgataccctgtctctaaaaataaagccaggtatggaaatagtaaaagaattttctttttagtaaaaataagctgagcatggtggcacatgcctttaatcccatcacttgggaggcagggcacttaggtagatctctaaagtcagcctggacca

SEQ ID NO: 30701 - DNA, 1204 bp, Mus musculus
gggatgctctgggctgcctctgagggcctgtattagggttctctagagtcacagaatttatagatagtctctatatagtaaaggaatttattgatgacttacagtcggcagcccaattcccaacaatggttcagtagtagctgtgaatggaagtccaagcatctagcagttactcagtctcacacagcaagcaggcgaaggagcaagaatgagactcccttcttccaatgtccttatatggtctctagcagaaggtgtagcccaggttaaaggtgtgtgccaccacacctttaattccagatgaccttgaactcgagatctccctgtcttaatctggaatccatagccactatgcttcaagatctccataccaagatccagatcagaaacttctatctcccagcctccaggatagggtcactggtaagccttccaattctggattgtagttcattccaaatatagtcaagttgacaaccaggaatagccactacagggccctaagtattccaatacaggtgattcctgaccccaagcccactcctccagagagggtagtctgaagatgggcacagccaaatggtctttgaaacccactggcaagcaagccagtatgacatgagtaagattggcactgcattagagacttgagtcgatagccaaggaaacaggtgcatctaggcctcagtaaggacacggctggaaactggtgggacccggagctttggactgcagccacgcctggcatttcagtggcacttcctgaatacagccagatgtgggctcttaggcaaggtccttccactctgtagataggcttgtgtgttcttggtttcttcctacatagggtggctcactggctagagctgtgaatgccaaacacccaggtttcctggcgactgggctgtgagaattgtcaggtcctcctgtgtgacctagttgctgcctttactgatgggctccaaggatgcagaggaattgctaacagacaatgcagagctggattccagcttcctactgccccacactgatggactgcccctagatctccattccctgggcctttgtgtgatctggaaccagtgcacaggcagcctgaagctacactagagtggaaccatctgtttctcagcgcctgctttccttgccttcagaagcagcctttgcctagtaggtttcgctgcagatcaacctccctagggct

SEQ ID NO: 30702 - DNA, 1101 bp, Mus musculus
ttcaaggtcagcaagttccaagtgagccagggctgtacattgagactctctcagtaaaactgaagagagtaaaggcgggcatcctggctagtggtattgagaactgcgctggtctttgtaagccaagtggttatctaacctcggggatttgttcttaaatacacagggcataattcctggagctattggtagctttggttcattaaccacatataaactctaccctcatcgattctctgttgatctttgccttgctagtggaaaaatggcttagaaagcacaaaagtaccaaaccagtgaacacagaatggcccaccgtggtttggttgttattccagtggctcctttaaagagatttcactttctctcttttttttattttttagatttatttatttattatatgtaagtacactgtagctgtcttcagacactccagaagagggagtcagtcttgttatagatggttgtgagccaccatgtggatggttgctgggatttgaactccggaccttcggaagagcagtcgggtgctcttacccactgagccatctcaccagcccgagatttcactttctttggagagtgagtggctcttaacttttataccctctgatactggaattggtttcattgagcacattgctcaatcattatcaaaaagtggccagaaaacaggcccacgttggagaggatggaatattatcgtataaccctcacatctggcatttagaaagaggtatatgtagactgcagaagatgccaagatggactttggtacctggaaatcacaggcttgatggcagctaggatacctcaagtgaagacaccctggtagtaggagtttataaataaacatccacaggagatgtctgtggcctgagaaacctgaaattataggcccactcgctctccgtggagggtttcttaactccttgccaatcaggatctgcattcgttaggaaggtctctgtgtgcttagcagctagactgtttgaaaaggacttcctgccaagagcaaaacatttacttactaaatccatgggacatgttaacattgcagtattaagtctagttgttttgagacaaggtctcaggtgt

SEQ ID NO: 30703 - DNA, 1189 bp, Mus musculus
gaagtaaagctgaagacaaggagtggatcctcgtcaccaagctgggccgcctggctaaggacatgaagatcaagtccttggaggagatctacctgttctccctgcccattaaggagtctgagatcatcgacttcttcctgggtgcgtccctaaaggatgaggttctgaaaatcatgccagtgcagaagcagactctaggctggccagcggaccaggttcaaggctttcgttgctattggggactacaatggtcacgttggtcttggtgttaagtgctccaaggaggttgccatcatcttggccaagctttccatcatccctgtgcagagaggctactggggaaacaagattggcaagccccacactgttccatgaaaggtgacaggccgctgtggctctgtgctggtacatttcatccctgcccccagaggcactggcattgtctctgctcctgtgcccaagaaactcctgatggtggccagtatagatgactgctacacttcagccagaggctgcactgccaccctgggcaactttgctaaggccacctttgatgccatctcccaagacttacagctacctgacccccgacctctggaaagagactgtcttcaccaagtctccttatcaggaattcacggatcatcttgtgaaaacccacacgagagtctctgttcagaggacccaggctccagctgtggctactacataaggattttgtacaagaaaaataaaagaattaagtctccttaaaaaaaaaattgacttaactggacatctgggctcactgagacacaggacgaagatgggcaatactcttgggaggatgatgcaatgcaaggttcattcactctcatctattcgcgtagttataccagtggagtgcttatcactggcactcttccaagcactggcttctcctcacagaaataactcgactcaccttccattccaactacactgccacagtggtagaaggtacttcatttcattttctgagacactggcacgctatgtagcccaggatagcctcagacttgagtcctcctacttcagccaaggactaggattacagatatgagctgcatgcctggctaggctacttttgttgctggctactttgtagaacataaacaaagaagaaaaatatttactcaagagatacggagggtagttccaaactcttgag

SEQ ID NO: 30704 - DNA, 1850 bp, Mus musculus
ccatcgaccacctgtgcgagctcctcccgaggctgcaggcccgctactattccattgcctcgtcgtctaaggtgaagggcaccagctctgccagggagggcggtggccaccggatggccgccgaggaagggcctctcgggggttgaagccccgctcacaccagcccttcctccaggtccaccccaactccgtgcacatctgcgccgtggctgtggagtatgaagcgaagtctggacgagtgaacaagggggtggccaccagctggcttcggaccaaggaaccagcaggagagaatggccgccgggccctggtccccatgttcgtccgcaagtcccagttccgcttgcctttcaagcccaccacacctgttatcatggtgggccccggcactggggttgcccctttcatgggcttcatccaggagcgggcttggcttcgagagcaaggtaaaccatgggggcgctggttcgtggtcagcccgggccgggccaggccagagctccccttaaccatcgccgcacccccgtccaggcaaggaggtcggagagacgctgctctactacggctgccggcgctcggatgaggactatctgtaccgcgaggagctggcgcgcttccacaaggacggcgccctcacgcagcttaatgtggccttttcccgtgagcaggcccacaaggtgagatgggcggctgcgcccgcgggctgggccgccccaggaaggcggtgctgtggggtcccgaccctgctcaccgccgccccttcccccaggtctatgttcagcacctgctcaagagggacaaagagcacctgtggaagctgatccacgaaggtggtgcccacatctatgtctgcgggtgagtacaagggacaggggaggcacggggtgctaaggatccgcctatggggtggctccacccacaaccttccgccacaccttcttgtcccctcttctccacctagggatgctcgaaatatggccaaagatgtgcagaacacattctatgacatcgtggccgagtttgggcccatggagcacacccaggctgtggactatgttaagaagctcatgaccaagggccgctactcgctggatgtatggagctaggagctgccgccccccacccctcgctccctgtaatcacgtccttaacttccttctgccgacctccacctctggtggttcctgccctgcctggacacagggaggcccagggactgactcctggcctgagtgatgccctcctgggcccttaggcagagcctggtccattgtaccaggcagcctagcccagcccagggcacatggcaagagggactggacccacctttgggtgatgggtgccttaggtccccagcagctgtacagaaggggctcttctctccacagagctggggtgcagccccaacatgtgattttgaatgagtgtaaataattttaaataacctggcccttggaataaagttgttttctgtatttgcctggtgttgattgagtttttatatggggtcagtcttgggatctgctgcagttagacaccccaccccacccccctcagaggagccaagagtcagtgccttgctggggccccaagccttgtgtcccttgcgcaaacacatccacagtccatcagatatctccatgcctctcttcctttattgaggcctagagcccgaatcctgcaagctgggctccaggcccaggccttcctcagggcccacagagcccacaaagctcagggggcacagaagggaaccccctacacaaggggtaaccccaacctgctgccccacctggcacacaggtcaaaaagcccctttggggctggcatcagatctagctcagtccttc

SEQ ID NO: 30705 - DNA, 1285 bp, Mus musculus
cgctttgtcttctccctcgtggacgccatgaacgggaaggaaggagtcgttgagtgttcttttgttcagtccaaagagacggaatgcacttacttctctacgcccttgctcttgggggtgcgtatccagggcgagcccacatcactgcctggggacctgcttggctttaggggaggaggaacaatgtcacttagagcagagctgtgcaagtatagcttggggaatgtggcagctgtgaacggctgtcaaggccaggccacagttgaaagaaaagggcttttgggctggtgtgcagctaaggtgcagtccttctgcttagaaccctccagtgagggactggccgtgtgacctggtagagctctgcgctgccaagctagaatgtggtttcacatgtcaccgtttcccttctcattcagaaaaagggcctggagaagaacctgggcattggcaagatcactccttttgaggaaaaaatgattgccgaggctatccctgagctgaaagcctccatcaagaaaggcgaggactttgtcaagaacatgaagtgagaggtgtgagcctcgagcagcagcagcagcagcatcctaacttattcagcatcatgtctttggaaccacttgagaatctagtttgcgttgatggagggtgttgagtcagcatcagcatctcttccaaattatgtctggtctgttgataatgacagtaaagcaggctctgattttctttttcaaggtctctgtagatttccttttccatcagctcactaatcaggaatagagtctatggttgggtgtggtggctcacaccttgaatcccagcactcaggacacaagatgatctctgatttcaagtccagactggtgtatatactgaactacaagccagctgaaactacatagggagaccttatctcaaaataataacatcaacaagaactagcggctattcccacgttaggcagaggcccctgaagagtcagagaagtctaaggccagcttagcggtgcatgcctgtcaccccagctactctgtggagggtgaggcaggagggtctaaaggccaaggcctgcctgcactgcagagttaagagcagttccaggccgctgagggagggagactgtctcagaacattagagcagcagggtagagcccagctatagagcagtaacctatgattagtggcatggctggaatagagtgcttcctagcatgtctcttaagatctgtcatgcttttaaccatcaatttgacacagcctagagtcacatgaaaggggagttttccaa

SEQ ID NO: 30706 - DNA, 1103 bp, Mus musculus
tgtcgctgtttttctctccttccactctattggttctgggaaatagaatgtaggttatcagacaatgtagcatgttctctttgttttgttttgttttgtttttgttgttgttgttatttgtttttgagacagggtttctctgtgtagccttggctgtcctggaactcgctctgtaggccaggctggcctcaaactcagagatccacctgcctctgcctctcaagagctgggattaaagacgtgtgccaccatgcccggcacatgttctcttttttaaagactaatttatttttatttatgtgtatgaatgtttttgcctgcctgtatatatgtgtgcgtgtaagtataccatgtgctgagaaggccagaaggctccaggtactctggaacttggttttagatggttgtgagccacaaggtggatggaaaccaaaccttggtcctctgcaagagcagccagtgctcttaacctccagccatctctccagaccctgcagcaagtgacttttttccattgagtcacatcaccagctcatattgtagttttggagatgggggtctcactgaatcgttcaggctagctttgaactcactctgcagcacacgctggccttgaactcgctgtctctctcacttagcctccatgaagtgtggattagaagtctgctgcaacagctgagttcagcttcctttcgtgttgttttatttttattacatgtgtgcgtgtgtgtgtgtggccatatgcactcgcacaagcactgtgggggtcagagaccaactggtggtagtcggttttctccgtgaaaaccaactcttgacagctagtgccttcattggctgagtcagccctctagtacccttttgagagagaactgagtttcctatatatctcttggggtacagctgggtcactagtgtgaggtcacttcagaaagcctttgagttaccagaggtctcttaggaaccaagagaagcactcagggcctctgctctctcccttgctgggtcatattataactgggaactcctgactaacccatctccccaagatgcgtgttttaggaagccctttgttccctgccccacccatgcccagctccata

SEQ ID NO: 30707 - DNA, 1230 bp, Mus musculus
cctggctccggaagaggcagtaagcagtagaggataccccaacaccctcttcaggcctctgcatatgcctgtgtacacaacacacccacacaaaatcttttttaaagttgcaaggtaatgttcaagactagcttggattgcatgaaaccagtctcagaaagaaaggaaagcaaagttaaaagcgggggaggatgctgagaagatgaggtgcaaaacgaagacacatttctggggttcaaggcctacttccatacatttcagactagcttgggctgcatatgaccgggtctcaaagttttgtcaggccctgtgagtatagaactccaaagacggctaggagcaatgttgtgagtttgaagccagagtcatacagttagaccttgtctaaaagaaacaaaaaaggaaagaaagaaaaaaggccaaggaaggtagagcgttaatacaagatcctggagttggggtaactgggattgggattcaggaatcttcccttctgggatctattttccccaaaccctcaatgactccagcaccgacgtcctctgcctccccctggtgggtactgccggttctgcagctgtccccgttagtgcgggtatttgcttccagccttgagcccagaccctgatgacagtagcgacctcgaggccagcccatctgagatctccattcccgagtttctgcatgttccccttcccaaacacctgggcttgaaacgaaggattgtgctgcctgcgtgtgcccataagagccaggcatctaagagtgaccactctcctacctctggccattgcggactgcccaggtacccggctgtaagctaggcagggctgcggctcagccccgccccacccagcacggagattgccttctagcccgagcgtggcaagagccaatcacaagccagcatctcgcctccgtgccaatggccggcctgttgctgggtctcgcatccctcctttggaattcgcctgccgagcccgccgcagtgctaatgcggagcttatcatggcttccgggtcctcttcactccgctttgtctcctcctttgtagtccttaccgaataatctgctttggccttttagggcgtaaaaacctcctttagagggtggtgcatcaagctccaggtggtcctcgccctcagggttgctatagaaacagtgacccactctctgacctctaagcttgctgcagtccctaatctccatattatcttcccgaaccgatcc

SEQ ID NO: 30708 - DNA, 2911 bp, Mus musculus
gaaggcctacagcgaagcccacgagatcagcaaggagcacatgcagcccacccaccccatccggctgggcctggcgctcaactactcggttttctactatgagatccagaacgccccggagcaagcgtgccacctggccaagaccgccttcgacgacgccatcgccgagctcgacactctgaacgaggactcctacaaggactccactctgatcatgcagctgctccgagacaacctcacgctctggacgagcgaccagcaagacgacgacggcggtgaaggcaacaactaaggccccaggtggactggcagcgcccgctgatgctactactgcagtctttattttttcccatgagttgggggtcgggtgggggaggggaaagggaggggtgaccttcccagggagaaacccacgactgtcctgtctttgattgcctctttgacatttttgccaaaataccactagtggaaagtcaggctagctatgctggtatgggagtagcagcctcacacagacgtccggactgttgtgcaggctcggaacgagcaagcggagctgtctgcctttagtttaacttattgctagacggtagggttctaagaagaaaaaccggagatggatggccctcattcagtgcgttctgtggttccagtaaggattcttctgtccatgcccttgtcctcagttccgtggctgttttctctctttggctgtgctttctctctctctctctctctctctctctctctctctctctctctctctctctctcttttttccccctggggtgtacaccagagaagttatagtttaaattacccaactcgacaggcttagagtggaaggcacaccttttgttagtgagttagacgtggccctgtatttggaagtctctgacgggttgacagtattaacactcaattgtagtttacagtatttatacatgacagccatacatgacgccaagccatgggttctcagttttcctttgtcaggtcggctttcatccgcgtccgggttggtctggctcttcatcatttcgtaacgtggggagagtcagagctccctgttccgttttggttgatgggtgtttgggagggggctgcgggggatacttttttttttagttcttctttacccttaaggtcagcccatcacaaaaacagaaaccgttaaataccccccacacagagaaaacggagaaaattcaggtctgtatgtcatttatcagagactctgctctcagcagccagggctccgtctcagtgtcactgcctgttgaatgttcctcagcacccaagtctactctgcaccttgtgctagcagcatgcaggtgccccgaggcgtaggactggagtgtagcgggtgggggattatcatccggtgccagcagctgagcctacagggaacccactaggaagaggcagttcacttgaggcagcctggtccctaagccagttgtccctgcctccctccagccccggcactcctttcccaagtgcttagtggagggtagccgaggttcggcaggaggccatgctcaccctgtttgacctaagctttcctggtttcccctttttgaatgaaatcgtagttgttgagattggcttctctctcatgaggtcgctgcacatgtgacattgaaggaagctctgctgctatgtcctacatggtccgtctcagccctaggtccctcattctcactgtggatagccctttccataaacacgcccggttgcatgcagagtgtgcagtttatgtcttctggagaactcatggtctcgtgggttcccaagacgggcagcgccccaaacttgcttaacttgtcttcagaggcccagcagccactttgtcgcccacttgagctggtgccgtggctgcggaaggatgacgcccctctgcacagtcccagcatgccctttctcggagcccctccccatgctagtgtgccagcaccccctaaccgagaccgcgcaaggccgcagcagaggaagcttggccaccagagtggacagaggggccggagaggcttcgcccgggggtttgtctccttgtccgcagtgagcgtgtctgtgtcccgcttgtactgtttggaaatgacctactggaattgcaaaacctagtttctctttacatttcagccttgacctttgctgtgttctagaacagtcatgtgagggtagaactgaagagggagagcgggagacctgccgtgagcttggttccttctccttcctttactgttgagaagtgtgcctgcctctgatgctgtccccagtgccgcgcggctgctcctccatcctattgatacagtattgtgcatgctggtgttgtatttctatacggtagcttgacatttattaccttacactgtaggtgttatgtatcctatgacaaaaaaacttaagacttcaattttttttttaaacttcttttttttaatttaattttttcctttcaggggtaaagtttgctttaccaaatagtgattgtaacagattgatctgttttggatgttgctatagtgacatgcagttctatattttgtttttcaggggggaggggacaaaagaaacaccagtgttagcttactcttaataatgtctggtgtttgtcatggtgaaactataactatcgcagtgcaggagaacgcgcggacgttctcagaacgcgcctctgtgctttcttgtcatgttatgcagtgaaaatatttttaaggtctaatcaagtgattttttcccccccaactccgtgtttcgctaaggaattatttcgcacacggaccattcttagcagtttcctcagtgatggaatattcatgaatgtgagtcattatgtagccgtcgtacattgagcaaaataaacttacagatctgatgtcggcggtgcccagcttcatttaatagcgtt

SEQ ID NO: 30709 - DNA, 1157 bp, Mus musculus
cttagctagcacttgggagatggaggttggggggcagcctgggctacatggcatcctgccttagacaacaacagaaaggacaaaaataccaaacaaacaaaaaaaatcacacaggaaagccatgtcctcagtatagcactgtggctgagtgcagacattctccgtttgatgcactgttctatcagtgttgtccctcatcatgcttttagaccacaaccttcctaccttagccgcctgagtgctacctcatcaggtcttaaagggtgacctgttgctcaggatttctagggtaagcttgtgttggattcccaaggttaccttggagtcattgattggtcaagcccagtgtgcttgtggctgagactgactatgctgaaagttggcaaggcctggtctgcagaggaaaggcaaggcatggctgccaaggacacggcatggggtgatgtccagtacagccaggcaagtgaaagaccagtgctcaccagggaagtcttctaaagaccgtaggtataggggggtgggagggtggaggtagggctgtgccagtacccaggatgcatgggagcctaaagagcctaaaccatgtagtttgtgcaaagactaaatggttcttacccaggtggggtgtgtgtatgataaaaaccttctcaagactcaagtgcccaaatacctgccaagggtcaggtcagccttaaaggcgggccttctgaagatagccgtggggaagcgttatgttaaccatctctgcacagtgtcattggggtttaaggttcttcagttatgtaacataccacattctttctcaagttttagtttattatttagtaagaatgggccgtctttggatacacagataattgtaaccacccagaagtgtgtttggttaattcctcagtggtttattacattgcccaagcagtatgcacgtctgggacattccacagatgcccttgcactctgctgctctgctttgtccgctcccactgtaggatagtctctgcactgtccttctcacagcttcttagctattttatgtatgtagtggtatttccactcataggcaaggtttaaagcaaaactgagcagcctgtgtgccccttgcctcaacacaggcagagtctctctcctgccaacacctccctcaccagagtaatgtt

SEQ ID NO: 30710 - DNA, 1197 bp, Mus musculus
cctaaccagcaaccttccgtttgctgcgactggctgaaccagtttcaaagctacccaatcaaaatccttcagtaagatagaggcgtggcttcagttccgacccagggcgggctctcctctgagctcctgcggtgactcagcaggaaggcgtgagttattggggcccggaagggcagggctacgtcacgtcctaccctgtccgccccggccgtcgaggcttacggggctccagtgggaatcccaacacctggactctgttggttttgttttgttttgatgacccagaaaaaccctggacctttcactgatcttttgtttcctccgtttgcacagtggttaagaacacttcccggagcagtgcctgagtgggaagaccctggaagtttggagtttgaccttacaggaagtcaatcccagttgcctcgttttttttttttttttttttttcccctcttctctttttgctaatccatcaatcctcaaggtttggctcccattcgagttgtcaggcaggtgtgacaacaaatacacaagggaggctagcctgctgcacttcgaaaaactcaccagaacttaaagtcatcctcaggaacgtagagaccaggacatagggtccggacgatggtatagatgatgaggggccaagctggcgtgatggctcagcaggtatcaagaatctggtacccgcatggaaggaaagaattcctgtgacatgtaccacacatgtactcaaacatgcatgcattagccttttttttttttaaagtaagaggggcctagagagctggcccagcagttagggcacttgctcttgcagagcccctgagctcagttcccagcacccacgtggtgtggtttacaaccatcataactccactaccaggggctccaacgctttgtgactgtggtgaacacagggtatacacgtgggcaacattcagccatgtatgaaaacatttatacacagatgcagaggtgtttcagtgggtaagagcaatcattgtacaaagttggggacccaagtggggattccagcacccaggagtaaaacctgagtggccaggaatgcctataactctggtactacggagggcagagactggatgacttccggagcttgctatcctttagcctaactcagcatttgaggagaaagcctgcacccaggggatctgcgtgtgatagaactggacgccc

SEQ ID NO: 30711 - DNA, 1183 bp, Mus musculus
gaggacagccttgtggctcctagcaggtctgtcccctgccaggaggtggaggtggccatcacagtaccccgccgctccttgctggtgcttacaggggccgcgaggcaccagtggacacacgccatccaccgcagacacatcaaggcccgccgtgtgtgcgccaccttcagggagctgtccagtgagttcctgcctggagggaagcagcaagaactgggccaagaactgctgcaggctgcactctcgttccaggggagaccggtgtgatgcttcccagggcccaggagctgtcactggcctggccaaaagcttggctccagcacaaccatcggaggagctaacactgaggtctccccacagcagtagattcgtggggtttttttgagacaaggtctcatgtagcccaggctagcctccaattaattgtgtagctaaggatgaccttggactcttgccttttctacctcctcttcccaagctctggcttgattattttgttttgtttctctttttgggacagggtctccggcctagactggcctcagactctgtttccagccaaggatgactttgaactccggatcctcctgcctctacctcttgaatgctgggattgccagcgtgcaccatcatatgcaatttttgtctgtgctgggatggcagcaagcgttctgccagctgagctaccccacccccctagcctgttgggggtttttgagacaaggcctcacatgggctagactggcctggaactccccatcctcctgcctcagcctcccagtcgctgaggtgacagtgtactggtgaggttttaggaggagccatctgacccttgacgtcatgagcatcgtatgtcctgcccggagctggttctgctgggcctgggctgcggccattcctcagctcactgagtgtcatatgtggagggattgagtcttttagaacttcagtacttgggacgagtaaggtggctcagtagctaaaggtgctgccaccaagcctgatgttcagtctctgcaatccacgtggtaaaaggagtgtcccctgatctccacacgcacatcacccattttgataaaattcataataaaagaaaaaccttggtctcatgtgaaatgaatttctccttttcccatccctgtgtgaagtagttgtagttattttgttttgttttaaaacaggg

SEQ ID NO: 30712 - DNA, 1156 bp, Mus musculus
gtgtgtgtgtgtggtgtgtgtgtgtgtatggggggttactgtttgtaaatacgtacatatgagtgtaggagcccacagaggccaggagagggctctcctttccttggagctggagttagagttgtgaatcatctctgtgagtgctaggaaatgaattaagggtagagtagtaagtgtgcttagctgctgcgccgtctctccagcccctcgaacactttacataggctttgctttatgttttgctagtcttgaacctagggatttgcgcatgcttggcaagccgtgtaccactgagctgcgtgtctggtgagtgcatgcctgccactctccagcccctacaatggttttagagtcacagaaacctgtctcatctcgttacagttagtagctggtttccctcccttacccaaggcccttcccttcccttccctctattgcagaattcagcacagagccccacagtgctcagtcagcatctggctgtatgcgcctttgactgagacagctgctcagacttactgggccagtgtctgtacagcatcccccaccagggtttgactgatgtctcatgtcatgagctggagctgcatcaccagcttactgctgttggtgctgatgttggctgccccacagaggcagtagttatcaggtatgctcaccaaaactcactgctcttcctccaggaacttactttggaaagaagtcttccatgtgcagcccatacaaaggattaaggtctagtcaggcgcctccaacctgaagtcagggatctacaagttaggaggtggtctctccatctgcaaaagtgtttgtgacaacagacctatgtgtgtgacccagttttctttcccttgttggaattgtctgttgtccctgtgcctgcctaccacaagtttccagcacttccttattttctgtactatcagataccccaggctcatcttgggggtttcctgccctcgacctagcattggatgagggtccaagataacttatcttgtgttggcgcaagatcatgggggtgagagtagaaggaatcattcatctttgactggcagttctgttgtgcaagtgccgtagagtgtgtgcctattggtgactgtgacattgctaggtgatgtaacctagtgggcccaccatcataacgatagactcc

SEQ ID NO: 30713 - DNA, 1222 bp, Mus musculus
tcccatgcctgctcctgctccagcctctggcatagctcccaacctagtgtctccagccctgtagtcacccatcttctgcactgtctcagctgtgttcctcttccctcaggttcgccgatcatctgcacaaattccacgagagtgacaacggagcagcagctggtgacttatggcagtgacccccaggctcaccggagatgtgttggctgctgccccctcccctgtttgatcagctgcttctaatgatgtagccttcccctctcccactcccacccccccaaaaaaaaatcccccatggaaactgtctctgtcttcagctaacagctgccaggagctcagatccccagctcctttcaaaggttgtcacggcttcattggagccctaaagttcaaacaacccagctagtctgacacccctgaggctccaccctcggtctagtcacctgacctgggctccacccacatcagaacctctagccctggtggcagagttttctgtgatacatattgtcactacccagtctggcatttctatagcctctcttaggaccccgccacacaataaaatagttgggaggctcgtctaggccccaggcttttcatctgccctattacctggcagggcgggaagcggctttgataaaaccttaactgtaatcccgaagacagggagcccatagagggcgggatggtttccactaccccttccctgcacccagtccatgatttgagttctgcttgcttctttagcaaaatattctggtttctagaagaggaagtctgtccaacaaggcccctgtgcctcaggcaccacagaccacacggtctgaggccccagcaaaaccgatcctgggccacaatagcaaggccaactctcaggacctcaggcagaccctcctctgctgggtttaatcttcttcagcttcgcaagaaataaagaatcattgcagccacagtggggtcttttattctgtgactcctcagctgaacattgagtgtctgagagactggtgggtgcctgcagcacctgccccctggagcttacctggcatataggtaggctctctcccattcttcctatcctcagaaatgctatgagtatgtccagagcattcctggaacccagaccagagtgtcagagtttgttgagtacagccccctccaaaccagaaatatattctttattcccaaacaacctgttggatctcagtattacagcctg

SEQ ID NO: 30714 - DNA, 1222 bp, Mus musculus
cgtctacatctcccccgcacttgagaaacttttaggaagcagaatgaaatgtttcctataggaaagccagtgtagagccagataattgagctcattgttttccttcacggcttgtttgccctttcattctcttcctaaggtgctagatgttgaggaatgtctccatttgccagaaagacagtggggtgtctcatatttccccgccagaccgccagttctgaagcgagcctgcagaatgaatttttaatgctgaatgttatggcatcgctcctgcaaccagccgcattgctctcctgagcctacagatttactgctcggatgagcagagtgaggacttgggggcactcaacacagtgaggattaaccccctaataaccacactggtgccctcctagcttcagaaagataaccctaaggagtcaggagggaaaattaaaactccgtagtgttctgaatgttctccaaacagcctggagcacgaagcagggcatagtctccgaattttatcagacagtgtgtatttttaccttttcactgttttagctgtgactgttcttacttggatgtatttctgtgatctttccacccttaaaaaagctttacaatttgcaaggtttacagaatatacagaagactggagactctccagttcctatgaaaagcccaaatgaaatcagaagtccagaattggtcgctaacaatgggaaggggtctgttcgtattcactggctaattctggtttaggccatatggttaattgttattttcccctcaggagctttctatatttttgaagttttcaaaattaagaacaagttatatataaaaattgttcaagcctaaataagttggagaaaggtagaatcttcaacaagcagtagaacaaatggctgagaatatacataataagctaaggctgcgctctgtgccaattaaagcctggatgtcttaaatataaatgtaaaagaaatcatgaaaacacgaagatggattttaggtggggatttatataataagtgggtggaagagcctttttaagcatgatgccaaaagtagagaacctatgggatattcaaagctttgtggaggtggagggtggacaggatataagagtgatatgaggatggagaaaacatttatggtgtgtaagtaggaaatggccaatatataacttcttgccatgacaaaacattagaggtcagcagagtggatggatggatgg

SEQ ID NO: 30715 - DNA, 1196 bp, Mus musculus
gattcctgtgaactgtcagttaagaatcagggttctggggggagaatttcagcatgggctcagtgtcatgaacaagagtgtgcatcctgtgctatactcaacactaaaatacaattggatggagggagataagaaagggtaatgggaggcaaaaatgtcaacatacatatatacatatatggaattgccaaagaatagtgaatttaaaaaagggaacaaccaatttgctgtgaagaggtattttttaatgttagattaattcactgaaattatataaatgatattattttccaagactgtttattaaaagcaagaaaaaaatgccaaacacgttttatacacctgtaatcgcaggattcgtgaggctgctatggaaggaccccaagttctaggctgctttggctacacagcaagaccatgtctcaacagtcctagtcccccaaaaaatgacatggaaaaaaatcatgatatgacttaatataagaatcacacatgttccctcaaccaaatttaagagaaaaaagaaaaagactacacaaatgcatgcacatatagctagcataagcaaatattgaacaatgcatggcatggtttgtgtgtgtgtgtgtgtgtgtgtgtgagtgagagagagagagagagaacgagaacgagagggcacactgatatgcatttgacatgtggagatcagagaacaactttctcttcttcccttatggattctggggatccaacttgggctgtcagtttgtacaataagcaatttcatctcaccaccccaactttgttttctaaggcagggtctctcattggcctggaacacactaagaaagccaggggtctgcctgtctctgcctctgaagctttgttacacaaatgtgatcctctggggtgttttgttttgttttgtttgtttgtttgtttgtttgtttgtttttaatggacctggttcttgcaaggcaagcactttattgacttgagcgtttttccccagtattcataaatggaggttaccacagtatggaccactgagctttcaggatcctaacatgttgtgtattgaccattgtttgtgaagggtgattccacactctcagtgttagcatcctgtgttttaaagttagtgcagtggagtagtgccttgcaaagtgctcaaaagtgattacaattagcatggtggcgcacacctttaaacccag

SEQ ID NO: 30716 - DNA, 1191 bp, Mus musculus
gctggctgcttataagctgcggaagggctcttccctctgtctattgtggaactctgagtgcttctgccttgtgcctgactcaggggctgcagggtttttgtagcagagatctatgtgtgtcccgaactactgctgctggtatgtggcttgctgtccccaaagacacagagagaagaccagtggcttgaaactgagggggaccactgggtagatgtcctagaaaacatttggtgggtaactcaaaagttcatattgtccacctatcccgagagtggggacatgggaaaggctgtcaactcactacaacaaccctagcctagcactgtgggaaaacgagactgtctaggccagggtgcagggttctgttcccaggtgtggaaatcccagattagagaccatggggacgagagctcacctgtaggaaggaccttcctcctctcccattcccccttccctcccatttttctggtatgttagcaactggccttggattgctcttgggatcagagtaaaggcataccttaccttttgatttgtttagactcctttgaccaacaactcagaaggaggtttcccaagcccagcactgggggctttttgcgtcactgttttagccactgttttcatgagtccattctggacacaaaggagccctgacccttttttttaatatataaaatatatgtaaagattggcttagaaataccttatttctttttaaaaaataatttatttattttatgtacattggtgttttgcctgcatgtgtgagggactttgatcccctggaataggagagacagttgtgcgctaccatgtgggtactgggaattcctctggaagagcagccagtgctcttaaccgctgagccatctccccagcccgaaatagctcatttctaacctgagcatttccattcactgctgcatacagacctaccttggtgctttctggattatatttaactattatttactctttaattacttaacaaattgtccaggctaaccttgagccctttgtggaggtggctcttagtcccccacttctcactctctgcgctcacatgagacctttttattcctgaggtgtggcttgacattgttcaggctgttgcttgcttcttatttttaactcttcttttgtcacttaagtaagatgtcttatttcttatttagtgttagatcattt

SEQ ID NO: 30717 - DNA, 1157 bp, Mus musculus
gatcatgtttctgctcagcaggcaagtgtggcgtcagacaggaagcctggctgctgctagatgcctcttccaggtgatgagatacaccacagcctttgcagtggccctaccatgccacagtggtacagtgtcacctgaagctggccatcctagagggaaggaattgcctttctcttccatccttgtccactgttgtcttcaaccctggcatgtatggtttgtcagcacaacttgggattgggaaagaaaggatattgccagttatggttgaaggtcattgtcagggagttagaagtggtttgcagttgttttacatgccttcctgttggtatgtaattatgttgtcatcccatagtttgatgatagtttaatgaaatctttgtgtgtgtgtgtgtgtgcgcgcgcgcgtgcacacactatttggggattgtttattgctgagatcttagctgttctaacacacacacgacctaagtttgtaatctttgcttgtttcaaaattgtccattcgaagcaggttgaaatccatggcagtcggctgccagatgaatcttctcaaaccattgattttgtcatgtgcctgtccagcaacacccacagcagcttactctggcatagaatggagaccacatgtcccaggctggcagatagaacttctgatagatgtctgtcttcagtgcatccaaaccgttcattccagcagaagcaagcccagaatcttgctggtgtggggacattgcccgggaagctccctctgcccatccatctgaggcttcagcctgattgcatgcattcctgcctgcctgcctggaggagtggcagactccctttgggaggaggcagactgaatggcaaggaggaggctttgtcagtgtgcctcgggctgcagcaggcaaggaaggccaagtatggaggtgggggcctcctgagaaacagttattggtggctaggggcctctgagctctcttccaggtgctatcttcctcctttagtgtatcagatggctgctggggcagcatccagccatcttgactcctgtggcacctgctgtccacgttaggttctacaagtactacctgccatactctctcctagggctgtgcacaattggaaagttgcctgagggctgtggcctcgttcaggggttagcctttcca

SEQ ID NO: 30718 - DNA, 1131 bp, Mus musculus
ttcatgcctgcacagcaaacactcttactcactgagccacctcccaagactccagcaaagagctttgatacatcgcttggcagacaagagcacactcactggccccattggaggcttgagtctgtcaagtgtatgctgctttgagtctgacctccctctcctctgagtgtccgtttttctcattaagtgaggtcgtttgtccctgctgggtccctgctgggtcccagttagcagccctgattcccttccacacctttccttccttcctgtctggcctcgggtggagatctctcatgaggcaggtcccctccctgggagaagtactcaccactgaactcaatgacctgtgtctgatctctgggacccacatggtagaaggagaggactgactcccacaagttgtcttgtgacctgcacacctaaacatgtacactaatgacgcccaaagctggggctggagagatggctcagaggttaagaggactcactgactgctcttctgaaggtcctgagttcaaatcccagcaaccacatggtggctcacaaccatctgtaacaagatctgatgccctcatctggagtgtctggaaacagctatagtgtgtacttacatataataaataaataaatctaaaacaaaaaaataacgcacaaagctggggtagagttagcttcatcacgccacctggtattggctgctcactcttgtgtgcctgccttgtctagcattttttttccctttgtccagtgtgctgaacagttttctcccaagttgacaagagctaaagtctccataagacccagatgtaagacgttttctcaattagtgattgatgggagagggcccggcccatggtgagcagtaccatcccttggctggtggttctgggttctataagaaagcagactgagcaaaccacagagagcaaaccagtaagcggcacccctccatggcctctgcatcagctcctgcctctaggttcctgttctgtttgagttcctgtcctgacttccttcagtcaatagaaaccctaagcaggaaagccagagtcttactacatagccctacttgacctatagaccacatagaccagactggccttgaattctcagagctctacctgcttctgc

SEQ ID NO: 30719 - DNA, 2181 bp, Mus musculus
attgaatcttctcaacaagctttgaaataagtcttttgtggcctcctgttacaactgagggagatagatgtagagagcttccctcagctctctgatccacgcaactcctgagtggaggagccaggactcaaatctgtatcttccctgcatccatgacctaaaaagtcctagtgttgggttgcaggagtttcacttacatttgctaggataagcagcccgatttctggactctgtggccctttaaaaatcctgctgcttctacaatctcttctttagcctgcccaaacctatctaatgctttacaggaacatgtgtgcccgtgagagacatgagctaaggcaatgagaagctgtgacgcagattctgacaccagccctcagtacataccttgtgcaccccacatggtataaggagctgggtctaggtgctaaggccagcagctcacgggcaaagtgagtctcagcctgtaaagagaacaaggcagatgtgcctccagagagaaaaaaagaacacatggagatgaaatccgggcttgggggcaaagaggaaccgtttaaatgtgtgtgtgccttgtgaaagaattacactccccgccccaccatcaccagatgtgatgacagtacttacataaggtactgtatgtagattgaactctggacctcacacattctggaaagggctctcccactaagccacatccccagcccctcactgggattctgggcaggcgctctactgctgagtcacgtccccaactctcttttgacttaattttgagactaggtcttactgagttgcctaggctggcctgaatctcactctgtagcccaggctggccttggactcacatttttccccctgcttagcctgctgagcccctgggatcatagacttgcctagttatacccatttgctgctgcagctaatacctttaaaccagtctccccccaccccagaaaaccttcctagcttagtattatcttaaattcagtgaagagaacagcagcttttccctgttcctccacatgagggcgctacaccactcagccatggggtgatgtgttcaagcctctcccacaacctttatgggtgcatttcttttctgtgtattctctaatgagaagcactgggccacctctgcatggtttttcttgccaatttctcttgtagccctctctcccagcagacaaccacattcagcacacccctcacttgtgcactgccatggccgtccgttccttgtgaccagccagatgacttagataataggggagtttgaaatgaatgagctgatactatctgtaggttaggattctgaccaaaaggtcttcagggctctaggggaagggattaattgaaataccttcccgagcatagggcttttctccagtgtgaattctctgacgttgaatgagtttcatgaatcttgaaagccatcacgtggtcactgttgttggtagatttctgttgtgcaaaagtagccagggtgcttggatgctggctgcctcctcccacaccctcgggacactctcaggtgaatgttggagcagtgttaggaaactgctttgtgttcctaacagtcgatattggttcctgctgttacaactgttacaatgttaaataaataaacttgatccagactcagcctcgcttttttgttttgttttgtttggggttttttgtttttttgttttctcgagacggtttctcggtgtagccctggctgtcttggaacttatgctgtagaccaagctggcctcgaactcagaaatcgacctgcctctgcctcccgagtgctgggattaaaggcatgtgccaccaggcccggcgagacagggtttttctacgtagctcctgctgtggtggaactcgctctgtagaccaggcagggctggaattcacaagatccacttgactctgcttcccaagtgcgagcatgtggggcttaaagaccagtgccaccacccccaaatggcaagaaatatttatttcttctaaataatatatttggcctattcccaccagtacaaacactgtaatattgaataaatttgatccagattcaagatgtaggccatactttatttttttaatgtatttggccttttgtggagggttgtgtggtacacgtgtgtgtactcgagtatgtgtttaggtcctaggccagccttgggtgctgtt

SEQ ID NO: 30720 - DNA, 1123 bp, Mus musculus
tatgtttgttgtatgtgctcgtgtgtgcagttgcatatgccaataaggagaggacttcggctgtcccaccttactgccttgagacaaggtgtcactacagtacatgtgggatcccttacgaagtcctgtccctccaccaccctgaccgtcctggggttacaggcatgcaaacagccatgcttagctttttacaccatgctgggaatttgaactaagagccccatgtttgcaaagcaagcactcttgcccactgaaccatctctccagtccttagttcatctttttctgccccagggttgcatgtagcccagctcaggctggcctcaagctatgtagcccaaatgagctcctcatcctcctgcctccacccctcaggggctcagtctacaggtgtgcccctcagtgctggtttgctgcctggttcctcttgattctattttgggcacagaaaagaacctcttaccaatctctcagtgaggattctagttctcagaatttgaccaggggtcattgccatggctacggagatatgtgaaactgtgcttaaaaaaaagaaaaccttctctgttaactctagcctcacactcaaacaaaggaaatctccaggcctgacagcttcatggagggactctgctcatatctgaagaaatattaaaggccaagcacagtggtgcaaagccacgattccaggtctccagaggcaggaggatcgaggccagcccaaactctttgagaatctcttgagatctcagaaggaattttttttttttttgagatagggttttactatgtaactttggaactctctatgtagaccaggcttacctcagactcacagagacctgcctgcctctgtctcctaagtatagagttctctcgaaatgaacatataaaaggtctggggagttggcctctggaacaggatgcacgcattatttaatatgtgtacagttcaacccacagcactgaagagctaaaacatgccgagccagcatagcaatgcaagtggaccacagcccagctgcgggttctcacctagcctggaggaaactctgggctccatcccacctggtgctccagatgtggagccagaggatgggagagttaaaggccatcatgaaac

SEQ ID NO: 30721 - DNA, 1103 bp, Mus musculus
caacaggggcaggcacatgatgcacagacacaggaggcagaggcagtggagttctgtgagttaaactacaaagtgggttccgggacagtcaaggctattacacagagaaaccctggctcaacatgccctccccccaaataaaattaaatacaaatttaaaaagaaaaatggggtcaaggagatagctcattggataaaggaatgtgccattaggcctgacaacttaagttcaattcccccaaatcccacatagtagaaagggaagaactgactatggaggctggcctcccaccttcacacgcgtcctgtggcacgcatgtgcttgccaacacaaacgtgtacaaaaattggaaaaaaaaatactattgcaccgaagtgtgaatcaagcacaaactgttaaaacattacccacctgaggttcccctatggatgtagaattgtcacccagggagtgaccaagtgtggagggccatgatcatggatgggagtattagcagccagtctgttaggagatctccttggcctgcggaggagagagcggacactggatttcctcaagctggatgtctaggctgttgtgagccatccatgcaagagcagaaagtgttcttcccatctctgcagctcccaaggcttgctctcctctaagatcctgttctcacttctgcaagacctaactcggtcacagacccctttacaagggtggcctgacccaagcagtccccactagacctcagttttgttttgtttttaaagatgtatttattattatatctaagtacactgtagctgtcttcagatgcaccagaagagggcgtcagatcttattacgcatggttgtgagccaccatgtggttgctgggatttgaactcaggaccttcggaagatcagtcggtgctcttaaccactgagccatctctccagccccttgttggttttttgtttgtttgtttgtttgtctttgtttttcgagacagggtttctctgtatagccctggctgtcctggaactcactttgtagagcctctgtagagcctttgtagcctttgtagagcctctgcctcccaagttctaggattaaaggcatacaccaccatgcctg

SEQ ID NO: 30722 - DNA, 1184 bp, Mus musculus
agaggagaggggaggggaggggaggggaggagagaaaaaactgtggtggtttgaatatgcttggcccatagggagtggtactgttaggaggagtggccttgttagaggaagtgtgtcactgtggggggtgggctttggaggtctcctcctatgctcaggctccacccattttggaagagagcttccttctagctacctgaggatgccagtctctcctggctgccttcagattgagatgtagaactctcagctccttctccctatgtctgcctgcaggctgccatgtttcctgacatagtgataatggactaaacctctgaatctgtaagccaattaaatgtccaagagtcagtgagggtgaccttagctctgaatcactacattggggatatggcaggaaccccagtggagggataggcatacaaacccacccacaaaactttcaacccaaaatttatcctgtctataagaaatgcagggatgggaggatggagcagagacaggccaaccgataaccagcccaacttgagacccatcccatgggcaagcaccaattcctgacactgttagtgatactctgttgtgcttgcagacaggagtttagcaagactgttctctgagaggctctacccatcagctgactcagacagatacagacacccacagtgacataggggatgcagcttgtggactcttttttttttttttttttctcgagacagggtttctctgtgtagccgtgtcttggaactcactctgtagaccaggctgacctcaaactcagaatctgcctgcctctgcctcccaagtgctgggattaaaggcatatgccactactgtccagctgcatgtggactcttatgaaagaatagaaggaaggaatgtgggccctaaggggataggaactccacaggaaaaccaacagagtcaactaacctggaccaaccaaaccaaataaacgggctggaccaaggcttccctgcaaatatgtagatgtgcagcttggccttcatgtgggtcccaaaaaactggagcctgtccatgggatatgttgttctagctgggctgccttgtctggcctaagtggaagaggatgtgcctagccatgcagagacttgatgtgccaggattgggggacacccaagaggggcccccacccgctcagaggagaagggaagtggggg

SEQ ID NO: 30723 - DNA, 1103 bp, Mus musculus
gttggcatagtcccagaggctgtcaagggacgacgctgggaacagaagactgctgtatcattagtcagttgactttgacacaggacctctaacctgtgcgtcctgcttcagctacctcagtgctgcgagttcaggggtgccgccagctctggggtctctaaaagcaaatactgtccccctactttgatcagtttggacttttaggtttcttttacagtagagcacagcagtgggagtggtgtcagcatttgagtcctgtttggagacacagtgcagaccctgaggagactgtagcactgcacagctatttagtgccgaagtggtggctgccgcaccacggaactccagcgctagagaggctggggcagcctgatggggagtttgaaacaagcccgggcggcatagtgagtgcctatcttaataccgtcctacggggatacacacacacagaatgaaatgaaaaacaagtcagacaagggtcactcagggaagatgagttataggaaaggggggcaggttgtgggcctagagtggtgattcacacctttaatcccagtagtaggaggagtagcagaagtaggaggatctctgagtttgaggccagcctggtctatagagtgggttgtaggacagccagggctacacagagaaaccctgtttcaaaaacaaaacaaaagctcagtctacggagtgcatgtttgctgtgtatgaagccctgcttcaattccattcccagcactgcataataagccagccgtatcccagaccattcaggaggtggcaggaggagcacaagttcgggcattctcagcaagatgagtgtcaggcgggaggtgaccttgcagtaggacccatggctgccagtgggaatgcacccatccatacagactgcggggctggctcctggtctccaccacaggtgtttgacaggcttacggctgtctcggggctgtaactgggaagctgcaggtgatagaaactggtaatggaggtccaggaccatgaccctcccaggatcctagagcaagtcagcgtagcaggacccatggaacacagtgttagaaggagactccatctttctcttctcccttccccctccagag

SEQ ID NO: 30724 - DNA, 1239 bp, Mus musculus
ttggaaccaacatggtagcgtgagtagatgtggcttgagacccggaaagaggcagaagaggcctgtggcctctgtacggaagttgccccaacaaccaggaccccatgaggatgaaaaccaaaaaggcagttttgggatggatccaactcagctgttttaacgagcgagagagcagagactataaatgtatcccatttcccagtgagaaatggccttggagacaggagagggttggccacatttagctattttagagccccgtgcatccagcaacccagcgcaccttctgggacctctcaccgtgatgggaaagtcatctcggaaatacttccagttgcggacccaggcagactggcgacccctcatcctgggtatgtgtcagtctcgataaagccagagcaggtagagaaccacaagggtccaagcccggcctagggaggctagaatcaatgtcaccaggcatagcagggctggagggcaagatagagagcgaggctaagagcccagatgtgcagggctggcaagatagctcagcaggtaaaggtgcacgctgccatgcctgaggacctgggttccatcccccaatcccacatagtgaaaggacaggccaagctgctctctgttccacacacatttgctgtagcataaacatgccaccccacaaatatatatacacaatacaatttttttttaaacaacccgaagatgtaataagccctttcctcccctctggcccaccctcccaggcctatggtatttaagccctagattccattaaggaccccagaggtctgttctacctcattaggatcatgggagcagagcaccaatagccaggtctgtctggttccagtggtttgggggctcaccaagtcccaagaaggaaaagacccactggagcacagccaacacttgaaggctccggtgcagggggctggaggaggctggggagccccccccctctccccacccccaacctacacactgagccacgtggacagtgaactgtgaactgggacaaggcaaagatattcctccctgagcttgcaggagccccgaccagcaggaaggggcagtgggaaggacctgggtcatagccaggagcctagggcaaagtgtttgaattccatagttagagagatctgagatgaactgggatgtcgccccctccccccgccacacacacaccatggcctttacaagaacaagcttgaaaaccccatagtcactgcctgtgtc

SEQ ID NO: 30725 - DNA, 1178 bp, Mus musculus
cccccccccactctgattccttcatctcgcccaccctgtctacccttcctggtgtctatgtcacccctgtgtgtctcaggaggatgagtcgccgcgcagtgtcctggaggagatgggcctggcatagccccgtcagccagcggggggccctgtggaccgggggaagacaagacaagacagcacttgggggctgtttctctcacctctcccccagaccccttctcttggagggactcggctgcttttcctcggccaccttacctactttagaaggagctgtggctccggcccttcgtacaaacattccctccttccaaatctcccttccctccaccctctacctctcccagcgaaggttttaggatctagaagggaggaaaaacgtgacctggatgggggtgctcagtggcttccattttccttcctttgaagaagcattgttgagcccagccatccctcgccctccatgtgccctgtatggctgtaaatatataaatacgtcaggttaaagggaaaaggtttccagggctcttttctctcctctgccccaaaacctacctccacgcctccccataaccagccagggcagcttctctgcctgggaggggctttgtcctctccagcccccacttcctcctgggctccagtgtccagccagggccagggaagggagccacagagttaacgtttttctaaccttgctacttggagggaagggaaggttgggggagaggcctgctttctgggacactgaccctgtcccctttcctccactccacggtgagggtgcggcaggagccaagcaggtggcatgggccaagtggctgcctttatctcctttcttctgaaataaaaggaaaaagtgtttctggacttgactttgccttggctttgttggagaagacggacgtccactctgaggtcaagggcagcttcctgctaatgtcttcctgggagctgggtcattgggaagaaatactaaacatagaagacgcccagctggatgtcagatagacaacaagttttgttgttttgttttttggggggtgttgttattgttgttattattttatatgctagaataatgaagcctgcggcttatgcattcgaggcaggcactaccaactgagctataagccctccattgttcagtcttgctttttgaggcagggttttgc

SEQ ID NO: 30726 - DNA, 1125 bp, Mus musculus
ggaagtatctatgagcaaggacttataaaatgaaaaagaattcatcaaataaaaccactggcatacgccaaagataaaagttacagatgtgttctgaagaaacatgtagattcctggcactatgaaataatgcctcccagagagtcatttagcaatatttgccacaggaggatttttttatttatttattttttttttgggatgattgtaaaactatgttaatctcagcctgcctagaattccccagtgagtggctcactggtagagtgcttacttgatatttgttccgtctctagcactggggcgggggcagggggcgaggatgtcatccccctttggggaatgcattctgggaagataattcagtagcagaaaaacatttgcagagagacctttacagctgcttcattaactggaaacccctccgtggtgaggcagcggctgaatagattgtggtttgatagaatgaacgtctgtggatcacaactatgaaaagtatttggaagaaaagtatgtgatgtagtcataagagagagcacagggctggggagacagctcagtggctaagaacgcttgctatccagtctcgaggacctgagttcaaatccccaacacccatataaaaagccaggtgtggccacgtgtaccagagctataagggtagggggcagagtctgagatctgtttactgccaggcttacaggttcatcgagagaccctgactccaagtaataggagagtaacagcatggacccttggtgtcctgtggaccttgtgcaggtgcgcacacgtgcactcatgcatgcacgcacaaggaaagactgaccgggcagattctgattgcgtaatgtgagccactggtgggactgtgtccaaatagttgccaggcagacaatggattcccaatctgtaaatagtcaatgatttgtttcggaggttacatctttttgagttattttgggctggtactcacatctgtacatttccatttcagttagtattatatgcttgaagacttctataaataatatttaagaataactaactagttggccagatgtgatagtgcacactggtaactctagcacatagagtgaggcaggaggattgctattttgggaccgg

SEQ ID NO: 30727 - DNA, 1184 bp, Mus musculus
gtccaacgtctccatgatttcaaggtccataaagattagccatgttcccttagctctaaaataagagaaacaccatgtatcttttaaggccattatgggcccaacggaaaggcattagtgatgcttggatgaatggtgggatttaatacgcaaaaaatggatatctgtaatatataatcttagaggcaaatcacaaaaccactaaacagatagttagccaatctgaagttaaataggatttaacttttaaataggatgtgacatttaaacagattatgaaatctctataagacttttcttatgctttctgtttcctggaatcttgtttatttatgctttttgttagctatcttggcaaaatcccttttcagaaatgttagcctttatgtgaatgaagtgatgtgatttcatctgtgacaggaggggtctggggaggcgctgaagcccaaaggccagcatgggagaatctgggaagtcagcagtgatggatgggggacctaaggcgggaggaggcataaaactctggagatacgcttggaggtgagtcgcagtcacctcagtgtttttaatctgtggcagcgtctttggatgaagacggtaggggtggctttggagggtgtgtttagccagggggctatggagaaatgaggctgaagagacatttaaggtagggattattatgacacagtgtgtgtgtgagacacaggggcctttggaataaagtccagatggaagtttaaggatagagaagggacatctttttctggacagaattccctgtttgtagaaaccaatgtagggaatcaccaatgtccagatttgattacatataaaatttaaaagctagatatggaggtgcaagcctggtataatccccaggactcagttggtgagagcagaattgtgagttcaaggccagcctaggctccatagtgagccccttcaagtggggctctggctctcagttggtagagtgcttgcctggcataaccgacccctgggttcgatccccagcactgaataaaaacaggtatagcacatacctacagtcctggcagtcagtcggaatgggagactcacaagtccatggttatccttggctaacctagcaaattccaaaccagccaaggctacgtgagaccttggctaaaacaaaaccaacaaaactgctcttaaaaaagcaa

SEQ ID NO: 30728 - DNA, 1071 bp, Mus musculus
ttgagatttagaagcctgattcttgatttgtattcttcagaaccattcctgggatggggtcaggactcctctgtaaagcacttgcctagaactcaccaatgagagactcagtagtagagtgcctgctaggttctaccagtgaggagtctgggcatggctcactgtagagggcttgtctagaatgcaccaatgagggtgggggcgtggctcagtggtagagcccctgcctagaatcccccaatgaggggctgggggcgtggctcagtggtagagcccctgcctagaatcccccaatgaggggctgggggcgtggctcagtggtagagcccctgcctagaatcccccagggaggggttgggggcgtggcttggtcttagaagacttggctagcctgctgaaagtcctgaagtcaattcccaggcatatcttccttcctaaaaaacaaaagaaaacaaaacaaaaccttggagcaggtgaaagagaatcctaagggagataacataagtcatcctccaagcaaaggaagaccaagtatacgtcaagatatgttaggcatgctggaaagaaggtgagaactggccattctcaaggggaacatggggtcagaggaggccagagatctcagaacaacaatagcattgccaatccatcggagtagaaactccctcaatgaagtatggggtcagaggtcaggggtcagagagtgcaggcacaagcagaagtggaggtatgagatcaaatccagatgcagcatcacacacactcacacacacctgttatcccagcacttgggaagctgaggcaggaggattatatgtttgagcccagcctgggctatacgcagagactgttaaaaaaaaaaaaaaaagctggactctctcccaactctcaggcaccagcttctgtcccacagagactccatctttggccgcatgttcaagtggttcagcaaagatgcccaacgttaagagggagtcgaactcttccagatggtggttgaaaggtgtcagcatccacactcgtgggtcctgtccagagggcagggttgcctcggcagtgaccgtccttgag

SEQ ID NO: 30729 - DNA, 1197 bp, Mus musculus
aattatgtctctatagctccgggagtgtgaactgagtcccggtgtgaacagagacctgacccgtcgtgtccgcaacataaatggcattacacagcacaagcagatagtgcgcaatgacatcaagttggcagccaagctaatccacacactggatgacaggacccagctctgggcctctgagcctgggacgcctcctgtgcccacagtcagtgactcccaggggatggtttctagtgtacccaatggttccttgtgctacccctgacctcatctgcttgttttcctgatccctgggtcctatccataacctcctttgtttgcccctttgtctggatgctacctcctctagcttccaacagcatagtcatttgtgggttaggatggacgaatgagattaggagacagggtttgtccgtgatgctgatcctgtcttcatggcccagtttctgcgctgatttctctgccttactgtccatgtcctcctcgctagagcctcccctcgcaaaaccccatcctgaagaacatcactgactacctgattgaggaagtgagtgcggaggaggaggagcttctggggagcagtgggggaccccctcctgaggagcctcccaaggagggcaacccagccgagatcaacgtggagagagatgagaagctgatcaaggtgccagttccgaccatctggagcatgcgtccaggggagtgcggcatgcggctttctgtatcggggctgaatagtgaccttgtgtgtccaccctccccgccccccaggtcttggataaacttcttctctatttgcgtattgtgcattctctggattattataacacctgtgagtaccctaatgaagacgagatgcccaaccgctgtggcataatccacgttcgggggcccatgcctcccaaccgaattagtcacggagaaggtacgttgcaggtccctcatgttgtctttcatggccaacctctgtctactgtccctcctcttcccccttgctccagtctccctctcagcttgcctttgtcacccacacagtgctggagtggcagaagacatttgaggagaaactgactccactgttgagtgtgcgtgaatccctttctgaggaagaggcccagaagatgggtcgaaaagacccagagcaggaagtggagaagtttgtcacctccaacacgcaggaactgggcaaggataagt

SEQ ID NO: 30730 - DNA, 1160 bp, Mus musculus
gggtggttttagtgcacccctttcttgattttaagaccttctgtgggtgtgagaggctatgccctgcctttcttgggcccctccccacattctggtcttgactgctcgtaactgttttgtctctcccatcctgcttgctttcttgtccaggttccgatctaagtaccaccctgatgaggtgggaaagcgtcggcaggaggcccggggggccctgcagaaccggctgaaggtgttcctgtccctcatggagagtggctggtttgataaccttctcttggacatagacaaagctgatgccattgtcaagatgctagatgcaggtatgggcttaaagggtagggaggtcttggctgggaggttacagaatagaaatcagagcctttgggttgtgacctgctgttgtcattggtagctgtcattaagatggaaggtggcacagagaacgatctccgaattttggagcaggaggaggaggaggaacaggcaggcaagactggggaggccagcaagaaagaggaggcccgtgctggaccagccctgggagaaggagagcgcaaagccaatgataaggatgagaagaaagaagatggaaaacaggtcgaggggcagaggctgagggagctggaagctgcactgggggtgtggggggttggaggggggtgactaatgcagccagcaagaaagactgacattgtcagaactatctcataggctgagaatgacagttccaacgatgacaaaactaaaaaatctgagggtgatggggacaaggaggagaagaaagaagaggctgagaaggaagccaaaaaggtaaggtgtgttttgcatgagaccaagatgtcggggcggctcctgaggggtcttgatggcctcctcctgttgcttccacagagcaagaagcggaacaggaagcagagtggcgatgacagcttcgatgagggcagtgtgtccgagtctgagtccgagtctgagggtggccaggccgaggaggagaaggaggaggccggtacttgtcactttctcgcttctgctcctttgctttcctgtgttgggtgagggtgtgtgagtgtatgtgtaagtgcgtttttatcaacagctcttcattgtgtagcttggctagctcccaaataaatgagaagactataagactttttgataaa

SEQ ID NO: 30731 - DNA, 1174 bp, Mus musculus
tgggctacataccaatactttaatctcaaataaccagttaaataatatgtaaaatgaaaaaaaaaagtctccagatgatgtctggccaggcaggtctcctggtccctcctcagtatcttcactgagccaaagtgctccctaatttaaggcctagttctttacctgtgtggtccctgtctgtatttctttctcctccaaggcaacctctgcagcttcttccccctaaaatctctctgaggactctctctttccttcttctacggaggccgctcagtaaatgtttggtgattactcttgcctttctcctcctgtggcctccctgcttggctggtcccgggactcctccaaccttctgtttttccacagggaccttctccgaattggagtcactctggcaggacaccagaagaaaatcttggccagtgtgcagcatatgaagtcccaagctaagccaggagcccctggtgggacagggggaccagcccagcagttctgacctccaaggactcaccaccgtggcagattcttctttccggggggcagagttgggtggggactcacaagatgagcccctccccctcgtcacagccttcccattggattgcactttgaacagagggggtcagagacccaggatttggggaaccgtgccatatgggatcatacatgtgccctccaggcggggaaccccaaactcagagtgagtctttccctcaagactgggcaaagaaacatccctacgtctctaacctcccatcttcccagagggctctctccccaagcgccttccacctcaacgggcatgtccctgcagaccaaagagaaagggtgaccagcctgccaacttgggagtggaaaatgccgtcccaggaggcaggaaggggctgtcaggacccggtgatgtaatcattgggttttgatgtcctgacttgctgtcaccaccaaaggcaatcatttttcccttgtaaatgcccctcccctcatctgccttcatattgaaggttctgaagttttactgttttttattttgttaattttttcctccttcccccctccctccccttcttgtccagattttgtgtgttaaagggcacctggttccactatctcctgttgggaacaaggacccatcgatatgttctagaacagtgccttggaaatgccacagccttag

SEQ ID NO: 30732 - DNA, 1152 bp, Mus musculus
cctgtcttgggtgatgctgagggcaccccgtcaggggaggtataactttattttctatgtactggagtccccagctaggcaacctggcagaaggttgccttccccacccctttttactgactgcctaggctaggggtcctttccacccaggccaaaactccagtttgccccttatcaaatgaggtaaggcgagaaaatcctttgaaaactgtgaagtcggttcacaattggccaagagctaaggttgtccccatgactcaaagtagagaaggggtaactgctgccctgcagatggtgggggaggggggctgtagcccttcgtcctcccactacacatggagggaggatatattttctatgtgtgtatgtgtatatataaatgtccacacatgtatgtgcatatctccattcgtcctgggaaagtggttaggtgattgctttgagtgtgaggcatttggggggttgactctgttaaccgtagtacaggaagttgctaaggtacattgctttaagttgcacaaagtttgggagaggggtagagtaaggaggaattgtccctaattgttgtcagcttgtgcttggagttctgagagccagagcagaggctgcctgctcccagacccagcctgagcctccagcaggggtcagtctttcaatagcaagggctaggggaggccagggctaggctgtggggaagggtcttacaaggcagagagagaggctgagttggcctgggtggaaaggacccctagcctaggcagtcagtaaaaaggggtggggaaggctagtccctaccctgctgcccatggtggtcttcattagaaagagcctcagatgccctctgaggagctgggatgggcaatcttaggctttgatttttcccccgtcatttttaaattacagtgtgtgtctgcgggcatgcgtgcgtgtgtgtaagcatgtcctgtgtgtgtaagcatgtcccgtgtgtgtaagcatgtcccgtgatattttgttggggtgacacagcttggaggagttggttctctctttccacggtgtaggtcctaagaatcaaactccggtcattagatttggccacgagcatctttatcagcggagctgtttcaccaacatgatgctgtttgttttttaatctattcttttccccgg

SEQ ID NO: 30733 - DNA, 1177 bp, Mus musculus
ggcctggggcctgcgggccaccctcacccactgtgtccctacccaggtacggcagcaggaattgttgctgaagctgctacagcagcagcaagcgacgaatgtccctgtgccccctgcacccagctccccacccccgctctgggctggcctagccaagcagggcctgtccatgaagactctgctggagctgcagatggaaagtgagcgccaactgcacaagcaggcggcaccgcgggagcctctgcgggcccaggcccccaaccaccgagtggtgagcacctgccccagggagcccctctgccgcagtttccaggagtgcttgggctggggggaggtgtccctgagctcatgttcctagagctgaagacctatgtcctttcattattagaaggatggcccctctccctagtcttcacctcctgccctccaatttgcccccaaatgagcctccctgcctagatgtccagggtcccattttagagcccctctgacttcctgccgtttgcagcagcttgggggcttgggctctgcccctctgaaccagtgggtgtctgaggctgggccactatggggcgggccagacaagagtgggggcagcagcggtggcaacctgggactctgggaagatactctcaagagtggcgggagcctggcccgaagcctgggcctgaagagcagtcggagcagcccgtctctcaggtgaggcgcctgcctagtggggcttgtcaggaagaagggatgctaaggtctgggcttatctgtggcctccaattcccctcctacctcagtgactcgtacagccacctgtcaggccgacctgttcgcaaaaagacagaagaggaagagaagttgctgaagctgctgcagggcatccctcggccccaggacggcttcacgcagtggtgtgagcaaatgctgcacaccctgagcactgcgggcagcctagacggtacggaggcgcctgagaggctctactggctctagggactccagacctgtccagcatgcttgactatcccctctctgtagttcccatggctgtcgccatcctcaaggaggtggagtccccttacgatgtccatgattatattcgttcctgcctgggggacacgctggaagccaaagaatttgccaaacaattcctggagcggagggccaagcagaaagccagccaaca

SEQ ID NO: 30734 - DNA, 2072 bp, Mus musculus
cctacacccctttgggaataatgggtgtgacattggaaggtccacagaggtttgtttttggttttttgttttgttttgtttttattttttagaaaaaaaaaaaaagataaaaaaaataatgaaaaaaaaagttaggctgaaaggaaaaaaaaaatcacactgttatttttggccagtgggtaccaggccccatggacctgtcctgcctggcttccctgaggctgcacttaccctgctgccccagaaggtgggtcattggggtgacttgtcagctgggtgctggcagtttgcacagcgagcgagcggaggccctctccagaagccccgcccactggacctgctgtgatcagctcctgtggccgttactgtggcaggtgtcctggtaaggggccagagtcgccccttacctcagctgctttgggaggaacgttgcacaaattggatgagctgcctcagctccctctccccacacccccgaaacagccctcccacactggctgagggagctggggaaagccctgtcagtgccagcctgtcagctgggctctgaactcaggcctgctgaggggctgacccccactgctgccatttcgggggacagcctgggtgtgacactgaaagccccagctccctgcctttgccacatgaatgtattttctggcccccaagcccgtctcaccccctctgagaagggactcagcccttcctccaggagctggagaacacccctccttttatcatggccgaggccttgcttgtgagggaaggacaccgaaggagtggcttggggcggaacctaggggggccccgtggtgagaaccccctgatcagcagccagctgtgtgggaagcagaccacagctccgtacctgacccctccattgaccaaatgggagaggagtgagcagcccctctccttgatgttttttgtgttgggtgtaaggctggaggtcgagagcgcctgtgtcctggctgggggctgccttgcctgttgctcgccgacctcactcctagccctcccgccctgcccatgcttgtcttcattgttgtttgcccccccccccccctttctttttaatatactgtgttagtgactctcccatcgacctcattgctcagaatgcagtattagggctagcgagcgagcctgccactgcctcctccatgaatgtatttctagtttctgtcctggggaagtagggagtggccccaggttcttctttcccatccatccccacagaggtgaccttttgttttcctttccactttttttttttcttttttttctttttttttttttttgcaccaaagtggcaactgggtcagtgttggggatcaggctggctttgggtggaagggcccctccacctgcttctccctggttttgacagtgttagcgtctgtgaaaagacaatattctctctaaagcaataagggggtgatgggccagggggaaacgtcttgctgctgctggccccccagctccctttccctcttgccattgtggtggcattggagggatgggagagactcctgttgtgactgaatgtaacctaccctgcccctgccacagccaatgcagggggagggagggcacttgtctcttcctacccctccccccagctaaagagactgaacttgggggcccatgagcctggagaggccttaaccctgtgaggaagtgtggggcctctcccaccccatcccctctgagagtggccaatgtttacaagccctgagccccagcccagggactcagaccccccccccccatcttaatcctttccccatcccagtcttacagggccccactgccccaccctacccccttggggttcagggtagtgtgggtgtcctgtgtatcccagtttaccctacctctaccctgtgtgacttccctaatacccactcttgtaaatactcccaataaaacttggtgtgttctcccagtctaccttgtctgccagcttttccatgactgagctggggtaagggcacagtggtggtggtggggtgcatctgggaaatgctggactcagcctcatgtagagcaagaatggggtacctgctatc

SEQ ID NO: 30735 - DNA, 1319 bp, Mus musculus
tccatgtgccgacagacattcataggtcacgagtcggacatcaatgccgtggctgtaagtcaggaggagtatggtgagctgcctgccccctgtatcccacacccctggctttgcctcacactcttatcatctctggcccaaatcttgcagttcttccccaatggctatgccttcaccacgggatcagatgacgccacttgtcgcctctttgacctgcgggctgatcaggagctgctcatgtattcccacgacaacatcatctgcggcatcacctcggttgccttctcgcgcagcggccggctgctgctcgctggctacgacgacttcaactgcaacatctgggatgccatgaagggtgaccgtgcaggtgaggactctgggcccacagaaggcagagatgggaagtgtgggccagaccggttcctacatccttccctttgttctccaggtgtcctcgctggccatgataaccgtgtgagctgccttggggtcacagatgatggaatggccgtggctacaggctcctgggactccttcctcaagatctggaactaacctccccaaccccagatgggcccaggcagggagcagccctgcccatgcccacactacaggcccggagctttggggctgggtacatgtgccaagcctccctccctgggctacagggcctccggtcctgctcccatacccaggtttggttcctctaggggggggcccccactgtggagataaaagtcggggatggaatgggggaagaggaagggcaggaaagccctcaccctttgctgccctggggccatggcctcacccctctggagggccagaggcaggaggtggaaactccaggggctggcttttttaactggttttattttaatttttattatattttcagtttttccataaaggaaccacttccaactctgtacctagtctccttgcttactgtccccctttctccagaaagcagacaggcagtgggtattgggctcctctaagcgatagcaggtaccccattcttgctctacatgaggctgagtccagcatttcccagatgcaccccaccaccaccactgtgcccttaccccagctcagtcatggaaaagctggcagacaaggtagactgggagaacacaccaagttttattgggagtatttacaagagtgggtattagggaagtcacacagggtagaggtagggtaaactgggatacacaggacacccacactaccctgaaccccaagggggtagggtggggcagtggggccctgtaagactgggatggggaaaggattaagatggggggggggggtct

SEQ ID NO: 30736 - DNA, 1484 bp, Mus musculus
ggctgtcctggaactcactctgtagaccaggttggccttgaattcagaaacccgcctgcctctgcctcccgagtgctgggattaaaggcgtgcgccaccactgttcggctcaagacccgttcttggatacataatgagtttgtggccatcttaggctacatgcatgtgaatccctgtttctaaatacgtaaatagtacacgaatcaaccccaacaacgtagtttcatctctcccgtccttcccgatccctgagagactgtggcccccagtgctcatctccctccttttgcagatgccccccagcagctggccaccagctccttcctgctcttcttgctggcaggcgtcatctctgtggccttcctgctcctaccactgcaggatgagcttggcagccagctgcctcaagtcctgcacgtgtccctgggacagaagctggttgcggcctacgtcttaggtgagcacagtggaggagtacggggccctcttccggagaaaggatagggagaggaaggcccctacatggactctctctctctctctcccaccttcaggcctcctcaccatggtgctcctccggacctgaactctcagctgaacccacctcacccaccctctccttcgcaggcagggacctaaggcagccactgtgatgtttgcaccttgctcctcctccctcgcttccgcccatccgttgctcctcctccctcgcttccgcccatccgttgctcctcctccctcgcttccgcccatccgttgctcctcctccctcgcttccgcccatccgttgctcctcctccctcgtttccgcccatccgttgctcctcctccctcgcttccgcccatccgttgctcctcctccctcgcttccgcccatccgttgattgtcagcctccccacagcaagcacctgggatttgtactcattttccaagttgattaaaatacattttaaaaatcaaaatgagaaacgtaggatgcttatcgcaaacttcttactttttctttttctaatggtgtgtgtgtgcgcgcgtgtctgcatacacatgtacgtgcgtgagtatgtatgtatgtatgtatgcatgtactcgcatataagagtgcacaccagagggctggtgagatggctcagtggttaagagcactgactgctcttccaaaggtcctgagttcaaatcccagcaaccacatggtggctcacaaccatccgtaatgagatctgacgccctcttctagagtgtcagaagacagctacagtgtacttacatataataaataaataaatctttaaaaaaaaaagtgtacaccagaggtcagaagacaaatttctgcattggttctctccttctagcttatggattctaggtactgagctcaggttatgagactcggtggcaagtgtgagccctacagtcttaatttttgaggctaaggctctcagtgattggctaggaccagtgaagcaggcgtctgcttgtctccacc

SEQ ID NO: 30737 - DNA, 1150 bp, Mus musculus
gctatgggggagctaaattatctctgttttgtagagagaactattagcaggggatgtgagcccagtatgggcccctggctctgtgtataaactgtatagattgtcacctctgtgtgtgcgtgtgtgagctcctgctgcagccaggtcttgtcctgcctgggctacctgcctgtgcaagcctttccctttggaaatgacaggcctctcctgtcccagtcccctgtgttaaccacccgtctgttacctgctggcagcttctatgtgtcatttgtccccaggtatggggcagtgtctaccaggagttcccaccctcttaaccttgctgggggaattcgagggggaaacctaacctgggcccctccccccaggagtccctgtgccagccccaccacatcctggaagaggaaggggcccctggaaggggcctccctcacatcgctgctgtccttcacgcacttctggaacagccttaggggtagaggttgggggctctgggccccaactaccatcggacctgtcctgggagcagatgacacctgggcccagccaattaacaaggacttggtgaccatggtcttgtgtgtagcactggccttggatatccccctgcccttaggctgcttcgggtacagcccccatctgggtgaagagcgttgtgtcaaacacaataaaaagaagcccaaaggcctgtaggttggtcctcaggtgtgtgcctgcctgtccatgaatgcgcgagctttttggggacctgagtcctctactgtgagtcccagtgtagactgctatatttctgtgcctggcagaggagctttaccggcacaagtgccccgtgcctctgccgccagggggagcccttgagaacctggtgggagcgtgccacgtggctgaagaaacgctggcgcaggcgtcgtggcgacacctctgaggtgggctaggacttgggcgctcatgtagtcagggccgcgcgcaagtgcaagcacggcggtgggtattgcctggtgcttcaccagtcgcaggatgttgccttggcttgggccatgggccacaggccaggaggaggcgaccgaggggctaggcctccccaccggcactggtcacggagaggccttgagctctggagaggaaaccatgaaggagcaagaaacgcctg

SEQ ID NO: 30738 - DNA, 1150 bp, Mus musculus; identical to SEQ ID NO: 30737

SEQ ID NO: 30739 - DNA, 1150 bp, Mus musculus; identical to SEQ ID NO: 30737

SEQ ID NO: 30740 - DNA, 1115 bp, Mus musculus
cccagccgcaacttcctccacacccaaccttccaaagctgccgctgtcctcccagatggaagcaaagctcgaatgtagggtaaagatgaggcctggtgttgaaagccaccagatagccctgggactgcggagcttctggtgtctagtgtttttgtttgccaggctcggccacacccacttctctccacctcagttcttcctagctgccccctcatcttgtccgtcagggtgggggagtttgacctacagagtatgcgtgcccgcctcctgtcaagcactttagttagccctgtcatgtttggataccagtgttttatatttataaatagagacttttctaatatagcctattatatacataaataaatatatatatgcatacacatatgtaaacagataaacaccgctggccattctttttctcctagacaacccttgaacttgggggacttgggtaggaggatcacaagttcaagactagcctggacaattttgggaccctccgtctcaaaggaagaaaaaaaaaaaaaacaaaacgataaaaagtaaaaacagagaactcaggatgtagttcagtggtagagcacttgtctagactcctcctgggaacttgaagaatagggtaactcctgcctgtgcctggataatcaaacccggagccccagggctcaggggaggacaaccaagtgtcctgacgctttccacaatacacacgagaaggggtaccccagaggctaggcttttccaatgaaaagtctgcgattggctggggagtttggttttttttttttttttttcttcttttttccacattcctccctctgttctcaaatatctgcaccaaagcttgtttggaggcaatgtcggaaaagattgcgtttgaaaggattaaaaaaaaaaaaaaaaaaaagctctgagtgtcttgttttgtgccagctggagtggacacaagtcagtcaacaggactgagccttgacttggatcttctgatcttcactgcctgggctgataaacacgtgacctgaactgcgcaccctctgttagcaagaagcccggagaccagtgagggtcccgatctggggctgaaaggtagtgatggcgcagggcggcaggtg

SEQ ID NO: 30741 - DNA, 1222 bp, Mus musculus
cggccagtttgatgcctccaaggcggtagaggagcagctgagaaagtcgttccggacccgctgtgccctggaggagaccgtggcggagggtgaggggggcaggcggccggccgggcgcggtggtctgggtgaagggcgatcctcagtcccgccttccctgcgctcgcagggttgaacgtgccgcgctctaagcgactctaccgagacctggtgagtctgcaggtgcccgaggagcaggtactgaacgcggcgctgagggagaagctggcgatgctgccaccgcagccccgagccccgcccctgaaggtgaaggaagggatgcagggacctggacatccctctaccccctgggctctcttcctccacctcgagtgtaacctgcttcaccttcccataggaggtgctcgggccgggcccagacatgaccatgctgtgcaacccagattctctgtggtccgaatctccgcacttgacagtggatgggctgcccccactaaggcttcaagcccggccccgcccttcagaagatacctttctcatgcatcggatgctgaggcgctgggaagcgtagccctcataactctggaatgctagtctgtaattttgttagttttttttttttttataatagaataaaatgtttccccccctaaattaccgaactgttcttgggagtttagataggattaaactgcttcagggtcttctacccttttcctgccccgacccccatggcaagtggaaagcactgtcccaagtgtggggtcagaccttcctctccatttaaatccccagctttagttattagaacttgagccttagcctgacaccgaggctccaagaatgtcccagcacttgggaggctgaggcagaaggattctatgtccaaggacagtctgagttacacaaattattttgatacggtttcaggcagggtaggttcagatgagtggtagtacctggggaaagcatgtacaaagccctaggttcaatccccagagttgagtgtgcaagtgtgtagtcaaacagtagtcaaagtgttttaaattccactttggctgggtgtgatgaacacttgaggtagagacagaatcaggaattccaggccaacctaagttaccaagtaactgtgtcaaaacaacactgcacacatactgctctagttgtacaaactattatttgtctctctacatagctctggttgtcttggaactcattatgt

SEQ ID NO: 30742 - DNA, 1134 bp, Mus musculus
ttttccccaggaaacaatctataagaactactttcgaatccagttgaagccagaacagttcagttcctacctgacatccccagaggtgggtttctccagctatgagcttgtggccacaccgaataacacctccagaggtaagaagggctcgtttttttgggctgggaggggatcgtcctggctgcaagggtataggccctgtggagaaccccagggtcctacccacctgcctctgtcttcccttcaggcttccagcgtcctgtgtacttgttccacaaggctcgatcccccagccactaagtggccttctgagaagttgtaaagaggctgcccttgctgctcctgaggacctggggggaaaggaaattattccaaggtctttcctaactccaaaaagtttctccttttcttggatctgtcaagagagcttttcctaagttgctaccccacatctcctccctgtcacctctggcacttgagcaagcccagctgtgctggaattccatcagcttcctctcctagcccgctgggctggatggcatggactgtttgctgactctgcccacctgggacaggggaagggggaatgtcgagttctccaggcccttcctcctgttctcaggggacttcccgcttctcctcagcctttgttcctagctgcacttaaatggaccatggatggactaagggtgttagaggggaagtttggtaaggagacacacaggtactgtgaaagtccttctgctgtcccccggtgggagggagctgggtttggaaatgtgagaacagcacaataaacttgataactagggcagtggcccccgcacctgtgtccagcactttctagcggtagtacctccgagtaggactatgttctccctttgcccgtcctagtccctctagggtggtttttattgggtgtggtgggacataggcctttttatgccagcacttgggatgcagagacaggcaagatctcaaggtgtgaggccggcctgggttgactgcatagtgattcagtgtctcaaagaggtaagcgttggggaagtcaatagtttagttttgaagactgttagtgcctgtcttagggttactattgctgtgaaacaccatgaccaaagaaagttggggaag

SEQ ID NO: 30743 - DNA, 1166 bp, Mus musculus
ggacatgagcctctcaatatggatgttgggcaccaaactccagtaagagtagaaagtgctcttaaccatttagtcatctctccaggccccacatagaaaaaatagttataaaggaataaagatgggaccaacaggagagtaacaagtttgagtaatgagaggaaatatgatgaaaggatcatgtaaaatttcatgccaaactcccttatatttttatacaaagtgtatacactattttttttaaagccaagtgtactggctggttttgtgtgtcaacttgacacagctggagttatcacagagaaaggagcttcagttgaggaaatgcctccatgagatccaactgtaaggcattttctcaattagtgatcaagggggaaaggccccttgtgggtgggaccatctctgggttggtagttttggttctgtaagagagcaggagaacgatggcggacgcggagacaaaacgctgttgcgacgaaagaggttctggctgaggcagcagccattctagaacctgtaggcttgcaggaagaagcagagctgcctgccaagatcatggaggagttcatgaggaagtcgcggaagaaagacaaactgctttgtagccagcttcaagtagtgaacttcttacagacttctctgcctcaggaggatactgaccagaatccagatgctttggcttctgaagatgcaagtcggcaaaaggcaactgaaactaaggagcagtaaaaggacatgaaggccacatacatggatcacgtggatgtcataaaatgggccctgttggaggccttaccccaggttaaagaggctcacaggaattacaaagagcttcagaaggcttttgagcaactcgaggctaagaagcgagtccttgaggagaaacttcagctggctcagaagcagtgggcgctgcaacagaagcgtttgcagaatctgacaaagacgtctgcagaggtcaagaggcgccgcgggaagagggctctggagaagcttgacggaccccaccaggaactggaaaccttgaagcagcaagcgggacaggaacaggggaagctgcagaggaaccagagctacctccagctgctgtgttccctgcagaataagctggtcatctctgagggcaaggctgaggacaaaatgtcaaagggcgagcccttaca

SEQ ID NO: 30744 - DNA, 1429 bp, Mus musculus
tgaagactgttgacatggacaccccgcctatggttgagatttcccctcaagaaacaactaaaatcaccttgcaccagttgttcactggtgaccagcagcaaaagtcggtgagacacaatagcagcaggtctcatcaggttggtacctgtgacctctgttccaagtcagactagaatcctacaaacaatcactggttcttgcttgactttatttcttagaccaatcctaatctctggcggcatctgagctgtttgcttagtgctgccagtgagtgttctatccatccagctgaaaatcaacagagctactctgaggattgcacctgactcactttctggagtgaggtggagataaagaggtgctttttaaggttctcttaaaggaatgagtcatattaatggtggacttttgtgtgagagctctggcctgtttggttttttgtcttgttttgtgttgggtttttttgtttttgtttttgtttttttttttttttaaagcaactgaaataaggtacaggactccaggagcacatcgagacactggctttgatcccaagaaaggactttggtcatttcccttttggctgcttatacacagacaattaaccacatgctggtgcacttcagccgttattctttgttcttaaatgaaattaagactgacctgtgatcccatccctcatttgatttccattttactggaacgttttactattagatagtcactgggatggctccagatcttccatggatgcagtcctggaggcagccacctgaaaatacattttacttagaaagctgactataggtggttatccaaatttcttagatgctcagcagtgtcactgcatcgtggtcaaatgtggtgacatctgtcgttagtgctcaggctagttaacagcctaagtgcttattagttaaccatcagcatgccgattgacatgatggaactttaagacttcttaaatgtactttacaacaaaagccagattcttcaagttttgaactttctacttcagcctggcaggcaaggctaagcattgatgtgtgagacaactttatatgtaaagcacttgatattaaaggtataatcgtgagactgttaaatatgtgtagagagactgacatgttaaatatgtgaggcagtccatgccttatatacatcagagaattgattccagaatgggaccgagtccgagtgtgatgcctggcaaaggttacactgtaaataaactctttctgtgaggccagctttatgcactcattgctttggacaggaaatttccattgtgcatctcaatcatgccgtaagttcagaagctgccagaagagctcagtcttaactccagaggacccacaggagagcccaagtgtgggcaatgctaaagaaacagtaaaaactcacaacttcttacaaacggtgaacactg

SEQ ID NO: 30745 - DNA, 1232 bp, Mus musculus
catgataagcctacatttatatagagagttaactcaggcactgtctttttgttcataggctagataaaccatcctgttttatccatccccagcatatactagaataaattagacccaaagaagaaactttgtatgccagcaggattaaaatcattgctgttaaaaagtggaactttgatttgaccagcctctgaagagtccagatgtttagtagatgttcaataaataatttttaaatggaatttgttttaaatcctcatttgttttttctacaaaagttccttttagtaaatggaggaaaagtagttttttttgtggtttttttttttccctttgttttccttaaagctaaagaactctaagcattattgagaactaaagtttcaaaagagaaatggcaggctgagcaggtagtgaagttggcagagtacttgcttgccttaatccagagttctgtccccagtaccatctaaaccaggtatgctggcacacacctgtaatgagcactgctgcgggagaggcagaagcatcaggagttcaaggtcatctttggctgtgtggtgagtttgaggccagccagggctctgtgggatcctggagggagaagaggaagaggatcttagtgcatctaaggtccaatgagctgttaaagtagtcaagttaggaaaaacctgaagatgcgtggcaaatatcctgttgcgccctggatctggatcctggtaaaagaataacttgccagtcccagcaggtgatgctggtgattgattttgtcttaaaggtaggttttcagagctggggagatagctcagttggatgcttgccgtgcacacatgaagacctgatttaaataccagaattgaagcaaagaagggtgggatgggaaagcagacacaggaagatttctaggacttactggctagtcacctggcttacttgattagttccagccaagatagggacccagcgtcagaaatttaaaaaaaagaaaaagtggacagcttttgagaaatgatgcccaaggtggtcttgcatcagtgatcacaaatgtatctgatcacatatctaaatgcaggtgttgggtataggcccagaacattttaccttgggtaaaattcaatatttttttttctttttttactgtctcgtttaaatgaagaagtgactcattgatttaaaagtgcttgccctttcagaggaccaaggtaggcaactcatggtcccctgtaacttca

SEQ ID NO: 30746 - DNA, 1209 bp, Mus musculus
tccaaggtgaggatggtgcttgtgtgcatcagaattgccgagatgtcacagctggagtcagtcagggagcacagaggcagagagaatcatagtctggagtcagcatgtgccgagaagacagacaggttgtgtttcttctccttttcttttttgtttgagagacagattctccctaggcatccctggctattcttgaccagactggctttgaactcagagagacccgcttgcctctgccttctgagtatggggattaaaagcgtatacaactattccaggctcccaggggctgcatctcaaaagcactcttcctaatccagctttaatattggacaaggaatatgctgctttggtacatgattccatgaattcaggaaacttggtgctgatgggcttattttattagggggaaacaaaaaaaaaaaaagaccccatcaagggtttctgtaatgactatcctttaggctcttggagcagtgtactgtgttttcaagagcagtcaggcagtactgtaggcagacccttgtgacatcactgacagagaatcccataggagcagtaaataacctgaggtagatctgaactggtagatttaacactggcctgactcctgtccttttttaaacttcctattcctgtgatgaaaagtaatttaatgtcaacctctagttactatatgctctcagggaacttgcctgcccctcttgtcctgccctcttacatataacatctggcctcagcatctggacgtctccggattccacctcttaattcagctacgtcaaagtacacagacagtaaagccagagaggggttgaggtttgagctttgcaggggcctctcctaggtttaggtggtgctccctgagtgctcccaacccgacggatgacttccatatttccccaccctgcccgtcctgtagcagaaatgaaatgcactactaaacagaatggtttttcccaagggagtgcttttgtatgggagccacacttgtgtcagttaaaacagcacagtgaccgtaaatggaatcctaaagtgaactttgaaacttttctttgataaactttttttggagggggtgggggtggcacaaacttgtcacacacaactctctcaatctcttgtagacattgttgcagactatataaatgtatgtagccatcttcataccaaattcagggtcttatgagctatagatcattttgtcta

SEQ ID NO: 30747 - DNA, 1216 bp, Mus musculus
taagggaggggaattcagtctttggaggtaggggttgggtgtggccacaggccgcccttcatttgccccattcccctgcagtggctgaacacctgatagctcagcatagtgccatcaagatgctgcacagccgtgtgaagctcattttagaatatgtcaaggcctctgaagcaggtaggagaggtgcctgtcactttgaaacatttttcctctcctggaaaagtgacagcatccacatcagtgcagcctccttgtgtccttaggagaggttcccttcaaccatgagatcctgcgggaggcctatgccctatgtcactgtcttccagttctcagcactgacaagttcaagacagacttttatgatgtgagtgttgacacctttgatggggaggtggggctcacaccacctcacaggtaggaggtgaaactcaagtgtcactggctaatacgagggacccctggggaactggttctttgtgttccctcccagcaatgcaatgacgtggggctcatggcctacctcggcaccatcaccaaaacgtgcaacacaatgaaccagtttgtgaacaagttcaacgtcctctacgaccgacaaggcattggccggcgaatgcggggactgtttttctgatgatggttctggaagggatggtgtgtggggctcagacagctgttccatggacctgagtaccacattccctttagagaaactcattaataaaagagcagccccttagcagcccttccagtggctttgtcctctcaggcaccacactggtttctcaacatggactcttaaggaagcttcacccattaatccacattttttgaccacctacccaccttttaatgactcgaggtgaccccttgttgaagtagacaaaatgtgataggacgacctgcttgcttccagtttttgtgctctgtgatcaattcatgtcacagctccacagaaagattgctttcccaggctaatttaatttcactgcaaatgtttctcaaataggaaggggagggaagctgaattccatctttgtaattgtggttatctcaagtccttgtttttctatatcctgaaggtacctaggagggtgatatgtacctcatccttaggccttccacttaagtcataccttgtgctaggcgcaactttctgcccttcacatcctggtgtcatcacgtctagatgtgggggtctaacaaacgaaatgtccat

SEQ ID NO: 30748 - DNA, 1117 bp, Mus musculus
ggactggccagtgttgagaggcggagacttgggcaattgctggacgctgccctgggcattgcacttgtctcggtctgacagtgccggcccaacactgcagatgtgggggggcagggaggagtccccatttttgttcaatgagtaggcaaatgtggcttgcccaggcttgaagctggagcaaagaaagatccttgacttcattcccctcctcccctcctatcccaatcttttctatgccttccccttaggctcgacttcggatggtagacattgtggagaaggaagatgtaaatgaagccataaggttgatggagatgtcgaaggactcccttctaggtgaaaagggacagacagctaggtgaggattttaatgaagagtgagactggaccactgggcttattgacctggcttgccctcagggttttgatgctgattgctgctactgtttgtggccttgcaccttcaccttttccatccttgtcttttaggacccagaggccagcagatgtgatatttgccaccatccgtgaattggtgtcacgggggcggagtgtccacttttctgaggctgaacagcgctgcatatctcgtggcttcacaccagcccagttccaggcagctctggatgaatatgaggagctaaatgtctggcaggttaatacttctcggacacggatcacctttgtctgatagccagtttttacaccctcctgcctacaccagagggcatgctgaatgccccctcaagaaaaaatctcattctcccatgctgcacttttttattctgccaataaagtgttttgattgcctcttgcttgttaataactctgtagagtttttagtatgctctctcctcccctagtctctagtactgacccttactatgtgctagtcaatctgggagatagaaggccttgggaccactgtttcttgagatgcttccaattatggacatttcgtttgttagacccccacatctagacgtgatgacaccaggatgtgaagggcagaaagttgcgcctagcacaaggtatgacttaagtggaaggcctaaggatgaggtacatatcaccctcctaggtaccttcaggatatagaaaaacaaggacttgagat

SEQ ID NO: 30749 - DNA, 1117 bp, Mus musculus; identical to SEQ ID NO: 30748

SEQ ID NO: 30750 - DNA, 4783 bp, Mus musculus
ataaggttatctcaagtctggctatcagtgaatgacttgattctgattgtttttatacaaagttgggtttttgttttgtttttagcttaagggttttcttagatgttttagtcgtgtttattcctatgtgtttgtgctcacaggggcatgccatagcatgtgtagaggtcaaaaggacaatttgtggaagtctgttctcccaccatgtgtgttctagagagcaaattcagatcatctggctagatggctatgtctaacctgctgagccacctcatccattcctagctcttagtttttaggggtagtctttgtgtggctcagaccaccatcaagaacacgctgtgtagctacatagctgaggttggctttgagctcctcactctgttgccttctgaatcctaagtgctgggattatagacatctaccaccatgatgtactgcattctgttctttccccagtggtaggatagtgactttagaagagcttttgtgggtgaggtgaacttgaccctaaagtgttagcatctcttctttacctcaggttcatctggctcatcgggaacaagtggcactgtatgtggacctggatgacatagctgaagatgaccctgagttggtcgactcaatttgcgagaatgccaagcgctactcaagactgtttggtgatgttgtgcaagagcttttgcctgagtacaaggagaaggaggtaggtggctggtttgtttctgagctcgtctgcctcgtgccctgttttctttctctgtcctgcctctcgccttttctttcttttaggtggtgaataaggatgtcttagatgtttacattgaacaccggctgatgatggagcagcgaagcagagaccctggggcagtccggaacccccaaaaccagtatccttctgaactcatgcgaagattgtgagtatctctgtgggaaagggcggggacttgctctccggggacttgctgacaaatgtttctcttttagtgagttgtatttccgaggcccaagtagcagcaagcctcgagtgatccgggaagtacgagctgactctgtggggaaattgttaactgtgcgtggcattgtcactcgtgtgtctgaagtcaagcccaggatggtggtggccacatacacttgtgatcagtgtggggcagagacctaccagccagtacgtatacaattctatgatggtgatttgatacctcgggtcgttttgactgataatatttcaaggaggtcttaatccttattttaaaagacacagagcagagatggttactgtggtgattgtaagacttcctgttttccttgtttgtagatccagtctcccactttcatgcctctgatcatgtgccccagccaggagtgccagaccaatcgctcaggggggcggctgtacctacagactcgtggctccaaatttgttaaattccaggaaatgaagattcaagagcatgtgagtttaggggatatgagtcctgcagctggttatgaaattataggaagaaagattgggagagaggtttacctagaatttttttatatttgctcttagtcagaaaatcgggaggtgatttaattgaagtttttttctggttctattgggaggaggataagaagaactcagcttccttcctgaagtcatctaggttgggatgactgaatcttaccatcaaatgggcatcttctggggtggtggtcagttgggtcaggtctgcctcgcttttctccttgtctcatgtgctctgtgtcatgccctcccccacacctcccaatctcctagagtgaccaagttcctgtgggaaacatccctcgtagcatcacagtggttctagaaggtgagaacacaagaattgcccagcctggtgaccatgtcagcgtcactggcatcttcttgccagtcctgcgcacagggttccaacagatggcacaggtgagggcgttttgaatgaggaaatagctgccttgcctcctcatccacccactcactcttcacacccttagaaaatgaaaatcagtgaggtggaacttgtggataaaaaattctcagggactctggtgatggggactttaaagggaactcttgtgtccagggcttactctcagaaacttacctggaagcccactggattgtgaagatgacaaagagtgacgatgatgtctctggggccggagagctgagctcagaggagctgaagcagattgcaggtgagggaccacgagctcaagttgagagttgagctccatcctagattttgtcctgaaggaaatgctatggcttaattttttgcagaggaggatttctatgagaagctggccgcttctattgctccggagatctatggacatgaagatgtgaagaaggcgctgctgctgcttctggtgggtggtgtggaccagtctcctcaaggcatgaagatcagaggtaagaaggacaagagacttaggagggagggtaaaaaaacatcccacgagagtctgtaaatgacaagagttgatgatttaccttagtggttgttgtgtcttagaagtagtctggactttaagaagggaccaggtctcaagtgctcttctctgttggtggacaacttgggtaaagagtatcactcaggcttccttctcatttgccaggaaacatccacatctgccttatgggagaccctggtgtggccaaatctcagctcctatcttacatcgaccgtctggcaccgcgaagtgagtgtgaacagggatgaggcttggtgtttggttgataaacactaaggcctctggaaggcctggggaaagcggttcctttcttcagcagtttgctctttatctttgcaggtcagtacacaacaggccgtggctcctctggtgtagggctcacagcagctgtgttgagagactctgtgagtggagaactgactttagagggcggtgccctggtgctggctgaccagggcgtgtgctgcattgatgagtttgacaagatggccgaggctgaccgcacagccatccatgaggttatggagcagcagaccatctccatcgccaaggcggggattctcaccacgctcaatgcccgatgctccatcctggctgcggccaatcctgcctacggccgatataatccccgccgcagtctggagcagaacgtccagcttccggctgctctgctttctcgattcgacctcctctggctgattcaagaccggcccgacagagacaatgacctccggtgaatgaagtagatgacacccatagagacagcccattttagtgactttggggcagggaggtaaaatcagaaagccactcaacttgtctgtgtgcagacaccttaaacacctttccttgtttgcagttcatatggagataggttggagctaagatcttgagggttttctgggaggcctgtctgccatgctttggagaagaggtggtgctaaaaggggatactgagtcaagattctcagggtgttagagctctaaagactgacgcccgtcttctctccaggttggcccagcacatcacctatgtccaccagcacagccggcagccccctgcccaatttgaacctttggacatgaaacttatgaggtaggaggggtggagatgggtatgtctggggagagtactggtctgtggcattgtcttatgccaagtgtgtctggaaagcattgagtcttgaaaggactcatctgcttatctatttcagcctcaaaagtagctgagcctgggtctctctgtagccaagggatcatcagaaactttttttctgttttgggatgacagagcagcaggccttatataatcctagctactctgaaacctgagtcattttggggatgtctccaaaaactacttccctcctgtatataaaggaacctctctcactctctaaatcctgtccgaggcaggtctagctttttggccataagtgcttccatggcacagatgactcgggtttctaaactggttttcacatggtctctgaagtctgtcaaggggttaagttaaatcctcccactacaggtgctttggtaaatgtcattctcctgaaaagttggaagttacttgaagtgtcctggcagccctgttttggagaaatccctcactgtccacgtcagcatagaatattaagtggggaatctcataaagcctgcctgctttcccgctttcccatgaaccttgtttcccacagacggtacatagccatgtgccacgagagacagcccacagtgcctgaatctctggctgactacatcaccgcagcatatgtggagatgaggcgagaggcccgggccagtaaggatgccacctatacttctgcccggaccctgctggccattctccgactttccactgctctggtgagtggtgggtccctgtcagctggaaagctgacccctgcctgccacctcacctaatgaccctcaagccgcctccttccctcctaccagccctgctgggactaaagtgctgacagtgcagatagtggtcctctctgtgctaccgcactgtgggtacttgctgctccagcagggcacgtgcaacgcccatggagggaaaggctgcttgctgcttgaatccatgagggctaggacttgaattcctggtgtcctagatatgatcttagaaatctccattctgtcctcccctcttggaccttagtcatgggggctccaaagtgctgttcgtgcaggtagtgtaattacctgacctactgctgagctagcacttcccgagcccccaggacacaacctctgatagtggccctagctgagcgccccaggctcc

SEQ ID NO: 30751 - DNA, 4783 bp, Mus musculus; identical to SEQ ID NO: 30750

SEQ ID NO: 30752 - DNA, 4783 bp, Mus musculus; identical to SEQ ID NO: 30750

SEQ ID NO: 30753 - DNA, 1156 bp, Mus musculus
tccttaactatctttccacctggctagtccgcggggacagtggtggtcgtgatgtggcagagctcttctaccggaagctgacgggactgcctggaggcgagtccccggttgtcatggtaactactgtggttggtgtgcagggccttagaactgtggaggtgggtgagtgcctcctccctgtcaagggcagcttggtaggaagcttgggggcgggggtgtgtgtgtggggaggatttgtttataaatgttttgagtactaacaagaagccagttacagagccatgcaccctattttttgactatcaacaactttgagaggtagatactacctttccacgttaggcggccaggtcttagatctggggcatcgcccatcactagtagacctcagggtgccatcttgcaggtttccttactacaattctggtcttttcttaatggcctctgtcctcaactctgcctcagtatcacggtgatcgtcattttattcacatcagacacagtgggctctatttggtggccacaaccttagaaaacgtctctcctttcagccttctggagctgctttcccggtgagtagagttgggacaggcacttaagaaggagggcgtgtgaggtttattcacacataatttgctgtgtttccttaggctagccactctcttgggtgactactgtggctcactcaatgagggaaccatctcacgcaatgtggcgcttgtctacgaactcctggatgaagtgctggtaaagcccaaaaactttggtctttttaagtttatttattcacgtgtgtgtgtgtgtgtgtgtgtgtatttgcccacatcactgcacatgtgtggagatcaggtatcttctacttgttgtagaatctgctaaatccaatatagatccaccataactcaagcactaggtcaatgcagatgacaaaaaggtattgtaatcaagccagtactgatcagtcagggctgtagaacagactcctgaacttgcctagcagttaaaggctgacaccacaaagtggaggggagtggggtgagctgtagcactgtccaatcatattttgacataaggggttgagcaagggaactttgaccaatcagattaggagtagttttctgggcttgagaacacgagcttagttgatcttgccagc

SEQ ID NO: 30754 - DNA, 1617 bp, Mus musculus
tcacggtggtctgcaaagatgcagaagaagccaaaagggtggagtcacagctgaagatcttgatccgtcccctgtattccaacccacctctcaatggggcccggatcacagcaaccatcctgacttctccagacttgcggaagcaatggttgcaagaggtgaaaggcatggctgaccgcatcatcagcatgaggacccagctggtctccaacctgaagaaagagggctcttcccacaactggcagcacatcaccgaccagatcggcatgttctgtttcaccggcctaaagccagagcaggtggagcggctgaccaaggagttctcggtctacatgacaaaggatggccgaatctccgtggcaggggtcacctctggcaatgtgggctaccttgcccatgccattcaccaggtcaccaagtaattcccaggtgcgaaggaacagagaccactttcccgacagcctttgcgctcgtgagcgtcatgtgcagggtgagggagggtgggtggtggtgaatagatccggtttccaaccacggtgcacaactcagcaactgaactcgctcctcgaaagagaggtagggcagaggcttcctcggctggtatctggaacttcgtcggctctaaaccaaactccctcatccttttgtctccagcttttctgaaagtttacacacgcaagaaaaatcacagcaccaaacacctgtcagccatggcactggaataggtcagacgctttacctaaagcctcaggtggtatcaggggctcccccgtggaccccggtagagcctcacgtaatagaggctgtaagagaaaaataactagttctgtcattaacagttgtcctcaagttcgtcctcctggtgtggagcaaactgtgtcagcagaccacattacagaaattatgctttacaaaaaccaacaggtctgttgccacttcaacagggacagtagaagatgtagtgtcgtgtccgcctgccccttgtcattgctgttctagagcctagagtctcatcccgttctactgcgaacgtccgcctcagcctatggggggagttacataagaatggagagcataggttttctgctcctgcatagcctcctctctcatcaaagagccgtggagagagagaccctgcccttgatttcagagtcctcttcagtcattgattgattggctcctactgggatggggcctctgcccagctggacctcttcatccatcctggctgcacagcctgtctcttcacatgagtcagacgtgcagggtaggatcagaaggagatactctggggtttgtgtgctgccagcccggctcagactccgcccttgggaaagataaccaccatccgctctaatcatgtagacgtactgccgcctggtttctctgttacaataaaattactatagagccagaaaaaaaaaaaaaagagggtgaacatgactagaaaagggggttttttgttttgttttttgtttgtttgtttgttttgtttttttggttttggagatcagaaacaaagtctttgagtttaagcatacaataagaagaatttcattcatgtcaaaatcatatatattgttcccaataaaaacaaactcaaacttcccaaatcta

SEQ ID NO: 30755 - DNA, 1239 bp, Mus musculus
aactaggaggtgtagctttgtgctagtatttgatcaccagcaccagaacagccacacaaaatcattgctctgattagtcacagagagccacatgcagggtggctggtggtatctgttctgatacttcatggcccaaactgccaacctccaacaaggtacaggccttaggctggaagaaagaaacataggggggaggacaaaaagaactttctatgcctcagtttctccatctgtgcaatgggagcatgggttcttctatgaaatgcagccagtctagtaccagttcttaaattgggaagatttgattaaactgtggaaattttgatttttttttttttaaattacgtatatcaacttcgtatcttaagacaagttggggctaagtggccctgctgttttctatctgtggtcatagcctcaactcttcctgccttcccacagatgtgaggtgagatgagccggccgccctctcccgggacacggatgtgcgtggcgtgtgacattcctgaacatactatgtatggtgcttcattgccaatgtgcgtgcggtctttgttctcctccgtgaaaaactgtgtccgaggacaaagagacagtgtccgtttgttcagtgtgacatcaaagcaagtactgtagcactcagagagacagtgagaaagcttccttgtcacagagagcgaaaacaaaaccacaaaaaagaaaaaaaaaacaaaaaaaaaattaaaaacaaaaaaacaaaaaaaacaaaaacaaaccaaaccacacccaacaacaaaaaaaaaccccaccagaagaaacaaaaagactgaagtgggcgacggaagggccgccctgcaggactgaccctcgagaggtggctgatgttggccaccaccctggattctgcccgtgggcacaggtgcttttcgccaaggacgcctggagcccgcctgggatgctgcctgccagctccgtgggaactgaacaggtgggagatgcccacggcctggaagccaccacctcgcttgagtctgcctaggaccttcctgatggccttacgtggaatttctttattttcgttttcctttccttctttctctctctttttttacaccatgaagtgagtaagcttctcctttttattctctgcctagctttttttttttttttttttaaatctcttggatgacattttcgtcgataacacgcacgaggctgctgtaagttgggacagcgagacggttatttttttcctagcca

SEQ ID NO: 30756 - DNA, 1118 bp, Mus musculus
gtgtgccaccgctgcctgttgaaaaatactttacatcatgactgtgaccctcacacttttcctggggggggggtaggggggggtatttagatttagttggttgactgatttttttttgttgttgttttgttttgtttgaaatggtgtctcactctgcaccccaggataacctggaacttgtgtaactcaacatggtctcagattacagggatccttcctcaatgcagttgcaagctgccaagtctagctctcctttctgtcttgagacattctgaactctcagtcagactgaaggtataactagccactttctgcagcacagaccctgaagctggttctgtgggctcccattttctccctctagagagccgccctggcctgggctgccgagagctggtcttcaggaacctctccaaggtgcttcctgccatctgtcatgatatcaccgactgggtggtggggacgcgggtgaaggcagcacagctgctgccggtgctgctgctgcacgcagaggaccacatcacccagcacctggagatcgtcctcagaaccctgcatcaggcctgcaccgatgaagagaaggctgtggtcggcagtgtgagtgtcctaccatgcaatggcaaagctctcagccctgtagaagcagttcttagtcaccagctaggtgaaggggtagacctctcctgcccttctcacctctcccatagtcagccactagcctggccctggtggtgccctccaggcaaactttgtttcacctttgatttcaccgggcacatgcagcaggctctgcttccagtgaccaggctgtcagcagctggcctaagagactggcttttccagcccaggcacacttatgtcatttccacacaaaacttagggggtggggggagggaatcctttcatgtgtgtttacatatgtatgtgcagtcaattgtatgagttcatgtgcagttgtgtgcatgcttatggaagcccaaatttaacactggatattagcggctgtccattgattgcaggatctctcactaaagcaggagctcacagattcagctagtcttacctagccagtgtgctctacggtcccctgtgtctgtatcctgggtactgggaggaca

SEQ ID NO: 30757 - DNA, 1197 bp, Mus musculus
gcaggcggatttctgagttcaaggccagcctggcctacaaagtgagttccaggacagccaggactatacagagaaaccctgtctcgaaaaaaccaaaaaaaaaaaaaaaaaaaaaaaaagaaagaaagaaagaaagaatttagggggctggagagatggctcagcggttaagagcactgactgctcttctgaaggtcctgagttcaattcccagcaaccacatggtggctcacaaccatctgtaatggggtctgacaccttctggggtatctttcaaaaaaaaataatttagaataatttagaagttgtaaagagaagctggatttgtgtcttggtcacatagggagggcgatgctggagtttgttagtgtcctcagcagttgggagagcagcatgtcaggaaggcgagccatggcctgtggcttgcagggctcctaccccagcagtgaggcctgggaagccatcggtggcctgctgcagcccctgttctctttcctaggcccggctgtgggagaagcgctgcagcatgtgatccccaccctcagggcctgtctccagccctccacagacccacacatgcgcctgaagctcttctctatcctgtccatgatgctgctgaggcctaaggacactgtcgattctcaggggtaggtcgaccctcaggtctgtgtacagcccacgtatgtgttggatgggtcttcccacgaccccctgggcagggcccccaaggtctaaagtccgggcttcttggtggtctgtatctctagaatccaccccactaggtaaacagtgatcttggtgagtataccacagagacacagacagtaaatcaaagtcactttagaggagtcattaaaattccatcgagtgagaaagttttagggcgcattaactattaatggcttctgtttcggctgttctgttttaaaaggcttttggcacctttcagacctaacagacctgactaaattagcattgatggtgaaggcttaagggtagtctgttatctcagaaaagctcaggggcagctctgcaacctaagagcctcagattttatggctttgaagtaaagggaaagtggaacaaagagcttaggaaagaacaggctctcaggggaggagggaagcaagccaagacacacacacacacacacacacacacacacagcagctcatcctggagaggagggtagagcga

SEQ ID NO: 30758 - DNA, 1155 bp, Mus musculus
cagcgtcctgttcccagatgtgctggtgcgggagacggaggctgtcgtccacaaacaccgctcagctacctactgcgagcagctgctgcagcacatgcagaccatggccgctgctcggtgactgtgtgcatcagctactgaaggcagacagtggtggcctgcagacctcgcacttgagacactgtgtccatggcctcgggccatccttgggcccccagatggtgcttgaacatcagcttctgtgtttcctaagcagatttctggggttttgtaacacacatacacacacacacacacacacacacacacacacacacacacacacacacgccagcttcccaattagctgcttgaacataatgtttttaaattacaagccccaggggtcctgggctgctttcagattcaccataatgctcttcacattgcaggaaagccaaaggattataaaacaaccaaccatccacttcctctgggctctgtcccatcatcctgtgctgaggacagtgtccagtcttgactcactgataaagtttctcccaactattctgggttttgacacagggtttccctgtgaggctttgactattctggaactctcagagatccaccagcctcttcctccccacactgagattaaagacccgcaccactaccaccctgctcctcccgattttaaatacactggaatgtcttgcagtgtgggtgcactgtcctggtgtttctgtttctcagtattagtgatgcccgtgggtaaaggatagactaggaaaccagccttcatccctaccacttgctgtagcagtcagtaaggtggccattctccagtgtcttttccaccaagtgcctaaagatttctaagtggttcttagccgcagcctatatttttgttaagacaatgttggggggggggggggtcgtgtccaacaaattttaacatttctgctttgccatttatggaattaaattatttattatagttatttgtgtggccatctgtgtgatttgactgattacactacatccgtacagacagctcctgtctccatatgtcggtgttgaggtggtccagcctgagggatgctggctgtggactccatgggatgggcccctctagtgacagtcatcactggctatgacctgcattctgacatg

SEQ ID NO: 30759 - DNA, 1148 bp, Mus musculus
tcttctgcttcagcctctctggtgttgggatttttatcatgcctagcttgcttgttatctcttggttttacttgggggtgaaggggggctagtatatgattgtgcatgtacaagcatggaggtcagaggaaaatgtcaagtgttgttccttccttccactttgtttgtgacagtggtagtgtgcactaggctggcgggctcgtgcacttctgacctcccatctcaccatcagaacactaggattacagatgaacttctatgtctggctttatattggttctgggatccaaccctggtgggcaagcttgtgtggctagagcttcgtttttatgtgcacatttggagggaacacatgaaagaaactttgacttgggactaagaaaaactatgtcttttgttataatcaaaatgggactgccagccctgtctctgaagtcctgttaaccctctaacacctggtcctcttctgtctcttctgcagcatggtctgagacggtgaacatggacttttctcggctgcacacgtacaccccaccccagtgtgtgccggagaacactggctacacttacgcactcaggtgagtgagtgctttctctggtggggtgcagcattgagggcacacagcattgaactcttagtgatcatggaggccttgagtggcttctatagctgtagacttctgagtcacctcttccagtgactcaggtgttagtcacttgaagtgactcacttttgcaggctctaccccttggccatgattgggagcaagtggttagtatggccaatgttttgtcattagctttaatagtttgagcatccaccagagaccctggactaggggctgtctttgggaggtgcatgcttcaggcgcatgctccagacaggatgtctgggtcctttgagtcagcagctgcttgctcctctgttctttccagtttgcctcctccaagctgtcctgtatgctaaggagaatcagttgtactactaggttagggcatgcctggcaggtgcctagcaagatatgggaggcccatgagatgtatgtgctgagttgtccagtggctctcctatacaggtgaatccacaagaaaacctaaaggaaatcagaaaatgtttaaaaataaaactctgtgtgtgtgtgtgtgtg

SEQ ID NO: 30760 - DNA, 1208 bp, Mus musculus
cacctataatcctagctctcaggaggcagagacaggaagagctctttgagttcaaagcctccctggtctacagagtgagctccaggacagctagggctacacagagaaaccctgtctcaaaaaactaaggaaaaaaaaaccctagagtttccataaagctagctagatcttcccccttgtctgtccttgtgggccagaatgtgctggagtgcacagctctccatgccactgcctttgggtgacaggtgtaccgagcatcttggaaatagaccacaacagtgccacagcatagcactggcctatcaccgggtacagttgtggtggggttggttgtatttcacagtgtaatgtgtgtgtgtgtatgtttcaggtctcgatgatgatggtgaccttaaaggtaattactttggtactttgtacactttttaaatagaagccattgctacgtaatcggtagatagtgatcagtagctttcattacccctttgaaaacctcaggtggaaataaagctgccactcagggaaatggtgaactggcagcagaggtggcgagcagcaatggatacacttgccgtgactgcaggatgctctcagcgcgcactgacgcactcacagcccactctgccatccacgggaccacctccagggtgtactccagagacaggactctcaaaccacgtaagtcttctgcttctgtagttagtaaaaaggccggcccagctcattcttttctcgtaaatctgactatgggccaaggatgtggctcacagtatggtgtttacctcctatgtgccaagctctgcattccatccccagcacaggccttggtgtcttgcactgtttgccttacagagttgaactcagtattctcacagcgttgaataggctcacattaactctgtcctacttgtcgcttcccagtttgtggttctgtggttagtttttttgtgcctggaagtagttcagatttggtaaatttgggcttgacatgaataaaagaaagttcctacttctgtggcttcttactggggagcttctctgtgtcacccagtacatcccagatactcaagtagctagaacaccagaagttaatgctgctgagagtgagagctctggtgtgatgctatgagacaggtgctctgggagggcaactcggagcctggcatctgggtggtggcatcagatcattggacacgatagaggtgggt

SEQ ID NO: 30761 - DNA, 2055 bp, Mus musculus
ctctctcgttcatgcctttgtggggcaggcatatggagacaatagtggggatcaccccatggccagctctgtgcctcagtaaaagaccaaacacgctagtccatgagtcccaactgctcttgaggcttatttgggatatggctgcatcctgttacatatcccacgggggcaagggattggtggtggtgggtggtctctgactgctaatgtgaaataacttattctcttaacttcaggaaagacctgaccaagccttccagatagtagagctccgggtcctgtccaactggggccaccctgagtacacttgcctctaccggttccgagtccacggagagcccatccagtagagcactccagccatgtacatgtctgtatataccaagacgccataacactggaactcattgagaaagagagcacgtgagcataggaacttgtcagccacccttcaataaatgtgctgtggtcctgaggacgtgctgagtcctctgaggctgtgcgtgtgttctcaaagcccaaaagccggggaggcttttttaattcatttgaatgtatgattctcggacactccttttgacttagggatttgcttgaatgcataaagtcaagaagcagataggctggcaggtttccaggctcctgacataaaggctgagagctctgcattggccatcctctggatgtcaagaaggcaaagtcccatctgctaaacccacgtttctttcagggaaaactgttgctctgtcttcagtctgaccccttccaggttccctggtggggagaggctatgtcatagactgtctgctttgagctgggactcctctgattccccaggggagtagatcgggctttgcagaagagcagtggggtgtgcacaccatgaatggtgctcttgggtctcagccaggccgttcctggcagatcacagaatggacaggaaccttgagaagggatgctctgctgtccttgagctatgagtctctgctgaagggggaacactaaggtggtgctagtggctgccactcttggtctttatcacagcagcattctgtgctgcccttgggtttgcctctacaccattatcagcccttctcactgattcaaatttgggtatatttaatatttagacttttgtgagtagactttataactgatacatcatctggacacttaaaagtgtttagatgtcttacctaaagaattgttaagtttcattggttagacagccttggcagaatacaaagctcacctgctggggctcagagttctgggatttctcgcatgttgcaagcagcccttaagacagtggcccaaagcacatcccactccatagggttagagccactgcctgtgtggccaggttgtgtgggatgcacacattttgcatactcaaggttacatgcagaagtcagaatttcctatattaaactaaattggggaattgggggtggagatatttcaaatatttatttttaaagatgcaagataggactttgtgcaatgtatttttgtaaatgcttttcaaaacacttgtctttggtagtgcttctactgccactaaattaagatgctattgagatgtttaaataaaagagttaatttttaaaagtgcatgtgcgatttcaagtgattaataaaagtgtgtatttcttttcttggcttgtcttatctctgcccatgtgaatgggagggattgctaggttgtgtgcttgaagagttcctgctaagtcctgcaggcactgccactgtcactcaagcctccgccagcctcttcctgcttagaggaatccgctcagagacattccagtcaggctcaaaggaagtgggcccagaggctttgggtctggatgtggtcacaaggccctgagctcagcttccagagccagagcacctttctactacagcctgccgaatatatttttggagcatttttcataccttttaacagctctggttcctaccatgtatacagaagtgtcacgttgatttaagcatcctcagttcataggctttcctttactttttttccctctcaccctaagacaaggtttc

SEQ ID NO: 30762 - DNA, 1142 bp, Mus musculus
tggtgcctacttacatggcttctgtgactggtgtcctccagagtccctttactgcctccagtcccacttgtggttggtggggttgggcttcacacttaaaaactgattatgtcatgataggcacattggccatgccccactgagccagcatgtggctactagagccttcatgcaaactgccctgaagcctctgctctcacagaggaagaagctgctttcagctggaggcaccctgtcgcttcaagcccgctcccacagaactgtctcccagcatgggccacccaatcaacatagccacagggaagtgggcaaaccagccagcagagactgggacctgtgcactatgtgtgggctatccagcagcactccaatggcttctggtctttcttttgaagttgcatagttgagaagtgtcttaaacatatagtattgctgcctgcctcctttatagagtgctggatttttgttcacctcacctttagtaagggtctgattgtgtcctttgcagaaaatctggctaaagtgttcagtttgatggatccaaattctcctgaacgagtagcttttgtgtccagagccctgaagtggtccagtggagggtctgggaaactgggccatcctcgactccaccagctgctggccctcacattatggaaaggtaggcatgggatcccatctcatcagcagctgaatcctctgtgtgtctgccagttgataagtgagaagaggccatggggaaagcatgccagcctgtctttcaacatctctgctttggtcatagacctctggacagaacctccacaggtcataagggacccctggatcatgacactgtctcctttccagtctctgtcctggttctcctacctggttacctgcttctcttcccacaacctcccattccccctcctccttcctcagtgtgcctccacacctcatgccttcactggctccctgtgtgtagttcttttttattcagttttgaagtgagctctgttggattatacagccatgggatatattgcaggcatgcctactcttcttggctcttgagctggcttgggcacaaagatgcttggtgactgtctgctgggacctgagcagcttccaccccaggagcattcctggggaagctggtgtgg

SEQ ID NO: 30763 - DNA, 1230 bp, Mus musculus
agtgtttggcgttgagaggcccccttccttgttgctctcagggttccaggtatagaagggatccagggtctgccttgacgcttactcagggctcccagcttgctctatgaatagggttttggtgttgagtgtaagggaggtttctgcatttaaacaaagcagtcattggtgatcttcgctgtgtgcaaaggagcctcccttagctagaactccctgagtagttggaagttcaggaaaagaaagttgcttgtgggcccagctctcatgcacacaagcgttaggtagacagcagtttcacatacttagaacggaggaaaaggaggttggatgacagtgcccattgagtttgtttagtgtttgttctctgagcacaaggaagctggtgacaggctaggggacagcagctgtgcagatggatagcttgttctagggttactggcctagcaaaggtgtgtccaaggcaaatgggtaggagcggggcaggagtagtgggtggctctgtgcaccctgtgctcacgtgtgcccatctgcagattctttcccttcacagagcaaaattactgtgagtctcggtatcactttctgcactccagtgatggcgagggctgcgccaacatgctggtcgagtactctactgcccgaggcttccgaagtgaggtggacatgttcgtggctcaggctgtgctacagtaagtgttcatgaggacgttgcggggccttcgttcagctcacagcctggagcaggcctctttgtctcagactccgcggtgctggagggggaacctcaggcccaaggctgtcttgatgtgctcatcaaccagtcctttctctgaaacacaagtgcaagtgtccacagttgcgctcaccctgcctagggggctgcaccttgtgcttgccaatcaattctcattataggattgaggtgcagtcagctggtaggatggctcatccccacctgcctgcatcaggaaggcacctgtgtttgtttgcctttttaaactacatatttaatttatttagtgtatgcatagcgagggttgcagggacacatgctgtggtgtgcacctgtaaaggctgcagtttgctggagcccttcccctcccctcaaccgtgttgatctgggattgagctcatcagcaggcttgagggcaagcaccttacctaccgagccatctcctctgcttcctcaggcctcaaaaatgcttgctctgtgagtaatggcaggaggct

SEQ ID NO: 30764 - DNA, 1616 bp, Mus musculus
tgaaggcccctagtatggtgtggcaccccagcagacagactcctgctgctggccaggggcccctggacaggctgtggaggggaggcctcaggctgggggaggggggaaggggagggaggagcttatgggctatatggggagggggagtcacaggctgaggaggggaggctgagtgagctggcagctcccaaggttagaacgttcccatttttagtggaagcccacttcaagcataaaccctaaggaagaaagcccggaggccccaggattctacgctcatgtggctggacaggcgcactggacattaggggagtccatcctccaggcccacaccctgttccttgtgtggcccaggcatggccaggtggggctcaggcaagcccattggatagacagtttttcagaacctcattaaagttgaaggcagacttggttttgggcctcacctgaccctggccctgtcacgatgctcccagccacgcccagctgacccatccactctcctgctgctggaagccctgcctcccaactttgagcaggaccctactaactcttctggcctgaggggatcttggcctcaggacaggacttggtgctgggctgctgtggacagccatggacagccatggacagccatggatagctgtggcagcgggctggcctggctgctggggactcactctgggatgtgccgcatgcctcccctttcctccccccacctcaacaagtatttattgagcacctgctgtgtgtcagtcagggatcaagggtcaggggtcagctctttttcccctagggctgacccagctggggtattgggggtcaggtatttttccaagagaactttgtgcacaggccctgagtccacctgtttggggcccccagtctccttgggacagctggctggggcaaccgggaggaaacctagtctgcagggtgctgtgcatggagcccagtagtggcttccttgggagccagggagcgccccaccccatctgcttttgggcgtcggtgcccagctcggtgctgtccctgctttgtaacccatgccctctggccctgaccttacagtctttgagcccttgatgaatgagagcccaagccaagaggcggccatgggcaggagtggctgcccccagccctgattgctgctggcaggccagtagttaaagctacctgtatttatctccctgctgccctctggccaccccaacagatgggctcccttctatgggatccccaaagggcaggtcctggccgctggacagctggggagcattgatgggggaacgcatctgtgaatgacctgggccctcatcaaagctgcaccccagggaatgggggaggggtccttagttgggcttctgctgccctgtgtcatgtcccctggaataaagtgtggctctggcgttgtcccttctgtgtgtttatggctcaagtggggaggagccagctggtattccctttgccctggcagcctccctttgggcagtaagggacatgagaagaacctgtcacttccatggcaggcctgagacaaagctggcctgactctgcaacctgtgtcctatagtccccacccaccatgctctgtgtgtgtgtgtgtgtgtgtgtga

SEQ ID NO: 30765 - DNA, 1182 bp, Mus musculus
ttggagctgtgggccaggctctcggacccaagcctatcttgtcatcccacctgtgctagctaattttatgtcagtttgatacgcactaaagacagaaagggataccagttgagaaaatgcctccataagactgggctgtaagcaagcctgggtagcatttccttaattagtgactggttggagagggcccaggccactgtgggggattgggagatggttgtggattttatataaagcaggctgagcaaggcgtggggagcaagatagtaagcagcacccctccatggcctctgcatcagctccaggtggctgccccattcgcgttctagtgctgacttccttcagtgatagacagtgagcgctgtggaagtgtgagccaagcagaccccttccgcccagctggctttggtcatggtgtttcatcgcacgtaacacatcacaatagtaaacctgatgaggataccaccctttgccgctgcctccttttactgaaaggccttggggtttctataccatgcttcagctatctacctcccttcctggctgtgggccgagagactctatctaacacttggctgcacaagccgtgtagagtcagctacgaggaatctcagggtgaagccgtgatgtgagccgaagcatgctgaggccttggcacgcaggatcctgagctgtgtctgtgcagatatcggtgctgtgttgactgtatcggctactgctgtgtcctgtcctctaacgggaagcaccttaggggaggaaggcttgatttggggctcggcttgagaggatacattcttcgtggcaggaggcagagagaagtggacgttgtttgctttgctttctcctttttatgatttgcgatgccagcctggggattggagttgcccacattcagggagggtcctgcttcagttaacccaatctggaacattttttgactgacgtgtgaagtttgtgtcataggtcattctaagccctaccacattgatagaaatcgtcacattgggtttggcactaatcaaggcagagtttcttgtggccacagagagcctggatcctggtactatctacagggctttcagacctgaacctgtatgtgtggctgagcaagagtgcatcaggggtccatgagacctgagaaggtccccattctcccagctgcctacacctcatactcaggac

SEQ ID NO: 30766 - DNA, 1201 bp, Mus musculus
agagtgtgtgagagagtgtgtgtgagtgtgtgtgtgtgtgtgtgtgtgtgtgtgtgtgtgtgtgtgtctttactagcagcagctttccttttattacacctgacagaagtccaccaggagacaaagctccttcttgtctggggtggctcttcctgcccttcctgtaccggaagttaggcttgggttttgccatcccaagtcatcagtgcacagtgatcatcgtgtgtgggtgaactgcctgctgcacgctgcactgttctggaacatgggtgtctgcacatgcgtgcctctgtggtgaggcttaagtcagcattggctgtcactccttggtgctgtctacctttttttttttttgtctttatgtatgtgagtacactgtggctgtcttcagacacaccagaagagggcatcagatcccgttacagagggttgagagccactggctctctagctagctttttgaagaccatgtctctcagtggatctccctgtttctgcctccccagtgccatggttacaagtgtgcactatcatgtccagtctctctctttttacaatctcggtgcttgggattgaactcaggacctgcgctgcacagcaagcactcggtccaactgagccgcctcccctgccctctgtatccttttctatggaaagatgtctcatctgcctcttggagaggagggcccaagccagctaggctagatctgtgggttccatgtggggtgtgtgcacccctcctggcccaaggccagctgtatcctgctgcgctctgctgtgccaggctctgtccactgacgtcttgtattggcctcatgaggcagctctgcgtcccagctgccccctgggtccttatgcggctacttcaggctgggttccctccagtgcacgtcgccagcatgtctgaaagggaacgtggatttgtaatgagggacaaaagctggcgatgtttcatgcatatgaattgagttttcctttccgttcgtattttgtcaggaatctaatatgtgatattttctgtccttcctcaagacaaactgccatggtcccagaactaacagctatggccacagaactgtcacttgttcagatgtgagattgctatgtggaacttcttttttattgctttatttaatagacccagggctgaggatgtgactcagccggtagcaagcgcccttacctagcatgcatgaagccc

SEQ ID NO: 30767 - DNA, 1210 bp, Mus musculus
tttctaagaaggaaaaaaaaatatcaaaactactcgagaaatccaaaacaacagcaacaacaaagaagtatgtgcatttctcgttgagatttatttaccactttatgaacatccctgttcacattcactgtccattcataaattatctttggctaaatgtctgctcagcttttaccttttatcttatttttttaaaaataatggaatcctctactgtggctgcctctgtccagtgcctgtggctcatgtttctgaggccctgactgtggagccctctatagctgggtatctttctggccagtgcctgtgccctccagcctgcacccagctgtgcagagtgctagtgcaggcagtgcgtcctgcctcaaagcatccctggatccttaactgtggacagcccagtgaggctcagtagcaggcacagtctcattacctatctcccagctccacagaactgacggctggcttgtggtgggaaggaatgagggccgtgtgttgtgtcacgctggggtgaggttgccatgggcactgctctgcagaggctcactgggagatgtggggtctgagcagggccacaagcagtgtcacagtggcttctgtgtctgcacagatggaactgaataccaagagggtggtttgtttagggtccgtgtctcctgaggtcagacacacttccctagcccacaggagacaggctgccatccagggcctgtgggtcatcagccccctggcctccctcttctgtctctagggaggctactgccgactgatttcttgtggcagctcctgggttaagtgaatataaaccaagataaaggaatcctgcctggaaaccccagaggagcttagcacagtgtttgaattctggcagaggccaaggacaggcgtgtgtggcatgtcatggattgatgatgtctggggcctgcaagggaagagctggcctcaggaaactgctgtctgtgtagcctgtctgccattgtcttcacaccgtggaactggcccagcccaggatgcttgggtcattgcccacaggcagaagtgacagttgaaaactggcactcctgtgctgggacatgccatgccgtcctggggtggggtggaggggcagggaagatggtgccaccagaggtttgcctgcctttctctaaaagagattttttttttttttcatattctggtagattcttaggaagttgcaaaactacacaga

SEQ ID NO: 30768 - DNA, 1235 bp, Mus musculus
tggagtctaccgtctctctcttctgtctttttttcttttgtagagagttggagatggaactgagggcatctcacatgctaggcaagggctctaccactgagccacaccccagcccctcactgggggattctaggcaggggctctaccactgagctacactccagcccctcactgggggattctaggcaggggctctaccactgagccataccccagcccctcactggggattctaggcaggggctctaccactgagccacgcctccagcccctcactgggggattctaggcaggggctctaccactgagccacacctcagcccatcactgggggattctatgaaggagctctacactgagccacacccaggactttttaaaagttctgtatgatgtgtgtgatgggagaacatgtcacaatgtctgtatggagttagagaacaattttatggagttggtttttcctttcacctttgtgtgggttctggggattgaattcaggttgtcgggctctcaggacaagcgcttctatccattgagccatcttgccagtccagtcctggtgttttgagacgagatcttgtgtatcccagccctctaatttacatgatgaccatccactccaaatactcctgcctcaccttccccattgctgggattataggtacatctccacatctgcgttgttggcctcttaggacattagtgttttgaatgttgaccactgtacgcattataatgtggtcacattgactgatcctcaccatccacttttggtttttctcagacaaggcttttatatatgtgtagccctggccatcctggaactcactctgtagaccaggctagccctgaatttagagatctgcctgcctctgcttcctgagtgctgctgggattacaggcatgcaccaccactttttttttttttttttttaaagatttatttattatttattatatgtaagtacactgtagctgtcttcagacacaccagaagagggcatcagatctcattatggatggttgtgagccaccatgtggttgctgggatttgaactctggacctttggaagagcagtcagtgctcttaaccactgagccatctctccagccctcaccaccactttttaaaaataatatcacaccccaagatctccagcgactccccagcggatgtgagtttttgggtatcccatttagcccagtacagctgttagtgagctgggttggtc

SEQ ID NO: 30769 - DNA, 1142 bp, Mus musculus
tggcaggacagactgtggcaggagctggtcgcaaagttttgaggccacacttcctgtttctctgcagacagcacggaggctcctaagccagaaagcagccctgagcccccaccaggccagggcaggactcgggcagggacgcaggtgccggtgcttggccctgaggacgacttagctggcatcttcctacaggtacaagggctaccgtcagagggcccctcagcagcaccgcctgcacatgtctgccctgcatgtgactcgtgacatgtgtgtctggccactattccattcttatcttgtgctcactcttcatgctcactgtatgaagtctggctctgggacccctgctggtccctgtgctagggtgctaggtacctgtgtccttcatggcagctcttggggtgttagactcccctgccactcatccagcaaagatcctgggtcccttagttaatgcactggggacggaatctgatgggcctgaggcaggctacgcatgggagccacgggtgcggggcctctgcgttcttatactttctgctctccagatcttcccactgagcccggacccacggtggcagagctccagcccacgcccccttgccctggcactgcagcaagccctgggccaagagttggctcgtgtccgccaggggaaccccgaggtgccaggcatcacagtccgccttctgcaggccatgaccaccctgctgagctccccgcacggtggcacccttgctctggctatgcatcacagccacttcctttcctgcccactgatgcgccagctctaccagtaccaggtatgctggcacgtgggctggcgggaggcaagggcagtgggagactagtggcccagtgtgcatggctctgcctactgtccaccctcaggcctgttgttgttcccagcatgtctgaggcttcccttagccggtcggtctagatttcctgtctttcagcacaaaaagaaggggcaggagcaagggcaaggccagggcctcatcgtagagggtgaatgagtgaggtctttgtcacccctgtctgcatgcacgagtgcttctgtgtacgtgctgtgtgtgtgtgtgtgtgtgtgtgtgtgtgcatacacctgtgtttcttctccactgggttacccatgaagg

SEQ ID NO: 30770 - DNA, 1099 bp, Mus musculus
gaccatcagtgcctatctcatctacctgtcccagcacacgccagtggaggagcagggcccacacagtgacctggccctggtgagggaattctggcagggccagatggctgtgtcaccaatgttgtggccgggtgttgggctggggcccccagtgaccagagtctttggagcctctgacagcccttgtccttgctcaggacgtggcccggctggtcgtggagcggtccaccatcatggcgcacctcttctccaagccctcctgcagcaccgcttctgacgctgtactcagcgccctgctgtctgtgttttcccgctatgtgcggcgcatgcgcaagagcaaagagggtgaagaggtctacagctgggtgagggccgagcgggccagctgctgtccagtggggtggggcattcagagctggatgggggtgagaggtggtctgcaggggtggatctgaggtggactgaagcaggcagggcacagggtaggtagactgtcgcaccattatcagccgcaccatccatgccatctggtgcctgtccctctgccctctctcacagtcggagtctcaggaccaagtgttcttgcgctggagcagtggggagacggccaccatgcacatcctcgtggtgcacgccatggtcatcctgctgacactgggcccgccgcgttgtaagcaacctgtcccgggcttttctacactcagtttctagtcagatggcctgggaggaccctcgggcgtagctcgggcgtgccctggcccaccacacagttgagctggtcctgtaggttggcctggggacctcaggctggctgaaacccctggtcagtacaggttccctttatgcctaagagagtggaaaggaaggctgacttgtctcatcttgttgggtccagtgggctcactgaagcccgagactgaaggctctgtgaggaccggcagcttgtgctgtggttctctggctcatatagaagtctgggtgaccaccaaacccaggcttccgtaggccaccacacagcagtcagggtgacatggagttatgtgcccactaccttctcaggccccatctgcaccatcatgtgagccttctctgttaccct

SEQ ID NO: 30771 - DNA, 1183 bp, Mus musculus
acctgattcaccgtaggtatacattgaagactcgctgggcgagcggatctgggtagacagccctcactgccgcaccttcgtggacaacatccagacagccttcaacaccaagatgcccccaaagagcgtcctgctgcagggggagggggcacgcagtggtggtgagcttggtgcaggtaagagatgccgaggtgtctgtgaggttgggccaagggcaccatcctccacttccctgggaggaggcacccattagctcccgtggtccctgcaggcagcagcccccacccctcactcacagaggaggaggacagtcagacggagctgctgattgccgaggagaaactgagtcctgagcaggaggggcagctcatgccaaggtaggtgggccgacagcttcagtctcagagggccagagggagggcacgggagctggcatccttcctggcctccttccccccctctggcctaggtacgatgaactcacagagagcgtggaagaatatgtcctggacatgctgcgtgaccagctgaaccggcgccagcccatcgacaacgtgtccaggaacctcctgcggctgctcacggccacctgtggctacaaggaggtacggttgctggctgtgcagcggctggagatgtggctgcagaaccccaaggtacgctgtgttggtgaaagagtttgtgttgggggggttctccttgggggttccgggcggttgtgcttgcgtgctcagtggtcttcctggcttccccgcagttgaccaggccagcgcaggacctgttgatgtctgtgtgcatgaactgcaactcccatgggtcagaagacatggatgtcatctctcacctgatcaagatccgcctcaagcccaaggtgctcctcaaccactatatgctctgcatcaggtacgcggtcagccggggcgtcaggcagtgaggcaggccggtgggcagccggggcagcctgtcccgtccccctcaccggcttgcctcttggtgtccagggaactgctgaacgcgcacaaggacaacctgggtaccactatcaagtttgtgatcttcaatgagctctcgaatgctcgaaaccccaacaacatgcagatcctgtacacagtgctgcagcacagctctgagctggcacccaaggtggggtactcagtgagggacaggcccctgggcttgcgtg

SEQ ID NO: 30772 - DNA, 1181 bp, Mus musculus
cgtaaggtagtaaataggggatactccctaaaaggttaccagaggttcttgccttactgagcatgcgttgaaaatcagtccgagccaggtcagtccttctagtctttattcctgaagagttgggaaaacacttgaatagaaactgtctaaatttacttgttaccaggggcaggatatgcacactgttgttcagatgggagtatgtgtagcctgatacgggtataagggggaggggtgttaaagtgttctgaggctgcgcacattgttttgagagaggtgtgcatatggtatgtgcacgtgaaggaactaggctgccaagtgctttattacaagggtctcccaaaccaaatgggggtcctatgcttcttatgcttgcttgccccaccaatgtccctttctccgtttctctcttgcatttgcctaggaattcttagtcactcaagcgttcactgctgctttctacacccaggggggctgtcgcctgctgttgcttttccttatgtcaccaactcatatactcggagtagtccaggatgtgagggcgatctggctgcgacatctgtcaccccattgatcaccaggattgattcggctgatctggctggctaggcgggtgtccccttcctccctcaccgctccatgtgtgtccctcccgaagctgcgcgttcggtcgaagaggatgaccttccccgaatagaggaggaccggtcttcggtcaagggtatacgagtagctgcgctcccctgctagaacctccaaaacaagctctgagtagtccagtggcttgggagatttttgttgaatctgacgcaaccacataaggtgagcagctcctgagagcttcacctggataataggaatagtgagccaaacaccctacttacatagctggagaagtggtatcacaaagatatgtgcaccaatccaagcacagtggctcatgcaaatgagagattgaatctacaccaaccacagcatagaatgcttcatgcaaatgaaggactgtatctataccaatcacagcacagtgttgcaggcaattgaaggcttgtgtttgcaccaaccaggggcctcccgctgagcttgtaggagaggctgtttccttttggtgtgggtggaaatgtctgcagtgtcaaagggaacttccttgaggtttgtgttggcaaaagtccagtgcaaac

SEQ ID NO: 30773 - DNA, 1207 bp, Mus musculus
cctctgccttgaactttgcctcagtgggcagctcaagcctactgagtgcatgaagcaagccagggcccctgtagctcaggctccactctagtggcaggcaacaagctttccacggggggagcatgtgaggacagacacctgtccaatagccaccgctgactcaactctcttctctcctcctgcaggccacaggaccctcgggctccaagatgcagctgctggagacagagttctcacggtctgtgcctgagctcattgaactgcacttgctgcagcaggacagcatccctgccttcctcagtgcgctcaccatagagctgttcagccgccagacctctatctagcctcttcccatgagcatcttcactacagccgctggacctcggcctagcctgtacctgcagcttctcacatgcagcccccagaccttgagctagctcttggtctacagttgcccacatcatccccagatccctttgccacccatagctgcatcatgtcacaaacactagccgtggcctctgctcaagcagccactgtctcttgtccctggctaggagcaagctactggggatgaccaagccagatcataccccactactctcctccccaccccaccccattctagagccgctccacgtactgtcccaaggtgtaccccagcctccagtcccatgcgctggttgcttaggcttcagtggccagactgtagcctgtgtccacagtctcagactaatgaaataaagtgctacctttatcttccttcccggattgtgtccaaggctccaagctacctctctgtccaggcctcaccacactgtactgtgcttacctggacggccggcaggcctgctcatacacacagcctgagaggcagatggggtgggagtgctcaagtcccatccctctgagccggggtatctcactccctgccttggttccttccctgcctctcccctgccggaggtctctgtgtccagtgggtaaccctcccttgccagctccctgcaaggggccccaccaggcccagccatctgtaccacattcaagtgtcctggttaacaggttttctttagcagaggtggagaggagggggatatgtctggattgtcctgagagacaaggcacctgagtgtaccatacccccttcacatgcctgcaagagaatggaaatgagacagcctgccgggagcactcagacttgggc

SEQ ID NO: 30774 - DNA, 1207 bp, Mus musculus
tgggcgtgttggtttctgatctgagctgctgcactttataaggctgggtgatgaggattcttgagggaatcctgtgctaggtcctttctctcccccatgccccactatcccccaactgccttcaaggccttgttagatgctctgacattccttcttcatctaagtcaaagccctcgttcccattatatgttggtcttggacctgggcaccctctggtactggggaagaaacattcatcctggggcttctccgtatggcctggccatagcatttgatgccggcccctttgagacccagcctcctctgcagctctaacggggctgcttggacctggaatcttgtggtctagcctttgggcttcctcaagccttacccatgtgctcagtatgcaggcagcctcctgcgctcccactcccgcctcactcttccctctagagaagaagagtggcttcaagttggcgcttcaaggaagattgattaaaatcagctgcggttcatcttaattgggaacatatgctcagagagggagctcaactagttaggattttttgtaattagttcacagctggttggcggggaagcaaaactctggtgaccacttagagctgggtgtgtgggcgtgcttgggggttcagtggaggggtcatcacagtggctgaatgcagacttaccaagttgacgcacgccatccttcctgggtttcctgggtcattggctgtttgtaccatgacctgtgtgcattgctagggtagctagggaataggaaacgggtactaaggtgtacttgtctaatggacacacgccaactggctgaatggacggctgacttatgatagacagccctggcagagcttctgggaggttagacactgtggtgcaggcctcgagtctcagcactatagtggctgttccgagtttcagagcctaggctacatggtgagatcctgtggaaagtatgggggcaggtgtctataggaagaccttacttagagatggggaaactaaggctggcacagaggcagatacagggattgccagtctctgtccttagataccttgtgctttccctaaaagcagggacagctgctttattacagagaccccccatgttcctcatagcctcccataaagcctccacatagtgcttctgatgagctaggtcaggacagcttggtgtagagtcaccaaggagaggcctgccaggggc

SEQ ID NO: 30775 - DNA, 1172 bp, Mus musculus
tggcttttctcctcagcctgtggctctgctatttatgctgggtatgcaacctttgctgtctagagtggccatgtattcagacacttgccgcattttcacaggagtcactgagagacagttgtgcccagtcaatcacagaattccctgtccccactagagtcctcctcatactgtagggcccttgaggagcacaaggtctggcagatccagccctttgaggatggaatagtagctggatttagcagtctagaggaggaagccaaccagggggtcctaattcactggagtggggaaccatacaccttctgcctccaccaggtggcagcagacaggctcactgctttctgggcctcaccactggcctggtgggggttaggtcagatgcaggaaaggatggcctggaggagggaataatggggacctgggcacatattgatcagaggcaaggagcaggcaggtgtgagagtcccacagctgagtggtctgttgtggagggagtttggaaggaccttagctttggccaaggctggccttggctttcgacttcccagctatcttggagcttggatttaggaggttactccctccctcagcacgactcctttccattctgttacctgctctgtagagtccagtgtacagctgggtttcctgtgagtctccatttagtgagaagggagatgggcaaacagtcttactttgtcgtagaaggcaagctatacataggccaaaggaagaagaagttgcctctggacaggcagatgtgggctcctggggccttggtgagtcaggaggggtatgtcctgagtcagttctggggatttaaggtgacttatgaggatgactggtaggaaagatccctgccacagtgagccaggaagctgttcctacagaagccatacagcttgctgtttaaagcccagaccctggtcatcaccagcccctgaatgttgtacaaccactttaagcttatctccagctagcttatgaataaatgagactcggactatggttattttatttggctttgacagttactgggggtcaccctaatttactcttctaactgctggcctggctacctctctagtgggataccccagatacttgctgtttctcctgactacgccatggccccatctcctcttatggtggcttcctcttctcctctt

SEQ ID NO: 30776 - DNA, 1206 bp, Mus musculus
gaggcagctggatgtctctgcataatctaggagccatcatcacctgtgccccaagtgtgccatgagtaacacggaggctgggtgtggcttgtgacatgtctgctatcttcctagtctttgtaaatctaaatcagttctgaaaaatacagcctgttactagggaggagaagccagcctggctcttttctggcagaggcttggggttgtgctgtctgctgagggtggagcctcctctgttggaatggtggcttggggaagagggcacatgggctggccacttcctacagtgttgatgcccacccagagacaacctggctttgggcttctaagagtgtgacatcattctgactattttccatgtgcccttgcagcatgtggcctctgaactacatccgggacacagcagctgtatacagagagcactagaccagagccttgtctttggggatgtgcacagtgtaccataggtctctccaaggcagttttccaagcctcatcttctagtctcctgtgacagctaggaggccagcagtgggttgcaggccaaggatttacctctgtatgggctgtgagaagcctccagcagcaggctgggcatctgtggatgtcgcaggtgtcagtcctagtcagatgggatgctttgtctagtttgtatacagcctttgacattgtgttatgatgccattatctacaaatttcaggtttgcagtagagttataaaattcccccaccccaatgcacaaatgtcataattttgaagtaagtttgtgatttgtattgggttgtattcatagctgtcttgtggtgcacatggcctgtggctggacaagcacagatgctgactcatgggttaaggttcctactggtagctccctctcacccccacagtagctgatacccttgggcctcacaccaagacatttgcctcttccaagatgtggcctcaacctttatgtttgatcccaatgccacataagccagatgtggtagttcatacttataatcccagcacttgggagatagaagcaggaggatcagaagtttaaggacatccttagctgcaaagtgaactggaggttagcttggactgcttgaggccctgtttgaaaaataagcaagcaaacaaagaaaacaaccaaaaagaagtatggaagccatttggaaagcccgtcacccttccccgagatggaactgaacacacagccg

SEQ ID NO: 30777 - DNA, 1139 bp, Mus musculus
tcaggatcttagggatctaacccaagataccaaattctcttcttttacttcatgctttctgcctcaccatggactaaatcattcctttcttcactgtttttttttgtttttgttttttcctttgccatggccagttaggcagcagtacctcagctctggagagcttggacctgtagtccatgtttgccataccagctgacatctagttagcctgctgcaggtaccagaggatgtgcaggaccctgtgcttgcctggctcacctgcaggcttcccatctgcttccttccacacacccttcctcctgcacaccatctactcaggtctgtgatgtctattgtacttaaaataccagcccctgcaggcaaccccacccagtgctttctcctcactcagagaccagtatgtatcctgaaatctcagaaggtatttgctgcggcctgtttgctttatgtgagctgttccttcccctgcagtcacctggttggtgatttatgcctgttttgcagccaggaggaactcagcctgttgatcattgtgctcagggcttcactgaagctctgcaaatgatgctccggagcgccctctctctgctttgctctgaactgcaatttatagtctaaccttgtcctgttggaaacctgggaacctattctgtctgggaactgaccttgggatctgctgtggcctgcaatcctgcctgttgtctggcatcttctatagaccaggcattcctcgatatctgcttctggcctccacagtggatgaaatgtgttttgttcttaagcgagaggatgggggggctggtgagatggctcagtgggtaagagcacccgactgctcttccgaaggtccagagttcaaatcccagcaaccacatggtggctcacaaccatccttaacaagatctgactcctcttctggtgtgtctgaagacagctacagtgtacttacatataataaataaataaatcttttaaaaaaagagagagagagaggatggggactgagaagatgactcaccgagtaaaacacctgctacacaagcatttggacctaaattcaggtctccataaccctcatagagctgggcacagtgctgtgtttctattagacagaggcaggcagatttcaggggctc

SEQ ID NO: 30778 - DNA, 1177 bp, Mus musculus
actatagggctaatttattggcctgtcatctatttacttatcatttattgtccctgtcatctatttctggggccataactctgtctctggaaggtccctgttaattcttcactcactggacaagcagatttctgtaattttctttcagtttttagagactccctggtgggctgggaggaagcatggacatgctgaccccttcttgcccagtgcacatggtgtagggactgaaggtgactgctcagatgcctccggtttggggatccacattttgcacatttcctcttaacatagaggtagcgattgggaacctataggcacctggtggcttagttcctgacctgagatgttttaggtcagtgctgcaggctatgccaggcattgtgcccagcagccaggaggggcaagcatcttctagttttcctggtgcacacacagtggcttcgcagaggtgactcagcggcttaggtctgcattgactcatccgcaaacttcaaggttggaaatcatttgtgttagcaggttttgatctgtgttcctcagccctccaaggataaagaggtgctgtaggtttgaagaaaaatttactaatttttttttagcttcatgaaagagatgaattacaaaaaattcaccgtgtacatggaaattccattataatctgtaggagacgaccgctattggtacgcgtcagactgctttgggctgtcaccacaaaggctctgaagtgtctgtgtgacacctctcctcaagtgttactgaattggggttctattggtgtgtttgggcttgtcacagttgtgctctagttagggctcctaatttgcaagcttgtctttcctcaggggcctgcagccaggtggctgaggttgcagtgctggcagatgtgcgagtgaggaggggctgtctttctgcttggcatctgctcctgagagtctcctctaatgtccctcacctcatcacaagtgccctcccctccctggccaggctcctcccaacactggcatgttggtgattagggcttcacactgatcctcagttctcacagagatgtcacctacttcagaaatgcccttggccatggagccctagatgtcctagagctagctctgtagtccaggctggcctcaaactcacagagatctgcctgcctctgcctttggggaattaacagcat

SEQ ID NO: 30779 - DNA, 1319 bp, Mus musculus
gggcctacagacattctgggaggagcatttgaagccaggcggaggtctgatgcaagggggaggtgagtgtgcagtgcttggagctttggaggacatctttcacttcagtgcgatccttggagctctggtccagggcctgtcaaggtccacagtggatgaaggctcagggtctttttgtgttgggtttggagggtgggagtgaggaggggttgtggggaagcactggaggtgggcatccctgttgggtgcccaggcctcaggctgtcaggccgcaggctccacctggatgtgagccgtttcctttaccagcccgctcaccagcctctgtgctctagtgctctgggtcccccacgcctgcaatagagcctgccttttctcacatagtctttccctgactggactgtgggtgcctgactccaaacttgaggttccactcctagggttcagaggaaccaagggtccccctacccttctgggtatcgtgctgtctgagcctgtgttgtgccccagccacgcttggggctgccagaaagacagagaagcacaagaggcaccggatctcccgcctgcttgtccctttccctggcctgagtggggcccagcggtagccttaactggacagtcctggggccatcagagtgggagtgaagggaaggggttttttttggtgctccctacttggtgttagccaccctggttgaagaagctagacagggcagtgggtctctgggctaagggagtcaagctggtgctatgggattcggctcgatgaatgaagcactttatggactgcggggatcagttactgccacacccaataaactggaagtgtttacagatggtttccacgctgcagtttctctccataaccccacaaacaccatcagatgtgtcttggaaactgagtcttaagttgggatgggcagctgcccctaccctggtggtccctgtggggggagtgttgtatggtagcttcctggatatagaagcatagcttcctggtgtagggaggcttctcagactcagaaaatctgttaagtttacaagtctcagaaatccgaaaagtacacagggcacaagtggtgcctgaagtgtcggttgctgagggaggagactgacctgttgagtgctcctcatgatacagaactcgagggctgtatctccagttctcacccatgctgtgggccttgtatgaggaattctactcctgtgagctaagctacactcctgtaaggaaccccagaaaactcactggccttagcagaattatttctttggtctttggagccagatcagttgagttcatttcctattgctat

SEQ ID NO: 30780 - DNA, 1198 bp, Mus musculus
ctgtgtggggctcagctctgaaccagagtgtgtatgtaaccgtttgtctctcttaattacactaatttgtgtgtgtgtgtgtgtgtgtgtgtgtgtgcacgcacacacgcacacacactttgaggtcagagaacaacttgcaggagtcagtccttgctttccaccatgtgggtcctggaactcaaactccgatcatcaggcttggcagcaagtgcctttacccatgaagccatcttgctcttttcccgactctttgctctttctgaataggaaaagccagtcctcccaagggccctgatggcccagtccctgtcagcgtgaacccttcttactgcctctgctgtccccttggcatgggaggtgggagctgtgagaaggtgtccggtcctccgggctctgggtccctttcgggtttgctgcagtaggtgagcgtgcctctctctctccctgaaggacctgtgtgagcggcacgagaagggcgtgcttcacaaacaccagcgggcactgcacaagtacggcctgatgaagaggcagatgatgagtgcagcgcacggccgagaacctgagtctgtggagcagctggagtcacgaatcgtggaggtgagcagcaggcaggtatcggggagcagctgtgggctgcagggggagtggcatctggagttgctctgagctcagaattgtggggatccagatcagggctgcggtgtgggagaggtgggagctgtcccaggggctcagcgctgtttccctggccttggatttgcttggtgctcactcctgagcatgtgaggacaggagccagtgcccgagctcaaagcagatgatctgtaccacatctaaggggcctgtgcacagattgctctctgcttgcagcaggagaacgtgatccagactatggaactccgaaactacttctccctctactgcctgcaccaggagacgcagctcgtccacgtctacctgcctctcacctcgcacatcctgggggccttcgtgaactcccagatccaagggcacaaggaggtgagccacccctgcccccactgttactaatgccagcctgtgttcaggtgcctggcctgtcacctgtagccagtgacctccagaatggagctgatacccattggcctgaacagttcctagttctccagcctcttgtgtggccagaatggtgacgctgaagactcgtgagtgggat

SEQ ID NO: 30781 - DNA, 1237 bp, Mus musculus
agatctcaaaaagtaaaaagagggctgggggtgtggctcagtggtagagcccctacctagagtcccccagggaggggctggggcgtggctcagtggcagtgtagaggatttgtgtagttgctgatgtcctgcctgctatgccccttttgttttatagcgcttcaagtcctccgtgtacagacgctacaatgacttcgtggtcttccatgaagtgctgcttcacaagttcccgtaccgcatggttccagctcttccgcccaagagagtgctgggaggtaaggcagggttcagggaggcccggcacagtgaaagcaagctgcactcctggttgccaggtgggcccgttgtagcccaggctgctgcagcttgtggtctcagaggggctcatgtacatggtcctgctggggtcggagctctggcttagccctgccatggtagaggagggtggccagactcaggtgccttctgaccccagtgttgcccctgctgggtgctttgggctatgcttgggattactaggatcaggccagccatcacaggatctttcttatcaactacaaatgaccccagaaccccaatgaaacttgatcaactgtgttgctgtaacaaaacatcagacaaaagcggctaaggaaggaaggtgcagctgtcatggggaaggcagggctacaggagtggtctgaggcagctgctgacattgcatccacagtcaggaggagagagaagagctcagctctttttctgctttcttccttgctggacctcagaccgaggagtggagctggccacctttagggtgtgtcttcctacttcagttaatcgaatctagaaactcactcacaaacatccccaggactggagattctagatcttatgaagttgacaatcggtataacccattaagtgggcagcctaattaatcctggtggcgtcatgagttccagaccagtctagcctacatcagacaaggtgcagagcccgccagctcactttcctggtgtccccaaccttctagtgcaagtgaacatgcacagtgggggagcttggttgggctttaagtagagatacagctgcctaccgtcctgaagctcctcactgtggctatagacgcgacacggttccatcctacttccgctgggcggctcagctgctgatgactgcccctgggacagctctgctccccactgacaaggaatgttgcacgcagtgggaattggaagataaactattaggaagg

SEQ ID NO: 30782 - DNA, 1124 bp, Mus musculus
gtgtgtctagtgcccatggaggccattggatggctctcttagaactggagtttgaattagaattggttgtaagtactgggaagaaaatgggtcagtctactgcaagatgagtatttaaagaatatttgaacccgtttaattcacagattccagtatgtatattatttccagaattggggattataggagtcaggggatgctggctggtgtgactgcaaggccagcctgccttcaacaagtctgctaggagcccagtgggtcccgtccagtgtatgcagggaaagggagagtaatgagaatctggcccttaatggttggaactcttaaggccatctggctttgggcatcagggtgtcacagtgtcatcagggtgagaagagaaacagccttttggtttctaccaggaggagcagtgtggaatcctcacatcagtatatgcctcctattctgttactgataatgaacaagttgttttctctagtgtgctgtgcatgccagcagttcagtacttggaaggtagaggtttgaggttagcccttgctacatagagggtgcagagccagcccgaggtacttgggaccctatatcacaagacagatagaagggggctgaagagatggctcaacacttgctgttcttccagagcacctgggtttgattcccagctcctgcatgatggctcacaagtctctgtaactcaggagtgatcatgtggtacacatatacacaaaaaacatttatacatgtcacaataaagtgtaaaaaacccaagcaaatggaaagaagcagtgtgttgcgttctgaggatattttgctctgcgcttctcaggagaagcagatggttagttacaggctaggagcactttgagctcctgggaaggagtctagtctgtatggaagctgggcttttctttattgtgtcttgttaagtttagatccagcttagcaggctgtttaattgtatggtaagcaggcttttaaaggaacccggagtttctgtagtgaaggtgtgtggcatggctgtgttgaaaatctgcctcttacctcctcactccttgcctgctcttgattctggcatctttgaaatgtgtcttaattaagtttcttttgctgtgacaaaagcc

SEQ ID NO: 30783 - DNA, 1184 bp, Mus musculus
tgaaaaaaaatgacagtaatagtggctagagatttgtgcaattagccattcttttaagtttgtcttagagcagtattggagattgaacccagggctactcctgtgcttaggttggggtgctgcctttatgttatatctgtggccctttgtattttacatctttaaggttattgtttttgtgtgaagtatggacaaggctatggaggtcagaggataactttcaggaatgggttcttcccatctggttaaggacgggtcaagctgactttgaactcagagccacaagcatctttctccaccttcaaagtgatgggcttacatgtttgcaacaactggatacatttagagaacacttcccatcaaaaggagtgcaagggtcagccttccttgtagaagccaagtcctgatttctttgttcatgtgaaagcacttggagtagatgcctcttaggaatgagcagcctgctgactaatgaatgagtgcttcttggcttaaatagaaactccttgacatttcttttaccccttcagaactacttggtgatgtactcaaagatcggcctcaggaagcggacgggattgactcggtgattgttgtagacaacgtccctcaggtggggccagaccgacttgagaaactcaaaaatgtcatccacaagatcttctccaagtttgggaaaatcataaatgactattaccctgaggaggacggaaagacgaaagggtgagcgcgctagttgctgaagcagcagttgaggacttgggggtttgcgtgttcaggccaccccagcgggaagcgctctagtgaagtgttggttctcaggttccagagctgagccccacagaagcagcagactatgcgagcataggtcctagatcaggatcccgctggcctgagagtgggcagaggcgggcaggcctgcctgtgggatgtctctgggagtgcttttgaaaacattttaacttctctgaagcagaggtgagaccttatagcactgcttacttagcacctaagtcctgggtgcggcctaaagtgtgacctgcagtttgctctttctcgtcaaagttaggtcttccatgcttgagtctaggcggccattgtgttgtggtactgagtacgactgtaggcttaggccctctgtgaaggcctggggcttctctgtctcccaggaccgaggttcatga

SEQ ID NO: 30784 - DNA, 1142 bp, Mus musculus
cctcctttgacatatgtgcatcactgggctgtcacaaggaaatgaccatttctgttaaacttttctgtcatttataatcatgaagtcagtcttgatctattaagatttttttctcccttccccccctttttaatgctgctaatgactgtcatttattactgatacagccgtcagggtaaatagagaaaataaaatggaaggtagcttgagaagtccgaatagtagagtatagaaaaccttaagattcctcagggagctgcttggccgtgtcactgctctgcattactgtcctcagcgtgactgccttggagacgtggtaggacggttagccgccccgtctgttcatgtagagagaaaggcctcagtgtacagacagtaagtctgaaggatgcatgtgtacaagccgctcactttctccttcaggtacatctttctggagtacgcttctcccgcccatgctgtggatgctgtgaaaaacgccgatggctacaagctggacaagcagcacacgttccgggtcaacctcttcaccgactttgacaagtgagttggagtctgagatctgtggctggtgcctgtgggtgctgggaaggccctcagtgggtgctggtggtctttcaggtgattggtttctgttggccaggcgagagagaacattttatggttttgctttgagtttggggtgggtggagagcgtgtggagctgcctgcctatgcatcctctcgtcccacacagcggtggaactcagcagtgcccattctgttccaggtacatgacgatcagcgatgagtgggacattccagagaagcagcctttcaaagacctggtatgttttaccaaacatctgcctttgtagtcaaaagacattttgtaactgaggtaaaaaaggtatccatatctattgaacttgtcatttgtcattaactaagatagttatcagtaacctttctttgattaaaattaatgcgatgtactaagtcccttgattttgattggttttagggcaatttgcgttactggctggaagaggcagagtgtagagatcagtacagtgtgatttttgagagcggagaccggacgtccatcttctggaatgacgtcaaggacccagtctcaattgaagaaagagcggtgtgtacca

SEQ ID NO: 30785 - DNA, 1472 bp, Mus musculus
tcctctgggaagtcaggagtgatctcagcactgtggtaagatctgtgaacaagaaactaggaatgagggtctgctgacgagccctggctgcttgttagaccaccacatagaggacatcccaggagggtggcagtgctgctgctagtgggtgctagggagcttggggagaagcagaggcgggcatggccatctccagaggtcagggacagcactgtcaccatgttgatattgttggtgcaggacggagtgcctacctgcctgcctgcctgcctgcctgcctgcctgcctgcctgcctgcctgcatgtggtattgcttggtactgggctccttcaggaaccatgagagagagggtggggggggagagggcgagcgtgagcgctaagcctctcatggcatggagcctgctcagtgaagagtccggctgtgctcccttgctttgtgtctgactaaatggtggttcatctgttgcagtgtcaccgtgccgtgcccaggatccgaggccacccttcacggcgagcctcgtgctgggctcttacctgtgctttcttgctctggactgcgagtgcacccagggttcttctatcccgacacagctctgtgccttcagccccaggtccacagcggggacactcgagcctctgctctcaccttgccctgtttgggtttttatcagccgtgtctgcattggagcctcactgcagtgttcctggtggctcctcttaactcctgctgctgtccatggggtttccagagccttcacctacagctcagtggggtttccattcacggacttgctgttcctgtgggccagtgtcgtgtggcctggagaccatcaggagtctgcacacccaccacttacttgtgccagaaactctggaggcacccacacctcccacctgttcaggttgtggcagcctctgtgcaggttggatgtggaaataaaagcaaccctgtgtgagaatgctgtcctgatctctttgtagctcagagtggccttgaggcctgcccagtccctctccctagggtaagggtacttgcatactgctcctggattattgctaagaacctacctgtctggaacctctctggatacattggacaggttggaaagcggattacacagggttagccacttgacatgcacctctgtagttacctagtatccagtagaaaagacagcaaacagtgatagatgagcttcacccaaggatgcgactggccaagggttgctgctcaccctgcatctcactgcctcagcatctcctgaccaggtagcccccccagcatggcctgcagccatgctacgtctgtagagcatgtacctctagcagaggactgactggtttgcatgtggagcagaagagatcagtgccttcatgcttcactgggcggtggctcacctgtcctcctgtgtcttggttccttactctttgacctctctgaagttggatcatggttgcaggcctcttca

SEQ ID NO: 30786 - DNA, 1144 bp, Mus musculus
cagcccacgcagaccagtctttactctgtcccaacaggttccgctctgtccattgccacctgtacccagacacaccctggtgtcctcgctccgccatcttctagcagtcgtggttgaaactctgtccctgggcgcccctggtatccaaagggcccagggacctttattgtatgccctggccttggtgtccgaggctcttcagggctatgtgtatgtgtgtgtatgtctatatttgtgtgtttgtgtggcgtgcccacccgtgttgcagactgctgggcagtcgtgttcttcagggagtggcaggtctgtccctaactacactctgagcaccactccgagggcagttgtgtgggatctgtgtttggatctctgcagtgggggtgggtgaggccttggggctccactcaggggtccgtgggtgctgattgtagcagtctcttatgttggggtgctagcacctatctggagccttccctgtcagctgagctgtgcccagtcctagggaagctgatttgggtagtaaaggcctggaccccttgtgagctctggcccgggcgctgcctggtgccattctggtgaacaatgctcccccaccccctgccctccagggtggaggcgaagtcttcagccccaccctctgatgccctatctttgtctcccacaccaagtggggttcagagctatgaattttatctcctctccaaagtagagagaaagtcgcccatagtgggtgtgcctgtacatattgtgacagtatttttttactgtgctctttcttgaaaggggaggggtgggtgtgaaaggaggtggggggtggttgttttctggggtgggctggagagggtcttattttatcttttctgtggatcagaaaaaagtggaagccagacaggcttggtctttggaaagctggacaatgagtgccttagtactgtatttatgccttccagtatctggaatcctgctcccccccaaccctccccagcaccccaagacttacctcacccccaccacccccaactcctcactcccctacccctgggctgtattctgtgttctttttgcaaagaccttaactaggcaagctaatgatgataagggaaaagctctcagggaattgatgtgttgttgctatggtgacgtc

SEQ ID NO: 30787 - DNA, 3204 bp, Mus musculus
tccagcggcagcgggcactagaccgcacaccggccagccatctgcccccacgtgccaatgccccacccttcctatgccagcaccgctgcttccgccctgctggaccttccacaagccacaccgggccagccctaggcacacctgaaggcccccccgctatacccaccctgcaggaggcatggaggtgcccagcatgagctccgggccagcctgtgaagtgaggcttctggggtgctcacctggacagtcgctgccaccagcaacctgaccctgcctgcctccgtctcccctgcccttctgtcctcttgggctccctgagccctgctctgtgccgggtgcttccaccctgcctgcgttccttctacaggtgacccttcatgctgccccttgcactctgggcgtccccctccccacagctacagcgagcctttcctggtactgccctaccgccacactcctgagaatcccatctccattcacaggcaggggaccctgtgcctggcgcccacctgctcatcaccgaacggccccttcatactctctggtctttgcaacgtccggcgcctgccttcccttagccacctggcttacttggctcttcctgttggttctgagctgcctctagggtggggctcttcttacacctcctccccacatgactcttccctcagtgcccagccagccctccccagacagcaggtgccaagctgagcccaggtcactccctggcctctcagtgctggccaccttcttggtgccaaaccctctttcccattcattcctgaagagtggcagctttgtcttcccctttgtttttgcactgaccacacttgtcatctccagggcagtctgggacataggcgacgcaggacactgcccactttcctctcggtttcattctcacccaggacaagcggcagtgccctctggagcccagccttgggggctggacctgtgacggctgtgaatgtgcccccagcctcagaaggccccccccaccccccgctgggactaaccactaacctcactctcagctgccatgggcactcctggctgaccctgagccagcaagcgtgaccctaagtctagcctggagccagggctagagtggtcatttctttgtggggtgctgccagggaggggccagacccacaggctactcaaagggcctagagacccctccccaggcaggtgctgccccaggaggagcatgtcctggggtccggggactgaagtccatgtggcctcagccccccacacccagaacaccgcttgcctaaggtgcttttggctttagtgtgtgatgtttgctgtgcttctgggctgaattagcttccaaatcaggacctggagcctctaccctggcccagccagccagtgtgagctctggtctgtgagatgggcagctacgggccagtggagcagcatgtggtgggaggggcaaggctgggacccagtggtttacagacctgtggccctcctggagcaacctggcagctacggatcccagaaccccctgggcttcagctcccccagaggggagaggctccacgttgctttccttccccaaaatccctttctttgtgctggtgtctgggaccaaaaggagtgggcagaggactcggagggcctaggggtcccagtcggggcatctgtagctcctaagcacgacaacatcagtgcaggggaccctggccttgactccaactggcctggcgccaggaacctccagggccagagcagcccagctgcagccagcctgcccactatgggtatgttcctggcctaaggtccggagggaggtttggggtatccctgcctgggtgcctgggtgtgccctggggcctctcagaagcacaaatgctgccccctggccgtgagcaggccacaaggtgaatgtatatagcatgagaggcgggcactgcccggacgtggctgtgaacttgtgctgtctcgggagtcctgaccttctgtgcgtgagtgcccccatctgtgacgtttcactcaccgaggctgaagaaaggaagcaggggaaatgaaagcaggggtttctcgccctgacccctgcggaggagacggctcctaccactgcggttggcttcatttcgttttcctgatttctggggtgccacttacctactcaatcccagtggtccacccccacatccccagggagtgagcagtccagtgccagctgcctgtgattggtccccagtccctattacccaaggggaccctacagctctggtgggtaacaaggagggctaagccaccaaaccagagcccgatcccttgccgagccaggaggagggatctggctgagaaaactgataggactggaggcccccaccccaaccaacactctctggtttatgtgagtagcagaagatcccggcctggagcatccttcaagcccttctccctgtgcccaccccgcccccccccccccccatatcactatgcaattcttgaccccagctccaaagcttgccctacccggtcccagctctgtccggcccagaaggtggctagctggtgggccacaggtgaccagggtctctttgtttttcatcacagcggtggtgtgccgcacccttcctcccatatgtgattttgtgagattgcctcccagttacggtccctctgcctgcatctgcccccagtggactatgtcatctgaatcgagccagccccaagttcccctccagcctctgtagggccatggctgtgtgttactgttgctgtgctttcattttttaaactgggtttggggtttgatttttatttctgtggggaactttatttttcttggcaaataactaaagttcttgtccatgtaatttctgtggtctctattcagcttgggtttcatgttttaaaataaacaattttaagaaacagctctctctctctctctctctctctctctctctctctctctctctctctctctctcattctcatcatgaacactgtacacagagtagctcaggctagggacacagggttgctgaatgaggtctgtgggagcaattggctgggaaggagccgtagagtgacactatctagtattcatttcgactgaattgctctagctgctgagtcaggaagggatgaaggacgtatagaagccaaggaccaatcagaaagctctgtactaaagcatggctccagggaggggctggggctgtggctcagtggtag

SEQ ID NO: 30788 - DNA, 1982 bp, Mus musculus
gtcccattctaggtcctaaagaaggccttccaggccacactcagatggctccagaacccacacaagacccccagcagctctgatctcagctccgacgccctgctgtttctcggaggtaaccctagctccttgcagagctgtatcaagttggagctgtggggcagggggcagctgggagctgggcagggtgtccctcagggaaggcagagtgtgactctagaggccactgacctccccttcctggtacagagctgttccccatactacagaagcgcctatgcagcccatgttgggaggtgagggactctgccctggagttcctgacgcatctgatccgacactggggaggtgagcaccctggggacaggagtgtgtatgttgtgtctatgtgtcctgctggctttggggctctcactacctgagtggcctttgatcacatctgtgtggcatttgaccccccccagggcaggctgacttcagagaggcactgcgttcctcagaagtacccacacttgccctccagcttctccaagacccagagagttacgtccgagcaagtgccgtgggtgccgctgggcagctctccagccagggtctgcaggccgctcccgctagccccgagaactcgcaggcccaacaggtagacacagggagttggtgagcagctagccaaatctgtagcaactgcttctgagagggggaccaccaaggagtggggggcagtcgggcatagtgcctgtgctctttctgacaccccaccctgataagcaagggcagggctggaggaactcagaacacatcgtgttgagggaccagagcagcacatggcccgtgctatggctgagtacttacgtctcctgggttccgtccttggctcgtcactgtattagttggatttcttgctgctgaatcagaattcctgaagaaagcaggttaaggaagtgagttcgttagggctcatagtttgagggtgccatcctcctggttgggtgagccgtagtggtaggagcttgaggcagctgtagtcagggtgcagagagatggacgctggcacctggctcacgttctcctttctattcagtgtgagaccccagccgttctgtgccttagccttccctagatgctctatcacggtcactcagagggcggtctcatagctgcattggatccttgacaagttatcagggtcgggccgacttttttggaattctccaacctgcagggcctactcatggaccttatgcatatcctgtccactgactcagagggcttccctcgaagggctgtgttacgggtcttcacggactggctgagggatggccatgctgacgtggttcgagacacggagtggttcgtggccactgttctccaggcagtgagccgggatctggactgggaggtccgagtgcagggtttggagctggcacgggtgttcctcacccaggcactgggccagcccagcctccactgtccctatacagtgggcctgcccagggcctcctctccccgcccacacccggaattcttgcagactctctgccgtctgccgctctttgagtttgccttttgtgccttgcttgactgtgaccgaccggtggcccaaaaggcctgtgacctgctcctcttcttgagggacaagacagttccctgcagtagccctcgggaggcaggggacagccccaactcagcctcagtggaggctgccctgcagaggtggcgggaaggagagcaggcccagcccctaggggacctggatcctgaggccatgctagccatcctcagggccttagacctggagggcctgcagggcaggctggccaagagcagcgaccatgtggagaagagcccacagtccctgctgcaggacatgctggccacggtgggtgtgttggaggagaacgaagctgactgctactaaggcgtgtccacgtcctgtccctgtttccatcctgtgccagcaggaggaccccagcccaggtcag

SEQ ID NO: 30789 - DNA, 1982 bp, Mus musculus; identical to SEQ ID NO: 30788

SEQ ID NO: 30790 - DNA, 3358 bp, Mus musculus
gaagctagaaaaacaaacgatatttatgatacagaaacaaatgaagaggatttttaatttcttctagtgaagaagactggatgagattttacatgagacccagctgaaggttctgaccatcctgtctcaagcttgtattcattaagaaatgaggtgttcagtcctgctattttgttgcaagatggatttaaagttctgtcagtgagactcgctttttgcttttggttaaatgttcttgcacgggtccctgtgtctttgccctgcagtctgtctctctgccagcttccctgtgctcatccttcctggtttccttccttctcaaatgtctcccttcctcatgttttccagaactacttccccagtaagcaagacatcctgctggctagaaaggccaccaagggaatcgtggaacatgacttcgttataaagaaaatcccatttaagatggtggatgtgggcggccagaggtcacagcgccagaagtggttccagtgcttcgacggcatcacatctatcctgttcatggtgtcctcgagcgagtatgaccaggtcctcatggaggacaggcgcaccaaccggctggtggagtccatgaacatcttcgagaccatcgtcaacaacaagctcttcttcaacgtctccatcatcctcttcctcaacaagatggacctcctggtggagaaggtgaagtctgtgagcattaagaagcacttcccagatttcaagggcgacccgcaccggctggaggacgtccagcgctacctggtgcagtgcttcgacaggaagcgcaggaaccgcagcaagcccctgttccaccacttcaccaccgccatagacaccgagaacatccgcttcgtgtttcatgctgtgaaggacacgatcctgcaggagaacctgaaagacatcatgctgcagtgagagacagcccctccctctgctgtcctctcggcctctggggctgtggccgcccacgtggttctggtgtgtctgccgcctgcatggacctgcagtgggcatctcgaatccacaccatctaatacctggctcaagagtgctggactaccagccacaccagcgagctccgggcaagaggacgcgggagtgtcagtgatagctactgaatcggggactgtgagactactgaatccacaccatcactctgctgttgatctgtaaaacctggggacacagctttcgcctctctacagaaactcttccttgttgacacagttaaccaaggttcaggtgtacgcagacacacgcgtgctctcattaatgacagaaacccaaccccagctggccttgcagccggctctcccctctgccgtgcaggttctcactgagtcacactaactcgggagcttggcctcacactaggctgtaaagagcatgcgatgctgctaagctcaccgtgtccaagcccaggcctcagtgccacctcccagagtgaacacacagccttagcatcgtgccagcaccctccgagtctcgcaaaggcgcaggcggggtcaggtgtccacactccccacggtagagaaggaacctgctttagtgcccaggagacactcaccgtgtctccatgcccatcgggccacagtgtgcaaaggtggccccgtgcagctctggctagcctgtgtacacgtagtggtgctctctactccttcacccgtccctccacagcccatggcagagacacataaccaagtggccttgtaggttgccttacttgacagttggtggcatgtagcatcccctgtgctgggctctgaaggtggaccagagatgctctgcagctcaagagcatcttcttgcctcgactgcttggtgggccccagccagcagccttcaggagcagccctgggctctgcacaccaccctcaccattgccttcacacagtgcgctctgatctcagggtagctggcaggccacatagtcgctgtgcacgcaaagccagccggcaccctgctagccctggtccatgagggtgcagaaggccgggacatcagcacaacctgctaagccctggccagcctactggcaggcgtcgcactgttttacagtatattgcattccagacctgcccctctgtacattagtgactttctgggagctggggtgtggctcacaacttcccccgagtgttctttggctcactaacacctctaagggccctgtctgcaaccaaactgctcctgacacttgatccctgttgcatcctggtcttggctcatttcagccaccagacatgtaggatttgtggagtagatgctaggccaggagacagggtgggaccgcttcttagagccctcgttattgcagtgctctgactgggaaatagccgtcagcctctcgctcacttgttcttgctctctgtgctcagtggtgtgtatcagtgcttgctgggcttctggctctttcctgtggagagagagcagccgttctgcctgcctcaccaagtcttcacaagccgaggggatgtggccaggttaggaccagcggccagcaacctttcagggctccctcaccaggtgccctgtggatctgtcagtgctgagaccccaaacagacacaacctgttcccagccgctgctgggggccactgtgaccaaggtgagtgtggggttgccaggagagcgctgtccctctgacagactgaccgtttgtaccagtcactttgaaaaccagaaggcagcatgtgagtagcaagatgtgaacttgagctagctgagcagaacgcaggtggatgggcagaggcccaccaccctggcgagctgagcctggctgtgtcctttctgctgggacacccctcctctgtggtctgtgaagtggtgcaatcggaagaccaggctggagtcatttacaagtttctccacgtagattgtagtcaggtttctcccagaccttaggcgtttgtatttttttttttaattttaatttcactgttacccttgactattgtcctttctgttgcagtgatggagaagcaggaggtgtttgtgcctcatctattactgcaaaaaaaattaaataaatgtaacaataaatgtgataaaaaccagtctgcttcatgcctagcatgttagagagtgggcacggggtggggcgttgtgaaatgcactcttctctcctctgtacagagattatttcacagttcctgacccgctctgtgatgtcacaggtcactaggattatttcacagtttctgacccgctctgtgatgtcacaggtcactaggattatttcacagttcctgacccgctctgtgatgtcacaggtcactaggatttctagtcctctgatttccctactttgagaagataaaaaaataataacaaaaaaatctgaggagatccctcg

SEQ ID NO: 30791 - DNA, 1134 bp, Mus musculus
ccaaatggcggatgacgccggtgcagcgggagggcccggaggacccgggggcccaggattaggaggccgcggcggcttccgtggaggattcggcagcggtcttaggggccgcggtcgtggccgaggccgtggccgtggtcgaggccgtggggctcgtggaggtaaagctgaagacaaggagtggatccccgtcaccaagctgggccacctggttaaggacatgaagatcaagtccttggaggagatctacctgttctccctgcctattaaggagtctgagatcattgacttcttcctgggtgcgtccctaaaggatgagattctgaaaatcatgccagtgcagaagcagactctgggctggccagcagacctggttcaaggcttttgtcgcgattggggactacaatggtcacgttggtcttggtgttaagtgctccaaggaggttgccactgccatccgaggagccatcatcttggccatcgtctctgtgcagagaggctactcggggaacaagattggcaagccccacactgttccatgcaaggtgataggccgctgtggctctgtgctggtgcgtctcatccctgcccccagaggcactggcattgtctctgctcctgtgcccaagaagctcctgatgatggccggtatagatgactgctacacttcagccagaggctgcactgccaccctgggcaactttgctaaggccacctttgatgccatctccaagacttacagctacctgacccccgacctctggaaagagactgtcttccaccaagtctccttatcaggaattcatggatcatcttgtgaaaacccacaccagagtctctgttcagaggacccaggctccagctgtggctactgcataagggtttttacatgagaaaaataaaagaattaagtctgctgaaaaaaaaaagactttaaaagaaagaggagaaataagtataaaacaagatatatgaagtcacttgaactcacctgttaatgactgagcttccagtaaagaacaggcgctaagaaagacaacctctggtctcaaggagcagatatcaaaacaggtgggtttgtgaatcttcacagaacaagaatcagggacctgtgaatgagactgtacctgcact

SEQ ID NO: 30792 - DNA, 1179 bp, Mus musculus
cttcaagctgggttttgttacactgccatcagcatggcgtaacaagcccaccgagtcttgggtgacttccttagatctgtggagtcctgtgctgctcgctagccaaaagttcttcatacaacagcaagagttggggaatgccatctgggcacagaggagcaaggactctgaagtgccccgtttaaaaccaaggttagatgctccccggtgccttttgttctgtgctcctccttcacactcactctaccttctgagagttcattttcgtctcacagttgctatttttccttcccatgtcctttttttttttttttcatctgacagtctttcttcatttatgaaaaaaagcagcagccattgagcccaaactagatccaacttaggcttttcaaacattgacttcccaaaactcgcgtgtatttccagcatcttgcctggttttgttaagtatttgaggtccacggttccacttgggtcttgaattctatcccctgtcttcccgaggaacatgtgatgtgaactcttgaatactcaacctgtttccttcgcggaggcgattctatcatgtccgggactctttgggtggcggaggagccatgcccttcccagccttccctctcttgtcacagttctcatctagagcagaacctccagaaggtgtggtctccatcctctctaccctcccccacacttgtctgttcctaacctggtttctgcttcctttgttttatcacggttgctcctcagcaatgacctctgtgaaatcagccccagaagaggctcctgcctctgaccggctcagtagactccccagttctgaactcttactgcttgtgaaatgcttatagcaagtctctcttagtctttcttcccaacagacctgagttctcagtctctccatcagtgtgtatctgtgtctgtctcctggttctccttccagagactgaataccatcatccaccttccattaagtatcagggtttcccaagcttagagttttggtgggttctattcttattctattattcttattcttatcctaggctatctatagaaatcatttgaattgttttggttttatatctgtgactcaagaaattatatgatacccatcctatctaccaaccctcatcttgatggccctctgtatgtattttggaggcatctcaaatgtgaagt

SEQ ID NO: 30793 - DNA, 1161 bp, Mus musculus
gaggcagacactggtggtttcagtgaagtgacccctagcatgttgggcatctgaacacttggtcctcagtcggtggcattttgggggaaggcttaggaggtttggctaaaggaagtatgtcactggggcaggctgtgaggctttaaaagccatgagccattcccagtgatctctctgcttcctgttttcggtttgcgataggagctactcagctgtccctgccagtgcatctgcctgctgtcatgattccctactgtggtgggttcttatcttcttatttttccaaaagttgccttgattgtgtggtactttagcacagcaatacaatcctaagacagacaccgttgtctaaggggtgggagaactttctggactcaccctcagtgactgacggagatctaccctggattgcctgctcagtcatgtgtagttcaaacccaacagccaaggtatggagctgttttctccagtccttagtagagcaggagtcctggatcgaggccagtgaaagaagaagccattgccaagtctgagtcttgtggtaacatctgtaagagcagactgtgggatgacaggagggagcacggggaaagagatagagatgtaccagacaaagctctcagaagagaggggcccgtgccaggggagcgcccagtagaagattaagtatcctggcagtgggacctggagggagaggtgacaaatggccctttgctctgggaagtgagccagtgatggcttcgcatccaggtcttagctcagtgttccttacaggcaggatgaagggcctcattccttccaggaaactccctagagcaaacaaggcgaggaggcagccaactggaagagcctcagatggaatggaggatacagcggagagagaggccatggcccaggccttctggcagctgttccttcaaactctggctcccactggagaccttctcctggctctgacatccgtcttttttttgaaatcccacatctggcttaaggttgcaggtgaacttcaaaaaacacactctagatatttctgtctctctgtctctgtttctctgtctttctgtctttctgtctctctgtctttctgtctttctgtctttctgtctctgtctctctctctttctgtctgtctctctgtccccctttgtctctgtttct

SEQ ID NO: 30794 - DNA, 1212 bp, Mus musculus
gactactgaaactagtcagaacaacatgttggccactaagaccccgccacagcattacacaagccacatcagcgacatacagaagtctgctgaagtcctgcactgggatccacatgatccacaggacccaatgcttgcttcctgcacagtgggtgagactttcctctgacctagcctggttatctcctcagctgttagcacttaagaccagccatgagcggccacctgagcttctttccctggtggctttgggaactggcgtctcccttctttttgctattgcaagtgaagagaggatagctataagctaatggttgtctgtctataagcaaatggttgtctctatccagatccaccgcacgatcagatcaggaccacaatgcctcgcccctgtaagctgagtctgcggcagctttgcttgctctgaagtctccagtgtcggggagagggcaaagccggacccctcggcagctcctttctgagtcccaccctagccagctgcagtcccctaggccgctggcctgatctcctgctcctggggtagacagaaggaagatccagagcagggcttgtcttgcgggattctgtaagcacagcttggatggatgtgtttgcgggctggagagggagaacactcatttaatcatctgatcaacggagatcaacacgtatcgatcgcctcctgttgtgtgacaggcagcttgctaagtgccggggacacagaatcaatgcagaaaacaaatggtgactaagcattgctcagatttgtgaggtcaccattaagaacgacctgcaagggtggggagcagagctaccgaagggttccttttcctttttcctttttccttttccttttccttgtccttgtccttgtcctttttcttttccttttccttttccttttccttttccttttccttttccttttccttttccttttccttttccttttccttgtccttgtccttgtccttttccttgtccttttccttttcctttaatgtcaaggccttgctctgtagtccaggctggcctcaagctcacaccaatttttcttcctcagcaccttcagggatgggattttaggcatgggtcatcccttggctgaggggtggattttttttttttttaattatttttaactgtatatgtatgtgtggagtttgtgctcttggtgcccatggaggccaggagaggtcgtcctctttgatt

SEQ ID NO: 30795 - DNA, 1085 bp, Mus musculus
aaacttgctgtcggcggggagaaggagtctgtgtgaggaacgggcagagaaagaactgtggctctggctttgctgctcgggtcagttagtggtcaaatagtgatgacccttaagtaacctcttcttcctaccgccagccctcagcagccccctgcagctcctggcagcccaggcaagttcatccactccagtggtcatcacccgggtgtgtgaggtggggcctgaggagccagcagcagccgtctcagtagccgctaatgcagcgccaaccccagccgcctccactaccacatctgcctcttctagcggagagcccgaggtcaagaggtcccgggtagaggaacccggtgggacagccaccacacagcccacagctatggcagccaccggccctcagggcccggggaccggcgagtgaagtgtcgcctgcaggaaggtggagtgaaactcacgccacaggagccctagtggccagcagctacattcaaggaccgagtggaaaagcccatcacagcctgcagccctcatgtgggtggccgccgcactcggacagtttcctttttatctcctgtcctcccatggtttgaaacaaacacataaacacgtacagacaacttgattgtatgaatctgggggttctgtgtgtttatttacccctctctcatgccatcgcctctccccagttcttgggggagaaggtctatctagcccagctcctcaggaatggatcccaggcagcgcccacaacaagagcctgagccccaggcctggacagaagcacagtgcaaacccaggctcctctctctgagagtgggtccacggatttcctatttgtgactgatccgggaatagaccagaaaacagaatggcaagaacttcccagccacaggctaggatacagagccctctccccaaaagtgacagagactgtggcattaactggggtcagggagatctgctttggctttggaccctaaatatttctttcagctaaatatggaatctgggctcatctccaacctgagacacacagagcagaccatgtgtctctgaggttcccttttgtaggcagccaagcaacacca

SEQ ID NO: 30796 - DNA, 1878 bp, Mus musculus
aggaggatgatggatggtgggtggtatgcggcaggaagacagcagaggatctgggcggtgatctgctcacaccgtctcctcccccacccaccccacccccattccagttaactgagaaccctgtccagtttgaaaatggaaaccctcttttctacctgaccgttatcctctggaaaggaaactacctctccggacagcagtcggtgccaagtttgagtacagtgcagcaagaaccaaagcgtgggtgtcagctgaggacttggacgcccggggaaggtccctttgcatgccggacaagtgaccaacagcactttaacatacaccacaccaagtctcgtgagcaggagccatcaaatgtttctctctgtgagaatgagagttgattttatagaagcagtcatgggggctgtgcgacaggaaactccaaagcagccagaaactcagtgttggtcctcctagagggtggtcggtaagcagctggcaacaacttggacagagccccaggccctgtcgttggtatcaaaccacccaccagtcagccgccttctctgcctggtgccggtcagaagaggcccaagggccctgtgggcagagagcaggctggacaagctgcctttgctggaagggactccagacctggaggctgtggtcacaggagagcagatgaccgggatggataagtccaagctccgatgtatggctgctgccattgaagccaccagtgccccccacacatcagggaccagggcggagcacctgcctcctctcttgagctatctcccaagctccccagccagtcatttctgtagtactcggcttcaagccagtgttttggaggtctcctgcctattgcctggaaaggttcagagaagtggggctggtgtgatggtggctgggggaggggtttcccctcagagggggcagagggctggctctgtctcacatcttcccttggtacctggcatgaacttctctctgtgtgcctggtgtgagcctggggttagggaagaacgaatggggtggagatctgagttgcgtagtgggctgaggtgacaagggacgttggtgccagctgctgatctttccctccatcaccctttactccagggctgtccatggtcaccctccaaggcagattaagattgtggatggtcatgagcaggttgctgtcccagttcctgaaacgtgggctccgtgctctgaggcagatcttcaccattaacaggggcgtggaagggtatggagagagagagagaacacacactgtcccggtacacggcctgacggcctggttggacagcctgagctacaaggaggctagactagtgctgctgctctgcggagtgggtttggtcatctgctgggcagaagctggcaccagagcgtgctcccacaagctctgagccaggagggccatgtccacgcactgtgtggcccatggctggcaaccctggagcaccccactaagccctgggttgggggaacaattcaggaacagatgtgaagcctttatagacaaaggaaccccttgggcagtggtaaaacagtgtaaggtgggggttaaaggtcagtgaaatgtaagaagaaacccttccccatagagagaaacgggtggattgttcctgttcttcctcaaaatcctcaaatttcataacacccacgtgacattgctcgcccagtccctccctccccatccgaactgcacagtgcctgcttagaataagtcagaaaggggtggcgtctcagctctagtgaaaggtccctcatgtgtgggaaacatcacatcctggccaggagaggcaaagtcaccacaaatggccacagggtaccccgaggctaggtcagggggaacagagcggccacctatatcctcacctc

SEQ ID NO: 30797 - DNA, 1178 bp, Mus musculus
actcccagtcctcttgcctcagcttcctgaatttctggggtgatggcctacatgctaccatggcccagcgctgtttgcgttttgtctttttttgtttgtttgtttctgtaccaaaagctgctacactggtgacacagcagggtgtggcctaggtgcccccacagactggcatatggcacgtctctctctctctctgccctccctaacccctaacgtcacagctgcttggcaagggaacatttttgaaccaaccacagatgtttccttaggaaaagtaggttttctactcgtggtgaagaacaaaagccccctgagtggtcctggctgctcctctgcattgcctcactgctccaaggttccctctatcaggcctcagctctactgcagggaacattctagaacctgccccccacacacacactcccccccatgggcacggggcataacagcctgggcaggcctgtcccacagatgaggccagccgcatgccttctccagaggtaccatctgggcacgaggcaggacagaggatgctcgaagggaggaagcggccagctagagggagagcagtttggtaagagctaaggggaggtaagccggtgggactggaggctgagggctgccctcacagctggtgccgagccagcagtggtaaagatccctcagtgaggagtctgtctgtctgtctgtctctgtgtgtgtgtgtgtgtctctctctctcaaaatacttagagtgcttcagtcacaatgaaaagcatgtgtttctgtacttgggctaagctgtcaaacacaggctgcctagggcccccaggacctcttcccctaagtccttgtctgtgtgtgcacgcacacacacacacacacacacacacacacacacacacacacacacacgcacacctgccttgtgagagttagaggactagaagggcctgctgctttacctctggaatcctgttcctgtgactactcacaggtgaccagtgtggaggaatctggggcccaggcaccccaaaagcctgagtgcagacagtggccaggtgtggtccacaaccccatatgtgaagcacttaccaccattagagcaacctcagcactgtcccctgtgtccctgggactggctgactctgagctccgtgacccactgaatgttcatgttctctgtcctgtatgtatcc

SEQ ID NO: 30798 - DNA, 1152 bp, Mus musculus
ttttcacgtgtaactctgggtgacctggaactcatggagatccacctacctctgtctcccaagtactggggtgaagagtgtgccaccacacccagtgtcttagtcagggtgtctgttactgtgatgaaacaccatgaccaaaaaagcaaattgggcagggaagggtcggcttactccagatcatagtccttcactggaggaagtcaggacaggaactccagcagggctgggacctggagccaggagctgaggaggagacggagagggtgatgcgtactggctggttacccgtggcttgtccaatctgccctcttatagaacccaggacccaccatgggctcggccctccctcattgatcactaactgaggaaatactttacagctggatctcatggaggcatttcctcaacagagactccttcctctctgatgactctagcgtgtgtcaagttgacacacaaagccagtacacccagcctccttttatttgggaatggtttgtcaagtgttgcccgggtcggtcttgaacttgtaattcttctgcttcgacctccagaatgactgagattattgttctgtgccaagctcaggactctgatgtaccatgggcccgtgaaagtcaaaagttgaggcctgctaccttcccgacaatgtcgccgtgatttgggctctgtggcctcagggaggtgtcaacatctccaggaggcctgttatgttctgaagattcatgcagccctggaggctcgaccaggctgcctgagctctggcctgcagcaggaatcctcgtgagtcactgcagatgctgctgctatagagcctaatgccctgccggctcctggtgtctttcaggggaagcggccgccatggacgcagaagccgtctacgggcagctgctccgaggtctcccttctgaacgcttccacagcccgaccctggcctttgaggtcatacacttctgcacacacaacctggctctcttcgactcccactttctcagccttctcaggctgagcttcccaagtctgttcaaggcatgtgtgggcttcatcggggtgggcccagggctcccctgcagatgatttcagtctggggtacagtgaggggtgaggctaggggttcccctgtatcatagcatccagagtcagctcagg

SEQ ID NO: 30799 - DNA, 1152 bp, Mus musculus
cccatagactgttgcacggaccaatacatttaaagtagaatcctgtcccaaggaccgtgaccgcacgcgcctttccagtctcagacccaacatttggcaaatcgtttgcagttctgcgcctcgcttttcaaatctgcaaaacggacgtgcgacattctcttcgagcaacgcggtgcgccaaagttcctagaacaatgatcaacgactcaggaccaacgaggtaactcgccgttctcagacagcaagcccccgcccactctccgccacgcgcaggcgcacccaccagcgcacctttatgcatgcgcagtcgaccggaaacacccgcggatgcctgcggcgaagaggcggggcctacgcagcgggcctgcgcggaacgccgccgtgcgacgcgagggtgggcgggaccgcgcaagcgcgcagcccgtcccggctctggagcataaacaagagtggggacgggatgaggcggcagttggtccccgcgcagcgagaggcggcgagcggggcgacctgccggaccggacgtcgatcctgagtgtagcgtgctcccgcgggccgcccgagtcgagctgcgcgcgctcccgccaaggggggtccgaggccgtcgcgcgctcgcagccatgaacctggcgagccagagcggagaggccggcgccggccagctgctgttcgccaacttcaaccaggataacacgtaaggccgggcgcggacgcggggccggggcagagaccagggctggtcaggttgaggggtatgggcggggggcgtgctgagcccgcgcggccgctcgagcgctgctgcctcctgggccgggggaggtgatggaactcggggtgcccccatccacctgtcctgagacctggcctttcgcaaagttaggaaggaactgtgcacgccggtttgcgcctgtcacccggactcggttttgcggccatcctgggcatcgcccgcctccccctttctatacatctgtatcctcactgcttctgtcgcttttcatggcttttctttttctgtttgcttatttcttctctgccgacctttctggcaagtaactttggtctcctccaaaaaaggaccaaacggcagtagtaatccaggccttcgatctgagactttatcctcaaggggtctgggagcttcaaaagggg

SEQ ID NO: 30800 - DNA, 1130 bp, Mus musculus
atcccaggaccctcacgatagacttgtgctctggtcatggcacacacccacaccccacaatacacattaaaaaccaacatcctcaagtaaacgtagtgagtgtgccttcaagccctgccagcagcagggcacatttacatttcatgattctgtgctttggcatcagagtttgcatgtagggtgtgatctgtatttatactgacagaagccatggctccagatagactttccatcccctctgctgaccttcgactccagagagttgtcagcccatgtatcccttacaatgttctgtgttgtgtgtgtgtgtgtgtgtgtgtgtgtgtgtgtgtgtgagagagagagagagagagagagagagagagagagagagagaagtgcatgcacttgtgccctaacctggaaatgtatgtatccacacatgtgtttttcttctttggttccagctgacactgaagatgtctgcattgtggagagattgttctcaagcagcttggtggccattgtcagcctcaaagctcccaggaagctgaaggtttgccattttaagaagggaactgagatatgcaactacagctactccaacactatcctggctgtgaagctgaacaggcaggtgagtggcaccaagccgctcaggtgatgagcacttgccttgctccccgtgccctgaagctttgggtaccatcccaagcaccgcataaaaccagctggagtggcacacagctggagtctgagcatagggagaggtataagcaggaggatgagaaggatggcagcctgtctgaggaggtgtctctgtgctaagtgctcttgctgtataaatatagggacttgagtctgaatcgccagcagctgcacacaaagccatgtgtatctaaccttagcattgcagtgggcagagcagaggcaggaggattgctgtgctttactgacctgccttagcttcaggttctcagtaagagacctgtctcaaggggataaggcagaggataactgagcagtagtacagctgacatgcctggcttctaaccaccatttttacagacatgtggatgcacacacatacgcgaaaccacacaaggaaacccaagtgtactgcctgttgtccggtgttcctcccttgtctc

SEQ ID NO: 30801 - DNA, 1837 bp, Mus musculus
gaaccaagaaaggtgatgtcgtcagtgtcgttaaatgctctgtctcctcctgtccccatccataactgtgacttggctttttgttttttttgtttttaaaggagagtctatagctactccaattcccaaaaaagcacaaaggtgtaagatgctaggtcagggtcagcctctgcggacctggagcagtggtgtctgccagaggctctcctccctccccagacatagcagagagtagaggggcccctccccctcccagggaggcggcaggagattccctcccggggtgatgtgccttttcttttggtcttacaagggcaggaaagtgaggtcagatgtcagtgctgccctgtgcctgtctgcttttgattgtttgctatttggggggaaggtgtggtctcacactacaccccaggccctggaactcactatatagcccaggctggtctcagactcaaagtagtccccctgcctcaacttcctgtgagttggaattacaggtactgctgtgctaggctccattctcagctctatagaataaaaagttgaggtcctcaaatctgcattctaaagaacagagcctaacagtggagcccaagggcgtggctgtggcttctgcatgactatggctttaggtgcaggggttttggagtaggaaatctggataatgttggggtaccaggttaatccagccggataagagggactacaggtagctgccttcaggcctgtgtggttatgtctggtagagtatatctgcagggtgcctgtagctaaatctgctgaggttccctgtttctgctgttcaaggatagctaatcacataattggggtttgaggggcgcccactgttagctctggctgctgttggcacctgtgccctggagcatccgaggagccaaacagtatgaggcagggttaggctgcgtgtgctggactttaaactatgaattttctggaccctaataacatgggaccccagcctgtggcctagttcagtgactgcttcactgggagactaaaactggccttcacaggaaccgactgtgggaagcacacggggctgattgggagccggggtttcctggaaccaaagagtgtggctgttgtgctggtgaccttggctttgtgctctgggtttggagctcagctccctctgctgaggcctctctagggagctggggtctcacagacagtggagttcacgtctccctaaagcataggtttcctcacttggaaacttggttagaaaaaggccgctcctggggtctggggctgtgccttccatcagtggtcttgccaggctgtgcaaatttggtgagccttcctctcttgggacagatgtgcccgtgcatcccacagaggtcagaaaagcaaaggattaggctgtgacctcaggcaatctgtacagcactcgcaggcctcaggtgagggaggagagagtggctggctgaggtcagcactcactgttgggatgcacacggtagagccaagcctcagcagggctcaggttcaaaggtaagaacattttggaatccggtgtggcacacacctgtaatcccagcagtcaagagagtgaggcaggagcatggctgtaaatttgaggccagtctagactatatactcctgggcaaacctggcctacagagtgagaccctgtctcaaaaaaccaaaggatgatgactttaagaaaagaaagaaacaaaacaaaaacaacggggaatgggagttgtaaaaccccccaaaattttaagattagtatggattgggaccaaagcttttgtattttctcagacaatgaaagcaagagttggagtcccttgtcctgcctacaccaaca

SEQ ID NO: 30802 - DNA, 1199 bp, Mus musculus
atggatggatgggtggatggatggacaggtagatggatagatgggtgggtgggtggatggatggatggatggataggtggatggatggatgcatgcatgcatgcattaatggcagaagtaagtcacagcagatagtccaaagtgtacaaagcaggcaggtcagagcagcctggatcccagcccaggctgagatcaccagaagaccagaagccccaccagattaggtcaggcccactcagagtcgtttatctgtcagatgaactcaaggaccactttctgcaggacctccatggccacacctcaatgagtcatggaacaaccaaggcccaggcctcagctgctgagtgatgaaagagcccctcgcagtgtgcagtttgccaactcaactccttaaccatacttactacccagataaagccaaatcagggtcatgccaccgctaagcgtgacacagctcatgtttgggcccctgaaaccatgggagcccattcctcagaggccaccgctaactgccagcaatccttgcagccctgtaacctcaatacagctagcaatttggagctgtaaaaaaaaaaaaatcatttattttgattttatttacattggtgttttgactgtgtgagggtgtcagatcccttggaccaggagttatagacacttgtagggtgccatgtgggtgctcagaactgaacccaggacctctggaagaacagccagtgctcttaatcgctgagccatctctccagtctcagagcacatctttaagtgtgtgtgtgtgtggggggaatctggttgtggggtgcatgtctttaatagcagcactggggaggcaatcttcgtgagttcaaggccagcttggtctatatagccagttccaggaccgtcaatgctacacatagagatgccaaacccactccttgaatgaaggaaggaaagaaagaaatgggggtgggggtgggggagaaaggtttatgtttgtttgtttattctagcggggtggagggcacacacgtgttgtggaggtcagagggaaacttgcaggggtgaattttctttcaccaggcagggtctgaagactgaattgaggttgtaagctttggccacactcgccactacccactgagccttaggttactgataagggcatgcaagagggaataaaaaatatttaagggccagcgagctggctcagtgggtaa

SEQ ID NO: 30803 - DNA, 1505 bp, Mus musculus
cgggcccacccaatcctgccccctgcccaggaagagctgcctgggccagttaccccaaggcctgaggaccctcccacccctgcctcagtgcctgcggggtcctggccacctcctaagccactaacgccaccttgccaccttgtcccagttgtccaaaacagctggaacttgtcttcaccgcccagggcaccgcctccccgtgtcctgtgtttggtcagacacctgcccttcaccctctgtgtccagaggcccagcatctgtcacacatcaagggggcgtttattcagtcttagagccactcggaatggctggccacagtctgagctgactcccttcagtgtgaccccactgtgtggttccatggtcttcgatgtggttttcatttactggtcagggggcacctccctgtattagaaatcttggaggaaagtccccaactccgttctgtccctttcttgttcttagacacttcttcacagccctacccctgcacccgcacacataaagcgtcaagtctggaaaactcattcctcatacacaggcctcctgtagtcatagcaacagagatgacctaggtgcacccaccttaggtggaggacttccccatgcacaccaccacccctcttagagcacaggctaagggccacggctaacagggacgtcccatttctttcctgttccatccaacttacccatcatgcagggacagctgaggtccactcgtgacctaggccgccccactcccatccaccgagagtcaagtgatgacacgacacacttgaaaccctggcaagtggctgcaaggtgaggattggactcgtgggtgccaggatcggctggaggacctcctgccaaagagagcttttgctgagccgggacacttgcctctccacacagtggccccagccgtgaccaccctgtaccagtccctgctgtgtcctgtctacctgtgtgttctctgactaccgcactggccattaaatatggcagagactgcccaccgctgtcctgaggaagtgtttgtggggggagggctgggaagtgagccactgggtagggtggggagattaaaatggggccctgatggggtgtcttccccacaatgctgagacacttgtggtcccacctgtcctgagctaggtgtttttagaactgatgattgcctagtgctgagcacctggggcttgcacgggccttagcaaccgctgcctctgtgaggacaggaaaagatatggatttctacatctggctcacaggaggaagagctcaaaacggggagtgtgctggtcctggctctaccccctctgggtctgggagtcaggctgctcaaagccagtaatgaattcttcccggttacagtccccagttctggtgacaatttagagacatcttctcttctctcttctcttctcttctcttctcttctcttctcttctcttctcttctcttctcttctcttctcttctcttctctcctctcccctcccctcccctcctctctttctc

SEQ ID NO: 30804 - DNA, 1188 bp, Mus musculus
gggtcctaaagggctgttgttggggttgccagagggtttcataggatatacgtggagggcggggtggggggagaggttgtgagaggtgtcattgggagtccggactactgctggctggggattcactgccacctttggcctccagggcatggccggactgatgatgagtgtgatcgagccaggcatcgggaggatcggctgctagggacacggctggaccgggaccaggagaagttgctccggtgaggactttggggcccgagagcgcgggctgggggcttctggagtaggggtgttgaggtgacctctgcgctccctctaccatggtcctcgatcaccttaggcttgtctgtccgcgtgactcaaggtccctccagccactgttgaagacccttagctgttcccaggcgctacgtgcctgtcagctccctgggctgtggctctcgttcacccccccccccccatccctaggctaccagctgttcccatactgtttctctttgcagagaaagtaaggagctggctgacctggcccgtctacaccccaccagctgcgctcccaatggcctgaaccccaaccttatggtgactggtggcccaacgctggcaggctcgggacgctggtctgctgatcctgctgctcatttggccacgaacccctggctgccacgctcgggtagtacatccatgtggcttgccggacacccttatggtgagtgtagcttgagggaagactgggaccaagttagtctttctctgactcccagtaaggtgggagtgacgtatgtgtccccagtctgcctgaactcttaaggttccttctgggattctcagtggacatcacggactatggtgctgtcagcgggctgagactctcctgacatttgtataaatttggctttctccccctaggcctgggacccccctctttgcaccagggcatggcccctgcatttccacctggcttagggggctccttgccgtcagcttaccagttcgtcagggacccccagtctggccagctggtggttatccctagtgatcacctgcctcattttggtaagtgacccttgagtcacagccagggactttcctggccacccatagggatggaacagctctgtatatggggtggggacaagggggtccagggaagcctgaacctcagttgtgtcttgggaatttcat

SEQ ID NO: 30805 - DNA, 3242 bp, Mus musculus
tccaccagatgtcaatagcgtgcttattttcgctaagtgctattttggcactggtgttaatcgaaatttatagcctgcagcatttgacgctgggaaaagaacccaccctaatggtccctgattggcaggactgggctgttaagtggcagaccatatgctgcctgctgagagcacggtgagcgcttgggcctctgtgtgtgtgtgtgtgtgtgtgtgtgtgtgtgcgcgagcgtgtgtgtacttgtacctgcacgtgtatacatgtatatgtgtatgcctgtgtgcatgcgtctacgcctgcatcttctggtggtgtgtttcacattaaggagggtcagacatgggggaattcatcctttgtaaacagaaagcccctgacctcccaaggctgcctgaatccctgccttggcccacccctggctgtttttgcttccttttccagaccttgtgggtttttggtttggtttggtttggtttggtttggtttggtttttgtttttttgagactgggttttcctggtatagccctggctgtcctggaactcactgtgtagaccaggctggccttgaactcaaagagatccgtctgcctctgccttccgagtgctaggattaaaggcgtgcgccaccactgcctggctagaccctgtgctttgtgtgctgcctttgatgccatgtctcccaaccctcttgctcggcgcaaaccagcaaaccaggctcactgagtgactttcctgttttcttcttaaaactctgtgcatgcgcgcatgcgtgtgtgtgcaggtctgtgtgtgccatggcacatgtatagagagcaaaggacaatcttgggtgtctcttctcacctccaccttgtttgagacagagtcttttgttcgctgttgtatacaccaggctagctgacgcatgaactaccagggactctgctgtctccacccatccgtccctcgatgggcattcaatgatgacagatgtagctaccatgcctggcttcatgtgggttctggggctctgagctccggtcctcgagaaacaagttctctatccatagagctgggtcctcaacccattttcctgatttttatagggaggactcttactggccagattgaagagggctctgctttgatatgacagggacaggctctgacctgccagtggcccctagaggccctgtaatagggccacgaggtccaggcccaggctgtgactaggaagggctgggcccagacacttgaatccaccggtagcttcacgtttgggcatccagggcagattctctgactatctactgtatcaggcccagagttaaaagccaatacttagcaagatgatggggttgggccagtctagggccgtaggggtctgagggaaagatgggcctaagcagtggggctgttggtgccaaaggccaggcctcaagcaggatggaccgccaccctcacgcccactccaagaggggccagcatgccgcctctctctccagcgtccactgctacctacccctttgaagactgggagctgctgaactcttctaagggaaaaataagagaagccaagtgtgattgtgcatctcatcccagactgcaggaggtgggagcagggggtcaggagttcaaggccagcttcagctatgtaatgaatttgaagctagcctgggcttcctgagatgacactatgtcaataaagatcagagtgggggtagtgggagagagagagagagagagagagagagagagagagagagagagtgtgtgtgtgtgtgtgtgtgtgtgtgtgtgttggtgttgaatggggtataaagaaacaggagacaagaaattttgaatggggcatgaagtatgaccaccagcagtgagtcccagactgtgacctcttcctgtgaatgtgacccattcattggtacctgaagttattagtagtatccaatgccctgttgttgggtttttgtgacaggtctcatctgtgtttggggttgtaggatatgatagaggtctgcaggctcagtgttaatgctgcatgagattctagactaggcctagctcctacgttagctgcttagtggtagcacctacatccctcagaaggatcaccagcgagtgagcatcatcagacccggagcttggctgtacctcccaccctaccccaacccctgcccgacctggcaggcttcatagggctgctgttcagagaggccagggtccctgaggctgcctctgctaatgctggcctgggatctgcttcagaacttggaacctggggtggagcagggtggggtggggtggggtggggttgggagggagcagggggagcactagctctgtgatcgatcatggggtgctgtgcaaggcatgtgtgtacgagccagggtttccacagcaggaggagtgggcatgcctcagtaggtgtgtctgtatgtgtgtgcacaagagctcctgtcctctcgaagcccctgtcaaaagcccctgtcagctcgaagcctcttcgctactactgactgtgatctactgcacgtgacttccccgagcaccaactgagttcagtgtgttgtttgggggcatggagaaaggccttgagaccaggtgctaagtgaccattccctcccttttgatgactgaccgccctgactcctgtccagctgggagaactgcctgtggttggtatctggcagtgacagatgtcactatggtgctgacaaactacattctgaatgggtgtttctatgtaaatctgtagcatgtggaaaatctctaataaatggaacttgatttagaaagccaggcagccgtgtggtccttccagcagggactcgactatccatgtatagccagcttcatgggctcacgtggggagggtccctcattctttttttgagacagaatttcatgtagcttaagctagcttcaaatctaatatgtagacaaggctggctttgaactcctaatcctgctctctggttgtgaaccttgacctcagcagagccaccgttaaaacacccataggtggccccctctggactggttggggggcttcctcacaacatggctgccagactgaatcacaagcattccaagaaaaccagcagggtgtgttgagctttggaactcaccatttggttgttaacctccacgcttaatagtcagttatagagatacaccatgttcagcagaaatggacacaggctaccctaggatccagggggtcttaggatctcattgcagaagagctggtggggtgggagg

SEQ ID NO: 30806 - DNA, 2690 bp, Mus musculus
ccgttaacggctgacctctggttcagtttccaggccgagaggcccgcgttgaacgtcgtcatcttccccctgctccacgagggcctgacagatgtcatccgagatgtccccatgctgcacctggatgagatcaccttgttcaaaagccgtgtggctgaggaaccgcccaacctatggtggtgagaggaccctggccagcccgcccaccactcctgctaccacgtccaccactcctgtcgccagagcctcttctgtctgagtctccacgagggtgcccggagccagcagacagtaaggccttgttccgtgacaggaagaaagtttccagttctcctgagacactcaccccagtcccccgggattctctctgtcactctcatgagtacagtgacaagaagtaatctggtgagccatggacgaatgggccgtggatgagccaggctgcccttcagggcctggctgtgctgggggtggggggaggatttgtgggctgcggtccccagtcctctcgcttgcttcagcttggggactctcgcctgctcctttgttcatggccgtctacacttaagctcagtcatgtgaccgcacccacgtgcagtcagggtgggccgggctgtcactgtgaaattctcgaatgttgtctgtgagcctgtggctccttttcctgttgagctccatttagggtgtgggccagtggcagagctagtgtgtgcgaggccctggctgccatccccgccacaaaaaaaaaagtttaacccattgatgtctccaggatgttttcagctcagtgatacttgtaccagagagtcccctgaagcagggactgtggggtggcttcacccccaaactgagcctgaggagttgagcctgtgtctcacaagtggtcacctctccttacagtcggtgctgtggtgctctgaatgccttccaggaacactgcaaccgctggccccattaagatagctgaatacggtaaaagccagcgttgggtgtaggttggagcagggagcgcctacctgtttagtccttacaaaatccaccaagagcactgctttagttagtgtgtgggcatggaccccaggttccatccccagaatgtggtgccagcactccagaagtcaggacacaagtgtgagtcaccctcagctacataactgatgtagaggctaacctgggctacataagaccctgtttcaatctcagcaaatgaaaaacaaaggccagacaaagctagaggaggagccagtgtctgtggcttcacgccagcgagactgagccagtagcccctggagggacgtctgagagcgtgtggtgtgtgggagcgtgtggtggcatcgatccactgactcccacctgggcctccccaggacgggctccagcacgtgtggacattgatccaggtggtttccagcctagaccacctcagtccgtgccgtgccgcccaccaggcctcactcactgctggtgaccgccccagacccagcctgccctcacatctcctgtctcccggtcagcatcccttgctggtgaggagcagcgctagactgtgcctggggagacccagctctggggacagtgttagggaaacagccctcaggcccaggccccaagaactgtgcctctgtctggcccttggcattctagcttcagtgtttacatggggtctccagtgccaagccctctcccctcagccagcctcttgcctgagggaatcctcgattctctccggagcccacagtgctcttccctgtcctgtggctgagcgatcttaactcctagccagaggtattggtctgtctgcaggctgatcccagggacacccagcccacacccagagctcttaccctcccagtcggagagttctaagccttccctgtcccttcctgccactgcaggccattggactgactgccaaggttccagggggcagactgaagtcccacatggctgtagacaagggacccaaagatagtggaacccacttcttccagttgagaagaagggtgagcatgtctttagaacattaagctggcacctgaggaccacccataggccctccaggacccactgctgcttgtccttaagatgagaatgtggctggtcccagcctgtgatgggagcaggctgcttggaggtatctggtcccaagaatccttgcgaatacttcctttaaaggcagcccccctcagctggctgtggtggtgaaggggttttttgtttgttggtttttttttttttttttttttttttttgtggtttttcgagacagggtttctctgtgtagccctggctgtcctggaactcactttgtagaccaggctagcctcgaactctgaaatccgcctgcctctgcctctcgagtgctgggattaaaggtgtgtgccaccacacccggccagtagtggtgaaggttttaatcccagaggcaggtgaatctctgtgagttcgaggccagcctgttcggcatagtaagttctagtctagccagggctatatagagactctgtctcaaaaaaacaactacaaaaacccaaacaaatggcagccccgttcagacaggaaatcacttttctcctgggatgttattcaaaaagccagagccattctgtcaatcctgtggataggcagttcttaggaccagcagtgctagcctctggcattttttatgcccagaaactgggctgacaggg

SEQ ID NO: 30807 - DNA, 1187 bp, Mus musculus
acaccgtgctgctgcagaaggactaccaggtgaggcacggtggacgggagggtgagcgagatcaaccaggtgccagcctgtggggccagtggcaggcactgatgtttgcacacaagactggctgggaatgatcttcaggttacactgaatgacagagccagggtagaagagggtaggcggcttgccccatgatggagtgggatgggtgggggctggatatagtgcatgtgggtggagttctggaagggagggagcctgggcctcaaacgcaggggtcagtgggaggccttccatgtaggcactgcagaatggagttgctgcaccacagggcagactgcggaaggttgttgttgagtggcacagcagacagatgccacagtagacattgctgcagaagggctgcctgccattgctccgggctgaagtctctgatcaactgagacataagcctgccatggtagtcccagcactcaggaggctgaggcagggggctcgtggctcagaccaggttagccccaaacaaacagataggtgtgcctgtgtgcccgatggtggcatgtgcctaaaattccagcacttaggagtcagaggatctataaattcaagctcagactggtctgtagagttccaggacaggcaaggctacacagtgagatcctgactttaaaaaaaaatacaacagcatgccgtgcaatggtagtacatgcttttagtcccagcactaaggaggcagaggcaatcagatctcagtgagttcgaggccagcctggtctacagagtgagttccaggacagctagggctacacagagagaccctgtctcaaaaacaaatgaaaattatagctttaaaaagctagttattgggctggagagttggctcagtggttaagagcactgactgctcttccgaaggtcctgagatcaaatcgcagcaccatctgtaatgagatctgacgccctcttctggagtgtctgaagatagctacagtgtacttggatataataaataaataaataaataagtctttttttttttttttaaagctagttatttttagatgtgtgtgtgtgtgcccctgtgtgagttcttgtgcccagaggtcagaggtatcaaattcccttggagctggagttacatgcagttgtgaagcccctgatgtgaatatttatttatttatttatttatt

SEQ ID NO: 30808 - DNA, 1098 bp, Mus musculus
gcagaaaaaaaaaaaataagagacaacattggcatggctttgtttttttaaattttttttaaagtttttttttttttttttttttttttttttaagtttttttgttttgttttggcgcttttgactcaggatttaaaaactggaacggtgaaggcgacagcagttggttggagcaaacatcccccaaagttctacaaatgtggctgaggactttgtacattgttttgtttttttttttttttggttttgtctttttttaatagtcattccaagtatccatgaaataagtggttacaggaagtccctcaccctcccaaaagccacccccactcctaagaggaggatggtcgcgtccatgccctgagtccaccccggggaaggtgacagcattgcttctgtgtaaattatgtactgcaaaaatttttttaaatcttccgccttaatacttcatttttgtttttaatttctgaatggcccaggtctgaggcctcccttttttttgtccccccaacttgatgtatgaaggctttggtctccctgggagggggttgaggtgttgaggcagccagggctggcctgtacactgacttgagaccaataaaagtgcacaccttaccttacacaaacagcttgtggctctgtggctttgctgggtgtggggagcaggttgggtgggtgtggagctctattggggggggcatctagggtgggctaggccttgctgatggtatctagtgggagggctacaggccctttaatgaagtctcacaaataaccacaccttcagactgtcttgaagagttgaaaaggtactcctccagaaacctaggccaagttggcctgcactaacactaccttcctcaaccgaggggtgtccacaccctttgcctccatctgcataactgggtttcaagcccctctgctagtctgaagctgccctttccagagctgtgactgacagcaggaaggtgtgaagcctatggcttccttcccagggatgggcatcttttccctggttttgttttgagagcctaggactgaggaacacctcagagggaggaagggggtcatcctggaaatcagccccttccacatggc

SEQ ID NO: 30809 - DNA, 1932 bp, Mus musculus
ggagggggcggaggtctggcttcctgccctaggtccgcctccgggccagcgtttgccttttatggtaataatgcggccggtctgcgcttcctttgtcccctgagcttgggcgcgcgccccctggcggctcgagcccgcggcttgccggaagtgggcagggcggcagcggctgctcttggcggccccgaggtgactatagccttcttttgtgtcttgatagttcgccatggatgacgatatcgctgcgctggtcgtcgacaacggctccggcatgtgcaaagccggcttcgcgggcgacgatgctccccgggctgtattcccctccatcgtgggccgccctaggcaccaggtaagtgacctgttactttgggagtggcaagcctggggttttcttggggatcgatgccggtgctaagaaggctgttcccttccacagggtgtgatggtgggaatgggtcagaaggactcctatgtgggtgacgaggcccagagcaagagaggtatcctgaccctgaagtaccccattgaacatggcattgttaccaactgggacgacatggagaagatctggcaccacaccttctacaatgagctgcgtgtggcccctgaggagcaccctgtgctgctcaccgaggcccccctgaaccctaaggccaaccgtgaaaagatgacccaggtcagtatcccgggtaacccttctctttggccagcttctcagccacgccctttctcaattgtctttcttctgccgttctcccataggactcccttctatgagctgagtctcccttggatctttgcagtttctgctctttcccagacgaggtctttttttctctcaattgcctttctgactaggtgtttaaaccctacagtgctgtgggtttaggtactaacaatggctcgtgtgacaaagctaatgaggctggtgataagtggccttggagtgtgtattgagtagatgcacagtaggtctaagtggagcccctgtcctgagactcccagcacactgaacttagctgtgttcttgcactccttgcatgtctcagatctatccatacagtttcacctgccctgagtgtttcttgtggctttctgaacttgacaacattatttatttttctctacagatcatgtttgagaccttcaacaccccagccatgtacgtagccatccaggctgtgctgtccctgtatgcctctggtcgtaccacaggcattgtgatggactccggagacggggtcacccacactgtgcccatctacgagggctatgctctccctcacgccatcctgcgtctggacctggctggccgggacctgacagactacctcatgaagatcctgaccgagcgtggctacagcttcaccaccacagctgagagggaaatcgtgcgtgacatcaaagagaagctgtgctatgttgctctagacttcgagcaggagatggccactgccgcatcctcttcctccctggagaagagctatgagctgcctgacggccaggtcatcactattggcaacgagcggttccgatgccctgaggctcttttccagccttccttcttgggtaagttgtagcctagtcctttctccatctaaaggtgacaaaactcctgaggccatagtacaagttaagtctgatttctgtcactcttctcttaggtatggaatcctgtggcatccatgaaactacattcaattccatcatgaagtgtgacgttgacatccgtaaagacctctatgccaacacagtgctgtctggtggtaccaccatgtacccaggcattgctgacaggatgcagaaggagattactgctctggctcctagcaccatgaagatcaaggtaagctaagcatccttagcttggtgagggtgggccctgtggttgtcagagcaaccttctaggtttaaggggaatcccagcaccca

SEQ ID NO: 30810 - DNA, 1941 bp, Mus musculus
ttcttgagtatttgaattatgggactgtaccttacatccagctgagcccactcagttctggaagctgacagcgggagggagtgttaatcctttggggactgacaaggtggggttaacatgtagtctccctcctcagactccacgggcaagtactggacggtgggtagtgattcctcggtcaccagcagcagcgacacccctgtggatttcttccttgagttctgtgactacaataaggtggctctcaaggtgggcggccgctacctgaagggggaccacgctggggtcctgaaggcctgcgcggagactatcgaccccgcctcactctgggagtactagggccacctgccctctgcaggccgctctcgtcagtccctcctgttatccttactcatcgggtggccctgcagcaggtggcaaaccccttgcctttcaaactggaaacccaagagaaaacggtgcccttgctgtcaccctctgtggaccccttttccctaactcactgctccccatgggtcggtggctgcagactgtccccaggagggactctggttccctctgtccccttctttccatggggaactctggcacctttcttctgacctcagtcaactctgagccttatttccccccaggaagtggcctaggagaagctacagggcctagggacttaccctgagcttgtaactggaagaccccgtccctatccccgctcccgcccccaccccaccccacccctgctctggccccagcctctggaggccagccttttggcgggactgaagccgggcatggccaaccttgcccacaagtgtttttctggatcttggctggaaggcagtctgtcccatcctgcagtgtttgggcctggctctttgactcaaagctagctaggtggcactccgtgtcgctcctgcacattctggaaggggcgggcctctcacccacctcattccttttccccctggcctgactggaagcagaaaaatgaccaaatcagtatttttttttttttctttaaggaaatgttactgttgaaaggccctaggcaagcctgccctgttggttgtagtcgtgagtggtcttggggggagatgcttggctcctgtccctgcctccccagcgggttccctccctccctcctgcctgaccaccccagctctggctctgtgattggtgctccacgtcttcccagacacctcggggctcctgggcgggagaaagccggatgtgcccctccctgggagccctggagtaaacctcagggggccctttcccaatcacccccttccaccgacccctcaacaccatgcatctcactctgggtgtctcgctcctttatttttttgtaactgtcatttctataactctgaagacccatgatagtaagctttgaactggaaaataaagtaaaatcaagtctgcggcccgtgtgtgtctcaggggaagtggatgctggagtgggcagagggccggctgggagggaggcagcgctgattgattggcagcccgcagactcttgtttcggtctcggaccctagcggcttcagcatatgccttagtaactctggactgagaaatggctgacacgaggttcccgagccttacaagctgggcaggctagagggttcagcaggtaaagttgtgtgctgtcaagcttgatcagactgagtccccagcaccgtgtgaaaagttgggcacaacggtgtacacccaccccagggcctctggcaagcacagagacaagaggatccttggagcctgctggcggcccaaccttgcccaatctgtgattcccattgagtgagccataaggtggagatgggttttggaagataccccacataggcctgcggccccccacacccggaaataaaaacaagccaggcttgtcatcccagttattcggggagctgaggcaggaggatcacagatttaaga

SEQ ID NO: 30811 - DNA, 1288 bp, Mus musculus
gatgccctctgggtgctgattgtcactgggccaattatagggcagctccctagtctgccatcttagcagccaatccagtggccctgaccatgaagcaaggcctctaatcgtttgccatacttcctccccagcagcccaatgaaagcccagggggaaatggcctaccatccctaagccagggctctctccttgttgcccaaggcccacttaggtccaagagcctccgagaatctgtggcgcgagttttgttctgttgttatctaaagaggttgctcctattcatgtagtttgagctgaagttttttttgtggtctactcatgcgtgtccctatccgtggaaagtcaggttgaaagtatttccccagggctggcaactgctgagagccagaagtcctgacacttgccatcaaacaaaagggccctttaggaagctgtcatttattcccaggtgggccctgttctggggtgagcagcttctttctcctaaggtgttgggggttccctggcagtgcagatgacctcatggagctgctacagtcatcacagcaaccctgctgcctgctccccgtccctcactagttagcagtgggtgcacacaggagagctcccagctcctgtgtgatgagagtccaggcctgcacagagcctttgccatgttcccagtgcctgtgtcccctcctgtccagaccaggcttttgtcctccagcgtttgctgagcaggaccggcagcaggtttctcagttgtactggctgtccttgtcctccccttgctgtgggggtgtcccctgttcagagtgtacagacttagaagggggaaagtccctgggaaagggaaggctccctgagctgcccattatcactggagtgtgggtggggcacacagtggctcaggagccctgccatggtcacctgaactgtgatgttagtctgaatgacagtgccttggaaagatgggccacatgctgcatgacaggatcctccaagtaccttaactgttagagtatccgtgttctctgcacttgtccagaagccccacgcatgggtgggtggctgggtgggtactccaagcactgcccctccacggcctcgtgagccgctggactgggcacccagttctaggttgactcagtacccgtctcacatccttccaccaggagaccagatgcaaacaactggcagtttctggggtgaggccagggtcgtgtcagtctgtgggtgcagggaggctgctcctgcctgtctccatccaggagtgaccctcccaacacctctgtgccagcagggatcc

SEQ ID NO: 30812 - DNA, 1150 bp, Mus musculus
ccagccggcagtagtaatagagtctagtctcctggacacactgggtcccagttcaggaggcagacacagatggatctctctgatttcaaggtcagcctagtcaagtggtgagctccaggccagcctaggctttgtgacaccctgattcaaaagattaattagttaaacttggtctcctattaaacaaaacttagaaatcatttgttcttctgtaacttgaactgggtgtagattgtttccaagctaaagttctgcttttcttcatttcaggtcactagcagattggacctcaataagtagcagccagtgttatattgcattttactgttcttggtacatagtttggtgtctaagtgacaaactgctgcagtgtgagtagctgcagtgcacacagtgaaagcatttgctgcctagattgcactcacctttacatcgcagcacatcctgctggacaccctctctgcttcactttgtagctggccacccaccctttatctcaatagcaaatttgttttgatcctgcctcccttccctctgtcttcaaggccctcagtgtaacagagaaaggtgaagggtgtcggtttgtagttgggagcagcaatacaaaataccaacacagtaagaagtatcctggcagtagtgggccctccttatcagttgaaatgcttctagaaacagtctcgctattgggggactgtaggagtgtgagcttggacgtgtgctccttcaacagagggattgcctactcccagaccaagtattcagagatccagtgtatatagacttggctcccacttcttaaatcactagctttgcacagaccaggtttggtttaggaaggagccgagtttcttctccctcttgacagcctgcaggagtcctagaatgaaaaaatgccacacatcatgtcagatggccttatatcttatctgaattccaaaactacatgagaatattatgccctcaatttgaaagtgaggaaactgagtctccaggcagttgggaaatttatccaaggtagtacagttgataaacttggagccgagttctcagactccaaaacatgggccctttccactgtctgaatgtctcggaaaggctcaggccgtccttacatacgggaaatagtaaaccttagtggccatgatca

SEQ ID NO: 30813 - DNA, 1158 bp, Mus musculus
ggtagatggaaaccaaatggctcttacactcttttgtccctagagggcagcattaagacagaaacccagatcctcctgaaagaggtgcttgactttctagccttatggggagtgatgctgagtggttcctttactgagaagtagtgcagtatctgtccagtgcacacacacttcagctttagtgtgtgttaataacatttctaaaacttaagggaaatcttttccttcagaagcccttttgctaaagagaaaatcaagatgaatgcaagattcgcagcacttagctgaccacacccaggttgaagttctgagaaatggtttgttttgaagcagggaaaactcctggatgtagagtgcaacttctggaaaggtgtgagctggttgtcacgtaccactttttagaaaaagtgggagaagagcaggaacatagaacctgtaacttgggaagttgaaactagatagatagatacaaggcctgagctacaaggagaccttttcataaataagtaaataaatacacgcatacatacataataaataggtgctggagagatggctaagagcactgactgctcttccagaggtcctatgttcaattcccagcaacatggtggctcacaaccacctgtaatgtgatccaatgccctcttctggtgtgtctgaggacagtgatggtgcactcacatatatagaataaatagaaatcttttaaataaataatgaaagataataattataataaaaaacttgaccataccaggtggtagtggtgcatcccttttagtcccagcactcaggtggcagaggcaggcagatcttttgagtttgagcccagcctggtctacagtatgagttccaggatagcccgggttacatggagaaaccctgtcttgaaaaatccaaggggggggggggggagaagacgaaggaagataaggagaaatactgtaatggcatgtaagccaaatgtcccaaaaattcagggtcatcaaggtttcccagattctctggtatttgaaacatctagccatgggttgatgtagaggatgtggtcactggcaagaggctatgggccttggccattctccaggctcctcactccaggtctgaatcacacctcagtcccccttccattctctctgtatgcaacagcttccc

SEQ ID NO: 30814 - DNA, 1201 bp, Mus musculus
cttcctgtaaccaacatcaagggtcttgaccacagaaatgacaggaccagtcttacttacttacttacttacttacttacttacttacttattatcatctgatagcagtttgatttaaaaactgaagataagaaaatttggagacctgcacaaggtccccatttcttgtggggactgtgaaaccaccttgctaaccggcctgactggctgctctacagaaagactgatctgaaggttcccaagttgctagagtggggctggctttttcatccaagcatgctatcctgcctactggagtcagtcctagcatgggcagttctaaaactgtccttactcccatgagaacagttatatggaaaatgctagcaggctactaaaggccttctgtcagtagtgtatgtacacctgtgcctcctcctttctccccctcccacttcctgaaacagtacattccctcagcagattccatagtaagaatgttccatcttgcttgcttgattccagggtctttgtggtccattgccatagctccagaatacagtccttatcaaacacttatctcatgaacacttagactccagaacaggcagcaggaagactactctcaaggactccctgatcagctttcctgttgctggagccccttgccaagtttcccgtggtgcaccagcatcctcagtaacttattatcaatatatgaatgaattatattgcatttatgtcagtgtccaccatcacctatccacctcttgagctgaccacatactttttgttccataccacactattctggagcttatttgccccaagtcatgtcactaaatgttcagaacccttggtaaggactggctgaggtcctgttgcctgtgtttgaatgaccttccctggcacctcgaatttcagctacacttagttcttccctgaccaaaggcaagggttgcagcaactcctgaagaggaatgaagattgatggcttggtgacttaaccagttccttaagagatggctgacactactcctcgttgttcccagtcttcctgctctactcggtatctttaagatcctggcttccagctaggtatagtgcttcatttctttaatcccagcactcaggaggtggaagcagatgaatctctgagttggaggccagcctggtctacatagatagttgcaggagctacatagtgagactctgtctttta

SEQ ID NO: 30815 - DNA, 1193 bp, Mus musculus
ttggttaacttatttaataaagtcctcagaactcagagaaatgcttatacttcaaatttgttacataggttgttataaagctccaggtccaaagactgatcgggagggagggagggagggagggagggagggagggagggggggaggttggttggttggtagaggggtagatagttacatagagcaagcaagatccctaatatacaagctctgtctctgtagagtttggagacatcgccatcccagcaagggaatggagttttgtttgcattcctgtaagcctctggtgttgaacacccaaaaattctctagatcctgtcctttgaatttttaaggagtctttattacatggataagattgaagtgccacagcttacagaaatggcattagacaagagcctgatagtctagagaaacccaccaaggcttcagatccttcctggcctgtgatatgacccatctgaaattggaggtcttagtgtgcagtcacataaaacgttcagagaattgctttatggctggctccaatacaaaagacaagaaagaaggtagtatatatagttcttttggactggtcttgaagagaaattttgtagtctgccttggggaagaaaaaggaacagttgaaatggggcatgagcgggtcaagtggactgatttctcaggccaacagtgcccagcattgtagtaaataattgtctctcaactttatcactcacaagttgttgtgaagctgcttctagaatcaaggacaaagtgtcaaacactttaaccacactagtcactaagaaagtaataggggccatgggaaacatgattgagaaaaaaaaaggcctaagtggaaaacctggtgagatctcctgcctaagcttcttaccctggaaaaggaagatgctcaggggactgggaccattaagtcaggtcatttccatgtgttcactttgggaactatctttttcttcttatggttccccagaggtctagtaccttccccacccccccccctttttttttcctttctttttggtttttaggaacatcatcttctgtataacattcttagtaatgatgtatttgaaagatttttgagccatgggcatataggccaaatagtgaccttgggtgtctgaatagttagtgcttcttgtgatcctgccgcagaccctctgggcccctttgtctgcgtggaacgg

SEQ ID NO: 30816 - DNA, 1178 bp, Mus musculus
tgaatagatcattttaaactaagccagaagtctgtaaaggtgaggaatagccttagcactcctgtactctgtacaacaaagaactagacttagggtgttgtcatttctacacgccattggctcgcttgtctcacgtggatgcttacgcgtgtgtagaactcaatggctgggtagcacggtacgtgctgtggttaccgccgtgctctgttctcctgtccctcggaagtgagcgcacacacagcggactgtggcagacttcacccagtgccttctgccactccctccttggctttcgtatgtcgtcagagtgcattcctccttagatgatgggacgcagctcccgggaagttttcattgtgggggtgagcctttctcagaaccttggacccaagtccagagagttcgaaaaggtcatttcttgaaagggtctcctcaaagcagcagagccttagtgaacataaccttgtctggatgcggtgcctgatgatgactgccaaccatgtataccctgtagtcatgacgacagaaggtcggaatgacgtcacagagccactaaagcaacgtgacctgtagccactccgtgtctggactgtgggttttgttttttgtttttctgagagactgtttctaaaccaggtgacttagggacattctgttaataacaacaggacagcctggtgccccattacactctgtaggagttatgcaattcagaagtggaatttaggaaatcatttattttgatgtgtcaatagagagatttattgtctgtaaatttggatgtaaataatctgatcattgaaaatgaacttgaaacaattgtgtatgcttccttaagctgtcatcagcctgtaagatggtttccgaatgtgttcatatgtgcacatgtatgcatgtgtgttcatatgtgcacatgtatgcatgtgtgttcatatgtgcacatgtatgcatgtgtgtggatgccccaggacaacttcaagtgttctttgggtgctgtctccgttgtttgctgtaaaatggcccctggcattgtgtcaggagcctcctgtatgcagcttcccatcatcgtgggtccctcaagtgtccagccttcatacatgggacctgggagtggaacccaagtactggtcctcgctcagcaggcagcggcccatcggccacccacgactgcatcggca

SEQ ID NO: 30817 - DNA, 1256 bp, Mus musculus
tgtgggtagatgtgtggcatgtgcatgtgtgggtagatgtgtggcatgtgcatgtgtgtgtagatgtgtggcatgtacatgtgtgtgcatgtgtgcatgtgtgggtagatgtctggcatgtgcatgtagaggctagaggttgatgttgggagtctccttcagtcactcttccttatacatggatgactgagctggtgctccttgaggtagccagcttgctcaagtaacctggccgagcctgcctggcatctgtccatcggggacctgagctgcaggcatgcttgcagagcaggctcttgccccagagctatttcccagcagcttgccctgcagctctgaaagccaggtgacagcagctgccctgcccccaactgtcagtgttggcagtgaaaactccagggtcattttgtattgtctcaccaaggaggagcccagctgaagcagtcctttctctgcagggttgtgtgaccgctgtgtgcaccggttcgaccatcactgtgtttgggtgaacaactgcatcggggcctggaacaccaggtacttcctcatttacctcctgacgctgacggcttctgctgccaccatagccaccgtgactgctgcctttctgctccgcctagtgacagtgtctgatctctaccaggaaacttacctagatgacgtggggcatttccaggctgtggacactgtctttcttattcaggtaattttgcggtgggtctcaggaaaacatgaagctactcttttatcatttaaaaaatattccttttattaattctttgagaatgtcatacatgcatacagtgtatcttgcccctcccaactttgtgtcctctctgggctgcccatatatactgataggtgtggggccatttactagatcatgctcaaccttcctggacccacaccctgaaaggaaactgactgtccctgccccagaagccattagctgcctacagctcctcagctaggctgggggctttcccctctctgctctgtggaatgttgcctggcttgatcttatgcagacaaccatgtctgctatgagttcatgattctgtcttgtccgcagacactgttttactctgatctcctggcctctggctgtagaggctttctgttcccctcccccatcctgtgattgtccctgggccttaggtttgtctatgtgtatgtttgtctgtgtgtatatgtatgagagagagagagagagagagagagagagagagagagagagagagatatgaatgttctgt

SEQ ID NO: 30818 - DNA, 1113 bp, Mus musculus
tgccgtctcccagcctgcttccgagcctcccttgtctcctctgagcctgatgcgtccgggatctggttgtgggatgggctccattcaccactgcccttccctggttccccgcagctgcagattctgtgacctcaagcatgcaagggccttgaataatgtacccggaaagtgtccagcaaagggaaacgactggggccctaccccatgtggacaacctcaccatgcgtctggaccccggtgtgggcgcctcagtgataggcgtagtgacagtgacagtgacagctagagggatgatagacccccaaactagtggactttgaagttttcttcccaggtcagcagcggtacagcatcctctacttctgaatgcctttcacagtgcactctgccatggagacttattcagcagtatgtaagtgttgcgtttgattgtctccgcagccggttccagcctcctggaacaaccatgtcgccagttttgcgcgtgccaaattcacggcgctgcccaagcggagctgctatctgaattctccttggatgtggcaaagggaaatgaacgcaaaaggtgccgctggaagtgtccgacctagagaaatatgtagaccggagccctgttaccttgtgagaatggcatttttttgtttgtttcctttttgttaatagtttctgttttgattctctgcgttggaattttggtccagaatcctgcctcgtaaagccaatgtcagtgttcccagtttcttaacacgggctttttatatttcatcattctggtctggagggtgatgggtgacatcatgaccactgacctgttaaatatgcccaagtttgggtgtgggaccctgactacctctaggagttgctcattctgatgaggtcggcgcaggttcttttgcaggactttatcagtatccatgtgaatatttaaagatgtaaaagggtgtattgctgggtgtggtggtgcacttctggaatcccaaccctttgaaagctgagacaggagaattctgagttccaaactagcctggcctgcatagtcagatcctgtctcaaaaaacaaggggttggtgggctgggagctcgctcggtgagtgagggtgcttgctgtgcaag

SEQ ID NO: 30819 - DNA, 2522 bp, Mus musculus
gtctgtcaggggcctgcctgcctgccctgctcccttcttggtgctgtggtaaaccacaagagcactttgctttaatgctctcagcggtgttttcattgtatgaattacgctcatcaagctggtggctcagttggtagcatgcttttctagtgtgctccgtaccctgggtttaatcctcagcactgcagaacaccaggcatggtgatcaaagcactgggaggtggagacaggaattcaaggtcattcctaggtacatttccactttgaggctgacttgagtgccccctgcatgagcccctttctccaaacaaaatgaacaaaaaactccaaggttcagtcagggctaagatttctgacagccatcaaagctcttaccactcagttgcagtaagtgcctcattaaacagtttgaggtagctgtgctcacagatctgggggaacactgcatgtgagtctgtagcctgcccctctccttcatgtcagtaaacagaaccaacacagagctttccaattgtacctttactttcgcagactctgtttgctggtattcagggtttctggttgctgctgtggaaatgcagtggtgagctcagcacccttatatatgtgcatttgcacatttgtgtaaatataggacatacagattactagctgaaaactatttgtggtccctgttcagaaaagaaagatgcacatctgatggatgcaggcagactcctgcagagctgagctcagacctagcctgggacccttagccacacagccaggtgcctggtggtgggcctgctccgtgccaggacatagcatcttaggtttgttttctgttttgctttgttttttcttgagacagagtctcactatgagcacaggctagtctaagtctcgtactgttgctgctctgcctcctgagtgccgggactaaaggtgtgcgccactcccgactagtctggctgtgtgcgtttctgttagctccttgtatttgggcatgtgtatgaagcaaggaccggggaaaggagactgagctcgcccacgtggtaacctcttgtttgttctatctgtccaatcgcagtactcaaagggaagaagctcagcctgccagcctaagtgccaaagaccagcagcagcctctgcccttcggggtgctcggacagggtctcaccatggcgaaggcgaaggcgaaggctcgggatgctcagtgggcagaagcagaggcttctgcggcagccactcactggtggctcttcgaggatgcagaggaagagaccaggaggcttctgtctactgcatcctgccttatcttttttattactatgtacaaagatttttttacacaaagaaacttaatgctgtgttaataaattcagtatgtagatgaattgggacagtttccaaaagtgacgattttgtgcacaataagtacaagccttttttattttttgagaatttgttgaggtggtcaattctttgtgtctacaatgaaattatactccttgacacttggtagattatccaaacatctgtcaaatttccatgctatttattttctttcttttctttctttcttttttttttttttttttttttttgccaaaaagataagttgtgtttgtttgaaatctgagacattgtgttccattggtgtttctgtccaaaagagtcctcgttgtcctggaaacccttcctcagatgtcacactacatgtcaggttcgggaggatgactagaaagtcctaaggtttcattaccaaaacttgaaggttcccagcagaaactcagctgatgctcaccaaacgctcacccttcccccgctgaggtgtggcagcttgaggttatccgagggtgctgagagctgccacacccagagggtctgagccacctgccctctgactatggagagggctgggggtgatggctgttttggatagaggactcagctcctctgaggaatggaacacaaatagccacctgtcactgtcagtccgaaggatcactacaaccatgttagactcaaatgtttttctcatagcacttttggtgataaaatgattgacaatctttttaattggcaacaccagttatcattccttacattctttttagtattttttttaaactgggctcttgcatgacctatattgtgttaacatcctaaataaacattttattaaacagaatgtatggtcttttctatgaatcaggcttcaactattcagtgttagatgcagcaaaagctctatagggctgcatacatttaagactgacctaaggagacggagagatggcttgatggctaggcacttgttgtcctttgagttcaattcccagcacccatgtggtggcttacagtcacctataactccagttccaggggctctagcacccttttctgggctctgaggacatacacatgcatgtatcacccttacatacacaaaagtaatatggataacgccctgttgatgggaacactagggtttttcatcatattgtgactttatacgatgcaccgttaatattagaagt

SEQ ID NO: 30820 - DNA, 1154 bp, Mus musculus
cttaagactgattgactgtgcgtggcttctgtgaggctggtatggtggtatctgtctatcaacagttacctgaggggtccctgcagaaatggacaccaaaatgaccatacaatttatacaaccttttctttctttctttctttttttttttttttttgcttgttttgatttttcaagaccgggttcctctgtgtggcgctggctgtcctggactcaccctgtagaccaggctggcctcaaaactcagatttgcctgcctctgcctctgagtgttgggactaacggcatgggccaccactgcctggcctatggaaccacttttaaccatagtattaacaggatccggagttgggaacacgcataggtgttgggacttgtaggccagcccatggcataagccacctaagaagtctacatctgaagacccttagtgggtctgcaaggcccctgctcctgatgggctcccatcctgctgtttacacgagtctgaactttaagacaacagatgagcactttatacttgcctgcgtctttccggggtcactaggacagcctgagtgtcctctgagctggcactgcagcccctccctcatggatacatgagctagctgatcactaactcttatgtatgcttaattctcacattatcagacctctgagccaggtggtaggctcaggggaatttaaataaataaataaagtagttggtataccatcaaaagcctgcaaggaaggtgtgggattcctgagagccaggaacttgctgagttccagtgtgccatttccccgtgtcagtcaggacactgggattacaagcatggactactgtacccaggggtgatgaggtttcacctttccattctaaatcaagttgccttgtctctctggttactaagaactacatacattacggaatccaacaagcacagaacacaattaaaaataaaaaaaaaatccagaaaacaacaaaaaagtatggtggtggcttgggcctgttatcttcaccacttagatgtgggcaggaggaccagacactggaggtcacaactttaaaggatccaagccatcttttgctacacgagatgttgtctccaaacaaatctccaaaggggggcaagtaagcctgaagggaaaccctgtaggatactaagtat

SEQ ID NO: 30821 - DNA, 2526 bp, Mus musculus
atggcagagagaagaggggaggggcttcaccttgtttctttcttcacgtgtagtggtatcctgaagtgcgacaccactgtcccaatactcctatcatcctcgtggggacgaagcttgatcttagggatgataaggacaccattgagaagctgaaggagaagaagctgactcccatcacctacccgcaggggctggccatggcgaaagagatcggtatgaaaccctcatttcttgtgtctgccttgcagtcctggtgccaggcagctggagtccacctgagagagggaagtttctccttcttggggtctctttgctttgggcaaccagccaggccaggcctttgttggtgtgggagttgactgctgggccacgccatgctgactcaggggctgtcctgcggaacatctgtcattgcctgtggctgtcttttctaggtgctgtcaaatacctggagtgctcagctctcacacagcgaggactcaagacagtgtttgacgaagctatccgagcggttctctgtccccctcctgtcaagaagaggaagagaaaatgcctgctgttgtaaatgtcggagcccctcgttctcggtcctgcctggaacctttgtacgctttgctcaaaaatcagcgagccttcgcatttgatgccaagtttttgttacagattaatttttccataaaaccattttgaaccaatgaaccagtcaataattttaaggttctgttttaaatgtaagaattccaacttacagtctattaaaattcagccctaaaatgacaaagccttcttaaagccttatttttaaaatcccccattcttgctcagattaaaaattgccaaaataccttctgaactaagttgcgttgtgctgagaacacctaagcactaaactctcttgagagacttctgttgctaagaagaccgcagcttctggagccaggggtgcagacccttccagagttcccagaccgtgtgacacagcacagcctccttaatgacacgttgccatgtaacgcacctgtaacttatcagcccatgttcattacgtaactttgtactgtacgtcacagtgatgagtgtgacagctcagctctttgatttcatagtgagttttctaaaagaccagccgactagcttttgcagactttgaacagaactctggttcctgtgttgcctctaatgaagtattctgttcctagttgtgggtgtgctgggtggagtgtgaaacacgacatgatcaaaggagacagacagtattttgactaatatgaagtagagattactttacactacattgtacatggagtaattcaactgaataaaagtgtcacgggtaaagctttttaacggttaatttctgtcaaacagtaggtgacaaatggccgatcttatcagtgtctcttgagcatcccttcgcgccccccaccctccactgccgtccctccccagatggggcgttgagtccatatttaaactggccaccctcacagttctaacttagcaagtgcttttctttagaaccccttcttaacgagcaatatgtctgacctgtactataagatctttctgataacgcagagattttttgtttttttttggtagctcagtagaagtgcgtcctgttttcgccttactttactcagagctagttagtgcttccttagtttcctagcaactaggtgtgcaaatcatgtgttgcagctttacggtttttaaactattttagatattcttaaactatgaaccttctaaacagtaccaacactgtcatgtgactaatgctgcctctagacctcgcccacgtggacagacgcttcctgtcatggctctgcctagagatgttccttggggtctgtgaggttctgtcaactgctagtgctaacgctgtcctgtacaacctaactcactggcaagaatgcagtgttgggcctttcaaccactagaacaaacttttttcaattgacagttgcagaattgtggagtgtttttacattgatcttttgctaatgcagttagcagtatgttttgcatgtatgaattaataaatccttgaatcatacaactggttatgcttgtgtttttggaatttgacaagctcttggcgtgtttgctctacttttaaaccctggatcactggagggatggagtcccaccttcagagaatagggtaggtgagcccacagccacatttgtggagtggggctggtttgagccgttgttaagccgtcgtgaggtgcttgtgtggggctccccacagtggggtatgtctgcctgagccgtgtgtctgggaggtgtgccagggctgagtgctgcagatggggaagctgagccacggggcttagcatggaccacatctcaaccagttagacggccattaggattagccctcattggtgattcttaaactttgaatctttaaataaaaattacatgtgtgtgcacgcacatttctctgtgggatatagatcaggctggcctcaaactccctcgtgctgggattaaaatttgtaccatttcccagtctaa

SEQ ID NO: 30822 - DNA, 1172 bp, Mus musculus
ttgagacagtctcatcaggctgacgtagaactccttttaccccaagtccttctgcctcatctttctgaacactgggattataggcttgtaccaccatggcaggctcccttgacttgtttctgagagagttctagaaatcattgtgtgtggttcgggcaggtgttacagtgtacagatttggggctgtggtattggtgagaaccaacagcagagattgtcctgtgaccttgacacgtgcactcactcacatgtgtatccgtcacacacagaacagctgtttgaaagcatgtgagctcactctagttatactaatgttaaaagctagttatcctatctaaggtgataggaacaaatgagcttcaaagtgcttgctttccttgtggggctaccctgtgtgtcctgggctctgggctccgggctccagccccggtgtgcctgtacctggggaaagaagagccagtttcttcacctgatagttttgtgagatgcaattaaatttgaggaaatatgaactcattctacatgcaaaaaaacaaaaacaaaaaccaaaacgaatggaggagaagctaaggatgtaggccagtggtcagatgttagcttagcatggatgatgaggtcctaggtccatctctaacacgttcaagaactgaagaaaacatttattggtaaattaatttggtaaaggattaataccctaaatacagaaagattttttacaattaaaaataaataaataaaatacaaaccccaagtagcccaatccagtcattggcagagtgttggagtagaggtttgtctgagaagatagacagatggccagcatgtccttgagactggactgtagaagaaagcgcaccactcaggagcagtgggaggccacgtcacacctgtcgggatggctgttgtcagggcagtggtgggaggaggggttgcaggagcagatgttgcagtggctgtcctctgtcgttttgtgctgctgggtgggagtctggtggttcttcacacagttgaacatggacttaacgcacagtctagtaagtctacctgagaggtttgaaaacggtttaaagtccgggactccagtcttaatacacagtggcccaaagacagcagcatcaagtctgtggacaggtgagtggatgagtagatgaaaatgggcactgggaatgtgg

SEQ ID NO: 30823 - DNA, 1136 bp, Mus musculus
gcagtttcttttgcattaagtctggcgtatgctgcagccgttcagttcctgttgtttcctgtgaaccagacgcacctcggtggttgatgcagagggggacgttttcgagcatgttctcaatcgtttcggaaagacgctcagaactgggaaccccccctcccccaggaaaatgattgatgtgctccgtataagatcagacaggaacctttatcacagagttctaaatcatggagacccatcctcaagggctagcgtccggatgccgcctgcctccgctcacctctggccatctgatggaagtggaggcctgtaggctacgccttccacttcttgtaagccttgcttcagtcatgaagagtcttgcttgccatttctgcactgtactgactcggccagaggtcccttctcacgtgtccccctccttccgcccgagttgcagtttttaatggaggcactttggagaagttgcaatattaaattgaggataatttacaattacagaagagtctgaagctttcctgccgacagaacacagacagcaaacgaagcaatgaagcattttcctttataccggcccaggacttgtgatttcttttacattaagattttcttccaaagtgaccctccctccttctgtggtttggtaactttaataaaggtcatttaaagagtggacattttacagcctccctacccaagacagagttaaaaacagccatgggagagttgggggaccctgactgtatatgtcatttatattgtgtcctaaattactatgccatgggctattttagtgttttgggaaaataataaaatctgttctttagcataataaatatgttttattttgtgtgtgtgcgtatgttctccttatcttttcgttaatgtcgtcgtcttcctaggatttcagcatctttagcagtgagtgaaaggttgctggtgaagacttaagaatcagctcaaagaaaaaaaaacctaacacaaagatgggtttgaagttttcctcctccctctccctcctcttccctctcctccctcctcttcctccctttctccctgctccctccctccctgcctgagctcctgtccccctccctctctccaggttatgaaatagtgcactatagctggttaat

SEQ ID NO: 30824 - DNA, 1119 bp, Mus musculus
aagctccagcccactttacttcctttcttccccagagcaagcatcagtagggacccgttctatgacatgttggccacgaggaaaaggaggattgccaataagaaataggtaaatgtcaggatccagactccagcagatacactggcctccccagcggcaggaccggggacgatgtggtgcccacgggccctccagaacagccagccaaggcctgagccctcaagcctgtgctctgggacattggtcagctgggagtgtctccttcctgccaccggcctggcattgacctttggggacccttgtccacaacagcacctggtgatacagcctccagatctgcacagcccacatgggactcctgttctggagccagagcctcacccacaccatgccacacctgctctttggggcaacactagatgttctagaagtcgctgttttatatcaaaatgggaaaggaaaacctaccacttttttattcagaatttttctcagatatataggattatagcttttatatgcctttttatattctgaaaattataatgaaagatacttaatttctaacagtagtatttttagaatggcagctataaacttaactcctggacacacgtatatactgtgcactgaaaacagtctatatatgcagcccccatgcacttggggccagagcagctggggcacagtcatcctgacagagtgtcagctgggtgaagaggcattggggtgagtgtggagagcagtgtgcttgggagattcaggcgtgactgccacttcccctcacatgcttctctaagatgaatcagtaaggtacagctatggccggggtatttatcctgtcagtgccaaggcctggagatggagttccttctctggaaaacaggccacttatgtgcagaacctcctcttgtctgaccttcatacaggacagtttcatgtggtccgagtgcacatggctcatgactttggtacttttgttgcttgctgtttcaaacttgggttaagtgctaacacatattttgatgtagtaagcaagcagaagcagccagaagtaatccacctgttctctggagtgccatgttttccaacatttgacatcctttggaggaggtgaaa

SEQ ID NO: 30825 - DNA, 1184 bp, Mus musculus
acatccagacccctaacacacacacacacacacaccagtgcatgccttcagggcatatgtgcttgggctgagactgggtaagatgagagggcccattcatggcttatttggaaaatggtcttcccctgcacgtggagctggtgttctgagagcccttgaaaaccgccaaccaaatgcccttacacgagactttcagtgagctgtcttaaggctttttgcctgaccttggtggtagctgccatctaagatggcacagaaggatgtgcaggccagagctccctcgctcgtgcaccagactgatcactttttggtttattcccaagcttctaggctttgcttttactgatacctcaaatctgaaacccttgcatttgagctgcctggctggtgtgtatgcagcctggcttccagtcttccatgatccctatcccctattccccaccccagacctgaatttactgctggtggggcacctgtagggaggtaggaactggcatttttttcaatcaggaccatggtgagccggtcagatgttcaacccaggtgtggccctgggcaacagagctctctgtgggatattgaggtcaggacgttaagcatgaggctacctaatgttgtctttgatgccatagtcatctttgaggggaccttgcctgatggctgttggtgctaagaatcctaagttactggctcttggagtatccacatggagtcacttaactcaggttatgttgtgacagtgttaaacccaagggcatctgccactcccagagcttgtaaaggctcaggcactcctgcccttcaccctttgtctgcactcgtcagtgaagcattaaagccctactctgcccaaagacagttccctgtcctgctgggccctgggcatcattcctgggtttcagaagacttgatgtggtactgcagagtaactaggaaccgtctggggatgggacttactgtgcttcctgtcatgctgagttcagagctacaggtgtgctttgctgacaagttaggtcgttacagaccagaaaccatgttgtgatttctttttatcttagaaaacatttctatttacaataaatagttactatgtaaataatgtacatatgtattaatttcttcagtgttatacaatgtatatactcctacaacctgcatgaagaaatatcctattaatgttgata

SEQ ID NO: 30826 - DNA, 1117 bp, Mus musculus
ccagcagggactcgggagatgccacgcctctcctgctgcttgtttctttcctattcttttgccagtttgcttattttccttacagaatactaagttactttctgctctcagacttgctgggatttactctgtccgatttattcggtacagggtcttactatgtagctcagactggtctttaatttaatttgtagcccaggctagcttcactttgacagttctcccgcctcggcttcctaggtcttgggattacagatttctgaccccctgtcaatattctaaatctcagtgaatgctgcccagatttgacattctctctctctctctctctctcttgaatttaagacagtgtcccatgtagcgcagccttgcctagagcctgctgtgtagctgaggagctacggcttctcctgcctttggctcccagttggcactggggtgctgaggctgcaggcgtgtgcccagaaggcctgccttgctactcacttagcagtgtaagcttcccccaggcttggaagagcagtgcagacacccttgtcagttacgttcacgtttgtgttactgttttttacttctagagaccaaggtggtgttaaagataatgaaagcagttcgtccattgtctttgctgaactcaccccagaaaaagaaaaaccttttggggagtctgaggttaaaaatgagaataacaacctggtgagctacacggccaacttagtggtcaggaacagcagtgaaagtgaatcgtccattgagctccaagaagacggcttgactgatttgtccgtcagaccagttgtcaggcatcagctgccgctggggcatagctcggaattggaagggaattttacatccacggatgagtcttctgaaggcaacttgaacctgctggggcagacggaggtagagtgctttcccagatcccgcagctgtgcaaggggttgactctgtatggcaatcctttttcctcagctgacgtcccgcctgctggacatgctccatgggttttcttctgtttagtctcatggactcagtgtggttcctttggctatatggtatttttcaggtttgggtttctttttccccctcacacagggtttcatatagcccagggctg

SEQ ID NO: 30827 - DNA, 1139 bp, Mus musculus
gcaactaagcctcctttctcaggacagagggctgaagagatgagagggaaaatggggcctaccctgtggcctgagttatgccgccaagcatgtgaaagtggacttgcattatagtcaataggaatgtacatttccaacccttagtgaggacaggtgtgactcccagttgtactgagaaaacctatgtaaagacttaaaaggaccccagcttcctttccctcaacccttccatgacccaagactggactaaatgaagcctcttcctcccacctcctccaagttttgattcctcaatttcctactcaaatgttactccccacccctgaacctatttttttaagctctgcctattgaccaggaatcctgccttccttcccgagggctgtactacagaatcagtgctccctccccacacccgcttgcctgccccaggatgactgccagcctggctgctgttgctgtggcagctgcaagtcttccctggtccttctgtactgctgccatggccagttaccaggacacttgatcactccttggctcaaaatgtctgtgggctctgtactgcctggaaggtcagagttctgcttcgaagcactgtgcactcttccagccctctgttctttccacttggcatcatcctgcagcttgccctaaagtgatctcagcagctaaaatgtcttctacctttattctgtatagtctcccatgatccgttgcctccttaaagccccaactccccaaaccacctgaagtcctcagatagcaatctctgacgccataaagtgcctgcctctggctggcagccatctcagtgcactgcacttggttttactcactttaaaataaaataaactccatagatgatatggtactttattggacaagtccctttctgacaacagactggaagccgtaccattcttctgttgaaccctgcaagacaagctgctcgaattcacttaaggagctgaagggcagtgctgaagggggccaggttttcacaggacttaagccaccgctgcacattggtgggtgctgccccactgctgcccccagtctgctggagcacagaccacagcaccacatctgccacagtgagctcatttccaaccagccacgggctcctccccaaagcggag

SEQ ID NO: 30828 - DNA, 1135 bp, Mus musculus
tatgcaagagcctttaggttttctgtttgcttggtttctcaagacagggtttccctgtgtaaccgtggctgtcctagaactcccttagtaatctaggctggtctcaaactcaagagatctacctgcctctgcctcccaagtactgggacgaaaggcgtgcgccaccactgcccagctgagcctttagtttttacatttttgttgtttctgagacagagtctccactatgtttccttggcttgttcgatagatcacctggcctggaactcagatccactttactctgcttgctaagtgctgggattaaaggtgcatgccacaccagcttctaagtgcaacctactcccttcaaaaagtgatcaaggcccagtgagatgactgtgggtacaggctcctgagttcagtcctcagggcttataagcagaacacaggacaacgtagaagacttgttcctgacctctacaggtttgcttccatgcaaccacacacatacacaatgtatgcttaaaaagaatttataagtgactagccctttccgcttttgtgtttataatggtcttcatcaagctagacagaactcagaccatcaattccatccccttgccattaactttggaggctacagcccagaaactagacgttccattgcttgcccagggcaaggatctcttcactctggacgtgaggctgagggagatagcactgggtggctcagcataaaggtgcatgtgcagaattctttctctggaagttgagataagaaaaccaaaggccagagtttggagctagcttgggttatgaattgagacactgtctcaaaataggacaggtatcactgaacgggtgacaggcaataatgtgtttctacctaaatgaagctcaggcaggagaggtatttctctgtggaacaatgaataaataataccctgctgtcctttacaggtcaaacagaaagacactgttggtgttccttgttttttaaatatgaccagtggggagggatagctatttccttggtttgcaaggttgcacaggaggaccccttcctccaaggctctgcttccctggaactgtctcactgagaaacccctcattcggaacactgagggcatctggtctcagacttacctccctc

SEQ ID NO: 30829 - DNA, 1207 bp, Mus musculus
gataatcttgagccctttctccaccagtggagaaagagcttccaagtgctggggttagaagtgtgtgcctgcctaactcagaacaattatcttaccatgcttatcactattgtttgatctcattttctttctttcttttttttttttattttggtttttcgagacagggtttctctgtgtagccctggctgtcctggaactcactctgtagaccaggctggcctcaaactcagaaattcacctgcctctgcctcccaccatctcgttttctaaagactaaaatttgttaggtctcaaatggctaactgaggtgccctttaacatatcaaagcagacactggccctcaggtccacccagcacccctcagtctctaccagtgacagggcctcctggttggtttaccccatcccctaccctgaaatctccagcccagaactgagcagggcttccctctccctagctcctctggctgctacataactaagccgtttggctatgccaacgtcccagctcaggctggccacgttcactccggactctccagctgtccctgcctctgctctcccttttatctacaataaactttaccctccaaccttaggagttgtcgcgctcttccttttacgttcttccccacccctttcagttttctactgattatctatcgcagcccagatttccagcagatagaaaatggggcattttggataaatacgtaaagagatgccgctgtgggcatctcctgatccttgtcatccctgattttgcctacactgggagagaagtggttaattcagaacctggtggtattaacagttgtccagctgcggaactatgaaaacaagagcagacatggatcagtggtccgtcagctagacgccgtcttggccccataagtgagcatctgagtttgacccctggaatctacatggaaggaaagactcaatgcccctgtgctgtcccctgacctccagtcacatgtgcacacataataaatgtagaaaaacgaaataaagcctatagcaactgtgattggtttcttaatgcatgccagactgtacttggcaaagaggatgcgttggtacaaaggatgagctgttggctctctgtggagttactctctcagtagtgactgctccagatgaccaagataggagaatgccagtgctgccttaaagcagtgctcagacttgatcacttgctcca

SEQ ID NO: 30830 - DNA, 1348 bp, Mus musculus
tctctccagccctggtttcgtttctttgagacagagtctctgttccacacaggctggccaggaattctctgcctccttatctgagccttctcagtgcagggatcatagggtgtggcatctgctcagcatgggtgggcatctgtgatggagcagcagagctgggtcacagatgtgcatacgtcaaggcttcatttatatcccctttaggatgggttctggccagtgttgctgtattttatttgcagtttgccctttgctttgtggactgcctgttcacgtgaagataaccctcctgttcctgctcagcacactccctgatacttttttctgttcctctctgctaggtaacttagtaaagctgcatactgcagaactagaaaagcctgtgccaggaaagcaagataactctccttcactgaagagcacagcagacgagaaaagggtagcatccatctccaggctgagagaggccttttctcttcatcctactaaagagatcaagtctaggggtccagagactgctgaactgacacggagttttccaagtgagaaaaggggcgtgttatcctcttatccttcagacgtcatctcttacagaggcctccgtggctcgcaggacaaattggtgagtcccacggacagccctggtgactgtatggacagagagaaaatagaaaaagactcagggctcagcagcacctcagctggctctgaggaagggttcagcaccccagaagtggccagtagctttagcagtgactataacgtgagctccccagaagacagaccttctcaggaaaccataaactgtggtgacttggactgccgtcctccaggtacaggacagtccttgaagccagaagaccatggatatcaatgcaaagctctacctctagctcgtctgtcacccacaaatgccaagcgcttcaagacagaggaaagaccctcaaatgtcaacatttctcaaagattgcctggtcctcagagcacctcagcagctgaggtcgatgtagccataaaaatgaataagagaatcgtgctcctcgagttctctctgagttctctagctaagcgaatgaagcagttacagcacctaaaggcgcagaacaaacatgaactgagttacagaaaatttagggccaagatttgccctggagaaaaccaagcagcagaagatgaactcagaaaagagattaggtactgtgtgttcttaccggtcttctggccaggcttgtgattggttactttgactgagtgaaggcttgtgattggttactttgtctgagtgaaggctcagtttgtagagcttcagtgtcggctgctctaggtatcttgcgtgtcttcattt

SEQ ID NO: 30831 - DNA, 1256 bp, Mus musculus
gcatgcagagataaaatgggagtttaaaggggtgggcatggagctcagtggtatagcatttgcctggcatactcaaggccctgggctctctacttagcaccacagaaattaaaataggtggatttgatggatcaactaatccaaggtgattatctctggaaaacccttgatcgacatctcaagactgtggccagggtttttgtacatccatcccgtcagcttctcaggagcattgcacttctagtgctgacccacgaggatctcaggctctccgcaaaccagttcttttagaaccaaaacagtggtaccctagtgtgttgggaaacatggaggtctcaggagtttgtgagctgtttctctgactgccttctctgttggttattactgcgtcctcttcttaagagaaagtcaaaattaatgcagacatttacttatttcctacctttatccccatagaactgaaggcactgatcatagcatgcagccctcaagggcagaagctatgctccttgacacactgttttctgttctttctgcagaagaggtgaagaaactgtgtgccacgcagttcaacaacatcttcttcttggattgactccactggctcagcagaacatctttaaaaacctcaacaacctttgtgtttaccattacaacttactggtcatgctagtgactgggttagggacacagtaaagcaatacctgcttggaaaaccacatttctacttggtctgatgattccctgaggtttctagatgttaaatatttatgtgaaattaattaaatgtagtcagctgaataccattccattctgctgacattgtatgggtattttactgggaaataagactaataaattgttaaagtttttaaaaatactggtttcctgttgagtcctgtgttgctggctgttttgactgcactggccagtagggctcataactccaggtcaggggccaggccaggccaggctcagaggacttggatccagttctcaccgccttcgtcaggctactcacagtctcctgtagcccaggccaggttctaaggcagtggttctccagctgcctaatgccgggatactgtgctcacccccagccagagcaggattttattgctactgttacatgaaccatactgtaaatatctgatatgcagcccctgaggaaggctgggtccaccctgaaggggtcctgaccctgtagcaggttgagagccactgctctcggggtctgatgctccttttgttctccc

SEQ ID NO: 30832 - DNA, 1368 bp, Mus musculus
tcacagaagaaggatctcctactgcccccacagacccaattctgaagccagaagaaaccaaatcctttagagatgtcagagtccccgaggactccatctgcttggagctaggccccgaccccgtgactgttggagttgaaattcctgctactgatgccaaaaccctcgatgggggcaacagacccccagacgtcacttgccaaagcaaggaggccttgagtctaaccaacagacaccccatccttgtgaatgatattactgctcagggtagcgtggagagttgtcttccagaatcgagacaggatttacaaaatgagccattttcagaagaccctcttagtgtcagctcactggagaaacactcggaagctgcggagactttaaaccagcttaactctaaggctgccccggaggatgcagccttggcgtctgccctctcctcggattctaccagccaagatagcctcttagaagacagtttgtcaacacccatccccacctcagagcagtctgtggagacgccagactccctggattcagtggatgtccgtgaagcattgctagagtccctaggctcccacacccctcggaaactcttgcctcccgataagcctgccgacagcggctatgagacggagaacctggaatctcctgagtggaccctgcaccctgcacccgaaggcactgctgactcagacgcagctgcagcaggtgacagtggccacagcagtttgcctcccaacccggtcattgtcatctcggatgcaggcgatggccacagaggtgctgaaggtcctcctcagagcttcacacttggcccccagagttcatatcgagactctgcatacttctcagacaatgactcggagccagataaaaagcccgaggaggtcccaggaacatctgccaatgccctggtgttggtaaagggccagtccccacctgagtcagttgtcccagaagaaagctctgatgtcagagaaggctgcctggaagccccacaggacaagccagatcaaagtcgggtgtctactttgcagaattcttgtcactcagaactacaagaaacattgcagcccacaccagctgatgcttccagagagtcctgtcctgtgaacgacgaggccagcagccccttgagtttgttgaattcagaacctagcagctgcgatgacctggacacacaggaagatcgcccatgcaccctggcctccacaggtacaaataccaatgaactccttgcatacatgagttccacactggataaatctttgcccagccacttggagagctccaagctgaaggagccagacattgaagggaaataccttggcaaactttgtgtgtctgggatgctggacctctcgg

SEQ ID NO: 30833 - DNA, 1099 bp, Mus musculus
aaacagcacccgtcttctttattgctgcttgtgggattagctgagcctgacgtgtgggtgggctagccgactgcctgcccacctccagctgctttcagggctctcccaaggctgacctccagaaccagctggggcggctcctaggagcagaggcaagcctgcctctcctgtttgtagagttggtttgggttttggctttctttggtttgcgttgctggttgctgttgtccttggctgagctgttagggccatggctagattgatgagtagggaagtggcttcctcccagggagcctctccaaagaacggctttcagcttcctggattttttttttctatattgttttctcttttcagtttcattgctatctccttcatctttagtacttccttatactcacattgggttgggtttttccctagtatttattttttttagtgagtatgggtgttttacctgcatatatgtctgtgtatcgcatgcatgatgtgcccaaagaggtcagttgagggtgtcagatcctctggagctggagttagagatggttgtgagctgctgccatgtgggtgctaggaatcaaagccaggacccctgggagagcagccagtgctcctgagccagctctccagacccttttcctagattctgggagttaacttttttctgttagcctttaattgttgctgctgttgctgcttcccggaggttttacatacgttgtatttctgtttctatttcatccagctcaatgagctcctggactcccttaaggcttcttcatcagagatttatatgcacattatttaattcctgagagttagagatccccttttctttatggttaatgcatttatcttatttactacatttctacttggtgtgtatgcgctcattgccgcctcaccgctgtgtgcatgtagaggtcagagagtaagttgaagagtcatctctctgccctgtgagccctgagagtccaattcaggtcattgcgcttggcagcaagcacctttacccatggagtatatccccactttcttttcccacttactcgtctgtttttgcagtgtgtgtgtgtgtgtgtgtgtgtgtgtgtgtgta

SEQ ID NO: 30834 - DNA, 3966 bp, Mus musculus
caggtgtacaggtcagcgcccgagtgtgaccatggagcctctgtgggagccaagcacctgtgtgtgcagccctgcaggttgtgggaaggaggggagacagggcagcacaggagggcaccagctatgcttccttttcctgccgttctggtctgctcgcctccatgctggcactctctgggtagtcggctcttaaatctgacctgcgctgttatgttgcttctgtctggacataggcagcagtgaagacggagacaaggactagttggctgtagacactctcccagccagcagcgctcctgcttgtccacctgagcaacgcaatccactccatgctgactggcaccagacagtgagcggctcaggagtgatggaaagcggggccaccacgccaggaagcaactccctctgcagcgctcgtctgcccgctcgcctgggctgctcctgcactcgtgctgggcatcctgccgaagtggccacactgccacactgctctggctcacgagtattggaggacctgagcacctcaggccgtgggtctgtgtggggtgtgtgggtgtggatgtctgcctcgccacaggtgccacagaggggcaggcgcaccaggggagggagtgctcacaagtgagccatatttattgtctttaggaaatcactaattgctctttgactgcactgtgggtgagtgttctgagctcccaatattgtacagcatcgtaaattatccaaggaagatatggcaggccaagctggtgctgaccgctggtttgattttcttttttgtttttgtttttgtctctgtctccttgggtgtctgctctgcatggcactgtaaagcttcggtattttgagtgttcttctttcttagacccacccgcgggaaccgttcacaggtaccctccctcgggcccttttgattctgggagttaggttgtgttttatgttcttagaggacatatttttgatgaggccaaaactgctgttctgtttcgttgattgcatcgagcatgtttctatataaggtgggtactctgagcagcctgccctgcctctcgtgctttgaaattcttttggtagaaatccctgaagaggtgcacccatcactcagtgcccagggtccttttctggcgagatgaggccatgcaccacttgctcagcacagaggccagcttgcgggagctctgcgtctcaggcaggtgggacctctgagacactggtccccacagagctgtaagtgagaagagcagtttgtccactctgggtgctgctgagggagctgtttgggaagaagccatccctggccatagcccccaggatacagccagcccctgtagctgcaagtagcagggcagagaccccagcagggcctccagcagccctcatggcccctttcctgtaccaagcacccagctctcctcttgttctgaaagggatttcacatcttcagcgtagcttcagtacatcatcggaggagtctgctgtccctaacacagagggagacctcgctttcctaccccaagcaagtattggtggccatggcagcgtggcgaagccatgctgggcgggagctgcacctgctggcgtggctcttctcactgagctcctcgccccaaatatcccggtgctgcccctgctgtccaggctccagtgtgacaatgggttgagtctccaggccctggccaggacatcctgctatcaatcagaaggacttggactctcctgcagagtgcaagtgtgggtgtcggtgtgagttcacctaacaaatcatgacctttatcatcaactctgattcgatccatgcgttttttttatactaagcaataactttacgatcaacagaagaaattttaaaacagagtctccttttcccatccttggtgcagactgtgcctgcctggactccgtagaaagcactggattttgtgacatgtatattaaaaacagggcatttcaaagtaattttgccaaaattgtcataactgaatttttgctgtgtggactttctgatttttttttaattatttttttacctctatctaccagctttagttgagaaagaaaggaggtgtaattataataagttttttttgtttttttttttcaaattacaggtttcagaagttgagattcactgattacagtcaggtggatccatatgtgtagcctcctttcgcagccagcctgggatagagttactgacatttgagggctggccatctttcaccatgctgaggggattttaacaatacaattcccgtttatatttatatctatattgttctcatggtaaattgccaaaataaaagcattttatatattgagttggggtgggggtgggatagatcttctgtgtcgttgcatggaagggaagactttgtataacacgcatcaacacatcctccccaaatctcaagcaatagacagaaatctcagtagactaaactccagcccattttttaaatgtgagcatgtgctttgccatccagtgtgggttttgttttggtttaggttttgttttttgtttttcaagatagggtttctctgtgtagccctggctgttctggaacttgctgtatagtccaggctggcctcaaactcagagatccacctgcctctgccccctgatgctgccaccatacccagctggttttatcttttaatgataacttaggtgcccttggtgggctttccaaacctggttactcaacgttagcagtgaagcgagccggtggtgactgtggctggaatgtggtgggcttggtgacttttctttctgccctcccttgagtgctcaccctccacctaccagactggaagctgactttaagtcctctaataaaaataatgagccctccaagtccctcttgatagcttctatttgttagaagatgacctaagtcagaaaaaagtagttcccccttcctgagagactctgtctgggccagaagccattcattgaaaggttgcgatggcaaccagcctccagccatgcaggcctgtttttagagagatgggtctctctgaggaggtctgtctccctgctgtacaatgccttttaaaccttcccctttttccatacttcccatagggcatttgtagaattagtgacccactgcatgtctgtccccaaggccgggaaaagagacaggcagctcctcagcctgagaacgccgccgatgcgaccaagtgtcaggctctatgtgccatgcttcagagtgcccaccttgagagaagccaccttgtagtcagagtgagcagacacagttacgtcaaacatacatctcaatatttcttaagaagcaaacgggggcaccagtcttggcttttaggaagctctgtttaacttacacataagttcttaagatgtgttggcagtattgcgtcacccacggccgtcccgggggctgaacgtgtggcgtttggttactgaagcctgctcaggcgaagctgggtcttgtgcatgttcccactgtttcatcctgtcctcgccagggatctgggtgggacagtcacacccacggcctgctacccaccaggttgtacttaacgcaatcagaaggggttcatggcaatataacagttaatgaacttggagtttaaattgtgtacatttttaaattgtaagatttttactgtatattgaagcttagtgtgattcaataaattgcttgtaatttaaaaactatttaatattcaaaataaatatagttatatatttataataatctctgttgctacatttactccttgttttttccatgtgcgggtttggcctggtgctgtggatctctgagctccccgtggtcctaaggcacgagggtgattgtcaggggactgcagcgtctggtgcgtgtgtggttgtgggctctgtaatccaagcctttctacttactgaggagttgtagcgagatttggcttataaggatttggccttggcccaggccccacatgctactccaagaggtcaca

SEQ ID NO: 30835 - DNA, 1101 bp, Mus musculus
gttatgcacacctggatccctgcaggtgtgttcacagtgccctctgctgctagcccctggcttttcaaggctgatcagtacaaaagcaggcatgcaggatgttggggggtgggggggctccctctccaggagagcagcacaggaggggggccagctttgcctttggtttagggaaagagtgtgtctgtttttggggttggggcaaaggtgttcccctgtaaacatctgagccctcccctgcctggtatgttaggtctgaaagagaggacacttctcatgtgactaagctttctcccttccagatgtggcctgccgggccctgtcctgtctttccctagtggcttggcaggaatttgtccaagtcacacgtctgtgattccctctgagtgagacttggcataagaggccggtgtcgcttgtcacgttgccattctgtctgagtcggagttaagcagcctgactccggttccttttatagacatttgcaagaagcagttctctcacccccagtggatggggcttctctcaggccccccaggcttccgtgccccacctccagcagtcctgtgtccgtgaaggtcctgggtctctgaggcgggtgtgtgcattccagcggctgtgggttgtccctagatgcagggcaggtgaggccgtgcccccggagggagcacaggtcacccgtggaatgtgcatgcacagggtgagtggcatggctgtgagtacagagcctgccaggcacaggttcctcgtgcactgcctgggctgtttgtttttgttactgcggatttagtttcttagtttcggaggtgaccagagagactagggagaaaggtgggagggtggggtctgggtgctgcactgggtagctgctgtgaaggctgtttaggaaagcccctgtgggcctgctgaggagggtcaggggaagatggggcagtggcagctttaggcttcgaagaaatggtgggtgggggaagggctgctctgccctgactgtggctgaggaagggggtgaaggagctgaccacgcctggcaggaggtggaggctggtgtcctggctgtgtgctggtcaaggcatgcaacctgagggaagcccagttggt

SEQ ID NO: 30836 - DNA, 1191 bp, Mus musculus
cttgccaagggctcatggctgagggtggctggcagcctccgagccagcgtgatggcagaggagtgagagaaataggaagtgagggtttggatacattaaaaacggagctgtctggggtttagtaacgtattatacctgaccttttccaggaatatggcagagcccgtttgcccttgtaccattttggaacttggggaccgtgttcatttctagatgaaagctcgctggctttgagtaccattgattaactgtttgaaaaaaaaatcttaactgtgttttgggctttttatgacatagaattgtagatgttggccaaatttttaggctttttggtaagagaagaaaagcagctttttcgagaggagaaagtgagattcacaagtttcaaatattgcagggaagtaatttttgtctgactttgaaagcctttccctaccaaaaaggcggcggcggcggggggcgggggggcatcagtaaaatgttctctttgagccgctttggaagctccttgctgtgtggttgggtcactggagctgcgtgccacagtttctattcagctggcctgaatctctctccctcccacccttccaaagctccagctccgcacaaatgtgtctaacgctgggctgccgagcgacttccgagaggtgctccagcggaggctcggggagctggagaggcagttgctacgcaaggtggcggagctggaagatgagaagtccctgcttcataatgagacctcggctcaccggcagaagacagagagcacgctgaacgccctgctgcagagggtgactgagctggagcgaggtaggtgctgtgcgcccgcccgcccgcccggcgctctgtctgagagtggcctcctttttaccacttcaggcagatctaggatttccatttatggacataagtgaagcagtggtagtggcacaacatggaggtgtccttagatgtctgtgctcacagggattagctcctagccctaccagcattaccctgggggggggggggaacaaaggcactccagaccagcttggataaacagcctgacctctgacctcctgccggatgtaactagttctgcctctgttcatcttgccatctcatgctgtgttaggtaagattcagacagaatctttcgtgagagacagaggaggagatgaaggctcctaaaggcttcagtttgtagtc

SEQ ID NO: 30837 - DNA, 1781 bp, Mus musculus
gagatcatcaacatcgccaactgctccacgaacatgcccggcaacatcatcccgtgggtggacaacaatgtcgatgtgttcggcggggcttccaagtggcctgtggagacctgtgaagagcggctcctggacttgtagctgccctctccgtcccagaggccacgatccatcgggctgttctgaggacttcaaggcatctcttccccattcacctaaaacctctggcctgaacagaaaagagccggagctctaatgcaggctgtgtggccgcccttgtcttaggctcatttgttccttaccattttgtcgaggttttttggggggtagtgacagaatccctggaagagtcttgagccacttcctgctggggtttctagtaaagtctgtgagcctctccaccagtccctgtaaatgctaatgcagcccagccctgcctgttgttttggatccttggtgtctcatgtgtacttcctgtctgtcccctttgatggctgtgcggtcatcctatcggcgtggcctaggtcccttgtgtgtgtagcacatccctgcttttgactgaacactgcacagaagcccctgaaatagggcctctccctcgttgtcatgtgcactttccgtctgagggaactgcagctgctggaaggccagctgctcagacaatccccagcatccccggaacagacaccccccccccccccccccgtggagaaggtccccctctcagacccacgctcgctcagaggctcgttgctgggctggctttgaggggctgctcttctcatctggtgccaaaagttcatttgcagcttctacaacaatccccacaaaagatgaacagccattagaagcctcccctccttttgatgctcagcccactgtgaagagtgagcttgttttgtaagccacattggttcctgtgagcatctgaccgtcccccatcgagtatttcccccggaactggagattcgggcgtcatttggctgctacttgcttagtgactccaggctgcatcatatatcataatttattttaaagagaaagtgattcagtggggaaatttataaagctataaatattatatattttatttttcatacatgtttgaattgcggatccatggatgttccatctgtaggaccaacttgatgtgcccatcctgacattgtatgccacaagagctcttgtgatgatggaattttgattaaagtgcaccggaagacgctttgagcttcttgttctctcccctccccccatctctctcggtctcctctccctaactcaccctatcacacacacacacacacacacacacaactggagcccagctcgtctgggagggtggtgctttgtgcttcctggcagatgcacagctgcttccgtttaatgagacctcaccccagtggacagtcacagccgtatgtgaaggacatggagtgttgacccttgggataggacattgtccaaatgtgtccccctccttccgcagcatgatatgggagtccagcaggctatctgtccctggcccatctaagaagcccctgagctctcctctgccctttctctgtgtaagtgttcttgctacatctcatttaatctctttaatacagctccctgtaagccaatctcaattcacaggtgagttcaaagaacaatgaaaagttgtgtgtgtgtatgtgtgtgtacgtgtgtacacaggtacatgtgtgtgcatgtgggggttgtcattaaggattatccaccttaaaaaaatcttgtgtgtgtgtgtgtgtgtgtgtgtgtac

SEQ ID NO: 30838 - DNA, 1237 bp, Mus musculus
cccacagaaaacagtgatttccgcaaatcctttagagcttgggcagtggaacagctcagcaggtttcggttccaatcaccagccctgatgacctgagttcgagtccctggacctctgtgtgattcctctgacctcaatacatctattaaggcacaggaacctccccccccccccaaacacaatgaaaatatgaatgtaattttagaaagtactgaggtaaaatatttcacaggttacaagctccccatgtccctgccagctgctgacgggatgtctctcttcacaggctggataaactcatggacttggcagctcaggcttgagaaaaacacaaactcagaagaaagatggcgttcgttgcaacccagggggccacggtggtcgaccaaaccactctgatgaagaaataccttcagtttgtggcagctctcacggatgtgaatacacgtgagtctgtccttttttgcacactgagaggaagagcaaaccttagtgtttgtccttggtctccccgtctaccttgtggagaagcacaatgatgaacaatactgctggagccacagagaggcacaagtgtgtgtgccagattgcctgtgtgtatgtgtgtccttgtctgtgcatgcacacgtgagtctgggaggatggatgtgtgtgactggtggtagggacctagccctgtgccatcttctgggctgtgacagtcaaactgataagatctgattgcttctcttcagtccctaaatccagtgatttttgaagcctccctaaggcagtttcaatgagctgactgttttactatttacagctgatgaaacgaagttgaaaatgatgcaggaagtcagcgagaactttgaggtatgagcatccccaccccacccctccctctcttctgtttttgtttaaattatacttattttaggtctgtgtacgtgctgacacatgccataggcgctgtgtgcttgtcacaggacaatctgagggagtctgctctttccttccatcgttgtgggcctggggattgaactctggacatttcaacagccctgcaatttcctctgttatccatgctttctcctgtccttgctgtcaatgtttttacaaatgtatttttattattgttgctgtataagatgtgtgtgtgtacatactaccacagtgtttacatagaagttgcgccagcgttgtgaagtggcactctcctgcctttacgtggcttctgagtattgaactcaggttg

SEQ ID NO: 30839 - DNA, 1227 bp, Mus musculus
ccaggttttaatgtattctgtctcttctagaagctcagtttattcctaacaagcaattacaacccaaagaaactcagatttacatcaagctggtgaagtatgcgatgcaggccttggatatttatcaggtatgaagtggccgcagacagtgctgttgagtctagaggatgcctttggaacagagcgcccaagccttcggagttcagttctgtttgcatggcctggctttgcatttcttttttctttttcttttttaaaaaaccttatttattctttgaaagtacactgtcgctgttctcagacacaccagaagagggtgtcagatctcattacgggtggttgtgagccaccacgtggttgctgggatttgaactcaggaccttcggaagaatagtcagtgctcctaaccactgagccatctctccagcccctggctttgcatttagctgggataacaaacatgcgtcctcatgccagtttatgtggcgctgagatcagatccacggttcatgcatgttactgccagtttccctttcttgatactgtggtaagatactctgacagaagcagtttagccatccagggcttacttatccagtgggggtgatcgtgtacctttaccctctgcgctggctctctgggctctacatttacttaccgtttttccccctggtgtggacacctggtgtttttctttttcaaaattgagacaagaacagagaacttagaagaaggataaccattattgaattcagtgcttcattgaagtacttgacttgtgattttatgaagaagtacatgttcagtagaagcttttcctttctaactgccatggggcttctcccgtcctaggtccagatcgcaggaaatggacaaacatacattcgagtagccaactgtcagaccgtaaggatgaaggaagagaaggaggtgctggagcactttgctggggtcttcaccatgatgaacccactaacattcaaggagatcttccagactacagttccttacatggtagaaaggatctcaaaaaactatgctcttcaggtataaaactcttccgagtgtgtgtgtgtgtgtgtgtgtgtgtgtgtgtgtgtgtgcgcgcgtgtgcgtgtgtgcacgtgtgcgcgcgcctgcctacgtgcaactcctccaccacatagagcatagggactgaactcaggtcttcaggcttggtgcctttctgttgtaagccatcttgcc

SEQ ID NO: 30840 - DNA, 1142 bp, Mus musculus
agtgtatttttggaaatacttagaaaaacggccttaatgtggaatttgtctacttggttttcaaacagctgcaatttaatggaggttagtttgaagtactggttctggggctagggagacagctcagctagttaagggcgcttgcagataagcctgggaatctgagttcagtccttagaatccacacagggcaagaaaggaccaactcttgcagtttgtcttctgacctcttcataactgcaaaggcatgtggactgtgtcatatgtgtgcccacatacaatctacacatgtacagaataataaaatgtaatttgaatattaggaatggcttcagagttcttaaccccaggggaaatgaaactgatgtgtaatcagatgtcactctcgctcccatgagtgaccttggctttgtcctgtgcctgcttcccctcttcccaggtcctttcttgctaccttgctaccaggtgggtagccagcccagcacagccatgttccacagtgaagaaaatgggtccaaaggaatggatcccttggtccttattgatgccatagctatctgtatggcttatgaagaaaaggaactgtgcaagattggggaggtagccctggccgtgatatttgacgtggcgagcatcatcctgggctcaaaagagagggtaaggacgtctgaacagtttgcaggcgcttggtcagaaaggcagcaccgacttattcctggcttgtttctctccaggcatgccagctgcccctcttctcctacattgtggagcggttgtgcgcctgctgctatgagcaggcctggtatgcaaagctggggggcgtggtgtccattaagtttctcatggagcggctcccactcacgtgggttctccagaaccagcagacattcctcaaagctctgctctttgtaatgatggacctgactggagaggtaggtcatgggtggcttggattctcaatgacactgcttgcaaagagctgatctgctgcagagctcctggtctcagacagtctgccagcatggaagttttgtactgggatttccagtggcacctttagttcagggacagctcccgcctggtgtgtgtcatctctagatccttccctgttaccttgctggtttcagggcactcagaggccc

SEQ ID NO: 30841 - DNA, 1100 bp, Mus musculus
ccaggtttccaatggggcagtggccatggcgaagaccaccctggaacagctcctgatgagatgtgcgacccctttgaaggatgaggagagagctgaggagattgtgctggctcaagagaaatcttttcaccacgtgacccacgatttggttcgtgaagtcacctccccaaactcgactgtgagaaagcaggccatgcattcgctgcaggtcttggcccaggtcactggaaaaagtgtgacagtaattatggagccacataaggaggtaggattctgacacagcccggctctgagtgcttccagtctgagctccaagtactactcggttcagagggctgttgcatgtgttctctggagccttcagtgtacagatggcattgtgcccacagctgttgataagactagaaagaaggctggtttcccggtgtgtgtgttatcctgtgggacttgttttgtgaggtcactctgcagtgtgaccaagtgtatctgacccagtctctcctgcacctctaacgtgtggctgttcttccctaatgaaagtctaagcctctgtaatgacttcatgtcacgggtttcacattggctactgtggaatacaaagatgagcagcctttgctctttgaggaacatctgaccagtggtgcccctccttgcttttcatccaggtccttcaggatatggtcccaccgaagaagcacctgctgcgacaccagcctgccaacgcccagatcggactgatggagggcaatacgttctgtaccacgctgcagcctcgactcttcacgatggatctcaatgtggtggagcacaaggtcttctacacagaggtacgccgtgtgagcggtgggcgctgaggtcaggtagccttcagaacaggctcggcagatgtttgtttccccaggaaaagtgggataaataaaccagaatttgctttttttccctctgccagctgctgaatttgtgtgaggctgaggactccgctctgaccaagctgccctgttacaaaagcctcccatcgcttgtgcccttacggatcgcagcattgagtaagtgcgtacagtgggagtcagcctgtggggcatagaacggtcatgcagagg

SEQ ID NO: 30842 - DNA, 1547 bp, Mus musculus
tgtaccagagagcagagctttgtgcagtccctaggtctggcctggccctgacggctcagcacctccggtgacacagctatctcgccctctcctctgcgcaggtggacggcgttctgaaaactgtgctccgggatgagatcattgcttggcacaaaaagacacaggaggacacttcctctccactgtcggccgcagggcagcctgagaacatggacagccagcagctggtttccttagttcagaaagccgtcactgccatcatgacccgcctgcacaacttggcccaattcgatggtggggagagcaaggtgaacaccctggtggccgctgccaacagcctggacaacctctgtcgcatggaccctgcctggcatccatggctgtgacctcggtgaccaccctacccagaatgtgaaatgtgcctctcagcctctgagcccctggctgttgagacctctctctgccttgttccccactttattcagttaccttcccagtagtttgtgtgtggaagagcatgagattagtcctggagggagcccctgcacacagtaggccaggccgttggcgatggcagagctgaactcagcagcttccgagatgccttttaacttgaggagccctgaactgggactccctgtgtactcctgtctcagtgtgaagtgcagactgagaacgtcccctccatcccccaacttccagaaactacacctcagagtggctgctcactgtcataccgggtctagggaatccacagtgttagagaagcaggaagcaggatcagttcgacaggcgtgcatctctgagcacagatctcactctgtcactggtgtggacatctcgccaagtctgatgatgaggctcagcgagcccagggcctgcaggggaagctgctccaggcctcatcagtcagatccgatgcagctgtgcagaacgaagctgtgaggccagcgggccagcctttctctttttactgccggcttgttggatatcttttagagatttactatcattgtaccagaaagaagaaaaaaaaaagacaaaatcattttgtttttccttcctaatttaaaaagaaagcagtgaaagtttgtcccctttagatggttatgttgacatttttataaatctgagcattgagaatgttctagctaaatttgtacagtgtggtttttttttttttagaataaatattttataaaagtatttgctgtgccctatttttgtgttagcgtctgtgtccgtgtggcgcctcttccagttcagcacctgctggcccctcctggacagagtagggtgtggctttcagatgatggtgctggctgcctgtgaaggtgtggtggcccacggtcacaggtcggtgaggtcttggctcccagggtcagaagcagaccagcccatgtaaagcctcggtgatgggaacggccgtcctgccttggcggtgagcacaaccctcttcgtcctactgactaagcatgtatgaggagcctgtgggaggcgaggctggcccagtgtctatgtcttaaccctgggaaaacagtgtgaat

SEQ ID NO: 30843 - DNA, 1166 bp, Mus musculus
acacccggctgaaacactgtgtggcagacagcaacatcgtcaggtggttctggcaggcggtggagaccttcgatgaggagaggagagccagactcctgcagtttgtgacaggatccacaagagttcctctccaaggcttcaaggctctgcaaggtgactgacgtggagtcagggccattcctgaggtgttgaacagcaagacttggagtgtgggccatcctgctagagagtgagagtggccagtatattctcacaacatatagttagcagtggggcgcctggcaggtgtgtggccacactggagccccccatgggctgatggatcccatgtgctcttttaaaatccaggagcagcaggggctactggtagcttccggtgtccccagcccaaggtggatgtccccttacccttcttaaaaaacaaacagccaaaccccagcttgtagggagtagggtcaggtggaaggtgctggagcttaaatactccagagcttgactgcactggcctcaagagaccgaggccaccttattttgtagtgatacaggactgaagagactctgcaggggtgatggggttccccgcccagcaccggaaaccttctcttagcacaggctaagcctgcgcctgctgctgcttccaacactgaggggctgggcagagcagggcctgcaaaggaggtggccagacttcctgcccctacaagagcctcttcctgcccccagcactgccaccctttaccctgcacacaggagtgtgtaacacacctatatagtacaacatccactggcctctgtagtttcagcagcagcaggccgctaggaaaacctacaagcatccaggaagaccagagtagagaaagtctagtggctttctgtctagtaaagtgtgggaaccaattagtctctacttctgctaccccaaaaagaggttcttgggcaggccatatgtaggggcgctaagctccttggcttcaagcatgccacactgccacagagcctcctggccaggtactcctaggacttgtctctgaagtacagtaactagaatgttgtcttgtaaggctctacaggcgcggcagggccccggctgttcaccattcacctgatagacgccaatacagacaacctgcccaaggcccatacctggtaagccctgcctccgtggg

SEQ ID NO: 30844 - DNA, 1236 bp, Mus musculus
tgcctcggggtggggagtttgaggtaacagagaggactaatgggaacaccattctttggaggccttaaaaatatgtgaaaattgattgtgatctggtagccccctaacgcacaagaaaccctcagtcatgcgctgtttgagtaggggaattgtgtcgtgtgtggatgacgttcctacggatgtttcttaagagagaagtgtgcagtgccgcatgagcctagaccaccacatccttcagagccagcactgcgggccacacagtcccaacaggacagtgagctgtgtctctcctcggtgctctttcccgccatgtggcagatgtgcgacaagatatgtcatctattcacctagcatctagctgtccgtctgtctgtctgtctgtctgtctgagggcctggccatggagctcaggctggtatgaaactcattaactagtccaggctgtccttgaactcgtggccttcctgcctcacttcatgatggctgtgagtgccagtgtgagcccttcgctcatcagatgatgatggtggtactgatactatatgctacattcttgctgtctgccttctttgaagttacatcatttatttgttaatgtggggatggtgcatgggagctcatacaattcgaaggagtctgttctctctatctgtgggccctggggattgaactcaggtcctcaggcttggtgggaagcccctttacctgctgagccttcttgccagccctttacagccacctcctcccttccttgtcccttttgttgttgtttttgtttttctagacagggtttctctgtgtagccctggctgtcctggaactcactctaaaccaggctagccttgaactcacagagatccacctacctctgccttcagagtgctgggaataaagatgtgtgccatcattgcccagctctggtacaacctccaaagattcagcctgttaactttttccccacaacactctgctaaaagctctgctttttctacggttttccctgttttccagtttccagtaccaaagtttatacttgcaaaactgaccccctacacacacatagtgttatttatcagaatacccagagtgcatagctcccgttgttgttagcagctctgtaaaggtaaatgcacctgctttttaaaaattggtgtttatgtagctttaaaacacacaggaattccatctctgtgtttgtgcagttaatgttttaggcttaaatgatagtgtttacat

SEQ ID NO: 30845 - DNA, 1187 bp, Mus musculus
tctcccctctctcctgactcagctgtggcaccactgagaccccgctacaggatagtccccgctcctaggaaaagccctgtaaagactgttcccttcagctcgttgtcccctttgctgaaagatttccgtgtctttggtcccttccatcactagttaggagccaatgtgtttggctgtgagcctcagcctgccttccttagcctccgtgcatcgctttgtgtttgaaagtgtcatgtctcttctcgccacactaccgtgtgggctctgagcagggtggctggcaagggtggtgcaagtcttgaacctaaatttagattccttcagaggcttcggaagcccttcctcagacccacaggcttgcatgctgctgcgcatccctgccctcgggagtgagagtgaaggcggggctggaagggctgcctctgtgggagggagggctgggagatggcttggagggcagaggcacttgctgtcttgagttccagaactcacatggtgtcaggagagaactgattccccaggttgccctctaagtccacatgcatgctgtggcaccatacacatccccatataaaaacaacatgggggagaaaagataggaggggctgagtactgatccagcataataaacacacacacacacacacacacacacacacattcgtgcacacgcacacacaaggagagatttgggtttggtggcagtgtgtccacaagtactccgtgtgtgggggtatgtgtggttttcttcttttgggttcactgtcttctgttggactgatgcctccaccctgattgatctgtttgacttcggtagcttctcagtgagttttgacataggggatgaaagtcccttttcttcttatttcttttcttttttctttttttggtttttggtttttgaagacaggatttttctgtgtagtcctggctgtcctggaactcactctgtagaccaggctggcctcgaactcagaaacccgcctgcctctgcctcccaagttcgcttcagtttggagcccctgtgatcccatatggattttaccaggagtttctgtttctgttttaagaggcaactggagcttaggaagaggtggtttgcgtcgccaggctgatgcagagtctattgccatttttccgttactgacttggactgttaatgaccatgggctatctttctgttctgt

SEQ ID NO: 30846 - DNA, 1207 bp, Mus musculus
ctgacgacaatttcaggcctccagaggcacgtgggaacgtgtgcagcccatatgtaaaaacaaaacaagcccaaaactattttattatagaaatcttatatgactgtgtgtgtatgtgtatgtgtgtgtgtgtgtctgtctgcgcgcatgtgcatatgcatgcgtgctaggcatgatggcatctgtaatcccaacactaggaggtagaagcagaaggatcaggggtttaagagtattctcagccacattgtgatttcaaggccacctgggcttcttaacaccgtgtgccaaaagaaaacacaaattcccagttctgttctacctggctttgtaaggatcctgcgtcctctggtgtccttaggagagaaacagccttggttttgtatgagataataaccatagataggagaaggaggggaagaaaccactaagcccacagttaccccatgcccagctgtcacccgccaatagcccagtcccttgccactggccaggcgtagcaagtgacctgtgcttcacttttaggtattgactgggctcctaagagcgaccgtattgtcacttgtggggcagaccgcaacgcctatgtctggagtcagaaagatggcatctggaagcccaccctggtgatcctgaggattaaccgtgcagccacttttgtgaagtggtccccacttgagaacaagtttgctgtggggagcggagcccggctcatctctgtctgttactttgagtctgagaatgactggtgagccaagttgcatgtgtcctctcactctgctttgtatactccatgctgggatgctgtgctcctgggacctgttgaggctctgtgtactgcagtgcccttcctggcctggagaggctttctccctctcaactcgtatgtgcatgactcagctcccataccttttctttgactcttcacttcccttccttactcctctacttccttttgtccattacttcctccctaccccttctttcccttccctccttcagctccttcatttcctccttccagctcccgacttatcttaattcacatgggcaacatttcctcctggctgagctctctttacagtttactgtttgtgttagatcgtccccttccaggtaaattagacctgactgtggtctcatgtagtctgaaaagaagctgtatattcagtgaagtttcccagctgtagggcagtcatcaggccag

SEQ ID NO: 30847 - DNA, 1138 bp, Mus musculus
ggctccccaacactctcccttttttgggaaacattgtctcactgtgtatccctgcctgacttgccttgtactcacagagacactcttgcctctgcttcctgagccagcactgagattaaaggtgtgcactgctcagctttccagctcatttgcctgagtgagttggtaccgggcttgtttggggtatgggccgtttcttgcctgccgctgccgtggctcttggcgtgctgtgctgaggacggtgctttagtaggaagaaaaggctaccccttctgtcagtgcattctgacgcggggtgacagcagccctcttcacatgcggctaggagaccctcagcgcctctgtgtctgcagctgctgcagattgattggccttgcccgtcgtgttttgttcgcacgctgacccctttgttctgcaggtgccttattctatattcatatcttcatattgcttttttcttcttttccatgtttcgaacaacagagtgttctctgcctatatcaaagaggtggatgagaagccagccagcacgccctggggcagcaagatgccttttggtcagctgatgtctgagtttggtggcagtggcaccggcggctgggtgcatggggtcagtttctctgccagtgggaaccgcctggcctgggtcagccacgacagcacagtgtctgttgctgatgcctcaaaaagtgtgcagtgagtatttccttgcaggtggaagatgtgatatgggtggaaggtttcactgaggctgccctgccctggtatcattcgaacaccccaacaactgcagctgcctttaaagtgacagacaggtactagatacctgttaacaactttaaagagttgggacttccttccagaaacacttcttggatgcagtactggtagtgtccctttgagtgccctcctggtgtgttgctaacaagggtcccttcagaactgccaggttattctgtgtctgtgagcctttccctggggagatgtgagcaagcacccgttcacctgacgcagtgtgcacatgacgaccaaaggataattccaccaaggtccgccttcccagccagtgagcccattgggttcacgcacagagcacaggtcagaggccgctcacaggagcgtgggtgaccccaaagca

SEQ ID NO: 30848 - DNA, 1151 bp, Mus musculus
actgagtaatagagggtgctaggggtccaaccagggccttgcacatattatgaccccaacttgaaggcttcagtttctgaaggtcactttggggtcgccttattcttgagattcctgtaaggagaggtcaaggaactctttttagagaagtgttggctaaccctgcagaagccactctgagaatggggcctttgttgtcctctgtctgtgaaggagcgtgggctgtggttcccctagtgtaacaagtgttcttgtgttcagggtttcaactctgagaacagagttcctgccgctgctcagtgtgtcatttgtctcagagaacagcgtggtggctgccgtaagtatctgccatcctcagtgtgccacgtgcaactctaagccagaaacaatgcgtgctctgtgacaggcacagcagcacatcccttctcagaaacagactgagaggccacggctgtgagcactgtgctggggtggaaggtgccagggagccctctgcctgactgatctcccgtttcagggccatgactgctgcccgatgctctttaactacgatgaccgtggctgtttgacctttgtgtccaaactggatgtcccaaaacagagcatccagcgcaacatgtctgctatggaacgtttccgtaacatggacaagagggccactactgaggaccgcaacacagccttggaaacactgcaccagaacagcatcacgtaggtaccttcagccgcctcagcctggaggccaggcactgggcttctgtagaaaattggctggccaaggtgctcactccatgtcattcttttagaaaagtcgcctgtgctgcaggccccagtgttgctgagggaatgagagcagtagtaagcctgtgtcttcccagctgctaagcccttactttcagtttgtgacagagagggagttggcccggtttggtggcacaggcctctaatcccaccgttcaggaggcagagataggtgtggatctctgtgaattgaaggccagtctgatctacgtagcctacatagtgaattctaggccagccaaggctgcacagtatagctagtctttgctactttgtgagttctttttcccatcctttatcccccatttcaccccctttcactagataggagagaaagaaggatggagggg

SEQ ID NO: 30849 - DNA, 1270 bp, Mus musculus
ccaacatctacatagctgctcacaaccaaatgtaactccagttccagggcatctgtcctccacagacaccaggcacacaagggtgcatctatatacatgcagacaaacattatacactttaaaataaataaatcttaaaagtccaagcatagtgatgcatgtctttaatcccaggagttagaggatagcagatctctgaattcctggtctgtgtagagttcaatgctggcctggactgtgcagtgaaaccctgtctaaagaaggggggaaggaggcagggagggagaagcagggtgttggtgatgcagggcttaatcccagtacacttggggaaaaaaaaaaagaaaacgaaggaagggagaatatacagggttgggtgaggtggtgtgagccttctggggacagacatccggaggcctgcagggtgcggggtgaggaaggtgggcctgtgccccaccagtgtggcctgcagggaagacaggcagtcagtcctcgggctgatcagtgttgtgcttttcccaagaccctagagtcttccatccagggtctccggataatgtgaagccgagcgagcctctggcatccagcatgaggaacaggactgagcgcctctgctgttcacgtgctggtgaggatcgctggcccagggaaacactgtcacactgaagcaactagcgtgtgttcctgtggatgtcgtgggtgacgtgtggcatttagagacggcagtggttcgttttgatttttctttcattttgttttgttttgattttgctatctcattccatttttgaccaaagcttctctttaagtagtttattatggaagattgtcacactaacttaaaggggaagggaagtatgtacattgtgtgctaaaaaaaattaaagaaaaatcccaagtgtgcaaaagtgttttttctttatactctttctgttctcagcagagaaacaaatacatctttatttgtttaggttgtttttaggatcaggccctagatcttagtccttaactgcgccatcctctgcagcctttagccagagaggaccatggattgagccgggcatgtagaaagcactacaattcagcaccctaaaggctgagacaggaggattgcaagttcaaggcacaaaaacattaatgtgcctcatggggaacaggggcatctgttgatgggtcctgggacactgcattccatcggtaaagttggtgcagaagccctgtactggagagctgaggagccatggagaatccctcctgtactggtgagcaa

SEQ ID NO: 30850 - DNA, 1121 bp, Mus musculus
gatctctggtgcctacagtttcccaagagagaattcagaagcctggagctgggaggaatttgggtccacgggccaagagagtgaggttgtaggtccagaagtgaaaaataacaaagcgagttttgttgcggttaccagtcattcgtatgctagtggactaagcacacgccgttctccttcagtagaaatcaggagagctggagtagaggaggcaggggagggcttgggcagactttgctgacattcaagagatggcaaggactccctccaccccagggtgctaacaggccacgatggtgaccatttgcagagcaacctgctggacatgaggagctgggactcctcctccaccctccaagccctgctgcttgtctgataggggtctccttcccaggcagacgtccagctcacctgcacttgaagtcacaggagcctgctgccaggagcacgttgttgggatgccagtccaggctgagcactgtggagcggatgggcttttttatgtgtttgcacacccacctagacacatgggtaagaaaggcaggcaggtggataggtagcatggattgtagcattccaggtaggtcagaactctctgccttgtcactacccaccacataagatcatgtggttctaaatggttagggtggaatatgaattctgtttctccagagtcaaaactgtccttgtcctcctacatgggagatttaagacacaggtgggacaggcatctgacacacacacaaattataatagagaattgaattccagggtagccttggctacatagcaagacgcggtctcaaaagcctcacctcgggtggggaatgattgagcagcaggttcttagcatgcatgaagcacagacgaggcgtggtggtgcacaccggtcatcccagtattagaagggcagaggcaagaggaacacacgtttaggatcacccctggctatacactgagcttgaggtcctcctggcctacattcagaccctgtccttttttaaaaattgtggctgggtgttcatgagtggtctctgaagccagatgcctactgactgtcggtgttgaacccgcttaacagtgcagcaagggaggctggtggtggtgcgtgcatggagctc

SEQ ID NO: 30851 - DNA, 1173 bp, Mus musculus
aaagtaaaagttttagagacaggcccctgagaatggactcagggttaccaagtgtccccaaagctactgtcccttctggtcacttttctgttaatatggagagcttgttttctgtctggaggatcacccagctggggaggaggtctgcccaaattaagagtcccagccatacatgaagtagatgcatgccttgctggggcgtggggaggacaaccttcttatctgcccctacttgatacatctagggttaaggtctcttgtctctctgtcctggggtatccatttcctggtagccctcagaggctgccagatgcctcattaccatgtttcacctctggcctcagtttccctgttttagagtccctactacagatgatcttaagtggctcccattccctccttagggccacgactgcttcccggtgctgtttacctatgacaatgctgcggtgacattgagcttcggtggccggctggatgtacccaagcagagctcccagcgtggcatgacagcccgagagcgcttccagaacctggacaagaaggccagctctgaggggggtgcagccactggggccggcctggattcactgcacaagaacagtgtcaggtgcttccagagacctaagaaccactctgagagctgggtgggagccagagggaggtggagttgcagagtggggacagggaggatggggggtgatgggacaggccaggactagagggaagcaggcagacttccaggctgcgctccaacagaaggaacttagcagtcatcttggctctacatatctggctgactagggcttgcttaggcacactggagcctctaggatgcaggagagtgactggtaggcttcttgggggtggatatcttgctagattccttcccaggtgaaggaatccaaaccttttgtaaaaccctaaagctataagccacaggggtccacccctgtatcttactaggatgcatgtactctgctggccttctgctagctaagccttatgaggttgtttgagccagtgtctaaactaagcccatcctccagggttgttcagtatcaggcactgtgtcctcccttcctagtccccctgcccccagctcagcacgctggtggcactctacattcccaatgcgttcaggtctaggccttgagtgtcttgttccatagc

SEQ ID NO: 30852 - DNA, 1195 bp, Mus musculus
gctgaaggccaccacatccatggtctccttcaagtgggcaaaagccacacccacccttctgcacccaagccaagcagcacgctttaatttggtgttggaaccccacccacagacctcttacaaacctttttactactctgtcctacagctagcaacagggcattagggcgttgttaaaaggctatcaccttcctcattttggagccaaccttgaatctgggtagctgcaggatcctctccagaggccatcaatcagagtcaagcccaaaggcatgtggtagtggtcactaaaaatggactcaaatgtcatctctgccattaagttatgcttgagtctctggcagccacacccatatctgaccctgagacatccagacccttacgtccctccaacttagaaagcacaaaggacaatgtcattcagttgcagtatctcactcagatggggccaggacaggagcctttcactgggcctgaatgtacaagtaactcactggctagcaacaggcctgcttcctccctgtcacagtgccaaggactgctgtggggagtcctgggagccttcctccagcagaagactaggatatgaccaggcaggcagcgccagggcaccacaggggcagctcagcactgctccagtctgctgtaggttcaggactggccctcagaaacctcccaggtctctattacgtcacggacatctaggccctgatccttactttgtgcaaaagcctgacagtgtcttcccaggtaggtgtgtgcctaaaccctgctggtactgccatgagcaaagatagagatagctgatagagaaactgccaaacaaggaattacgatgttgtcgtttaatctgccaaatatacaagttgaatttgaggagcatgtcttgtctgggtgacgcatggtaaccagaggtttcttgaaatgatcaatgggtagggttaaaaacgggcactagcccagaccaggtgggtgggaaggggacagaacagagaggagaggcctcatcggacggaactggccaggcacaaaccttggccctttcacggcacaggctcctggagcccctctgagtgagcacccagacaatctgggctggttgtcatcaattcccacagcagctgcctgctggcaccccccctcccacgctagcgtgcaatctactggacaaatggaatctcctcaccccacttcc

SEQ ID NO: 30853 - DNA, 1231 bp, Mus musculus
cgtaagaaagggggcagaatggacatgagagagcgcccttagcctactttgctgcccatttacctaattatgaggaaactgggtcctagaactgagacctcacaagggcatccatatcaccctcctgagcttgtttaatcttgactcatttggcttcacaaacccaagcgagaaaggactcgatgtgttgctagatattgttgctgacttgagactttagacttcagaatacacagagagaggttggaattgcaggggtctgctagggtttccagaagttcccagtagccaccagacggcttgtgggtgggccactcagttgggcacagcaggaacatctggatggctggccctgtggcctcagcagaaattttctcccttgggtggcagcctggatgcttggctctgtgttagcgcagtctgtgtgcacagaatgtttctgaggcctcggtcttgaagtcctgtgattcagaggatgtgggaggtatgtttgctgtgttctaacccccacctttcccttccaatccctcagcaaaagatgacgcaactttgtcaggaaaacgaatgcagtcgctgtccctgaataagtaagctggcctgtgggaggagatgccggggaactgggccgtgccgccaggacctctgccatgtctcacccaccctgtgccctggcgccgctgcagcagcccctatggccaggggcccctacggcctggggcctcctcttcatcttggcacagaaattgttcaggggatgtgggggggctgggggaggggcagctgctatctttgagacagaaagatgcaggacagcatttcatacgtaaccatttgaatgtttctgctgtttttagaatttggaaccctggtttgggagggggggtgcctgggaagtggggtgaggagattccatttgtccagtagattgcacgctagcgtgggagggggggtgccagcaggcagctgctgtgggaattgatgacaaccagcccagattgtctgggtgctcactcagaggggctccaggagcctgtgccgtgaaagggccaaggtttgtgcctggccagttccgtccgatgaggcctctcctctctgttctgtccccttcccacccacctggtctgggctagtgcccgtttttaaccctacccattgatcatttcaagaaacctctggttaccatgcgtcacccagacaagacatgctcctcaaattcaacttgtatatttgg

SEQ ID NO: 30854 - DNA, 1190 bp, Mus musculus
agtctgtgtagtgaaggctgacgtctctctcaccttcctaaactactgatctttgtgcaggtagaaagggaggccacaaaggccgagtgaggcagtatacgagcccggaggagatcgatgcccagctacaggctgagaagcagaaggccaacgtgagtacatgtctgtctgctccagtggtccagtatgttgccttgttctggcttttggggagaacaggaaaggactactgttctccaagagacatcacacatgagggtgggaaggacaccagatggcaggtgtgagccctggagcagccagtcacagtcacagaaaggtggtcctatgattggaccaacaagaaaggactttgcccattttgcaggagctgtttggtggtctccactcgtggtcctgtttgcctgccttctagaggccctctctctaccagctgctgtccatctacagctcctatcaattccctgcagctcccccccacacacacacacacacaaggctacctgccagactctatacaacatacagcctgccttcccgttcccccactgtcctgtgtattgctattggctctgttcagcatcacctcttctgtgacatactagtgctgcctgccctcctccagctcctctgtgctgagataccctgtccagtctactcttacctgcatcctctgcaacagtgaatatccacacctgaagtaagggcttaaggaagcaggcagcccctctcccaggatccctgagaaggggagaagccatctctagctggaattctgggagttttgagaatttgaattttgaatttgtggagttcctggcatggaaccttggagtttttcgagacagggtttctctgagtagcgctggctgtcctggaactcactctgtagaccaggctggcctcgaactcagaaatctgcctgcctctgcctcccaagtgctgggattaaaggtgttcgccaccactgcccgggtggatataagggtttgtttgtttgtttgtttgtttgtttccagagctgaggaccgaacccagggccttgcacttgctaggcaagcgctctaccactcccctggatataagtttttattgggctttcttactttgtttttttttttttttggacaaactatgtgcagcccagactagtttgcactcttggcaatcctcctgccttagcctcccat

SEQ ID NO: 30855 - DNA, 1127 bp, Mus musculus
taaacggtcccaagtagggatgacaccatcgaccgttactcacagctcccgcagaagctgagtgaggaaactgaagcagtcagtcagagctcctgattgaagtgagcttcccgaggctgaagttctgacagttctggcttctcttttctaccctagacgcttttatagcatgagataaacaatagatccatcccttccagtagatctcaagcaaggcctcaagtgttttattcttgggctgttttgctgttcctattcctctggtgtagagtgtgtgtgttgagggtgggggaacagctcatgcccagagaagagtctggggaggatacggagacacctgcttgggtctgaaacggggcagaggcaatgcatggttacttaaggacataacatacattttactctctgagcttgacatctagaggagcaggggaatggctgtcaaagccctttggcaacctgaggctcagaaagcagttgattttcttgtagatctttataagctatcttgctgggaaatgcccaaggtcaaaagaagccggaaagcacctccagatggctgggagttgattgaaccaacgttggatgaactagatcaaaagatgagagaaggtgagtggggtctttctgcctgggtatgctggacagtatcaaggctcagcgtctccaaggatagaaagaaagaaagaaaaaaacaccgagaagaggcttgtagcaaactggtcatgttttttctatcagctcagagtgttttgaaggttctgaagagtaaagtaacattaatgaggctatcatacctctccccaaaaaggtctgttgttgtttcattattagtgtatttgtgaaagatcggggggtctgtgctacttttagtgttggctggaaacggggtctccagcagacatagttctggctatcctggaactcactgtatagaccggctggcctcaaactcatggagagctccttgcctctgcctccctagcactaagattaaagaggtgtttcccacaatgcccagctcactgtgtgttggggtttttttgtttttagattttattttactttggggtggggttgggagatgtacgcatgctagcacaggtgcctggggaagccagaagagg

SEQ ID NO: 30856 - DNA, 1151 bp, Mus musculus
aagagggctgggcattcctctgcactgtacgtggaatgtggtagctttggttgcagagctcagcctggacgtgcatcctcatgttggtccagcctgatgtcctgtcctgagaggtgctggtcaacatgttatcattagcaaggtgtatccatgccacagcacacacccagcctcaaactcccaatgtatagtccacccagtggttctcaagttagaagagttctcctgcgccacagctcataggtgtgaggcgtaggcagaatagtgatttcctggtcttaaaatatctagtttggaactaccttgggatgttccaggtcaagccgaactagtacccttcccgtggcagtgatgtgtgtgaaggcaggacttgtcacagccccacagacactgcccttagctattgcatgagcaagctggtcctggacgctagagccacctggtccctttggtttgggagacagtcccagcacagttccttgaggccatatgtacacatttcctgcaggggaatgcagcaataaggagtgccccttcctgcacatcgaccctgaatccaagatcaaggactgcccttggtatgaccgcggcttctgtaagcatggtaggtgacagcaggcctcctcgggctcacctgatcccaaggctagatcctcctgggacatcacttcccctcttctacctggctcagcaaaacctgacctactgtggccactgaggtgtttgatttatttattgttttctgtctcacggggtctcactgtgtaggccaagctggctttacactcagtcctcttctgttagtttcctatgtactgtgattataggtgggcgctaccctcatttccctaaagcctcccaacagggctgtgatacggtgttcccacttgcatggagagtgtagcacactgtcccctgtgaataagccatgcagccagcatttgaagctacactctggctctgtacctcaggcaggctgagcagggctctgactgaaatgggacacttacacattgcctcactgaaaggccatctgaacaaactgaatgctgggctttgcaggtcccctgtgtaggcatcggcacacccggagagtcatttgtgtgaactaccttgttggattctgccctgagggaccatcatgtaaattc

SEQ ID NO: 30857 - DNA, 1179 bp, Mus musculus
agttcgcatcagaactctcacgctttttcccattccttcccctcctgttcccagtgtggtgagaaaggacactacgccaacagatgcaccaaagggcatttggcctttctcagtgggcagtgacagcagcagcagcagcagcagctggaatcactgtggagcagcctgaggggcctgctgaggggagcacgcacttggctgctgactgtaggactggcaggactcgggctggagctgcaggcataccagtcagggctcattttgaggggccatgtctgtcctttcattttgctataattttttttgtttaaaaaagaaggaccatgtgcttcagttgggtcccctgagccagagtttgcctggacatcagtgcctcgtttttttatttttttattttttggactccctgtacactgtcctgttggggagagagaagctgggaagggctatgcttcgtcctgggtggaagacggctggcagttcccctcagggcctcatttaaacaccagcacctaaagaggacgggtggatcatgtggggctgtggccaggtcagcctgctttctccatgtcctgctgacatctgaaactgtgcctatgaatgtgatttgaacacaggagccccttcctcacaaacccggagcacccactgcctggcctggccctaactgtgggaggggcgccaggctccccaggctgagctgcttgtctgggcttgcttgtgggcaccttcagccagtgctgcagaccaccctgaaatagctgacccagttggtctgcgcctacctcctgccaagcaagctctgtgctgtcactcagacacctgtggcatgcagaggccgcccatcctcgagcctagaaaatgtgaatccatcacctgcaacctgctgggcaagtgggcctatccaagttcggttataagaatactttctatgaggttgattaaaaagcttgttttttagcctgtgtttcattacttaaagagactcctgaagaagagtcccatttggcagataccaatctcacagagaagtgactgctgctaggaagggcctctgcatcctctctagtgttaggtttgatacctagtcatcaaacgaggcttagctctatcccctgttcataaaggctccatgcagtgaatagtctccatccctccctcctgttgtatgaatatttt

SEQ ID NO: 30858 - DNA, 1153 bp, Mus musculus
ggctagtcaacagctagtggatggataagaggtgctggcctgtctgaagcaagctcatggctgtcccaaagcacccaccattcctgacccttcggatttaaggacaagctatcagttgcttatgggattaggggagtgtagtgggtttgctgcatgctgcttgtcttctaatgttaatttaggttcccaaaactgttcgcactaagacactgaaggactctgccccagttaattctgattggtaaatgaagatgccagcagctaataggtggggggagacataggcctgccagggcttgggaccaagagtgccaccatgcctcaggaaattctggggagtggggtgggggtgggggataaccagaacagccatgtaaaagggccaagagcagccaagatggaacactgaaattagtaataatgggtttatggagagaaagtacattttaacaacatggaagttaggcagttgccctgctattttctgcttaagaaatattgaaatataaaggccatgttgtgtgtgtgtgtgtgtgtgtgtgtgtgtgtgtgtgtgtcttccatccaggaacgtaaatggtcgaaggcgggaagtaaccctgcgccaggatctactaaaaatattcatacaacaggagggagggatggagactattcactgcatggagcctttatgaacaggggatagagctaagcctcgtttgatgactaggtatcaaacctaacactagagaggatgcagaggcccttcctagcagcagtcacttctctgtgagattggtatctgccaaatgggactcttcttcaggagtctctttaagtaatgaaacacaggctaaaaaacaagctttttaatcaacctcatagaaagtattcttataaccgaacttggataggcccacttgcccagcaggttgcaggtgatggattcacattttctaggctcgaggatgggcggcctctgcatgccacaggtgtctgagtgacagcacagagcttgcttggcaggaggtaggcgcagaccaactgggtcagctatttcagggtggtctgcagcactggctgaaggtgcccacaagcaagcccagacaagcagctcagcctggggagcctggcgcccctcccacagttagggccaggccaggcagtgggt

SEQ ID NO: 30859 - DNA, 1255 bp, Mus musculus
gtatgtgtgaaaccagtttaagtgaggagcctaggagaaagaacccaggaaaaataagatggagttaggctaaagtttagtgattgggaagcatactataaaatgctgaacactggcttactctcctagtagctactgtgaagaggaaggtaagtagtcgagtgtgtgatccagggattatacatgctgacaaagcacagcgctcctccgtcacagacctgggctgctggtgtccagtggacgactgggtgggaacatgggcctctgagtaggcttcacggctgttctcacagcaccagctcgccagtctcattggacctgggtgacactttttgtttcggggctataatggataactgtgtcgccatttgacacgggaagaaattagccaggtggcaggtcctaacttatctggaagaaaaggacaggaaggactgagatgactgtggtctgttgccgccactctgctttcacatggacacctggtacgagactggttttcctatttctagaacatgagcggcgacgcaagtaccactgaagaggggtcgctggagggcattgcatggccgagcataactgcccgccccactccgacctaggaagaattcaactggctgaaccttcataccctgactgagaactagtgtccaataaaaggtgactggttcacatactgcttgcctggtgtagtcattgttctgacttgtccacagtccaggattttggttcatgaaacctgtggggctctgtacaccattgtgtgcttgggattgcgagctagctcactgcagggcagcatattatctggggtttccagctgtctagagacttgtcctctaccataagtactgtggctgtctagaggtgctgtggccactggttgctaatacagtatgaatcatgacagtttttctctttagggacagggtctctctacttagctctggtcgttctaaaattgactacctagaccaggctagcctcaaactcaagagatcagcctgtctctgcctcttaaatgctggggcttaaaggcatgtgccaccacatctggctctttggggtatttttcctgcatgcatgtgcacagtgtgtgcttcatgcccacaaagatgagaaaaggtgatcaaatccctttgaactgcagtcaccgcatgcgctgccatatgggtgctgggaatagaacccaggtactcttaagagcagctaatgcttttacttaattaaaaaaaaaaaaaaaagtgtatgggtg

SEQ ID NO: 30860 - DNA, 1770 bp, Mus musculus
agatctgtgagcaggagtccatctgtcatcagaatgtaccagatgtgagtctgattgttatgcaaatgctaagatcaaaacatctgcaccagatgagactgatataatgcaaacggtgaaatttaaccactctattttccaggccttatccagtatcaaagtattagaaaatgcttacttctctgtgtaattattactatttagtctcagtcttttttactgctgaataactgaatccagaagataattgggaaacgaagtcattttctcacagtatcctttaataagtattctaagaaggtacaagtattttattatagaactcatttgagtgaatttattttaatttggccgatacacattaaaacatttttcttctttgaaatggattcttattcacagtttacctagaatgctgttaatgtgccagtgttgacatagcttctggagagtagctcaatgagccttctctgttctggccagagtactctccaaaggagactcaggcctattcttttctgaggaccctacagactattgtttctatagccacacccttggcttcctgttgatttctgcgttctcttaggcatccttaaatgatgttctggtgttagcttctcaccagctgataaagagttacttccacatcagccatccatacgtttggaggattcagtcttcctgagtttgtggcaggcacccaaacatttgcaagtgatgtccaagtttttagctgccttgtttgcatccacagccctctaatgagatgacaaggacatcagggagccagtaagactcctgttggcctagctacattcattcagtgcctactttgcatgtatgtgtatgtttagaattcttttatatgcctatattgaaggccaacaaaatgctcaggtctgcttttgatagggaaacaaagaacacacaaatcagaataaggatatacagccttccaataaagatattgctgttagtgatgtatctagacagtatttcaagagagtggcaggtccgttcctggtaaaaccttaatcattaggattgcttctttatctgttccctcctccactcccttcatcaagccagggtagtattttgaagcataaagctttgtgcataattatttgtgcattgccatacttttgtgttgggatgcagtctttgttgcccaggctggtcttgaattcctgggttcacacaatttcctgcctcccaaatagctgggattataggcatgcgctcctgtgcctggattttatttttgtattttaatagaatctgcaggccatataaaggatcatggctcttttgatttacagaagtggtcacaggtgttgagtccagggtccctgcccgatgccacagagttcatgattttttacatgatgtgaagcattttcatcttaaaatttgtaacatcttgtgaataagaaaagtgttatttcaaattctagttgtcaatcaagcagttgaggctttcatagttcagatgtcataatgttcactagggatcctcaaccagtatataaaatatgctgctcactgtaaatcttgtggctgacctctagggtagtcccaccactgtattttacttctttgccatcagcaagcgtagtgtctcatcaggacaagaaaatcaacatatatcaaattgatctaaatgtaaaagcaaatgaaaaatgcatggttttttgtccctgtcgaacatgtatattcttacttatagagaccaatagtcacttccagtgactgaggcagaggatt

SEQ ID NO: 30861 - DNA, 1093 bp, Mus musculus
gaagtgtgaactaagtaaaccacgatccttcggaactgtgtgctaaggcaaaactttgctcaccaagttctccaggctccggtattctactgcagaaaacagcagagtaatactgtctggtgatgccggatactagccttgcagcatgctccctgataggcagtatttggccacgccttcttgctttagtgtcaggtctataattgaagataacattcctaacatggctgatctgtactgactgactgttgcgtgtgactaagcctcagcaagtcttgctctagactgcagtgcttcaaggccctcttcagtctttactaatagtagtctcagaattgcccctgttctttccattttttcttgaatattgttggtgctttgcaaagtgagtgggtaggattattagtattagtaggaatactttcaggctaggaacacaaaactagatgagggcttctcctccttcccctctctcttgattagacaagctctcactgtgtcacatataccagtcttagttctgccacactctctagttctgttcttgcatcccctcgtccccagcttgtaggttagtaggctttttattttattttttcaacttcctgtttgagctgtagattcccagcaatgaaagacttaaatctaacagaagaataaagaaaacagcagccaggacacacagaaaacacacagggtagtgggatagtgtgtgtgtgggtggttgtatgaaagtattaggtaagcttgaggccagccagggctaccctgagaaactctgtctcaaaaaggggcggggggggggggagtattagatagtcttcgggaaaaccttgacatttggagtcttgtctgagtggcctttattatcttaatcatggattatactgtgagaaatgaggccaggaccttcacatgctcagcagttttaataaaaagctttcctactaatactgatagatgaagtcatctatcagtctcttcataccagaatatatacttttactacatttcccgattcaactccttaaccactggtaccacaaggaacccatcctgagatcaccagaagctgttctgtaatgctggggga

SEQ ID NO: 30862 - DNA, 1401 bp, Mus musculus
gaaaaatgaagattcacaaatctgggtctctgtgtttgaatatttttacattactggtaaaagagacccatgaatcttaacagtacaaattagtgagtgcagtgtcatgatagagatagattggaaaagaaaagaatgcttgcttgttgggtagaagagttggcaagagatggaagacatgcggaagaactatctccatgtcagctgtaggacccagccatttagttctcttcagcaacccagtgtaatgacagtagtaatgacagtgtaatgacagtagcccagattattttgatgccacacctggcactgggaagaatctactcaataagtcttgatccattagattgagttttaagaatcatacacacacacatacacacacactcacatacatacattcatgaatagtattttattacagatggcaatctactttgcacacaattgtatattttaagaaatacatctgagtgtcatgaacataaaattttaaatgagacatgggcgcgggaaatgtgtacggaagacgcactccccggcgccgctcgtggggggcccaagtccttctgatcgaggcccagcccgtggacggtgtgaggctggtcgcggcccccggcgcgccgggctcggctcttcctggagtcggattgcttgggaatgcagcccaaagcgggtggtaaactccatctaaggctaaataccggcacgagaccgatagtcaacaagtacctaagggaaagttgaaaagaactttgaagagagttcaagagggcgtgaaaccgttaagaggtaaactggtggggtccgcgcagtccgcccggaggattcaacccggcggcgcgcgtccgccatgccggtggtcccggcggatctttcccgcaccctgttccaaaaaaaaaaaaaaagaaaaaagaaaaagaaatttatattagtaaacacagaaattgacttgggactatttaattttatcttattgcttatccagagtccaaaggttgtgggcaaatgctaataacttttaattctattcgtttaataaaactaaaaactagaggtttctatatggctttttaaataacattctcagttttggttaatctttccccctatgtcctgccactgtggatggcaggagatgttagtgcagaccagccaaaagggctttttccaaaaatatacagatgccacatcactatggagcacaaaggggcccccaagtgactaccaacccttggggcacctcagcaagccagcaagagacctagaaatggcagatactctacaagctccaggcaccaaacaagcctttgcctagccagtgcctacctgcagaaggatagaggacttggttttttgttttttttaccaaaagtaatttaatttataatgtctccccaa

SEQ ID NO: 30863 - DNA, 1655 bp, Mus musculus
tgcttctttgaaacaagattcccttccctatcagccttgatggcgtggggccaagctacctcgagaagtccctgaatcacgcttttccctcgtcttctttccagcgttccaatccacatgctgcttatcccaaccctggaccaagcacatcacagccccagagcagcatgggatactcagctacctcccagcagcctccacagtactcacatcagacacatcggtactgagctgtgctggagtctgtcagtgcactgttgctcatgctgcaggactggctgcggcactcgcgggaacctggtgtgggccatgcgaatgtactgtacaaccacatcttcacaatgtccagtagccgagttccaccagttgtcacagattggggtggtagcttccaggttgtacctaagtttggagttagacttgaaatgaaagtgctagcacagttgtgttgtgggtttgctacttccatagtttacttgacatggttcagactgaccaagcatagttttcagtgacagtctgtagcagttgaagctgtgaaatgtgctagggcgagcatttgtcctcgtgtgtggtgactttgagtgtaacagcgtgatctgaccaatagtacacacagacgcaaggtttaactggtacttgaaacacagattatgttaacaaaataaccaagatttaaagattattttggtacacctttctttttagtgtcttatcagtgggttgattcatcttctacataaatcagtgttttatgaccaagaatattgcttggattgttttgaaagtacaaaagaaccacatagtttctactgacaggtttcagagctcccaaagattaatttccaacttagaggtttgtttttattttcaacctatgacgacttgactggtcttaaagctgctatttgatagtaattaaatatgttgtcattgatagaagcctgttggttcagcaaactgaaatgagtgttgcagacagggttttcttttcctcgttggtgttgctgatttgtgagcatgctttctgaatacaaaagcatgagtggcgacctccgtgaggcacggtgacctcctcgaggcacggtgacctctgcgaggcacggcgtcagtccgcactcttctgtcctgatttgaagctgcctagtgtagtgctattacaattttgttcagttaactttctttttaaaaggttgttcgcacatttttagggtgcccttacttcagcaaaggagagggagtaggagagccttagaacttttgaggggaaaataaaaagctataacatacaacgtactgtatcaaactattttacatgaatgacacaagtattctgaataaaaaaaaattgaacattgttaaaaacaaggtgttatgtaataaatttatttttcataaatcaatgtatggtgtcaactatatttttcaaattcaccaagggtcttttgttgtattttaaaacatgcctctgtataactcttcccagtgacttattggtgacaactgatggcttaggctgaggtgtgcactctggtcagctgtctaggtctgtagcacaggggacaggtagctttatagtcggctagttctggtaatggtagttccactccgttacccttggttcctcctttttagagctaacagatattttctca

SEQ ID NO: 30864 - DNA, 1169 bp, Mus musculus
gatggagacgggggtgtgccacctgcacaaaagtgtggggtgatagcacctcctctccacccagagcatccagctgaggcagctgagctttcctgcttccttctccatcagctgacagctccacaccgtgctgcctgcagcagaggagagatagctgcgtccatgaaatgtaccagccactctcctgtgttctttgcctgtgatagcccatcctctctatctcacactctgaaaggaggtatggtgggccatgtttttacacaggggtacttgaggacctgacagtagtaccttcacctgtgtctagagctgtgggtggttgatccatgtgtggaggtcaggtctctgcagaccacaccaccccatttcctcacctttaccatgtaggcttgggattcacaggaaatgtgtctggcagaatcatattggatgctgtaatgaagtaagtacttccagctacctggtcagagatgggatttaatgtcagagatacttccgctgtatgtgtgagtcattgtgcaggcgatctcattggcgtgatgggagtaccaggccacagcaacaaggaagtaagagcttctggtggcaaatagatctagagaatgcagtctgtcctggtggggaggcatggcggcaggagctgctcacagtgtgtccacactcagggagcaggaggggtggcactggggcttggctcactctctcctctattcattctgtgggatggggccacccacattcaggtggatctttacacctcaattaacctaatctagaaatttcctcacaggtgtgctcagaggcctaggtgatctgagagtgttaaccattacaagttcatctccatgtcaatttgacagcaacatacatcactgttaaaccacaactctcttcccatgggcttgtcgtcatctcctgatttataatgcgaagtgcatgcaatccaaagtccccgtgatttttaacagtgccattcagaagataagtgcagagtgtcccagaggtaaggtgtcccttacctgtgcgtccccacaacatcgggaaagcgaaatgcttccaacacgcagtggtgtaacggaaacatctccatttccaaagataatcagaccaaagcaagactgaacccagcagggaaaacagctctggaagctgtgtgtctggcatctgtg

SEQ ID NO: 30865 - DNA, 1125 bp, Mus musculus
atcccatggttggtcagcctgttgcattgggcctctggtaaagcatcatgggtcatgcagacaaaaatgggaagagctgctcacaccattactaagaaccaaaatggggaagccaccaaagtctgccagcctcctttgatggtactcctgcagtgatccgagtcccggaccccaactctagaagtttctactctcccctcaagacattgctcagagaccaggactgttattctcaggtctctgaaggtcatcggaaacccaaaagttggtgtgtatatctctgtgtgtgttcatgtgtgtagttcttttcaaagcagcattctttataattgactcaaagttaaaatggctcaaaggcattcaactgtagaatgggtaagtcagttgtggcactggcatgattggtgtataacaagaaatattctatagcaaagaactaagtattatgtagtgtatttttatgaacatacacaaatatttctggatgctccatagaaaaattaaaatccataaaaacgaatgctatggcatccttttaattttaaaaaagatgtttttaattaaaatagaattatataatttcccctttccttcctccatccctttccagctagcctccctaaaactactcccattcccccagctctcaagttgatagcctccttttatttgatttatatatataggcgtttgcatgtatatgcaagtacatatacatatgcatgcatactgagtcccttttcattggtagtatgtatatgatttagaggctgacttctctgcattggacagccaataagggggcttatccctgggagaggctatttcttgtcccagaagtaaaaagttgcctatagtctttgtctagactggggcctgcaaaactgcccaccctctctgtgatgccatggccgttggtattgctgttgctccagctttgttaatgcagccatttccagaagagcctgtttcacagtagacttcctggtgtgctgcctcttacggtctttctgatctttcttcctcaatgttccctgaaccatggattcaggacttctgtgtatccactggtctagcctgggtggttgtagattcttttctaagtttctagtaccagtttcaatt

SEQ ID NO: 30866 - DNA, 1105 bp, Mus musculus
agaggggcttgcatccaaccactgagagaatggaatacgccttggctaacagacaggactgtgtaagaatggctttgtgtctaagcaggtaagtttatctgtgcatgcgctcatgcgtcacacacatgtacatgcacgcacatataggggctcaaaagtatgtcagtgtgggaaataatttttatgaatggtattaccagatacttcacatgaacaatgcagatctaggcacaggcatgttaaacaggctgtaaccccagcaggcgagagtgctgacccaaaggtaaaggtaagcaactatgggggagcctgttgtatctgtagagacccactgtattcatgatggacctggtgagccccgaggcatgtgctgttagaattccctactgttggatggaattaggatgtgaacacctcttgcgtgtgcaccaggcttgttttctgtgcattgtaactgcatctaacctgctgttttcctttcccttctgtcttggcatgcttgctctcttttcttggacatcaggaacaaaagcgtgtagatggcaccacccgagaggtgaaaaaggttagaaaagccagaaacaggcgccaggagtggaatatgatggcgtatgacaaggagcttaggcccgacaacaggttgtctcagagtgtgcaccacggagcatcctccgagggatctctgtccccagatactaggtgtgtgcatgtcatggacccttctccccatgtttgagtccctgtattttgggtttctgtgtgccctactgtgtccttaaaattgacatctgtattttgcttttaaaatactgccttaggcatgctatttgaatgtgggtcactttgcaagcctttaaagctttctcttgggttctcttgggttaatctggaaggtggggcttaatgtggattctcaacttgggtgactggcagtgactcgggttttgcttagtcatcaggtactgctttaatgtaaaatgttgaatttcctttgttctttgtcagtaggacccaggaagaccttcatttgaagaaggcgcagacaaaaaggagggcttgctatctctttccaaaccactcaacttacacactcttatttcaggag

SEQ ID NO: 30867 - DNA, 2240 bp, Mus musculus
gggcttgccacgtatctgcgcagctgccccacgtcagctctctgcaagatcactggctgtgtgtctcagtgatgtcttccaaccagtgggtgatacgttttcctgtttcttccctttgcaaattgaattccaggtagatatggttgtagaggggaaagtttaacaaatcagaatgaaatgtttgtctgtttgcacactgggcctggtggcctccaaggaaatgtgtacgatcgtttgctttctctatcttggcgcttgcaaccgagagcggccatttttatgaggggagccctgtgggtactcatgtggaaagtgcccactgactttggcagatggagttcactttcatggctagccctgatagcgttgggcaccagttagccaggccatgttcaagctgcctagagtctgcagagcttgcatggcagagcggccgcatctggttccctcctactccacccagtggaaaagagacctccacgttttattttctgggatccctgctcctctgttcaccagggagtgagcacaggtcagcacctcaccccccttgctctgaatcatggaagcttggctttagctgagagatgccaccagctgttcacaacccatggtgctgtggctagattcctgctcagtctctcaaacagggccacacccctcctgaagcacagctctcttctctcctgttgtcggcacattttcaattttaaaaagtacctcacaagataaacttgattcagccagttgcccgggcagagacctgacttcccctctcctgccctgatcctttttaccaaatggcgattccatagtcctggctgaggcaggggctcaaagtccagtgtctgctttgcaattctggaaggacagctgcttatttaaataagtctgtgatatccgcaggcttgggttacagggaggaccttgcagagggaccaggacactgccttcccttaggtgcattatttacgtggcctgcagctcttaatatctctcactgtttatgaaaagaaagattcagatccggggtgacattgtgtcagttgacagggaatgcctgtgggataattaaaaatggtttttgctcatgagtttgggatgtcacccagccgcccacatcgcctgctatgtgtgtggacgcctgtccgcttggccagctatcctgtaacacctgccagtagtaggttttcctcatgtcactatgacagtgaaagcccatgtgcaagcccctccctacgccctgctttggcgtgtgtctgagtgctctgtgctgcgccatggccatcctggagcctgcgcacacgtggccgctgctgtgactcgctgtccttggtaattggtgagaggctttttctttctttctcagttctgcttttccacactgagacccaccatgttgacatcatcctcgcgacgttgacatttgagccttttgttctgtctcccatgtgccctgtagaacccagcactcatgtttggcaaaactttttttggtaaggtccttatgctctcagggtggagggaagacattaaagctacgcagccattgtcaggattttttctactgatgtcacatcagaatataactagtggctccttactcacaaatgttcacgagcttctccgttgtcacttgtcctgtagttttgccaacaagttaattttagtttgattttatagctagagagaaagcttttgcccgttgcattctgtaaccttcaaaagaatgagaaacgactaaaatccaattcagattatttttagagattctttttggcaaatttgatttagtctaaaatttaaattcaagttgcttgaatactttacaaaacgagaacaaagtaaaaagtttagatttttgatttccactttttttttaaaaagtactaaaacaaatggagagcagacatagtagcatatttgacttctacacatttcatgcttatacttaatctacagatcgcaaggttgttttatattatccccttatagtgttccatgtgtattgtagctgagtttcagatacggtattttctcatagtgtaaactcaggcagatgaatagctggagagtgggtggatggatgggtgagtatatgggtagataaatggatgagtggatgggtgggttaggtgggtaagtagctaggtggatgggtgggtggatacatggatgagtggatgggtggattggtgggtgagtggataggtgaatggatgataggtggtggatggttg

SEQ ID NO: 30868 - DNA, 1792 bp, Mus musculus
caaggtgaactgaaaattctagctaaaatcactaagataatcatgagatgattgcaagattgcagtgagcggggtcagtgctgtcaggagggactgtctctctctggctgagcatttcctctttggttatagtttgtcactttttttaaagctttaatttcagtaaagtaggaattccctgttgctagaatgataaaggaagccgcagcgtgaagccggcattcttgccagccagaaccccaggaccgtgcacagctgcggcggtggcatggcgtgttcttccggtctctttttagccttgggaagggctagtagagcagccagaaccccggcagcagggcagcgcacgccctttggaagattacgttttggtgaagtagtaatctcgaaaagaagcccctccctcccctcccgacctgatcgtcctattggagcagtgtgttcagacgcttacaactaggtctgttgggagtttaaggaacagtacggggagtctccatgtcccgccaggcatcaagtggtatgacagtggctgaatgtaacttgcagaaagtggatgaggattctagtcgaagctgtcagactctgggtagcctcacactgccctccgcatgccgtggtggtggtggcctgttgataaagcccctggttttctattttactaaaactgttgactgagaagcaaacagcaaaaagaaatgtttttgtgctgctatgattaacatttattttctacctttagctcaggaaatgacttcatctattcatcccataggcagatttgtggcggggtcacttagctaatcgggcttcgtggacagatgtgctgggagaaaaagatggcctttgacaaactctttctgatagtttctgaagccttaccctggctgggtttgtgatctgccagcatcgcacagagaaccacaaccaagagcatgggaggtagagccaggagcacaggcctgcgagggcctacgccagattgtgttggaattaagacatgccacggctgcagccttgggttcagagacaaggcatacagtgcggctgggtcctccaggcggccttgtgcagcactgaatactgtgtttgcttgcacacacatttttgaagttaaaacatagcaggaaaaacctagttaagttctccatgaggtgaggtgtagcatgggagccaacctccgggcgagcaggcctgcttggctcaggtctgcgctggacggtttgcaggggaagggctcctgggtgttggctcctaatttactttttatttatagtgcagatggatctgaggaagacattttgaattttatcagagactcagtaaacttaaaaagcatacagggtttgggttggggactggggaaggcaggtatggggagtgagaaagaaaggtgacaaaggtgacccgcccagcacacacttcaggggattgtcgtttgtttgcctgcgattatgatgagggcagatgcaagtttcagacaaggctagctgctgtgttattatgtacatgtttgcttgggcagctgtcccagattttgtatattagaacaaaagtttctatgaattagcataactaaaagtaaatattgtaagtgaagcccacttctgagccatgcggcttctgtcatggggatttcgcctttagaaggttactcaagacaggagccgagtggcttaggccgggccaggaaatgtgctatggcgtcagccatcagcatcgggtttttctttccatgatggccgtaggaagacctcactttcataacacgctcctcctgatactttgtgta

SEQ ID NO: 30869 - DNA, 1192 bp, Mus musculus
tttggattagttctatctaaagaatttttttattacagagtgaagaaagaatatgattaagaaaaatgtcttagggcttcactgagaatactgattctgttatatataaaattgggatctctaaagagtttgttttgaggattaaattccaaaaatttaaggtaatgtatatgaagttctaggtgtagatttttttctttttgaaatatttacaaattgtatctgcctgcctgctttcgtgtgggtatgttcggtgctcgtggagaacagaagagggtgtcacatgccctggaactggggttctaggtagtgagacatctgacgtgggtgctgggaactgaacctggggcctcttcgctgcagaaccagctctgcaacccccgtgctttcttaataaatggtagtttttctactatagatgaatagtatgcttataggcataacgaacatgaaatacatgtttaatatacttggtgatggcagatttaagatctcatattctaaaattacaactatactgacttgaaaatgaaaatttcacataagcatatactttactgagtttgaggctaaataaacacatgtgcttgcctggcttcagacatggacttggaggatctgatctggatgtgacctggaggccttctccttcctgaggaccagcttccatagtgctgacagctgctagttgagcttccaaggtgggaagcagccagtagtccttgtgaactgtaatgcctgtggtccacagcagagtccatccagcatggcagggtgtaatagcggcactgacatttcgggggcaaccacagctcaggaccaaccttaataggaggtaacttaatgtaacccaggacctgttgctcatgaagtcatggaccgcagtggagagccgtaccagcataattcctccctgcagtctgagtacttatccttacaccacagataaatgtaaacttatccttgcagtagttagagacgttataaaaagcctgcgactggttaaagtgaatagaaagtgatcaaggggtacctagccccatctgcaatacagttcttgcaacaaaggctcaaggagaatcactaaaaaggggatggaaagattgtaagagccagaggaccaggaaatgtgcttgttaaaccaattttaaatgtaataatttttctctagccttactacctcccaaataag

SEQ ID NO: 30870 - DNA, 1182 bp, Mus musculus
gaagtcctggcggagttcctcctcgggttaggtggagccccaggccctggctcgggaagggggcgtgtgaaggtggaaacttttaagagtgctgttgaaatgttttcttattttcaactctctgaagcgataggaactcttgcggcttccaacctgtgtccgtccagatggcagccttgtctctgggaatctgtgttaatcttgaaaagctgcattcgctttcctgtcatttgtttattttaatagagcagacaccgctgtgtggggttgaagtacacagattcccccgaaaaaaacgaaacgcgcgcgggtgggttccaaacgtgtttttgtgcattgccagaagcaccacggcttcccacgtgataaagcaaatccattacctcctttatgaacttcgccgtagagattgtgatttatgaatcaatgaaaaaagttactctttgcagtgtgggtctggagttatttaccaaagacctgcacctgcttcatctccgtttttgtgttctgggttgtatctaggagattctccaaaccatcttccacctgcaagtgatctgtggttgtgtgtgagtgtgtgtgtgtgtgtgtgtaaggagtggagaatcaggtaggaaaagtggactctgtgctactttctgtggaacagtattaaaaaaaggggtggaataagtggacttaaaatccacagcatcaaaaaagtcggaagattatggaatcactgaaggctccattttcccacgtgggtaattcttctttcctggggttgagaagggggctgtgtttacagttactgggattggttgtgctaattagacatgccacatgggataatcgaatctttcatagtgataattttgccagattgctgagctccgtgtattttggggtcatggttcattgacaaagtcgaaggtttcaggagtggtgtgattcctgtagtctgttcattcactcagtttagtcaagtatccatctagcaccagctgactggaactggggctacagcagtgatccagacagttgccacagcagggctttttatggcatgcttctagcccaggactttgggtgtagaaagatcacactttccaggcaagtgtagctaagacctcctgtcaaaagaactgaccctccctaaccaaagataatgcccactttcttgtgtttactactacttga

SEQ ID NO: 30871 - DNA, 1955 bp, Mus musculus
aggaaacatggtaagtttgttatgtctgtgcctgaggagaagtggcatgtcttagtctggctttgcttgtcagagacattgtcctttacagtgtatgtaactgccgaatgtggacttgggttggaaactggtatactcatgaaagtgtacctgtggttctagaagtcttgattttttttttttttccttttgcaggcgttgttcctttggccacatacatgcgaatctacaagaagggtgatattgtagacatcaaggtaagttgatggagtggagggaagggcacacgtgttaggaattgtgatttaattacttgaagttaatagcccaggatgggggaaaagtaaaagatacagttaaaaataaccttattaggaattgagagcgctgcctcatgcctttgagcctagctagcactcagtgcaaaggcaagcagatttctctagttcaaggccagatgaggctgtacagttagacccccatatgaagataatatttgttattaaagatggcagtgttacggaaccccccgtgaaggccgtgtcctttgatgggtcgttgaacagattctgtcgctctggaacttaatgatgattgtctgtttgattgcttgatgcaatgtgaaaaccacatttcaccggctctgagagttcttgagctgaccttgaaagggagccttggttagttacaaggatttgaaaagaggaatttctggaataatactttttctgttgactagggaatgggcactgttcaaaaaggaatgccccataagtgctaccacggcaaaaccggaagagtctacaatgtcacccagcatgccgtgggcatcattgtcaacaagcaggttaagtgagtagagcgcctttctttgactaagtagctggcctcaccccccctttcactttgccaattggacttaatgtcttcattggccattcaagtggggcaaaggaaataaccttttaaaactcaggcaaacttaagtgtttgtcttgtaacctgtcaggggaaacattaacgttggggaggccggattctgtgagtagtcggtgctggcttttatagcattaaaacttcgttacaggcttcctttgcctggtttggctaagttactgtggtttggggtctgtttttatcagaaaaaggagctttaaagtgctctcgaggcctcttcctttgggtgagaatgattgacatgtcaccatgttgatcttgggggagtgttagttaacagctgtcagaacagcgtacattgtactgtgtttctgagtgaagcatttagaacttaccggtctttgctcattccaggggcaaaattctggccaagaggatcaatgtgcggattgagcacatcaagcactcaaagagcagagacagcttcctgaagcgggtgaaggagaatgaccagaagaaaaaggaagccaaagagaagggcacctgggtgcagctgaagcgccaggtgagagctgccttggcggtgttcactcactgttaatcttgaggaacccttagaacttggctcactttgttaataagcttaagaagtgtgtattcattatttccaaaaaccactaaacttcactataatttcattttttttcttaccagcctgcgccacccagagaagcacactttgtgaggactaatggaaaagagcctgagctgttggagcccattccatacgaattcatggcctaatgtacacaaagaaataaaataccagcaccaggactgtgaagtgttttccttagactgtagtgtggggtttgctcattggctttcttgttcagattttactaattgttctaaatgatacagcttagtgtgcagaaaatatcctcttgattggaaaatagccaaatatttacaaaacaggtatactagtttgaagaggctctatatggggggagggggtgctggaaaacattagtgggtgaccagtaatggtggta

SEQ ID NO: 30872 - DNA, 1221 bp, Mus musculus
aatggcactaattctgcccctgtttgtgttttgttcaggtgtggagacatgatcgtagcagtaaacggcctgtcgactgtgggcatgagtcactctgctctggtgcccatgttgaaagaacagaggaacaaggtcacgctgacggtcatctgctggccaggcagcctcgtatagagtcttgacatcagactccagtctcaattcttcctgcaggtccgtgaaggaagcccctccagggtggcatatctgctgggcagcgacacaggacagcaatactgacatcatcctgtgtttccccttggctcggaatcggctcccaccagccccaggggctcatttcagatgctctcggtggctgccacgactgtccctggctggacggaagtggcctctgtgcctgcagcagcctgcagcagctcagtcatgaagcgagttccacccgcaactcctccatccgcagcacctcgctgctgcagcgtccgcagcaccccctgccccggagacagagctgcggaggggcgcatcttaggttttcctcattttccattggtgccaacatttcaagatttttataccgtttataaagtgacttttgggctcgtttctactgcggctgatcttcagtcctcaactgaagacataaaccgaacaccactgatgagacttaaataatgtactgcggttaaaataggagagagtcaagaataatgctattgaagggacagagcaacctgggaggcgacttctggaactggcaaagctatgttgcctggaacagcccagaagcacgaagactctgttcaaaaggaaagctttgttgcgtaggaaaagtttggagatgtttttctaaaagtcatttctagagtttatatttatcagcaatcttgtctggagaagtttttgtgatttatgcaattgaactaggtgattaaataacattacttcttaaacatgagtgcgcatacacacacatacacacacacacatacacacatacacacacacaccacagctaagttgaaagggagcctttgatttttgttcctgtgtattttagaaatccttagtttcccccaagagaccaaaaagctctgtttttgttcttgtttttttaatctgaaatagtagattttagatgttagtgtcttcagctgttggtcacttaactttctttatctttttttttttttaatgtttagaaagctgtttgtcctttattca

SEQ ID NO: 30873 - DNA, 1263 bp, Mus musculus
ttaacttggtggggtttttttttttttctgagatgacacccctccccctctttgctggagtcaaatgaagtagggaaaaactggagttaaatatctatggctagaagtgtggaggcaggagaatgaggcagtgaatcataaaaagttaatcagaaaacgatattccatgtgatcttattcttacaaaaaaaatatgtgtgtagaaaaatatcaggattgaagacctcaatggctgaaggcgagaggaagacagccctggaaatggtccaggcagctggaacagatagacagtgtgtgacatttgtcctgcacgaggaggaccatacactaggaaactgtctgcggtacataatcatgaagaacccggaagtggaattttgtggttacactacgacccatccttcagagagcaaaattaatttgcgaattcagacccggggtgcccttccagctgttgagccgtttcagaaaggcctgaatgagctcttgaatgtctgccagcatgtgcttgtcaagtttgaggccagcataaaggactataaagctaaaaaggcaagcaaaaaggagcccacattctagtccctcgtgcagggtacaagcaggaccaccctcaggatggtgcagaacccagaattgtgattgcagcatgtactgtcctgtaggaaagaaaatgtggctctagctattgacccatacagctgttggaatctctgcaagtatatttgcctaataaattctctcttttgtttaaactagttttgagtggtttctcttccttgaacctagatgaaccccaaggatggtgtcaccctcttaattgaaccaacactaaaagtgagcaaacagataattgggccaaggtaggggttttgatcatagatttttttttttttttttgagacagggtttctctgtgtagccctggaactcactctgtagaccaggctggcctcaaactcagaaatccgcctgcctctgcctcccaagtgctgggcttaaaggcgtgtaccaccacgcccagcttgatcacagctcttaaagagtctctttatttctatatgattgaggtgctaaggaaaggagaggtgacatagaacgagacccaggagactgtaactagaagggctggaaagaagactggcagagggacttgaatttttttttttaacattttactcattatttgtgtacacaaacttgccatggcacacagataggagtctcttctctccttccaccatatcggagctacttggtgattgc

SEQ ID NO: 30874 - DNA, 1141 bp, Mus musculus
agaaatcggtgacatgcctttaattaggggtcaaagaagaaatcaaaggaagaaataaaaagaaattggacaatgtttcaaactgaataaacacacatcaaaagatataggatgccactaagttggtggtaatgataggaaatgataggaaagttttttgttttttttttacaataagtgattatagcttcagccttaaaaactaggaacaaaatggtaagtcacacccaatgaaaacaaactctgagcagaaatgaataggaaaaagaaaaaaaattggggggtagggcagggttggagagatgcttcagtggttaagagcactaacagcttttataaagtgctagagtacaagtcccagtacccatgtagggcagccacacagctacctgtaattctggctccaggatctgatactctggcctctgcagacacccaccctgatgtcacattccccacctactctcacagagttaagaacaaagcgacaaatgtggatctgtggggcgtattgctttttttttttttacacacacacacacacagacacacacacacacacagagggatttaacaagatgaagtggacgatatctgaatgacagacactaaattatttgatgagccctcagtgtattaaagaattatgtttagtgtgttacacagggtctcactgtgtaccctcggaactagcgttgtagagcagttggcttcaagctaatagtgtatgtgccatcacatctacctagaaatgagctctgtaattatctcccctccccatgcctaccctgtatgtatgtatgtatgtatgtgagacaatgtttctgtgtaaccccagctgtcctagaacttactgtagatcagggtggctctaactcagagatccactccacctgccactgcctcccaagtgctgggattaaaggtgtgagccaccaccatctagctgtaatttactttaatacgaaaaagtttagatgtttttacttatggatttgctcctaatatgtaaaagaagaaacttcatattctacatagacttaagtagtaaatttttttttaaaatgctattataaaatttattctatgatgatttcatcatggatataaccctcgaatccatcttttcaactttctgagc

SEQ ID NO: 30875 - DNA, 1148 bp, Mus musculus
aatttaaagtttagtaagccccttaaagaacccatagacagaccttgaagaaatattacaattagttttatagacacaaatatgaccacaaacataatcaagatttgttatattcctggttcctaaggtcctctttttttaaaagtaaaatgtagctcatcaattaatgctatcctttgggggtatggttcatatattttggtgaggaaaagatcaaatgtatccacattgcttagattctccagaaaccctttaattttaaaccctcctgaatccttgtctgaagcacaaactaggttcccagcacctaataatcagccttcggaccaaccatgtaatacataaaggagcttcctacagaaggccaggcccttggagaggtaaatgtttcggtcttccgtgcttcagtccctgggataccctgtgaagtgcgacagtgcacagtgttttatggtattcctttttgtcctataacttttgcttttaggcttactattttacaaagtccctaagaatttaaatttaggttaaattgggcagcgtaggtcactgcatatattagcacacgagttcatttctgtcattattaattgtaaaatcctgaattgtgctcagtagtagctgagcagtgtgtaaggagtggggaatcttcccctacttttgccttaaaattggaattttgtaagtattttctttaatgaattagattctcatagtctataaacagtaatcttgcattgttaacttgcattaatagacactcaaaggggtgtctattaattgacaccaaggatttctaaatttagaaaattttaagtttattctgatattgattactagattaaaacatattatcaaggccatgcaaagaataagcataataaaatgtgcctgaagaggtgtgagggctgatgtaggttcaagcccagcctgtgctgcaaggcgaggacaaggccacccttgcatccgtcatgaacccatctcagaacaaagtgataggaagtctgtaagttagagtcttccaacaactcttttgtgttttcaatttcaaataactgttgtttaattgacattgctttgacttaaattgtcaggcagctaaagacagttttatctattaattgagtcactattacttttaaaactct

SEQ ID NO: 30876 - DNA, 2684 bp, Mus musculus
agggaactatttgcaaggacattgggaaacaaagggggcagctgttcgccactgagagatgcagaatttgctcttgggggatgggccaggtcagtacattagttcatagaaatgccgtgtagtgcatagtccttatgagtattgtgtgcaagctccacatgccacccactgttagctcaagttgaggcttgtattgtgtttaagaacacgcagagagaaatatcattgagctgtcagatatgaatttccgtttgttgatttaaatccttttccaggtaacgatcggaacagtaactgaaggagcaggcgctgctcttctccaggttcatctagaggcttcttcaaagaggcgtctgtctgccagtcacatacacttatcttgacgtaatttttaatagcaaaatgaaattgtgctgaaggcctaaaagtggaggagttatattaccttagggtctttccagtttatttgttttttgtttttttttttgtttttgttttttgttttttgtctttgaactacagctttataatggtactttacactggatagactcagacactgtcgaggaggtgagctgagcacagcagtggcctgatgctttgcggcctgactctggagggacacttttctgctgtgcctttgcactcactgcttaacccaaaggaacaggacttttgataaaactcaccctgtagggtcggtcatctgagaaggccatttcaaaagttggagttttcctccatggaacttactatttggacatgcagttgtcgccaaactcaagtattgtgggatttgtggtcacttcgatactgaagactgccaaatacattgggattttctcttaaacagccgccatgaagacttcatctccttcccggtgctgtgtgttgagcgcgcactgggtgtgcaccccatacctgggaagaaatgtggggatttggaggtcaggacagactccaagcacttgcaactgatgttactgtcttcatttttaacaagtatgcgtatttgtatatttcagagaagtttttaacatttctctgtccactttttataagctttaaaatgatttttctctgccttgaaatttgcatcaagaaaaagcacctctcttcactgaaagctttgaggactagagacacacttcccatgtctaacaagcacgtctgtatctgagagcgctagcatcagttgttaatgagaaaatcaattactgcatttgatctggatggattttagaagaacataatgttcaatattccaaggataatgaacatttgccaccatgatgttccttgtgtttaaagggaacgagaactttcggtgtaccacgcagaagtctttatcattagctcatgtatttgaggaagagcagctgtctttttatatgttttttgacaaatcatattgtaattcttttgtacaaaaaagaactacttgtattctagaagaaatatgaaatgcttaatttataagcgggctggagatttttttccaatattgttttctttgaaaatgaaaggggatcatctattttagttttgggggcctgggaactttttgaaaattttcatttgtggaccaatgttatgtgaatgctaaggaagggcaggggtaacatagggcttggacctctagtcctgcatagaccagcaaactcccctctgcaaggcaggttcacatcacaaccccgagtgtctgcatcagaaatgctagtctgcttccgccccagcaacctcaggacttgggttgggtataaaaggtagtcagctgaaagtacctaagtaaatagtgtcagccagaaaacagtcggtgtcaggtgatacgtattttttagctttgttttatatttatttttcatttcattttcattgggaatggttttcaaaagaactcttgagttctgctttgatgggtttcttttttttttttttctgttttgttttgctttgcttttttttttttttttttttttttctgggagccctcttttccacagtgtaaacccatatagaaggttgtctgaaagttactatttagtgcataggaagagtttaatatctgagagtatcgaatgaaggatgtgaactcatcataacttcctgttatgacagacacaacacggaaaggacaacccttgaaatcatgtcgcgtcgctcacttcagcagtgtacccatctccagtcctgttagtgtattcacttcactgcagatacctttgagggtgcccttgtgttctgctttgaccttggttctgtcattggatagcaacattgtctctagaaagcaccagtacgtttaagttctaatgtcacaatcccagtacctgttgctcatctttaaccctgttttcagtctctacgtgtatagcagtattttttaataaagaattgcagaaataaacttgtatttctgttgtttttattaccagttcatatatggtcttgattgggtttttgaagtctgttacctatgtattttgggtgaaatggtagcagatttgctcagtggtttagcagttatttgttgattgtggatcccctgtgcccttggatctgtgctaaggctaaaacttacagattacgaagatttgcaatggacagaatgtccaagaaactacttatctgacagagtaggaaatggcatggagctaggtcccttccctctttgggaaggaaag

SEQ ID NO: 30877 - DNA, 1169 bp, Mus musculus
gagcatcagaaccttggaagagggtctgtctgtctgtctgtctttctctctctctctctttctttctaggtttatttttatgtgcattggtgttttgcctgcatgtattgctgtgggaagtgtatgtagttgggtcccttcaagcaagatacaaacttgttttaccgcccaccccaacttcccttggcctcttggcccctttgcagtcagttccagctccagccctagccagcctgcttgttgtcacactgggttggttcagatgatcacagatcctgatatgatgactcctgcgttcccctctgtgtctgaatgcccactgatagcgcttctttctgtttctttccagatccatcacaaagtgaactgatgggtgagccccacgtgatggtggaacataagctgggcttgctgtaataaggggcccgcgcagggaggaacgacgagtgtgctcagcatagttgcctgctacagtctgatgttcacagcagtaaagtacagagaggatcactgggccatgtggaagcatttgaggcttggttttgggttgtgggtcagttgagagcctagaggtggttctgaggttatagcaaagctcaaattctgaaaatgtgtgtcttataaatgttataaaaacgcaataaagtccccgggagttaccttgagaatcatgtgtgtggttgggtttggtagcagcatccggcgcagagccttagtgttgctcggtagaatgctactcgcactttaagggttatagccaagtattcttacaagttgagaagtttaagtttgcagagtttggccttttttatgtgagaagttaggtatagcagccggggcatgaagcttgaatgattgtggttcaaagttttatctcacctgttagcttatcagtgttctgtggaaggaaggtacaggtcacttggttttaagttatgtatcaaggtacagaaatgtttttaagttatgagaatattcctgttatacacccatgaatagttccaggatgaccgcacaaccaccatgtctccctaccccctgacacactggcatctctgggttctaatatccagccgtctctttagaacactgaccacaaggcagccagcccttgttatcagccccttggtccatggagacctgttctgggacctccaatggatttctga

SEQ ID NO: 30878 - DNA, 1169 bp, Mus musculus
ggatgcttttctcaagaattatcggtcatgaatacacctgtcgataacttgagaacttaaaatgagatagtgccactggctgttgagaactagttgggggtggtggccttaggtcacagacatagaggagtcattttatgggactctaagattccacggcaaaacaactgagtatcttgggagtgtaggagagaggaaaaatctcaaggagtttattaattttcagaacactatatgtaacaaatcagtggggttcaagatgccaggataaacctgctacatagaacttgagcaatttattaaaagccacatgtgggcgggaaagacagaatcttggtaacttatgtatctcttaacccattccaaattcttgtttttgcagctgcgtcaagagcattggctgggaagagggaagctacacactcctcgtccacgaagaacccagtgagcacacatcagactagtgacagtcggcagcaatgcacacgtccctatgcagtgagcacacatcagactagtgacagtcggcagcaatgcacacgtccctatgcagtgagcacacatcagactagtgacagtcggcagtaatgcacatgtccctatgcagtgagcacacatcagactagtgacagtcggcagcaatgcacacgtccctctgcgcaactcctgaagaatataaactccacaatcgcatttcatcagcaatccacaggacaaaaccctgtctcctaacccaagtgagtcgggaggaaggcacccagctctgctgcttcttgggaccacccagcagcacactgtgttctacagagaacaggcccagcacctaccatgctcacttctccatggaccagagaaaccccgtgaagagccgaggaaggcttgtgaaccttgttaaaacttaaaagcaataacttcactggcatgctccagtctcccatgtgattgaggagttctgacctcagtctctccgtctgcacaatgggcttgctggcctctcagggattttgaagacataatgaggaatttttattcagaataatcactgttgaaataatgtttcaggcatttctagttcttcccatacttgactgatgttttaagagcctgttaaggctctactaatggaatgaaaagtccttgaacagaagtaccttttaaaatatgtggtt

SEQ ID NO: 30879 - DNA, 1166 bp, Mus musculus
gtaaaatgtagtgaatatttcgtttaaattttcccaaggccaacaactcccctactcggaactcttctcctctcatgaactttcagtgtcttctctctcacattgcttgtgcagacgcttgctgggtccaccggaatgctgcagtgaactgcaaccctagcgtatgacgtttccaaccacttattattatcatcattattatcattattattattatcattatctgctttggacaggagtcttgttatatcgttgggctagtctcgaactctcgatccagatacctatgactccacggcgcttcagcgaaaaccaataatcctatccagatacgcttagcagaaccttcgcagagctgccgggatcacccaacttgcccagcaactcggggagattcagccgctgaaccttcgggggcgggtgcaagagaatgacactgcgctagaccaatcgctacgggggcgccggccgccatacccaatcacaagcgagctagggaagcgggtgacagctccggccgaagattgccagctcttggcagagtgatgatgctcggcggccgagtcaccactagggcccaaagaccaagagtgcggcggcgcggggagcggcggggactgagtccagggccaacagagtccgggaggtgcgcttatttctctttgccttctaacagggctcgagtgtcccgtcccaagggacgtccccctgttgcggtctagctccacctcgctgccccttcctttggctcttcccagctggcgaaccgtgctgaaaacccgggggcgctacgccccgcactgggtaacggagaacacagtcccgactacggtcccacctgtgcctagcctagcaggaaaactgtaaccgtggggtgagttttaaaaacgaaaacagaaactaaactccccttccgatcgggagctgctttttacaaggcccttaacctgcagccaaaataatagtaattacataacctccgggtccccgggtaacttcattgtttaccttatgggaaccggccggtgctgttctgctcagcactgtgagcattagctaagcggagtcgggggcggaggttgacttagtccctgctcctcggagagaactagggtaccctctcccggcaagggcactctctcagaaatctggaactctttttgctt

SEQ ID NO: 30880 - DNA, 1106 bp, Mus musculus
cacctcaggaagttatggtggcagttctcagagcagcagctatgggcaaccccagagttatggtcaacagtctggctatggtggacagcaacaaagctatggacaacaacaaagctcctataacccacctcagggttatggacaacagaaccagtacaacagcagcagcggaggtggtggagggggtggtggaggcaactatggccaagatcagtcctctatgagtggcggcggtggtggttatggcaatcaggactagagtggtggcggtggtggtggctacgggggaggccagcaggatcgtgggggccgtgacaggggcagtggaggtggttacaaccgaagcagtggtggctatgaacccagaggctgtggaggtaaccgaggaggcagaggcgtcatgggcggaagtgaccgtggtgacttcaataaatttggtggtcctcgggatcaaggatctcgtcatgattctgaacaggataattcagacaacaataccatcttcgtgcaaggcctaggcgagaatgttacaattgaatctgtggctgattacttcaagcagattggaattattaagacaaacaagaaaacgggacagcctatgattaatttgtacacagacagggaaactgttgaagggtgaggcaacagtttcatttgatgacccgccttctgctaaagcagctatcgactggtttgatggtttcatttgctacctgccgagctgacttcaatcagggtggtggaaatgatcgtggaggccgagggcaaggaggacccatgggccgtggaggctatggaggaggtggcagtggtggtggtggccggggaggattccccagtggaggtggaggacagcaacgagctggaaactggaagtgtcctaatcctacatgtgaaaacatgaacttctcttggagaaatgaatgcaaccagtgtaaggcacctaagccagatggcccaggacggggaccaggaggctctcatatgggggggaaactatggagatgttcgacgtggcagaggaggatatgaccgggacagctaccggggccaaggaggggaccgtgggggcttcagagggggccagggtggtgcggacagag

SEQ ID NO: 30881 - DNA, 1183 bp, Mus musculus
tggttggccacttagctctccaagttaggacccgcctccacagctgtacctgctgagggcaggtactcagcaatacagagttcgatgtgattatagaatgtggtgcagtatgttaggctgttgtggtcaaagtggtagcaatgttagatctatgtaccctcattaggtggactagagctttgccctaatcagcctcgaccctgggcacttgaataaatctccccatggccctggcttcgtttctccatcacagacacccatcacatatggtaccccacttgaattaagttctgagatccaggtggccagagctgctatgattcctctgcctccatgctgctatgatccggacctctcggcatggaaacccgagtctgtctcccttcccaggctggggaactgcgccctcccctcctgccacagacagacctgccaaacagctctgttcttcatggagtcaggaggtcctgctggcctgcagcaactcagttgccttgggctgggactgcattcttgtgatgtctggatgggtttggggctggaggtcaggtactctgggattagctgaagggggcacagtgttctttgtcctgcccctccggttaactgtgctccatatttgtgttgaactctaaaagcatattaaagtgaacctgagggactcccatgatatccatgtggtctgtgttaactggggacaaagctcattcggtcccgacatggcagacaagggcgcaaaaggtatttttataccctttcctgtgtgggccagggttgattggaaccaagtctggagactcagcaaggccaaagctatgcatccctctctccaatttctccccaacagtccaccacccaggaaccaaacattcgaatagatggtcctatgtgctactccgtattcacaccaccacagtggctaagatacacatttgctcatttttttaaatctggaatcagccactcttcctatcccatgagccattgttgtggatggattatggccagtttgtccaaccttgcctggccctagtgtttcccacaggtgctgtcttagtcagggtttctattcctgcacaaacatcatgaccaagaagcaaattggagaggaaagggtttgttcggcttacacttccacattgctgttcatcactgaaggaagtcaggactggaactcaatcaa

SEQ ID NO: 30882 - DNA, 2009 bp, Mus musculus
gagaccgggttcctaggataagcgtggacacgccccacgggctcactcatgtctactggcaaagccatggccactgctgatctgtgtacctccctgcaatggaaacatggctggcttccgccagggcccatcctttctgacttgagcatcttatgtccccacagatagttatttcatcctaataaaagcttactgttttgttggctcccaagcattaaggaatcttaagtggggaatctaagtgccagggtgcccaccccttggggtgttggtgggtgatgcaaacagggatgtttgagtccaggtatggttgggctagcgaagggagtggccagacagagaatacatggcccatggaactgttagagaactcagagtcagcgctgaatgtatgtcatgttatataattcaaaccgcgtctgtttgccttcatcatgagaggattgtacataaggttcctggggggagagcgagtggtccgtttctttaggcttgttttggtttgcgaaatactttgattgtcacagtggtgcaagtgaaacgtgctacactccaatgtggttaggatgaaaattttagggcaaaaataaataaataaaaattaaaaaaaaaatctaccagctggttttcacctccgttacgctcgcctggtctttctgtgtccactgctccactgagccggggaatatggtgtagccaaaggtcttgagacacggtgatgaccaaggagccttcctggaccatcctgttacacgtgctgaatggctggctcaaaagcccaggagagacgaaagtccatgtccaaagatgttctcagggcgctggcacgtccagcagtgtcaggaagcaaggtttaggaagctacatcatgcacgctagtttattgataagtgtcacctttcgtgctctgacaagctttttgagtttggaacttattttccaatttgagaagttataatatatctttgtatttaagatatttactgctttgtttgtgccttgaagcttcgatgggtttaaggatcacagaggggccaggatactaacgagggctggtttatttgcaaacctgaatacttgtgttgtggtttctccaggacaatttttttattattatttctactgaacatggagccattattaaaaagagttatgtgtggtttttcattatgtaaattgtatatatatttttttgcttgtttgaggttctatttttctaatagtcttcttacagtttcttataatgatgacattagattaagtccgatactaactgtaaatcaagctggtttctgctggattcccgtggattaattctattttattttaaggccaagtgcaggtgtcatccaccacccttttgaaaaaaaatgtgaaatttatgtttcccctcgttgctgaatacattgtacactggcaagacccctcccatacttatgtgttgtaaaatcaaagctgttttgtggtacattgtgtcatgctcctgcagacgctaataaaccctgtctggcttccacaactcactgtgtggtctcaagcgggctagcagctcttgcctagttcccgagcgtgtccattctggagggcaaagggtccatttgtcatctttagcatctttctgctgcataggacgaagccagtggctttatttctatggcatggatttttctagaagccatttgggaaaggctgaggcctgcacttctagatccttgctgactccctacctcacccctccagactcacctggggttagggctacagacttcatcaaccatcggacttaagtaaaccgcaaaacccctcggtccacagacaccagaggcttgcccttgctgtcacacgcaccatcttggaggaaacaagttttatgcagagcacaggctgggaatgagattgcagtttatctaaggatgattgatagcacattcccatgcactccatggaagggcacactcttcattcattcattcattcattcattcattcattcacttatagcacaggag

SEQ ID NO: 30883 - DNA, 1502 bp, Mus musculus
ccaccctggcctggaccttattccccttcatttcccctcccccaccccacgctccatatctctcggggtgtggcctgagggctgacacctcttcatttactctttgtagatagaaactgcttgagagtgctggtggattctcagaaccagcagggtgcccttcccccaccccacatcccccttccaccatattggggtggcgaagcctagtgtcttagtctaatgttaatgctgtttataaagccaagctttcttttctgtctggcttttgacccaagtctggtggaaacaggctgagtaggtagactgatggccctgtctttcctctgctttggaagattcttgagaatggaagagttagtggggctggacaggcgtgtagcctagtggtagcacacttccccagcctacacagggcctcagcttccacccccagcactacgtatggaaaattagggagattagagaaaccacctaattgctgggtcagccagtggaggacagctgagcatccaagagccaggccctgaccaccgtccaggcactttgtctcctaggctgcctgaaaacactgcaaagggagtattataagaccctacatgttgagtttctaaaggtatttaaagttatgtagattggtgctgtaaaatattttgataaatattaacttattttattcgggtcttgattacctattgtcttcttagggtctgttaagtatctgtctgggttttttttttccttgttacttgagagagagagagagagagagagagagagagagagagagagagggcccagtgaggtgttggaagaatcttttaaagtttagtgtctttggcttcttttttgagacaaggtttcacactctagctggcctggaataggattatcgttgcccagtgtggcctctgcctcaggctcccgagtgctaagagcataggcgtgagcctccgctcctcctgctgaactgtctcttgctttctgggtaaaacctccctgtctaaggcagcctaaccatgtgtttacagttgacgtttcagccagcagcttgtatcccaccaaggggaaaggtgtgtatctaggggtttgatctgtcaccatccctcctgaggaccgcaagcaacggtctatatatacatctgttctatatgtttccctgtgcgacacaggagcaaacacaggccctggcggggtggggtggggtcgggggggggggcatcctgaacccacttcctagtcaggaaaagatgcttgaaggcggtgtgcctagttagttgattggccactgagctcttactaagagtggacacttttgggggtacacaggaacaatgatgtatatagttatgcctggagcgagcctctaatgtgctttttattatgcccccagttccttctgaaaggaaaacacaagccccaaacccaaacaacacacacacacacacacacacacacacacacacacacacacacacacacacacatccctccagaccaac

SEQ ID NO: 30884 - DNA, 1448 bp, Mus musculus
tcctatcactacagtgggaacgggaagatggtgaattagatacataaaacttcgctgatacctaccttcctagaattaccagttcaaatgaaagtatcatttactttcctaaattcaactatggagaaataagggcttttactggctcattctccaacattctggagttagttatatttatgccaaatgcattagtccccatgagtttaaggtggagtggagccaacttcaagtacgttttgaagtccacagtaggctttggagactctagagaacacattttcattggttgctatttacaggcaggagtgaaacacagaggccgctcttgtttcctggtggtcagctgagatttaattttgttggtgcagattgcttgggccagcaacagtaattccctagtcgtccccacactggccgtcataagggacggtttatacagcactggtctcctagacaaggtgacatttgttgcccaggtggagcctttaagtctgtctgaagactagagacactgctgctgggccgcaggggactctgatactttaggagccaagttctgccggcctggaacctgtttgttttattcaagtctataaatggccttgttttacttattcatttccctttttccagctgtagatatctatttctcccgatagccctgtgtacatatgtatgatgttgcttgtccctcagcgacaggcccacacttccccccctaaccccattcatcacgtggaggacctctggtaacgatcctaggatgtcctgagtgcttctctgtggctataggaacacactgacaaggaaaggattagtttggtttatacttccaggtcacagttcatcattggtggaagtcagggcaggaacttaaggcaggagcctggaggcttgacagcacatgtcagggagcggaggtctgaggcaaagtggggcagggtctctgtggaaggtttatccttgctcttgggtgctgcacccattccatcggttggagaaggctgtgtgagccccttgtcggagtcagagcatctgtcgtcagcaaggcacccaagcttctgtttctggtcatttatctgcgctgtccacatggcaagctccgtcttctccaccttcatttaataactcgactttgcttgtcttttttttttttaaagattttatttacttattttatgtatgtgagtacagatggttgtgagccttcatgtggttgttggggattgattttttaagatctctgctccccccctaagaagaaaaggaaattttctgaggagcctgaagttgctgctagcttcacaaagagcagcacaaagaaaaagaaaaggtcccagaaagcacaggaggattagaacggacctgcttggtgggaggggcataccttgtggtggcagctcctgcccataataaaaccccaataaaaacaaaaacaaaaatga

SEQ ID NO: 30885 - DNA, 2166 bp, Mus musculus
gagagcaagtaatcagaccgtttttgaaaaatgccaaaaattaaatgattccttaaaacaagctttgagcaaaactcaggcagtttgactatgcctgccttttgcccaggcacagcttggctaacccaggctggccctgtttccccaggtcagagaaatcgggagaaaactggtgagagcaactgctgtgtgatcctgtagcgtcgccagcacagatgtggcagtttgttggcactgcggggacagaggagactcagcagcttccaacacctgtaggacagtcgccagcacatccgtgggactgaatcactcatgaactctgtcatctcctctcacaaagtaaaaagaaccaagaacactttcagtgtggtcctttattccttatatctgtgtgtgtgttgagcagtctgaagtgcacagtggtccccaggggacgcagcaagtctctctgcagacaccggtggccctgctgccgcagagactcctccctccgcagaagtctgaaggcaagtgctgcaagtacaatttgcactaaaaataattattattttcctcatcacataatctgcacgtgtctgtggcgcccagttctcctgtgtgtagtccaccctggaggacaccaatcatcggtggagtaaatacgaggctggtcagccagggggacaggaaggaatcttacgtgctgggtgacttctaccaaagtcggccgcagtggctgtcctcacaggatatcaaactgggcaagactgttgtcactgcagcaagtgagaagccatgcctgctgctcccagcgctctgtagagggtgcccctgctgccggcccacaccgaggggcggcaggatgacccaagccttaatgtggaggggccgtcactgtgcagaactggtgggaagcctgagtggcagatatcagaagatcggaagcctgcgccatcactcatcgaaccgtgccgggttgcactcattcactagagcagagggatcttttaaagtctccagatgctaattttgttactttctgtagtttgcattcggaatcagtgcttgcaattgtattaaaatcacaagctgagttttaaggcatacatgatcaatagcaccactcttatttttaccaataatttaaagattgatatgctataaataaacaatttgcacagcactaaagcatgagctaatttcatctaaacctgtaaaaaaaaaaagattttatatttttttttcactgggaagaaatcttcctggatgaaattacaaatatgtgtagattatatttaataaaaaagacataataaaatatctaactgtagaacacaaatatagattggcgtgtagcattataaaccagtattccatatcaataactttatccagccttttgaaagatgaagttgcagactccgttgtgttctgtatttaacgagggctcctggccctctgcagcatcagatgtaaatggtctctaaggtcatccttgtttcaatgcaatcaggttactttattcattgttaatgctttgaggaaggaagaggctttatatgcagtagatctacgaaaatattgttcatactgatcagaattaaatttgtatagaacagagttttaaaatgaatgtaaatagcactaaaccttttctttctgcagcctgtccttaatagatttcttctgtaaactaaataaaaaaaaaaacaaaacattgtagtgcattttgttgatgatttaaaggtcgttaattgcttaagcattgtctcatctattttgcagttaattttctactcttctgaggcttttaaaactcattcacttaccactctgttgctacttgtgagtgccccagtgtctttaccagttagctggttaatgagtgaggcccatcagccggggttatgattctgttatccctaaaagatgcaggagatattaatggagcagttagccataatgactatattctttgggaaatcaaactacgcttagtcatctttaaaaaaaagagatttatttattttatgtatgtgagtacgctgtagctgtcttcagacacccaagaagagggcatcagatctcattgcagatggttgtgagccaccatgtggttgctgggatttgaactcagaacctttgaaagggcagacggtgctcttaaccactgagccatctctccag

SEQ ID NO: 30886 - DNA, 1228 bp, Mus musculus
gtcaccagaggggacttggagttggctctgaagaaaatcgccaagtctgtctcagcggcagacctggagaagtacgaaaagtggatggttgagtttgggtctgcatgattggtcagctcttccatctctgggagttttctttatgaaatgtgaagaaattcctgaaattaaaaaaaaaaatctggaagttttaatcagaggaatcttcacttgaaggccaaaccaaaacagaaatgccagaggtacagagaaatgtagttgagaaacaaggtatgatcatacagtctgctggctccaggctaccaaacctcatacttgtgtacagaataagagagccagtggcccgggctgaaggggtagctctgtgcagggagggccttgtttacaaagcattggcagagttttcttgcccatacgtgcactgactggtagtttggaattgtcactttgagtggaatgatcacaagttcttcaggaataatttttaaatctctagaatctaatacttcctgttagagttgaaaatgtagttagtactcactcctcttagcttaccagttcctctgttagctgccgccttacatccaccagggaagagtctctgaccgactgctccgttgacatttgccctggcctgtagtctctgtgccggggcctctcctgcttcctttgcaatgatgggaagagcccttcttagttagcagcagccttcagcctttgaagtcctcactcttccttcagtactctcaagtcaatatggctactgttttttctcacctccaacactgtgtgcttttgtagaatttaacctgtttaggtcggtaatctgagttccaaacaagactagtctcctaggcgaatgcaaaagaacctttcccctcttctgcatgtgagcgagcattctgccagcacgcatgtctgtataccacatgcatgcagtgcccgaggaggccagagaggacattgggtcccctggttctggaattacagggtgtgtgagccaccgtgtggatgctgggaaccaaacccaggtctctacaagggcagccagtgttcttaacggctgagccatccctccaaccccacaaacagaacctatgaacttgtgcatgcagtgggactagagcagacagctgccatgctcgttagatgcggagtaaccaggaaggaggatctcagacaggggccgcatgagtgtggtcacacgcactgtgccctgatgtccgtt

SEQ ID NO: 30887 - DNA, 1202 bp, Mus musculus
gtaattgcaaaaaaaaaattgcggctgttttgttgacattctgaatgcttctaagtaaatacaattttttttattagtattgttgtccttttcataggtctgaaagttttcttctcaaggggaagctagtcttttgctttgcccattttgggtcacatggattattagtgtgttatctttcatctagttagctggaagagagcttttgtccacatgccctgccattgtggtagggtaacattttcatccatagttgaagaatctcctaaatcgtgatagttggataagagatattatataacctacttggcaaagcaaggagtgatcaatactgtcacaccgtgggactattaggatcaagcaatctgaacgtctgtccttgaaggactgatagaaaagtaccttctaatccttacacgaggactctcctttaaccgccattactgtgtaatgacagttatattttgcagtttcccctactaaagaagacctgagaatgtatccccaaaagtgtgagcttaaaatacaagactgctgtactatttgttgaccttagtcccagcgaaggctatcacaagaacgctggctgtaaagcctttgcccttctatctagatatggattgctcaggaaacttgactgtttaaaggtatttttaattacttgagccagcttttaaaattatgccacatttaaaatgaagggtatattttcctatactgtggtttgtccctttatgaatcagatacaagaggataaactttgcatattagtaccatttgtccaatacatttgctttttctttataaaacccaaactcattcattaatcaggtttaatctgcttagtttagggaacaatttggcaattttgtggatttttttttgagattatcgttctcttaaagtgccagtgttttaaatagcgttcttgtaatttcacgcgcttttgtgatggagtgctgttatataattttgacttgggttctttacatttgcgttgttaatgtaatttgaggaggaatactgaacatgagtcctggatgatactaataaactaataattacagaggttttaaatattagttaaatgactttcacttaagaatttaagcttttggtcacactttataatagtgccttatagtataaacaactgaaaggctctttcccattaacaacccttgatgctggggccagtgaga

SEQ ID NO: 30888 - DNA, 1108 bp, Mus musculus
agaaatacttatactattgttctgatacagattatttataaagaacataatattttgtgggtagctttttaaattctgctggttatgagcctttaatcccagtgcttgggaggcacaggtaagcagagttcaaggtcctttctttctctggtagaacagtgggtctgaaggacttaggtgctttctcattgtaacaacgacacggttttttatagagactggaaagcttaggttcttcaacctagttgactagcttgctctgacaagtagctacctgtagggagagttctgtgtgttaggaagctgtatcctgtggtcactctcatacatttacacatatctacatacatggaggtgttctgaagactagagtctaggatatacttatccaagagcatgtagctcacaaacatacttaatatctcttgtcttataaaattgcaaactctctttttagagtaaataggatttttatttaattgcctgttgactttttttttccagggttcattgaaaaatccttagtgattttgacatgttccaagtgacataaattagccaatgactcggaatgacggatgattctctgaagattggaaatggtttgccactggttggaccagggactgatgtagggatatcttcactccccatgctggggtacttgggaaaagttagtgtacttatttttggcctcagtgcaaaactggttattttcctcttatgtttgaaatttaaatgaaatttaaaattttatactatgaataaaatcctaaaaaattctgtcttccacggaaatcttacagcaatggcgaaagatgattataatttgtttacctctctgttattgatatgtgaaattagaaactaatgcctagattttatggtttgttattctttgaaaatatggactatatacattttccttggcagttgatatttcctttttcttgtgaatgaagctaagtcaaattttaatgttgtttggataatagctgtttaagatagtaaatgtgtttagtcttggcagaaatcttctagaggaaaattatacatttttttttctggtcacccttccatttaactcttttataacttactatcatag

SEQ ID NO: 30889 - DNA, 1334 bp, Mus musculus
ggcagagagaggtgaatttctgagttcgaggccagcctggtctacagagtgagttccaggacagccaggggaacacagagaaaccctgtctaggagaaaaaaaaaaaaacatggtgttcaacaccagatctgacagacttgagtgggtttaaacaactgatccaatgccacgaggaacctggagaaagagcaatggggagagccaagcaccctcccccatacaatggttacacaccagagcaatcacaaaggagtctggcaagtgttatccccgcccccagcaaaggatgaccccttttgactgtgacaggagtccaactggagatgaaagcacagaacttcagtgagtggcaaacaaactgccataaacagggttctccaataagtcaagtgagtctcacaacaggaagcaaacgctatacgctgcagggagacattgcaccaaaaacccagagcctggtgacaagtttggaggcagtaagtagccatctttaaaaaagacaagccgggcacggtggcgcacgcctgtagtcccagctactccggaggctgagacaggaggattgcttgagtccaggagttctgggctgtagtgcggatcaggtgtccgcactaagttcggcatcaatatggtgacatcccggggacagggcaccaccaggttgcctaaggaggggtgaaccggttcaggtcagaaacggagcaggtaaaaattccccgggctgatcagtagtgggatcgcgcctgtgaatagccactgcactccagcctgggcaacacagcgagaacccgtctctttaaaaaaaaaaaagacaataaccacttgtcaacgtttcccagtccaatgcttctcccactcaaagcattgtgaaagctgaacaccaatactaggtcccacgagtcctcctaacactggtgggaactgagaagtctggcaggaactccagtcagatggtcacctctttatggagagccagaggcagccagggagaccagcaaagaaaggaggaagcctagaaacgtgaactacttgctctggacaaggaaaccctgctctatctgtgctctcttacgtctctgcctcctcgaccttgcactagagaagccccactatgaggagaccgagagctgccctcctctgaccgcgcatccttttcaagagagagcagaaagcgttgtccggctttccccattaaacagacggagagatgttctaagctggccaggattctgaacgccctgccaacggtcttttcccagcaggttagcagcgtatctgtcaccgcacctcagcctgtgtgctctgcaaagtcaaggaggggagctaacaacac

SEQ ID NO: 30890 - DNA, 1497 bp, Mus musculus
gcagagatacattagcatctaaggctacctagcaagtcccagagaagccataggaggcagtcagttgattaggagtcattgtgattgattgatgcagctttgagaagagtagaaccaggtaggaaagcactgggccaggggtgtgaggaagtccttgaatgaactagatggatatcagttatcttaatgataactaattttgtttttttaggaattgaacaatgtttgtgaacctgttgtaactcaacccaaaccaaaaatcgagtcacctaaactggagagaactccaaatggcccaaatattgacaagaaagaagatttagaaggcaaaaataatcttggtgctgaagctccgcatcagaatggtgaatgccaccctaatgagaagggctctgtcaacatggacctggactaggctctgtgctggctccctcccccacttcatgagatgtgtttgccatagtatgtgatcctgtataacagactgagtctatttatattttcttttttttaagactgtctagaaattttgtgtattatgaggggaaaaaaggaaaagcttgaatctgtgtagtctctgaccctaagtgagaatgactttggtgtcagggtcctgtggagttgtgccccacactgagctctgtacagtattgctgctcatacactgaggaggtggggtcgtcttctgaggatatgaactacactgcttggtcacacgctgggatcagaatcttaagcagttattcttgccaagggttttgttttgttttgcattttgctcttcatttccgcatgtgtgtggctgtggttgtttataaatgagactaagtctgatttgcataagggctttcaaaaattaagtctgtccagtagagtgattttgctttcattattaccaagtcaagagtacaacagagctagtgaaccgtagcagcatgcgaagcagggctgtgaactatcaccacacagtgcattgtcccgtggaggtgtgacacgggagacacacgtgtggatcatgtgatcattgtgaacacctcgtgagctttaaaataaagtccaccctgtggtgtcatttctaagctgttggctttgtctccgatcggcattgggaaaaggagtccatcgtagagaatagtgcctgctctccacattgacaaacctgagcacaaagtcccaccctggaaaagccctgctgggacctatcgccatcctggtccttgtcctctggtgactggctttttgggtgggtctgctagtgttctagactatagtgccctacagccaaaaaccagaagttaacctgtaagtgttgtccagtattacaaattgagagctttggtgaattctgttctgaagtcaatttaaaatatttgtgtcatcttgagttcttttgttgtccttcaaggttttgccacatagttctttggtctcaggtggtgtggctccctagggcagggcatcatggtggttgtgagcaagtggtggggaactttcttc

SEQ ID NO: 30891 - DNA, 1201 bp, Mus musculus
gtgcttcatggtggatttggtccaattcagtcattcatacgttcactcacaaactcttcatttagctcttatatcagaatggcaaacgtgccttcaagggtctaactccagtttaccttttcttgttctctgtcatcttgcctgcaggtaattacctatctaaaagataaatctgtttcttttatttcctaatgattcattgggcaatcttaggatacgcattctttagataaagtccaaactcaacaagaagtagaagaaagagcaaatctgtctactgaccccggccttgcccgtccccagccccttccttgcctttcctcctccttgtctttccaggctttgtcagtttcagacgtcagccctctgagcttgctttagcagggttaggcatacacactgccctccctcatcagtacctgtgtgagcagctgtgcctcccttctgagccctctgctgggtgggcccagtctttggactgctcgtctcatagcatttatcttgccatattgtaatggtctcttttactcgtcagtctcccactagctggtgattcacgggttgtacgggtcttgttgactgttggataccagttatctgtcacaatgactggcacatagcatgcctgcaccggatatgtagctcactcagactgtaaccctcctgccatccttcttctgccccaccgacatccagaaggctgcttctgttgatgtctctcctcatctctctctctctctctctctccacaaacacacacacagagagagagagagacagacagacacagacagacagacagacagggcagacagggacagagacagagacacacacagagagacagaaagagagaggccttttgcccactcttctgttttttggtctttttttttttttttatggctagaaggtccaagtccacacatccatctttcataaccacctagaatcttcctctgataccttttcacctccttttcgccagtcccctcctttaccagagctcctgcccttacacgcctcctcccccttatgtgagccccttcccttacgccattcccttcctttatgccagtctccttcttggctgcaatactgttaacttagtgtctgtgtgtaaactcttagcaaacagactatacttaaagagagatttgtgtatgtccttaaacaggttctatatcacatgtccttcagt

SEQ ID NO: 30892 - DNA, 1160 bp, Mus musculus
gattctcccccatagctgcttctcagagcacaagagcgccagctcttcagtggtacccactggcattccgctgatttcacttctgtttgtacctagttcttcatcgccagacctaagctccagcagtaaactgacagcgagcaggaaaagcaccggacagctgaacgtcaatcccgggactcctggcagcggcggaggcggcggcggcagcggcaacaccacgactgcagagcgaagccggcaccagagaagcttctctgtgcccaagaagttcggtgtcgttgaccgatcctcagacccgcctcggagcgccaccctggacagaattcaagcttgtacccaacaaggcctttcctcaaaaaccagaagcaattcctccctgaaggagagcctcacggacccgtcccacgtaagccaccccaccaacctgctggccaccattttctgggtcacggtggccctgatggagtctgattttgagtttgaatacctgatggccttacggctcttgaaccgactgctggcacatatgccgctggagaaagctgagaaccgagaaaagctggagaaactccaggcgcagctcaagtgggcggacttcccagggctacagcagctgctcctgaagggattcacctctctcaccaccacagacctgaccctgcagcttttcagcttgctgacatcagtgtccaaagtccccatggtggactcgtcccaagctattggtaaggccagcgccacactgcctgtagacctgttggtggctgcattcagctttagagaaacaagctaataccatatgtctatgtctacagtattaaatactggcaatcgagtaacaggaacagcaattttgtgtgtgtgtgtgtgtgtgtgtgtgtgtgtgtgtgtgtgtgtgtgtgtgtgtgtatgcgtgtgtgctctcgcatgtgtattcatatatgtgtgttcatgatttcgggtcaaactgcaaacattgtcaactgagttccttgctcttgtaaatttctttcctaattcccaaatcttgtttttctcttcccttctctgtcctcttgaaaagattgcattggctttttattgttctgaattaagcaaaatcaacacaccagctttttaataccatggcaagtgactaagaatgcatttcactaatt

SEQ ID NO: 30893 - DNA, 1171 bp, Mus musculus
tccagaggcatgttggaagactgaacttccaagtgatcaaccagagtacctagcagaggagatcggcaaacagcaaactgcccaggctgctgcttagctgctcttagtggcttatggtcagatgagagagcaaagggatcgtttgaagacaaaacttactaaaagaaaatggagcggcataggcagaggaggagccaccgggatcgaaagaggaaagactttccagaagaagcccaggccaaggagattaaagctgataaacagagattgcctgtgttgaatgctggcactgagaaggatttctcgagggaatcccaggaaagatctgaaaagctgcctggggactccagtttgcaggcaaagacatccttgagttcagccatggttccggaggctccggatgcagcctttccaagcagcatggctttgcagtgtcacagctgtgcctgggcttgtgaaggcactgagaacaaaagtacagagtcccggctttcaccgcgactgaagaggacacccagtgagtccaggaagaagactgccttccggttggagtatctgtggaacgggtctgagatgatgatgtcgagcccaagaagaagagcgcagacggagaagactgaagtgggggaagcgtccagcaaagccccacaggagagaaggtagctttgagggctggggttgttgttggctccattggcttggctctgcttcccccttgagttcattaacaattagaccatcccttcacctgtccaaccctgtatcttagaagagtgtaacttgtttccataacccagggtcaccgctagaagagattgttgacaactatctcaggtgagccttgtgaacctaggctgggataagttaagactttgggattattcaatgagatttttgtttgtgagaaggatacgagtttaggagccagtaagaactgggagttggatgctgggatttgttccctgaactcgatgcaggcattttttccccctctaaatctgcactaatggcagtaagtctctggtgtctagaaaaggacctttgggaaatgatttattaagatcttagactagagacctaatgacagaatcccagtagtattgctagagggagggagaagagactctggacacagtaatgtaagtcttcccaacaaggtgatgcactgccc

SEQ ID NO: 30894 - DNA, 1131 bp, Mus musculus
actctgtagatcagactggcctcgaactcacagagatccgcctgcttctgcctcccaagtgctgggagcgccaccaccgcccagctttcttcttgtacttcttattttaaacactataacttgggaaaagcactgagtggatgcaattaatcgtactctaacttgtcctatcactctgttttcttatgcataggtataccagattcttctgacaaaaaacgctgtttaccgaatgatcctgaagagccatccttgaccaactcttttgggactgctaccagtaaagaaattagttatattcatgcattgatatctcaggatcttaatgacaaagaagcaatagtcattgaagaaaaaccacagccatatacagcccgagaagctgactttctgttatgcttgccagaaagaacatgtgaaaatgaccaaaaaagtccaaaagtttccaatggaaaagaaaaagtcttagtttcagcatgtcttccttcagcagtgcaactcagcagcattagctttgaatcacaggaaaaccctcttggtgaccacaacggaacaagtactcttaaattaactcccagctcaaagctacctctgtcaaaggcagacatggtttctagagagaaaatgtgtaaaatgccagagaaactgcaatgtgagagttgtaaagttaatattgaactaagtaaaaacatcttggaggtaaatgaaatatgtatcttaagtgaaaattctaaaactcctgggcttctgccacctggtgaaaatataatagaagtggcctcttcaatgaagtcacagttcaatcaaaatgcaaaaatagtcatacagaaggaccaaaaaggctcaccttttatttcagaagtagcagtcaatatgaactctgaagaacttttcccagacagtgggaataattttgcttttcaagtaactaataaatgcaataagcctgatttaggaagttcagtggaactccaggaagaagacctcagccacacacaagggcctagtctcaagaactctcccatggcagtagatgaagatgtagatgatgcgcatgcagcccaagtgttgattacaaaggactcagattcattagctgtggtccatgattatacagagaagagcagaaat

SEQ ID NO: 30895 - DNA, 1470 bp, Mus musculus
ttaacatgtttggaaattatgaaagctgaggaaacatgtatgaaatcttcagataaaaaacaattaccttcagataagatggaacaaaatataaaagagtttaatatatcctttcagactgcaagtgggaaaaataccagagtctccaaagagtcattaaataaaagtgtgaatatttttaatcgggaaacagatgaattgactgtcatttcagattctttgaattctaaaattctccatggcataaataaggacaaaatgcatacttcatgtcacaagaaagcaatcagtattaaaaaggtatttgaagaccatttcccaattgtaactgtcagtcaattaccagctcagcagcatcctgaatatgaaatagaaagtaccaaagaacctactctgttgagttttcatacagctagtgggaaaaaagtcaaaattatgcaggaatctttggacaaagtgaaaaacctttttgatgagacacaatatgttaggaaaactgccagttttagtcaaggatcaaaacccctgaaggacagtaaaaaagaacttacattagcatatgagaaaattgaagtaactgcctcaaaatgtgaagaaatgcagaactttgtctctaaggagactgaaatgctacctcagcaaaattatcatatgtataggcaaactgaaaatctcaaaacatcaaatggtacctcttccaaagtacaagaaaacatagaaaataatgtagaaaagaatcctagaatttgctgtatttgtcagtcctcttacccagtcactgaagattctgctttggcatattatacggaggacagtaggaaaacttgtgtcagagagtcttctctatccaaaggcagaaaatggcttagagaacagggtgataagcttggaacaagaaatactatcaaaattgagtgtgtaaaggaacacacagaagattttgcaggaaatgcctcatatgaacatagtttggtcattatcagaactgaaattgatacaaatcatgtctctgaaaaccaagtgtcaaccctccttagtgaccctaatgtgtgtcatagctatctatcccagtctagtttttgtcattgtgatgacatgcataatgattcaggatatttcttaaaaaataaaattgattctgacgttccgccagacatgaagaatgctgaaggcaataccatttcccccagagtatctgctacaaaagaaagaaatctacacccacaaactataaatgaatattgtgttcagaaactggagactaatacttcaccacatgcaaataaagatgtagccattgacccatctctgctggattcaaggaattgtaaggtaggctcactcgtgtttattacagctcattcacaagaaactgaaagaacaaaagagatagtcacagataactgttataaaatagttgagcaaaacagacagagtaaaccagacacttgccagacaagctgtcataaa

SEQ ID NO: 30896 - DNA, 1386 bp, Mus musculus
acctgtcgaaaaagaagagccttggatttcctaagtcggctgcccttaccgtccccggtcagtcccatctgtacctttgtctctccagctgcacagaaggcttttcagccgccacggagctgtggcacgaaatacgcaacacctattaaaaaagaacccagttccccgcggaggagaacgccatttcagaagaccagtggcgtttctctgccggactgtgattcagtagctgatgaagaacttgccttgctcagcacccaggcccttacgcctgactccgtgggaggaaatgaacaagcgtttcccggtgattccacaaggaacccccagccagcacagaggccagaccagcaagtagggcccaggtccaggaaggagtctctcagggactgtagaggcgacagcagtgagaaattagctgttgagtcttagcctcccggtttgtaagatgtgtacagttccaggctactcataggtgttcgtgtgagaaggcgggagtagctgcactctactgaagcgtgtgtttactgctcagatgctctacctggtctgtgttggtgtaactaaagctggttgtcatcgactgatttaaaaagctttaggagtagactggatcactacaactatcattttatatacaaaataaacatagctttgcttttagtttagattactggctaagtatggttactttatatagtctggttcctgtttttgaagttttttctttttttacctaggaagtcctatgaaatagtgttctttcctgcatgattggttctgctagagctccatcctgtcagggtaaacagacacaaccgtgatgtttacctctgtgtagccttgtcactcctttccactgtcccagtgtaatctctcaagttattctagctagaaatccagtcaggcataatgacacacacctgtcatcccagcatgtaggagatagagaggggagtttgggccacccttcattacacagaaggttctaggcggtgggttacaaagtccttccctgaccacagccccatcggcaggtggatgctctcactgaacttcagctgtaaagtgctctgctctgctcttagtgatttaaactttgttcactaagtaatttggttttcatgtcctaatcattgtactagagacccaacctagagcagagtaaataaatcttacataacaggaattatgctatttacaaaatttaactttttttgttttttgagacagggtttctttgtgtagccctggctgtgctggaacttgttggagaccaggctggcctcgaactcagagatccacctgcctctgcctcccaagtgctgggatcaaaggcatgagccacttccacccagctgatatttaaccttttttcttgtgaat

SEQ ID NO: 30897 - DNA, 1236 bp, Mus musculus
gggggcaagacttgatcttgtgagacattaaggttgctttctaaaataatgcttacctgtctttattctaagttactctgaagccagaagcttcaggcctctgaatgaattaacacctgttgattaacagtgacggtgggttgttaagtaaaggattaattgctagggcatttttctctctgcccagaaaccttgcctcttgcttgccaggcaggagagaggtttagagaaataaacttgtcttgaaccagaagacagggtacagaaggaaaattttttacacaagcaaatgtgcataaacacatatacattcatatacacattcatgcatacacactcatatataccttcctacactcttgtggggcacagctacttatctcatatttacatacacacacacacacacacacacacacacacgcatgcatgcatgcaaatggagcaaaagcacagtgcacaaagaactcagtcatctggatgaaaaacactctttcaacctttattgcatagagaaaaaaaaagcttctacccttttattgctaagtgaattaaacccaaatctgtaagaaaaaaaagctttttcctctttatttagtaagaataagcttaccttgctgttaagagaactgttccatcctgtgctctctctgcattcttcttttgtctgactctgcattctgtgtactcctctcctactcctagttctgctctcctgcttcctaatgccattctttctagggttttgttgtacctattttaggagaatagatcacattgtatcttatctcaaagctcaccacaaatttaaacataaattcaaatcataaattgaatcagagtttacaacagagatgtttacaagtgttttcattaagtctagttatttatatatttattttctgtcactagctccataaattcattgaaagttaaaaactacaattctcatatttaagttaacaatgaggttttgtatgataaacccaatcaatattttatcttctgtccttgaacctacaatacaacattcctttcatgacctttggttaattcttttcacagctctaaagaatgtattcaaagttataagtgcctgctttctgtctcagaagcaattaactcatggtaccagaagacgagcagagatttttggttttggtttttctaccaaagagctctagttgcagccctaattataaagtgcttaatagttactagtataattttaagaat

SEQ ID NO: 30898 - DNA, 1728 bp, Mus musculus
taaactactttatttttcaatacagttgaactgcttttttaatagatcatactttaaatttttataaaaccgagcatttttgattcattaccctaaatatacagaaataccagctttttgtagcatactttatagttgattcctttaatttggcatatcaggaaattatgtttcagctaattcataatgtgacaaaattagctctaagccataattagcattttaacttagttcacacagaatttcccagcaagtgttagacagtaggtatacaactcacctcatggatcatttatttacatatgatgtccatcaccgttgtgatgaatttattgggaccaacacagaaaagcatatgaagactctttccttttcagggggagcacatgaggggaggctctctattctctaggttcctgtaatccactgacaacatatatcatttttagaccatcccctactcctttctgattggatttgtagaagggcaacagagacaaggcaagtctgtatttttaaaaacctggtaggcagttctgataatggttcagttttttgttgttaaatttgatgtaatataattctgatacaaaagtattttggacagttacttagtgctggcaaagaacatctgtcctgtgaaatgttgtctcctggctctggtttttactgtgaagccagctctgtctttactgagtagcttccttccttagattctattctttcacttagaatttaaaaattagctctactttttcattttagagccttgtaattcatgtccatcttcaaacagagcttgcctcatctgatcctaaagagtagtactggaaagaaactctaccacctcttactagaatacctttgttacactgtggtatagaaaacctttaatctctggtttattttcttaagaaaaagtctagttaattgcaatgtaattccaacagttaatttatcatgatcctgtgtatgctttgcatattaatattttatgactttgaaactttttcctaaatagcctatcttaagtcatgtaatctctgtgtgttattttgctgagtttcttttcaagtcatgaggctgaaaagtagatacagtattgcaggctaggtctcttccttactctcctgttagtgagactctgactgctatttacctaaatgctttgtgctgttcctctgtgagtagatcccaactcgtgtcatcttatcttgtttagcacatgtgtgtttgtacgtattttatcatcttagctaaacacatagtaaaaatatgctaacatatctgtgtgtcgttgtaggtatgtatgtgtattacattatacatatctctttaacataagattgcttttaatttagatttgtgttttccagtatattatttagatttgcacagtttgaaaatcatgctaaaaatttaagcttgactgttaagatatgctgtgtctttaagaaactttattcagaattgagacatggctcggtggttaagagtaagtgctcttccagagtttgattcccagcacccatatgaggtggcacatgaccccttgtaactccaggtattgtggaatccaatatctctagccttttatgcacctgtacacatagacttgtacttgcacacatgttagaagcttcatttcagagtcatagtgctattaatctagtgtttttggggtttttttgtttgtttgtttttgttttggtatggtctgttttctct

SEQ ID NO: 30899 - DNA, 1133 bp, Mus musculus
ccgaagaaccaattatttcttatgactgggcctgtaatactctaaagtctgaggaggaaaacaaagatctcagtgatgttcttcagtcacattgtggttatcaagagtacttggaggatgaaccagactatccctgtgatgagcagttgatgcctgcattttgtgaaacttcatttccttccttcaggcctgaatggcagtccatgcatccttttgtcataccccatgatcctctttccagttttaattattttaattttcaaagatttggtaccccactacatccatcaccagatgttttccatggtcgagatgactctcagatgcagaatgggtgttacgtagacagttatcaggatggctggagctgcttgacgtttgatcagaacgatgaatatgctaactatgatgtgactagcaataatgttcatccctttagaaatggctgcagtgtacaagatgaaagtgtgaataatggtttctgtgaaatccgagagtgctggcaagatccttccatggacaagcataatgaaacagacaggtttgtgaaccagtggtttcaagaggagaaattaaataaattgcagaaattgcttattcttttgcgaggcctccccggttctggaaaaacaacattgtctcggtaagtaaaagacctgagtgaatacttgattatgaattcattgcttaaaaatacatgagttatcagtcataaatgcttttgtatttctagtaaatcctttatatgctatatttgagagtgacatctgactggaaatactaagatgtacaagaatgggaaagggagaatttgtgtatatttagtttctcttaagggctttacaactaagctacagttaaagcagcaacagaagcaatgctgcttagcctttataacttcaaagaaggtgggctctgcactagaaaatctgggctctggtactttttcactgtatgctgttgagcgtgttttgctgtctttaataggggaataagagatagctattttcttagaatttgaaaaagaaatagataatcaaaggaaagaaatattgagtgtattaagcattatgccatgttcatacctgattgggagaatctatatatgtgtgtgcgtgtgtgtgtgtgtgtgt

SEQ ID NO: 30900 - DNA, 1181 bp, Mus musculus
tcgatgaaacattgtgaattattatgaagaatcatgagaatgtcaagatttatttctaactagatcatctgaaaaaaaaatgttctatatagtcttgctcttgatttctctcagtgctgtttttctgtttcatacaatgaaaaggtcctacatatattttgactcaagtattaatggttaaattgatttttttttccccctcttcttcttaggactgttagtatgcatgcttcatttagatagtagagtgttcagccctaaatggaatgtacctatcatacttctacccataaggcttagggatctttgaggaagggggggggcagaaagatttcaagagtatagtggctattcctggttgtcaacttgactatatctggaatgaactacagtccagaattggaaagctctcacctgtgagctctcacctggaggctgggagatacaagtttctgacttggttgttggcatggagtccttgaggcatagtggctatgaatcccagatgattaagacagggagatctctgagttcaaggtcatttgagacaaaggaagctggagacctacacaaggacattggaagaaggaagattcagtctctcttcttagccggcttgccttgtgggactgagcaactgctagatccttggacttccattcatagctgctgctgaccatttttggggacttggattgcagactgtaaatgatcaacacattccctttctatatagagactgcccataagttctgtgactctaaagaaccctaatacagaagttggtactgggagtgagtggttctagaggagcagaagatgaattttttaagaatctggagttagttaataattcaccagcaccttcaactactgaaacctctttagatactctttctcctgggagtttggagaatattgaatgaagacacgtggttgaaactatatttcaagcttaaagaagctaatgcctttgattatcttgatgaattaggtgtacaaaactttctacaagatggggaaaaaaatcagaaaatgattttgctgacttgtcactcttagtatgaaggatgaaggaaaagaaggggctgtatgataagatcgaatggctccagatgcaagcaaacagtctagaagttgctaagtgtgtccttgaagagagtcttctcttcagcagccat

SEQ ID NO: 30901 - DNA, 1138 bp, Mus musculus
gtcactccaagatgcagtcagccctcttttgatgctttggtttttctggacttaccatgtaacagactatatttctattcatctgtatcatttgaattggggaggatatttaggatgactaaatactacttcttttatctaataaacattgtttgaccatttctatatggtcaatctactatgaaggagatccgaaaggaatgtagttatttttgctgggaagagatcttatgatctaataggcctgatttttctacgaaaagtcactttaccttctttcttttatggatatgtctttcattccatttactcaagagtagcttttaaaatgcaaataatattttgcttttcctaagttgaagtacagggctagggatatgttctgtggtagagccgaggaagctcacagtagtaaactggatatgatccccacctctgcagactaacggacatggctagttatgtaaacatacataatacaaacgccatatttgtgttttccagaacttaaacaagcaagcatatgatttggcaaaggctttgctgaagaggactgctcaagctattgaaccatatattaccaatgtaagtgtcacagttgattttagaaggattaaattgagaatttaaagactgttggaagcaaatcttagcaagtggctcacactgcttaagtttctgttgctgtttatccagtgagagttggatttccattctcctctcctaaagtttcttttgtttaatatttttgagaaggctaactcttgtctgtgcctttatttatttgtttcaggttcctagagacaacagccccctccccccttgactagtaagatagacagtttctaatgttagcaattgagttaaaaggtaattagataaaacgtatggtactttgtaatattcagagacatcgcttacatcttttggagatgaaattgatttgtgcagtaggatggtatgaaccaatattaggacctagaaattaaaggcaggcataaccacagtagcagttttgtggaagtccttatgtattgctatccccaagagagatttctataaataggccttttctgaggaagagggagattggcagtgacatgaacccttttaaatatcaccctacttatgagtgact

SEQ ID NO: 30902 - DNA, 1108 bp, Mus musculus
ttttgtgatagcgaccctccagcccccacctccagttgaagaccatgctgcacatatgctacatataagcagggaggcctaggtccagctcattatgttctattacgatacctctgcttctgctagttgggccacatgaaagcagggtctcctcagccagtgtcttagctttacttcttcagcaaccatattcggggcttctataattatatgatagaaatggtaataatccattatttcccaggaacatcagatgagttgtttattttattcttttataaaaaaaatgatactgactgtactttagctgattgagttagaaacagcttcccttcctgggagtgcaggcttcacttttcagttgcagaggacatttagattgtgagggaaggggtagccccactcctagcctcttcccttcccttgctcttaatttttttgaactattaagcattctatttagtatttgcttttgctctgttgatttgcaaagatctttccaatcttttatttatttatttttgtttttttcgagacaggatttctctgtgtagtcctgactgtcctggaactcactctgtagtcctggctggcctcgaactcagaaattctcctgcctctgcctcccaagtgctgggattaaaggtgtgcaccaccaacgaccagcttttccaatcttttaaagcagtatgttaattattaaagtttccattttaatcagaagattttacctttcagagtatcttaaagtgaggtcacatgatcctgaggaagctattagacatgatgttattgtgtctatagtaacagctgctaaaaaggatattcttcttgtcaatgatcacttactcaattttgtgagagagcgaacattggacaaacgggtgagtagtagttgataattcccagagggttttgtctttgtgtgttttattttatttttgagacagagtctctctgtatagctatgccctggatactttggaattctctctgtattctaggctagccctgaactcaaagagataagcctgtctctgcctcatgtgtgctaagattgaagatgtgaactaccatacccagcagaggtttttctcgagacaggaat

SEQ ID NO: 30903 - DNA, 1178 bp, Mus musculus
gttggaagatgatgagaaaatacggaaacagctggaagcccttgttagtcccacatgttcctgcaagcaggctgaaggctgtgtggtaagggaacagcagggagagaccgtgtgtggacacccatgtgtggacatgcatagaactctttcagcacatctacctcattgttatgttatttcaatttacaaaatgttaaataaataacaattcagataaattataatttgtctgcaaaaagagttgccaagaatagtgtatttcctttcaaaatgaaattatcctatgtgaagaattttacacattccatttccattcattttttatagtgttctatttcatagcatgccattcatctgtgctttgtagcgtggtgagtactaactttcccaggtcactttcacactcccccctctcgtctttctttggagtggggtctgtctgcccactctgggcttgagcaaactcctggtggagcctcctctgggactgacgtgatagttccatagccatgcttctgactctgcttctgactctgcttctgactctgcttctgactctgcttctgactctgcttctgactctgcttctgactctgctcctgactctgcttctgactctgcttctgactctgctcctgactctgctcctgactctgcttctgactctgcttctgactctgcttctgactctgctcctgactctgctcctgactctgcttctgactctgctcctgactctgcttctgactctgctcctgactgcttctgactctgctctgcagcactttcataactgagtcttttcacaggctcttgatttctgcagattattatattaattacttgggggtaatggtgcatttttactgcctttaacatgtgtttctcaatcataatcctgtccactgattgttaaaaacaaaacccaagtgaaaacaaacaaaacatagttcgatgtggattatgttattagttacttacttacttcctgaccactttttgccgtaagtttttttttaatcatttatatgtctcttgtgagttgaatgtttaaaatctttgcctatttttatagaataattgttttcatttgcagctagttggtttgtaacatgccatgttaagtggcaattaattttttgtcagctttcatttgtatgtgatgtcctttttttata

SEQ ID NO: 30904 - DNA, 1182 bp, Mus musculus
gaagggacttgagacctctaagactgcaacatccatgggatggggaacagatgcatatctgcttcactcacgcaaaccctattcattccctcccttctgctgatttacacagaatcagagatttaagcttcatgtaggccttgctcataaatggtttatgtttgaacgcagggtctcactgacttctgtcctaaaatgacccagtcctagagtcaagtgttttctctaccacagaaaggaagtagaaagacgatggcactgagagtagtcgttactcacctgtgcacactgcattatatctgtgagtgactctaaacatgaatacagaagggaaataatctgtggcctggaaaaggctgcttatgggcttgtccagatgtagataccatagaggccttaatatctgaagataggaagaagaggaggacagttttaggaaaagaaatacaaagaaattcagaaatgtgtgagaataaagattgttttaaaaatgatggctggtacttaggctaaattcggatgtgttcacattggtcatctgttgacttttctcttcaggtacgacggcgaagctccaaacgagagagacgatgaacacgtcattaacttctattgtgaaagctttggggggaaaaaacattttttgtctaaatatgaggctaaataaagccttggatgcacaaaccagaactgccaaagcgtggacagttggacttcggatgaccatgggtttgtggtcacacgtatcagccatccacacagtgataacactgactccagagtcttgtgaaagtgtcctgtgtgatggctgtgtagacacaaactaaagaagacacatgtaaataatcccactcccccatttctgacttctaaagtgcttgtatagcttttatctgcggctttaaactgacaggacccagctgcttaccggatctgttcatttgaaaagcatttgctagggtggatcttaagcagtacgtagtctgtcagtgtttgtatttgaattctctgcaattttactgtgaaaatttgttttcaacaattggtgtcattttctcaatgtcactgtttgttggagttaaatggtttcttcctgcccctctttgtagctcatctatgtttactccagggcactgttgtcttctgaggtgctaaagcatctgccagcacactagaacatgc

SEQ ID NO: 30905 - DNA, 1277 bp, Mus musculus
gacagctaaggctgggttatgatactttgtattttaaatgtttcattaactcagctctccagacaatgatgtttcgatttcaacagtacagaagcatgtttttaaacttacagcataagtaataaaggatagcattgtatttttgtcatcaactaaacttcattggaaatatttatggaaatatatgtttaaaaccattttataaaacaaaaaaaatattatggaggatttttatttgcatgatcatagttcaccagatttcattgcacattaatgctgtgcatcagttcattacagacatggtcactgtagattttgtttgtgtccaatgccaatgagcctgtaattttacaacccgcctgttcacttttgggaggattataatgtaaaatttccatttttgtgtagagaaataggtgcaataatgatcaaagtttttatgtcctgagtctccatcttgggggcttattattatgtttaaacttaacacttcctgtactaacacttggagagccacatactttaaaataaagctaagtatgtatacgacattaattgctacagttgttagcatactgcagtggtcgtactcattttgagaacgtgtactgtctgacattaaggacctgtaacaagctcattgtaacaagccgactgtggaaggaatctggtgactcccaggtgagccttgcttgctgcagtaccccactaagctctttcagtgatctccattctatgtgtaaattagaaatgtgctgtaaaacttgttctagacattaaagtttaaatgactttctacatcttcttacagcttgcaagtttgacttttaaaggttccttttgcctactgaaagaatattggggatttaatgatttgtttaacttaggcataaccttctaccacatagtattatgttatcaatgaacagttggttctagatgtccagttttcagacacagttttggattttctgtgaacttaaataaatatagatgctcatgtaattatatttttatgtgactcaatatatatttgctagagaaagtcatgttttgtgatttttaattttagagtcattgtttcccagtgacatttttctaaacttcatgtttaaacttttcatgcaaaatcttgccttgagaaaatttactaacaactactcaagttaaagaattacataactgaaaaaaaaaactgaatgtaagatttgaaactccggactagcagatatgttgctaaggaagttgtatttgctcagtaaacactatgaacccac

SEQ ID NO: 30906 - DNA, 1179 bp, Mus musculus
aggatatattaaccctcctgccctgtgtcataatttagttagaagggatcttgatcatttggatcttccacaaaatatcacattggtgcactatattgatgacattatgctgattggaccaagtgagcaggaagtagcaaccactttggactcattggtaacacatatgcgtatcagaggatgggaaataaatccaaccaaaattcaaggaccatctacctcagtgaaattcttaggagtccagtggtgtggggcatgcagagatattccttctaaggtgaaagataagttattgcacctggcccctcctacaaccaagaaagaagcacaacgtttagtgggtctatttggattctggagacaacacatccctcacttgggtgtgttacttaggcctatttaccaagtgactcggaaagctgctagctttgtgtgaggcctggaacaggagaaggcccttcaacaggtccaggctgctgtgcaggctgctctaccacttggaccatatgacccagcagacccaatggtacttgaggtgtctggctgatagagatgctgtttggagcctctggcaggcccctataggtgaatcacagaaaagacctttgggattttggagcaaagctctaccatcatctgcagacaactattctccctttgaaaaacagctcttggcctgctattgggccttagtggaaactgaacgtttgacaataggacaccaagttactatgcgacctgaactacccatcatgagctgggtactatcagaccctgcaattcataaagtgggacgcgcacagcagcagtctattatcaaatggaagtggtatatacgtgatcgggccagagcaggtcctgaaggcacaagcaagttacatgaagaagttgctcaaatgcctatggtttctactcctgttacaatgccatctgctgccaagcatgcgcctatagcctcatggggtgttccctatgatcgactgacggaagaggagaagactagagcctggtttactgatggctctgcacgttatgcaggcaccacccagaagtggacagctgcagcattacaacccctttctgggacaaccctgaaagacacaggtgaagggaaatcttcacagtgggcagaacttcgggcagtacacatggtattacagtttgtttgcaagaagaaat

SEQ ID NO: 30907 - DNA, 1195 bp, Mus musculus
cctatcagtcattgaagggcagctgcagagagagccaaaggccagcctttaataggtgccaagtgatagtgatgtgtttagtggtgaatacaaatatagaccgtgttctctttgtcttctactcttaacagatgagcattaggaattcaagcttcgtgaagtcttctgaagtatttagtatcttctacctcaagctgatttacttagttgtagggggaatgggaacgtagaggaagtagataatgtgacagtccctggtcccttttcatcttaatagctgtcaataaaatgtactggtttcacacaatagacagctttccaactcacagtagatagtggaaggttgtatgcagcaaaaccttgtggttttacttcctgctcctagttgatgcagacagattgcacactgcagcaccttacgtgtcctgtaggaggcagcacagagcaggactgtgaaaggcttccacgttgatgcaaacagtagtgagaaattgcctcacggtgcttctctgttaatttttcttacagatttgcagtgtactatccactgtctgcaggaaggaaggtctggctctcccttcgacattggcccgtaggctggccgagaagtcatgccgaaacctcaggaaagccttacttatgtgtgaggcctgcagagtgcagcagtgagtggggctatggcagcaggtagcactctgggacatgagactttgttgttcacttattttctttgtgtttcatagatacccttttacggaagaccaagaaatcccagagacagactgggaggtgtatctgagggagaccgcaaatgctattgtcagtcagcagacgccacagaggtaacagtgtgcagggggcagagataccatgacatttacaagtacaagtcagtcttgagcctcatttgaaaggaaaaaaaaaatcatttaatgtctgaaatatagcgggctaagttgttactttatagtttatgcttttccttagtctgttaacgtgtataattgaacttttatttataaaataaattttgaactctttctgttttttttttttccccagaatgttagatagcttagttttagtgcatagcatgaactgcctagtgtgctcaggctgagagaataattgtaattgttataattgccttgaaattgatgcagaacgtacttagaaagatgctgaccttcagctg

SEQ ID NO: 30908 - DNA, 1178 bp, Mus musculus
gagggctttgttgaaaattcaatatttattcattcttaatacaaacaaaaatattattctgtgcatgtagaaaatcattatttaaagatgaaatcgttgaaatagaaacccaataaggagtgcatttaagatggaaaagcttaattggggtatgtattttcaaagtcagtttttggttaagaattactttgtcttggttgcaaaaggattgttatattatttttttaaataattgtatatattcagcttatataactttgtaatctagcagatattttaggaaatagttaagaaatattataaaataaggcctcttgaaatttatgcttattttgtttcttctgaaatactagatatgggtttcaaggtaaatacattgctcataatgctaattttttatacaaaacttaattataatggctaattgtaattatacttggtttctactagtccagtaaaatggtaaatagttattagttataaatggagggaaggtagttaatattttttttatatttctttgaaaaaaagtttcctcatcagctcttctgttgattgtataggaacagttggatgtagctctttccaaaatctgcaagaattttgacattaaccattataccaaggttcagcaagcttaccggcttcttggaaaaacacaggttagttctaagcagatgtcgctcataaacctttatggttgggtctcattattaccaatatatccttacaaaatttcactaacaaaagtgcattgtaatgctgaatgaataatgctaacatcttaacggtctcagagtgttaaataatgtaacagaaacatcctaaaactttgttttaaaatatgtttgccagttctggtattttcactactttatgtagaattaagaaaagtatattttacttaagaggctgaggcaggaagattgcaaggccaagaccatagcaaaaacctgatttcaaacaaataatcaaacaagtatgcgagcaagacaaccacaaaggaaggaatgaaaagtacaagctaattaaaattcaatgggagattgcatatagtattttgtaccttaagttttggtcctgtgaggtggatcttaataaggggttttgtttgtttctagataggctagcctgacttcctcaaataatatataaactatttcttttttttttctttt

SEQ ID NO: 30909 - DNA, 1206 bp, Mus musculus
tgcattgtactgttgagactactaaagtgtgtctgccctccctggtacccaactgaaaggacttttgctttacactctggtcgtggtgtaaaatcgccaccaaagtttatcttgcagaaatcagagaatctagaaacaattaccatttcctaaatactcagcaagtttcagggctgctgctcctgctctcctgctctcatgcgctgctcctcctcctcctcctcctcctcctcctcctcctcctcctcctcctcctctttctctgctgtgcacactccagtgcacactccagtgaagtttgcttgtcaggccgaaaggcctggaagcactcacgaggcaaagagtttcactgaaactcacctcctggaactttggcattctcataatccgtatattcattccctaaccccacgttagtctggtgtatggatccacgtgctctcttttagtattatcttattataagtgccttttaagactgaattctgacatagctaagcctttgtcagtgttccaatgtcccagaaaattcttgaagccgacaaactggaattcagtaggaattcagtaagaaagttgcctattcatcattacaaaggacggagccggagtagctctgggctggtctgcagagtctttactggagacagcagccagcctcaccaaaacaaaggaatacacaattggcctagctaataggtgggcttaccttgaaagagctagggaatcccactgagacagaaatcttcagtacaggttacattgcatattagaagtaagttggtgaattcttctgacaaatggagattctccacagatacgtaagttacactcatacaagaaattatcagggcccaggaaatagggggttgtggtattgcagtattcatgagaatatctgctagagcagaacccctggtggtgggcttaacaatagactagctttacacctggctcccttcttagtggcagcagcctggtccctgccttcttttgatgtttacattccttttgaaatgtgtcactgtaacttggatgtatctcgcctggtttcttgttattcttctgtttaaaaagtttggtgcttgacttgacaaattacattcagattctacaaaatctcctgtgtgcatctgtctgtcatttccgctgactccttgcccaactgcaactagagacctgttccacgcagacaaagggacccag

SEQ ID NO: 30910 - DNA, 1448 bp, Mus musculus
agtggacaaaaccttgtttgatagcacacaaattattcaactttattgttaatggcttttcattcatatgactggaataagaaaaaactaaatcatttgtgctttccaattatgctaaagaatggaaagaaatggttattggataatgaaagggccacgagagaactgctttattttgcatggagcaatcaggctaatttccaagctaatagatacttgaattgattaaatgtacagattatctttacaaatacatactaataacaatatgtaaattatttgagtgtgcatgtttagaatgttagaatttatttcattttccttattttctcataggattcacaatttgattctacaactggatttctaggtaaaaccatgggaagactgaagattttgtccagagggagccaaacaaaattgctatgctatatgatgctgttttcattgtttgtcttttttgtcatttattggattattaaactgaggtgatggaagttagtgtgggctttgaatttgttgcatttaatgtcttggggttcctctttgatagtcagcattgcaacattcctaatggtcttctccattgaagttagtggagttttcctctttcagaaatcatactatagcatataatgctttgaatactgttctttagtgactcattgtaactcccagtctcagggatattgagttagcctgaagtcagcgtggctgtacctatctatgtttttccagggtttcccagacagagtaaatatgactaccataccttgctgttccataagtgtaactttctaaagcaagtgggagagcagacgaataccagagaagctgggtcagcctttgggggaggttgcatgatgggagagagctcgctttcctttgtttgatgtcatccttgtgatggcatgctcctttgctgggtaccatgtagggccatttttttccccctgcagttttcttaatacatttgtcacatgaattctttgtacaaggacttccttcagtaaaactattgacatatttctactggtgcctaatccacatctgtatcaacatagctattgtttatattaatgataaattctgctgacttattttataatagtttctaatttctagctgtttaggtgggccatttgatcattatttgtgtcagaataatgtgaagtgaagtgattgctaagctctgaccagaaaaaagtgtccaagaaaattaatttcctttgttttactatatgctcaaaataagtactgaaaatatttaggctctgaacccagaggtcagaggattgttatttaactccattttatttgcttaaagaaatcaaaacacaaggtagatttaagtaataaagataaaagtactaaaatattgtaaaacattctgtattgctcttactttagaaatttgcctatttccaggcttaaaaaatacactttta

SEQ ID NO: 30911 - DNA, 1175 bp, Mus musculus
cgacactcaacatcatcgtcagcacgttcatcttcgtttgtgtggcacatgagatttctcagatcaccactgacctcgcgcaggtcgttattcctaaagataacccgtctctcttccgaaggctggcatgtacgattgcattctttggtggagtcctcatcttatcctccattcaagataaatcaagactgtaggctcctacaatcctaacaacaaactcttcgggcttactttgcatctgcctagacgagaaaatcatctgtttgaagatattaatgactgtgtaaatataaacatttggcaacaggacagttttgtgacgtctgttgaacttgcgcgattgtatatatcagccctgtgtatatccaatgtgaaatgcacacagtgaaccaggatgcatcgtataagagtgcatgtggaaaacccttttctaccagatctgtgtctctatttataggtgattatagttagcatatgaaggcagggaatggtggactttccagtaaacctatgtaagtacgttaattaggttagtgacaccactgtgtgtcttgatatcctctgactgtgtggtaatcattgcgtcggcatctgtgcgcccagaccctcctacttcacagacaacttagtaccgaagtgacttgcggtgttcttccctgtcacgtgtgccgtgctgtggaatgagagactgttatgtctttaacccgtgcacattcacgtccactgtgtttcctgatgtgattttttccctagctgtagtttgcgggtatgtaagcctaaatctttggacactttgcccttcacagagttgttctaaagctcggtgacaaggttttgttattgtgtatgttgttgttgcttatttttaaaaaggccaaattttccttccaatccaaacagtctatttctttttcctaaactataccagaatttaaaaagaaaagaaaacaaaacaaaacaacaacaaaaccaaaaaccctaccccatggatccattagtgtttgctggtcgctaattaagtagagtgtattatttccaatgtttggaaggttctttataaacacttggtattgcttattatgccctcattttttaaaaaaaaaatatttatcgatctgaacctgtgcagcataatgaagttccaaatctttgattgaaatgtgtgaccgtagtag

SEQ ID NO: 30912 - DNA, 3520 bp, Mus musculus
ctgcgtagaacctgtcatgtcctttgtagtctctgccctcaacttgatcctgtgcagcttctcaatctatgactgtgtggtactggaccttcagaggcgcacagagctcaagtcagttttcgtcttgactgccactttataagttgacaggcctgggttttacttgttaaaacctctcaccatctcaatcacaggctgccaagtgtctttacaaagaagctgatacaaacacaggccatgctgatttcttacagagggagagaagaggaagagaagaagaaagaggaggaagaggacatgacttgcccatatgctgggcaccttataaaggaagccagacttttcggtgcagtatggaaaggcttccgtgattctcttgctgcaccccacgaaacttcaccaccttcaaactccattttcacggttccgttaattttcaaggagcagcaactcgactggttctctgctacatgaaacacctcagcttgaaaaggaagtgctctctcagactgacttgtgagtgtgccttcacattctggtgcaaatcatgtgtacccaagaactctgacatagcatcttaccatcatcatgccaggaattggtttccttaaagtgtgacacttggcaaccagaagcgtctggtggcttcaggtgtgttagggttttgtagaaagttgtaaccacctctcagtcatgcaagagggtacatcaaaaagacttctaaatttggtacccagactttgacaagagcctgtgagttagttcattgtaaccaacttgtcaggaacttcagcaagaattttcatgaatgttgttaattggctggagaaataccagcaaagttttgcaatcatccacccatttgtctgccattgtgcatctggacatccatcaaccgcccactcagtggcatctaccatgaagatgtttagagacgggaaatgattttgcacccagatccacactcctctcatgtcagatatttggaattagagcaccgggaatcgtcttgaagatatgaacttctaagaatggagtctcttgctactaccttgaaacatttgtttatcctctctttctgtttgattctactactaccattaaccctgctgcaggatttgtcaccattctgcctgactgctgagactccattttgctgctatgcaaggagatgaaagaggcaggcctaaaggagcagtaggacataacatggtttttatttctatctgtcatgatcttaatggtgaagtttcctttttcgtcagcatttatctctttgttatcctgacatgttttaattagtttagtgggttttttttttctattggtggtggtgttcttttgttgttgttttttgtggtcgtcattttgattttggatcacttcgtgttttacagtaattacttttaaatggtgcatttgcttctgattttttttttttatgaagcatcacatcagtttacctcatatctcaattccatccttcatgcattttttttttaactcatttgatcttcaagctgcagagggcctagcaatgggtcatcacctgcagccctggcatgtacacacggacatttgccaccactgaaagcaaacagttggagaagttggccacctgagtcaaggaggtggtgctggtgtgagttcacagctcacaggggacggtgaacgttgacattgactttggcagtgtgtactatgctctactcctatatatactctatagatgttaggcattaaggataagtgatcttaaatttactgaaattttgttaagttgattagatttacattaattgtttatattgtgttttttcttttattttagcacttccaacaaaaatgcctttattcatttattaggaagaaattggagtggcgaacacaaactagcaaaattaattaattggctgtgggcccaaatttgaattccttattaattcaaagtgaaggaagtgtgagagtttctattgctggtcatgaagttcaccacgaagagtcagtttagtttgtaccgagaggcatttagctgagagtgatttgagttgggcatctctatgatgcagtccagacttgtgtttaagtttacaggtacctcttggactcctgaattgatctcgatgtcacacatcatcgacatcccgcatcccacacagttccaagattggcgacagagagcatcctgttggagagacctgaccagtcacgaaggaccgcctgcagactcttctgcaggaccatgctacatattcagctggagagggaacacgcatctgatgggaatggattgtttttgcttgtttcagaattttgctgttgagatgttgttaaactttgcattgtttttcttttttctttttttttccctatagtcaattaagaataaggggtagataatcataagtattttgggctgggagggattgttaagtaatcttaggtgggtgggtaatttaggaaattaagttaggataagataggataagataagataagctaggataagttagataaattaggataagttagataagttaggataaattccataagataggataagttccataagataggataagttagttcacataggataagcataggataagttagatcacataggataagttagatcacataggataagttagatcaaatacctcaacaagtggacgagtgtacttattggtcccttacccctaccaactttacctttaaggccgagctcagagggaactacagggaaatcagtgttaggagtgaattggacatggatgacattctagtgaaggttaggacgattagagtaatctaatacaggctctgggaattaactcaagggattttaggaatgccagatgacagtcatcatttgataaaactgttgctggaataaagtttagaatgttgaatggtaaatgttaatggaaattgtacgaaaatgaataaaagctctttccatacccctccccctccctaccccactctttctttcctccccccctccataacctaccccttctcccaaacacacccctccatttcctaactcaccacgtctccccttccactccctaacccaccccttcttccctccctccctccagaacccgcccccatcttccccctccctaacacaccccttcttcctttccccctccaaccccacccttcaaactatattactgtattctctttattatatttctttgtattaataaaactgtattgatgttacaataaaaattcaataaataaagacttagtggttaaggcaaattgtgtcctgatcatttcagcgcccgctggcatcaagaatggagggaggagaggtgggatgggtgtggagtgacaaggggtgggagctaggaagataaggggttggcgaggggctaaatggaaaagaagatggtggggaagggtgggtatgggaacacgtttggcctgggggtggtgtataaacaacacatcagtcacacagtacatcatcaatgataatacccaggatacccca

SEQ ID NO: 30913 - DNA, 1160 bp, Mus musculus
ttagtcctgagaggatctgaaactgaggctgcctcagaaagctgtaaaggtatctagaacctgcaggaaggtgccacaactttgttaacttaaatgtgtgaatatatttgtattcttacaatgaaaatttaattaaagactgtaattgaagtcaggcagtgggtgtaggaacagcagagattagagggcagcccgggctagggaggcactgtctcaagaaaaccaaacaaatcaaaccgaaccaaagcactttcctccaaaggctccattgagctttcttttgttttcagcactcagagaggagcttcactttgggttctgtctttgccttcactcccttctatcgatcttggaagtgtttggtttcactctagagcttttgggtaattttgtaaacattagttgttgggcgcctcattctgcagtcaaacttttgctgagtatgagtgtgtttatctaggaaataatcacatattctctcaagtcttctctctgcctacagttttcccctcctccttcctttcttgagacgtatctcaagtatccaaggttggccttgaactctcttgagcctcctgcttgcacttcctgaactgggatcacaggcacgtacctctgtgcccagattttcttggttatctgcaagcagttagtaagaagctatgtgagaaaaacaggccaagatctggacatccttccttccttccttcctccctccctccctccctccctccctccctccctccctccctcccttccttccttcctttcttgtttgcttctgtgtgcgtgagtgtgtatgtttctataaattacattatctggaggatacctgacagttgtttttaagatgaaatatgaaatggctttgcttatttatgcaaatttgtttataagcaaattttctccaggcagaactaggttttaatagcaccctgtggggttctgtatatgtgcttttgaatatatagtaaatttataggggtttgcatacactttgggaggtttatcttttgagattggtatgttggtgggtgctttcgatcctgatgcttgagtgatggaatctggcagattaagagtttgaggtcatacacgctatgtggcctgggttacttgaatatatgataataaaaatttaaaaactatttttctatgtt

SEQ ID NO: 30914 - DNA, 1150 bp, Mus musculus
ccttgtgcatccctctacaatggatggatccaatatggagggacgcagccactgttgctgtatcccagaactaagtacgtgataggcaaaaaaatataagttgtctcagcttgcaactgaacatcaatatcccatcctcctttcagagtcttagtcctttccctttttgtctcccctcccctccccttcctcctttctcctgtattctcttttgttaaagatagagtctcctatagcccagggtaacttcaggcctcctatgcaactgagggtgaccttgaactttgaacccttgctctcccacacagtattgagattgaagatgtaccacagtgtctgattgatcgtctatagacttccttaacatcgcagtaatagacttttctggttcacgtggattgccacacagctctgctgatagctactgacatcagcatggagggtaattcctcttgtctgtgcagcttcagtgccagaagctcctgtgacccatttgtacaggtgtagtttcctacagaaagagtgttttgtaagtctcttgaggtagctctcctaattagaaatcagagatgagaacttttatataatctcgttgtgatcaagtgaaaaaaaaagaggcagacttgagagacagctgtctgaaagcatcttttctcagatacgatgcagcttttcacccatggggaatgtgctgacttctgagggaccagccttcacctataagataaacatggtaggatgtgctatggtagtgtcttgtttgggtaagggagtcctgagtgtaaagtgtctaaagtagagcgtggtgcatggtctgtactcagggaaagatgctagcacgcttccccagatacattcagagtcttctggacttggtccttaagaggatccatggctgccatagttcatattccctctccccctgtactgagaattataccaggctgttaacatcttctaacattgaactgaatttcttgtacccactgtcatttttctatgccattaagacaatttcgtagagtgggagatcatagtaattggcatgtattttagagagtacgtctatgtgttctctatctgttgggcattcacatatatttggtgttctcttagcctctgttaggagaatcgggctagctgtggcagt

SEQ ID NO: 30915 - DNA, 1162 bp, Mus musculus
tccttccttccttccttccttccttccttccttccttttcctcctcctacttttttgtgtgtgtgtgacatgttcatcccttgtcagttagactgtggggaaagaaaaaaaaatactgaataccagagtaggaattgcatccaacacttaatgaaatccactgcttatgttattttgattggtgttgtttgctaaggtgtatctgccagaccttgtaagaccctcgttttgaagatggaatgctagtttcatccaggcattctggttatctgactgtgaaaaaaaaaaaaaaaaaaaaaaaaaaaagaaaagaaaagaaaaaggatttggatgggaagaaaggttacagatgtaaagagcatcttgtgtaaaatcaaacatcaggatagcatggggaggtctggtcacctggatttggttgtttttaatgtgcctaatgggactttggggttattggattctttttcacaataatcaactagtcttgactgttgttacacagagattttttttgtaaagtatgctagttatatggtcaggaggtgtcgaataatacaataaattaaaaaaaaatagatgcactgagagctaaggaagtttgagaccagctttctctagaggtatggttacataaggccaacgtggacaatgtagacatggagaacttaagtcgatagtggtaaagggtaatcagattgatgtgagttcaaatcattactcaagaattagcatgatcctttgtaccctactatagaagatggagggtggggtgtggaagagagagagtgggagggagggagggagggagggagggagggagggagggagccagggagcatgagtttataaatcacataaagattcagacagagaatctcatcttattaggaagatgagagttttttcttcttctatagtattcctccctgaataatgagtcctgggttgtagaagaggattggtttgcacttaaacccttgttcacacatataacagaaacatatactatgctataagaatcatccatatgggtttaattaggccgtgtaagtctatacgtgttttggaacagagaagacaaaaacgctgttttataaatatcaatttgagcaatctagggaggtggctcagcagttaagaatagtcactgctcttgtaaagg

SEQ ID NO: 30916 - DNA, 1200 bp, Mus musculus
gtgcttggcccacagacaaggcctcctgagtgctaggccggtgttctatcgagctatcggctcagaccccagaatttccactcatgtgcacgtacaacagtgattggcattgctctcagctctctacagttgccttccagctgtggagtggagtgggacaatagcaggcctgatttaggtgacaaggaaacttgatatgtatcctctcttcctcctgtagctcaatgtgtggaggtttctgagagctcatagtatagccttctctttctacatagactttcctccagaactaccagtatcagttatcattgaccaaaccttttaggagattctgatatactctgaagagccagtgtttcaatgcagtggtggaaagattgaaaatatctgtgacactaaaagtttgtgttctcttttgactacacagtatttttttttttttttgtatagcttaatcattatttgaaaaccttaggtgagattaatcttattgcctgtaattaagacaattttattaattagcatataaaataatggtccccattctgacatgttcatatataattgttgttgtctgtagtcataattttaaacttttatggactagaaaaggaattttacatatatttagacaataaaatagttgtgaagtttttgagtgtaattagaaaaaatgtgcttcataaaacttttgattgattcaatactgtttctagtttatctgttagtgggattatcttaagccaggcttcacacagaagagggcctaggtattgagtctatgtggcacaaagagtgctggatttaggagcacagtctcagttaattgtccctttgaatcccatccattaccgtgacagtgaagtgaccagggctcctgggatgccgagagagcctggcttctggagcccagctttttgattttaaatgtacagtcaggatgataggcgcaagtagggtactttggctacacacagtggaaaacattgctatctgttcacttcttccgagctgtttcttatttctcttcctcatgtttccctttgcttttcaaggcctgattggcaacagcttctccttttaaaatcgctctattgcagtagagttgatcacttacatactgcacatgcttaatgcttgctaattacaagtgtgtgcagaatttgtgcccccgtgggattgttatagcaatgaagctag

SEQ ID NO: 30917 - DNA, 1149 bp, Mus musculus
agaaaaaccagctgtttctacctggggctgattgaatggcagcagtgagagtctggctcaggactgtgtgatgtactccatagggccagcgttgcccctagaggacatcctcataggcctttactctgtagtgcctgtgactgtttaaagagctccttggtggccacgctgctgtaagactgctcagtgggtgtgagtgcagctttcttgttggacggttgccagtggcatcatggccaataaaaacgggttgtcaggtacttgtgaaaggacgtctttaaaaagggtaagtgtaaatgagcaaaaatcacctgtcacacgtgactgggttttctcctcaggattctgaggcaggttcttttagtaagatgttatcagtgatgaaaaaaattaccttttgttttcagtagttagatttaagtcacttatgaaaatcttcaaaggagtgttaatgcatcttgtttaatacaaaggctcatgtagaaaatacaacctacgaacctcaccaaaatgaaaatctaggtcagctatccctcagtttttcaattgtgtggtgttggttccctacgtgtctcctccttcagactgtacgaagtcttcaaatcacctctatagtctcacccggaggtcacagttacaggaagtacctggtgtggcgtgcttgggtaatcccttgcgcaattagagttgaaaccactgctgtagaaacaggaggttggaaccttgttggagtcctgtgcagtgggagggttgagaagaaagcgcgagcaagtcacacgtatgccttcagaaggataggaacgagggaagaccttccttgtgttctgcacactgtgacctctgtcagtcctggaaatagtccctgagaaatgatggggttgcagttcttgttagcagagaaggaaacaaatggattacttttagtcttcttgttctacttgactttaggtataaagttcactgtcaggtacatttctagcattttagatgagattagacatgtttctggtggtgtggccataaactcctaccattttaggaaaaaagaattctacgcctgaaatatcagaaaaatatatgaatggaatagatcaagccaaagaacttcaacaaacattcctctttgtttcctgtctgaactgatagttt

SEQ ID NO: 30918 - DNA, 1152 bp, Mus musculus
gtgccttgtctgaggtcttgctctatagacagagttctcctctattttctctcagaattaagtctgagaatatatgtaactggattcaaatccagtaaacaaattcccacaaactgcataattaaggctatttttatgattagcaccacttagtgtcccaggattcaccagagtaaacattgctatagcaaaaatgactgcaaatggttgagcctagcaagagaaaatccccagtagggccatttcggcctcagctgcagctgtgcttaacggcatttcatactggaaagctgagattaacaggaaaatcaggctctgccatagtgtgcagatgtggctgcaactgtcttaatttattcagcaaacatttgttcagggcctcctgcgtgccaaactggccactgggattccagggataaattgtacctggcacagttaaggagcttccatttgatgggaaaaggcagatgtgactgagagttggaggtgtgcacggggccaaaggacagggagcctcacttcacagggtgtgcgtggataggcatcgtggaccatgccgacagacgtgtggagaggctgtgagacactgaggcacaggactttgcttgagtttgatataacttgctccacacttgtaacacaagaaaaggagtcagtttaggaaaggaatgtcttatgtcaaaatactgataaaggatgtatgcgtggagtcctgaggaatctcaggtacaaggcaacagctgggtgaacgtgtgcttaccagatagaggctttcggaggcttcaggctctggcaccaccgcaatgttggcaccaacaacaccaatcacaaacatcagctcttttgactatctgtcatttgtcattctgttaaatgctttccgggcaccatgtcatttaacagtgacatcttgtcttggtaaggaactattttttgtttgttttcttttgcttttcacttgacaggtgaaaagatcaaaattttgatctagaacgttccttcaaatctcagaggcagcatttgaactcagatcattggtccccacattgccaatgtcctgtaattgaaagcttatgtttcttcagtaaaacataggctactgcatacaggtcctgtgtgtgctacaggctttaatatgtctgcatgcctgct

SEQ ID NO: 30919 - DNA, 1166 bp, Mus musculus
tcctcgtattttaggccattggggtgactcagaaggtaaaggtgtctgatgccgggcctgatgatctgagttcagtccctggaccccacatggtagaaggagagaacagactctcacagattgcttcctgacctctgcatatgtgctatggcatgtgtacacctacacacgtgtacccacacataaataaatgtaacaaagaaggcgttcattccctttagcaacgtggtcttacttagtgaagctgtcaaatactcagcgtgagaaacagctctttctgctgcttccgctcacttttaaagtgcacttgtctgtatggtctgcactgggtaatttggatcttcgcactaacatctgtttataacatcgggtgcatgaggcatgctggatttaaaccttaacactctgaccatttggtgaaatgcttttctcttataaaaaaattggtttactaacatctctgtgtaggataaggacggttgtatctttgcgctccccttcttttcagactggagagtatgccactgatgaagaagaggatgagggcgggcctattcttcctagtggtgacgtggccattgaggtctttgagctgcctgagaacgaggacatgttttccccatctgacctggacacaagcaagctcagccacaagttcaaagaggtgagcactggcccgcacgacctttgcctggacctgctcctttggtcgttcgtttcgtatgcttttgtttgtagattgaatgaagaatcctctcttttctgaataagagtctgaatcttaaatttgaggaaacaagttttagcagattgcattctactataaccaacttcagtgtttgtcacctgtcacggtggtagtttgtgatttcaggcatcatttcaagatagttcaagttacgtatattatttgttacttttacggatgctctagttcctggtcacagcctcgttcctctagggcagtcatttttctaaaaagttctttttctttcttttcttgaagtaggcagatatctagtaagaatgaagtgcctaaagagctccaaagaacagttcagtgagcagacattgaactgttcatagagccgccacagagtggtcacctgtccgaggaatggtgatagctggtagccatcctcctcctctggcctaaagaagccgtt

SEQ ID NO: 30920 - DNA, 1148 bp, Mus musculus
gctgcccacgagacgaggcagacactgtgcttagcacagaacacgagtggagaccaaaaaaaaaaaattctgttaggcccacaaaacaatcggacataattgtcagtttgatgaacagcgtcactgtgatgttggttacttccaaagtgattaaaggttttcaaaacctttgattaatcaaagcatggttgtgatagcaccttcccagagctagacctccagtaggttcccctccatcccctgagcgtgcacaggtagatattgggagaaggccaaaacagaggctcattctttggagctgctgatgcttggagtcccatcgtgcgaggctatgggacagagcatctgacctataaggcagggttgtttcttgcattgctttgtttggctattttcagtgctagagattggagccagagcccctcacatgctggatgaatgttctacctttgaactgtgtcctagccccacaactcactatctaaaggcataacgatcagaaagtgaacccttgcccaagaaaactcatggggtctttcaaaggcagtgcagtcttatctggactccctctgccttttgcttctaattgatggctgctttgaagttggcagcagagtaataagcagatgtgaaccttcctgggcccttagcagacacagcgcaggagaaagcactcatctccacctccatggtgctgtcttgtctgtgtctcctttgaaattaactagaactaaagaagaagacagggcatttcttctccagagagaagaaatcttgggcgttcccttcctcaggtctcctgaactaaccagactgctgggtaactgagcagagcggttcaccgacctttatttagtcctaacttagaagcagacgagcgggaggcctcctgtagcggacgctctggatcatggtttctgcaggcggagtcaatttgatgaccaaaagcagcttggggaggaaaggtttattccgtctcatacttgcagatatcagcgtatggtccagggcggtcggggcaagagatcaggagaagaggagacaggagcagggactcatgctgatgctctggaggatgactgcttactgactcactctcaacattagctcccaaaccctcacaaatcagcccgctgagtgctctcagt

SEQ ID NO: 30921 - DNA, 1646 bp, Mus musculus
aattctaatacttgttattgtacgtatcagccatttttcttttctttgggggaaaaaaagctggactgcactggaagcttctgtgtgttcattttcgagagtgaaaacagaagggtgatgattttaagttgtgtttacactttgatgatagttgaaaatgaatgtatatattggaaatgtctgtaagtctgccctgcctgtaacttatgacctcttatattgcgtttcttaaatacagtgttctcactgtgactttattaacactccatgcttggatcagcgtacatctggcagttacaaatcaaactaatgttccttacatcattagtttatagtttagtcattgtaatctttaagttaaattattgcaatcttaaaccaaaatgagttcttttaacgttgctacttaaaactagtaaaatcgtaaagggctcttgattgcactgttcagcaaaggataagagatggactggttggtccggtgtggaaacaaagtgaaggacctcagatcttgtgagcgttttgacttcttgttagctcctttattggctgtagtgcatgataataattgagtttccaacgtcttgcacaatgctttctttaatgctgtggttttcagggtttatacaacttaaagagaattgttgcttcatggactttaaggatttcggacagtttttaagctatcaacaaatgaacagaaggggttgtctgcatattgtgaactgtactctagtgaagactagtgggtcccaccagaaaccaaaagtgtttggggtacaatatatgttcgggtgtcagggtacatggtgaggccctgccataggtagagagcattgtaggagtagattctgggtcagggttccactaaagaactgtgcactggatgtctgtgattaagatcatctcctttaaggcaacttatccttatgtgatcacgtctttctcctccccagcatcaggagggtactgttagagcagaaaccctgctctatctactttagcactcgatcgaagcctgccattactatcgtgacagcaaagtccctctgaaaccatctgccatccttctgctggggttgggatggacttcctgctccccacctcgtgtagacttttaaaataccgcagtagtttctgatcacactatgaaaggagctaatgccaaactcagtttgcaagaggcacaacatgtgactacctactttatgttcttttatttcaggaaacaaagtagcagaggagagagtactcccactactgctcatgcccaatagtgttcaccctgagatcttaaataccttaggcctaagcttcaagaatgtccacaggtcagatttagcatctgggcctctatggcttgtgctgatgatgaagaattctcttttgggatctttgcttgataggattaatttgtaccttaaaattatataagaagaaaatggttgcatttatacagctattctaagttgtttataaacgtgagaggttagaaaattttgaggaggaccattaacatttaacaagggtatttaagatgattctggaagatggaggggaaatgattctaaaagaaacttctgtacattggatgcatatcacactgtcatacactgggatcgttaagaattaccaaattctatgtg

SEQ ID NO: 30922 - DNA, 2061 bp, Mus musculus
atattaataccttgaagataacatggaagaagctagagtgagtagttagagggaaaggggaagcctgtacagtaaactgccctctggagatagtgcgagctcctcacacaaacacacccacttgcacttgcgcgcgcgcgcgcgcacgcgcgcacacacacacacacacacacacacacacacacacacacacacacacgcacactgcctcctggaaggttggctccctacgactctggtctgtaagcacctgggtctggatcctccgagtagggggcagaagaaggtccatgcttccctgccgctgcccaaccccaccccaccccaccccccgaccgttagggatccagcgatgtgcaagacagtgtacaagcagtaagagaagaagccacaaattctcagttctgtgcatgccacttgtgtaggtgtcagagctgtgtgtgtgaatatatccccacctgacacacacacatatataccttaagcacgtggcacaaaaatatactcaccgtggactgcagtgatgtcagttaggaccctgggctgtaatagtggcaacaccgccactttttatgttgtgtatacattgaatggctcatagatttttaagagatttttttttttttaatgtaagtatcctactaaatgcacttatgcttctaaatgtttatatattttggtaaaattgatttactagatctttagtattgtattttagtaaggtaaattttcctcagatatttgattaatgctttgatgtcaagattgcacattttttagttagaactcagaagctattatgcagcttggggcattttcaactgcaggatgcccgcagttttcttgactaaattgcactgtgtgttctcgtgtatcagctcccacctcagtagccatgatgcttctgtcactaactgctggctctctggtggcagtattctgtcgtgtgaccactatgtacttcctaagccatccgcttgtaatggcattttggttgccaccaaaaataacacaaaggggcctgagtatacgctgttgcaagctgtatacttcatttccttcggctggtttatgcacgcacacaagtttcttgttaaagattgaagcactcagccatgaaataacaattggccagaaataccctaaattgcctttaccaaaagaaaaaaaaaaaaaaaaaaaaaagcaggaagcgatgcccaggccagatagctctttccagcagcatcaggttcaatcggtgaataacaagcagcgctcagcgtacatacgtgggctctcctcaggattatttaatgtcataactactgcttttgtattttttaatgatgttttgatgaaaccacttctaagtctgctatagattactgacaaggccagacagctgaaaacgacaggggaaggaagttccgttctactgtaagacttgacttatgttcgcccttccttatatactgctagaaaggaaagtgctttgtaaagcattaaagtctggaaagtatgcacagcacaggacctgaactttttaatttgtacgttttgctgtctggtcatttgcatgggagaaacagcagtgccacacctaatttgttctctggcgcttcgttagtgtgtgctgtttccaatggcattctttacttttcagttttcagaggcattcaaagcaaactctgctgtcagtggaccattgttttccgaccatctaaaaaatacctgtgattaaacttaacttgttagtgtaaataaatctcttgccaatgagtattattgttgttagataatgaatgcaataaaggaaatacagaggtctctcggagtccatgtttcttttctctctctttctttttttttctcttccatttctaccttcaactaaaacaagccctgactgggtaaacctgcactgactgtcaaaacatctctctccatcaagagcaaagtgcacatttttcatggaaatgaaactaaaaataagttctaactctggcaaagtgtaaattggcagctagaattacacttgaaagcacaattatggaactgggcatgaagctaaagagctga

SEQ ID NO: 30923 - DNA, 2666 bp, Mus musculus
ttggggttttgttgtgcagggtagctggatgtgtgagggaaagcagcgtcctgtggctgccagcagccaggaaaccatgaagaggaaacacataataagcttcgcctctgaaaaatcagacctaataacttcatgaggttctgatttcaacaggaaagcaaaaaaataaaaataaaataaaaaataaaaaattttttgaaaaccactttctctgtttgttctcaaccacttgaaatagtgttacggataaataattgcttagaaatatttatgtatttaagaatagaaacaacaaatgaaggttcggggcaggggggttggtcgctgcagacagtactgtcacgttgtgctctccagaggacagcaaaataggcattttattgcactggctgcttaactttctttccacggccagcagttcaaagcacagttatttttatatagtgagaatgtgagtggactgacatggtatcgtgtctcggctccaggtatgcctgcggcatctttagtgacccctgctgatgttatcaagactagattacaggtggctgcccgggctggccaaaccacttacaacggtgtgaccgactgcttcagaaagatacttcgagaagagggccccaaagcattgtggaaaggagttgctggtacggaagtaattggttcttaactaatctttggtatcagggaaatttcttaagactctaatggtgtctgttattccccccttggtcgtagctcgtgtcttccgctcctcgccccagtttggtgtcaccttgcttacgtatgaattgctgcagcggtggttctatgtcgattttggaggcgtgtaagtgtcatggcgaattcactgctaaatgtccacagcctctaatactcagttctcattgagaagtgcagggggctgactgcctcctgtgacaacgtccacaaggtcgtttcccagggagcacaccattgactagaattcagtcactgctccatgttgcatggttgtattggtgtctactggtattttttaaagtcacttgacactccctttattctcttcataggaagcccgtgggatctgagccggttcctaaatcccggattactctgcccgctcccaatcctgaccacgtagggggctacaaactggccgttgccacattcgcagggattgagaacaaatttggactttacctacctctctttaagccatcagcatctacctcaaaagtgactgctggggactcctagagtgactgacctggatgtgcctgtaaaatgattggaaccacaataagcctcatctgggtctgaggcctggctccgtcccttccacatctgtcccatttaaattcaggtcaatgcttcctatattaaatgcaatcattcatttttctggatgtttttgtagcaagatcatggggaattattcctaattatcctttggcactttgcccacaacctgtgtttgtatcttttaaatactgggatttggtcaatactaacttgatgtggagtaagtctgaagggaaattaaggaggtctcctacctggatgatggtctcactaatgctactgaaaggcggccatggtttccaaaagacttctgagtatgtttaaagtagtagaaagcaaagtatatatttataaaaatgaaaaacactggaaaggaaaaaaaaacccaaatatctagcctggactcaaattttaaacatgcacaaatttggcctctggattatattatgaaggttttatgtgaaacatgttttttcataatgaaaaccacattcaggatgtttagcaatcatattctcttgctatagcaagtctactagggaaaagtctcgaatgctaaggaagtgctttgggccgttttattatagagacagaagaaacacaattctgctcctgggtgtactgatttgaaataaatatgtatatgatgaacacatgctgattccaattttaacagacactgtaagaataacagacacccctttttgctggtaccaccctcctcgagtccccatggttggcacccttttgccttaaaaatcaactttctcttgaatcatgtcagacagatatgctctaagtttataattgatttggggtgccttgtatcatggtcagaggcttgtgtgtttgtgaagggaaaaataaactatttttaaagctattgattgcttgctcttgtgtgtttccatgataaatgtcaaaaatattgtcattagtggactctgacaactcttcatgccatgtttggggacattgtgttcccattgaagctggctttcggagtaatgcatgggctccttttcctgtctcagaatgagtaggggaacatatatctcatcactctgagtaaagaaagaactactggacagatacactcacccgaaccatcattttgttgttgttttttaagatttatttattttatttatatgagtacactgtatctgtcttcagacacatcagcagagggcatcagatcccattacagatggttgtgatgagaattgaactcaggacctctgaaagaacagttagtgttcttaactgctgagccatctctccagccaccaaaagaaggcatcaaatcacagtacagatggttgtgagccaccatgtagttgctgggaattgaactcaggacttctggaagaacagtc

SEQ ID NO: 30924 - DNA, 1149 bp, Mus musculus
agtatgagtgccttataaatccagcgtttctaaacacagtacatccagggtctcttctctcatgttcatagccacatggttttaaggggtttgtgtgtgtgtgtgtgtgtgtgttactaagaaaagttttttaactagtttcttataatcatcagcaattgtttctttctaatgttatagatgttggaagtaggttataacaaattcaagagattagtgaaaaagaagcagcctttgatacactaatacactgcagaatgggactcagcacagagaatggctaacacatggacttggtattttgaaagtcttccaaacttgagaagaccctgtcctcttctcctacaggctgggactaacgaataatctgggccttgaaactgcccctttttctaatcacaggctcacttgtatagtcttggagtccccagagaagctgatgccagctgccagccaggggagagaggcccggaagctcccacttatctctaactgatggactatgcgcaccatagtggaaacagtctgtagcatattagcccttacagagatgtgagaagtgaggcggtggattcctgcgtgggcttggcacgcctttgggagtgtatgtaaaagacaaattcttagaagtgaaattgtagatcactttgtgtaaacatttcagtattagtggatttaatcaattgcacctatttatcgacacctatgagaataattacccatgtgtctgcttagcttacagaatatctctttttatgtatctctgtcctgcatgaagaaaacagttgtgtaggtattcatttgttttttgagagcacctcagttgagaagggaacacgttgtcactttgcatccaccttagtggccgttcccacgttcccatctctgcttttatcttttaactggacctctgtaggagcctcctgagggctttctgtgactcttggcttttctgaaacccagcgtctgaagtaatgtaaataaaattaatccactctctgagcacacatgtgttattgtttatggaagctttatttataattgcccaaacctagaagcaatgaagatgtcccttggtaaatgagtggatgaacgtactgtgatatattggacaatggaaaaaatgctaaaaacaaaacaaacaaacaa

SEQ ID NO: 30925 - DNA, 1172 bp, Mus musculus
ctggagtcttgtgctttcgaaggccttgtgcacaccacttagagttctctctgatttcagggtgagcggagcccacagcagtctccttcaactcaatgggttcttttgttctccacaaaactagcatctctgtcctgaaagctggaatctaaaagtggattttgattcacataagtctctaactgcattttgattctttttaaaaatttagttacgtgtgtgtgtgtgtgtgtgtgtgtgtgtgtgtgtatgtgtgtgttgagaaagtcacagaataacttgtcgggagttaactctctttccaccacatgagttccaagaattgaactcaggtcctcaggcttggtgacaagtacctttaccgatttagccatcttactgatggaccatctgttttaattggtagatagaactgagttatctgagaccatcaatccatggtgatgaatatcccaaacttggttcaaagaaaattttcttcttgccttgatcccttaacacgtttcagcttttgatgctaagttttcccttttctctttaggctggaggctcccaagtgattttcacaaatcctttagagattgtgaaaatccgcttacaagtggccggagagatcaccactggcccccgagtcagcgccctgtcggtggtacgagacctggggttctttggcatctacaaggtaacttttgttttactgatttgcttaattattgttattttaagaagataagagttaagttctgctagaacccatagggcactatcatgtcaacttggagacccctcctaccatctgccagcaaattgcccttagagacaaaggctcagaaggactgtgatgggagtggcttctgatagagtctgtgagttcgagtctctttagtggcactgacctcagccactggctgcagggtttttattattttgtttgtttgtttgtttttctttgtttgtttttttggacttatattgatataagaacttgattctctttgtgtgtgtgtgtgtgtgtgtgtgtgtgtgtgtgtgtgttacatgggttggtgggtacacacatgtttgaatgtgtgaacacatgctggaatacccaaaggtcaacactgagtgtcttcttctactttctattgttttatgacatgtgttcctcactgcatctggaacccactgac

SEQ ID NO: 30926 - DNA, 1147 bp, Mus musculus
ttctctttacagacataattgttctaattgtaccttttctctcttacccaatctgctaaaaccctaattgttacccttggcttgggccccttttttccaaattagcaccaaacacagccctttgttatctaagcctctttccaagtcttggatgctcccctacagttctgagttatctgtttacatgccctctcttcattcagatttaactgcaccacatccactgtacattccttcttcaggatggtggtcaggggccagtccttctttccagaactttttttcccatgatttggctcagtggtttcattttccgccattctctttcatacccttctgttctatctaaatcggtggttgagactctttggggagttgcataccagatatcctaaatatcaggtacttacagtatgcttcatgacagtagcaaaattaaagtgatgaagtagcaaaggcaagaagatcacttaagattgaagtcagcatagtttataaagcaagttccagaccagccaggacttcatagcaagacctaatctttctccttctcacttaacaaaaaaacaaacacacaatggtaagactgtttttagaagctccatctccaaatacacgcactcgctgaagcataggtgcttaggtatctcaacttggtcatagacatctgtgacctttgataaactagtttaacttgtataattacctttttgtgcttaccatgatgtaaagatacacagtacatgcaaaacaggatccaagtcacccatattaactggatgtcctttattatttctgctcttattttaagttctccaagaacaggaatgttttcttgcttctgcaaaatctccagggtgaactttgcccttttgggggtgaagcaaggaagtttgctccaaagaaggttgacctcaaattttctatacagcgtaggaattcttcgtcttcttgcctgcctccatctcccacatgctgaggttacagatagtgtgctcccacaccaagctcttaagcacaactttgaacatcagtgtttataaaacatttagagaataattgtgtgaatagatattcaggagcagaaataagtgtatcagttagttttctgttgcagtgataaaacaccatcaccaaatacctcatg

SEQ ID NO: 30927 - DNA, 1170 bp, Mus musculus
gtcctctccttttgccttactgtaggtgcttcctctcttcctgttcctttttcgttctctccttctctcccaccatcgctcttgtcattttcaagagatctttctatttgatgtttgtatttctcataacttctctgtattttgtgtgtctctcctcttgccacataatagacaagccttctactcattaacatattccaatgatctcagataatacatgacaacttgccatcaggtgcttattaaatatttgataaaggaaacagtttttaagtcaaaactgctcttcaaagtgattttcattgccagaccagacgatataggcctgtaattgtagcttcttgcttgaggaaggagaattagttgctgggctaagacttacctggcctacagagtgagttcaagaccaggatgaataacttggtgagactctgtctcaaaattaaaaagtaaaaagaacattgggaaatagcccccgtggtagtgcactcacctgccacactcaggacctaggttcagttctcagtacgagaactgaaagtgatcttgttaaatatgaaaaactccagtgacgttttggtggcatgagtgtcttctcattgctcttggccgtgtgccttcctgtccaccattgttctccattgtccctacaacatgctccccacgttctccaggtcaagatgagcagcaagcacatggttggaccgtccttttacacactgaaagtgttattttcaaaactttgcagaactcatttttaagaattatcataaataataaaaagaatcagaaagccctccttgtctcatgaactcctggtatatgtgacatataccagattttatggcagtaaatgtttcccgtcagccttttggataggactaaatgtaatcatgctctgttcccttgggagatagggaagtgtactggggtctgactgcagcagctcctgaggccctatgccaccttgagagctcttgacattccgaatcctttctgccatactgacgatgggaggttttgtcacagtggcaacatcccacacagatggtttattgttggctcactgtcccacactctcatgggcatcagtccagcatcacttggctcccattttagacctgtgacaaaacagagacttggcagcaaagcttgttcaaaggatgttgg

SEQ ID NO: 30928 - DNA, 1936 bp, Mus musculus
tagctccagaagttttgcactgagtgctgcttttgaaagagccgactccttttttccctgtgcttcactgtcattctccagtaactttaagtaagaatcgcagcatcagagtttaaattcaacttaagtgtatgtcattatagtttcaaaagctcatatttgctttaacagtgagtttgagaacaacattttaataattcttactaatccaagtattaccacttaaaacaaagacaaaaattcaaattaaaaagccagtttgatgaatcaagaatgatgtctccttgataagtttttacactgacatttttatgatcgttctgagaattgaacacttgaaaattggttataatgttatttttcacgtggtgattatatgtctcagtatgatttcagccatgcttagcagcaaacacttttattaataaggaattgatggacttgcaccgagttctcctttttgtatttgctttatatgagactgagagtccagcgagtgatattttaagtgaccgtatgcatttctgttcttttctcggcttgcttgcttcctgcttatggcacgcgtgaagcagaaggcctcgggtgatgctgctcggccctttcttctgcagctcgcagagtcagcctacaggtttggactgggttctattgctggaggtcagtcatggctaagtgtcactgtcactgttccttcggtcttctctctcattctccaccttctgctgaccgtggttgttccccaagtcagttatcaacctgcctgtatctgttaggtgtggacgagagccaagggggcttttcctaaacgtgggcatgctcggcatcttacaagagatcatttttgctcccttctgtgaggttagccattcttgatatgctattaatttaaactctagtgatatcctcttgtcagaggacattagaataaaaattaaaagtctgcaaaggtagtttggtagatctatgcataaaaaaatacttctgccgggcgtggtggcacacacccttaatcccagcactcgggaggcagaggcagaggcaggcggatttcttagttcaaggccagcctggtctacagagtgagttccaggacagccagggctatacagagaaaccctgtctcgaaaaacaaacaaacaaaaaacaaaacaaaaacccttctgttttcagtcttttctttgatttttatccacctatttctttcactcaaattaccttacttctggctgagctactggtatcccttcatttcagctgtcggagccactgccgtgtatcctatcgatcttgtaaagactcgaatgcagaaccagagatcaaccggctcttttgtgggcgagctcatgtataaaaacagctttgactgctttaagaaggtgctccgctacgaaggcttctttggactgtaccgaggttagtgtggcaccgagcggggcagtgcgacgttcgtgcagatggagtgggagccaagggtttgctttcccatctcagagcctgaaatgaattagagagcctgtgttcaaatggaaatccagcggattctcaattattcatgctaatgggtgtaggctgtaggcatctagggcatggctaatcaaaacagcccatagtctgaaagccatttatattgctccgttgtgtttgatttcttaaaataataaattatttttatacactttttttagtgagtttttgaaaggctccttgtttgtgttgttaaagtattccactccccatctaccagggagaggtaccctaggaacaagacacagcttgcttcagagttttgagtctcctggaatgtcctgtgatctccaatcccgtagtgtcactttccatgatgcagttattcatggtcagccatgttctaaaaatacagactagaaaattccagaaaggagcaactcacgaattgtgagtagtgtactagcct

SEQ ID NO: 30929 - DNA, 1209 bp, Mus musculus
tccaccaatgtaaagtctcgggacttaagtgattatttattgctggtttaagtattaagacaacttttgatattaaggatgcgttagctgcttctcagagtatgtctgcaccaacataatgcagttttgcatgcatgaacaagtgggtgctatcatttctatgtttaaggccttaagatttgctcattagatgaaataaaccaacttataaaacatttccaactgaaatttgaactctgtaaatgactactggtcctgttataatcctacacatgtatttatttagttttccagggcttgtataagtcctggtcatgattatctgcagtcacttttaaaattcacttctagctttttttttttttctaaagtgaaagaaaaatattgtgatttttttttgtatattcattcccctttagttccaaaacagtgattaatatatgtacttttgtaacctcttgccctttctatctttttttttttcatctctctcttgttttcaacttggcaaggctgctggaggcactaggtcccatcaagttagcttctcctattttaatggatttaattcgctccttaacaacatggaactcattaggaagatctacagtactctggctggcaacaggaaagacgtggaggtgactaagggtgagtgagcataacaaaatgtttgtttcaagtgtcttagggagcaggggacagggagtgaagaaggcagtctggagtttatagtagaatttgctatcccattcatactggtaaaattggtgatgtgtgtcctccagaccttgatcagacaaactaaagcaaacaaagcaatgtacactcagtttttgaaaaacagaaaacagcctttgaatgaagtgaagatataggatttgttgaatctttttgttttttacaagaacttaagctaaacggtcagtggacctcaaaaacacatgtgggtcccacaaacctgtattgatgatagcataatatgatccatgaacttgaagaagaaattatcagcatttcaataggattcacaaaaaaaaaaaaaaaaacctagaaaaataacttgggtatctgaaatgtcagtgtagtttgaatcccgtccggtgtcatttgttagagcattcacatggctttactcccagtggtggttggaatggagttctgcatcctttgaacaagtgggagaaagagctgggatgacttcatgat

SEQ ID NO: 30930 - DNA, 1193 bp, Mus musculus
catccctggctccgtgcctctctcggcctgcaggtatgaatgtaaagtctctcagctactgccctgctgccatgactgtctggactgtctgttttagattaaccctctaaagctggaaacaagcctctaattaaatgctttttttttttttttaaataagagttgccttggtgcctcttcatagcattagaacagtaacttagacacagagctttctcatatagcccaggttgacatcagagtcacaatgtgtctgtgacaatctctcaacttgatctccccacccctcctcccaagggctgagatcacagacctgtgccaccatgcctggctctgttcctgctgagtgtaagctttaaaatgcagggtactttattaactttatattcactgctctgaaaaatgttcttttctttcaaaggaaaatgtagtttagggggacgcatttaaacaggcaggtggggcctgtgaaatcacgatgtaggcctatttcttttgtttgatttaaaaatgagcagtcatttgcagtaagaaagagacataaattaactgtcttaccttttctaaccgtaggaaatacagttggagcacgcgaagcaagcctttgtgcaacgagacaatgccaagacaggcaaagtctcagccattgacttccgggacatcatggtcaccatccgtccccatgtcctgacgccttttgttgaggaatgtctagtagctgtaagttgtgcattgtcctaatgaagtagtttattctccctaatttgtgccaagttaacgggaataataaagagcagtccttgtttaacaccctaacgtgatcatgtatattatcacccttgcaaaccaaaatatatcttggttcattttagtgggtaggttcattgattgtctgcattgtgtgtttcagggatgtgttcagtggtttcttactgtccctggaggcttgtaccggggtcctatcaaatgctaaagtctgcaggccctcagatcatttcttcacagtgacatctctttggatataatgtgcatgaattttctcttactttaaatcatggctagattattcgtaatatctagtgcagtatttttaagtctttgttttgctgtgctggtcagggaataatgccaacagaagacatctgtgcatattcagtgcagatgtaatccccgcccaaaatctttgcaaaatt

SEQ ID NO: 30931 - DNA, 1219 bp, Mus musculus
gagtctgttctcactgaatcggtatcgtactgcattgtattggtccctgcatttggatttgtctttcctgtgtactggtacagaagttccgagagtcccgtgacctgcctgatccagctgcagctccctgtgtagcatccctacctcatgtgtgctcaggagctgctacaatgaatggggacttatgaggtccttgtgtgtggtgtataaggctgtttataaggaacgggactgctcctgggttttgccattgctttataaagtatctaagctccagtcacagaacccaacaatgtaccgagggaaaactgaggcctgaggcttggaggatagttaggttagaactcccaggcccgtcagggtttacccttgggctcccagctccccttcattgatttcctcacagtggatgcccaagcaagcactgcgtgctgctgctagctgtgtgaagtgggaatccacggttctaccagggcatctgattttgtgactttagtgtatgattgtacagttttattttctataggggactaactttgtatatttgcttattttctgttgcaggttaatatccttccaagagtttgtagcctttgagtctgtcctgtgtgctccggatgccttgtttatggtggcgttccagctgtttgacaaagctggcaaaggagaggttacttttggtaaggaaggtggttggggagcattgctttgttttaggaatgaaaaacacccacattctcattctctccctctccctctccctctccctccctccctccctcccccactctctaatagactttcccccttcacataatatatcctgattatggtttcccctttacccatccagtttcccccacctcccttcacatccagacctactccctttttctgtctcaatagagaacaaacaggcttctaagggacaaaaataaacgataatataaaaataacacctcatatagaagacctcaagggaagactcaagagagaaaaagccactcaatcatgcccctgatatatactaaacttgatatcacactacactagccctgattatctatatctatatctatatctatatctatatctatatctatatctatatctatatctatatctatatctatatctatacacacacacatatatatacatacattcacacacatatatgtacacacacacatacacacacacacacacacacacacac

SEQ ID NO: 30932 - DNA, 1216 bp, Mus musculus
tctacagcgtgagttacaggacagccacggctacagagagaaaccctgtctcaaagaccaaaaaaaaaaaaaaaaaaaaaaaaaaggaaagctcatagttgtaaggaattttttagagtcagtgaccagtttatgaaaaacatctgtttcttcttccagtggtacctttggtctgatccagagatctactaggctgtgacactactgcctgtgtcctacttggacatggtgttgttttatagctgaggctgccctcacactcagcaatcctcttgcctcagcctcatgctgggattacaggagtgtgccatcatatccagtgagctgtatttaccatttttcctttataaagtgtgactttttttgtttacattggtgatagctgtccatgtgtgagccaaatgttttcagggtttggtttctctccctccctccctccctccctccctccctccctccctccctccctccctccctccctcccctttctcccttcttttctttgctttcgtttgattgtggtttgttttgttttggttttctttgtttttgtttgtctgcttctccatacagggctgctctggcactctctctgtagaccaggctggcattgaactcaggtatcttcctgcctctgctgaacttaaaggtgtgccccacctctccctaccacgcccctaaccatccacccttggcattgtttggttccttatttaaggaatttaaataaaagcccacagagattgcaaagtagtaaagaaactgtatttaaagcaaagcagtagaaatgatcagaatatacttcaagagagaatacatacacttcaaagagtcaagaatgaaggtactcaaggtccttggctactgaaacttttttgtggggtttgatagaagaaggagttgcgttattaaggggctgtagtgggtgtgcctctctgtttcttttgatggattaactcatgtaattctgctgcacatatcttcttctcacaatgcatctgattttaatcacatgcatgcccagtcatgcataggcataagatggtaaacaggggattctaaaagttcacttgaggacagagcattaccttactgcttatgcttcccaaactagtctaggctaggtcagactttccattctattatgtggatacattagggatatatctgaatagaaactatgtaagtttctattgttgattgtttataggggagg

SEQ ID NO: 30933 - DNA, 1439 bp, Mus musculus
caattttggtcgaggagggaacttcagtggtcgtggtggctttggtggcagccatggtggtggtggatatggtggcagtggggatggctataatggatttggcgatgacagaagcaattttggaggtggtggaagctacagtgattttggcaattacaacaatcaatcttccaaatttgggccgatgaggggaggaaactttggaggcaggagctctgacccttatggtggtggaggccagtactttgctaaaccacggaaccaaggtggctatggcggttccagcagcagcagtagctatggcagtggcaggaggttctaattacgtacatccaggaaacaaagcttagcaggagaggagagccagagaagtgacagggaagctacaggttacaacagatttgtgaactcagccaagcacagtggtggcagggcctagctgctacaaagaagacatgttttagacaatactcatgtgtgtgggcaaaaactccaggactgtatttgtgactaattgtataacaggttattttagtttctgttctgtggaaagtgtaaagcattccaacaaaaggttttactgtagacctttttaacccatgctgctgactgctaaatgtaatagtctgatcataacgctgaataaatgtgtcttttttttttttaaatgtgctgtgtaaagttagtctattctgaagccatcttggtaaacttccccaacagtgtgaagttagaattccttcagggtggtgccaagttccatttggaatttatttatggttgcttcggtggagaagccattgtcttcaaaaaccttgatgttgttaaactgccagttactgttgtaacttttaatgagtttcaccattgaaaggtcacaatttggttataaaatggttgttggcacaccctatgcaatatcaaaattgaataacggtatcagataaaataacagatgggaatgaagcttgtgtatccattatcatgtatactcaataaacgatttaattctcttgaaaaaaattcagatgacagcagatgctggcaaggatgtggagaaagaggaatactcctccattgctggtgggattgcaagcttgtacaacaactctggaagtcagtctggtggttcctcagaaaattggacatagtgctactggaagatatagcaataatacctctctgggcatatacccagaagatgttccaactggtaataaggacacatgctccattatgttcatagcagccttatttataatagccagaagctagaaagaacccagatgtccctcagcagaaaaatggatacagaaaatgtggtatatttacacaatggagtactactcagctattaaaaacaatgggatttatgaaattcttggacaaatggatgtatctggaggatatcatcctgagtgaggttacccaatcacaaa

SEQ ID NO: 30934 - DNA, 1143 bp, Mus musculus
gaagatttcgtgcagtgtattttgatcacattcatcctttccaccaggttcttcccagatttacttcttccagaccctacccagctctgtgtcttccccacacccatcaagtccactgtgtgcttcctatatattctgactgtttggccttcccctggagcatggtcagcttactctaggctcttaagaaaactgacacttactctcaaagcagcaatcagttgcagtagctcctcagctaggcctagggacccatatccacatcccgtctggatgttggattggacgaggtgagtttccttgaggctggtgtgtactgacaggatcacttgaattcattgtgcgcagctgccctgttatgtatggaggggatgagaacaagagaacaaatgttgcagatttgcaggggagattacaactttcttagataaattgtttgtggttttgttttatttttgacttggggggtacataatggcaagcttatgtttgtggaaataacctacgagaaatacttagacatctctttccatcttcagactgggctggcttagatgaagatgaagatgcacatgtctgggaggataattgggatgatgacaatgtagaagatgacttctctaaccagttacggtaggttctcagccacatttttattgtagttcagtattaattttaaacatggaatatccagcttccatagatagttgttttcttaaaacttttggggtaattctttcattatgtcagacatactacctttggattttcaaacaggaatatttcaggaaattgcatgcaacttctattccttttaaaaaggtagttaaatagaagcatatttactatttttcatgaactacatcttgtcaacatgtattttcaaccagtgttgaataactgagcaaatattagaatcatagaactaattcaggaattccataagtgattgtcgtttttggagattggagttacagtagtctactttattgtatgaaacacaagttcacctgctttgcctgttctggacatctcatataaatgctattataaaagatatgtccttgtgtgtctagcttcttctacttagcataatctttcccaaattcagaaacactgtagtatatagcagtactttattct

SEQ ID NO: 30935 - DNA, 1177 bp, Mus musculus
gccatataccttttaaaaagttcttttaaatttcatagatagaaatagagagacagacagacagacagatgtgtgtgtatacatacatatatatcacatatatacacatatgtatatacatatatcatatatacatatacatatatatacatatctatatacatatatacacatgtgtatacgagagtgtttgtgagtgtgtatgtgaatgtatatatgtgtgaaagagtgtgtaatattgtgtgaatgtgtgtgtgtgttcatgtacacacatgtgcaagtgtgcactcatgccaccatgggcctgtggaaatcaaagaatcactgggggtggggggttggttctttcctttcaccatgtgggtcatggggattggactcaggtcgtcaagcttgtcaacaagtgcctttactagttgagtcatctgaactttgtttttgaatacacagtctcacacttacctggcaggagagataccatgatcacaaaggtggttttcccagtacaaggcttatccattgcactctggatgtgctgacccctgtgatttccccaaattcgggaaacttgactgcataatttgtggtagtgggggactgcgttcgcattctcccctaaaaactaaagaagaagaggaggaggaggaggaagaggaagaggagaagaagaaagagaaggagaagaggaggaggaggaaaaagggaagaggaagaggaagaggaagaggaagaggaagagaaaaaagaaggctgcagtttctaatgtgcctggaacttactgagtgtactaaactggcaggtgcacagccctagagatcagcctctatctgttttcccctgtggtgggattataagcaaattccaccacactcagctttccataatcttgagctctaaggaggaaattcaggtcctttactatggcttctcttctgcccaagacataggacatttgaattttataaacactcagagagaaataagtgaccaagagtagaatacatattccgagagagaacagcaagtcaagctaagccagttgccaccgcacccctccagacattaaaaccagtacagttcacagaaaccccatatttggagttcaatgctttggggtttctctcttgaaattcttacaatatcatcttaatttggggtgtcatgagtgaggttgagt

SEQ ID NO: 30936 - DNA, 1356 bp, Mus musculus
cacctcagtcaagaactcctggttcaagattttgcaggactatgttgaacatcaggtctgtctttaaagatatatattctggaacaataatagtttaatagagagctgggatctctgtttgcctttcgtttgaatagttgtatctaaaggagagtcagagttcctgcaaggaatatgtcttttataagctttatgtaataattaaggaaaatgaaggactataaagtagtattgatgatcaaaagaaaagggatagagggaagacttccaattcattgctgatcattttgcacgtctgggtacctgatgagtacaaatgagtcaaacactgagcctctaagtattaatatgcatgagagcttttaaaaagtcactgtctgtttattatggcttgctttggcactttctaaataatgagtgacgtaaagggtcttgttgcttcatagcatgccttaacttttttttggtcaccatcagagcaaatacacatcgaaatgttttatgttcctactttatcttataggttgatgatgagatgatgtctgcagcctcccagaagtttcccttcaatactcccaaaactaaggaaggctacttctaccgtcagatctttgaacgccattacccaggccgggctgattggctgactcattattggatgcctaagtggatcaatgctactgacccttctgcccgcactctgacccattataagtcagctgccaaagcttaggcactctctacactcttgtgtaaaagtaaatgtttcttccggctctgaaggtcgagacagcgacacaatcagaaagaatgagactcagccatcagtcacccaggcttacttaggcatgaaaagaaataaaagtttcacatctgaaatgcctcctggttgtgggtaccagtgcagcctctttcaaggtagccagagaccgagtggctcttgctgtattgccactgtctggatgacaaagctaaaggggagagcatgtggtcgttgcatcttagttctgcctacattcctaacagctggctaggctgactgggatgtgagtcctttgtgggattggtgacagttctgtttataggacagacattcaggtttcgtttttttgttttgttttgtttttgtttgtttgtttgtttgtttgtttgtttttgttttttatattatactaatgttcccttgaagtcttgtggagctgggggtaaacttctcaaatacagggtcagttgctaatgtttggtttttgtaggtctgtatggaattgttaacactgatacaaaactgaaccttatgaaacctagctcacacagcctttttccataaaacttcatttcgaagagcaggtggtgggg

SEQ ID NO: 30937 - DNA, 1377 bp, Mus musculus
gcatcaggagtggcacatgagaaaggcatctcatagtgatcccaggcattggagacaagagatgggctctgtcctaaataattgaatcaggagaaatcatttgatgcttgaggagcaaggaaccccaaccacaccttatcttccacttctccaccatggatcacaccaccacatggagaccaaactgcatccaaagcattgcaaggccacgccttactctactgtgttagtacacatgccgtggtattcaggcatttgagtggttcaatccagcaaacatttaacatagaaagtcttgttctaagaacatagctttgcaacctgtttgtaaaacatgacagtggattgcaggctattttattgtttaggttggattgacagcttgtagatgacttacaaatttccgatccttttggaagctgctttaatacttatactaactcagtccaacaagacactccagcctactgttgcttctgaagacaacaatgacatcgccattgatttctctttcatttaaggcatgtatttaatttccaagtatattcggaagaacacagacagcgtggtgatcttctccggagaggggtcagatgaacttacacagggctatatatatttccacaaggtaagcgctctgaactgaaacgatggccaggctaagttaggaagtcagaatcacttgaccctttctattctgtccttatgatttgttgtagttttagagtgtatttgtgtttgtgtttaagaattgatgctatctatctgtctgtctgtccgtccgtccgtctgtctatctatatatttataggagaaagaagacttaatagtatcagatactttttattcttaaacacgagaattgcttttgtattttatctgtctgactgtctgtctattgatttttttttttcaagacagggtctcattaagtagctctggttgttgagaaactcactttatagaccagactggcctctgcttcccaagtgctgggatgcaaggcactgtgtctgttgcccagggcactcatttaatttgttttcacactaagcacttcggaggatggatgggtcggtcttgtaaaacattgctggcctctgaagtcatttactcacatcctataccctcctcttaagctttctgccttactcattctttatttcatatgtaagaggggaaaatgaaggctgcctgtgtgccaaaggaaggcactcaccttcgtttgttaaataggctccttcccctgagaaggccgaggaggagagtgagagactgctgaaggaactctacctgtttgatgttctccgggccgaccgcactactgctgcacacgggtaactttaaaatcagttgtaaaaccaacaagggagaagg

SEQ ID NO: 30938 - DNA, 1131 bp, Mus musculus
ctttaaaaagcttttttctttgaaaactttataaatgtctaaaagacaggtttcagaaaattcagctaggtaaaggaatgggatgatgaagactttcattttaataaaggtatcagggcctttcaggtgggagagaggattgtctcagaggatgttattgtaacgacgagacatacactagttaaaaggtgatgtttggaatttttatcttgctatgttaggaaattatctcgtaaggaatcatcttcctattgcatcaaatgactgcaaatccatgctgttttgtgttctgtctccatgtcattcttgcttcttcaggagagatgctagggtatggggtaattatttcccctcccaccttttttgtataatggatatgcgtttgtacttaagggggaaagtatgggttagagtgtactagctcactgcacaggctgcagagaagcacctaattgcatacgttgctgttttccatttataggccttgtttccttaaaacactccaccactcccttcttaaaagtggagcccttccttcctggacactatgaagttttggatttaaaaccaaatggcaaagttgcgtctgtggaaatggtcaaataccatcactgtacggatgaaccattgcatgccatctatgacagcgtggagaaactcttcccaggtgactagtgcccatgaccaaaccccagaactctagctcacccctgacaactcagggccatttgcgccgttttcaatgatgttggttttaagatgttcctctttgatttggaggtggagcgatctccgtgagtgagggagagccatcacaatgatgtagtagactgcttgcctcatctcagtcagcttagcctcagcttgtttgtggcggttccatttactttctgtgttgttaggctttgacctagagaccgtgaagaacaatctgcgtatcctttttgacaacgctatcaagaaacgcttgatgacagaccggaggattggctgccttttatcaggtgaagtcactttaaaaaataaaaacatcttactggtgtttaaatgaaatgatttgtagctggcactgagctttgaatgttaaaggcctactatatagtttcatgtttcattttctatagacgtgtt

SEQ ID NO: 30939 - DNA, 1145 bp, Mus musculus
tattatatgtagataatattctatttcacaaaaagcactaggtcacctgcaggtttttgtcttggggctggggtcctaaagaaaggatgacttcccatgtaaatgtgtatgtgtaactacagagtgtagactctgggctgcaatatgtacttgaatttcttcatgtgtcacagctctgatgcctgacccttgtatcctgtttatcagaacacagtctttatcgtcatgggtttagcctttatggtgaaaatttttcagaattgtgagtttagacaaggtagatttgaataatgccatacttttttttttctttctccttcttcttcttttttttaaatcactaatgcacacgagctgatgctagaacacagatactgggtcagcatccataaggatactaactttttgtttgctctgcttccttaagctacagcaacgttttgaatttgaatatcagaccaatgtggatggtgagattatcctccacctctatgacaaaggaggcatcgagaaaaccatctgtatgctggacggggtgtttgcattcatcttactggacactgccaataagaaagtatttctgggcagagacacctatggagtcaggcccttgtttaaagccatgacagaagatgggtttctggctgtgtgttcagaagctaaaggtaataatggagtttaactatttttggtttgtgtttcttcctggatcatagtgagaatcccagagaggtgtcaatcaaaaactttaaaatgatgaaagatgaatactcagtatgaataggatttgaaatcttagtcaatcctttcctctttcatgtgtgcgtgtgtgttgtatacacgtgtgctcatacatacgcacacgtagagaccagagacttaacattagacatggtaattttattttatttaatccgccttcctctgcctcctgagtaccaggattaaagatatgcaccatcgtgccagtctccattttaattcttgacacggtctctttgcacttagaactcactcactcacgttcctgatttagtggctgagctccaggtctccacctgccttcttcgtcctgccccacctatcctagaaataaagatgcaggatgctgctaccaggttctccatggggcctggggattaaat

SEQ ID NO: 30940 - DNA, 1230 bp, Mus musculus
gacatgcctaaggatgtattatactagtgtgtgtgtctctctgtgtatacacatgggttaatattacaaaatggtgcccacgagttgctgtttattccctttgtatttgacctggaaatagagagatggcatttaattatagaggcttaagaagaggctgtacgaacatggagaatctacctttggggtgttttgaggttctcacctggagtagctggggctggtatcccacctagcttggagccagctactcctgctattgctctttggagcatcctgggttgcagctgtgacctggatgttgctgggcgtaacccccaccaaaaatcctaaggtgggagaaatgtgagctttggctgggtgcagggtttatggttggatataaaagtcatttgtatttcttaatatttgtaagcaaatgaaatcactccccttgtgcctacccacctaatgggacattgcagtagataaagctggtttgtgtccaacatttggagagggttgtgtaggtttcaagaatccagagttgcttatactcaatgtgagaccctgtgcttctctctgtagagtgcctgcagtccgcctgtagcatgtgtggcatctgggccctcttcggcagcgatgactgcctttccgtgcagtgtctgagtgcgatgaagatcgcgcacagggggccagatgcatttcgctttgagaatgtcaatggatacaccaactgctgctttggctttcaccgcttggctgtggttgacccgctgtttggaatgcagccgataagagtgaggaaatacccttatttgtggctctgttacaatggtgaaatctacaaccacaaggcggtaagcagagtgaagctggggatggctggctggctataactcaccttcagacctatggttatgatgttcatattttgtgtcacgcttttttactttgtatctttttctatgttctgactcctttgctctggtcttatacagaaaactgacacagaaaggtaaaattagttagattttttttcaagtgattaacatggagatgccaattcaatttttttcctgttatacattttaatattgattagggcagtgttagctgatggagtcctgtcagcgaaaatgtcaggcctgtgctccattgcaggttacgctaacaggagacagacaaaaaaatcactgtaaattgaactttcggaaagcaaatgcagaagtggtgcacataggaaagcgg

SEQ ID NO: 30941 - DNA, 1759 bp, Mus musculus
tatttgaacttaatgttatcaacttgatggagactttgtgaagaagttaaccttggcacaacagtttcttaggacaaacatttctttttattgtacaatgaatttgtaggcactattggttcaagagtgcttttaatctctgcagggagattacctggggttcttcttagctgctcagtagtagtagttatttgtgtgtgtgtgtgtctgtgtgtggtgtccttctaggtattcctatgttacttatgtatccacatctatatatcagacactctgttaggaagtactgaagactacaattaaggagtaggagatctattgctgatgggacactggacctggcggcccgacctctgggcttatcctgcctgcagtgtcacagcaccttaaggaacagaagcagaacacctcctggctctcggccccaggatgcacgtttgccttggcctccgccccgcctggcgtcgctcgtcagcactgcgggccacgcccctgcgcacgggttgggtcccagccacatgatgaaacttcccgcacgcgttacagaagcccggcgactctaaggtgggaagcggcctccaaccggtcttgtcactgcgctgcctctgctccaccttctctggccctggccgctagtgctcaggtaagcgggagccgggtgctcagcgcggagcgctctgctcgcctgggaggccggaggatgtgctgtccgcgcgggcacatgtcccgggagttcggatgcggagcgctcgggtccggcgccagaccgatgctgcggtgcagcgcgaggcagggcggggcgggcgcggggcgattgttgcgcacctaggacggagctgccaggaaagctttcatgtgagcgaagtgcagcgcggaggcagggccgctccagacagaaggcgaaggtggccttcatttagacaccataaatatttttttttactgtatgacgtctagatctgggaaatttcagccatccgaaggttttgcctgggactaggtggacgcttgcacaagaccagctgtaattgggagccccaggctagtgtaggggtctcgctctccagcaggacagaggctctaccaagctctagagcgagtgtctctgggtctgtctggatccggatttctgagcactcactcacctcgctgctcaggcccttcctccactccagttccatactcgcagccacgccgggaaaaatctgtttaaggagacaggcaaccaagtacgggaaaaggcaaaggaattggcgtgcttttttttttttttttttttttttcttaattatggatagctatttcacaggtctagtttcagataagataacttttaaaatacacgggcgagtttgatttttcgttgcctgtggcctacgggttttaacagctaactcttcgttgattgatgtcagtactataatattcatttgaagtaagacttgcacaaggccacgggttgattattgaggtcttaaggtgatccagtggagtttagaactatcagttcagtgtacgaaagcggcgctgtccagcggggagcctgtgctctttcatagactgacccctagaaatgctggctagtctgaactgagatgtggtaagagtgtaatgtgtcgatttcgatgattatgaaaaccgaacgcttgatgttttgatgtttgattgcagcctctaaccactaaagtatccctccagcccggttttaataatttaggaaaagtagtgtaaatataattaattttgattatattgtatt

SEQ ID NO: 30942 - DNA, 1176 bp, Mus musculus
gcccccacccatttttatgaccgtaggggataagaatcgcccggatgtgtctttctctccttcttctagtcttttggctcgattaaaagctctcgaaatagtaagaaaagaggtctggaaacagctaaaagaaacctatgttgctggtgacacacaggtgccgcatcagtttgaagtaggagacgcagtcctggtgaggagacaccgagcgggaaacctagaaccgaggtggaagggaccctacttggtgctactgacaacgcccaccgcggtcaaagtggaaggaatccccacttgggtccacgcatcccacgttaagagagcaccccctggagtcagccatgatgagtggactttggagaagactactaatccttttaagttgcgcctgcttcgtaggagcgatcccaaaagacttcaacccccacagtcctgttcaacaaacgtgggaggtactcaatgaggggggtagggctgtatggacaatcactgaggtacaccctctgtggacttggtggcctgatcttttccctgacatctgtaagttggctataggagcccctcctggatgagacttggaggggtactctgacattcagagggcacctttaacaccccctccgtacgtagaaaaacattcgagagacccatggggtggttgctctaaccaaagggatagaagtatgcttcgaacccatcccttctatgtctgccccgggccccaccgaagtcagtccctcaatccaacgtgtggaggtaaggctgacttcttttgtaagagctggggttgcgagacttcaggtacagcccgctggaagccctcctcgagctgggactatattagagtaacagccaactattccctagcgtcttatgtacctggaggatttgacctagacgagtgtactgactggtgccatccgctccgtgtcaccttcactgaaccagggaagagagctctgggatggacaaaagggtatacctggggtcttaggatttacaaggaaagatatgatgagagattattgttcactatcagattaaaaatagagaccccctacaatcctttaggccccccaaccaagttcacacccctcacccatacaattactcagcctactccagtgattgcggacccccttaatatggccgctatcacccaacctcccactcctc

SEQ ID NO: 30943 - DNA, 1220 bp, Mus musculus
gaaggaatcgccttcaatggagatttcaacagaaccagcagccatacttcctgctcttggggtacaggacaaaaactgaccctgactgaagtatccgcgaggaatccaggtctctgtataggtaccccaccttccactcacaaacacctatgcggacaaattcagtccgtgtccagaacggaagctgattactatcttgtaccttccccggttagatggtgggcttgcaatacaggacttactccctgtgtatcaactaaggtttttaattcatctcatgatttttgtgtcatgatccagctgttaccccatgtatattatcaccctgcatccagtttagaagaaagctatgcaggccggcggtcaaaaagagaaccaattactttaaccctggctgcattcatgggaataggtatggcagtaggagtggggacgggagtgtcagctttgatagaaggaagacagggaattcagtctttgagggatgctgtcaatgaagacctagcggcaatagagaagtccatagacgctttaaaaaaatctttgacctccctgtctgaggtaattttacagaacaggagaggtcttgatttgttattcctaaaggaaggaggactgtgtgctgcccttaaagaagagtgctgcttctatgcagatcatacaggaatagttagagactctatgcagaaactgagagaaagattagagcgaaagaaacgggaacgggatgctcaacgggggtggtttgagtcgtggtttgaatcacgaccatcttggataacttctttaatttccgctgtagccggaccaatccttatgatatgcttagctttagttttcggcccttgtataataaatagaggaatggctttcatccacagtaaaattgatacagtaaaactcatggttcttcaaaggcaatatcaacctatagttcaggtagatgaagagttaagggacaccgacctctaaaattctatgattagaattagtctaaacagaagaagaggggaatgaaaggaaataaaactgtaattcatgtaatgtatgttaaatagcccaaagagttgtttctgagctttgaaacctggggctgagaacatagcagaacagaccaggacatgcccgggcaagcccatcgcctccctagctcccacccctctgacctaagttaaatgttacaggctgctgatgtttaaatggaccaatcatgtgaaacc

SEQ ID NO: 30944 - DNA, 1131 bp, Mus musculus
gtttgatccgcaacaacccccacatacacactgtcccccccaccctcaattactagtttcaataatcagatgaatcttagtgaaagaggcacacactgctggtaacttagataatcacctgtatttaaggaatggtatttaaggaaggtattgacttgctttggggcttgttgagtttgagttgcctgtatttgagtctatgtgactttgaatcttagagagttctgagaaggtccagagaagtgatggggagggatgcatgtttttatttttactctctagataaataattatctttaacttttgtaggaaaagtagaaaccttttttattttacatatacagaaatgtgtgtgcccttcctttgagggtttgttccctttcattctctttgttttgttttcatgctacttctacaaaacaatctattagcaattaaaaatgttagccacaggtgcagatattttcctcgccaacacgtgtagttatggttcttaccagctgcagtgtatagtactctgtgaactaacatctgaacatatggctctcatgaacaacttagaaggcgtcaatgaatttacccatcagttaaatttctgatcatgaaatgattgttcagagtatattcagttaagcttctgagataattgccaaatattctttgaaaagacagtaaaagtatgttgtaaggaagattgtatggtgtcatttaataaatactgcatgttaacaaaccaggaattctgccagtatgccagcttagaaacagactctcttcatttgatttgcctttccttaattgttggtgaaattgaataatagccttgactgcatccagtgtgtgtattcctctgagtcttttgtgtctgcttttgtacgttgttaatcattttgtgtctttatgccatatatgttttaaagcatgttatgaagaaacattgctttgcagctgctgtgcctccgggactcgcccactgaagaaactgtttttcagtaggcccagcttctgagttttaggaagttctcagttcaccataaaaatatgcaaaaagatgttttctcctagcctgtttttaaaatattgaaatcttagaagttgtaattgttaattattagcaaaggacccagctgg

SEQ ID NO: 30945 - DNA, 1107 bp, Mus musculus
agttgacagccaggaatggaacttgtcctggcaaacaagcttggctcatggaggaatcctgatgagaggtaggtcccaggctctgggccaataatagggagtccatcttccatttgcttgtaattgtccacagagggccattagaacaacacaaagagttaaacttacaaatgaggagaagtgactactattagataaattgtcttacagaagggattaacttccacagggaattaaacctcagaatacttcttcgtgataatgtgatcacttagtaattttataaccaggtactaattataaaattatttgttttattattaattattttataattattacaatttttctttttttacagaaatacattcccaggaaatggcctctaaatcttggctgaattttttagtcttcctctgtggatcagcaatagggttttttttatgttctcaactcttgagtattttgttgcgagaagaggctgccattcagcctaacatgcttcacaatgaccctcatgcaaggcattcagatgacaatggacacagtcacctcaaaggacagatgaacttcaatgcagattccagccaacataaaggtaggctctgtgttacagaaggatttacttgtaagaaatgtgtcttgttcatatttcacggccagtacgaggtaactaataagtgaaagtgagagaaaatgagaaaatcgtgttctgggagtggggagaagaaaaaggaaaaagcttagacattagagagtgggatgagtaatttttagcattacccacatcttgtgatccataaaggtaacaaatatctatcaaatatatgtgcatacagtgagaggatcagtcatagcccagctgtggggataaagctgtcttgtctccctccatgtactataccagtttttgctgttggtccagggtgtgatgtgtctgtgtggctaagattgatcccatagttccagaagcagaggctgcttcctccctgactgcagagtgcagctcttctggactcagttcctggtgctccatggcttggaaagtctttcatgcctttccccccttttcttctgttctcttccagtcagttaactacttaactg

SEQ ID NO: 30946 - DNA, 1463 bp, Mus musculus
ttgtacaaattcataacagttggctcatagacttcaaaaataatgaactgacttgagcagcatggttttcttgttgtgttttcccttttattcttctgtcttagaaacatattcacagcagtgagaaattcacagggatactgggaaatactactttctttgtagtcttaagttgcaaggagagacaatgggaggtggtatgtgagtctgaactgctaggcctgaggtggggcctgctatccacctcactgctaacggacttcccagatgctgttgatactctcaatccattcaggtagtaagcacttaggaggagctagtgatgtttcagagatctgtgggtaaaattgacaggaaattagagtgtcaggtcacattagcttgtgcccatttatcaaagtcattaataatgatgggtaaatagagtcttaaattatttatgaaaagttttttttgatgtgatatatttgggttttacatctatgtaaaggtaacttttaaaaatgtttgtttgatagatgagaacatagacgttgctgagaacctctatcagaaagttaaaattctttgttgggttatgacaagtcctcaaaatctagagaaaaaggccaaacatgtcaaagctacgtgggcccagcgttgtaataaagtgttatttatgagttcggaagaaaatcaagacttccctactgtgggattgaaaaccaaagaaggcagagagcaactatattggaaaacaattaaagctttccagtatgtacatgaccattatttagaagatgctgactggtttatgaaagcagatgacgacacatacgtcattgtggacaacctgagatggcttctatcaaagtataaccctgaacaacccatttactttgggcgaagatttaagccctatgtgaagcagggatacatgagcggaggagcgggctatgtcctaagcaaggaagccttgagaagatttgttaatgcatttaaaacagaaaagtgtacacatagttcctccatcgaagacttagctctgggaaggtgcatggaaattataaatgtagaagctggagattccagagataccattgggaaagaaaccttccatccatttgtaccagaacaccacttaatcaaaggttatctaccaaaaacattttggtactggaattacaactattatcctcccatagaggtaagtctagaagttattagtattatataaatacttgggactgacttatgtttacctgaattttcttaaaaggctagttaatatgtacgtttcgttagtaccataacccaagcttttttatgtatgtactgacagtgtaacacagcagatgagaacagaggccccagccagtcattcagtagctagctattgagacctctgtaggccagccattagcatactgtcactggcagataaaagttaatacaggcatcttagttttcttatgctctctata

SEQ ID NO: 30947 - DNA, 3238 bp, Mus musculus
aataaatataaataatttatacttactgtgccaaaaccacaacctttatagatgatatacttgacaggatgtttgtttcattggctagtatggatcactctgtccctgtaatgaaaatacaaagccaaatttacaaatttaatttggtttaggttcttacggtggcgccatctaccaacatcctaggcttcctagtctgtgttgtacacagctctttaccgtggtttggatatgaatttgtctctattccatatgtgcttctcttctctactagcagagtaaatgatttatcctagtcatccaaaacccttaacatttactcataggaaatgagcgctgcagtgaagccgggcgctaaagccaagcagcctggcttttaagttcctcctccattactgttcatgtaaccttgaacttaatttctctgtgcctccatttcctcaactataaattaggaataatgatactacctacctcacaagattttaatgaggattatagaaatgaatatacataaggttattagagcactgtctggctcagaaaagggcatgattttaagtataaggttttattctgttaccttggagtataaataatttaatgtagataaatgaaattatcaaatcagatctgaaggaaatgtcttgcacatttcctataatacggaatatgtggtattcatctagtgcctgctgtatgccagatattgctctttacctgtacacttgtgttaatcctcataaattgggtgttagtcccatactataggtgaggagactgaggctattcaagtaatgtttccactgtcacaaagctagtaagtaagaaggctgggatctataatcaaaacctgtgttttgtttgtattattgttagccttagggttagtcgtatgaatatatgaatatgtggaataattacacacatgtatgaatagtacgtaacttctggaactactggccagtaatagtcaaaattggtcaaacagctaaatgggtctgtttattgttaagttgtgactcttgtactccagctataagtttgttgaggtggagggctcaaggttggatttttagcatggggccctagagtatgcattcttcccagataccttctagtgattaaagtagcattgctgagagcttgttggagcttgtgcttgtcttcaccccagcctggacctgtgtcagaaactccaagacagggcctagcactttggtttgaaaaaataattttaccaatcctctgctgagaaccattgccggtttacctacatgattttggtgcaaatcgtctttggaacacactcaggatttctgcccaggagagaggcatttttcaaagactctgaaacatgttttaaattagtgtggtccaggatcatactatattaaaaataaaatcttgtaaagtttaaagggtctgtgcatcattggttttggcaaaattctttacttctctataatggctattaccaagaccttaaagtgtgtaattctacacgtttattcatttcacactgagtagcaagtgttcagtgagtactaatatgtacatatgaattcaataaagcatatgtaaatgaatatcatgaaaatttccactagttactgaaatttgcaatagaaatggaaaaatactgctttacaatatgccaagtattttctgctagtttatactatcagttttgtcacctatcctatgacctaatgaagcaaaaaaattctcccaaatatttggtagagcacattaaacaagattttatggtgaaatgattacttcactatcttaaagatctctgtcatgagtaattgtagtgtggtttcaagtcaagactttattttaataaagtcttatgttatctattaatatgtttgtgtttttctactggggagttcatagatacaaagcaggtttttgccccagagttttgactgtttgaacatatctaaatttcagagatcagtttgttactataaaatgattcaaaaataaatcattgactacttcattctttgtcgtgagggaggtgcttgggattgagcacggcagtgtttgctgactggttgttttctgagttgtttcttgaggtttgatttttgctttgttttgtttctacacccttagcctggcaaactgtattgctagactgaggccctgttacacttgaaagacatccccacttggtttgtcagatcctacctggctgcgctcttgcactctcggtttcattctggttttgatagttgctttatgcttagcttcaagctactcggagtgctgtcttcttgcagttgatttgggtgatcagaatgtttatcatttatgatcgttttaaatctaccacaggtttcccatgagactaaatatccaacaatagtcggcttgctttcaggctacttgccctaattgaatgtacaacctaaaacaattctacatctctaattaagaaagcaaagttattttccctcctcttaaaagcaaaaggcaaacacattgccttcatttctattgttttgtattaggacttacaaaaacatgagaaatatgggagacaagctgtggtatatgttacactaatgtaacctctattggttaaagatggcttacagttacatatcagagctatatcaaaaatcttcccaccggtggaaatgagaactttgtacagattctctttagagaagcaactggaaaagcggcgtccgggctaaatgtacttagttcatctcccttacctcttttgagtcttcagttacattaattaagtttgagtaactttgcagggcgctataaattaatgatctacatgaagtgtattattagagggaaactaatcttactgctaagcagtgtgttgtattatacagtgaatgtttgtgttttggaatttaaaaataatttaaagtaatagtgtcaatgaagggtttaaaatgtctggtgacttgcttattttaagtgatcaccattaagtcagaaaaaatgtatttttaaatgttttttaaagtgccttttgagaatttttaaacaattgattcaaacaactacataaaataaattaccatgttcaaaaattgcttcatctgtgtattttttttaactgttataaggggatggtttggggttttttgtttgtttgtttgttttttatcaaagccttttctgtttgcgtaagctttcataattgttctagaatatatgttatataaagcaacaaagtatcccgcatgtgact

SEQ ID NO: 30948 - DNA, 1659 bp, Mus musculus
gatggctccttctcctaccaaacgcaaggaccgatctgatgagaagtccaaggatcgatctaaagataaaggggccactaaagagtcaagtgagaaggatcgtggcagagataagactcggaagagacgcagtgcttcaagcggaagcagcagtaccaggtctaggtccagctcaacctccagctcgggctccagcaccagcacaggctcaagcagtggctccagctcgtcctctgcatccagccgctcaggaagctccagcatgtcccggagctccagttctagcagctcctccggctccccaagcccttctcggcgcaggcatgacaacaggcggcgctcccgctccaaatccaaaccacctaaaagagatgaaaaagagaggaaaaggcggagcccttcacctaaaccaaccaaagtgcacattgggaggctcaccaggaatgtgaccaaggatcatatcatggaaatattttctacttacgggaaaatcaaaatgattgacatgcctgtcgagaggatgcatcctcacctctccaaaggctatgcatatgtggagtttgagaatcccgatgaagcagagaaggctctgaaacacatggatggaggacaaattgatggccaagagatcactgctactgctgtgttggcaccctggcctcggccaccacctcggcgattcagccctcctaggaggatgcttccaccacctcccatgtggcgtaggtcacccccacggatgaggagaaggtctcgatccccaagacgcaggtcccctgtgcgtaggaggtctcgctctcctggccgccgccgccacaggagccgatccagctccaactcctcccgataagcagggacattgattcgtacctctgtaacttatgttccccagactctgttttgtccttttctctagccaagtgagggtctgtagagaaggatcccttactgggtacagcagttgagatatctcctctacagaagggttctggcttgtagagctactgttggttcacggctgctcccatagaggtgccctgtagttttctggctagaaagttcatcccttcagttcttgataggctggtagcagagccagctggaacctatggcagcacacggatttccacagatgacccagaaccagacagcctggtctagcccccgctgtgccacacctgtgcaaaggaccacaatgctgttctgttgggccgaccatgccctgctgagtacgcttcaacttagagggctaaaacctttgaaggattcctccacaaatggttacctttctgtccccgtgtctctgttactttctagaatttgtgagccagttctacagggtcctcatgaaacctaccccaccccgttgtcacctgccattcatggtgatgttgcaggttaaccttggcagtgtgtacattgcccctttttgcttttattgtacagtcagtactataaaatttgttttgagttttataactttgtagcattttagataaggttgtgtttgtacttgtgtagagtgaaaggactgttgaataaaacctaggattagaatgcaaaaaaaaaaaaaaaaaaaaataaagtcccgaggcctttgtgtggcaatagctaactgaagcactcctggtctactttaagcagctaggtctttttctc

SEQ ID NO: 30949 - DNA, 1164 bp, Mus musculus
ccagaggaatcaaaatcaaggaaatgccccacagatttgtacttcacactcgagagtctttcttccaaatgcctctagcttgtatagtgttaacaaagacacctgcaggaagtgctccatcaaggctctgggggtggatatgggtgaaagctcactgatggctccatctcttcagggtaaacattctccggattgggaggcacatggagctgcgtgtctgtatccgctggtgacctagcacagaccgctttgggaggaaagatgccctgttcttgcaatggaaacaataatagcttcttggtaactcaactacggtgcaaagtgttttatttgtggtatactgcttacttatgctattgtaagactatggttgagaaattgaatattctaaatgttgaaatgtttctttgtaaagctgaagtgtttcctaatatatttcaaaataacaataaacaaaaaatataaaacttttctgtttttaggaatggtagaaagcagcagacataattggagtggcttggataaacaaactgatattcagaacttaaatgaagaaaggattttagcattacagctttgtgggtggataaagaaaggaacggatgtagatgtagggccatttttgaactcccttgtgcaagaaggagaatgggaaagagctgctgctgtggctttgttcaacttggatattcggcgagcaatccaaatcctgaatgaaggggcgtcttcagaaaaaggtattaggttatatgctctgagaatttgcagttcatagaattttgtcaagaaaggatgtggataattttcagttatctaatcaacatctttttcattcaaagggaaagtatattatagtcttgagcagtaaatactagccaatcccatttctatatgccttgggataggtcaataaaaacaaacatatcttaaatgacatcttaacaataatatacgaagttgtctagcatgtatgcccttgttttctttttaaagaccgaccatatacattaaagaataaatattggaactgctttcatttgtaagcactctgactacaaacagctggatatattctagtgtatgcgttctcctttggtaggagactaaatgatatttttgcatagaccagtgtagattcttatgaaaagcatattttgacctgga

SEQ ID NO: 30950 - DNA, 1812 bp, Mus musculus
taagtctgcctgcctctgcctcccaagttctgggactaaaggtgtgtgccaccactgcccggctctaacctgaactcttgatatttcctcatcaccgagggactgtgagcaagccattttggtatattagtgtataaactaaaactgttcattttccagtaactttctcttaaaagttcaccttggtgattgttttaatttgatgctactaatgcatgttttgctgtgggttttaattcctatacttaacccagtgtcattttgaaagttggtgcataaatatatttgtgtgtataaatcttggattcctaacgattctttcacctttttcagggaccatgcagagtgtcctgtatctgcatgcacgtgtaaatgtatgcagttggatacaacaggaaatctggtgccagcagagactgtccagccatgaaatgttccacctaaagaaaaatcttcacatgtggagtttttaaaggatgtccttcatagttcaggaaataaagtcactcatggctttgctgtcgtggaaaaataaagcattctgtcagctcagcaatgtgatgtttgagtgactttgacgtactcctcagaggccaacgctgctgataggaacattagaacatgaatattggtgctgtttagtaggttaaagttcatttgaaagaactgtctaggcttttgtcaaaattatgtttatagatggttttagaataaaaacaggccttgtgcctgcatcttcaatctgaaattgatatcttttgataaaatctgtacatatctaaaaccaaatgccaattcattgtttcatatatcaatttaagcttattcatgcttaaatatgctttcagagaaaatgtcaattttacattggtaattagctcctggcccatgctggagaatacatgcatgtgtgcatatgtgcacacacacgtttaaggaacgttctccctcatacatttatattttaatataaaagatttgacataggtcattcttgtcttcctcaaaactccaagttaaaagcaggctggtgagctggttcagcatgcgaggaggcttgcagccaatcctgatgacctaagtgcggtcccatgtgttggaagcagtgattcaactcatctccagaaccttgctgcagcatggggcgagcacgtacacatgtgcgcgctcgtgagcactcgagcacacgcagacaataaataaaaaaaatttaaaacgataaactttgaaacttttttcttttcaaaaaagaactgtgtgaaaatttcaggaaaacatgataataactttttcagtttcagttttttctttacagtgtgctgatttgtctctggctatcatctttacttaccattctcagcaccaccaggtacttctgagtatgaaatctatgcaagatcatatgtgggacaccatttgtggtgctgtcagacaccttcctattttggagtctcatctttttccaaggtagactacatggtgttggccaaaacaagggcattcctgcagtcacctttagatataagtcgctaaaagtgtgtgtattggggccaattcaagggctttgtttccatttttgtttgttccattttgttcataagtggacatagtaccacgcttctttgttgcacattgtgtgtagaagggaactggattttgtgcttgaagttataagtgtgaggcggctcctggtccctaggttttggagaggtatctgcagctgcccagacagcatgaagagcaccatgtccaaagactgaagacccagtggacgagactgaattgtaaccttgcttccttaagacctcacgg

SEQ ID NO: 30951 - DNA, 1226 bp, Mus musculus
gtatgatttcactcttgaaaattcagtcctctgtgatttgtagtctttgtgtctatgcataccctagcagctttaaaggaaatgaggctgcccattttattgaacctgtgtgatgttctttgtcatttcactggtggcggccttgaggcaagcaaggatcataaaataaataaaatagcatcatattcatggttttatcttcaaaatcaagtgaatttatataaaaattaaagtcaatttaatgaatggaactgactttgggaaaaaatatggattcagaccactcatatttccccatgtgataaaagtccaattgtggagagtatatgagaggcacagggtgtttttgctgacacaacagtgaaagagaaacaagaacttccctcgctcagttaccaaggctcagcaacctgagcatggagcgggtgtgaagggcctgggttcagaggaggctatggtcctatgcagttactctcacagtgtttatgaatgaggtcagacaaaccactagggaaaattgaaacctcttcgaaacaccagcccttctttgctgattcaagactaagggagatgctttggttttcttagactcatgtggccctctccaccctcctgaaggatcgctgtgtccttctttattctcatccctgctgagtgtgttgaagccctttctagagaactgtcctgtgggtccttcctgaccacgtgtgttcccagctcgtgggtctgcttctgctttcacctcttctgcttcctagatcactgctgataagccctggttagaagtgtgttggccgcagtacagtggcagggtttgactgttaaacacacccagttgaatgatgctccaattagtgtgtaggcagacacccagataggactagaatgcccactgtttattccaagtaaagctgagcaggattgctgtcggtcagtacacgactaagagagttggtctagagtaacagggccatttccttgccgtgaaaattttaagtcatttcttttgattagttataatttattaattctgtgccaaaggtttttaagtatattttttcacaaagagagagtatcaggaaaactaaacactgtgcagaaaagtacaagagtttttctaatttttatgtgctctgcatactcatttaataaatgtggtgtggtcttcataaaacatactgtgtgatttaaagttaaagggacatttgtgatgacaaaattatact

SEQ ID NO: 30952 - DNA, 1105 bp, Mus musculus
gccattttaataaacactggacctccctgttgaaggaacccacacaaaaataaaagcttgaatgaggagaaaagggtagcctgaaatggcaatcccatcttcttgtctaaataagagatacaggtgatgattaatctaaacaaatagaagggtcagcaaattatatgcaattgagtttaactctttggatttcagtaaggtctatggtaaacaagagcagtcagtgaactgattctttaaaaaataatacttggcatttgcatatcatcttacgtgtcacatgactgggtttgctccgcacccgggtatgtgaagagggcaggcaggtcttattgaccccatttcacagatgagcaaggagaagctgcaagcagtccagaggacttctttccatggatagtactacctctatatcctggtgccggccctttctgatgaaaacttacctctttgttcaaataagggcagagcctccatacaatccaatgttaactgaagatgtgtcctaaaactgtaagaagcatgctactgacaagtctttatggaatttaagcaaagatcctttattctctgtcattaaagtctgaagtaaattaggaagagcgcagatcatacatggtcagttgtgtgtcagaacacaacccgtgcccttgtcaggggctccctcagctttgttcagagctcagttctcagaatcaatgagttctggatttgggccatgccatttatgtttttccaaaagccattttctcacatgagctaaggttcttgaagctgctctgtgccctctactagctcgatgcactccccaatgcttccatccaactgctccctcagaatgacaggagcctggtatagttgtaccctgaaaggctctctgccaagagccttaacattacggatgcgtgcagatgcttgcagccaaccatcgaactaagcatggggaccccaatggaggagttaggggaaggtaggagctgacgggggttacaaccccataggaagaacaacaatatcaaccaaccagaccccccagagctcccagggactaaaccaccaaccaaagagtatacatggagagatccctggctccagctgcatatac

SEQ ID NO: 30953 - DNA, 1739 bp, Mus musculus
ctcagatccatcaaacagaccacagccctcccttgccaaaactccaatcaattctatcttagtatctaagatagacatcctgtttgtttttcataagtcaatcttggcacttttatgaacaattagttcctctattcacaaaaggcatcataattatttttactttcttaaagtttgagggttttttggtttttgttttaagtagccaagatctacagttgatcttctaaaaggtcacgatcttagtaagttctttttagttacaggcaaaggacccactttacagttggcttttaggatcttgccattcaaacagtctttgttgttatggtaagcacacagacactttgtacaatattcaaattgacagctttcccgtttgcagactgctcgctctaaatagtggtcatattttgcagggaaattatagcaagcacaggctttgaggcttcccttgttcttcaatgtctgccacctccacgaacttgttgtgccagctgtaggtagaacctttctgaccacgctgactggaggacttgacctgaacatctttttttgggaggtgcccaggtcgacgatgactttgaacagaagttagtgcaggtctgcccacaacatgtcctctcgttgcagcatgtagtgacaacttactgctttcaatgactctgcatggttttgctgtagagctggaccgctcccttattgttttccagtatcttcttccaaattctgctcactttagacaggtttattaagtccgtgccccgagcttcatcacaatgttagccaacaggtgcacgaatcccctccgggagagctcagccaggagatctaggtgttccaggcccattttcttgccaattatactttgcagtctaaagttgccgctggtgataacttccttcagcatttctcgatccactttagggtttcgcttgccattcttttttagtgttgagcaaaccactctttgacaatgcaggacaggcagcaggttttgttgggatgctggtccaggctctgtgatggcagcaggcgggcctggggactgtttctgaaattctccaggataaggatgccgtcgtcacggtcactttgtgtaaaagatgagtagccactgtcctcatacagtctactggcctctagctcttctgtttcgtttgaactatctagtgtgttttgtacacgttgattctccttgctatcatgacccacaattggtgactcgatgaaagacaacctctcatggtttctaacacagtccttacaggaaggtttcaaacacacgggactgtaggaaccttctctcccactgtcctcaggcttcaaccacttcaagctcagaaagatcagggttgcaattaaaacacttcattgtaacagaaagaacagggctttcttctttatgtccacggtcgtccacgcgccaagacggcagggacagaacgacggccggcgcagatcactgcaggtgtgcctgctcatgcgggaaaactcgggctccagtgcaggggaggtggcggcgaccataggaaagaggtggccggccctccatttaacttctaatatctgggttagcattacatgatgtgttgatcttatgctcagcatttgtctaagatgcaatagtatcattatcaatttcagaaatatggactgaatatgcttttttggtgatgaaatctatgtacgatatttatagtgatgtgcttttattttctcatgagaaactaaatatt

SEQ ID NO: 30954 - DNA, 1284 bp, Mus musculus
acctcagaacccacctccagtgactcatttcctccagcaaggccacacctaatcctttaatcctatcagaggtcattcctcggtaactaagtattcaaatatatgaccgtatgtggatcattcttgtgcaatccagcagttccttaaccaaggcgaaaagtctatatatttaccttctgttagagattcctgaatataaataatctagatgaactagaagcttaaaaggatagaagtatgtatccgaaggaattaatagttactcattttgcagtggattctctctattggtctagctagtagaatatacttaagcttcaggttggatgcctagttacctcaccaaaactatcctgaaagactgcaattttagataaagtaaatttttgtgaattaagtttacatcatgaaatattctaaaattttttatttataagttgttattgagaaagttgcatcatcaaattctaaaatttctgtgccatgtcagtttttggcaatataaaatgttttttgttttgttttgtttttaagttctactctgtgaatgtggactacagcaaactgaagaaagaaggcccagacttctaaactatgaagttcactgtaaagctgctgataatgaaggtctttcagaagccatccgcacaattttccacttaagcaggaaatatgtctctgaatgcatgaaatcatgttgattttttttttttttggagtttattacactgatgaataaatctctgaaacttgatgcgtgtcactatttaatgctgaaaattcatgtgggatttgatagctaggatataagaactaaagtattaggatgtaaagaatctcttgaatttctcttaatacatttgaaagtgagactttatgctgctttaataagtgtgtgtgtgtgtgtatgtaggcccatacttggtgacttcaaactggaaactaaagggcaaccgagaagaatattcatgcctttgttcaatgatgaacaaaatagaaagctgtgcatttctgttattggctggaattgaaacacagttaaccttctttaccttgacattactttcagggttattcactcactagtactagcataagataaactcagtctgtcactgctattagccaaaaggtggtgagactttctattgtgtggctttggcagatgttccaaggttagaaagtaatcagtgactttaaaattgggtctttgagttctacttagggtggcgaatggtgagtgagtattttgatgtttcccaatgtatacttcaggcccctggg

SEQ ID NO: 30955 - DNA, 1134 bp, Mus musculus
aaagttaatcttaaagaaaagaacttacaggaggtgagattacacagggaaatatatttatatgtaaaagctaagcaaagggtctaaatggagaagaaaagggcgcatgtaaagagaggaggggaaccaggcagagtacagggaagcaactgagaactcagtataatgtatgaagattctcgggcaaaccccaatggcctgtatgccaatctaaaaattaataaatacacagttgcctaaaaatgaaacattgtctacagatctccctgcactctaaaacatattttatgtcatatattctataagatgtttataaatatatacaaaaggactaaattgaacctgttgtatttaaattcaatagagacaattccactatactttaaatggtaccagttttaaaacataattaaaaaaatgctataccaaacatgtgatcaatgttttatttgaaagtttagctcttaagattctcaaatgtagggctggtgagatggctcagtgggtaaaagcacctgactgctcttccgaaggtccagagttcgaatcccagcaaccacatggtggctcacagccatcggtaatgagatctgactccctcttctggagtgtatgaggacagctacagtgtacttacatataataaaaataaataaatcttaaaaaaaatcttcatttaaaaaaaatctcaaatgtttgtacaatattccaaaactgttttgaataggacttacagcaaattttttctacaaaatgtgcaaagagataactaactagtaagtcagacatcccaagcacacacacttcttcagcagtatgtaacaagaactgtgaatgctttgtattcattggatcctgtgcttgatttacttgtacatacttgctctatggaaacacagatggtttttcaagagaaagggttaatattttcctacttaaaatttgataaattttgccaaaatccttacatattaactgcaaacatcaaatgacatctatcattaagcataaaagaaccttatatgacaaattcttatactaagccaaaaatataaggttgtagttatcaaaacagtattccaagagccaaactcttctacaatttcttcctcaatgagaaagaaatatttcctc

SEQ ID NO: 30956 - DNA, 1214 bp, Mus musculus
catgacttttatcatgaaggggtgttggattttgtcaaatgctttctcagcatcttaacgagatgatcatgtggtttttgtctttgtctttgtttatatagtggattacgttgatgatttctgtatattaaaccatccctgcatccctggaatgaaagctacttggtcaggatgtatgattgttttgatgtgttcttggattcagttagtgagaattttattgagtatttttgcaccgatattcataagagaaattggtctgaagttctctatctttgttgggtctttttgtggtttaggtatcagagtaattgtggtttcatagaatgagttgggtagagtacattctgcttctattttctggaatagtttgtgcagacctggaattatatcttctttgaaggtctggtagaactctgcactaaacccatttggtcctgagctttttttggtttggagactattaataactgcttctatttctttaggtgatataggactgtttagaccattaacctgatcctgatttaactttggtacctggtatctgtctaggaagttgtccatttcatccaggttttctagttttgttgagtatagccttttgtagtagggtctgatgatgatttggatttcctcaggttctgttgttatgtctccttttttgttttttattttgttaattaggacactgtccctgtgccctctagttagtctggctaagggtttatctatcttgttgattttctcaaagaaccagctcctggtttggttgattctttgaatagttcttttggtttaacttggttgatttcatccctgagtttgattattaactcccttctactcctcttgggtgaatttgcttcctctagttctagagcttctaggtgtgctgtcaggctgctagtgtgtgctctctctagtttctttttggagctactcagggctatgaattttcctcttaggactgcctgcatgtatcccataagtttgggtatgttgtggcttcattttcattaaattctaaaaagtctttaatttctttctttatttcatccttgaccaaggaatcattgagtagagtgttgttcagtttccacatgaatgttggctttctgttatttatgttgttattgaagatcagccttagtccatggtgatctgataggatgcatgggataatttcaatatttttgtatttatggaggcct

SEQ ID NO: 30957 - DNA, 1155 bp, Mus musculus
tttggaaatacattttctccacttattaatgtgctagacatgcttatgttctaaattgagatataaataacagtgagtatggatcttgagcaagagaattcattttctcttgagaataaattggtaatgctttatgtagagattctgccgaaatatttgttctgagtaccttgtactgagattattatgtttatctctagaccacagtttctaaagacccttcgcatatcataaaagttgaagtttactcacattggtgattatagagtacgattggcaacaactttcatagcacttcctcattgctttccaaaatgaatgtgttaaatgcttctctgttatgaaataaagaaaggtgaaaagatggcctagatagagtttattttttgtttggtttccttctttgtttgttttgtttcgtacttttaaaattttttaagtcaaacatgataccttccaggaacctcagctgacgctgctcagtggctactcctcaagcttcaaagactttgtatctctggctaaaagaagaaactactcaaagtgatcgggggaggcgggcatggatggaaagcaaaaggtgctcatttaaaagagtgtctagtctttcagggtccactgacacacagtgtggaacagtgtgacacacagtgtggaagggagttttttctgagttcttttagaaatgatgtttaataaatctatagtcaattaactggggacaaagaaagtaaacatttcaaaaggaataaaaaaatgataaaacacatatttgtattgtatgatttaaaacatttactattaaaatggcgtcatgtatgtcagtcactaagaatataacttctgtttgtgttacttcataaaaggcattgagttgtaaagttaataggtttgtttttttgagaagattaggaggaagtaaaaattctagtgaagaaataaaaggataagaactgctctatagattaagtcctatcacaagttaaatttctttcaactttgagaattacccctgaatagttgtcttcccattatgatttttgaagactgtcagtggtgatatcagaagcataagtatgacttagttgtattcataaaactatgacttttttttaaatgatagccgcatataattaacaaaactcaatgaaagga

SEQ ID NO: 30958 - DNA, 1178 bp, Mus musculus
ttctcatcctttacagctgctgttgtgcaggctgttaagctcgcagtgtttaattaatggatagataccattagagagacagctggacctgcatccaaatgagcttggattcaaggtgccacaagataaagatctgaaagtggagaagctgggctgcgattgggttcatttataaaagaggctgttaaaggtcaactgtgttttcttgtgtgagagataaagagatgctattaaaaacaattggaaagtaattcataagggaccaggaagtcactcatggtaaattaatttgtctctctgatagcatggcactcatgatggcaaagtaaatttgcctaaaatcaagctctctcaaaaacagccattgatcatgtctctccttttaaaaagccactggagtaagctcccgtgtgccaggtctgctggagctgtctgatcccagcacactcctagctctttacaaccacttttcaggctgagaattaaccaattatttcagaggaccataagtgcagtggcatttctctggccatgctgagctgcctcgcctgctgatgcttcctgtcacctctgatgaactaatcgctaagcacccgaacatctcatcctgcacacagttttgctttcctgacattcaacaacaccctggcatgttccaccccactgctccctcatttgaaacctccctctgccctgtcccccttccagtattccacaggttcaaacatgtacataccaagacaaacgtgttttaatttatccagaaaatgtatctacaattacaactggcagtttctttaactccctggaacatgatacgttttctttgcatcacctcccctgggtaaattcctccattcatgcaccatgaattccctttctcctccctagtgtctggacgctagcatgagacgtgacaaagggcagtgcttttcatgctcagtaaggacagaccattatgacacatcttcctcttcctctaggcaaggaggaggctgtcggtggtttgcagccagtcatgaatacgaaaatgggaaaaagcattatatcagcctgtgatctttgctgacttaaaccgggggtggctgtgttctctctgctaaaaactgttactctttttcctttgagttgaaaactatttgggatcgccctcctctgcctctgcctctgcctctgcc

SEQ ID NO: 30959 - DNA, 1110 bp, Mus musculus
aattgaaattaagaaacctataaaatatcagtaggttccgctacatgttggatctgacataacatagatgcacagtaaaacatttcgatgctctactttttatattaattatatagatgcttttcccagcaattaggtatcatcaattttatgaatgttttagggaagaaaaccatttctttctagaaattagtcaaggaataatttcattgaacactggtgactacatcaaaataaaacctatagtttgcttaaaaaatttaatcattacccatcatcctgagtcgatgcttctagcagttacagtaaacatttattttttaattttgtctaacatggttttcaaatatgatggacgtattcatcttgttgctttatatttccagtgtcatttttgaccaagtattttccttattcacccagcaaatttccagtgcattctgttttcttatgtcagaagttgggttttccgtttcccatacccaagtgcttccgttggttgtgatgtgtgctctgttcctcagcctggctctcaagtggaaagcagaaactctaacggcttcaccctgcccttgaagcactcgtcatctttccttagcagtcacctgcattcgctgtatgagggagctttggggtcacccgtggtctgtgtgtggccacccttcccgtacacccagagcaccctctgcagtcattcacgctctagtcaagctgggctttgtttgtttggtttttcttttctgtgcttgctggtcacctccattcttgaagctgcacagttggctggttgtgcttacatttttcaaatcaacctcatttcattatatgcagtctctcctttttatgtaactgtctgtgagtcatttgtttcatttcatttgttttgtctagaaatgtctactcctgttacttaaaagttaccactgtctttagtttggctactcagctgaacactagccataaatacgtgtgaggtgtgcaaaatcatcatccatccatctctgcagaatcgccctttacctaggcctcatgtagtagccactttctctgccccttccatgtgtatttcagtccaggagagcactgtgttctgccagagttcgtggacaa

SEQ ID NO: 30960 - DNA, 1319 bp, Mus musculus
tgaagtaattcttttttcttaaaacctattaaaagagtaaaatataactgacttcagatcttataatttgcacttaggaaatggtggtgaagtgtaaaaggatgtgggaggttgacatccaaacaccgtctaagtaacattaggacaattggaacttggccctaatgggccttgtggtttttagcctactatggaataattttggctattatgttggcaggtgtgccgacttttccattctgccttttaaagtgcttaaatcaactggttgttaacacattgcgtcttattttagaagatagtttcattcatatgtttttaaaataggagtaccttttacattttcaaatacatttttgtcttctttgataagtaataagagctaaacatttagccattggtttataatcaaatggtaaaccgtgatgcctgagacactaaaatgccatagctgcttggctcaaagtgtgtcttagagtgggcagccttattcctctgactttgtgaaactagattttaaatgaaacatttatctttaactttctaaagaaaattagtacatatcttagaaagctgaataaaaaaaatcactatttcttcaaagttgtaattttagattaaaataaatgtatttgtgatatacttacttggctcaaaaatttaacttctatatcaaagacctatttacattacagtcttcattcacagtttctggttgcaactactttgtgtggtttttagcttgcttagagaacaggtttcacagaagagctctgacgcttatctttaaattcgataaaagcaacagcaatgggattactgtaggaacacaaatagaatttccatgttttaagctgttcttgttcctttttacatgtgttaacacagactccaagctgaagatacagtgtggttggggttcaaccctcaaagcagtgcatagacaacgtagcaatattatgaggagcttcatagttaagtcttaactattctagaaggaagttgttgccttctgtttaattacattcatgaaatgtgtttaagtgaaatattttcaggatattttgtatgctgtaaaacaaaaaaggaattgtattgtgccaatggccaaaggtaatattactaccatgtagatgatgacagttcaaattgtcccacgtcacccagaagtttagaaactagaagtctgggagacaccacatcagttgtattgggtgattcttaagtgctgtacacgctattcatcttgtcaatgtccagcacaagaaggagcgatgccaggcaagctgcaaagatgcagaatttcatgacgcaggctg

SEQ ID NO: 30961 - DNA, 1969 bp, Mus musculus
gatattgaagaagctgacccgccacagctgggtgactttactagagactgggtagaatacaactgtaactccacaaacaacatctgctggactgagaaggggcgcacagtgagggccgtgtatggcgtgtcaaagcgctggagcgactacacgctgcacctgccgacaggaagcgatgtggccaagcactggatgttacacttccctcgggttacgtatccgttagtgcacttggccaactggttatgtggcctgaacctcttttgggtctgcaaagcttgttttaggtgcttgaaaaggttaaaaatgagttggtttcttcctacagtgctggacacaggacaaggctttaaacttgtcaaatcttaatgtggacatcaaggaaggctattattgagagttcatgttaccatttatcagtaacttgccattttttgtatgctgtatttttatttgtggaaagtatcttgctacatttgtagctgttctcactttgtcttttcttaagtaattatgggatgtggaagatattgggaatatgcatgattttatactaaaagtatatggagggtcatgaaaatgctgaatgtaaatgtgtaagagatgttaaaagtaacagtgcactttcaaataactttccatttgtctccaatgaaaagaaacacagttgtctgtgctctggagtggccaatggacaattcctaatgccttattttctaggcacccgttagagaatgtagaccagacaagtgtgttttaagagaactaccagtttacttagtaggagattctttcatgtgtgtgattcatataggtttggccccaggactgtttgcagaagtataaatacttggagcaggaagagacctgctcataatgactgcaaaatgcccttttaccaccacacccagatgtcttggctatgacctttacagtacagcagaaaagccccaactgcctttgagatgaaagcattgttaatgtaggtaacaataagagcttacatgctacaaagtgttccttcatggttagtgagggactttgaaaatactggtaaatttaagagtccttctcagggtaattttgttttcttaatgagtagtatttccagctacaaattcctttcaagtaaattgccattcttttcaaaaagtacacacttacaaaaataaatgtatcagtttctcattgaccgattcttcctgtcttacgtatttatgaggagttagtactctgccatgaaagttgcttttcagtcctattgtaataacttttttctgctgaaggtcaaggatgggaacagatcattttgttgttgttgttgttatatacctgtattgtattatgtaaaaaagtattcattttggcagttttaggtaagcataatggtatggttgtaatttgtaaactttaattcagtgttttgttggagtaaagtaggcgctgatcaggatatctccttaagaggtaagtcacttcctgtccccttccaattatccttacattctagattttcatctttgaaagagggaggtataattaaagtggagattagactttgttaccatggtgacttctcaccgttgaagccatttttccatgcccagagagggaaggtaacggatgcatctaccattttctaccaatgacttgaaaactgacattttatttagaaagaagtcacaccatcagggaacttgtatactgttatctatgcagcattgctacagcctatttctatgttttgaatattgtactcttaatactttgaataatattttgttaaaaattaatttttcatttaatgtgaaattaagagttcctgaatattttactgtattaaaagtggaagttatacaaaatgcctttgcttttagagtttatgtttggtggcatgttgatttgaaaatatttccttattccagaatactgaagaattgatacaatattgaaagttagtggcatccta

SEQ ID NO: 30962 - DNA, 1105 bp, Mus musculus
gaattcttactctgccttctttgtttttgtttttgttgttgttgttttgttttgtttttttctacagagtgtgtataagtgtgacttcctgaacctgcagctgcagcagccactccagcttgcacaagatgctatagatgcttttctgaagcagctgagaaatcctattgatgctcttccgggggaactttttcatgtggttgtcttctctctccttctttcctattttccatcaccctaccagcgatggatttgctgcaagaaagcccatgagctgttagtcctgaacggcttattgctcatcatcactcccgattcctcccatcagaaccggcacgctatgatgatgaagagctggaagattgctatagaatccctgggttttaagcgcttcaagtattcaaaattttctcatatgcatctcatggcttttagaaaaacctcccttaaaaccacaagtgacttggttagcaggaactatccagggatgttgtatattcctcaagatttcaacagtgtagaagaggaggagtattctaacacttcctgctatgtccgatcagatctagaagatgaacaactcgcatacggtttcacggagctccccgaagctccttatgattccgattctggagaaagccaagccagctctattccattttatgagttagaggatcccatcttacttttaagctaatgtaaaagcaaaaagcccttccattccagattcctaaactaaatgcttacactaatcagaatactaacatgaactcagtatttaaagcctggtttgcatagaagaaatgcaaacgtttacagagtttgctattttttctacttctggatttcaaaatttattcttatataggaagcttaaagtttcatgcagagtgactctgtcttagcagaaaccactgttactttagcattttgcattaagattcaaaaggtaccttttctctctttagtgctgttgtaaagcctaatgtactatgtatttccctcttcagtttagtgttgactttacacccttgtcatgaggaacctcaagatgtgtagaaagctgtagattgcactttgatgactcacaagttgaatatttcac

SEQ ID NO: 30963 - DNA, 1176 bp, Mus musculus
aattagggcacggcattctgaatgacatttagggtagcggttcctggtgacagagaaagaaaggaactgttcagctttgattcagtgttaaccatttgctaatcagcacttccacagatgtgctcaagtaccttgtgtgacataaaatgtctcatgctttgtactaggtatggctggcattgccaagttccatgctgtaggtacctggaaagcttgagttttgatgtttttcaaatcatagtctatctaccattagttctgaaaccgctaaattaatgaacagcagaaagaacagatccaaggagagagggcagagcagtgggcatgtaaacagtggatctgggccagaccaaggaaagagttttgaaaaatggctcaaccagatggtgggagaaccatggatttcctccctctctttagtctgaatcctgtaagaagtgttcgtgggatgtggaaacagtctggctttgattctctactgtttactagccatgtgtgtgatattgggaaatttagatcctctttttgagtttcatatagggtattacggcgttgccttattttaacttaattaataggggggagagagattggagacgcactattgaaaggtcaatcccttcactgcctcccacccaaataaaaaagccaattggccttgtaacaagagccggtcgaactccttctccctgtttcccacctatcttccaaaaatgcggaggaatatcaacttagtgctattttcacatctttcagtcaaacttagccagagttccatcgccctacttaaaattcaactagaaagttacctaccaagtactaattagcattataaagtcagagtctgcagctccaggcctttcagttgtttactagaaaggacagtcttaagccagatacagtttaccataagaaaggttaaaaaatcccagtgaagcaagttttttctttagccctagattccaggcataactattgagcatagataattttcccccctcaggccagctttttctttttttttttattttgttaataatagggaggagatgtagtctcccctcccccagcctgaaacctgcttgctcggggtggagcttcctgctcattcgttctgccacgcccactgctggaacctgaggagccacacacgtgcacctttctactggaccagag

SEQ ID NO: 30964 - DNA, 1155 bp, Mus musculus
cctattttaaagaggaagctagagtcagtgagaaacgaacagcaaggacagaaattggtaacgagtacagaaaacactccctaacagttccttcaaaaagagactactagatttaaagttagttctcacacacagattgctaaatgaaaccaagccgagaagcaaattcatcccaagatctaacataaagatctggaattccttcgccctgggagggtgcaaatttgttgggttgtgcaagtacactaggagaatcaatcctggaatccccgggagcggagtttgtaccttaccggaccgaaagcagccattacaggaatggagagcagggcggtgtcgccagactacatttcccacaagccctgctgcctactcccgtcatgcacagcgcgctctgggatccctgactgagggatagaccacaggctgcttgttgttcgggtttcacaagtttgccctctggttttactgttaaagagagggtgagtgttcaagaaaaggtttagtgaattcgtaggactaacgaaacaacaatacgtgttttctgccctgtaaaggaattctagccgcatgaatatgtcttgttagtactctgaaataaggaagtaaccgtgggagagggtagctgagggaagccatctgtttgggaatgtttcaaacctggggccttccaacatttctgcagcagaaaatccccgttatcattttccaaatgtgcctaatgacatttgctaattttttaaaactaacggggaaaataagcacatttaatcagaaagtttggaaaatattgaatcatttgtggtgcaaatcaggtttagaaaatatggtttcagccctatacacagatcttttccgattcgaattcttgtctttttcagaatgttcactctccacagcctcccaatattttaagatgccaagtttagtactcaaaaccattataagtattattcacatgcatctgtaagcattaactttgaaaagttcttgaagtcttgttacctgggatatccatactaaatgttccttctggcccgagcactttcatacttactgacaatttgtcatcttctcattgtaagttactcacggtgctgagttagaggtgcccggacttgtcctgataaaaatcatgcgaatactgtgggcaca

SEQ ID NO: 30965 - DNA, 1747 bp, Mus musculus
cttcctttcgccggatgtatgtggtttaatatgtgaagttttgactgtctaattggttttttgaaacttcttcatagatgacaataattggaagacattttgacacacacagcctaaaatgttaaatgtcttctttctcttgacatgtctgttttcgctaaccattctgagcagctctttgctctaaacacaacattgctcagtatgtatttaagccagatcactttgatgtttatctattggaggttaaaagcaaacttttttttaattctaagtaagcacaaacattgggcagagccgtaaacagatgtgggactctccgtgttggtctcctctgggcttttcagctctcttgttctgccagagtgctctgaagaagatcacattgctctcatccagagcggcaggaagtgtaatggaagcaagcaggatgggagctgtaaaggatgaaccaggtttcaaagcatgctggcttcaagactgtaaaggcaagaggccataggaacatacagaagtgaataacaggttacagaagaaggcctggaggaagatatggcactgtggatgctctaggaccagctacttgaatttaaggaaatgttgaaggtacacagcctagactgtcagtgctttggacaagtgaaaaggatttgccttgtatatcgcagcaacacagctttcttagaactgtaaaatctcaactaatgcaaatacgcactttcctacatgtaatttaagtgttataaattttaatgaaaacataataccttgttaacataactatattttaccaaaaaatgtagaacactttttaacaacgttcatttaaatgagctggttttttttccttttttttaagattaaaaaaatcccagtattccttggggtttttccaaagctgccttatatttggaaagactcggttctttatcatgcaggggtgggggggggcggggttctatttattttcattggcttgtagtcctagccatgttgtctttcataaggaggtgagttttggatccactacaggaggacttccgacgtccaacaccatccaccaggtatcaggattccaactgtgtgtgaaattatgccaagtgacaggttataaagatactaaagtacgaagaagaggggctgcaatgagactaattctacagtgatggagtcagctcatgtggaggggagagtttggattcacacacaccctcccgtgggcgttttccctttctctccagattttaaaatttggttatattgactgattccttgtaggctcttgagagtatgttgttgttagtggttctttctagttccagatgaatattagattgttagaaataatgcaatcttaagaagccattagccagcctaggcctttaggagacttaaactttttttctttttcatgaagaatggcgacatcaccagtgtctttcctttgaaagttagcttagcttataattaaattattattttaaatattctttgaaaaagaaaagctaatccgtctcctttctagtgcaatttccacgtgcatacactttaaatacgatgctaatgtacagctgccttcctcctcgtctttgaaacagaagctttgattcgctgcgtcaaatataatggcaaccttagtatttccacatacccaatgctagtgtgtgcttatatcataggatgaagaagtgccatctgtttatggataagcctcctaatgattgttaaaatatttgcctcattatcc

SEQ ID NO: 30966 - DNA, 1122 bp, Mus musculus
gaatttaggttgctgggcttgtgtgacaggcctttttcctactgagccatctccctagccacataaaacaatttgatactctatcttgataccttttattagctttctttatttcatcaaaatcagccaactccttcgaaagaaaatgtaaacagaaattgtgacatgtcaaatgctcagcattccagcagagaatgaatgctttttaatttgaaaaggaattaaacaatgtcaactactaaattagagttcatctctcattaagaataaaccagctagaataattttacaaattgacatactgataattattagctacatgttaaagcagctgaagagtacaaccttatgtttctctaaagtattcataaaaatttcaaagttactttcatggccatgagtagtcaatatcagcatccactatagtctctccccccaaatcttttatttgaagaacaaaccccgctattcaactagagcaaatacattgcctccaaagtactaagaaacttgagaaataatactgaaccaaactggtatacatcaacacaagaatcaacaacagttcatgattagttataaggcaccttacattatatagtatgtcttaattatctctgattgcctcagcttttcttcttcctgtatcactgatttcatcaggaacagctaaggagttgttggttttgagattgcaaagactttcctccttgctaattctgtgcaatcagcacgagcagtaaccgattctcagactcaggttcacttgtcacctgaaaccaaataaagcgtttactttcatcagttggtacagcccagtcatgtgatagtgttaacttccttttcagtagacttaattcctagggaattgggagacagtatgagcttgaaaagaagttttatcttcttcagttccaaggacagttctcaggtctggtgtgagaaagctcttggggtttttattggctgagacttcttcgagggatcatggtagtgaaacggtggttggcatggtaacagatcattttgtattccttaatgtgattccttacctcacctttgctctaccttattactaatatcatgagttcatgaagcactaaagtcttctctcatgctttg

SEQ ID NO: 30967 - DNA, 1149 bp, Mus musculus
attctcataaaataaaacagataatatcatcttaaaataaaactatatgcattctttttaaaatactcccaacagaatatgaaaatgtatactgccaaagtcaaataaatgcctgtagtattagtaatgtcgtacggggaaaagagaaataggtcagaaaattttaattctataatggggaacacagcacttgatgacataagctagaatggaaggatggatgaatgaatgaatgaatgaatgaatgatgtttgccagattagaaaaaaaaacattgcaagtaaaatgaacttttgcaacgtatctgtagtagagacactagatgtagagttttagatctaaagggcagttgtcatttcctggaatgtatgagtgacatgtcctagagaaagaagggatgtgcaagatataacagcagctagagtggggagcctgggcatcaggctctctgcggagcagtcttgttcatggccagtcgtgatctttgaaaaatgtttgtgaacagtttgacaaggcagtatgtgaaaggggagaggtaactggaattcctggctgccattcaatcgtctaagtgaaagctgtgcagtgacaaaacaccaagctgtaatctctctggaaaccaggcagtagtgctgagcaagtaggagcagtgattcaccaacatggaagtgggcagcatagtgctcatgctccatacatctaactggtgttcttatgacaaacacgcgtgcaaggtagaagcatgcagaatgctggggaatatgttataaaaccttgtaatgtacagagctttatcacatgcttacttactgtattctcttttattgaggtggcttttcctaaataaagggtatttactaaattagttccacatacaggcagaagaaagacctaaaagggaaagaactgcattgggaagtattctgatgtaacaaggaagattcggctttaagcagattttggaagcccagagatcactaggcatgtactttgaatgcatatgccatgtcccaacataaatagatttttcaacattaacagaagtatctcagaagaaccactttgctaaatatgaaatgcaagctcaaggtgagtattgtgaagtatgttcattgttaagaatgctgtttgcaagtggaattatagaaa

SEQ ID NO: 30968 - DNA, 1150 bp, Mus musculus
tgtgatgttttatgggggaatgtatatgaacgtcccactcacttaaaagaataacttggggaaggacaatgaagcgggtgacgaataaaacaggaaatttcctgctatgatactttaggtggtatttatttatttatttatttaggtgtgagattgaggagtccgggacaaagaccacatgggttatagtcacactggctgggccttttggacatatacttcttacctataacctaatttttcaaagtcatataaagtaagggtgttgttctcctgtgtctctcttgcttacgtttatgaattctcatcccttctataggaaagaaacaacttggtctttgtgtgtgtgtgtgtgtgtgtgtgtgtgtgttctctgtaatacactttaaaagtgtttcaggaaccaccaaggactgcacatgcatcactggttaggtgtacttggtcattttctgctccctgctcaccccccaaattataggaaaatatgtcgtaactgcaaatgtggtcaagaagagcatgacgtcctcctgagcaatgaggaggaccggaaagtggggagactctttgaggacactaagtacaccaccctgatcgccaagctgaagtcagatggcattcccatgtacaaacgcaacgttatgatcttgaccaatccagtggctgccaagaagaacgtctccatcaacacagttacctatgagtgggctcccccagttcaaaaccaggctctggtaagtaatgggagggttgaagagagagagcctattattattttaaattattattattattattattgaatgttactagattatttagggcagctccttttgtgacatggccacccaccgccacacatcagttgtttgtcttgaatccccatttttttaattttggtacctattactactttttaaaccatgagtctactacattgccccacagacttttttctaactatctaatttatcctcttttagagaatgttctaaaaatgttagtagttacatgaaaatcagaaaaaaaaaaaccaatcatgtgttttatatccatctagctggttttcttgtagactcttaagatttttcttacgatgacaaaggataaataatgaatttcttgtctgcatttggaactgaacaaaaaa

SEQ ID NO: 30969 - DNA, 1319 bp, Mus musculus
tttaaccttatgaattttgtctgtcttaattttaaatgacttttcatgatttaaaaaaaaacagtaaagaattgtagcttttatttctatacattaattaaatctttgaattggaagcttgaatttaatcagtccttataactgcatactcctagtgccaaatttatattaagtgatagatatgaaatcacttaaaattagtgtcctgggagagatgaccattttaacttctatgcttatttcacatgggaaatgtaaaggaagttgcatgttgcctgacatgacgctgtgcacatagcctgcctcatcgatggatgacaaggtgacatcagctcggtgaatccttctggcagacagcgtggtccacgatgggcgttcctttgcctaagcctttgcatcccctggtgaggcagaggggcctctctcactgcatctctctctctgtttacctcacctccccatgttcgcttttgcatctagtgaccgccatctgtggccttgcatattttctatgtgtgtggctggaacaatatgtgcactttgctcttagagattattattttttgcccagaacataaaagtaggccattcatttagttatttttttttgaaacccaaagaatatgtataggttttggtacccagggaattgtaacttgtgctaatatcacctctctgccatgccttgactcaattttgcatgatttatggtgttaccagatggatcctctcttgtgctacctctgagcttgctgtagacacaaaggctattttctttgcctgtgcactcccatccttgggtgtttttaatgttttcccttgtatgcattcatacataactatgcactataaatattaaatggaatgacttatgttattgaaaataaagtctctttcactttaataattgtctttctatgtcctttttgtgagtgggaaaatccttctgcagttgagtgtcatgtacagcagggggcactgtctccaagagtaaaaatattcctgacaaaagtaaaggcagctgcagctagggcagacagattggatttgtctttgcagataaagagtgggtttcataaagactgaaaccaggactttttggtaattcttaagtcatgcaggagtctgttatttttttagttaaactttaaaaggagtcaagtgttgcatttttagttgttttgggaggattttttttttttttgagacggtgtctcactaggtagcccagactagtctacctcaaactctcagttctgtgtcagccttccaaatgttaagctttcaagtggtgtgccccattatgcctagctataaat

SEQ ID NO: 30970 - DNA, 2192 bp, Mus musculus
aaaaaatagagagatttaattttccttttttttgtttttaatttcagaatgaggtgcaaacagcaaaagaatttataaagattgtagaagctgcagaaaatgaataccaggtatgattttctaaagtatctgttcactgagggatgggtcttaagttctttaagtccattttgtgggttttttatttcactgttaaacagtgaggtgtgcttcttaaagagtattctgaaaatgtcctgtgttgtaagtagttgtttcctgatttaaacatctaaccactgtttcttgtagactgccatcagtgagaattatcagacgatgtcggacactaccttcaaagccttacgtcgacagttgccagtgacacgtactaagatcgactggaacaagatccttagctacaagattggcaaagagatgcagaatgcataaatgaaaattgcatgagcagattgttttagtgtcttcgcgttacaaaaattattgcaaaagtattctgagctgacagctgcccagtgaggtgggctgttgcatctaagatcactgtaattaagtagtgtggttagagcacagagcttagctaataacctgttccatttcctttgttcagagggttggacatgagtttagataagtatcttactctgttcctcctttcgaagtctctctctctctctctttctttctctctctctctgttccttctcctacaatgaagaggtgatccctctgggtcatgtctaaagggtttgaaatatctcaaaagtaccttctttactgtaaccctgaagttgtctttggcttgtgaaaggggcagcttttgatgttagcccaggtagttttagtggggtcagtcagtaatgggcactctagttaaggtggttgatggacttagccatgtatgctgctaaagaaattgtctaccttttcctttcacctcttccagcatggaagatggagattagagggagagcattttctaacgagttacgttaaaccttctcagcaaggttatttagctagcttagtgtctaactaaacttttttaaaacaaggccaaggtctgttgctgttttgagattctgaaattaaatgagaatacttatttcagaaatgcatttaatgcttttttcttgtgacagttatgcaaattagcttgaattccatatgttcctgagttatttttatcacaaagccacaagtgtattataaggcagattgtaatatatatataatcctgaactcatgaacatgtctcagttgattctccctccccttggattggaaactgaatatcagtgtgacattaaaatggcaacatttggtatttatttgagtaaaaaaaaaatcaccagtgaatcatacactattttaaaatactttctttgtatattgtcattcttaacaagttgtaaattagaaaatttgggagtccacatggtatgcaactgcatcttttgttctccattttcctatgcatcataagcatgtttgtaatactttaaaaatatatctactgccaccacaggaattcacgcctcggtgaatgttagcgtttactgtaaggagttggtggatttgtggtttcattcagtagctctgctgcttatactcgagtggaatccattcctcacgtactcctgcagacatctgggcctggaatttttttttttttaaacaccacttttactatgtataataaaatatttcattagcttgaattgtatagatttttaaaaattcaataagagcatgttgtttaatttctttttaaaatcactgttgggctttgaaagcattgcaaatatatgacattgtgacagttttggctaatttcctctttagcttttagtcttggcatcaggatttttaaggaaaatgaactgataacattaattctatgtctagatttttaaaacacgtacttaaattttgatgattctgaagtaaatactaaataagtaactaatttggtaagttgtgtgaattgggctagctagcatgggtttatatccatggcagccaattatttttactattttctagaatatacttttgaaaatgtatgcaactttttaaattggcatgtgaaacatgaaattcttccaaaatttcaggcatgccaaaacagtgattgtacaattttagagtcttaatattttgtttatatgaaagaagaatggagccatggg

SEQ ID NO: 30971 - DNA, 1159 bp, Mus musculus
aggacttgtagtttcttccatagtaaaacaggctgagttaatttgtagatgtggggcctgtttgtgacagttccaggtggcaaactcaattgcactaaggagtggtttggggattgcctgcgagggtctttccagaagagactgagaagtgagtgtgagcacatttgatggggaatgttcaccttcagtgtgtgtgagtaccattcaagaacctggagaccatagaactagagagaatgtactctccttctaccacagaagaggcattttgacctcttcttctgttgacattggccatgagaactccaggctttagactccaggacttggaccagtgccaccttcaggcctccagactccaactgtaggttgtaatctaagctccccttccctaccatgggtcattctttgaaattagcctgagcggcgctacctactctctggttctccaagactttcatggaacttctcatactatattcttcataagccaattccccagtcaaccaacccctccttcctctcctttctcttctccattctatactgggccttaagacatcaagattcagatcacctctgtgtttctcccagcaatggcctctagttacagcctgattgttacctagagggaactatgttgtgggttcctaccaccaattttactaccaccacctcatcatcatctatctaaaaatgatatgtagatggcatatagtattttgccgggcacttttgtcctcctgctccatactacctgtcatatatttctctggctgcccttcccagccaggcaacatgttcctattagcagatttttcagagattccattgatgtacgacctcttttgacacaccaattccatcagaccatcacaccactcatccttttctgaaagatgcagcaccaggaggctagtagtgggccattacagcataggcctactaggtatagggctttattcatgattttgccaatcactagtgggatgcttcttgaaagttgctaatggcccttgagctacacagtttattcatctgtactgtggattcctttgttcctattccaaagggacctggtatagactgaatgaaatatataccaatagtgctatgcatgacctgcacacgccacgcttttctctgccagtaaagtagg

SEQ ID NO: 30972 - DNA, 1248 bp, Mus musculus
atcatataatccaggctgtcctcttatttgctatgtagctatgaatggccttagatccctgatccttgagtttgttttctcacttctcctcggatcttagaaatacaaccatgcctgtctgctgagcaggttttaaaatcattgagtgtttctctcctgtataaatcttaatgttgcccttgctttcctcattcctccatgcacttgggagacatcacttggctagaatattaactactagtatcttaagctggggattacaaaaatgtgagagaagcctataagatggaaagctaattatagccgtagaggttcctcatataaagaagagaatgaaagtataacaacgtaaaaacagaattataggcctttaggcccaggcttgggaatgtggcctttgtaaaggtatgctaatcataaaagagatagcgacattcctctacccacccgcttcctgggttcaaagagtgctcattcaaagaaagtcaccctgaccattaccagaacctgcaatgcaaatgtgctattgttaggggctcttagaagctgtcttgagagttaacaattaccaggtattccttgtgactcttgtaactttacacttccttgtgacccttaactggtatctttggtatcttccaacaacgccctccccacttccttgagtttcggtttcttcctttaaataccccctttacccagctactcggggcgccacggtcctctacccctgcgtggtgtatgaccatgggcccgagagcgctcttgagtaaaaatcctcttgcaatttgcagcaagacccgtttcttgtgggtgattttggggtgtcgcctctcctgagtcagaacgtgggggagccctcacattatgggtctttcaagaacgttctaaagagaaggtattgctggatcctccggtagtactatgaaactcaagaaaaatgaagactgaagtgtggacactatgcccctccttagaattgggaacaaaacacccttggaaggagttacagagacaaagtttggagctgagacgaaaggatggaccatgtagagactgccatatccagggatccaccccataatcagcatccaaacgctgacaccattgcatacactagcaagattttatcgaaaggacccagatgtagctgtctcttgtgagactatgccggggcctagcaaacacagaagtggatgcccacagtcagctaatggatggatcacagggctcccaatggaggagcta

SEQ ID NO: 30973 - DNA, 1232 bp, Mus musculus
ccttcacattacttcttgagtcccatgacatgggtaattcagttcacttagtgatgagatgaaatggcttttgtttcctaccttgtatttttgctgcaccttctcagttccacatgtttaagaagcatgaaacaagatgctgtagttaatgagactttagaaatgtatgtcaatttattttagaaatgttttgactcttttttctcatattaataacagagcagtcattggggaaatagatgaagagacggattctgcactcgacttggggaacatccgagcagagcctctgaactccgtagcacactgagacctcagtgtgtagtgagatgtgtgtaaatcctgtacagaagcgtctgtcctgagagtgatgtttagggtttttatgagtgtgtaattgtgcagtttgacttcatgttggtacactgtaatatgtaatttaaatatttctacattttttattgggaaacattgcctaaattaataaatgtggttggctggtttatttttctaccaaatgatacaaaaatctaaggatcatttgaaaacttagaaaataccattacttttggtaatttaatatttatgggaaattggctgtaaagagaacttagactattattgtaacttatactaatgcaaataatagtaataaaagacacatttctttttgtggttttcttttctttcctttttttttttttagaaataccagatagtaaatggccgtctacaggtaactgtcatagagtttatcccaatgtggtacagttctccagtagttggaaaaattgtgtctaaatttttagatgcctgttaaggtcacaagatttggtttctgaaagaagattttgtgaatgttaaatgccattgtactactgaatttttttaaactagagtgaggaatatctctattcaaagagcttttgtttaatgtgggaaattagttaaatcaagagcagtgctctctgctgtctctcattacttagtccatgaggcaacttttgttgttttgttttttgtttttttgttttgtttgttttctcaagacagggtttttctgtgtagccctagctgtcctggaactcactttgtacaccaggctggccttgaactcagaaatccgcctgcctctgcctcccaagtgctaggattaaaggcatgcaccatcacctcccggctccgtgaggctactttgataaactttttaaaaatattcatagaaacagtgc

SEQ ID NO: 30974 - DNA, 1200 bp, Mus musculus
gataaaaatgaaaattggccataactaagccaagctttttcaaaaatgtagattttagttaaaatttccttttgtttattaatgtttgcacaaacaatggtccacttccctgccttgtagcattgattgcatttgtgcctttgttggctgagtatcttccctgttagtgtaaggcagtttgcatgcagtgtggccggccctaggataaagttgagacagaaggtaactgaggcacgttttgagaagttgccggttctccaaccctcggaaccctgtacttactttgattctcacagcccctcttctgaaaatcggtcacagaacattttctaacagatttgagacgctgctttcttaaaaataaggttggggaggtattagcccagtaccctaagatgtactaagatataagttgattgactagtctaaagatatgaagcagacttaccttttagtaaagaaatattgaagtttcgtcattaaaccgtacgttagctgggccccagattttggtgttatctttttttttttttttttgaaacaggtagatcgccacttgagaaagctggatcaggaactggccaagtttaaaatggagctggaagccgataatgctggaattacagaaatactagagaggcgtaagtacaatttatggtttttctattcatcttggagagtagttttctcacaaaagcctgccagatcatatatgccctttggtggatggtagcctctgggtcccgtaacttctaggctggcattgaagtctttgggtcataaacactgagagaaatatgcaggctgtcagtctactccctctttatgaagacagcatacaaagtctttcactttgtgttgttttcactttgagatgggaccatgctctataaagcttgccgccccagcctccagaccattgtgattctgagcacgtgtgcccacattgcagactccgtgcgtgtttaatattcacatatgctaagttagaagagagttagagaaagaaagaggcaaaaacgtccaagtgtccaccgtgagagccaagccacgcctgttctgtgtgcttcagctggcagaattgttgagactttgctcctcacctgtgtggactgaggtttccatcgcttccgtaacacttcctcttgtgctgggaagtcttttcaaaacctccccttatcagaagaactcatcctaata

SEQ ID NO: 30975 - DNA, 2488 bp, Mus musculus
tgaccttattgttgacatgtgtgtcactgaagcgagggcaggtgtgctgtgttcctctacattagcagatcacactcatttttgttttaatgctgtgaatcatccttgtgttcccttagcacataaagaacaataaggaaacgaacaagtacgagggatggcctgaggtggtggagatggaaggatgtatcccccagaagcaagactgacgggaaggagcgagaggcgaggaggaacgcactttgactctgcaggagagtggtcaggcagccgctctgtgtacatatttcagtagcatgtggccgtccagggtgtgcatgagcaagaccgtctctgtcgattccaggattatttattgctaacagaaatggctacctttttgtaaatagtcttcattgagccaatcactgaactatttgtaagcacatttccctgaaagtacaacgtgtagacgacaatggcaataatgtattttaattctaaaagcatattcagggggtaaccacgcaggttgtacaggacgccgatatttatcctggttgctgggaaaccctatcatggaataatgtggcttttagggaggagattttgttcgtatacgtgtctctgtataaaaatctggcatgttatggcagtacccttcaaatgaaagagatttttggctagttgtctgtgtactgtcaccttacagtccaactcctgttgtatcttttcacagtctttatttttgaccttccaaagaaatccagaaataaaatgtttcacacaaaaatttacatcagatttgtgaaaagcacaacagtttttttgttgttgttattttttttaataacagtgaagaggaatattaatgtaggtgtcattcagagctcattttctcaattctgtgttagcggtgtgaattctgtgatgctgtgtaagctgtgtagagtgagcctaggggtaggattccacagaactgggggcccaggccgagtcccttcctcgacctaatcaggtcattcaagacaactgggtcagtacatttagggtaatacaggcatttttctgctttcatcgaccacatgattttaggacaggaatacttgactctcatagccttgatttgtaaaccaagaaattctgttatttatttctaactttgtgatagcagctgttgcctaaacgtgtagcagaagccttgaaaagtcccgattattgttttttttagggcatttgatgtctattatataggtgacatacatccacttcaaatgcaacataaacaagtgaaatgttcatgctgccctttgtgggatgaggccacacgtaaaatctgaacctaaaatttaggtggtttgtataaaaatctaagagcagtatttgctattttgttaaaagctagaagcagcccaggtgtccccttcttgactgttactgacctgcgctactgtttctctcctcaaattgaatgtagttcatgaggagataaataatcgtctgtgctcagagaggttttgtagactttaaatgtagagttctgctgctcctgtactaatacatccagcatggatggtttagcttttctttgtttgtttgttttttgtttgattttttttttttttttttacagttctagggatgggaaaataaacattgcagggttattttgttttttaatactgaatataagtactcttggtttgacattgtgaattttttatttttcatttttgtatttgacaaagcactatacctgcagaacatcccctgaaatccttccttttttttttttttttttttttttggatacatcttaacatataaaaattaagtttttgccattcaacatagtagtatcatatggcctggatatatttgaatgtgtatgaagtaaagttgcttgagaacaggctaaccctttgagagatgggctttccatttgcataagctgctgggagggagaagactggttctgtaactgctgtggcccagtggggtcttttggcctggattctgtcttgtactggttacaccggctcaactcgggaagcaataatcgactgttttatgttcacatcagccttagaagtggaacagtgctcacttactgttgacaacaagttttctttattaaaatcaaaaatctttaacactgacgtgtagtagttgcagtgatgtggggggcgggggtctacaaatgcacttctgctttgttaaaacaacagaaggaaggagacataagcagatacctgggaaatgagacaaagagaacctttctagtcttcattttcatttggttaatggtaaattcattgttccgtatgttctgttagccctctaccttcccctgtccattttaagagaaaagagaaatgtactgtgctcaaagaacaaagcagtctacactggaaatacatttggtatcatttccagccaatatgagaaaggggaaatgcttgttgagcgggtaaaagattggccactcagccaattccttccacctctt

SEQ ID NO: 30976 - DNA, 1178 bp, Mus musculus
tatggcacgatccatttctgtcaggttagctcattcctcacgagggtctgaataagggagcctttttatattggaagctttgcctttcttcttgttcttttgatactcttagagaaaaacattctgacagattttgaaagtttttatttatttatagtttattaaagaatgtgtgtctcgcctttttaattaatttttaaagtatgtgtggtgtacagcctgcatggatgtatgctcaccacgtgtgttcctgatattcaacgatgctgggagggcatctgattctttggaactagagttatagatggttgattatgtggctgctgggagtttaacctgtgtcctctggaaaagcagccagtactcctaatcgctgaacccccacctctagcccctaactaggtataccttaatgtcttatatatgtgatttcgtgtatatagtttgagatctaaaattatctgaaatcttaattaatttgttttctaaagaatctcaaacgtatttctcttctccccaaagctacgaaacctccgaggtacaagtgtgggatctcaaaggcgtgcccagagaagcattttgcttttaagatggctagtggagcagccaatgtcgtgggacccaagatctgcctggaggacaatgtgtgagtatcggatggctcagagctcgaaggtcgtggattgagtgacagaccgtggactgtcatggcgttctgaaatgcttttgctaacagccagtaattctggttatcactgtatgattttttttctcccctgtgacaaagagacctgcatttatctgactttgtgtaggatgcaggtggctgtttcatttgattcttaagtatgagaaaaaaaattaactcatttaaaatcattaaaataaaaacatttctctagttggtatagttcaactgttcagtgtctccaccacacggctgttgaccacacatctcatacagaaaacatttgtgccagagcaaagtcccattgacagctctacccagagcaatgcatgccttacatcctaggccagatgcttgggtggcgctgcttgctgaggtgtgacatgacctggaggtcaagccccttgcgctcacacggctctgggatgagctgagtgactcccgagttgcagtgctctctacaccaatgctcgttggcttgtcatcatgc

SEQ ID NO: 30977 - DNA, 2425 bp, Mus musculus
atttttgttgccttttttgctttttttttttaaattaatctgtgcaatacctcatttaatctgtaaaggtttgttataatcctatataaagctactccttgttgctgtgtgcaagtttacatcaggatgctcacgtgatttgtgaatattttcattccatcaacaagggagtttaattatgtgtgagactgacacaaaccttaatgtaatttagttagaatgccagaaggagaacactattttcataccctactttttctgtacctaaattttcttaataaaatttagtatagcactacattcttttttaagtgatgtaaactttagtttctttagccccttcattttgaatatgatgccacatatgaatgttgaagctgatacattgcacaattctctagacaccactcactacactaatgcagtttttcaaattctagtattatgtgttgcttaagatcactacagagatgctactgaagagagacggtagtacagctctcttgcagtactgcctgccgttggtaagcagtggcatccgaaggcaggaaccctgatgagccctcacgtgcctgtccttgaccaaggtgacttttatgctgtggcaactgtgacaggctattttttagcaaagagttagacgtttgttatcatgccccaaaatagtttgaggtaacatttttggaggtagcttcgtgcatcataaacaactttcgtgctcgtgtctgactcgagcggtatcagaacagggctgggatggagtcttcgtgttttgcaccctgtgcattgctatattcacaagtaccaactgtaggagtcagaggtgttggcaaaagtatgcatgaatgctaacctttgcacatactctgtttttactttgatggcttctccaggtttttgtcaggtaccacatgtagaattacatttttcttaaaagattgatcatccaaatggcaaatttcttagagtccataactgatttgatagatttttctttttaaataaaacttcacagcctgcacagttgttacgcatactacatggtatgttacaattagggtttccttgcctctttacagtacactaatccgcctaaaggtggctgtttgatatttaccgtgataattaccttacctacctacctactttcaatacactttaggtagccgattatctgatttaagtgcagacacacttttctcacattgagttgtatgcagaatgtagcttcagatgtattcattatagttacaatatccaactaaaaagtacgctatctagaagtataccgaccaaaatctagtattgacatgatcttgacaggctggacctgtgagatatggtttgaattttaaccagtttatcacataacctctagagaccatgcatctagttattgtcaggaataatttaaaaggtttagtcgccaaaagcagttaagtggtgcagtaagatagttaagttattcaaagagtgttaccctccttgcaagagtaactgaagcacattggaaagattctcaattttgtgtttcctgtaaaaacagtgctctctgctgctaggaccttttttctgcttcctgtcattttcatgtggcttgagctctgagacgtgcggatgaggctggacaactactacccatacaattagggggtcaaaataactttaaataaatagcatcggactttcatatttttctttttgacgtggagaaaacattttcatgcctaaaaatgtctttgagataatgccaattctgatgtcccttaccttttggccaagaagtttgagattttttcagctaatttgttatttgaccagaagttgtctggggagactgagttctttgagttgcatataaatgggggtatattatttgccaaaggtaaaattgagtttattctttttcatacagaaatggattttgcttttgtttgctttttatttttgtgtaaaatctaaattccaggagctatggggttcatccaggcatgaaggctaatccactctgagtaaagtgtcagttgcacagctccgtcctcttctgtcttgcactgtgggtggcactatttattcctgtgcgtcatctggaagcctcacggatacatccagctatgtgcttgtctggtagcctttgcgtttaacaaactagcatgaggcctttcatatctaaatgctgtgtgatagacaatttcagctagccacatattgtattatgaaattcataaagattttcaatcattcaatttcatttatcaactgaaattttgtttagtatgtgaatttttttttgaaatgtatagtaaataagatgttgcactggtggcaattcatcatggaacataataaaattaatttgacccaaatagtataaaatagtgtgtctcatttgttattaagatgttaaaataagtagaaaatttta

SEQ ID NO: 30978 - DNA, 1150 bp, Mus musculus
ttagtagtggagagaggtgagtgctgacaaagtaaacaagcttatttctccatcagtcaagtttggagaatgtctgctcattttattcttttgacaatggtggtttacttgtgaactaaacatagttatgatgagtctctgacatcctgcgtgtgaaattatacatctctaatgcaaatttattagctaccattcaccgagttctttactttgtgctaattagcagaagtagaaagccaagtgactagaatttaaacatgatgctataggctgttacttagtaatttattgatgtttcccagatgttgaaatattcaggaatgataagataagacctgacatagataatagtctgaagcaggttttaagacacatctcttggtgtattagtcaaaatgtttccagggaacactaactgagcagggaagacgtactattagtgtgtcagaagcatcccataagattgggaagcagatagaataaaaggggaaagggggaaatgaccctacaggggctcagatttataaccttaacacttaggatgctggtggaaaatggcaggtatagtttgaggccaatttaggctacaaaatgtgacaaactccccaaaacaacaacaataaatattaaataatagcaagttccaaaaatggaaatgtagaaggcaagctgcttgacttcatgcctttctagaactaaagaacaacttccttcatatgtccctgtcctatgacattttacccaagggtacgaggccaaatgatcataaactgagcccctacccccaaactgtatagcaacataaatcgttcctaagttaaattgtttgtgcaaagtatttgtgtcactgcattataaagataactcctatacatgctaaatgatgtgacagagatatacacaacataaagagaggtaacttttgtgctatttcaatatcagacataatttgacagatgaatttaaatgtcattgttatcaaaacaagcagaattaaacagagccaaaaaaaagttaccgtaaggaaaatatcattgctgaaaaacaggagatagatttgagaacagcaaaatgtttactttaaatagaatactctttatttgaaagaaaaattagatatcattttatagaatattttcaatgctagcag

SEQ ID NO: 30979 - DNA, 1175 bp, Mus musculus
aaaaccaggtacatatgcacacccaagagtcccatgaaaacacaaaactggaagctataatacatgtgcaaaagaccagcagggtaaaaaaggaggaaaaagaatagagtaaaataaaagaaaaagccctgacatgacattgagacgaggaaccttcaaagatgcctctgagcttgttttctattgggcaggcagcctgcccttaaaaatagttcatttccccagtgagaatcccttggcaagagctacattttcatttgcaaataattatcagttggagatatcttctggattaggcatgtgcctacttctcctttcagctctacgactcccatctgatagaccgatgtaggccctgtgtgtgctgccttagtctgtgagcttagatagtgttgatcctgttgacttagagggcctctttcccttggtgtctccatcccctccagctcctacccggtccagttcttcactctgcacagtgccctgagccttgaggggggtggggggatttgagcgtcatcccatttagggttgagtgttccaaggtctttcactctgtttaatatctgtctgtgggtctctgtatttgctcccacctgccgcaggaggaagcatttctgacaatggctgagcaagtactgatgtgagtatagcagaatgtcactaggagtcattttattgctacattgttttgctttgttttgtttgttttagtacagagaatttcattttcccagaggttcctgggctatggcttcttaggttcttggttacacagtgttgggtatgggctccatcccatggagtgggccttcatcagatactatagtggtcactctcataggctttgtgccacctttgcactcagcacacctggttggcaggacagcattgtaggtcaaaacgttttgtgttatgtttggtagtgtaagccgagtgtcttgataatcattgagtcagcttagtgataaaactttctcataggaacatgactgtctgttactcaggcattctacctcttagaccaggccacacacattgaatacattccttaattcttgatttttttttttacttatggaggtacagattatctcactgggcatgtttgtttgtttggttggtttttgattgtttttttttttaactagagtttgacaaaacttactttaatt

SEQ ID NO: 30980 - DNA, 1130 bp, Mus musculus
gccaacattcaagagattttgtttggcaaagttttgcaaggtctatcagtatgctctcagtgatagcacacccattctctgtccctctaacagtgagcaccatcaacatgtatcatggattttgcccgtacttgtttatacattgtctctttctttacctttttaagttgattacaaagattaatcagtagattacaaagatagaagttttttttttctcttatttttacttagatgactttcttttttcacgtaataaaaactcagtttgtgtcattcatcaggcccaatgtatacttttaatggaaaactggcacctcttgacttcctggttttgtgctttttgggtggagctgatttctgagtgtgaggttgtgacaggaaataatatgaggtacctgcaagacaacactgggaacacttgccaaaggttctgcgtaactataatttttctcgtccctaggaccctgcctacagaaaggttgcgtctaggtgtatgttggtcttgtagtgagcctactcactcaggtcctttaaaaaagtcatttatttgcatttagatgtatgtacttatatgcacacatgctgctcctatccacagaggctgcatggggttggatcctctggagctggggttgcaggtggtggagctgctcagtgtgtgcaacactggggcccaaacgctgctcctctggaagagcagcaagtgctcttagcttcagccagtcagtctgtgtatcattctctaaagaaagttgggcaactcagtgttgaaaaaaataattttgagcatttctaatgaacttacaacttagaagcaagccatgataagctgaactcaccatctaactaccttcttacattgccaccttctaatttgaagagattcctgttgttgatcactttgtccgtggtgtcactgtccctttgctggtcatacagacttcagagcctgtcctctgtaaatctgttcctgctggttctagcctacagagacttcttctcccaatgaggtttgaacatctgcctttctactcattttcacttttattctttgtaatattgcatccatattaattttcctgtcctcgtgaatcagatctagcccttggagaccaaggctacttatt

SEQ ID NO: 30981 - DNA, 1189 bp, Mus musculus
ttatattgtattaaaaatcatatgtatagtaacatccttcctgatattttatccattctgggttgtaacttcttgagttggctttggtattctaaaattttcagactaaaaaaccaagtgatcgtatttttattgtttagagtgatccatgtgcttgtgtattttataataagggaacttagaagcagaagtgacattttagattatacctttctcatttggtaaattaaagcaaaattttaatatagttaataactaggtttatattcacaaaatgctgaaagtagataatgctataaaaagatacatatacgactaaaagaggtttcattatatattttaaaatattagagggtgagaacaagttaattctttcaggttaaaaacaatttttattttcttaacagatcttcctgatgtaaatgataaacaaagccaagccataagtgatctcctagaagccatatatccaagagtggacaagagagaatatattattaagctagaacccatagaaaccaaccaaaatgcagtgtttcaatatatttcaaggactgataaccctgctgaagtgaccgagtcaagcagtacacctgaacaaactgaagttcaaatacaggagacaagctcagaacagctgaaagcagtccccgacgcagatacagaggtggaggaggccatagagcctccttctatagagactgttgtagatgaagctgcagctcccactgaggagcaacctcaggaatcacaggctgacttggagacgtctgacagttctgaccttggtcaccagttgatatgttgtctttgtagaaaagaattcaattctagacgaggtgttcgtcgtcacattcgaaaagtacacaaaaaaaagatggaagaactaaaaaaatacattgaaacacggaagactccaaaccagtcttcaaaaggacgcagtaagagtgttctagtttcattaagtaggagctgtccagtttgttgtaaatcatttgctacaaaagcgaatgtaaggaggcattttgatgaagttcacagaggactaaggagggattcaattactcctgatatagcgacaaagcctgggcagcctttgttcctggattctgcttctcctaaaaaatcttttaagactcgcaaacaaaagtcttcaaaggctgaatacaatttaactgcatgcaaatgc

SEQ ID NO: 30982 - DNA, 1225 bp, Mus musculus
agggtactgccagtattgagacagcatctcgtagtggtctgtatgtggagcaggttagggagaaaggctgggggtaggaggtgcgagttagggaaatggtgagggtcttaataaataagatattgtataatgcttctggctcagagctaggaataaatgtgactcccaggggaggtcatctgactttggaacatatacagtaactatgtatgtattccttcacagtcagcatctggcccacttgtgtcttaattctctggggacatacatcaagctaggaagagaccagggagttaaaaacagtgacggtttgtcccaagggctgaggactagtgagttcctcccaaaacttggaaccttgcttccaggaaccagctgagccctttgtgcccatcccagagagggtcccgagcagccatgtgagcttagcgatctccaaagtggtcctgtttggtccaggacggggttaaaaacaaacctctcctgcttaaggcaggcagagagtgggagtgatgacttcatggtcttcccttcaacatggagcttgtagaagagatgacatctttgcttctttcagagcatttggacagtaagccgggacctgcagggatacgaggaatttctgccaagatgtattcccagctgtgtttgcttttgcagggacaggaaaaaggaggtaatttgctgcagattccagaacactgttaggaccctcccaggaaaagcagagttcagctgaaatactttctgccctatgatcctggcagaggttaattctattctttattttcttttggttaattctgttctttaaggaaagtagctctcagaaaatttgggtcaaagcactatgagttgccaattcttttctttgatcagtctgctcttcctggttataaagacctttggacctgaaagatcaatgtttggccattaatatatatctttttgctatttttattatcgagatctgttttgtgagggtttggggtgcagaaaactttgattaacgatgttttcagtgggaggaggtgacctgattatctgcgggagcagacttcaatggaacagaagtgatgtctttgtagtaataacaatggtcattaaacctgagtgacttgagctgtgttttcttaatggtggtgtctatacatctggacacaagtagagtgtgaaaataaatggtgaatgaaaaggctagatatatagttccttatattgatct

SEQ ID NO: 30983 - DNA, 1408 bp, Mus musculus
gaggatgagctccgggatgcggtgctgctggtgtttgccaacaagcaggacatgcccaatgccatgcccgtgagcgagctgactgacaagctgggccttcagcacctgcgtagccgcacggtaaggctcacgtcccctcggcactgggccccgtgctctcctgggcccgctggacagagaagaaagagaggggttgtctatgctaaagagaaatagcatcttgtgttacttgttcttttgttttctgttggaatttttgtcatctttgcttagcacaaggaagagttctcttccctgagactgatctccttctctctgtccctacagtggtacgtccaggccacctgtgccacccaaggcacaggcctgtatgatgggctggactggctgtcccacgagctgtcaaagcgctagccagccaggggcaggcccctgctgcccggaagctcccgcgtgcatcccgggatgaccagactcccggactcctcaggcagtgcccttcctccccactcttcctccccacagacaggcctctgctcctgcgcctgcctgcatgctctctcttgtcgttggagcctggagccttgctctctgggcacagagggctctgctctcctgcctgctgggacctgtggatgggcttcctggccaaggccccctcttccaggggaggagcagggatctggatttaatttggttttggttttggttttttgatttttttttcttttttttctttctttttttttgttttgggggtacccttggggccaggttttggggggaggaaagtgagggctccgggtggtgctatgacgtggaactggatattgagtaataaatttgctgtggtttgtacccggtgttgtctgttgcctggaagttgggaagctgagttactgtgggcacagaaagacggtgtgggagaggcagaaagcagctgaatccaggagggcagtgcacttgaacccttttcttcctcagcttcccctggagggcttctagggggaggaaatgccatttcttcctcagttctgaggatggttaaggctataagtacctttctcattcctcaaaccagagtgtttcctatctcttacctagctacttagcagttcatcatagctttgtgcacatggacattcaaaagataggttccccaagacacacgagaaaaatgatcgatcctggcagcccaacaacatgcgtgtttaaaattaccccgatgattccatctatgccagcatctgtgagccatatttactgagcactggtggaacctttgctgggaaccactgggactctgtctacatgggaggattccatcactgctgaagcaggaagggcacctaaaggaccagggctctgggccattctccaggcaaggttgattacatgtctccctgta

SEQ ID NO: 30984 - DNA, 1162 bp, Mus musculus
ccataaagctgtgattacacgagaggcagttgtattttcttcagtcacactgaaacagagctgagaaacagaataccttatggcaggcttgactctgaattgtgcttctcccacaacaagcatgctttctgttgtctgcttttttataacaacaacaactttctttggaggtggattagttgaaatacagcattttagtatggaagattaaagagtgtgaattagactagactgtatgattagaatgtagtatggctagagattgggtagagggacggagggactgggctgctcagtaatcaggataacaggtgggaatggttgcttctgcgtgggctatatccattcagtcccccgtctatttctgaatgccttcccttttcctggagcagtaggccttgatttgtgaaggtaaggagaagtgagagcttgagcagtacttcgtgagaagagtctgcttttgtctaattcttaactgagggactcttttgcctggaggtcagctcttatttttgtagacattttccactttcattgtatgtatgggaagtatctttatctgttttttttcttatccttgggattgactctgaagtcacatgttggctaggaatgcctgccttgaggtacatttccaacccactttcagccgtctactcctagtacttcctgtcatggtttcttttcagtttcagtgttcttactgtgtatatgtttatttacttattctcactacgttctccagtctgtctagtcctaatctcttggattatgggtaggtgccaccttgctggatttcagtttttgattttaaatagaaaaatttagagaaagtaaatcctggttttctaaccaggtcattgtggggagaccacctgggagagccattgaattaacatctaggagagtcctgagaatctgtgcttacaaaagccagccagccattcctgggtgattctgagaggctcagtttgggataggactggaactggcatttgggacccactgatttgcttaacttctgaggttgttatgccaagattggggttgagcgtgcctggattttatgagggaagatagagaattctcttttggtattcattttgatggctcccaggaccctgtcagatctgattcctgggtcaccactgacagctgagaa

SEQ ID NO: 30985 - DNA, 1193 bp, Mus musculus
ctggtacctggcttcagaactagttaaagacactgtagtttccatctcagtctacctaggcttccaggtaagtctgccaggcttccttgtcttggcatggttattagtaatggtctgttggcctgatatgagtgatgggggtggatgggagcaacagtcagcacagggagaccgagtgcaggaaagtgagtggtggtgtagctcccagagagcagcatgaacaagagaggcgggctccgagtgccctgggatgacttgatagaaggagggttgtatgggctcaacagcccggctttgtgtgattctggccaaagctttgcttgagaggttttgctgcctgtctcatgcagttactgctaactggcaagaagtaaggaaggtggtttgtagtggaaagaggaacttgtgaatttaaatgtccatggttttcttagaagtaaaatgggttgggaaaagtcacatgttagttttggttggtttgaaaatatctttccagagaagatggtgtaagggacagatgtcttgacagaggtaaagtacggaagataaagggcaggtgagctggcgaagcacagtgggaacactcagaggacgcatgcaaagctgaggtatttatctaaagaccaagggtggctggaagtttgttataagaaaaaggaaagaggaagaggcttcaaagctttttgcttccagtgatgtcagccaagtgttcaacctcatgaattctgtcccaggaggttcattgtcctatagccttaataccagcaacatttttatttgggcaaccatccaaggcataatcattgtgccaagtaaaatttatctatttacccattaggggattgtcctaggctttaatgagaaaaatagtgtgtgctattcctctatgtatattgcaaggtagaggccagaacctgggtcttggggtcccactgggatctgttattctgtgtgcagtaattacttgcattattgctcttggcaggtgaggccttttacagcccagaggccaggaggctgcttctgttacttaaaagctaagttaccttgttaaactcctctctggtgagagctttagaatctctctagacctcccatgagctctctctagggtacaggttcagcacaggttaaggctgccctgcctttgtataattagtcataggcattctagctctgagtagtggaataaa

SEQ ID NO: 30986 - DNA, 1150 bp, Mus musculus
gagtcattggctagactatttcatatttattttggtttaagcttcatagtgagacagttctattagatttaaagtaatcaaggcctgtttggtttggggcaccaaagagaccttaagacatgaagctaggaataaagagaaggaggtctgagtggctctgaagctttgtagatatgaattgagttcatgtccacctatccatgtgtgttctaaagaatcaggggtggaaagcaaggtattgccgaattgtctgttggtaaagggaccattttaaaggaaagtaaactgctccgcgtgctgtgtttcatttgtctttaacacagagcttgattgctctggtgttttaaagatggtcagaagagcagcttttcgaactctgagttcaggctgtggccctcatgccccttggaagcctgatgtgggtggggtcactggctctcacctcatcactcctcactgtccttactgtcctttagtgcccaaccttccgtcgggaaacagatgggagtgaaacgccggagcccttcgctgcagaagccaagtttttcaccgagtctcgactgcttcagagagatgttcagatcattctggagagctgccacaatcagaaccttctgggtaccatcctccacccggtgagtgggctggacccctgggctgatggtccgccttgtgctctgttcaacattgtttcaaatcttggcaggtttcttcttttttctttttgtattgtattatccattgccttgagagcctttcctgtgtagataccattagtcatgtatctaatttgtgattgtgcacaaatcagtgcataagtaagttcatctcaagtgttccaggctttataaagggaagtcttggagtctggaagttgccattgccagttgaaggctggggagtaggactggggagtttcatatgtaggtctagaattcagctctcctggagtactgacacatcaatcagaaggagactgacacgtggaaaaattatttcccatattcttatctttaacagttccctcctaattctggagcttgggtttggggtttttatttttaattttttttatgttgttaaagttgtgactgttgggaatttcactctgttgtgtaccttgatagatgtgatattcttgcacaggtaa

SEQ ID NO: 30987 - DNA, 1171 bp, Mus musculus
tgtggatgaacattgggtgtctccatcagttaaccatgaattgaggttggaaagtcactaggtggcactgtcagcttgagaaatccccaaactatcttataaatgtaaaatttttataaagactcttgaggcattggctgatggattttcttctcactccctctaccctctctccccttcccgccgggcccccccccccccgcctcctcttatggaaatgttgaaagtaataggtttcagagctcaactggcctctcctcccctccttagcaggtatctaagtagctgttaggggatggcaatcatcactctctttagtggacatgaacagcattgtctatggggacagagttgccagtgtatcctccatattctgaggtagaatacagtggctctttgcttcctttttctgaggtctatgctgttgtgcacttggacatgggctgctttgccatcttgaagctcatttagttttgcttacatgtcctgtaagtaagaatgtacctacacaaagggtggccatccactcagcagggagacggatcttcagtttgataacattcctaagaggctgtgagactagcgatgtaggtgagatttagaaatgtttccctggcccgctctctttctagtagatcctactgattggggaactaacgagttgctagtaaagaaagaattctaaagaagtaaatgtctgagccttgcaaccttgcctgcctgtctgtctgtctgtctgtctaagacagggcctcactgtttttcatgttagccaccaaatagccatcatcttgcctctgcctcactccctcttccctctctcccctcccctcccctccctttccatgttgaaagtaataggtttcagagctcaactggcctctcccctccttagcaggtatctaagtagctgtaatactgggattacaggcacatgttcattttaaatatgctgtgttgcctacttgaaaagggaggaatggctactgcaacatttcttccacttttaaaatccaggatttcttgttgtctgggttttgttttgttttgtttttttaaacacagtaagtgtcttgatactcaccacaattaagttttactgattacattgccaaagtgaggtttatgaaggatgatgctttctttagaatgttaatgtaaatgtaggtca

SEQ ID NO: 30988 - DNA, 1236 bp, Mus musculus
tctttctcatgtagtgagagtggtacccttttcttgtccaacccatgtctctttcactacagccattgagttgggattttgatttgtagttttaaacttgtatcaagaaaagtctcagtagagactggctttagtgtgttggtttttaatgttattattcatatttaagcagggtttttactgtctagccctggatatctcattttggaacttaacctacaccctccaccagccttaagctcagtggtcctcttgtcactgcctcttgagggcttagactgtaggcgtgcaccattgctcctggctcaggtttctagtcttttaacctgctagttaaccacaagagataaagactgatcgatcatcttgtgaatgaagcagcttttgttttactgagagatcatcatatggtttgggacttgagtattattggatattttctctgccattgttggtaggaaaacagtattgggtctattaagatggctacctatctcactttcatgtctgattgtgatgggcctggctctttgctggatggtgaggactatggaagccagttcaaacattgtccccttcttccttataggtcatgcaggttttgaatgctgatgccattgttgtgaagctgaattctggagactacaagaccatccacctgtcaagcatccgaccaccaaggttggagggagacaacatacaggtgagaacaggaagtgtactggtggggtttctactactgtgatttaaaacaccatgactgaggcagcttggggacggcagggtttctttgctgtgtgctttagagggacaggagtctattggtgggaaaccatggcagcaagtacagtggcggtgggaactgagtgctgctcagagctcacattttgaactgcacacacagtgtttgtaggggaagtatgaacacagacatatgccataaggctttgaaatgttagagtccacacccagtgacatgcttttagcgtggcttctcctagacctccccaaaacagcaccccaactgaggaccaggtgttcaactacatgaacctgtgagggtcattcttactgtaagcactcaggaagcatctgcacttagttaagtctgatgtcagtctgtaaaaggacaagtctttgacagtctccaagtattatgcctttttacttgcagccaaaaccttagttagctctgctctggtccactgcaaatagtgacacttggcattcctccct

SEQ ID NO: 30989 - DNA, 1147 bp, Mus musculus
gctttcttttttctgtctctatgcagtttgattttctgggtcaagtagattcctcatttcttcaagtctattgcaggctaaccatgtagttggtactcagttttataaggtgcttgaattctcagtagctcctgctcatagtctttggctgcagattggcagagtacattgacccttaactgtgattctgccattagtccaccagaagaccaggaggcccagactctttccttgggtggctgccttttgtaaggtgggctgcaattaggagaaagcctcctccttattcatatgaagtttgcttagcatctgcttctccagctggatggctagttttagatgactggtgtgcaggagctgtaggtggaactttgtaagggattgctggtgtgtgcagggttcccttgtcagccttctgctcctccaggcttggtcttgaggcccaggccctatgagttggggtgcaggtgtattgagtaccctcattggagcttctttaccttttactgcagcggatgggagagagctcactgtgtttacatggcagatcgacagacagtgtcatgtgctagtttgacggtagggatatccagattattagcccagttagcagggagacttcacatcattcaactcaccttattgtatccacttgtgatttcttataaaaagggaggaagttctggtagcactttgctggtcccttccagcgtgtgttaaacctccaactcagcgttttcccaggaaaatgtccgagttccttcctgccgcctgagctacttggagcctttctgtcagagcacaactgtggcttgcctggaagattgctctgagccccacctcctccctctaaaagcttttcgcctcactccgcctgctttgcctactccagtcctcctctgaggaagagtagctgactccttcagctcaggcaggcttatctgcaggggagcttagttagttctgggctgcctggatctagaaatagcagagctgtggaagatgactgctcctctgggtaaagaacagcaggtagaggaaggcagttcctcttgtaaggagagttctcaatccaagaagatagaaatgagcctgatactgttgaaggaaactgacaaatgtaaaactcagtgcagtaaaaccctgc

SEQ ID NO: 30990 - DNA, 1150 bp, Mus musculus
gacattttcttacatagaagcgctagctacactaagagggagcctagggtgttagaggggtttagccctagtccattgggtgttctaagcagtgtgttgtgctagggcggcatggatcacaggtgttcagggtaaagactgttgtccaaagtttacactccgataatagctacttgagtacatggaaataaagcattgtgtggaaacctgctctctgtgtgtgtgtgtggggggggggaggcaggatccagtggcgtttgaatcaaaggagaaataacttttgctttgtcgaatctcttggactattgtgatattcatggttgtttctcttgttcatccattttccctttggtccattgatttgtttccttattttaaagccttttgtcatatccagtgtagtaggaacgttttcaaatcagcaaaattgcatgtgctagtcactggctatgtggctgtgctttaaacctaagagtatgcaggtgttctctcttgagatgtccatttttacctagatgttcgtggagtccactcctcaggcagctcctgtcattttgctgaatgtcaccaagcatttactgtcacttctctgatgccaaggaggaaggtgatgccttctagcaaaatagcccctgtccttttggtagcacattaaaaggtcagcaccccctctgtccttctcttgcctcctctgccctcactgtcatctgtataacctttccttactgaatgctgcttctgtaaagtgcactggagctgcatttaaagagattaggttccttaagtctgaaggtgccagtccactgtaagcttgaggtgcaacactggaaatcattccatgacttagaggtaggtggctcacctcgttatagagtcttgtctttctagaagttgctattaccgaaatgatcttgagaaagctcctgaaacttgtaaacttcaggaatttcttgagattgttttgtttacttggcaagacttaaaggattgtttcagtttgcaggtcaccttggtttctttagtaaaaagtccatgctttataggtctagctctagacatacacagtttgcttgtttgtttttaaggggaatatttttaacttggaccttatatgcctgccatttttggattacaccacagctgacgcata

SEQ ID NO: 30991 - DNA, 1195 bp, Mus musculus
tttttgtagccaccaaacatactttttataggactttttataatttaatttttaaacagaatttttttaaaggttgttttatgtaacgtatcttaaattctttacattttaaaaatagacagaggaagggagaaaaatggactggtaaaaagcatatgcatggaccaagcagtgattctttttgtttctaaagctttttaacctcagattaagacaagtctgaattttgttggtttattgacttgaaacagacatcctgatgttactggcaagaaggccagtatggagataggattatccccatcttcacctctaccccctcacacagatggtaaataaaactgactagacatttaatttattcatctcatcatttccagcttttaagtaggaaaattgtacttctaggctgaactgtgcctttatcattgttgtgagtggacagtacacttccttcaaaggtcacataaagagtgttaggagaggcttccccttctcccctgggcttggccgtccctggtccagagcgttcctgagaagcagccacattgtcatgccacattggtcttccccgacattctctagacctccagctaagcatggttgtgggaatgagagctatattctacacatgtgctagtaccataaatatagttaaatgcagggactgtagaccaggaatagtctttgcatgtgtgtttcctttctgtgtgtatacaaacactagaaccttagccggttttgtattcacagttcggggaaagcttgctgctgtcctatagagattccatcctaattttctctatggctaattttctacttgaaaatgcagttatcagttgattttaacactggtactgttgtctactatatccatgcttatgatcctgttttccgctttctcacttactgcctacttcatcagtcacaaaacaacactgttgattgtatcggcttattattgtcgttgttaaaacaagagaaaaagatacaggaaaagctgtgtttcccagaggtatcatctgctaacatttgagtgtctatcagtccagtgtttttatgcacatggctcttagcataatgttcacttcgactagtaattacatgctgcttactgctttgtaaccctcaacatgatgatttccctacgtcgataagtagtcttctacatgagatacttttatcatttaatacc

SEQ ID NO: 30992 - DNA, 1133 bp, Mus musculus
cattcatgcaacaaatacttactgtatttcagctgcaagtacgctgctcgttcaaaagacatgttcgtctgtcccctggtactttctctctttctgtttcagttaattagtacaagggaggtatacattacagagatttaaaaacttaggatataacacaccatttttggctaggttatcttttacagttttagagctaaatggtactgtaaaatcataatctagtgttcttagtttccatatgaagatgttgcacacatgtaaactcaatatctatggaggagcatctgcaattgtttttctttccaccttgtctttagagaatagatcatttacattttatcatttcattatcagcagcaccttaaacagaaggaaccacttaccacaaatacaaaatttaggtcaccatttattcagacagacattactaacatttcctgtcattttaattgaacctggttaaacttcagcttttcagagtgattggcaggtcagtgatgaatatctggagatgaaaaactccaaggcaggggaacagatctgagaattcacaggagaggggcataaatgctaattacacattgactttaattcctggcttgccatagtagcctgcaggtgtgtatcttggctgtgggctattctcagagcttcatttgtatctgagattttctttaataatgttgccgccacgaagagctctttaatctctgactcatttgcaattctctttctcttgatataggaaataattaattgaaagatgaatgtagttgttatttcttctggttattgcagattaaagtgtgtgggtgggagatgtgttccctgggtgcagctcctctggctggcctcctgacctggaagcacgagtgttcgttcactctggtttcttgtcattattaccccactgcaaccacaacccctgtggaactagagagagtgttccacagactatttcttggtttgtagctgctttcccatcccccgccccactccctgtctgaggaacaagcttggcattggcagtacaaggtaaatgagattcacatagtttatttttaatcagtggtgatttttttttcccctactgcttcaatttgttggatggggcttgaacttgttggatg

SEQ ID NO: 30993 - DNA, 1146 bp, Mus musculus
agtaatatacacagccatataaaaccaagtaataataaaattagaattatcataaatgaaagcagcacatcgtaagaattgtcttagttccttttgtgttgtggccatgacccagctaagctgagactggtaatgcgtatggggaagaagtggattctggctctcagttctggaagccgtgtcatctaaatcccgagtggtaccagcatctgcttgcttctgtgggaacccctgctgcttcaactcaaggtagaaagttgaagggcaagtgtataactaaaagagaaaaattccgaagagcagggtcacttcctaactcctactcctccagtaaataatccatcccttaaagtccctgcctgccaacactgccattgtaccagttgtatttcactgggatggaggggtgtgggggagggtaatacaggatggcaaacccagatgcaaagcacagcaaaagagcagaggaaagaacaagtaattgagggatgaaaaaccttccagggaaggtagcagaagatgtggagcttttcttttggcagattggctatctaggcagaacatttttgcctgtctcagttctcagaagaattgccttacgaaaaggatgcagtcctcatcgctgtgtctgcttctgtgggactttctcaacaaacttcttctcaaaggactttcctcccattgagcttcagtgctgtggcctcagcgtgaagtctctgcctgctcacgggcaggtgaaagagcaaagcctctaactgtaggctgattgtctaccttctcaatcatgaaccagccccagaatgcactgcctcataacttatgagacattcattggcatggttatttaataatgttttctgtcctctgggcaccatcttaaggaagatagaaatgcatgataaagttggagccttctagcaggaaggaatgtatagacataaaggggaacaaatattttaaggatagggtagctgggctgttcagatcagtcatcccgacacatgagcggctaaggcaggaagattggcatagttccaggccagcctggagtacagtctcaaaacagtaataatagcaaacaaaacatgaggtaggagaaagagaaacacaaccttaaattacaaacagatgagactcacttggaga

SEQ ID NO: 30994 - DNA, 1218 bp, Mus musculus
ttgtggttatgtaaggaaatgaccgagtatttttagagatgcatactgaagtatgtaaagctgaagtggcaccatggctaggatagactttaaaatgctgaagcaaagaaagcggggagagagaacgatgaagactttattggatctctatgatggtttatggagtactcgttagtattctactttcagtggtccagatttctgttttcacagtagtttttgtataattaaaatatttttaagatttttttaccaccactccccctgccaggaattcctatatgcatctaaggttaagaactactggcttatttggaaattaaattcagaccaccttaccctagctgatcatcttagacctaacctagttcatgactttggatttctatcagcataaacttgatccctccagctcataaacagtgcacatctggggacaggatgggcaggcacaaagaacaacctagttctgcctctagactagaattgaggagtagctcagtagacagctctgtgtgttccccacaactctttaggagagttgctgtaccttggagctgacctgccttaccccttgccaatgctccatcctgagagcttctctggccacaccaggggaataatggtggttgcagctattctgtgatcgtgatagaagaaagtcctcatttccttggagcactttacccactgctggtgtgtcctaaaatttgtatccaaccgtcattcccagaagtccatccacattctcttcctcccccacccctccctgtgtgtgtgtgtgtgtgtgtgtgtgtgtgtgtgtgtgtgtgcgcgcgcgcgcgcgcatgtgccccttgtgtcctcaacattgtcccaattcccaagtgctattttgttctggctgcttagtagatgagaccaatagcagctgtgcagccaaattaaatggagttctggacgaaggctggagcttctatcctacatttgcaccatggccttgattaggaccctggctaagcgcttcttcattcaaaggcaagctactgactaatctttattcagggggctttgtgacttacacctaaacattaagctaatctgtgtgttgctatagggtcctaagagggggtgagactacaggcgatctaggtcacttatcagactagaataaatacagttttaccagagtatttactgagagcattgctgccaagctcccagctcctagggcagtcc

SEQ ID NO: 30995 - DNA, 1231 bp, Mus musculus
tctttagcacattaagcttcctgtgtgattttaaagacaaaaggaactgagcccaggggacaaggacaaggcaaggctcccgttcatactgagtaagaaatgctttccagctggtataagcactaacctagacttgcaggtagccttagtcacacccactctgcttccttagcattggtttgagctgcaagagaatccagagaaaggaaagtatcagaaattcctcctcctcctcctcctcctcctcctcctcttcttcctcttcctcctcttcctcatcttctctttcttccttttccagtcattacagactttggcaatttttcaaagcactgctcattttctcaggattctcaatgtgttaaaaggtagtagttgcatattatttaatcatttagattctctgtaccttatccccctctaacagaaactaagtcactataacaagcacgaggagggttgtggctgactctccttttacagaggaagaaatgtggcagcaacctcaggacagccctcaactttttcccagggtagctcactgctagcatcaggactgttaactacataggaggcagaccatagtctatcagactctgcctgagtgacacctcccaggcatctcttcaaacagccgactgtagggagggaggccgtggcagctgctctgcactagagaactcttctagtcccaggctgctggagtaaggaagaacagaaccctcaagcaaaactctcctgtagaggaacatcaagaaaaatattttccactctgcacaatacatggtgtgtttgctgcagggtaagcatagcttcagtcactggtaatggtaaaatattttgcccagtaacatccttactgtaataaaggcctgaagaggcatgtgcctgggtccactctcttctgtactctccgtctaagtggaaggaggttgtgctagtggtgtagggttaagagggctgtagtctggcatcttctctctcatttggtagagaggaagtactctttgtcatagtagaatgccaggaaccttatttctataaagccacatagcagacctcaccagtgagatcagttctgtattctttgtgaggcttgggcctcatcatctagaattagatgtcactttctcttcctgctacaatggtgacttaacctcttaaccataggaaacataatctactggctctttttaacccagtaagtctacttgtgtaaaaatgctggact

SEQ ID NO: 30996 - DNA, 1228 bp, Mus musculus
ggaaatcagaaatcagcgccccaccttgtggtgctgaggcagcaacttcatccccacttgcctcagaatgtatacccaggaagctgttcccaacagcctgagttgtgtccatggcactaggaaacgcagtcatttcttggattttcatctgatcctgggccaagtcccaccctttgctctgctgcggttttctttctttattaggaatagatagtaaaaggaggacagagagaaccagccactgttgcctgcgttttaagtgcataccagtgtttatgtgctgccataggcactgatagccagaaatgatctgtatacctaggaagattcaaaattggccatttcttagccaactgctgcaaagtgctgcctgcctctttcccttttcagtgccagatagatcacacccactcagtcctcattccctgcattagtataaatattcgctgaagaaacatgaggtccttgttcatggaacctccctgggagtcattgctctgtgaacctcaagagccagacccccacctcctccaaacacatcagactattcagcaacactgcctgtgggaatttgcagccaaactacattaccgaggctctcttaaatccaagcctcccagggtcctctggttgagcctgtactgcctgaccatcgggatctgctgaggtggcggttcacttctggccaggtcccaggagctgaggctgacccatttcccctgcttttttccagggcatggggaatttggttatatccccaacaaagccagggactaacacacttagcttgtgaaagatgcactggagttggggtgcatttatttaaactaaagaaaggtggttgacagcttttagcattttcccacacttaaatttaacattgtctccctccccacatcaagcctcttccctccccccacccccttcatttaaatataaatgactcggtctgtgtgtataaggctgtatgtataggttcagaatcttattcaatttaaccctttagggacattgaattaaaaattgaacaatatttattaaaatacaaaaatacacttttctcacattacaatcagtgttcttttgttggcatctcccacccataccaccccctttcaaatctgaacccttaattttctcttaaagctaaaataataactgaaagttacatcattaaatggaccagaataagagaccttgcccttgcttgtaactactggaggtagcc

SEQ ID NO: 30997 - DNA, 1190 bp, Mus musculus
tcgtagtaaatgaagtcggtgctgattagagtaaatgttcccaaattcagtggagtgctacatgggattgctttaccctttatgggccagctaggccacagaagttcctggaacctacagagtagactaaagaagaggctgtcaaacctgcagttcacagtcctcctgacctgaagcagtcttccagcgtcttactgagtttcctctggtattttgcccctcacaactagtagttctggctggtgcctggatctgtagtagtaccactaagaaataagagaaggcagttcacatttaaataaggaacactgcagtggactgagaacatgggcagtttcacataggcactgttaaaagaatgctaaaggtgtgttcaagaggctggccaaagcctgggtcagcagctcagttttgaagaatgggccttgtactgaagttgggatgcctgcgttctggttgttgtttcagattagatagaatgtataatgaagtatgccttgatttatgaaatcaaggagatgggctagaaagtttcacttacttctcagagtccatgactttccctccttttcagacaggcagctttgggaagaaggctgatcctttggggttgtagccttggaattaggctgtggagctgaggagagaatgttcccttcagtttagtataaacatccacaggactggaatagagctgatcacagatcacagcatgttcatttttaaagaatccttaagagagatcatattgacttggcctctcactttattgatgttaaggaaactcagaaaggcatggtaacttccctaaagtcacatgactagttaatatcaaagtctgtccctctgagttccttctatcagtatgctgatatgtggctaattggcctttaaagcctgggcttgaagatattatcaaatgcttgctctgtattctttgtgagcagacatgttctatgcttactgttttgggggtaaaggtggagttttgatagtgctaacatgccatttcatatgacttgggattctgataagaagtcaaaggaatgttcatgtagagggacccagggctgccaggctggcccactccctactttgcaaatatgtctgtccctgaggcattatcctcagcagccactagatgtccataatgcctcatggggtttgcaagtaacagcagggtaccatct

SEQ ID NO: 30998 - DNA, 1154 bp, Mus musculus
ttctatacagttgaacccagacgcagggttattgaactgcgataaacaggaaggcaggatttttacattcagctgaacaaggaggcaggtttagctaatttccgtaggagcagtcttcaggcggtaaacatgggtggggagaaagcgacagtggaggtgttctacacactgtcagcattcacactctgactcaagaaggctttgccatccctctgagcctcactcggggaaggttttgccacttccacagggcaggggcattggggtccttggcatggctgtgcccatgtcagtacattcactcaggacttctctggttctagctgcttctgctacatagaatgaatatagaagtgagcttggtaccattctcaagccttgaacttgcagaactgtgcccgtgagctgacacgtgtaccctctcttttgtttccaggtggaggtagaggtagagagcatggataaggctggcaacttcattggctggctgcacatggatggggctaacctgtctgtcctgctggtggagcaagcgctgtccaaggtccacttcactgctgagcgcagtgcctactacaagcctctcctgtctgctgaggaagctgccaagcagaggaaagagaaggtaccaagaacagactgtgacagtcagtcgctagcatgtgctcttttcttacctgccccttcccatacaccaaagggccaaggatgaggtgccagcttaggcacctttgatcctaagccagacacagaccttcagtgggccagagctgtcagtctggaagatgacattggagcagtggaagcactgtccaggacaccactggtgaaagcctggcggtcaacctgcccttctcaggcagtgtccaccaagggagtggacaacccacctctgaatttccttactactcccatttagggtggcagtccaaagagatgcatggagcccttagaacaggagatttacaaccagtctcagatactgcattgaagagacaagggaggtggatccaaagaagcttttggaaacaaattgactattaaggaactctgtggctttggggtgggagctgggctggacccttcccacactagcctgtctccagtgacttatagcctgcctaatagtaggataaatcagctggccaccaatc

SEQ ID NO: 30999 - DNA, 1225 bp, Mus musculus
atgaggggtttggaagccagctgggtgacagtaacctgggtatctcaggtgtactcagcatcttccacttgtgacctcctgaaggctgcttcactgctgaggaataaaagatttcttcacagtgtgtaaacgtttatacatacgggctaaaccagcaagggaaatgccgagagcctctgagaccaggtatgtgcagaactgtttggacagtggcttgtgtgtgcatgcattagtgagtgtatatatctggaggaacctgatgatgctgaagcctagaagctgcctcctcaggaccttagctgcctctctgctgggtttatttaattccacccagtgtcccatacaagcctccctttcctctatacttagtggttctgggcaggaacaaggagggaatcacgggtggcacatatccacatacagatatatactctctctctctctctctctctctcctcccccacccccgtcccctccctcctcctttctcatcccagcagggccttgaacagggctggattggccattgattagttttattgagcttggccaccctgctgtgtgtttgaaggcctctgccaccatggctccatgccagccacacccttggagcctagtgagtagggatattaaataggatttagacagccaatggagtcccttggcacatttctctttcctgtcaggaggagggtctggggctccctggaaaaagcacaaaatagagaaaggatggagggccagaaaccaggaggagacacagcctctgctcctcgcctattctgacttatacctgtgcccagcacaatagggtccttccctgtgacagctgcagcaacaaggggaccctagtaagttccagatatagtaggaacctgaggaaatcagaaacttgcttggcagaacagcctgcagcagaagcagaggagggaagggtggaagtctgtagctagagctgtgaagggtctcagcagtgccttgccccaagacagatccaccgtgcccccagctttgcagcagaagagaatctttctttagcctggccaccatccgagttcaagaagacatcaccacacaaatgcactcacaagtgacccaagatcaggggaaactaattaccaggctcctcatgtgcctaggccctgctgctgagccaagattcatagctccttggccataaggggtctttcccagcccctccctccctctgccaagaacctgggag

SEQ ID NO: 31000 - DNA, 1200 bp, Mus musculus
gggtggcccagcctctgagctgaggtcagagcaacctgctggaggtgaggaatccagagcacaagaaaaacagttcttcacagagccaagtcccccattcccagctgcaactaggagtgcctcaggaacaggagtggccatagaaatgacctgcagagtgaccttgcagagcactgtgggaagggaggtggaggtttgaaactagagggactgagcagactgcccaaagccaaggcagctcactggtgggatccttacactctactcctgggatcacctggaactcggtttgattctaatttaataagcctggggtgagatcctggagcctgtttttaaataagcttccagtttgatatctgtcagaatcatgaccctctaacctggaacttcagagactccagctttcctgctcagaatcagccctgcagtgaccccagacttacccaagggcaacacctatttacccaaagcccctggttgggggtcctcagcgatgtccccctcagctaccctgtcttcactaccgcacctgcaggtctgggcccactatgaggagcggcctgtggaggaggtcatgcctgtgctggaggagaaggagcgctctgccagctacaagccggtgtttgtgaccgagatcacagatgacctgcacttctatgtgcaagatgtggagactggtgagtgcctgtgtgctgccccctcacagatcccccacggaacttacaactgctactgcccctgcctccatcgcactgggactatgtcacctctgctacccacaagtgagccctggagtggacatgtggcaggccaagcaggtcctctgaggacaggtggcattatagattcatctgggtggttctctgagactcttaggtaatggttttcctctcagacacccctggcagccctgagcgtgaggatttgttgcctaagtgtgtcaggaatcatggagcagattgtctgatatgatcagggggccctcttcttacagaggaccagaagggtacaagcttgtccctctccttgaggtggtttctcctacagaggttggttagtgtagaattgtagtggccagtttccatgacaacaagcagtctctaggggaagctatcccctggcattctttgtgaaggaccttctcctttctcctatgctcagtccaccacccgatggccatctcagtagagaccgttc

SEQ ID NO: 31001 - DNA, 1182 bp, Mus musculus
ccaaggggaaaagagaccacaaaaggcacggtgagctggcggagtgactgtgaggctggggagctatgacgacaatccaggatgctagtgtggtaaagacaacaggtctgatagggtctgtgtgctggagccagactccagagctttagaggggccagtcattaggtaagtctggggcagagaaaagccacttttcctcagaaacaggccaggtgagtgggtacccaaaacttggatataagagtgttttctgtgcaattggtttgggtagaagaagggtttcttcatgtccagggcctgtttgtcactcacagacaccacaggggacagtcacagactctgctggaggtcacaggacaggccttgagacccaggtagctgttgtttgaccttcacccatccccttcaataacatggctccatccatatctaggaggacgctcgcacagatgctgtggacagtgtggtgcgggacatccaaaacactcagtgcctgctcaacgtggagcacctgagcgccagctgcccccatgtcactctgcagtttgcagattccaagggcgatgtgggactgggcctggtgaaggaagggctggtcatggtggaggtgcgcaaggagaagcagttccagaaagtggtatgtgatttggagagggccccatcctggaagcaggcccttagcacataccctgcatcatcagcagtatcacagatgagggactggggactacacccagtgccagtgaggaagcagagaatccaccagcctcctggtcctgctggggaaagataatggatttgggtttgttgggtttttaaaaaaaaaaaaaatctaattaaagcacaaattaattgactgcgggtttggctgagaatgcagctgcaaactagagcagaaagtttccctctgtctgtgccccagtcaacaggctagggagctttgccaggggcgatgcagagggtcaaaacttggctccctcccagtcttttttgttaacatacagtctccaagtcctattacacaggaccacccatagccatgttccaaaagactctatctcaaggctcctccagcctacttggaaagtcccaggacccaggttactgggaacccccactgatgagatgagggttcatcgttgagaagctgggccttaggctcatgagatgaagagactatta

SEQ ID NO: 31002 - DNA, 1506 bp, Mus musculus
atgggggtcattgtacttgacatgaagaaggaagtgttttatcagagagttgaggggtggaatagatagccaggtgggacatgaagggaaaaaaacctgtgaacacatggattagccagtgcaaagttgagcaaacccagagagcaatgtggctgtacagcctgcagcttgctctaagtgctagtctcctctgggggccacccatctgtagcagcattttttggttgctcattcaagagcacctccatcttgaccacttcccatcttcttatgtccctcagatcacagaatacctgaatgcccaggaatcagccaagagtgccagggtgagttcttgcctggggtcatggaggggttgagtttgagaggcgtggcctggtggcttccattgggtaacaggtcccttaagagtcgtgtcctgtctccctctctcacagctgaacctgtggcgctatggagacttccgcgctgatgacgctgatgagtttggctacagtcgctaaggagaacttgcctggcccccagcaccgctgatgccagaccttctcccgctgccaggaagctgttgtcgactccagacctggttgagggagtatagattgggtctagcttgcttcagtgtacagaaacctcctctgtcgtggctagcattgaagctggggtggagaacccgaggttagttgggggcagacccgcacagtggtaatgccgtccagtctctcccagatgattttgtatttttatttggggagagggggctggttttttttttttttttaattgtcttcaaatcaggaaagaaccatgaaagactttgtgttagtgaagggtataaccgtgacacagaggcagctgtcagctggcacccacctcgtcccccagaccacccttcttcccaagtgttgattatgtgacttctgatacatccgttctcaaactccggtgtgcccacatctgcctcctcaccagcctggtctgtatttaaagcttttgagacccaataaaatagtacctgctgtctgcagccttactgtcgtggtggagccagaacactgtgttcctgaccccagccagggggaagtctgaccacagtcctgaaagcaaggctgcgtatagaggtctaggcagccctgaggcctgctaagtccaaccatgccatgctgcaggagagcagacgtctccttggactcactgcatgtgactgtcctccaggacctctgcctcggagtctgcatggctgcagtacccagagtccccaaggctcacccatagcatgatcccagtgaggactctcccagttcctactgtgggctcacattggattgccaataagctgggcttggtaattcggggtataccccaacttcaggagactgagacaggaagatcattaattaatttaaagccatcttggactatattgtgttcaaggtcagcctgagcaacttaaaaaagttttaaaatggccgggcctataccttaatgataaagttgcttgcctaggtt

SEQ ID NO: 31003 - DNA, 1571 bp, Mus musculus
taatatacacaaatatagtatgagttttttctaaatgaacctttttaacatttttaaatcggttacatagtctgtaaggactaagcacagagaaaatgcttactaaagtagtctctgaatgtcagagacactgggaaacgactgaaggccatgggcctggcagcaagtggcacctgagaagggtctgcccccggaggggaatggctggctgggaataagattgcaggctagaccccagcctgaccatggatggcccagatgaattgcacagagctccttcccccagggactgggagctttctggtgagaaagcagcgaacttgaggccatgacctaaagcctaaactcttatctagtcatgttgaatatgcagttaactaaatgctctcctggtcactccctgcactacatactcttaaacattcttacctatactttctcttgcctaaagaaagctgggggtctcagagtcagggtctgcaagaattctggtggtgtgaagagtgggctgttgtgaaagatgaagctcactggaggcaaaccaacccccgtgctggacaactctgacacaagatgtggagtacactgatagattctgccaccgcagagcctcctgtctgcccccttggcctggagagcgtctccttaggatcatttgtttctcagatctctactgaaccctcagcttttctggtgtttccttcagtatctgaaatagggctcctcttacctctccaacctgactcctgactggactctccgaccctgtttgttttctcttggcactcactaatcatcatctcagattatctccccattaaaacatctgccttgagactttctcttgtttgcccttacatagtggctgtggaataaatatttactgaatgaaaaagaaaaacaataacaaaggaaaaggagcagtggtagtctgtagaaaaggctgagaacttagcttaacttgcttgggtccctgacctaatgtgctgatttaaagtatgctgtcccaaaatatcgctgagccaagcagagagctgttttatggcattgtcttgagaaaaccagcgagtgctccagaaagcccttgatggcctagaggtagtgaaggaagaaatcatggaaacatttagactgtactggctggttttatgttgtcaacttgacacaagctggagttatcacagagaaaggagcctcccttgaggaaatggctccatgagatccagctgtaagtcattttctcaattagtgatcaagcggggagggccccttgtgggtggtgccatccctgggctggtagtcctgggttctataagaaagcaagctgagcaaggcaggggaagcaagccagtaagtaacgtccctccgtggtctctgcatcagctcctgtttcctgacctgcttgagttccagtcctgacttcctttggtgatgaacagcaatgtggaagtgtaagctgaataaattctttcctccccaacttgcttcttggtcatgatgtttgtgcaggaatagaaaccctgactaagacagaccatttggatgtatatcccaaggacaggtgttgtctt

SEQ ID NO: 31004 - DNA, 1398 bp, Mus musculus
cctcctagccaccaaggacgatccactcaggtgtggcattggcaggaaggagcacaggttcctttagcactggcatggtttttcatgcagccttggccagaggaagacagaggtccagggccacctctgcctcctccagccccctggctgagaggcaagctctgcggccccttgccctatcccaaacctggggggctatgggcaagaggatgctgggaagagagtagaggccacacatcttctcttagccctgttttctttgtcttcacagttacgagaagcggctgtactgaggacagcggtggcggccaaggcagtggagggggcgaaccccggggcccccctctaggaacagcctccctccagaactaagtggtccatagatttgcactacgggttccccagctcctttccagggagaggagtggagtccttgaggggcctgtggcccctctcccgggcaaccccacagagtcaggtagccccccccccccgtgccaggctgccccataagatcttccgggttcccccttcttcagttccctgagcccagtcagccttggctctcaggccctgtgcctgcctcaggtctttctcactgcagcctgctctggcccaatgtccaactctgacccctggggaaggtagcccctcctggcttctcctatagggcacctctctctcttgctgcccccttcctcccaggaaatggtgctctcctgaccctgcctctggcccgtccctggagtgctgtcctctcagccatgtggcactgtgggttctggacctaggccagggggaggtctctgcccccttcctctggcttgaggctcccatggggcctgctcctcggcttacttccccatctctgagcccagggagggcctgctgatgaccacctgcccttcattcctgattcaccaccatccccaagtgtaccgtccctgccctctcttctcagctgcagttgaaggctttaactttgcacactttggggtcacaattgtgtcattgtatattaaataatctgaataaatcaagcagttatcaatgcctctgtgatcctgtttctgtcctttgccctcggggtggctggcccctgtctcaaactcagaaattcgcctgcctctgcctcccaaatgctggggttaaaggcatgcgccaccatgccaggccttgggcaatctcttgtttctactcttccctgacaacccctccccaccacccacaagaacagggaacaggagacttcaaataggcatgacccaggagttcagaagaggtctgggctagctctcccctgagggtcatttcaacttaggttgccctattgtcaatcaaggataacccagcccagaaagaaggatgaccagctgccattaatccctttcccagtgg

SEQ ID NO: 31005 - DNA, 1165 bp, Mus musculus
gctttcatctcaactgaagtgaccttgcccatgtgcctcacatccactttcttttcaagtggagtgatcagttccccaagagctgtactgctcactgctgggcctcaaagcctggcctatgcaggatatagatgctggcgaatgtttgtccagtggataaaacccttcaatggactgtgcttctatccttaggacctgacatcagccctgacccggaagatcacactgaagacaccattgatctcgtctcccatggatacagtgacagaggctgatatggccattgcaatggctgtgagtcgcttgcctgggtggggctgaacaggaacggggtgtgcagagggaagaggaggctagcctttgctcttaccatacctcccttctataccagctcatgggaggaattggtttcattcatcacaactgtaccccagagttccaggccaatgaagtacggaaggtcaaggcaagtactggactcaccctcaaaaacatgcagtctacttgatcctctaactgatgtgggacctaggttcccttccttacaatgaaatatgggcttagccccccattttcccgttggttctcaccctattgaggactctcacttctcaatggcccatcagggtcccctgtgtccttggtggccaggctatgtgccacctttgggtttctttttttttttttttttttttttcgagacagggtttttctgtgtagccctggctgtcctggaactcactctgtagaccaggctggcctggaactcagaaatccgcctgcctctgcctcccgagtgctgcgattaaaggcgtgcggcaccacgcccggctcacctttgggtttcttgcagctcttttcttcttctgtctacagaagtttgagcaaggcttcatcacagaccctgtggtcctgagcccttcacatactgtgggtgatgttctggaggccaagatacagcatggcttctctggtatccccatcaccgcgacgggcaccatggggagcaagctggtgggcatcgtcacctcccgagacattgacttccttgctgagaaggaccacaccaccctcctcagtgaggtgcctgcagggcagggaaggcagagctgcatcacagagggaactctacccccgggggccccagactggtgcctgtgaccag

SEQ ID NO: 31006 - DNA, 1366 bp, Mus musculus
gacttgccattgtccctgtctccctggccggcagggcctcctcttgctcctgagaaaacaagggttgagagtaactcagactctttctttctttcttcacaggatctagcagcagaaagcagctctacttccctgcaaaggagctgggcaccgtcgccatgaagttcatgctgaacctctatgtgctgggcatcatgttgaccctgctttccatctttgttagagtgatggagtctctgggaggcttactggagagcccactgcccgggagctcctggatcacgaggggtcagctagccaacacacagcctcctaagggcctgccagaccatccatcccgaggagtgcagtgaacctccctccctgcaggcatcacagcttcagcatgtccaaccacacgttccatttctcgggaggcagcatcaagtgtctccaaaggactcttactaggcctggaagggctgttcccttaccctggaaaagagcctatttcccctagagctgtgagtgggctgtctgtggctctgggatggaggtgtaccagttccagctgttgggagaatggattttggtttcgtttgtttcagacctctgtcctaaaggactcttttggacctaagtatcttctgttggtttaccattgagtctcttccctgagagttgtttggatggcatcaaaggggttgtggtttgactgtgaagacagagggtggactatccagtgtccaggtcaagttgtacatttaagttctttctccagtgtaatgcacatgtgtttgtatataatgtctaaagggctatgggatgatcaggcctgcttagggtatgggagttccagccactgtgtggcttaaacatgaatttttctaatgcaataaatgtgaatatatatgtttccactgtttgtcctgttgacatgcctgcccttgaaattagtaaggggaagtttaaatcctaaatctataataagtaagctttatctctatttttatttttgaggcaggatctcactgtgcagccctggttgtcctggtagtcactatgtagaccaagctggcctcatagagacacctggtgcctcttttgcttctctagtgctgggatcaaaagtgtgcaccactacatttggccatttttacatacatacatttatttatttatttatttactccagaagagggcgtcagatcttgttacagatggttgtgagccaccgcgtggttgctgggatttgaactcaggacttccggaagaacagtcagtgcttttaactgctgagccatctctccagccccctgtttttactcttgagatagtctatggtagctaaggctggccttgtcccccggattcacctgcctctacc

SEQ ID NO: 31007 - DNA, 1193 bp, Mus musculus
cttaaggagctctggtgtccttttctgacctgcaagcagtagccacatacatgatgcagtgttttgcaggcaaaacactcatgcacataaagtaatcaaagaagaaagaaatgccccttgtccaaggccacacagctagaggtgctaattcacactcagacaatgtaacttagagtctccactgcctcccagatagacacaagacattcaagtcttctactaaccttaacaccagtagtgctgagaccgcacattctgagttaggtagtcaggagccagttctgtgttgagtggcagccctttaccttcagcttggacctgatttggaggtgtgatcaccaaagctttagttcaaaacaaagtgtctttcaactgctgcttctgaaatcaaaagccatttcttcatgcttggtttaacttcacctggatattcattgtttgatttatcgtttgtgagatctgcctgttccctttacttttttgtgttttcgggaagttttttttaagatttttacacaatttttgttttctagatgatccagatcctgatgatggatttaattataaacagatgatggtcagagatgagcggaggtttaaaatggcagacaaggatggagacctaattgccacaaaggaagagttcacagctttcctgcaccctgaggaatatgactacatgaaagacatagtcgtgcaggtgggcgaggcgagggtcccggcagctacggctgcagcccagcttctcctgtgcccatgcgcttactctgctctgtgcttgcaccgtgcctggctgtgcagtggccgcacactgaagctaaggagcattgctgcttttcttcagtaccctaggtttatcataacactgtctatcaaataatgtatttttccacttcattgctatgtcatgaagttaaaaattagaggaaatcttattccaaatatcctgtgattggtgttcagaagccaagtaatgacatgacacttaggagttctcccagaaggcagaatcatctccctcattagcaagagttcagcatgactagggccacagtctttgtcatttggtagtgtcctccaaaggactcagctattctaggtagaagtaaaagaaattgctagtatttacctattttctaactaaaaggatatgggtttccctccctcctttccttcatttcttccttcctttg

SEQ ID NO: 31008 - DNA, 2951 bp, Mus musculus
ctttacacggaaccatatcctcagctcactaatgactttcttgatgaagtgtgtgtgtgtgtgtgtgtgtgtgtgtgtgtgtgtatgtagaagggataggggatagcatgtttacacacgtagagggaactaaaaccttaagttattacagtctctactattttatagcagtctttctgaatttggaatggcaagtatatggcctcaattcactgttcactctggtttcaggatggcaagctcaccaaggaggagattgtcgacaagtatgatttatttgtgggcagccaggccacagatttcggggaggccttagtacgacatgatgagttctgagctgcagacagaggaacctacatttcttcaaaagtaatttatttttacagctctggtttcacataaaattgcgctactgagactgttattacaaactttttaagacgtgaaaaggcatattgagatagtgaaatcacccgtccccactcctcctccctctgaggggctggagggaacccgagcttccgaggaacaactctgattagtacacttgtgtctgtaggtttacactttgtataatgtataacatggtgtgtttatttttgtattgttctctagttggggctatactatgaaggatcgagatcctccacccacacttgtaggcagatattagcatttacacgtcctcaatcctttaccatagtttttataattctcacttaactaatttttttaaagcctgagatcaataagaaatgttcaggagagaaaaagcaaaaggaaaaccatgtgtgtcaggatcgatgcttagaggagaatgctttctcttgcctgttgaaaagtctcattgcatgagttgctgctcggttgtcataggcccagccactgagcctgccattgtctgggcaacgatagagtcctgtgctgtaagacagcttgacacaactcgatgtcattctttttcccctttaggactagctgttttctaattttgtcagacacagctgtgctaggaagaattagggccagtgtcttgaaaaatcaatcaagtagtgtgtatgatgtcttcacggggctatttctagctctttatagagctgtttccaactagaaacagctggaaaacaagaagaacaaagtgtatgcagggcatgcatcttactcttacttgaaatcactgtaaggccccatccagcccctttctaagaattaaccttggttttactgcagttaaagttgattcttttccaatcatgacattgaaagtgcctttaacaggaaaaatgatcactgaatgggaattggactaagataaacaatttgggcaccttccatgaaagcattgaacttcctgatacagtggggtttccccctttttctcttgagaacaggagctaaatagcagtattcattacaagcttgcttgcagtgttcttaccttgtgggctggttcctaaacctcaccctgctgattggaccagggatcctcatacctcagaaggcaaaccactcttctcccaggcctctgctcaccagggcttgagctttgcctcaaggatagaaggatgtacagagggggctcttggtttgaggaccacttgagccgttttctcatctccctttctctctgacacaaaaaggtggggttgtaggagggttgtagatcatcatgttgccatccttattaaaaataatcatcatcatcatctgttgccaactccattcacctgttttggtctcgagttgatgggcctcttaagaattattgtaccccaagtctttaaccctcaggttactaagatgaatacacatctgtataatctttattacttcctatatctctgaacaacacattcaggtggtgctgggtgatggccatatctgaacctagacttccctttggtcttccccaatccagttgaggtgggcggcctggtgtggtaaaagcccagttgtggtgtgacttcaccttagccattgcatcaagctcttgatagcagatacactcttacgtttctaaccccagtctaggagtaatgaacatcactgccttccaggccctcaactgtattgttaaggagaccagagataatgaatgccaccaaccctggcttagaaagggcaggtcacacactgtgtggcaagagggcattacagctcattaggtgcacagagcctaatgctagcgtgaaagtcacacacttatccagcaagctgagtctgctaggatggcatcttctggacctgggtgctcagcagcaaaaactgtgctctaatgtctatgagcccctcatagtgttggggtttgggtgtgggtttctggtttaaatcaagtctgaggcagtgagcagtggtctcatgtctatagagtgtgccctgtgaatgctaagctctcttgaatttgagtattggttcttttttttatagagtgtaaaccaagttttatattctgtaatgcaaacaggtacctatctgtttctgaataaaactgtttacattcatcaagggcttatgtgtcttttattctcttggaaatgtgattatattccaggtcagccaaggctgcatagagagactctgtctcaagaaaccaagaagaggctgaagagatggctcagcatttaagagcactgtttgctcttcctcaggacctgggttcaatttccagcacccacatagcagcttacaactgtctgtaactccagtgtcaggggatccaacactcacatagtcacacacactggcagaacgctgatgcacatgaaataaatcagtaaaaagaaagaaccaaggaagaaagacatgggtttagggtactatgataaaatgtcagaaaaggaattttcccaactccatttacctatcaatgggcctctttaagaattactgtattccagcctttaaccctcaggttactaagataaatatacatctctgtgatcttttatcac

SEQ ID NO: 31009 - DNA, 1128 bp, Mus musculus
ttttgcaactgttccaggctgccagtatgaggaattcctctgctcttctcaaggctctgggagcagagaagaaatgatacttctccagtttatatgggttttaaccttggattcttctctctttccctttgttttctcatcctcattatctgttgggtttgtgtgtgtgtgtttccatacaatcacgtgtctcccggtctctcctgtgcttctcatttgacatgttgcagccatcccctgcccctgatccccccatattctccttgcctcttgtaggcctggtggtcatatcagctctgctctggtgctggtgggctgagacatcgtcctaacccaggtactggtattgcttcctctcttccctctcagcttcttacttctcccattatacaataggtgatgctcaggtctgagttttagccctggcttttcctttttttgctgtaaaacctacaagcttccttgagcatgccatgattgatgtatgtaatggacaggttgttggagtgctttccagaagcacaggttgagtttctgtctttggctgcgtaaaatttggataagaacatctctgttgctactgacagagctgctccgctcttctgatgagctgatgtttgcttaaattctagagccaaacatttgccattgtttgaacttggaaggaattcctccctgtgtttaaggtgatagaggaggtctaaagagctgtggtccttctggtcctctggggagcatttggatgagcacactctgaattggtcccatctaccttgaaggaagtagaactgaatccccattgtactatgttgctcaccttaaaagttctcaaaagtttggaacttctggttaccagaaaaatgtcaacaaaataccagggaattatatacattcctttgggtcaccagattccattgtcattggcctctcaagccagacttctggagagggtgtgatgttgctgaaaagtttctaatgattagagatgaaaatactctcaggaagtcaagagcgacgtgttctgggcacctctcccttggcccagttcatgtaatctgctctgttgacagaattgccagtttaggatggagattgttccatggtctaaggtaggaacccgaggtgcct

SEQ ID NO: 31010 - DNA, 1205 bp, Mus musculus
acctgtacagtaatgagcttcttctctcggggtttgacatcaggccattcttctccaaagcaaaagaagatctcaaaaggtggtggggtattagtctggcccttctggaacaggatgagctctgcatcaagatgaaggcctttagttagaggttacaacccaatcctgagtgaggggcagccaggaggagcacagaacagacctcaccattgagaaactgctctaggctaaagagcttcgtcttgacttcccgctgaatggggttggggcaggagccatgggccaaggcgcagggcccactccagaacaccttacactggcacagacggatggcgtacaggtcctggccctgcagctgcaggatgagcccacggtccaggacatctagcagctggttcgtatagaaacgctgcttgtcactggggatgtcctctgggctagggaagcgcacttgctccagggtcacagggccaaagagttccacttgctcctgggtagcctctagctggctgtagaagagcctgcagccttgtgggttgctgatggtgagggtccggggtgcgcgtccccggtactggaacttgatctctaggtccgtcactgtggagcagagagtcgggttgccctgactgtgagcctcacagctactcagcagccgggtggtaggcccaacttccccagcctccccagttcagccttgacccaggaagactggcctaaaggcttattttcttcgccatcctcctcccgtgcaaccctgccccatccccacgactctgccctggcaacccgcctggcctgtcaaggtccttacaaggcaacatgtgggggctgatcagcaggtcaggcaagagtggttctgtagggggctggctggaagccagaggtccaggctccaggacctcagggagaagctgcctgaagccagcaggatttccagagggaggggccaggagatttgggtctgggacagggggacccagccctacaggtggctggagagcaggtggccacttggtgtcttctttgggtaaggaatagggtgcgttgggaggcccaggtagcgcaggctctgcagagaatggggtggatacagctgctaaagccacctctaagaactatctcccaggcctgactcccagacttgcctcccacagcctctctctcagtgccctctcaagtacctagaatacccatcacttctt

SEQ ID NO: 31011 - DNA, 1624 bp, Mus musculus
gagtctagatcagtgcttgttaaaccattgtcagtaaacagagtgttctttcagcattaaatcttacatgaaaactctgtatttactaacagactaaagtggagcttttcagatggttttgcattgtgttggcttcctcccaacctttccatcatccttagtgtctgcagctcagcacaggagccatgctgcaggcagtgtttcagcgaagtgaatgctaccttggagttgcaagttggaaaaagccagtttggttgtgcttatttgttaaccagtgttctgtaacggagtccacagcactacctctgagctggctctgtccctgctcaccctgctcactctcctctggagctcattagactctctcttctcttttgtcaggaatgtctttttttattagaagacaggaagaaaacaacccagactgtgtcccacaatcagaaacctctgttgtggcagaggggccttcactaccaccagaccatcccgccacacagggagagacttcaccctccaaggcatcctaaggagtccctgtttgggatgtgagggagaaacagcgcggtttttaaggatggctggagcctgtccgacgtggtgggaggggaactagtttcctggtgaacttctttctaaaaggaaaaataatttaagaaaagttaaaaaaagaaagaaaatttttaaaaaggaaagctgagatgacaccagaactgaaatatgcacctggtagcagatgatgcacacacatgatagacacacaccagcatgcagtgcacacactgagacacgacagtgagacagacacattaccttagggaagcgcggggatgcgagtaggtaacatagttacagttggaattaaagaggtagggtcacctcctctgctctccttcctttaaacacaggtgaatagaggaaacacccccccccccaactgttcacctttagaaatgtccagacaaggagcctggtctgcttatatcatggttagggatgatagtccggactagccagggtcaaagttgcttttaatgtagagcccaaccctgatcctattgagttgctaagtccaatccagttcatgggcctttgtcatcagccttggggagaaaagccaaaactggtgggtggagaggacaaatatggattaaaccttgctctctctctcttttagtgaattattcatccacaaacatggggtgggaagggataaaaaagagggtgagagtctggagggaatgtatttacagggctacctgtattttgctaaaaaaaaaaaaaaagtgtgaaaattaattgccttcaagggcactgttctgtcctgtggtgtagccatcttatgaataaatcaacagcaccaaaaaaaaaaaaaaaaaaaaaaaccagaaaaaagaaaaaaataaaaccaatttttaaaattttaccagtgtttttatttcccttcactactcgctgttcagcaatgacttggctgatccacctatgaaatcagctttcatggaacctaaaaggcgtctaagcagagagcttaaaacgacgtatcttgtaggagtaatcttgctcactgtgtaaagagatccataaagggctcagcagcccacagcaaggcaggatagtaaggtgg

SEQ ID NO: 31012 - DNA, 1173 bp, Mus musculus
ttgtaatatcacaccatacaccagcctgtgctaggctccttgccctccatcctggcagtgggaaaatgaatggcatgagcttgcacacatacttggctgcttccttatttagcacatggtttactttgaaatagactcaaaaatgtaccattattagtaaagcttgttaagtaccagggatatagctcagatggagggtatagttgatccattacatgtttatggtggagaaaacctaaaagaaaataccctatcatcaactcctggaatcccagtcaaggttttcatcatgattttggacctttatatttgttgaatgaattggtagataagcattttgacacttttctgttggatagctcttaacagttatccccttgggtgtttaaccagcacaggatggcaagtctgctttcttggaagtttgagttctaggctatatccctgtgcccgagtcccttgtcaggagagtgtgaggaagtgccttttccgtttgcttttgcttagcccggagttcagttagctagcctgctaggaagataccagaagaattaagtttctcaattggtttctaagtgggtttcagacaaagggaactttgaaaaaaatggagtcagatgtacattacttccataataactggacatctcagcatttgcggagaaccaggttctgcttattcattctccatttctgtgtgtgttaacccttttctatctcctcctcctccaagaggaaatcctgagcagcctgttcagctagaaaatcaatggctgacagactagttaccagacaaggctttgtaaacagaatctgtcacagcagaaaaatggaaagctcgggaccttagtgagccatgcgcacagaactaaaatgctccgagccttatggaacctgctggccatccttcctttgagggcatctgggtttcttctcctggtgtcaggaatgtcaagtagtactatagacactcacaccttctgagtcacttttgctcactgcccctttgtcataaatgttttttaggaatgggtttgatcctctgagtaacatgaagtcgataatagatgaggagactaaggcagagattggtgtcttgcccaagaacacaagagctagaaatcagccctaaacagtttgtctctgagcccattccttcagaaccaataagct

SEQ ID NO: 31013 - DNA, 1099 bp, Mus musculus
agatctccagttcctttcagctttgttgattgcaaactctccctcccccctcctttcccccccctcccccccatgattccaggtgtggaccctgttagcagttttcctctgcaggtatcacctgactctgacatctccaatatctggggtctccaacacattccatgcttcacctccacagcctcatgcagtggcctctctgggccatcatccagggacactcctcacagatgtccggcctcaatggcttttcttaactgaggaggaagattccacaaccccatcttgtatccttgagtctaaagccagatccagctttagactcaaaagtggtggttgaagctgccaagtgttgctagctggggctggtaattgattccctaattcaaatgcatttgtatcagctttctgttgatggtttccttcagtgctaaagcttttctttaatttcttttcccaggttggaagcttagctgggtgggctcttgtcctgaggccaccactccctttattccgtttagcatctggtttttctttaaaccttttatctcttgagcattggacttcactcctttacacttcctgctgctctcttttgtcctctgcttaagggggaccactgatcaccacccacagtcaatagtaattttgctgataatccaaaactccccaatttcatctcaggcagacttttttggacaagagaagaaaatagacccattcttaaccaacatatcacaagagcattctttaggccacttaatactctcctcctctgaaacctcttgagccctgctgtcatagtctacatttctctcaactgtcttccacattcctgctacgatggcccattaagccctgcttaaagtgtccaaccaattttcgtcttctaagtcccagagtcttccatattcttccaactaaggttacacctatcacagcaatgccccactccctggttctatagctgtgaaaagacaccatgaccaagacaattctttctttctttctttctttctttttttttaagtgtttacttgctggttagttcattatcatggagagaatggcagcatgtaagcaggtatggtgctggaga

SEQ ID NO: 31014 - DNA, 1135 bp, Mus musculus
cttttcttagtttcttccaatcttctcaaagttagagcaggaacatgctagcaccacctttcttaccatctctgttttccttggtttctctggtgtccagatatttactttgaattgcttttggcctttaagctcaagagtttctggcacacagcagttttttaggaatagaccaagagtctcatccagaagagacttcacttggctggcttctgtctctctggagagaagctagatctgcatttgcagagctcatcaatcaagaatgtttgaaggcctaagatagcattttgtttatttagtccaactaaagggagttctgtggagttggttggtgtctttcgggagcaaggtaagtaatcctaaaactcactcaatttctctatgcagactttctgtcggtggctagagaattccttgaaaggtttgccaaaagagaccacagtgggagctgtcacagtgacacataaacaacttacagatttccacaagcaagtcactaggtgagtgatcctggggccttgtgaatagaagacagtggctgtgttatgtagaaaacgtgtctgcttagatttgaattccctcagttggcatagagtgtcaatggatagcaacatcaccatgctctgtgtatgcacgtgcgcatgctttgtggtttccacatagtattcatggcaataactttctttttagtataaaatgaagtttgttttggggcttaagaagggagtagaggcagagatagagggggtacagagaaggacagagagacggggaacatcatggcagtatcttcctttgtagtttataactgttagcctttctctggtaggtagaacctttaaaatcttggctaaatgttaagcacaggcttctactctttcattttactgtatgtgtagtatgtgcaggtggcgcagtgtatgtgtgggtggtacagtgatgtgtatgtgtatgtgtgggtggtgcagtgtatgtatgtgtatgtgtgggtggttcagtgatgtatggcaaggtcgatagtgtcaggggaagaaacctggaaatacagtaactatccaccaatagagaatggtgaagtaattcatcatatgtccacactagtgaatagtcaccaaaaaagaaatacatgtgc

SEQ ID NO: 31015 - DNA, 1173 bp, Mus musculus
gattcacttttgatgttgtacattctgggttttcagaagggtccaatgactatttaccattataatgttattaaaagtattctgtgctctattttagcctccttccctattattcctagcagccagtgttttttgtcctgtttcttggctgcttttgtagcctaatcttgttgttaatgcctaatctcctctcactagatttattcagcgaagccctgtcaccttgctgaggagccaggttgtcatcccaatcttacagtgggccattgcatcaaccactttggaccaccgagatgccaattccagtgtcatgagatttctgcgagacctcatccacacaggagtagccaatgatgtgagtatatatttctactccatggccctttctcttgtttgtgttcttgatttgttttagttgacctataagggatcggccactgatgatccagttactaacttctagatctcatgtatctgttcagtgctgtaggctgtgcaaaggaacattaagccatctctgcttctagttatctgttttcttacagcatgaagaagattttgaattgcggaaggaactaattggacaggtgatgagccagcttggccagcaacttgtcagccagctgctccacacatgctgcttttgtcttcccccctacaccctacccgacgtggctgaagtgctctgggagatcatgcaggttgacagaccggtaaggctcttcataaagtagatactttatagatctattctgaaggtccctagcctaataagctttgcttccttgaaattggccctaagtttgaaccagctatactgtgtatgttcttggaaccaaatttattgctaagctccatttcaaagtaaaggagcccatagaaagccagtaattatttcatcatggggttcctgaaagtgtgttttgtcattgccgtgaggttcataatgtatatcaccagaagtaagtaccaggctttgggctcactcacttgtgtctagtctgtgggaaatctgtacatttatgagagatacctgcatattagttatatccagttagattattcagtatacaatcactctggaatctgtagtggactataaattagtgaatacaaatattaaaagtaaaccacagtatatacacctggattgatttcccctttgggtctatt

SEQ ID NO: 31016 - DNA, 1242 bp, Mus musculus
tggcaaacctcttggtaagctatagttcttagagccttttagcttttccttttttgagagagtgtcttacaatgtagctttgactggtttggaactcattatgtagaccaagctgacctcaaacttatagaaatctgcctatgtctacctcccaggtgctgggattaaaggtgtgcaccaccacacctggctcagctttttttaatgctcaggggcggttcagacagtttctatatatcgttactaatttggaaaaacaatgcagttaggtttaaaagaaaaataatagaaaagtagtagtatctgtcctgctgcccacatagccagagttgcatggagtttgcttgttctagtggaagtgaacaagcggtagtttaatatttgtgtgtttgtgggatggcttcaattatatttgtatttgcttgaataggctagaagaaacggttgatgtaagtaaatgactctaccacttgattttatgagcagagagcatggtctgggttcttagttaatttttctttcactgtttggggcttttgtcttttgccagacacaccaatcctattgtagaaaatggacagactcatccatgccaaaaagtcatccaggaagtaagtactgatgggcgttctcttctttttcttttagggccttaaggacctcagttgaagagacactgtgtcatttgttcataaggagatttaaactattattatggcttgattttaggtttaaacttgataataaaattggtttggaaatgcactgaaaggccaaaaaggtagaaattctaaaagtaactaattgctagggagcttaatcagccctagcacaacctttttgtcagtgctaatgacattagctcccctctacgtaatatttcccttagactttattcactcaagataatgtgaggatcaaaaggcatgggattttttgcttgttagattgcttgcttgttttgtaaattttgtgtatgtacagaggtcaaaggacaacccataggagttgactcttcccttgcgctgtgtgtatctcagagatttaacataggtgtaagtttcggtggcgagtgcctttactgttgtgcagtctttacagccagagtgatggtttttagaagtgcattaaagacttcagaagttgcataaatactagataaccttagttgttcactgtagcagatattgctatttataaccctgtacttttgtttgtcttccacttccctgaagctgcctt

SEQ ID NO: 31017 - DNA, 1207 bp, Mus musculus
taagctacacaattactttggatctttgtgagtttaaggccagtttagtctatgtagtgagttccaggccagccaaggctacacagtgagacttcatctcccaaaaaccaggcaaaaataaataaaaagaaaattttatatgagtctgattgaggaaaaaagacttttcattttcttggcatgtctggaagtaaggaagatgatgtcatggtgaggtctgacattatggggctgttcataatgtactctgatcacactggcatgcatttctgtaatcctagcacggggaaggtagaggcaggagaaacaggaggctagttgctgcatagtaacttcaagactactctacactacaggacaccttgtctcataagacagcacaaaacagttttcagaagaaggtttaaatgtttcccttggactgcagtggttctgatttctgcttctgcattccttctgttttccagcaacaagataagacctcatctaacctacacgaagctgcttcagactgtgtatgctcagctctctatgctattgaaaatgtagagactaacttgccattggccatgcagctttttcagggagtcctgacattggagactgcatatcatatggctgtggcacgggaagatttggacaagtgagtaattgttggagtctggagctctgggttacctacagcctgtggtttttcaaatctttgttagttcacccatcgtgttttgattctctgtggctttgtgaatataaagtgcatgctatctgaagtgccatcttggatctgggagaggattaattactaccagttagtgattgtattttcttaactcttaaaatgagaagactataagaaatagtcataaactttaaagcatctagttgaggggctggggagatgactgagtggttaagaatgggctatgctcctgcagagaacttggctttggcttttagcacccgtgtctggaccctcacaactgcctataattccaacactagggaattcagtgctctgtaccatgaacatttgcattcacacatgcgtatacccacagagagacatataacctaacaaaaacgaccaaggtaataaacatttttgaaatgtctgattaggaattttagattttttaagatttggttttgtccttttgtatgtgtgtgcgcacacacacatatgaatgcaggtgtctgcaaagaccag

SEQ ID NO: 31018 - DNA, 1226 bp, Mus musculus
agtagtgcagattatagtttagatgaagctttgagtctgggggattttcctatgtagtttatatttctggtgtaaacataaatgtcagaattttatcccttacactatagttgccgccatcttgaaattattttttaaattgataccagttgattattggcactcaattaagagacattcttctgtgataatggatacggttctggaagtccaactgccagatgtcagatctggtgaataatacactacaggatatagctctttcctctctgtgtcttgaacctcatggcagctaggatgtttcaagcctacggcccataagctgtcttaaaacattctcgtcttgaagaagttgcattgtgttttactttgcttaatctagcacaaaggctcagataaaggcagtgagtggcgacttttggtctgacttgttttatgccttttataaaacttccctttaatggtgacttaagtataaagatatttttaactatatttctcttctatttagatgacatgtgtagagaaagcaggaaccgatgagaagatgcttatgaaggtcttccgatgtttgggaagttggtttaacttgggggttttggacagtaacttcatggctaataataagttattagcactcctttttgaggtcttggtaagtaaggctgcacctgccattgccacttttaataaccaaccttctgggacacctcagtgttttgttggagagaagcactttgtgtgtgtcttaagactaacgtaaggagaagttgagattgatgggaactcaggacctctggaagagcagtcagtgctcttaactgactgagccatctctccagcccccacccttcttttcctaataaaatgtctttactcttgctactttaaaagcaggggtggttgtgatggtagagagatgtagtggttaagagcactgattgctcccagacgacgcaggcttgattcccagcacctgcatggtggctcacaactgtctgcaattccatttctggggggtctgacatcttttggcttttgttggcacctggcgagggcatgccacacacacacacacacacacacacacacacacacacacacacacacacacacacacacacacacacacacacgtaaaacaccgtacacataaaaataaatcttaaaacaatactaaaaattgagatgatttacatgttagctttccaacttcagagtctgtt

SEQ ID NO: 31019 - DNA, 1191 bp, Mus musculus
tctgtggaggcttctctgttgacctgatggagcatggttgtcaagcagttttcaaatgcttgcttttagggttgtgagtgacaggagcctgtcttgagagatttctgtcacatgtagagaagtcagagcatatacacacgaagcactagaagcaggaagacagaggggtgcaaggcagtgtgggttggaagaggacatctatagggataacagaatgatagtgatactaattatcatttactacatacaaataccattatgagaactttagtccttttattaatcgaatccttacgccctatgaggtaggggctactctctcagatgagaaaaatgaaatagtcaaataatttgtccaaggatatagagccattgagcagcagtgggcctccagtcagtgtatctgctcttgcccagtttcccagacccccttaaccctgatttaatctctccccgtggtattttctttttccttccccgtgtcagaacgaggtacaaaacatcaagttcaacagctcaggccaatgtgaagcacccttggtgcgaacagacaaccccaagagctggtatgaggacgtggagggctgtgggattcagtgtcagaacccgctgttcaccgaggccgagcaccaggacatgcacagctacatcgcagccttcggggcggtcactggtctctgcacgctcttcacactggtgagcagtgctttatggacaagggtataggattgacagcccaaggagcagggacttggtaggggacccacagaagcttatgaggggggcttgggttcagatcgaggcatctgcagcagaacagaccctcacttcactgcatggccgcttctccctttaggccacctttgtggctgactggcggaactccaatcgctaccctgcggttattctcttctatgtcaatgcgtgtttcttcgtgggcagcattggctggctggcccagttcatggatggtgcccgccgagagattgtttgccgagcagatggcaccatgagatttggggagcccacgtaagtatcttggggacccagaggtgagggtgggaggagaaagcctgtaatgcacattttccttagaaggaaggagttggacttgaaggcagccataatgggtaggatttagcattgccctgttgtgttcagtgttgagacttgtgattctccagagatgat

SEQ ID NO: 31020 - DNA, 2168 bp, Mus musculus
ggagatgccaaggcttgggaagcctggagggacgggtcccagaacccaagaacagggattctgggagggaagggtggaaagaacagaacaaagccctaagctgtgctctttgtccccctgacagtgccaccagaagaacaagccaacatgtggctggttgaggcagagatctccccagagttagagaagcgtttgggccggaagaaaaagcggaggaagaggaagaaggaggtgtgccccttgaggccagcccctgagcttcaccactctgcccctgttcctgccaccagtgcagttcctcggctgcctcagctgcctcggcagaagtgcctggtagctgcaaacgcctggggaacaggggagtcctgccgacagggagcctggactctagtctccaaccccttctgcccagagcctagtccccatcaagatccatttctccctggtgcctcagccccccgggtctgggctcagggccgcctccaggggctgggatccattcattcccgcactaacctaatggaggctgagatcttggatgcagactcggacttctgagcctgcagggcaggtcctaggatgggaaagacaaatgtacacctttctatggctcttcctgagagcacacctctgggtctcatctgacagagtctgtgggccaagtgtctgcctagaagagctgtgtatgtctggctagaagcagccaggccatggaaacaagttgaatacagcgattggtaggcctcatgtcagaatcaggaccctgcacttcaggacccttgcttctgcccaccaatcagagtctgactggcagtgttagtctccgacagagcttgtactagggcaggaatggcagagacagggatgatggtacccagagtgggctgtggtggtctgtgaggtaaccaagcccatgtctggcagatgagggctgtttgcccttttctgtgccaatgagtgcccttttctggcactctcagaccaaaagtgtttattgtgtcatttgtcctttgtctaggagaggacaggactctctttttcctcttcctggtagttgtaatgaccactcccataagggctataactgttcttcacaggtggccctgctcaaaatacatcctctcttttcccgttctatccctacattcacatctcagttccactaggccaacctcttcctggttagcaccttaaaactgcagtgagcacacacagacacacacacacatacactctcacacacacagacaggcatgcacacacacacacacacacacacacacacacacaccccttacttctgagctctgtcttaagagactactggttcagctccaggcctctgaaagacatgttatttcttcctcacatccatccagtggggaggaccctctgacttaagggaccaccttgggaagcttctgtagcttcagccaggcaagaaagcttcttccaacttctgtttctggtgggagcggggggactcccactttttacaatgtctagtcattttcatagtgccccacattcaagaaccagacaacaggatgccttagaagctggctgggttttgggtcaggggctcagtatgagaagaagaaatatgaacagcaaataaaacatttttgtataagctcatgcgtgtttcttttccccagccccagctctggcttatgtacctggtccagaacttccatgaactcctgaggtctttttcaccagtggaaagcttgctggtgtggtcatgactgacagatacagggctgattcagcgtaatatgctggctgctctctctggctacttggcagtaaatgaacaaaaggtgcttgttggccacctttgtatccttaagttccaagcataaagagaatgaaggacagacatgcaggatgcccttggagtggccatgggaagcgagtgttttcctggtggtatacagacgggcacagctactgccagtcccaggtttcaccattgcagggtggcatgctctgcctccttccagagatgttaggtcgggtacattctgatccacagcttcctttctgggcagtcaaaggaattcaaacacaaggagagcttgttggttttgcttctttaaaataccagcagaagattgggaactgaattcaagtgactagattatgtagcaaggtctgtggagaaa

SEQ ID NO: 31021 - DNA, 1145 bp, Mus musculus
aagatcttctcaaaattaaacggaccaaactgactttggtcacgggttagcaaacttattttaggttttagactatgtggttttcatcgtagctgtttcaactagtgtcatacaaatgtagccataggtataatacacaaattctaagtgtaactctattttaaaaatacctttatttatggaatctgatatttgggtttgccataactgccttgtgccagatacagtattcttttgtatttttcagctattaaaaaaaaagaagaaagaagatcaaacctatacattacctttcctctcttgtccttttccccttcctccacagatacatacacagaaacttacttttcaagttataaaaaaaataaatattataagaaaaaaatccagagtctgaagagatggctcagaagttaagagcactggctgttctttgagatgacccagtttgattcccagcacccacgtggcagtttgaagcatttcataactccatttccaaggaaattcagagtcctcttctgactgagggcaccaggcatacacggtgcacagacaaacatgcagccaatacccatccataaaaactaatgaagcggtaaagagtcactggggtcaggaagatggctttgtgagtatacgagtgtttgtcttgaatgtgaccctcagaacccacagtggaaagaaaactggtgcatggaagttgtcttttgcctttcacacactgaaagaaagatcagttgtcatcagagttaaagcaacataattcattttaaggaatatttgtgtttttccaattttaatatctctgaaattgggatgtcagtttaattggcaacactcttcctgaccatgtctgtggcttacctggccagcatcttcgcctttgttcctctcagatctttctctatgtttaatttacatctcttcctttaatcctgtcctttgacataccctcattatttacacgttaccttgggattcaagacatttttgaatctttcccaatctccagcattaagatcctgccatgtctcctggccttgcccttgtgcttcgatgacattatgtcacatgttcccaagtgtactggtcaacattctttgcctttgctctggaatctctccctgacttgaaatgtcctc

SEQ ID NO: 31022 - DNA, 3786 bp, Mus musculus
cacatttttgttacttattttgtaattgtgtatggaggtggaggtgggtgcttgttcatgatgcatgtgccctggttgcatgtgtggaggacagaggataacccgtgggacgaagcttcccttgtaccgtgtgggtcctgtggagactggcaggcttggtggcaggtgcttgtctccactgagccttctcaatagcccatggccttttttcactgtatgaaaaagagccacagatatctatgcttaccatatacactaggaaagcccttgtctccctcttacacctttaggcaggctccttatgttccagtcccaccagcagataacatcagtttcaactttctttttccctccaggtattaagttcctgtaatgcaagccagaagacatgttaaagaatagaaccaagccttttctcaaatactatccaaggaagaacctagcaagctgcttctccaatcagagctgcccgccgtgctcatcctgtgtgttaggttatttatttattaaaatctagaatcctgtgcctgtagccttggcccagagtgtggttactaactcgtggggccgtgagagccacagaggacaggctgaggaaggaaagaaatgggctagccattcctcgtgcatcactcgcattattgcccattaatggaatccccagcgatgaccatgttctctccaggctcaggagttagttcagggatgccagactccttgttacttagggttttctgaatacatttcagcagctgcctttctcaaagctttggtcctttcccaggtgaggccttttggaagccactgaattaataaggcctgaattctcagccttgatagttactgtcactgccttccttataaaaaggctggggaggcaggagtggtaaggtcttgtaagctgcaccaagaactcagctgtgcctgtgtccgtgcctactgggatctcttctcttacccaggacttctttcttctccttgactaactatatccatttcaatgctttctggctctaagagggttgtgactccatgatcttaacagctctggtgttggtcaggcatttgttttactttctaaccctactaaactctgctcaggaagtagccagccagctccactgggacccatagttctgctttcttcccatttaactggactgtttcctaggaagccccctagatgggcactgtcagagaaggagagccccgtatgaacagtgcttctgttgtgcctgaaatgatgcttggagctgagttggcgaaggtgtttgctagagatttgggggcttcagactttagagtgggctatagcttgatatcctaaagaaagaagtttttccaggaaagactttgcagcctggctgcagaagacaggagactttgtaaagtgtgtcgagatgatgaaacctagtttgagggctggaggttagctcagtggtaaagcacttgcctggcatgagtaaggccctgtgctcaatcgctgggaactaggggaagggatggggcactagtttgaacctcatcagacattcatccctttggctgttagccttggtgaaagtgagatctgcagtctgatagcttatctttctttgctgctgctgctgctgccgcgctgtatcgttattatgatctggccccttctgtttaaggattctgtttcagagagtttcttaagtaactccagcattataaaataataatgtaaacagtgtgaagtttctcattctacccaagagtgatatcctttggagatagactgagtggtttcgaggtttccactgggatcatttgatttcaagaattaacctggagtgaccctaggaatcttgagttgaatgagtccctctcatggccctccctatttagaagtctcctgtttgttccccatgtgtcttttacattgatacatcttttacattgtatcaagagcaaggtcattccaacagaggacacccagaatcactgaaaccttcctctagatcttctcccctggctccaccatctctgctgtcccttggtctttgtgtgtgccctggaagctagtctggaagtgtccttattttctaagatagggaaacagaacttgggtaggtggctggtttgccttatggtatacattctggctcaccccagaagatggactcttgccaggacagcatctgtggctgtattctgttgtataaggaagatcagaaacactgaagaccttaccgagataggccgttctgtttgcctcattctgatttctgtattagcggaatgcatcaatcactctcccactaccatatctgttttgttttttgttttttgtttttttgttattgttgttggggttgttgttgttttgagatagtcttgctctgtaacccaggctggactcaaagtcacggcagttctcctgccttggcctcctgaggccatgtgctactatgtctggcctcataattggatctctttagtgaaagattcatatctctgtgcctcattttatgtccagagcagattccgttaggcaggtatctggcttgggccccaagtcatatcctggtgattttctgcaaagcctagctctctacagagcttcttatggctgccacaccatagggaagagatcccctccaagtaaaaaaggagccacatgggtttctaagttacgttgtacctgactgcccatagtgaggtatctgcctgtgagttacagatgacatctattcccttctctctggagacttctgtgtcatcaaccattaagaaagtagccagaaataggatgtaagacagtgataggacacttgattagcatgtgccaggccctggggcgaatgaatcccagtacagcaggcttgtggagagttgggaagaaagaagatagcccaggttctgccctaatgctggaaccaaatcattgtttcctctaaccttggaataagagcaaatttcttcttattccaactcttccttttacaagcactctagctacctggagacaaggaagagaagactggttgtctctggttatgtggccctgggcagagggaaatacaccacttgtctacaatgaatttgtgctacttcaaggtcttcttgctgttttagtggaaatattgttttctttttcttgttaaacaaaaatgcctctaatctaccttccctctgccctcctccctcctcatgttcccctcctgggagagccaggctccccacggccacacactcctgcaaagctttttctgctgcttggcttttctctgaaaagatctgaaattgctgctcctgtgcttttcctcagaattaacttttgtcatggtttaaaataaatcagaatgcattgttgcattaagcttttttaataaaggaaaattatggaaagaaaataggtaacaccagcaaattatatattgacattgacaagtctaaacatatatatacttatatatgtaaaacacatccatatctatacaaataatcatctagttcttactgtcatcttactgaaaggaacaaagcctctaaggatcaccagttctgagaagctcttggaaatctctatgtctaagtgattgtattagatcagcaataatgactatgtaatctcaaaaaataaagtattcttaaaactgatctgtgtcctgagaataccacttaattctgtgaactatgaattcagagatgagagatatgtgggcaaaaaataacaaggatacctgccgtaggatgaagatgtgaaaagctgatgcagttaccagcaggtgtgttggagtgaccatcaccctgagagtc

SEQ ID NO: 31023 - DNA, 1148 bp, Mus musculus
gccttatattggagtggaaaaatgagcttgactcttctataacttgtagaaaataagaaagggtaaaaaaaagggaggaattagtttttggggagggaccatgacaaagggaaaacaaattagggagggttatgtgtattaagtagagtctcaggacttacagacaggagggaggccagcagtcatgcaccttgagaaacagcaagtggatttaacttgtacttggagtgtggaagacaaagttttcttgggaaagtttgggaagttggtaatcagcactcacgagtgcagcataggtctcatctctaggcctgcggcgggggtggggggtgctaaggcattcaggagatctagcattctgtccataactttgtactggtggtgctgagtgttgagtcctagcccttggacctgctggtcaagcactgtgccactcagcagcatctctagtactcactgggtttttaaagattgacacgaacattagattggaaatgtttgagactttggggttgtactgtcactggagacaattgctggggactatgtgatttgtgtgaccattgactataaggagttaggtctgtaatccagttagtggatgttctcccttaaggtagagaacatgtaagaacaactagattggaggaagaatgtagtgtgctgagctctgtgggaattgactgtaactcaaggagatttgggaatggagcagattgatgattttcactcatcaactaatgtcacagagaattgtgagatgtacaatcaagagtgaagaaaaaaacactttttaaaaagacttatttattatatgtaagtacactgtggctgtcttcagacactccagaagagggcatcagatttcattatggttggttatgagccaccatgtggttgctgggatttgaactcaagaccttcagaagaacagtcagtgctcttaactgctgagccatctcatctctccagcccccgggaaaaaaaaaaaaccaaacaaacaaacaaaaaaaacaaaacacttttaagaaagatttatggggctggtgagatggctcagtgggtaagagcatccgactgctcttccgaaggtccggagttcaaatcccagcaaccacatggtggctcacaatcatctgtcatgggat

SEQ ID NO: 31024 - DNA, 1163 bp, Mus musculus
ctgtagcttgagaaaacgtgacttttaactgagaagcagtggacttctcccactggctccttcctactgctgttacctaaaatttcatcatcttttcgtttgattctgttcaatgtggtgtctttggggccagcgggtattttctccttctacttggaggagtatttgttcttggagttctgcagtggctaagggaaccagccccacccactgtcttgttgcttggcaccagctctccctggctgttgagcatcttgtttacttctgcccttaattccctgcaggtgcgaaagtacaagagcatgatcctggaagacctcgagtctgctctggcagaacacgcccctgcgccacaggaggttaattcagagctgccgcctctcaccatcgatgggattccagtctctgtggacaaaatgacccaggtacaaggcgggaaaggaggaggagatgcaaagataagagatgcagatgtgggcggcctctcttcactcctctagctttgtggttggcgatgtgaccagagcttgagacccagactggagtgtgtggcagccttgggcaaggccaagtcccaggaggagtctcctgactcagcacacactgtcacctctgcccgctgcccacgctctcctttcaccaggtttctgtgctagggaagagaactttctgcttggggttagtctgacctggagactgttcaaagtttgaggagacaagtttagcaggctaggctgctcctctgctcctccccactcttacccccaccccaggtttttgagatagggtttctctatgtagccttgagtgatttggaatttgctgtgtagaccaggctggcctcaaactcagaatagttgcctcagcctccaggtgctgggactaaaggtgtgtgctaccacacctggcttaattactaacttttagttttgttctgtttttctaggtagaattttaaagcaatgactttttttttacacttggtcttagccaaaaggctgagaaatggtgactttttattttattttttattgctgctcagtttagctgctcaacacctaaaatagcatgtcatgtaaacaatagaacctgtttagtaaatagcctaagagtattggaacaaagctaaattcagtatagcagggatcagcttgaatgggtct

SEQ ID NO: 31025 - DNA, 1161 bp, Mus musculus
caaaacaaatcactagagagttagttgagtggttaagacagcttgctgtttttgcagaagacctgagttcaattcccagcactcatgtcgggtgacttacaaccacacgtaactctagttacagggatccaactctcttctggctgccatgggcaccgtcacacatgtaggatacactcacacagacacacccagataatatacatacatacaaagagacataatacatacttcttgatcagagtgttacctcttatgagaaattggagagtttggcctcagtttggaataggacacaaaagcaaaatccgaacttggttaggaaggaaggacagaaaaccatcagttgctttgctccagaataattctgtgggaagtcctaaaaaactaactctatacgaggtttgataaatacatgcctgattctcctgtggtggcataaatccccaatttctttgtggcttattatgctttcctgttgttttgatgacaggtttcatggacccaggcattacggaccatagttaaaaattgctataagcaacatgggcgggaggatcttttatatgcttttgaagatcagcaaacacaaactcaggccaccaccacacacagtatagctcatctcgtaccatcacagaccgtagtacagaccttcagcaaccctgatggcaccgtgtcgctcatccaggtatgtaagcctgatgtctcaggggaggtggctcggtgctatctcacctctaatggagaagtttcctgtgttcatgctctcttctctgcacatcctaacagctgctctcgctctcgctcttcctgcctagcagtcgcttccaaacagtttcatttattttttatttcattttcttgtgctgcttggaatgggaaagtcctcacccacatggccacatcttatctccagcctttgaaccatattttacattgcatgtgctttatttaattcagagctataagtagcttctggaacatttccaaacaaagcacctgaaaattgtttcttgggttagggtccaattaaatagtagaatgctcgcctatcatgtagaagaccatcaccttcaatccccatcatctggagagagaaacagagaggaggattttggaggaaggaggaagggagaaagacagataggtgtgtacctg

SEQ ID NO: 31026 - DNA, 1200 bp, Mus musculus
cgcagcagccgtcggagcacttactggagtccaagatgctaatggtaagagatcatgaatattttattgactgtattccctgtttccacttaaaccttcctgatatagccagcaacaaacccgttagaaagacattgagcttggtttgagtttttcttcgtaggtaggcaattaatgcctaggaaaatctaggggcccccgattccttttactaataggattcttgaggttccctgaaggaaaatgctataataatggctacctaattggagtattttttaaaattagctgttttgctaagatgagaggtgctgaggcatacttaagcattcgctttggagcactttcttcctttactgtcctacggggtagggtaagttgttgatcttaagccgggcgtggtggcgcacgtctttaatcccagcacttgggaggcagaggcaggcggatttctgagttcgaggccagcctggtctacagagtgagttccaggacagctaaggctacacagagaaaccctgtctcgaaaaaaccaaaaaaaaaaaaaaaaaagttgttgatcttgactgcagtagagactcccacgggtgggtggaacgcaccgactcaggccaaaaggcacagcaaaacaaaaagggtaaagttcatacaagtgcggtggcaaaaacttatggctccaacccagatctttgggtccacttcagcgggctctggagtcagtggggaggccctgggctcccggggtgtctcagaagaccgggggggggggggggggggcagcctgatctgtggcactgcctgtgcctagcaggactacttatgtcttatgtcctggcaagagggtaaatagataacatctttttatctaggcagacagttccttagtggcattaaatgtctgaaagagaagtttcagctgagtgtggtggcacatgcctttaatcccagcactgggaaggcagggcaggctgatctctgagaagtactatagtgagactgtctcagaataaagagagcagggtagaggtggagggaaggaggcagaggtttctttgcagcactatttctttggttttattgtcggcccataagaactaaatactctgcaagtcaggaatgtctttgggggaagacacaatgtgtcctttacagtaggaaaaggtttttctgtagtactaggagagagagcaatgtagggac

SEQ ID NO: 31027 - DNA, 1566 bp, Mus musculus
atgtataaagtatatatgtacatacatacatatgtatgaaacctgcatggaattacctgtatgaaatcaaggtgaactgtgggaacaagaacccacccagattcgtgggtggtagggtacatgaccaaacacagtcacctggttttcgttcataccagggtcatgcattgagctactgacagactcaggcggaggtgaccacgtccttcaccaaagctgcctcccagtggccgcctagacctctgctagattcaccgaaggaaggaagatccaggacacagcgtggtccagagagtgcttgtgaagtccagggacagagagtgcgtgcgcacatgtgcgctttgccagcagagacacacggcagctggcccaggtgctgaccttgccacaggcaggtaaacgccctgcaggctcctggcaggggcaagaaatcgttcctcagcctccatcttctcccttcccaggaaccctcagtctcacgactattcaagagttgcttggttgtaaggtcagtcctgttacaaactgaaggtgacagaagtgttaagggtctgaggagtgttcatggagcaggcgggtgtaagtgcagggtgtgtgtgtgtgtgtgtgtgtgtgtgtatgagtaatggagaaaatgggaagattataggagagcaaaataggaaggagggagaaaactcttcataaatcagggtgcgccgtgggaaccgtgttctccagctgtctgcagctgtatttcagcagaggagactgcctcacacaggacctctgcgcaaaggctggccgtcacagatgtgtcagaagactctgtgaggacttttcccaggcacatcctggcggcacaggcctgggacagctttcctgctcacagtgtggcttgcactgagcagtcattgtcactgtgagcttctgtgctttccagccacaagccctgagtctcccgtggctcattcatctgatgtcttgacaagccaaatctccactcctggcgtgcagggactcttcctccttcctgccagccctctcccgtgcgtgatagtgtatttaatgtggtgtttttggttttttgttttttaatgagacattaaaagattcttcatgtcttgctcagcctttgagaaaagtttccaattcttatatttgcttgttttatataaaactattcaatgttctttgtatgttcttttctgtatgtgataagggaggggtgggaaatttgcatatcaatgtcctggttctacaattggttactttttttttttttttaaactgtgaagctgtccaggggctttaaggcccgtgttcctttgtggtgaaataagcctcccgatagtttgagaaattgccaagaagataaaagcaagatcccagcagcagagcatggaatctgtgttgttctccattctgtctaaactgcctcattcaataaatagtttaatgtggcgacaaaaagtgcccctctctctagcagccttggccacttgggctacagggctcttttggggtgtggctcattgtcctttacaaaagacatgcactagaggtctctagcctggaccacgctct

SEQ ID NO: 31028 - DNA, 1211 bp, Mus musculus
tggctgtcctggaactcactttgtagaccaggcctgcctctacctcccaagtgctgggattaaaggtgtgtgccaccacgcctggctccctgctcattttttgagctctggttcccacagaccaagggccccatgaagtcacagaaagaaggcctttcttggctttgaccttccaaaagcaagtcgtgtgccagggctggcagctgagtctaacatgagggctaaggatagaggttccccaaagcagctttccagagagggaagctggggcctggctccagggaaggctctgcctggcctggcctgcagctgtgtgggcatacactgggcttgcaatgcttacagcattgctgtagggcttcccctacacttagctgggctggggaggtaggccaagcaaggggttacttgtgctgtgcagggaggacacggggcaaggcagccaagtacagacaggctcagcaccttggtgctgggctggtcctatggctcctgaatttaggcagtacgcaaattgggccttagaggagagacaggatagaaggctgtagggggagcagctgatggccacatgactgcatagccacaggatgttgctgtggagtggggctgagtactgttacccccagtcagttggcactatgatagagcaccaggctggcatgggtcagtgcatcgcactggaggtgagctttacccttttttagggatgtgcattgtacccggagacatgtctgttgtcttgactacaggggatgagccactggcatcatggcagaggccaaggatgtggatcagcatcctataataagacaacctgaccctgtcagtagaagccaggcacactggcagacttggaatctagtaccccataggctgaggcaggaggattttatgatccaggcagcctggactatagagtgaggccttgtttttttgttttgtttggtatttttaaaatgtcagctgagggtgggaaatggcacaggctgttaggttacagccagcgagctgatacctgagagcaaagatgcaggccagttagcggagaagaaaatcaatcgcacaagggcaagtccttgagattcagagatggaactgctgaaggactccaggagacctggtgactttggcagagcatgtacccacgtgggacagcactagaggaggtggaccatccctgtgccttggtaagatcctggcaccttcag

SEQ ID NO: 31029 - DNA, 1940 bp, Mus musculus
ccctggcttgttgaaaggtggctttagctgtgtgctgtgtacctgcttacgtggcctgctgtcctctgtgtgattaggagggtttctgctggccctgcagcttgcttccctgcggattaggcctttgctcatgctatagccttcatgtgggtgctacctagagcaggcgtgaactgctgggtggtgattgtgagttcagacaataaaaaaaatgtatttttttcaatactgtataaaaatagtattctgattacctccccctcaataaaaaaaaagtccagataattgcttttgatattgatggaaaaactacaaaacagacacaacaaaccagagccaagtttggggaacgggtgtgagcagctctggctcctgaccctcaccgggtccgctttgccccagtgaagagacagcattccttcctgtgcagacctgagtgcagagtgtgtccatctcggcgtatggtgaaggtgtcactgggttctgcagcactggagtttccatgaccgctcccacatcaccccaccctcgactctggcaccagtatggttctatgcatgttgcagctctctgggctgtgactctgttaagaaggtttgccagctttctggcccttccccgctcctagttactagatgaccatactcatacttgcaaaggagaggagagagtgctaaagcctggttctgactgagggctctgcgtccctgcagtaaacaggtgagatctgcagcagggcagggctgctttaacaggcaggggtggcagtaagtcacagctgctgctgctgtcgtctgcccgccattcagctaaccgttctgttgaggtcctgccttgtgctttcctagtggaagccgtcctttgcccccgttgatgacttgagcccttgccaaacaaacaccgatgagtgaagtggctgcaacttggcagccccaaaacctgccacacccctgcacccctggaagcccagcaccggggccagcaggctgtgttccgtgcttgccaacctagaccctggcattagaaattgttttgtcagcagtctctgccctctcgagagagatgagcagcctcaactgacgtttctattaatgagttatcagaagttgcaacatctctccagcactaatgtgttttgtccacttcaaacgctgttctaattgccaaccggctgctctaggctcctgaggagtgtcccttctcaaaggaactgcgccctggaaagggctccccgaagttctaggtggccttgacctgacacttgcattttctaggccactctttggggtggctgagaatcatgacagaccctctgccagtctctagtttctctgggtcaggtttctgagtactggcattggattttaagcggcatgtgaccctttgtgttttagtgactcagaaaagtcaagccatttgcaaaagttagcagtttgttttgtcaacttgtaactgggtcatagccttgctgagtgaaaccaactcatttctgattgggcacaaagaactgcattctttggacgtgtgaatccatgttcctcttcctctggccactgaacacctccaccagctctttgggaattggatggaaaggcggcccctgggggccaggggtgtgcagcttcccactcacgggaggagtggccagggctcttggtttagcaattacacagctctaggtgcgggaagaaatggcctttaattactgattgtatttggtacatattgtgtgatacttgaagagataaaagggacttaccagcccttaattgaaatctaagctttttaccgctttcccctccttgccctctctcctcccttctgccctccttgcattgtgatgatctagtgggcatgtctgtcacctggacaattgcctcttctgactataacctcttaatagttgtgtataatgaaaactgtaaacttttttaaataaa

SEQ ID NO: 31030 - DNA, 1099 bp, Mus musculus
atattcccacattccattttggtagcaatatgcagtccgaatgcatgcattcataagtccatttggccaagtcagcctgtgtgctactgaactgtcaagagattgccactctcataggtaaacatgaggaaaacaggaaaagtttgcttctttttattgatggttccaaagaaacaaaccaaatctaccagctcttggatgaagatagaacagtgcttttccagagtgggaaggaaggggttgagacgcgtgctttgagagcctgtgaggctgctccgtccttgccagctgctccctagtcctgagtggtccttggtgaggagcagcaagatgcagcgagttgagtgagacttagggcttttgattttttttttttttttttttgactcggatttaagtgcatttttctaggtagactcctgccctccttgctaccagacctgcagccaccttggttttgccttggagaacatttggggagcatttcctgaacccatgtcttttgggggtacagcttgtcatccagcaggaattattgagcgagcaggactggaggagacgggaatgaagacacaagagtgacatctgatcctagcacggggcctgttgatccattgcctggactgagctgtgaaactggacgcggttttggttttttgttttgtgtttcttttttcttaatttgtgtgaattgtacctagacaggttacagatttaattttcacctaccaagggacagtctcctccctggacaaggctcagtggaccatcagatggaggaagactggccccattgcttgagcccctgtgcgacccttgacctccagccttagttctcctggaagctgccaactgcttacgggagtgggtagattgggcgtctgagacccagaacatcctaaatttgcaatgggtaacagctgaaacaaacggaagtttttgtaccaaagtggccggaggtggggaagaactactttcgagaattgttacggaggcaggttgaggggacactttgaccctccaaggtaacagccagtcagatggcttgaggtgcctggcccatgctgccggctaaatgccatccagtgtgcccagcagt

SEQ ID NO: 31031 - DNA, 1159 bp, Mus musculus
tgaatcagggagtccagattagcctgagatacatagtgaagctgtgagtcaaaaagcccaaatcaaaccaaacaaataaaaaccataaataatggtcacagaatcctatatcaactggtttacaagcatgatctcattttttttttttgaagcttacaaaacctttatttttattttttttctttccattttttattaggtatttagctcatttacatttccaatgctataccaaaagtcccccatacccacccacccccactcccctacccgacttggtcgtttctaaaacacacacactcaccgggcagtggtggcacacacctttaatcccagcacttgggaggcagaggcaggcggatttctgagttccaggccagcctggtctacagagtgagttccaggacagccagggctatacagagaaaccctgtctcgaaaaaagaaaaaaaaaccacacacacactcctagaatagtgcctgctgtacagtatggtttgttgaactaaatcagtgtattgaccatgtccagtactgcttaccataagctttggggactagagctaaacctaattgggtggatttaaaaaaaaaaaacacacaaaaaccgaaaaacacccctcacagacacacatttttggcaagctacctgaactatttggtaatgatgtgtttccttaaaatgtattcacattttagaaatgtaaataacaaaatatcccagtctggttccagtcacattcaagtaagttagatacagtctcacgaacttttgtacaactgaccagaaaacctttctactgattctcaaagttaacaacagatttattaattgtaattcgtatgactcagacaaagtgatggtttttgtctgtcagtggtatgcaagctatcaccaccacccccatcctaaagagaaagacacttgctagccagcaccacacacacacaccaccagccagcccacttcttatgtttatagagccatctgctctgaacattcttatcaactgtgtgcctgctgtggctggctcttttcagcttgcatggccttggaaggctcacccttgtagtcttttttctgactaagtagtcttagcacattttattgatgtgtttgtcagacagtggtcatttgagtagtgctttggtaactgtg

SEQ ID NO: 31032 - DNA, 1210 bp, Mus musculus
tctgtaattctgagaactataaaataagtttttacatcttaggcttaaaaaaatttttaagtattttatgtgtaagggtgttttgcctgtgtgggtttgtctaagtgtcacttgagtgcctagtgccctgaaaggccagaagttggcatttgtatcccttaggactgaagttagggattgttgtgggctaccctgtggatgctaggaattgaagcagggtcctctggaagaacagtttgtgctatgtacccctgagccatctctccagcccccatctcacagtgtttagactatcatctactgatggtaaaagaatgctctggagctagaagaaaatatcaaaggacattttcatttagtgccgtcttcatggcagactttgtgcagtagtaacacggactgtgtgtaaatgatgaccacctgccctggagcaagcgaaaccgtggtttgtagtggtttctaaggtgtaaatactgtactgaagcaagcctgtctacattgtgagatctatcgggaagaaatggatatagtcatctgatttggattaacctcaaatgattcttttcttccttccccttgtgtgtatatttgtagacagacacacacacataaaccccctcccaacctcccactgtgccacagtgtgcacgaggtggtcagaggacaacttgtggagtcagttccccttttctaccatgttggtcccaggtattgaacttgggtcttacatcctgacctctcatgctaactatcctttattttccttatctcttacataagtatgtaatttgaactaagggcaaggtaatttctttggccttagatgaacaaatctcacaaatctgaaagttaaaactggaaaggcagtatttgtcagtgtggacaagtgtcttgtgtgtctgtggtagacatagcagggagtcagatgccacagccagagggttatttgagaaagagctggcacagaagctgcgtaaggtgatctcattaatctgcgcatgtccagcactcttctcctctcgggggtcttggtggccatggcccctgccagcactccttcctgatgtttcctttgatgctaatagttcttccttttctggcagacacctgttccttggtatatatgaatacacttagcctggccgcactagagccttgctatggaggaaagccctctctttctccttcagatggacgctctgtcagtgtt

SEQ ID NO: 31033 - DNA, 1195 bp, Mus musculus
attccccaagtcaaatcattattattctgaatttttggcatgtataagagaaatagtatggaagtgggcaaattttcaaaaagtaggacttctttttgccgggtgtggtggagcatgtagatctcggcctggtctacagagcaagttccaggacagccagggctacagagaaactgtctccaaaaaacacaacaaaacagaaacctaaaccaaaccaaaccaaaccaaaccaaaccaaaaatgaacaaaaccaaaaatataggactgtttttatcttaggtttttctttgcaaattcacttgttttttgtttttttttttttcctggtttttcgagacagggtttctctgtgtagccctggctgtcctggaactcactctgtagaccaggctggcctcgaactcagaaatccgcctgcctctgcctcccaagtgctgggattaaaggcgtgcgtcaccacgcccagcatcacttgttggtttttgttttgtttgttttttgaaacagggcctctctgtagtcctggctgtcctggaactttttatatttatcaggctaactttgaactcagacatctaccttcttctgttcttgggtgctgggattaaaggcatgagctacatatgtacaccactccatcccattgctgttttatgcatagcatttgtgactttacacatgtgataagtgtgtttgcatatgagctcccttgagtctgacactttagccaatggtttctgttttaggatttaattgctaggtatttgttttggtattggcagttaacctgtggttgaatgcatgctaactgataacattctctcctcctgagctatgtcccagcctgtaggtacagtgcccttccccatctctgtatgtgtgcatgtgtgctcagttagagaaacacagttgtgtgcctaaggtcatggataattcccttctgttttgagtttttctgtgtgtttttgtctggccaaaaactagccttcaacttctgatcctcctgtcttccaccttgcaagagctggggttatattggtagatgtctcatcagttactcttctggggttccattacacacgtcacctgaaattaataggaatggtcattcattatttgtcttttgtgctttactaacatttatactgagggtacaaaaccgatggcaggggaatctgtataccttagtgtgccc

SEQ ID NO: 31034 - DNA, 1192 bp, Mus musculus
tgatgatgcagttaccccagctggggaccacatatatcattgtatgtgggaaataactaggtccaattagtgcttgtgctgcactcagcgtgggtcaggagtgcccttgtcacaaacagagatgaggacaggacagatgcagatatgctgagggacaatctgagcgaggctttggaaattggcagtgttggcagtggtctggcaatagaacacaggcttcttgattttgtttgacttaagctgtgcattatgtatgtagcataacataaaatgagttttaattctttttattgtttgtttgtttgtttttcgagacagggtttctctgtgtagccctggctgtcctggaactcactctgtagaccaggctagccttgaactcagaaatctgcctcccaagtgctgggattaaagacatgcgccaccactgcccagtgagttttaattctaataataagcttttctacctacagagtctctctgaaaaatcaaggaaagtgttccgaatattccggcagtgggagtcttcatcctcatcgtgaagatgctccggacagaactgaggggactttgataaacaagtctgagttcctttggtcagctgctgctgctgttcttcattctggtttcactgcacatgcgaaggcctgcatgtgatgatgaagaggagacccgatagctctgtgtggggtgtggacagggtaagacacagcaggcccagttccgtcaggggactgcagggttagaacacccattcagcggctttggttcggcagtgttctgagcatgtagctcagcaatgtgacagtatttcttaataaagtgtttgctaagattcctgctgctagagaattgttttctccctccctggttccccaagatttcataaaatttagctgtggtttgtcattggaccttagaaagaagcagtatagctattgcatagtcatccccaagagaatgttcttgcaatagtaatattctatccatactttgcctcagttgatagcactaagaaatatgacttctttagtgtagattatgtccagcaaaactcatccctgaatatcacttaactagtctatattcaaaatttataatgaaggggctggaggtgtggcttgatggtaaaaagtgtttgtcgtgaacaggttctgggtatgagtcccagcctgccctgaccctgtgcttt

SEQ ID NO: 31035 - DNA, 1098 bp, Mus musculus
aaggtccttctaatctggttagttaaaaagcagggcaccaacaagttttacactaagtttaaatatgctttataattaacttatttgtgtattgaacctgtgtatatctacaaaatattcagccctagtaaatttgtaactgtcacttaaaatatttaaagggatttaatttattagtaataaatattagaaaaattatgataaaaactgtaataatcggccagttcatagtggcacatgccagcagcactcagaatggataggaagattaggagttcaaggccaccctcagctgcctggagagcttaaggcctgcctagacgtaacaaattatatttattgggagtgtatagtaaattaagccttgaattataaataagtataggtattcctttttctacataacagttacctgaatattaaaagcaaaactaacacatgatactattggaagctgtattgagatccttgaaggaagaataaggacaaagttggtaatgaaaaaacatctcatctacagacaaaccaccctgaacacgcccaatcttgtctgatctaggaagcagggtcgggcctggttagtacttggatgggagaccatctggaaatactgggtgctgtaggctttaaaaagaaaaagaaaagaaaaaacatctaaagctatgtatgctagctcactcctgtaattccagcacttgggaggttataacagagattaccacaaagtcaaggccatcctagctacatagtgagtcaaggcagactacatagtagataatctgagcttcaaaaaagactctgcttcaaaaaaaaccataacaaaaccaagacctagctggtgtagcacatgcctataatcctagcactcaggaggcagaggtggaggaggcaacagcggaatgatctctggccagcctagtctacgtagtgagttcaaagatagccagagctacatcgtaagtaagaccttgtcttgaaaaacccaaaccaaccaaccaaccaaccaaccaaccaaccggacaaagggagtggttatggcttggaaagatgattttgcagaggaccagggtttggttcccagtcccacatgatgggatc

SEQ ID NO: 31036 - DNA, 1152 bp, Mus musculus
ttatgcactccctctttcttgatggagttgagggaatgtctgaaagtcccttaataatgttaagaatcaagagagagaaattgttgccttttttttttaattctgagcatattgaccatgtcaactaacactacagattaaaatatcatcaacaaacacaaagcttaaaaagccagcaacaacaactcttggtctgggagatagagcgagaacactagtcttggtagcctagcaggttgttcttaagtctggatgttgagttagtgtttctgagatgtgcggagtggctggactcaacggtgcttcatgacttgctgtaaaaatgcctgaccttgacactagcaggcagctcagtgacgtctgattagcgatcccttcaatcctgtaacgctccggtggttagcgttggcctgccaatgtttagtgtgtctgtcatcatcaccctctgttgttgtctctcaaattaaatgtatatggcatcaagttctttccaggcagttctgaacttcccttgtgcttattaatggctttaaatatgtctttgacttcttggtgggggattgtagactcttaagtgtgtgatgtaaatgtctacggacagtagatagagcacagcacccgcacccttcaggcttaactgtcttaccttctgcttggggtgctggctttgactagcatagcagctgctgcttttttagaacttgtttctctttaagtctctggaccatgtccctgcgttttcttaaactgttggttcttgattgcctcctgagcttgttgcctcctttgctgtccgcttctgtgttcacgatgctgtggttgcctagtgactggaggaaggtcttaagggaaaaggtacagggtctccttctcaagaagcaggggtcattggagagccagcaggaggaaggggtgagacagggtgattcgcttctgttggtgagagattttgtttcctcctttctggagagaaaagtaacgtacgtttttactccttttgtcctcaggcagctagaagagctgaggagtgacttgtgtaagcctatgggtgtccataggtgcagtcaggatgctagaggcctgcaggagggtgcagccagtcccccctgcaggctccttgcagaggagacatgtaggagatttcaaacacat

SEQ ID NO: 31037 - DNA, 2579 bp, Mus musculus
ttcttttagcccaaaagagatctctttagttgatatgaaataaaagtcacctttgagttacagtaaaaaaacgttcctgcccggtgtgcagtcttagagaggtctcctccctttggctcccaacaggccttatgctccatccgtgtgggttaagttagtggagcctttgctctgtggtcctgagtgaagcccttatctctgagtgaggggatggacctgcgtttctggggtcttaacccccagctctggccacttcctgttggtgtggcttttacttcctgccaccgataggcgcactcctcataagacccctctccagagcaagtcagcctgagccactgtgtgctcaaaactgtgactctgggccaggtctcctggacacatggtggaagtgtatcccaaactaaataagccatgttttctagggtgacagaaggatatttgtcattggtttatatagggaccaaaggcaatgttcagcctctgtgctttgactcccatggtccttggacaactgaggctgactctggttctgttacactagaaagctgtagaaagggggctgattcaagccaacacttgttggcatcctttttaagccagttgaaggcagtctctttgagatggatgttggaggcctgacatcaacgaccttctgtatcttagaagtgcatgttgggtctaaagtgtctttgaatagaacactagcgaaagtggtgcaggaagcagctgaatgccgcagccactcacgcacatgttctggatgccaaatgactgtggagaaggacttaaaggaaggtgactggatcctctctaagggtcaccagcattttggtttctctataaccagcactcgggattcccagtggcatcacctggtgtgggaaggttgtgatgcctgctgcccccctgcctttttgaggtgcgcccagacatcttcctgcagtcctggaagtagaagtgcaatatgtagaaacatatggtctgtacagattatgtagaatcgacgagtgtaaagcagtgacaccactctttgtacctgtcttgggcaagtcaacttattaccttagagtagaattatgccaagaacttttagtgtgatcataagccaacttcttggtaaagctggatttctttcaggtccatgttttcttattctagttataaaaaaaaaggtctgttcctcagtttgctaggagctgagggtttcccatccctgtttgtactgcctcccatttgcatgtcttgcccaggaataaggaagtccacttgaaagtgttgcccaggtagagaattgaaacctaatgttaatacagcccccccccccatatacgctaacttatctgggaatgtaataccttattaaatgatgttttctttacgataaggtattttccactttacagaaaactgcaaaccagtatataatagattgaaactttacctgcttttcaggacaaacaaaacccttccttcccactggcagaaatcatctttcagggcctaatgatttgatataaaagcttgctttatagcattcatgtccagtacagagctagattttaaaattatatatatgatgaaaatattaacatttctagattaaaagtatgactgatctttcgttatccactgtagcaaggtgaaagcacacacaatcgaaatccatagataatcagtgtttagccttctccttcaaacagttgatttacatatcttgtcccttcctgtccttcttccacacacatccccttttcaagggacgagaagtcagagaaggaaaagaagctcaaagaagggccagcagctagccaggccaggctcccagttaacttagacactggtaggaaaatgaccaccggtgggaaccttgagcacagcctgctgctgagttctctgctgcttcctgaccagagagaactcttagttcctgtgggatgaacaggctgtgttgaacagaaacagaaaccccactgtctgagcacatttcctggctcttggcaaagcttgcttttttgtttcctcctttggagtcaccttctgcagtctgatgtcctggtgtgcagcaagggtgctctgtcctctcggactgtgttggttttgtcccctgtaaaagcagtttgctgttctgtggtcttagtgatgcttagagagtggccctcccaccaacactctgacgtagcacaaaaagccattttcctttttgttttctgttgtttcctggtgttgggcttcagggtgaatgcaggaggatttattgttacagccacgcttttcaagagctggttaccataggtgtaaattccattggtccccaggtaccttagagctctggtagctttggctgggcctgaagcaggctcagtgggggttctgggacctatgtctatatgttgtcacccgtccataagtttgtgagatttggaagaaaaaaaaaatatcttcccttgtctggtgtcaaaagcagagctgtgcttcgatggtagcgccatctccttggtggtctttccatgttgttaatcttttttaaaacttttgagaagtttttttaaaggccccacttagtctgcagagggcga

SEQ ID NO: 31038 - DNA, 2561 bp, Mus musculus
tgttttgtttttgacacatgctttttaattccagaacttaggaggcagaggtaggtggatctttgtgagttggaggccagcctggtctacagagaaagttctaggatagcccaagccacacaaagaaaacttgtctcaaaagacaaaattaattggcactgtgtaatactactaaaaaaatttttagctctctttgatgtagctctctaaatctactgaaaaattaatttttcaccccataaaccaatttattctaaacatagattttaagcacagttactgaagtagtcatcattacttgaactcacctgctgagctgtgtgacaggctgcattgctgagtcacctcagctgccaccagttaaacagatgtccctcctattgttaattttattagaatcagcccttagatacttcggcaagcaattctactaaaactgttttccttcctttgcaggagagttaaccttgggctctctggcgtgaacattttgtggatctttggagagtagttcctcatttaattccaaacatttggactttgcttttaactggtctggaagaagttggagctgagcccctccgagtgcgcacctcttctgacataagatgcatgttttgcagacttgttaaatttaacaggagacaagctgtgggagcttcttgtgagcatagcaaagcctgcaccttctagtccacagaaaagcattacactggatggctctgagcgagctagtgccgctcccttcatttggtgagggcaaggacgcctctccattttaaccccagtgagaacctgcacctcatcctgtaccatcagagactgctttcattgttggatagtagtgtaagttctcagatgaaccttgctagttctctttgttgtatctttatatttccccagtgttctacaagtcagcctaaagctgaaatgaaattaatttctaagtgatgtagtaattaatcctgctgagccatctccccaaccccctattgttttttttaatattaaaagagatttgataatattggcatcttgaaaggtcaatgcttgcattaaaattagctgataaaattaaacttttgggttttagttaaatgtctaaggacacgaaaaaaacggttcactgcttttattagcactgcgtgtgcgcgagggcctgtgtgctggcgcctgtgtatcatcagcaggcactttatcactcctttaagatcccaatgatagccttcctgcttctagtttacaggtagaacagagtatcagctctccatctattcttctatatgtgtacatagatagggacctatacatatctatatgtatatgaagtaattagtagtcacatttttttggtgggggttattttcgagacagagtttctctgtgtagtcctggctgtcctagaactcactctgtagaccagactggcctcaaactcacagagatctgcctgcctcggcttcctgagtgctggcaccaaaggtgtgcaccaccaacgcccggctagtagtcacatttgtaatgaacatgtctttataaagattgcttccatcacctgaatgtgaacagatgggatgtgccgtccatttttgtatggtttgagggtttttttcttcaaaaggtcagaaggttaaccttaagtttaaaagctaatgtccacaaggaaggaactgtcacttaactaactgctcttggttaccctaaaagaaaatatcatttaaccatgctaaacttaaggacacgttataatttaaacctgtaatttttgagagagattcggggtgccatggaatcagttgctgtgctatttaagtatccagctgcacagactgcactaaaaacaccggagaatctttaacagcacataagacaccaccaaccctgtcttttattataactctgaaagaatatagtatagtagtaaatagatgtaaaaacacttgactatgtaaaaagaaaagttgttttgcctgcatacttagtataggttgctgtagagttcctataacaatgtctacaagtgtttgagctagctgtacttactattatcttgtatttaaacagaattggcacagacatggtgggaaattgccaggaacctcagctgctcatgaggttgaagtgggaggatcattagttcaaggccaaactagggtaccttgtgataacctttcataaatataagacattaataaaataattatagtaattctgccttggtgaaatcatttgaatttattctacagaaagtgtggtgcaaatatagcatcatgttttgttctgtttgtttgttttcattactaggaattgaatccagggtacagcttaccgagtaccactgagctgcctccccagcctccaatatagcagtttcttgtattaaagtgagtcaatatctactaacaccacaaatcctcctaggatgtgtgtcacgtgttccttttctttgcttggctcagatccatgaatctagattacgttcactgtgacatttatctttttctttatcaataccagcctttacttaaaccaaatttgttttaaagcatactgaaagtgtt

SEQ ID NO: 31039 - DNA, 1291 bp, Mus musculus
ggtctgtaaccagtgttgttctgtaaataattcagtcacatctgctggtgtgttcttcccagctagcttttttcattcactgttgattcatgaaagattctccaggtgggcctggaattggccgctgtccccacaggtgcagatgagttcttggtttctgcagcccacagtcctcacactgagtcttagctcgctctggaggctgcaggctctgctgggcatttgaagctgaggggtggtctgtgagcatgggtgcatcttgctggtttagcagagaggctctgtgcaaaatgatcctctccttaaatggtttcctgggaccacaaagatgtgtgttcagctttcctcaccagaaggagggcccagtacaggaagaccccagcaacctgcgggtctgtgctgagagccttggaaggccaccacagctgtccccttcataatgagccttatatcaattaaaatttcccattgcctgatgtgagtccagctatgttaaagggatagaaatcacagtcatttgaaagcatcagcttcacacggacaaggggacacacaggtgagggggactcaggagtcctttgtcggggctgacaaccccttaagcccttgcttaaaaatacagtattagtctaattgagtaattagtgcaatttcctgcttgcttttcattctcagactgagctgtgattaggaggctgtgattatagattctggttttggccggaattttgaatcggcattaattgaattgctagatgactgacatccattctatttaattgggggaacaaaagacctcaggtaaggatgaggcccatgaagtcagagggaaggacgagccttgttaatttttatggtctgtgatcgtagctgtgataagggactaaagaataaattgtgctctttgtcatggcaaccagcttctgaaaagccagctgaaaattgcctacccttaggttactgctgctgggtgagagtcgccttaacagtgctattttctcaccactttaggaaaaaaagaaaaaggcaaaggcccacagtatttctagcagggaggctgtgtttgtaagagaaataaacgtaataaatatctcatggagacatatggaaaaataactcagtcaacccagccccgcttcagagtatgtttattcttctccacttgatttccagagtgcaacattttccaatgctttagaaatcaaacaaaccagggacattgttcagatgtcaggccgtgcccaaatttccacaagattcaagaatcgtgtataaaattcagccaacgtac

SEQ ID NO: 31040 - DNA, 1174 bp, Mus musculus
tcactgcagggttctgtaaaaatgctaaaacttgagcaaacaatttcctatggaattctcagctgaattccatttctagtttatttgttgacacagcagtaaaggatgatttcagatctctagcctggtggtgaagggctagaagacacaacacacaggcctcttccagctttgctgtggcctcactatgttaatcctgcctttcctggtgttctcctatgataggtctgaaagtcttagctcagaagttcccagaaggactggtcactggttccctgccagcctcttgccagcaggccctcccttttggttctgtccggaaacgacgtggccccaaaatgccagccctgccagctgagaacaagtggagatttaccccagaagacttaaaaaagatagaatgttacctggaagaggaccagggaccagcagacaaccctagtaagagactctgacctttgtttgtgtggagctgagctgtgctcctttgaatatcccttgtcacgtgaaaaatagctttctatccatgctcttaaagtgcttggggctctgtgcgtcacacaggtactgggggaggggcggcactggtattggcaagcattgggtgttgagaacaagcatggggagcctgtgtcttaggcagagaggacacacgaggtctgggcactcaggttccttcctgggagactccctccagtctctgcttctgggtttgcttaaagccctgcccagaggccctgccttgccttcctgtctttgccttctgcctcctcttctctctctctcctcagtcacccctcaagaaaggggtgagagaccaggtttgttgaggataaggaaggggaagaaagtctctccgtccccacccttgttcccagcaccaagctgatctcagggatgagcaggaggtcacccctggcccacaggggatgctgcaccccgagggcttcactggcatagcagtggccacagactcagcagcaacattagcttaaaagtggtcttggctgactttccttggagacccgtcttgcggccctgctccctctctctctcttgctcctttcaggccgactgaaccagaataactctgctggaaaagactcgaaggtggctgcttgccgcggtggccagaacctgcccaccagctgtcctgccagccactcgagccccc

SEQ ID NO: 31041 - DNA, 1099 bp, Mus musculus
taatttcaatccagtactgttggcaaggtattttattgtttgaataatctgaaatatgtcacatacagaaaaagttcccatcactattagcccatctttgtaacagtttgattttttgagttgcatgaattctgctagtatatggacaaatggtataagctcaggtgatccactgggaagaactgtcacatcttagatattaggtgtgataaatattgattagggacaaagaagttttagcttgctgtgattatagtattttaactgtttttcctttttatttaaaaatttgagttttatattaatgtcagcgaaaatatgaggatgtctacacaactcttaagtgatgatgaacaaactgttttaagggttttcatgtaaagcatgccattacgatttaaaagcgcagattaggaggaagctcctgaagtcctgtcagcttgctttctaacacagcatggtgatgtcattcatttagtctgatccttttgactggattagattttggtgtcgtcaaggctgccttgcatgcagtttgcctcatttctcattttcctcctagattctgtcggtgtggtcggaagccctgagatagttgtgcttttacatggctttccaacatccagctatgactggtacaaggtaataatgtttctaggtctggcttatgtcctaaaaaaaatactcaaaactcaagatattttttttgttgttgttgttgttctggtcagccctagaattcttttgcagatttgaactgtttgataaaatctcattaaatgtagaattgctttttatgtactgtaaggggagtaaaatactgactgcagaaagggacactgccaaattaaagctggagttacgctctccgtacagtggcatgcaggcctgtttgctgtggggctgggcagtgggagcagagtgctcaccatgcttgctttcttaacagatctgggaagggctgaccctgaggttccatcgagtgatcgcccttgatttcttaggctttggcttcagtgacaagccggtaagcagcagctgggtgtggtccgtgatgggggtaggtgggtgggtacaaatgagggtctggcaggcactg

SEQ ID NO: 31042 - DNA, 2035 bp, Mus musculus
ttgtgtttgccagatgttgtctgttgggttctgaacaactgaaaccactgtaagtggagttggcaagtttatctgcctaaggtacagtttcccagtaggagatgagtaatgctgttgattccttccagtgtggtgtgtctgtagggcatctgcggggcttcccatgccttacatcctctcatctccagcctcaagttcacctccatgctgttctcttccactaggaaaacgctgccgcggtccacagtgtcgattctggatgaccacattagccactacccacagctagaggatcccatgggcttcttgaatgcatatatgggcttcatcaactccttctgagctggaaagagtagcctccctgtattacctcccccattctcgtatctgtgtgtattccacttagaaatgcccaaaagaggtcctggccatcaaatactatcctttcatcaaagtccatttccttcacattggtgaacaaactacaggaatcaggcagctggaactctatagggtgacacaatagtccacctcatctctaagggtgacatgataatcctctcatttctgtgacatctgaccaaataaatagagctgctgttgttttgtgttattaggacattctgactaataacacttttcatttatgtagaaaaacagcattagatattcttttttggtgttaaatacctcaaaaaacccccaaaacataataacaacaaaaacccagtttctgtggactttattaaaatatttagaagtgctcccttccggcccaatcctaactggaatacagagtgagggaggagcttgctatctccctttcaggatctgttacagtttatgagagggatcatcttgtcactcctttacatttagtttcatcggctgcttctaacagacatttttgttaaaacagacattggcttagggggctggggaagtagctcagtggtagtgtgcctgcctagcatgttaaagcccttgggttcagttcccagcactctccccaccccagcccatcgaacctaaatagacattggcgtaaatacagtgttctgagtatgagtctaagactgatttgcatactcatgtatatatttacaaacagttggcccttgctaagaagaaaacctcattatatatagaatttgtgaataaacaggttgaaattatttgcagaatttcctaaaactgccaggcattaagaactgcatctgtgccagagatttactgttactgtttagaaagtccaagctgaatagtaaataacagcctaggggcagctcctccagggctgacgtggaggggaagggacatgtaagtgcggaatgaatgtccattggctcctctatgatggccgctcagcatcccgctggctgttcagaaaggctttctcatataactcctgtacttaaacaggcaagtttccagagacattaagaacaaattctgaaagacctaagagcaaatggtgctgaatacttttttaagccacagttttaacttagttaaagcagcattattgattattttaaattcgttttttaaattagaaatttcaagtatagcaactttgaaactggaatgaatgagtgtttattttctattaataaaaacaaactgtgacaaaaatggattccggcttcccctccccctccacccttctgggataaaattttccagcattgccaagagtttttcacacattaaatagaagcatataatgaagctaagcagctgtagaatagcataagtagtatctgattttcaagcccactcaaagctgcattgtcgcaccgaggctgagtgagtgagacatgagatgagggaagaaactctaaagctcatgctcaaagacagacagacagacagatgtttgatctgctggcgcagggccaaacacttggatttgcttcttcaaagtcatcattattaatctttatgtgtgattcttggaagatcatgccactagcctaaaaaccaccaatagggagggcatagcaacatcacccttcccagcaagaacttatcc

SEQ ID NO: 31043 - DNA, 1322 bp, Mus musculus
gatgatgtaggtagtagtctacgttttaacataggaagttgttctcttaaattccctcgattgctgttaaataccaccacagtgtttttgttgttattgtttttaactcacttcttcatggtttgtatcattatttttttctttgatgttgtaatgcatatattcaatgtatcttaataatgtccacccctttcctgcccctggaggctctccaactcaacccaggacctcccattagtattttaagcatatttctttatcatgtgttaaatatatttctttctcatttctgtataccatgcaaacatatacagaattccaactgctgtatttattacagctaattattttcccacttgaaggggaacaactttgtttttattgttatattaaataaagttagttgaaattttaatattataagcatgaatcttaaaatataagcatttctttaaaataaaattctaaaaagttccttaaaatgggaacaccattggtggtgggtggtggttagattttaaaaaaaaaaaaaagtctttagaacaaatagcagttttatcttctcttttctcagggaggttttgaatacaaaaaggccattgtggactgcataatcagcattgtggaagagaaccctgagagtaaagaagctggtctagcccacctctgtgaattcattgaggactgtgaacataccgttctggctactaaaattctccacttattgggcaaagagggccctagaactcctgttccctccaagtatatcagattcatttttaatagggtggtcctggagaatgaggctgtcagagctggtgagtcattagagcacaactaatgatgtcattgctggtctttgaatataggtgattcaagagagtagtaatgaagttgcaggttccctaatgttgtgatatgatcttggaggacaccctggttccagatatacagctcttcttttgtgtttcaacttccacacagatttttgcctttaattagagacctacagcccttgtctttcagtgtgacaggaatactatagtggggcctctattttttctttaaaccataagtaaaatgtataaggatttatgtatgtatagatgtgttcatatatacatcttaagtgactctttctagtctattacctagaatcagtaaattctcctgtgatcccttctcttataaactattgaccttatctatccttatattttgtttccagataaactcaaaaatgacatcactagttgcctttatatgctctttgtccatttttttttcagctcaataaaatttggccctctttaaattctttc

SEQ ID NO: 31044 - DNA, 1227 bp, Mus musculus
catttattggcagtcatgaaagtccactctttgatttcattgagagctgcttgcgaaataaacacgaaatggttatttatgaagctgcttctgccattattcatcttcccaactgtactgcaagagagctggcacctgctgtctcaggtcagttgtgtttgaaagctgtcctttgtttatgctcttatattttttttaatcagtgggcttgcagagtgggtattaagggtagcatttagggccaagattgctcagtgaaaaaaaaaaatgcttgctaatggtctcagcttcctctaatgtttagaaaacatatttgctctcagaactagcacgctttctcttacttaaatgcaaatattaattgggatattgatttttagaggaaaaaagcattttgttttatgtgaagtttttatagctgaacaaaaagtgctttattttttatttgtgatgataactttgttcacatggaattttgatgctgtgattaatttcccgacacacagaatgaacatgattattacatactataattttcatctatctgatgaacagtatccacagtgatttttctgtttttctttttccagttcttcaacttttctgtagctctcctaaaccagccttgagatatgcagctgtgaggaccctgaacaaggtaggtatccctttgattaacaatagacatgcatgtttacttcagaaacatgaaatgcaaagcatttggcttcctcttcaagcttagagtatatgacctgtgggcctcacatctgtagcaccctgcttgtacttatggccttcgttgaagctgtttatactgttagtccataacttatttctgatgtctgagtactttatgttcaggtgttagactgttcaatatggaggctgttcacaagtgtccaattaagttaattaagattaaataagggattcagtttcttagtcactccagtaatcctacctatgcgtatagccacttgtggtaaatgaaaatcatacaaacgagtgcagagattgagcagttttacaattcctcgtctctaatcttgcaaccagttgtgtcttaaaatttatgtgtttgtgatgctatgtcgtatatattaactccagtgggcctgaagttgtgcccaaccattaaaatacacaaagattctccacaaaacataaaactcttttgctgcatggataaagactttttcattagtctgggtcatcttttcctgt

SEQ ID NO: 31045 - DNA, 1189 bp, Mus musculus
ctttccaaatgctaggactggaaatatattttacgtccatggctacaatatagtttttatataagttttaagtaaaagtggaggtggtggcaaatgtctttaatcctaggagttggcagatctgagtttcaaggccagcctgatctacaaaatgggttttagaccagccaaccaggactatacagtgagaccttgtttcatacaaataaacaaacaaacactcttttaagaattgatttctacagtttagggtccttttaagttttctatctcttctggagacaattttgttaatatatattttcatagaaagtcactttcttatttatttgtttatttattacttattcactttacatccctttcactccccccctcccagtcaccctctctcacaatccttcccacatccccctctccccttctcctctgagcaggtgggggcttcctgggtatcccccaaccctggcagaacatcactttcaaacatatcccaaacttatttgcattaaagtttataaaatattcccacaataattattttacttcttaactatgtcttattatttctcttctgttctaattttgtacaatatttctttttctgaattaagtttatttcagtcttttaaaaaattagctctttggcttgtagttaagctttctatattatattcttatagtttctgttttatctttattaatttctttcttgtttatttgcattttccccctaattttataaatagaacacttagttcacagggcttcctgaactggacactccaggtagagcactgaatactattgtgaccagagccctatcactgctgtccatttctgactagagaactgattcaaggttcctaaactacaggcagagaacagacagaaccaggcagatttgaagttattaataggcaatgcaaaggaccataaggtctggagtcaaaagctgctgctgtgcccagcacagctgccacagagcagtgcctggttaactgagtgtagtccagtacttgatgggcaattggagcagcagctgctggagaagttctggggtgtgaacatttttctgactgtcttctgatactgtagggcgtactcttgattctctatagactttcaaggacatccacaaactattgtcaactacagaaaacatccaactactatataacttacaggc

SEQ ID NO: 31046 - DNA, 1237 bp, Mus musculus
ctacccactgtgtttagatgctcattctgcccccgattcaccctcttctcttctctgaatgatacgatcatccagtgtgtgatgtttccctcagcgctctttgtctcttcctagatagaacatggcctcctctcaaagcagattgtacctactgtgtgcctgtaaaactgttcctggcctatttacatgcacactgttgaaagaaggcagttgtccctctaacccatgtctagataaggattgagaaccaggtgtgctgtgtatacgtctctctgccgctttgttcttaatcccctcacacaaaaggacagactgtgaaagtgaggggaacatcttttaaaaattaaccacagtggtgagccatgtaaaacaccaggcgtccagttaagaagtggcaattaggtgtgcggcgtaggagcggcgcttgaggcctggaagcgttccgcggcctgccgggtcagcaccatgagctccatcggcactgggtacagctattgggatcagatgtaaagatggtgttgtgtttggggtagaaaaactagtcctttctaaactttatgaagaaggctccaataaacgtctttttaatgttgatcgacatgttggaatggcagttgcaggtttgctggcagatgctcgttcattagcagacatagcgagagaagaagcatccaactttaggtccaacttcggctataacattcctctaaaacatcttgcagacagagtggccatgtatgtacacgcctatacactctacagcgctgttagaccttttggctgcagtttcatgttggggtcttacagtgcgaatgatggtgcacagctctatatgatcgacccatcaggtgtttcatatggttactggggctgtgcgattggcaaagccaggcaggctgcaaagacagagatagaaaagcttcagatgaaggaaatgacttgccgtgatgtagttaaagaagttgcaaaaataatttacatagtacacgatgaagttaaggataaagcttttgaactggagctcagctgggttggtgaattaactaaaggaagacatgaaattgttcccaaagacataagagaggaagcagagaaatatgccaaggaatctttgaaggaagaagatgaatcagatgatgacaatatgtaatattttcttccccatccgctggtttacatttctgtaacagttgcatatggctagcaccatggactatatatacccactgaccgattt

SEQ ID NO: 31047 - DNA, 1163 bp, Mus musculus
tgtctttacctgagcttgtatgaaaagtcctctgtgccactcctctgccagcctcacaggaaaggaaagcctccctgggagggtcagctaggaaaggacagcgtgggaaacccgaggaagcggcctccaagcagccagtgccggccctgcgcggtcgggttcccggcgcggcccctttaagagcaggccccgtccccgccctcctcctggcggggctggcgctcggtggtggccgctacggtgctgacaagatggcggctggcggggctgttgctgtggcgccggagtgccggcttctgccctacgcgctgcataagtggagctccttctcctccacctaccttcccgagtaagtgcggggccccgcgctcgagctgtcggagccgctcggtgagagcgcggcccgccagagcgtgcggtgtggggagcggagccgagagaggcccaggcggggcctgtgacggggaacgcgcggcctccggagcttctcagtgcggcggccgagtgctccggcctggcgggccgaggccgggctgagggcccgggagcgagctccgggtggcggcggcgaggcgggcttgcgcagcgggaggtgaggcggagcggagcggggctccgggcccgggccgcgggcgagcctcccccgccgtcggaggtggtcagggcgacgacgggggcccggtccttcccggacggctcggacagcgccggagttcctgagcccgcagtaaaagtgcttagctctgcacgagtggcgagagaagttggggagtccatccgcaccctggcgagaacttggaggactggcagaggggtgtcttggctttttttggacgggggggggggctggaagttctgaaaaagatagggaaggagggcaggtctgggggcgtgcggcttgcccgagggcaccaccaagtcagcagaaatggccttaggaacacaacgaggaacgggtgcagttttccgttgctattcgaataaaattgctacatctccggagtgtcctgaacagggagtgtgttccattcgtatttttaaaattcctcccgtttgttcagattggatttctcgagtccagtcggtcaggactctggaagttgaagctgcgggtgaagagtcagcctccgcggactgcccacctgccctcctcctagtcacca

SEQ ID NO: 31048 - DNA, 1149 bp, Mus musculus
ctagatacatagctagtctgtgagtctaaggaagcaagtttagtttataacaacttggttttgatgtgacacattggggtcttttaaagttattatgtgagtgtatgcacacttacatgtgtgtgcacactgtggtatatgtgtggagatcagaggacaacttagggaaatcagttctgaggagtgaactcccctcagtaactgaggtggtgaagactctgcctactgaggcatcttgccagccttcacacatttcatagggaacggtaaggagctctgcctgccacagacatcctgacagcacagttgtgtctatgccacagggcatttctgctgcctctctgcagagctgacatctgtacgctcttactctggatgctcaaaaacagttttttagatatccagaagagatcatctctaagcagtatacctttcttcaaaccttaaggccatttcttataactgaaagtaattgcttcccttgttttgtgttttctaggtttgaagaaaaggcccaaatggatccccttagtgctctgaagtatttacaaaatgatctttatataactgtggatcattcggacccagaagagacaaaagaggtaaagaaagatggataaatgtttttcttgtgtaagtgcttaaaggaaatgaagaactatgatgcactgcccttaaggatgctcagttggataaaataaaagtgaacagctgtagtgctaaactgctgcactccagcattgggaaggttggtgcaggaggatcgatcactaattaaaggctagccgaaatgacaaggtatctcattacaccatctatctgaggggaaagaaagaaattgaacaggcacatttgattcattcaaaattaatttttaggtataaaatttcaaattacgggctggtgagatggctcagtgggtaagagtacccaactgctcttccgaaggtccagagttcaaatcccagcaaccacatggtggctcacaaccatccgtaatgagatctgacgccctcttctggtgtgtctgaagacagctacagtgtacttacaataatgaataaataaatcttttttaaaaaattaaaattacgttagttctgtatttatggaggaatttttaaagtctagtttttataaatcaccaag

SEQ ID NO: 31049 - DNA, 1281 bp, Mus musculus
tgttgtagttttaaagcttattttgattttcccattgtacatgactaatatctaagtcagtacacactaacttttttgttctgtattgaatttttgaaataatacataaatttgttttattttcttcaacaggcttttcagatgtggatcatacctatgctcaaagaactcagctctttgacaccttagtaaatttctttcctgacagcatgactcctcctaaaggcaacctggtagacctgatcacactgtagactggggagtgggattgaagaattactgggctcagacatggagaaggaaccagctgttctgtgggcagaggtgacgctgcaggtactgaggacggcaccagagttttgaaggatccttattatcacaagttttaaccctcttccttcatacctgacctcaatccccttttcctcttatttctgcattaggctaataaagtgaaattgatatacttcccatttaattatgtatatttttctttagcctttaagaattagtaagtattaatgaaaattagccttttttctggcttccaagttttcaaagtttatttttagttaggagaacagcactactggtagacttggtgctgtaggaatttggggttttgctgctgggtgtttagcctttgtttcccttttcttctcttcccccttcactttccccacatcaccgctgttgtggtgccgactctgactccctccctcatccttaactggctctgtgtggctctgtgggacacacacaggtggtgtatgtttaggtgatgtgtggctgttgacttttcgtgtattaaacatagagcagttagagggcttgaatttatactttttgccatactaccaaaagcaaaactcaagattggcccagacacctgatcaagaattgatatttctgtattgaaattctgtagtggacattacagtagccattggcatagaatcacagaaacctgaaacccagcctcctacccagaaataagagtgttccaggtgaccagcaggagaggtgctgtccttccccctatttttactgatatctctgttgggattttaaaggaaatgactgctggtagagctatgcagaacctacgctctcactctcctctgagtgaactttttgtcatagttttatctggacaataggttccagagctgtgctttcatatttttctgatatgtgaccctactattttgaagagtaatagtttgtggttgtcttttggcatacaatttacaggcattttagtaataagcatgtgggcca

SEQ ID NO: 31050 - DNA, 2440 bp, Mus musculus
aatgggattctgctgcctgcagcctgcctgtacatgcttcccccagccgccaaggttttttctttcaattcctctgactctattatttgggtgaaattcagttcttaaccttagtgattctttccccccccccacccccgccccttcttttctctgtttttatagtgcctgctttaattccatcccccctcactgtagtttagaatttttcattttttactgccaagtttaaatgattgaatcctaggaaaccactcagagctgcctaagtactaagatgctttaggtactaaggaggtggatgacataactgactcaggcaggtcagagcctgtgccttgggcattagtggggcactccaggggtacctttaggaagtgtagggattacacatccagaaccaagattggcatgctgctcgccacatccccatgacagctctgattgagaacttgtatagatgtttataaggagtaacagcagaatattataatttaaacaataaaaggtagtatttaatgaaccaaatatgtgtgctttcctaaaaattcctttcatattctagcttagccccaaattaatatacttagctgtagatacattcgttagtggagaactgttccttgacagaatccccagcttctgcctcacctccatctcccttttttagcagaatatatggctttccatcagaaataagctattgataactgatgctactttcacccttgtgttctgtaagaatttagattgcaagtcacttcacaaatgcatttacattttacttatgaaataacatgagaccttacttggccagtttgtttgattcagagttatgtcatgtttttacacacaaagtaatttagaattggatttccactcctgtgttaaaggtgacaaacaacattaacctttatcaaagtcaccttttttgatatggtttccatctctactaaaactgacctttctgtgttcaaggagtaaaaactgacagaaaacattggaaagttgggtcagtgtttgttgtagtaaagtgtgtcagatttagcatccagtgctttgtttgtttataaacaaatgaatgttgagtgaaatatgtattctgtgtataaatgttggcagcttgccattctactggctccccacatctgccttaagaagtgttatatagaaatacacagtaacagtttcatgtaacaaaacaggcttaaagtcggtctgtagatagaagctggctggagaccctaaccatctagtgagagtctgagatggttgcttaataagtcaacaagcacttaaaaagtggtcctgattgctattctccgcgttatattaagtcttatggtaattatataaagacattacctcactattgttttgttgtattggaaaattgtgaatcatttatttcctgtgaaacaagtgtgaaacccttcactgactgtcatgtgacagctgggaattctgctatgaagtgacttcgtgggtggaagtcatgatagtgtgcactttagacaaagtcacaaagctctttaaagatgcccttcctaaaacttgctttcttaaaattcctgttaatctacagtctcaccatctgcagaaattcttaccaattttcaccaagttttagctagtctgtggtttaggatttacaggctctacaagaaaaaaaaattctatagttgctggagatgtgtcaaagaggtctgtatatgacagtatttacagattaagatgttgggctctttaatgcagtttttgttttctgtattaagcaaattctaatttttatatgtggtttttgactgtgggggttgtctctatagtttgtcttactgttgaaatgacatggttatccaaagcctctagtgtccgtcaggtgtgtattctctatatagatgtatcagctggaggtcagagctcccacttgttttgaagttctgtggagctgactagtaccgcgcagtgacaggaatcgtttacttgttttcagggcgggggttattgcagtggattcttttcttcatcaaatgcgcttcttgttttcttattaaatgctatctcagattttatttttagatgattttttaaccttaaattcattctattcacctattactgtgaattgtgtttctatttattttccttggctaatttaactttattcgttacttcctagatttttctatggcactgtttagaactattgtattgcttaaaaaaaaaaaagtcaaatcattgtaaatcatatatgcttctgtttatgataagagaataatgagattaaaaagtgtatattagtaaagaagtaataacatttagatattgctatacaatgtgtgtgccattttcttttggggatagtgatcattactatggcagctttaatggagacgtctgatttagcttcttttcctggttctagaaactgttgtcatag

SEQ ID NO: 31051 - DNA, 1177 bp, Mus musculus
agacagtatcatgtctaccttttaaccttagtacagccagttagactttctagtactcagggagaatgccttctggaaaaaattcctgctactgactgtctttttcaaaagtcacagatcttgaagtggaatccagttcacaacacagaaagcacaggataattctaatttctcttctgcattcaagagctttgtaaatcgggctggagagatggctcagcggttaagagcactgactgctcttcaaaaggtcctgagttcaaatcccagcaaccatatggtggctcccaaccatctataataagatctgatgccctcttctggggtgtctgaagacatctacagtgtacttagatttaataataaatcttaaagaaaaaaaaaggaatctttgtaaatcatatctgcaaatgtgcagttcccaaacactgccaggtttggaaccagaactccgtgtggatttcatctgacagctatggaatcaacaacaggaaaggccgtagtgatgggtgtttagtaaggacgggaaccagttcagaggcttgtgaaatcgcgtgtctttctttcctctgctactcagagagactcagtagttgctatgcgtgcgtgtgcactgacccaagaattctgactacaacgaagaatgagcgtgagctagtgcatgttcccaaagctaagcacggcaaaaagctctccattgttaacctagaataagtctacaggttcaatactaggaaaaaagttatcaaaggagatcaaagcttgtgcttttctgaacggccttgggaaagtagcattttttttttaggtagttaccattcttcttgaaaatacaggccttaatacaaagcccagttttatctttaaattttaaaacttggtaagtagtttcgtatgtatggccagttccctgataagcccacagggaaaagctataaatgaaagatctcaccgtacagcttggaggctcccagagagcttgcttactcatcgtctctgagctcttactgcagcatagccctgaactgtcgtgcgtgtgagcctcaagcccagcagagagttttgatacttgaactggctgccacacagggagtcagccccattacatcatcagtcttcattttcatttactgcttagtggatgccaagttagttggccaaaaggaaatacagtgtg

SEQ ID NO: 31052 - DNA, 1227 bp, Mus musculus
catagagtaatgttatgcttttaggtgttctacccattcctatagtgatgaatgagattggagaaagaacctggagtttttgccagttccctttacagctgcaaagcttttcagattcagttgcagccaaagactagaaaccatccagaccatgagggcctgcatctgcaagtgacctttaagttatatttgctgtgcaattgctgcattggagcagtggccgctgaaaacagatgtgtgcagcttcttgtatcctttctaatgcgtccatttctgaagtcacagagcacgtgcacctttgcagagtcttggcttatttttgcatctacatgtcagtcatgcttgtgagaacacatggaaaagtaagtttcagcccagcccacttactggtaaatgtcaaactccaaagtaggtgatgtgtgagtttctatgggggaagaatttttgtttgtttgtttttaaattgggatgaggagacacacatgcagcaagcacacagtgaggaagactcgggaaagcagaggacactcaggaggctgaagccccaaacatgtctttttgttgttgttgtttggtgagagaaaaagaccatgtgtttgatgcgcttcagaggtcactcatgaacagtgctgctctttcctaaccagccccttaccctggacagactgctgctacactctgattaaggtggtctgccttttgatatgtgtgcaatgtctttttaaaccaatgagattgtatagtattagttacccttcatgtctagccttctgcttatttagaggttgcaaaatgatgggttttctttgagcagcttttgttcaggggtctgtatatgcactttctcttttagaagcaaaaacattcctcttgaccaccactctgaagtcacgcacagcagggccctcagcctcacaggaggagtacagggaggctgaggaggacttttttcttatctttagttttgagaccatgcagtgttccatctctgaaaaagacatacttgtaatccacacaagaacaaatgttagattttttttttaatgtccgcttttgtgagttcgaagtacttagtaaccagaaatgaagatgtcttctgataaagagcttcgatccaaagcttgggtgggaattaacttcagaaagttaacagcttgactacagagtacagcctcatcttccaggcctacctcagtctgtactcatctggcctggacacacccttgg

SEQ ID NO: 31053 - DNA, 3407 bp, Mus musculus
tctcaaggacaggtccccaatttccatctcctataacatggcctcggctagcttgttgtatcccacctctcatgagttagtctttagtcccattatttcccagggcatggctttgaacttcttgttctacattctgatttccttgcctttcttagtgggattgggactaaactcacaggcctcactatctaatggagtctgcctaaggggtgggtgggcaggcaaaggcatctcatgctctgatggcttccccaatagcttcctcatggcagctgattctgtactgagactggcctatcatttaagacactccctagaagacacttctcaaaaatctcctctggccgtctgcttctgctccttttttgttgttcactgctcagctgagtgggtgactcctcaaaacctagtgtcacatagcagttgtctaggaacagatatgtcctggggtcccaactggtccctgattggcaaatgtgtctcagtagacaatcgatctaacctaccaggcattattattattccacaggaagctcagggacttttcaagttgctgagagcttgggttggtgtgctgtggtgtgttgtgtgtgtgtgcgccagctccttactgccaaaggccaaagctcagatcgtggagactgtgagctaattccatcggtttgcaccctcctttgccacatggagaaaggcccagattgtgcagttttaagataccttggcctactctcccagcacggagccaggcttttgtgtctggtgtgctttgtggcattccagctgtcccatttctgatggcctctcagggaacataaaaccatgcctagtacctagcacaggatttgtccaggctcagcggtgtcaggcagccatgtccaaggttgcgagggcccagcatagtgatgatgggtttcctgagaaaggggaaggggccctgtgtggagctttgaattaggcccatggtttgtattcttgtggtataagttcccaggactgtctggtttggagcagcttatttgaaaggggagctaggggggcagacaggtgtcctctgcctgagtccatctttaccactgtctctctgagatacagactagagagaaagaaaaggctgacagaagtcagggaaggctcctagtgagtttcacaggagcttgaaaaaaaggctaagaagaactcaacaagccccttggcatgcttctctaaggtttgcaggggagtgtggggaacagtgccaactggggggggggggggaattaggtctgtttgatccctgcattaggttctgccacccagtgggttcattctgtcatggtccgagaggcagacaggatttcttcttctcaatggggcaaggccatttgacagaccgcaaatgctttttctgcaaactggtcacagatttcaaccctacagtctgtcagctatgattgtaatattagacaacagatagtgtgtctgggctggaggaacagccatggctctgaccagactggcccagtgttccttcttgtgcactcaaattgtgtagccttttattacctggccttcacttgctcttacggctgggacatctgttcagcaagacatgctgctagcatctataaaagtcatcttcctgtggttatgaccgggtttttagagctgttaactcagaatctcaggcccagtcagagaaaagggagaggaagggaactttagagccagctgtaccaaagagaaaccagagctcttcatttcagtggcaaatggttctcccctagctgcaaaccccaagggcccgatggctgtgcctgagcacacccagcagctcttgtgctcccacgtgcatgtcaagagaggcaggtgagcatggggcactgagcagtctgcccggcagaaaaggacccagactcatctaggacactcacttctatcttccctgatagagtgagccagcccactctatcagtgtttgagttctattggtctttgcctattttttggacaatacactggtgaaactttggagagtaagttgaagttgacaagatctatgcatatttttgacaatgtaaatacaagagccacatgtttatttaccttgtactactttcagagagtaaacttggggtaaagatttgatagctatgagagatagctaagcctccctccccacttctgaacaagaatgtaaatgtctatttagtagagatgacttttttaaaaatgaagaaagtaacaagacaggctggtaacaaacgtatttgccttggagatagtggatttacacctcccctgccaagtcgcagtcctactgcagttcaggctggagttgagaatggtctgtgatggtcacggggaaaggtttggagatacagtctagtctccctacaggaaatcacatctgaagacacaaagagtctccccagggacagggacaagaggaaaacacgcatcccacactgcccaccctgtgctgcgtgtttctcaagaacagggaattaaggactgcaacttctaggtacaaggttataggagaccgccagccttcctcacgatgaccctggaggggctgggagaacacaagggacaatagcagccatatttggggctctggaatcatgtggtccgaggtgtaaataagcattctaggggcttgggtttttgtttttgttttcctgtcaggaattaattttgaaaactccttgaggaatgtccagcagaatgaggctcaaagggactgcatagatgaaggcagagggggagaagccctgtgtagaacagcctgtgtcaccgtcaggtgtctgatgcttccctcggtctgccgcaaacccaccactggccaggatcactgttttgtgggggcctttctgtttgtgaatgtcaaccagcttgcccaggagattgggggagtgtatgttgtagtggacaggggtctaaagtacactggaatttattgagagattatagttaactattgcattttcttataaagtctattttggaaaattgtacactgtcaataaaaatgcttttgtgtaagctggttcaggccctagtgttttgctttggcttaaaattctccacctgagcagggacattagctccttctcctgtataattgggcagcatcccctgctctcatcagcacctgcagcattccgccagtagagggggaaagaggagatgctggaaggagtggaggaccgcagggccagcgcctgagaggaccatgttccttgctgtgcaatgtttacaaatttgtcaccatctaacacccttcttacttctgcctggagtgtaaagatatgtgaccatcaccaatgaaagataccatgccagttgggtgtgaaaacaccaccaagagataaaaccaagcgctagaatccagctcgggtctgcacagagaggtggtgcttcccctc

SEQ ID NO: 31054 - DNA, 1179 bp, Mus musculus
gacatttggtctcaagtcagtacctgacactagagggctgctgtctgctcctttctgattttttggggtctccagagtgaaccctaatcagcaagaaggtggaagggagatgatgggaggagggatgtaatgagggaacaaggtgagagtcaagaggtgagtgagtccagattttacaggctcccgagttctcaaactgcaaaaatgcatctctattaagccttcaaaacacaagccctgtgacgaaaccctccctcttggtccacagtttgaccttttaactggccttcttgatttctcatccctcagagtggacccgagaaagtcatgatggagtagcttcctcctcagccaaacacgacaaagttgtgtcatgtcacatagcctcctcctggatttctatgtatgtgaatatttcctcaatctccaatgggctgccatcactttttgtgcagagtgtatataaataaaagcatcaggggcttgaagattatccgattcgcccctctcctatgcgtgcatctggagtctgtgtacttcctccatggctctcccctccctaacttttccattggcacccacgatgagcactggagagggctggaaatgcagtggcatttctgtgcctggggtttgagggacaggaccagaaggactcttatactgctccactgtgaatgggctctgggagggtcctttatgtagtctattcattcctttaccgaacagtaagcatcgacagtgtgaaatcctattttggtccattaggaatgggctttgggggtctctttttgcctggtttacatcagctgagcacctactgtgtcaaatcctgatcagagacaggaagatctaaagggaatttagctggtcaccttcctagtctccttttctaaaataattcattttcagggaggggatttggaaaacagtttcccatttgttttccagtttggttcatgctggtatagtaggtgaacagtgagcatttgtacattaaaatgagccatagcaccatgaaggtaaaggggtagttcttcccccccatttttaagatgcttttatgaggcatcttgttatagcaagaaaagcagggagtgcacagcctagcacaccaggttagtaacagaacacacggcagtcgtgctttattcctgttgtgataatgtgacttcaagc

SEQ ID NO: 31055 - DNA, 1405 bp, Mus musculus
cactgtttcaacaaaatgtccctgattccagatgccacagcaccctcctgccattttccaggccatggtcttacccaggccgttcctctcagatgctgatgggtgggtcatttggagattcaggcgggcgggataggtatttcttaagagtattttgagatgggaaagcatatgctttgtccttgggttggaagttgatatttgaaaagcactgaaatcatcctaaacgcttcctgccgtttgtttgccttgccttctggtagtgggacttacactttctgtttctcttgcagagcatgctggagaagggaggctaaagttaccctgagaacatgcaagctccttcaacgttaattccagaggtggaacatttttcttttcctagtatgaaaatgacccatttaaagagaagaccactaaagacagacaggcactggaaaatggactcaactgaatcataacgtgttttgatcaacagtttaaaaagccatgttctagatcagcgatcagtcatcaaagaacactgttaagtgttaatgaaaccacaaaatgaataaaagaggaaggcagtccaccccacctttttgtactctctttccagcttccactgatataaaacgttctcgtcactccaggctccatccagcatttagtgacttccactctgacaaagctgggaggagggacattaaactatttcagatggagagacagcaagaaagcactgggctggggcaacagtgtagacttgccaagactgtggagcctgggtgtgctcttctcattatatagaagctaattcattgtaacttatgatgatctttcaaggaagacagaaaggagagaaaatgtacctcttttactggaataatgtttatgattacaggtaaaataaggcatttttgtcaatataaaggcaaccttggcttgttcaaccaagtagtgaatactgacaacttcactcactatcaataataaatctattttctgactaagactggcattttctgactaagactggcctcatgtgttcctctggctggagttgggctgggtgactgagtcacgtgactcgaattgcttttagtttgcattttcactacagctctcctgttcagggccagtcatgcagtgatgcctgcagcttgcctctcacataggtgcatttagtaagattttacatgttgcatgaaccttcctttctttggcatgacttaaagtcttctgcatggggccagagacagtagctataagacccttctgaccctgccatactatgaaggtgcttaaaaaacagccaaggaccagagcctttcttttcccagttcattgccacttcctgattataactgcttaatctaggattggggctccagcctcaatgtagggacctggaagctacatg

SEQ ID NO: 31056 - DNA, 1540 bp, Mus musculus
gtgtccaccagggagggtctgagatactcttcttccttcactaatgtgtgaggcttcactaataagtgtaatttccctagactacagttttattattcctggaagcagttttccaaatcatggctattaaaactttcacaggtaggtcctcatttcccagtagtcagagatcacagactttcccgttagtatttggatagatgagactataaactcttgagagtgttaaaaacctcgtgtgtaggtttatggcccaaagggagctggatgagtatgactcttgcttcagagaccagaataatattaactcctggctgacagtttgcccagaggaagcctggagcagtctctagagaaggttgctcagtgttctcacacaactggcctaagtcccttgggcagttttttctgttttcacaattttattggtgtataattaattgacacgtctatactgcttcacagctctcaatgataactgtacattatataataattgtgattaaatatgtatgttgttagacacatactatattttgtctaattttatcctcacagtaactgtatgaagctgcccactctgtgaatatcctgaagctgagagcagcttgcccccagaatacaaagccagattattatcagtagatctggttttgagtcggctgcctcaacagtgctgggggccaggacactgctgtctttaaaatgtatgagtttatgcttaagttgtttagtctatctggggacagtattagttctttgagtgccgagttagcacctctagcttctagtacaactcttgggcatcagatctcatcattggatgattgccttctcataacctgaaagtattgagctaaacactcaaaaatgtgtcatgtcctcctcaggatttggcactttcaaagaaacttttacagaaaggaagaaagaatgttttccgtacctgaacctgccgtacgctgcagtccccaagttccttcccggtctgcatttggtgctttccctttcagtgaggactcagtagccgtctgagcagttggacaccctcgaggtgtctgcacacttttactcttgtaggacagtcaggtcattgtgcctcctggaaagaaaacatattttttcttattaaacagttctgactgataatttgtttgaagtggattgttgacacgttcttaaggaaaatgtatttttttgccaggagtttattggttctaaggttgtcaccaactgaagaacacaaaggttctcctatctagagtctttccaggataaaagtccctgtatcccaaggacatcgtgaacacttgattcctttgagggttccaatgtcatgcatatataactttttaatttttacagtgaagttcaattaattctttttgctgaatcaaccactttgttcttggctctgtcaaggatgatggggtttggcacagcatacaggggaagtgtaaaagccctggtggccttaggagctgagggtgaacagagagcttaatgaggtgtaggctcagtacaaagatcagcctggtcg

SEQ ID NO: 31057 - DNA, 1672 bp, Mus musculus
aaattgctaacagctttttcctttcttccttttcttttttctcttttcttcttgttcccttttaaaccttttattcccttatttgaaaagggaacctatgaccaggtgacaaaaaggaatgaaaggtgaagtcagtttataaagctttttcttagtgaccagtctgaggtcccaggctacatggggaggaaggtgttgctagagtggacgtgatagaccaggagggaaatgccagtgggcggactgtggtcagcacattgagcattctattgagtggcgctcagggaaggagggtcagaagggaagccagttagtttaaaggagaaacaaaggaatgggcagctcacttttgattctgcctgccgtctgacctgcagcatgtcttgaagtaaagtgtcaggccagttgtctgagtggtcgttgcaatcacagtaaagtctcacaacctggaggctaaagacaggagaggacagggttaaaggtgctcatgttttaggaaggcactgggggcatttctggtgagcattttttctgtcccctctcttgatcctttgcacctgatacctggaacactcttctctcaatgactaaagcctttacccgaatgtgggagtactgccttgtttacttagtttaagaattaatgattccttacatacacatgatgaggcatgagcggtttcacagaaactgtgaaaccttgatcctgtaagccagtggcagctcacacgtgcgacatggttggcatgggatagtatgttcagcctttgatttgtcttaaccacctgcatattgcctgtcttcacgtttacttaactgctcgagtgtaagatactcaagcatatgttctgttcgtagctttcttactgattgtggagttgtgtggcatagatggccaattacagcactcacagctcctctatttcaccactcatcacaatgttggctaaatccagctctcagagcattagggagggagtaggattgatacagtggtgactcggggtcttctcctgttcacagatacttgagtgttgtggtcacagaggcataaccactgctgggtaattcttgatgcgtttaccacattatcgctgttattgtagaagacttaacatattcactggataaagatcagaaaataaattcagtaatgtgttaaaaattaatacaaaaatcattatccatagataactattaatattttatttgtgtatatctgcatatgagtatatgtatacttatatatttgtctgtttatgtatacatgcatacacttaagttgtgaatatctttatgtgttttggggtaaggttgtgtgtgaagtcagagctcagtcttgagtattgttctttgtgattagctcaggtgttgtttacctttttttgaagcagggtctctcactgggctggaactgtgcagttaagctaggctaactggccagcagccctggagatctccctgtcagcaactctccagagctggggttattagtgtgaaccaccaggcctggctttttcttgtgggttctagggattgaactcagctcttccatgcttgtatggcaagcacttaacggacaaggttatttcctgacctaaagtctattttttaaagaatcgtgtttgtccagatgattatggttgcatggcaggcacctaccaaccagact

SEQ ID NO: 31058 - DNA, 1232 bp, Mus musculus
ggtttgagattgtggttggtagagccctaaattgttcatgtctttaaagaattattgttgtgtgagctttccttttccaacatatggaaattagtagtttctgaggattctctaggagcatctaaatctctaaacaaatatgttaagattgaaaattcaattgcccattactctgtattgaaatggacactattataggtagtggtgaatatcatatgccatacataaggcttgaattaacaaatagcactagttagtagtagaccaacttaaataattaagatgtcatagaaatttgcatagttaaaaatgaaagtcctttataattctgtcttgcagaaataaccactttttcatattttgttctagactttttcatatgcagctactcccattttgttattgccattattaacactataagagaataataggcaaaagaatgctcactggagtaattgagttaaagcctggaagcagctcagtgtcgtctggggagtgaaatgtgaaccacatacaggccttcagtgggcagcagacgtcagtagatccttgtgtgcgctttcaatcatgtgcaagagtcagactgccgggagcttgggggggagcagtgtgtaaaacaccacagagaacacatgtacacacatttattttgagaaggtgttaaattttaaagatctgaagtgtgtacatagaaatgtgtgaatacattttaacccaagataaagagtcaactgcttcgccgcctccttgtgcagattctgaaagcctcacagagcatagaacactgtgtcatgtggtcgtgtggaatctttccactgccagcagtgggtccatgctcagacagagcaggagcttagagcctacttgtcattcatttgacaagtgagtagaaggaagctttgggttgggttggtgtcctccctggccttcagcataggatttgaatttttttgtccttcatcccccagctgatgattttgaatttagtctatccatacaacatacagaaaaagaatataagctattgattatgtccaccatttttaaggaactagataaagcgttatcacttaaaaaattgagatataattaacacttccagaagactgtgtgtgtctttatagtgacttcctatgaaacactttataattatttaattactttaggttgatggagtgtatataattagtgaagtttaaatattaaaaaaaatccacatcagtttcatg

SEQ ID NO: 31059 - DNA, 1161 bp, Mus musculus
tttgttgtgactacagtaggatatacataggtacttcacaagaaagaactgtatttagcacacaggtctggatgttgaagggcacaatactgtgcatcaactcagctcataaggacctcatgtcgggaacgcatacaaggcaaaccggtcctatgacaccaggaagccagagccagcttgggaagggtcaggcttgctcctctgtaacagtggatgatgtgtgcatcctgactgttcgcatgctatttcagagttatttgtaatgattgctacctgacagggatgctaagctgctgccctcctgctgatgaggatttgagggttgtctggagctggaggaggcacctggagagagggtgctttcttggctttaagcctgttgaagtctgttccatgcaacaggagataactcagcagtggtgtttgtggtacttatagaggaacccgggacaggattatagatatggtttgacttaccctcggaagatttttgtattagaatcttggtctctatagtatggtggttttgaggggtggtggaacttttaataggtggagtcagaggtccttaggccattgggaaactgccctgggaagagcttaaatacatgttatgggatctcagagtatctgtttccagttgtgaggtgtgacctcttcccagttattagcctgccattgtgataccatctaccttttaggcccccgcaagggtctcttcgggcatccccagttttggatttttttcagcttccaaaactgaactaaccaaacctcttttctttgcaaagtttgcctgcctgaggtgtttcattataagcaatgaaaaatggactaatatagatagtttgagagaaccttgaaaataatatgacagggtgattaagagaagcatttttaagattataaaaatataactattgctcatttaaaatatgtattccaactaagcttgctattaagagaaatgtttaagtgggttatagttctccatttacatcttttataaaattggacatgctatattggaaaaaaagggcccctggatataatttgcatttcttaagaatgtggtaaatctgtcattgcacgcatgctttgaataattattttcttacagaactttatgttaaactctgaaaacattactgcccctgtccc

SEQ ID NO: 31060 - DNA, 1196 bp, Mus musculus
ttatgtctgctaggcaagtgttctactattgagctctggtcccaacagtacagagttatgtagaatatattgtaacattaatatattgttatgaaatatatgctacatatgaattaaatgtattatgtatcggttaatgtaatatatatcatttaaactagccctgagcttcagaaatgaagacccatttcctcccatgagagggaacagtgtgctctcaatgtatctaggaagactgatgggttctgatgcttccagagctgtgactagaggttggggcagccagtgctgggctttgcacccctgtgactggatgttactcagagtcactcgggagtggggagcattggagtcaatgttaacaaagccttttcagccttgtagatgaatttcagaaaacatgaagccatacttggggcacatgcttctctttccagtacatgggaagtgaaggcaggagggtcaggagttgagggtcattctcagctacatagtgagctgaggctagccctcaaaaaagaaagcaaaacaagacaagcaaagcaggcaaacaaagcagtaacaacaaaaaaacccaaccccttcccccatatgtgtgtgtgtgtgtacacacatatgtagctggctctgctggggatgtagctctgaggtaggcttggaggctcatgttcaacccctagaatcacaaaacaaaataaagcaacaagaaaaaatgtagctggctctggtttcaggagatgaagcctgttgctattcccttttctcatttgcctggtggtctgagagaggagatggcctttgtctccagggagcacagttattgagagccatcctcccttccttatctcacttctactgtatttgggccctgagacagaagtaccggttaaggtatagacagctcatacaagtgtcccaggagtcatgaggcagcacttggtgtttggaatatttgttgagtgaatgacccagtgatctacaggagctcagcgccatgagaggtagctagggcgggggttctctgttagtggggcatttgtaatgggtgtagtggggacaaggaaccatagttctgctaggcaggtatggttggatggaatgaagaattaatttggtgagtgattgcttttggatgatcaaaccaggggtcttgaggcaaggtaacagtagcagaaataacactatagctacctgtg

SEQ ID NO: 31061 - DNA, 1125 bp, Mus musculus
caaaaaaacccaaaccagtttataggcacatttggatttcttggtatagggcttagcttgtgctgtggaatgaaggcagactaatcgtccttacctttatttaacaccagctcgaagtgtgaccggttgggcagcatttgtacctgttaagtctagagtggtgatacattcatgtagaaatgtttgtgggtgttttttgccatcctttattgtagcttggatatagctggtgcctgggtggcttctattctgattattttaggtagattatgtagtttaaaagactttagtataatagttaagctgtctaggctaagattcaacaagtttggaccagctatacacttgattttaatcttgctcatgtgcctcttgaatctttgctgttcctctggttttcttcagggctttagtggattgagattggggtacaactgtattagttgacaagtggtggctgtgtagagtatgacaaagtggaaacaattttggaaaatgtggaaacctgggcaaagggcttcaaagatgttccagattctcgtcctgcctcagtaagtctccagtgcttttagcctagagaggtgaatcactttctgtccctgatttttagtgtcattacctataaaaatgataaatattgttgaatgggtatgggaagaagagtgaaatattgcaggtaaggtatgctttgtcaaacttaaagcagtctaaagagttacaccatcattgtcatcatcattaccaagtgcaaagtaaaaaggatactagtcctgagcctgtttacacagagcaaacagcgtttctagcctgatgccggtgtcactagggcacacgttgttcagtcaggtaaactacacgagtgtttgcacacttgattttagaggaaaaatcgtccagaataatgccctagttatttgttgttatccattacattctggtttcagttctacctagaggcttctttgaacagatatttgattagttgcttttcagccaaatgtgagccagatctttgtgccagtttgaatgccggtaacctgtgttgatagatgtcagtgtctcagcctgactatgatctaagaatgcttagtagtttttacttagcttgacaggatggagttaagt

SEQ ID NO: 31062 - DNA, 1261 bp, Mus musculus
tggcttctgtggttatttaatacctcatcactaacctttttcccctcaaactcttctcacatatttatgttgtcttacatatacttcttttcatttctttttgcttgctgtagtcatgttcttttgcccctacatatatttataacatcttttattctcaccatttatcacatctcactaatgagtaggaagttgaggcttgggtttgagtctttaaagttctcctgaaatgccgtgtattgtactttagatacagcttataccatggacttaatttatctacagactgggtctgagtagtctgtgtacgcctggagatttacatcttcctatagaattgcttgtagatttcatttcctactaaaacattaccaattggtttgaattgtgggctgtttcatattactttgtaacttaatttaacataaaaatttcctgattccttaacagaataatcaaagcagtgattatctgctgtgctgttgaattaatatggaaactggatctgatatttagctgttgttttcctttgcagtgagggagatgaacctgcaagacgtcaaggaggacttggagtgtgacccagaggagaacagcactcttttcatgggaattcttattcagggcctggccagactgaagaagatccctgagacagttaaagccattaaagagcgtctggagcaggagctaaagcagattgtgaagaggtcaaccacccaggtagcagacagtgcttatcagaggggagagagcctcactgtggacaatcagccaaggtaggtatgggtatagtctggggttggtgttgttttattgtatacttcctagggtggagagtaaataacttattttcagttgggctcatcttcttgaactgaggttactatattctatacatacccaggccaggcattatctgtcttgctatcgatttattgagaagttttaggtttattgtccatattcactgacaaggaatgagagatataaacctgtttgttatggagagtgttatcacacatcttaataaatcactggcaagaaagaatgaagcaattgtcagttaccaagctgcttttgagataatttatggatattgtttcatttagcttttcctattacttgtgagctacttctgagtgtcaacatcttatagttagaggagccgaggctcaggggtagtgattagcccaagcacatgcttgccggctgacgagtcttggatttgaatacgagactactttgattgtaaagtctg

SEQ ID NO: 31063 - DNA, 1198 bp, Mus musculus
ctcctagaactgctggaactgttgtttgataagtttaatgccgtagccactgcacactcagtggtcctggggtacctccaggactctgttgggacccagctaacacagcaggaggagatcaaattatatgacatggcagatgtgtgggtgaagatccaggatgtgctgcaggtaaggcctttgtacagaggctgccatcttgactgggacaacagtgtagagaaatagaaaacagatgcctcagttactaccgtaggaagcacaaactggataaggaagtaacgctttcagagaaaggggatgatgtcatttctgtcatctttcaaaggacttctaatgttgttattattgttattattttacgggggggtgtcaggctctaagaataatcgctgattctcaatatatagcactcaaagatatactctatgaatatactctatattcatttggtttttttttgtttcattgaaattagtcatatgtttagctaataagaaacttgcgtggttaatataggaatatcaagagtttgaggccattctgggatttatagagagtgaattgctgactgtgcctatgaaatgagaccttgttttaaaagaaagagaacaggtatatgtgggggagagataataaatattaaaatgttttaaagctattttatgaacatggctgttcttaattttagtattttcttacaaccaccttttcaggcattgggttaatgacaggtcaggagcttattctgagagatgaaaataagtccacggttgcaagtgcatcactctcatttgttgacagtcaaagggatcgcaggactgtttgatgtggtactgctgacatggcatttagaaactgcattatatttttctctctgccgacaaaatagatttgatttggctagatgaaaattagaaatgcaattaagagttagccaaaataagtttgacatagctaaatagaaatggtaatatctacttagtattaaaaagagtaagtacatgtggagaattgaaaaatgtagctgttggaatggaatcatttgcacagaaaataggaatgtttgcagtgataaataaatcatgaatgcaaattgtagtcatttttgagaatatatgcacgctcctggtagattgaataagattgattcttagtaactcattttctagacttatttttgggagtgaggtgatgt

SEQ ID NO: 31064 - DNA, 1159 bp, Mus musculus
tcatttcaaggaaattagcagttctactaagactttgcaggtcaggagtaccttactcagccccactctcttggcctttattgataggcttactgtcatgcttatatatagtgctggcagaatgatgaagggtctcagcatgggtcctgtcattaattcaccagggaccacttcgcttctgaacctttctgaacccacaccctaatacatctaaacagataatgtcttgcctagagcacagtaagtgctcagtaaatattaggccattgctgctaatgctgttgtactttggaataatgaggattacatgctaagtaaagatggattttgacgaattcactcagcatgctacctggcatattccaatgcctataaactcacgttccctgtgaattgctaacagggatattattttatggttgtaataaagcttttcttatatctttgagtagaagaatgaacatctaggttaatatattctggaagtctaggatgacgtacaataaattgaactcctcattgtgcttatatagatgctgttgactgagtacttggatatgaagaacacacgcaccgcctcagagccatcagcccaactaagctatgccagtactggacgagagttcgcagccttttttgccaagaagaaaccacagaggccaaagaattctcttttcaagtaggtatcacagagtggagagctagcatgctgtgatgagccagctctgaaaaggtgggacccttccccaccctccacagccacacatttactagctgaaactgcctagagcaatttgtaggaagtgaacatattttatttttgtatcccgttgccttctgtcaggtaaagtggctgttttggaatggctatcagactgtctataactctgagtacatttttaaagcttctttttaggagttttatacaaaatcaagaaaagtgaaactttccaagtgtttctagagaattttatatgaaattaaaggaaatgaaatatgttatccttgaaaaggcccaagtgccaaaaaacaacctttgtttttaatacagaaacaatccaaaagtttttacttttttcttaattaccatcttagtgaattctgccaagctgtgtgctcagaatgtacatctcttggtgacagttaatagttcataagt

SEQ ID NO: 31065 - DNA, 1211 bp, Mus musculus
agaaacagctctcatgttcatcaacgggaggatggttatgtagagtgcagaaggtttatacagggtgcagtgtagtggtgaaagtgaatgaattattgtacagtgactcagttatacacaacaacataagaaaactcatcccctcccccctcccttgccccccccatctttgtttctctctgtctgttggtatgtctttgtcttcacacaaatccagtacctacaaatgaatttagatggctgtcagaagcggatagaaatgaagagtatattacttaggtggccatctttgagtgataaaatgtacagaagctaagctgaggaattacacacaaactcagaaatattccccactgaagccatagactctgtaggacctgtgctgtcttttttattctttttttaaaatggtgcaaatgtcataggcactattttatatgttatactctcacataaagtacagaatgaacaagtaattaaaaaggcgtattgtaaggccagaatataacatcatgtatcttatttgatgtttgtatcatcaaatctggactttcctaacagtagggtgaattttttggcctgtaccatctcattgaaacctgattccccccacccccaaatctgtgacttcctcctgagctcttaactaacttaactagctccccagaagataatgtctgtgtcaggtactttcctcgtgtgtcacctgtgttgctttccctcaagctccactgtgcagtggttaccaaggctgagttggagtcactggctggaatgtgtttacttcttatattttccttccctgtgtattcattggtcctgtacaacttcgtgatatgtttacttgtgctaggcgcttttctaaatggcaggattcaataatgtgtgaaactgagataccaaagcttttaaattcagactccattttagagaacctggcctaactttgaactcaggtagactaacaggctggtagcattagtttccaagttgcctcccaacaaaacctctaggctaatccccaacaagaccagtgtctccaggtcattcccccaacaaacctgcaccccaggttataagcccacctcttgcctattgaccaccaaggtagaggggaaccgaagttaagttcccagcaccagccaattgtgttaaaggccgcagtagctttctgattagctgcacagatattacctgcttgctgcttacta

SEQ ID NO: 31066 - DNA, 1156 bp, Mus musculus
tctaaagctaagcctttagccaatggtttacagtaaccacagggctcatgtaaaatgtggctaattaagattcttcatgtttgagcgccaccatgtaggtacatggtatcttacacccactagctgtaaattaaaacttgcagaatatgagcctcagcccatgcaaaatgaagttatgtataggtgacttgctctgtttgaattaatgaaggggctgctggtatcgaccagctgtgctctctgatgacaaaaacgagtcttgacattttgggtaatgaaaattcagttcagcacctcttagagatatgtatgataatatattgtcagtcagaaaagacagaagagaagcacaaacctggtcttattaaaatggtgtgacatgtggacactgctcgatctctgctttctagggggaatgtgtcaggggaaacctctttttaagatgataggaataactctcttgtggaacgggggagaggatttgactttggtacatgacctctttgatagttgcctttgttcatgattcctagttttgtggcttgttttactgggtacagggtgagacatgaaagctctggaaaggatactggcctttttggcttgacagtattaatgcaattgtctagttcataccttgtaagcccactcattatttcctctgcatgtgtttctctagtttagcggattagctgcactgtctcttcaaaggctatccaatcaaggaggggttattaaaaccagggcgatttatgactgagaattaattagagaagcattttcatgcaaaacatccaattttttgattagcagtggagcagggccgcaattagcactctaggaagcttaaatttccagctttttgattctcaggaaatgagattatcaaaccagggtcagacacttgacagcaaagcgagagtgggggagtgtgaaattatatcttaaaaaaagttctttgattttgattctgagattgctattcaggaaataaaaaattcagaagaggagaaagacaagaaaatctcagagtgcaagggctgcaggcctggttcttcagtggcctgtttgttgtgcagactgtcagttataaatgtgtgtgcagagacttgatagatgtaaactagtgggctttgtctctttattattatttatt

SEQ ID NO: 31067 - DNA, 1137 bp, Mus musculus
aggataatttagacaattatattaggcatgagtaagggcagtttgctaaaaatgcggttaatgttaaaagctagagatcatctctgaatgtagtttcttttctgagatttcagtaggaaaattacatggatggagcatgacccagaaacaggcctgtcagtgattgccagtgggagtaattgaagatttgtgcatgttgattgactttcagtatctgattacagacactcagggcagtgcatcttgtcctttttatctcttttgttacctcttcttagaactgcatgtacaatgtgttgtgcttatctgtagattcctagatccatagaagttttatctgtttctcttgagtgtgtgcagaggggagtatttcaatcaatttcattgctaacacacagcatctgaattcagctgtactagaatactgagactaatgtttgatgtgtgaatactttattctcataaagttccatctatgtgagtgtttgaaatctctcatgatcttgggttctgagctattgtagctgtgagtgaccactttttttttttcctgtaagatgtatttattatatataagtataccattgcagtattcagacacaccagaagagggcatccgatctcattacagacagttataagccaccatgtggttgctgggatttgaactcttttttttttttttttttttttttttgggggggccgaatgacaccttctgccacattgaaatcttgtcagcagggtagaattttgtagctcaggtccagcatgctttctctgtatctcttactaccattcaatgcagagaaaggctttttttttttttttccattttttattaggtatttcgctcatttacatttgcaatgctataccaaaagtcccccatagccacccaccccctctcccctacccacccactccccttttatggccctggcgttcccctgtactggggcatataaagtttgcgtgtccaatgggcctctctttccagtgatggccgactaggccatcttttgatgcatatgcagctagagtcaagagctccggggtactggttagttcataatgttgttccacctatagggttgcagggatttgaactcttaaccgctgagccatctctccagc

SEQ ID NO: 31068 - DNA, 1098 bp, Mus musculus
gaggaaaattgttttattttattgtgtctttctgtgaagatggagttgcatcattttggacattttaaaaagtaataatagtaatggatttaaatatgttttcatggtctgcgagtaatggtattgtgaatggcatttggcattttgatagaatataaaaagtaataaaatggttgtatcgtgactgcatgatattgaagatgttttatatcattaagaaactttgatttcagaaataggaaagaaaaagcaaggttctattgaacaatgggttcaatcctcataaaaatgtgtctctaagctcgagtcagaggtgctggtataagtgtcagctggtattgttttttattgcatttgaaatgctttagtctctttccaaagcagttgttttattagacaggacagaaatgattaacaatgaacaatgtctttttgttaatgatgttatgtaaaaaacaaaagggtacttcttgcttccattgaacagctcttttatatttatttattctctcatctctgtctctctgtctctgtctatctctgtatatttatatgtatatgtctctctctctctctatatatatatatgtatatgtatacatatatatatgtacatacatatatatatatatatgtgtgtgtgtgtgtgtgtgtttgtgtatgtatgtgtgtgtgtgtgtaccattcacagtaaatatatgggagagagagcacatcttgcatgagttggttctctctctttctaccatgtgggtcttggggataaaaattcatgtgttcaggcttgattgcaaacacctttacccattttgccatctcacagtcccatttgagacctttaactcaggtatttaactgataactaaacctgctgggaaaatagaggcataattattggattgttagtgcttgagatgacattgatggtcatatattcagtggtatccacccagtggagtaaatggcagaatgggcagttcattaggctcttttttactggggttctttggggattagaataaaggtagaagaggaatgggaagaagttaatgtaaattgaattataattacataggataaagtaagttcttatgttat

SEQ ID NO: 31069 - DNA, 1067 bp, Mus musculus
cctattctgtgccttaatttagaagatggttaagactcaaacaacagagttgacatggagtactcataacattattagatggattaagatagcatgtcacagtatatgtgtatattatttattactctcactgccctaattcagaccttgctccctcagattgaattatgcctgaattatcctaaatgaattctcatgtcttttactgaatgtgttcagtattcctaccatagctcatcttttctcttcttttcttttcttttcttttcttttcttttcttttcttttcttttcttttcttttctttccttttctttttaattggatattttatttatttacatttcaaatgttatcccctttccggttttccctctgcaaacatcctatccccacccctaccctgcttctatgaagtgcatccccacccacccactcaccaacctacaccagtttcaccgccgtagcattcctctgcatttccagactagtgtagtaccacctgtctaccctgcagctcttatcctctgcatacagctcttccctcagctatcacctgtttgtcctctgtattctttccattggtgtgctttggtgtatgctataatatgtatagtctttgcattcatgtgacctgttgtctctattcaataaaatttgatacttctatctttcaagacttgagtatgactctgttccttagttttcttttatagaattttttcttttataacaatagataatagactctaaggataaaaggtgttgtccaggagagggaaggtactgaccaggagacagaggagttatccagttttattcctgttgtgtctttttttgctgctgaagcacttattcatggagggtagttacctctcatgtgtcctggccccattcgttccacacatgtcctttctgcttccacttttcacatgtgctctgtggtggttcaattttatttttacccggtaaatagattttatgtaggcctataatcacctaatttttataatagagaaactaaaaattgacaaatataatataaattccttaggaaattgtctatt

SEQ ID NO: 31070 - DNA, 1099 bp, Mus musculus
attttcagaacattatgggtgctcattttgtagcccccaagtttgtagatgcagatttttgccaacacacacacacacacacacacacacacacacacacgggggcggggggggagagagagaatgtgagagcaagagagacatacacacaaaaaaattgtttttttttcttttttttttatttattacgtattttcctcaatgacatttccaatgctatcccaaaagtcccccataccctccccccaacttccctacccacccattctcattttttttggccctggcgttcccctgtactggggcatataaagtttgtgtgtctgatgggcctctctttccagtgatggccgactaggccatcttttgatacatatgtagctagagtcaagagctcctgggtactgtttagttcatattgttgttgcacctacaggattgcagatctctttagctccttggatactttctctagctcctccactgggggccctgtgatccatccaatagctgactgtgagcatccactatgtgtttgctaggcccctgcctagtctcaccagagacagctatatctgggtcctttcagcaaaatcttgctagtgtatgcagtggtgtcagcgtttggaagctgattatggggtggatccctagataaggcagtctctagatggtccatcctttcgtcacagctccaaactttgtctctgtaactccttccatgggtgttttgttcccaattctaagaaggggtttatcattgctaaatttattcattttctataatgttattgtcacctaagaattgaagacaagtaggcttctcattttgcattgccctttggtctcatctttccctttttctataggtttcatctcttaaatattctagtggtttttattatttccctttagatttaccttagtagatataaggaaaattgttttttgtgtttgatgcaaaaccatgattgtagttctcaggttgctaattagtgatcacctatatgtcaggtcctcattctccatttgcatatagggcttggatctttgtatattattttcatgtctctaatcaataaaatatatttctccttga

SEQ ID NO: 31071 - DNA, 1130 bp, Mus musculus
aggttttgctgtaagatatacataagaatggacactcctgcagtgttactccccctacctgaaagactggatgtgaatcaaagcttggatgatggccttgtcataccaccctcttgtgcggtccattccttcaaattcttgtcaccaagaccagtctgtgacagaatgatgatccattgtcactgtagccaccaaattgcagaaaggacaaaacaggaatgtcatataccagttatttttttcaggaagattttaaaatggaagcgcattgttgtgtatgtggtattggccaaagctaaccctatctaacttcagggcagagccatatatacagttgtaattcaaagatactcaagcaacaagcaaagtaatagtctctgttccaccttccccatttagtcatcaacaaattcttttagtagacagaagaccaattacttaatatttgaaatttatttacctcaacttgaccttttgaaagctgtggtattctcagtagattaatgtccaatatttcaagactgcagaacttaatgtgcatggctgtttgcttagcattatagccgtgggttacacagtgttattgactacttaaaatgtcgctgatgtactgactaacagaatttgaagttttgctcagtttaaaatatctgattcaatcactagaaagtttttatcatttctggaacaaatttagcatgtgactaatttttaaactaaattttatggaatttaaaaacagatgagtacttctgatgaaaatttaacatctgagtctatttttgctttaagtataaagtgggaattggtttttaaaagtcattataaaagtataatctctcaatttttaatcttcaactacagtagatttggtcattataggttgaagacaatactcactaataaaattcattttctgcttctattcagctactgaaaatttaaaattatatgtggagctcacatcatatttccaatagtcagtactttggaaagcttcacattttttaacagaggacttgacttcttagcatatttggtttctgaggcaccaaaagtttctctattttaaaatctatttatttatttatttatttatttatttatttatttacaacccactatcagcc

SEQ ID NO: 31072 - DNA, 2271 bp, Mus musculus
ggtaaagcatggtgtgcatgtgtgtggcctctctacctgctgcatttcagttgagagtagaagggtaactgattttctccttttttttttttttttaatctaatttttttgttttgttttgttttaaggcatttttaactaggtattttcctcatttatttcaaatcctatccccaaagccccttaaaccctcccccaaccctgctccccatcctaacccactcctgcttcctggccctggcattcccctgtactggggcatatgatcttcacaataccaagggcctctcctcccattgatggccgactaggccattctctgctacatacgcagctaaagacacaggggatgggggggggggagatactggttagttcatattgttgttcctcctatagggttgcagacccctttagctccttggataatttctctagctccttcattagggccctgtgttccatccaatagatgactgtgagcatccacttctgtatttgccaggtattggcaaaacctcacaagagagagctatgtcagggtcctgtcagcaaaatctttctggcatatggaatagtgtctgagtttggtggttgtagatgggatgggtccccaagtcgggcagtctctggatggtctttccttctgtctcagctccgaattttgtctctgtaactccttccatgggtattttgttccccattctaagaaggaatgaagaatccacagtttggtcttccttcttcttgagggaaactgctttctaatgagttcaatcctgtaacttagtgataatttggggaaagtttcatggaaattggagttgagaaaacaattaaacaatatttaaacactgtgctgaaaagtctgtgagaagctgtgtttagcaaacaagaagatgcctctacttacactgagtcttgcaaatcttcatgctttattgccagagaaatatgtttatgtttgttttgaacacaagaggatggctctaaagaggaagatagatagcttaaagcaagatccttcaatcttctaggtagaatgcctggagatcccctgttcactcagaacttccttttttaaattattattagatatttctttatttacatttcaaatgttatcccctttcctagtttcccctccaaaaatcccctattccctcccctctccccctgctcctgaacccacccactcccattcctggtcctggaattctcctataggggggcatagagccttcgcaggaccaaggtcaccccattgatgactgactaggctatcctctactacaaatatagctggagccacaatgtgttttctttggctggtggtatagcttcaaggagctctgagtttactggttagttcctattgatgcacttagaacttcctaaagggtgtcaggagagaacactttctgaggtaactttgcaaactgagatcatcagtcacacaaaacaggctctgttgcccactaagccatatgccactcacagctccctaatttggcattgcactctggttgtatatgaagatttcttttatttgttttaagacttaagtttctggtgaaatttttctaggtttttttaggaattagttatttcaacctctggtagtacaaatttacaattgtaattgtaaacactatacataacagacatggtattcatttttcttgtgaagtaaaaggactttgttcagggtatggaagctgtgatggctacccctactctctgtgtgatctatattacaaagtctcccacttaagctaaaattctgactctgggcaagtgcttacttccaatggtttctttcctcatctgtattgtaggccaactcactgcagtgttctcggcattcagttatgtggcatgtgtacaaggtcctggcatgtgcttgctgcccaatccatgcctgctttgttttagttgaattccattgtgtcaatgctttccttgcttgttgctagcaagaagacaatgatactatagtagtgatttgcctggagggtttttgagaaactatgaaggacaccctgaaaacctattttgtctctatgccaaggtcatgagcttccagaatttcctgtttagattctcctattttgtcttccttccatagtgtatacaattgtgtgatgagaatttcccctgaatgtttgtgtctgcctttatttctgtttgtgcataggatatgcctgatagggtaattctagctggtgttcacactttaaaggcttggaggacattcctttgtattcctct

SEQ ID NO: 31073 - DNA, 1136 bp, Mus musculus
atcttcccctttctcccaaaaaagcgtggtttcctttttatcacaactagactgtccacctctgacccaaccatatttgcaaagggaacacttacaggaccagtgcttttcatatcatttcccatagtgctacaacagattcaagggtcgtatgcctgctggccaagtgctttgctgctgtgcatagttcctagccctttatttttagggaaagagtagactctgagggtgctgactcatcattttcccatctcaagctcttaggagttgaattccttccaattagcctctcagtgtggagaagcttggtatcattcaacgataagttgtcataataaaatcatgaactgtttgccaacaagttggtgaaactaagccattaatatcttgaatcagtctgtgttgataattgtggcagtggtagcaactctgctttaagcattattaagtgatgtctgttgtgctctcagcattttaaaagttgaaaatggaagtcttagagccgtctatattatgcttcacttaacaatgaaattgcatggatcaaatcatgcaataatttttaaaatctccatgtattttatgtggtgtggctattctgaggcattgtgtaaaataattctgtctgttacatgaaaattgacatgtaagtttattccacatatcagagattactttaccactaacatactccctcccaattttatgtcatctatgtgtatgtgtgtgtgtgtgtgtgtgtgtgtgtgcgcgcgcgtgcgcgtgcgcgtgcctgcgcacacatgctgagccatccactggattataggaaacttaggagtggtcacattctccacaaagaatgattctccctcacaaattaactacccattctcaatagctccccagtaagggctgtggcctggagatcatctatctgtttgtgtaaggattttgtctggcttgaacttttgtaggttatgtactggtaaccatagctactgtaaatggatgtatgcaaaaagcatgtcatgtccagaacacagcattttatagctttgatgctcgctcacctctcaggcttcattccttccatttctttttcagcactgttcactgagtctctgtggtgatgggcttaatgtaggtgccccatt

SEQ ID NO: 31074 - DNA, 1183 bp, Mus musculus
ctgaagttagaagcctgccttaaccccacaagtttttcccaaaatgggcataggttgtggtggattgctgtgacttaagtcttcagaggaatgcttcccgattagttaatttgcccaattaatatgaaggtgactaagattatgaagatgtctttgtaactcagactgccattgcaaacacatcagactgggtgactgcagaaactgtttcttaaatcaccggaggcccaaaggctcagatcctggcaccagcattgtcaggtaatggtcaaagcccagtttctggcttgcacatgtgtttcctcgtattagttcatggtgcaagaagaggaagaggagaagatagaaaagatgacaaagatgagaggaaagtgcttacccggttgtctcctatggaaatgccacttttatgaccccctataggactgataaaactgtaacacttgggatcagggcttcaaccgatgcattgatgagggagaaacaaacactcagactaacatttctaggctgattccatacatcaggttccgtgccatgtttatttaattatgtttctttctgttttcctttaaaaagaaaaaaggtactgctcgtggtaaatttgaagccaagatactcattgagcacatagtgaactgccagggacattggagcattgaaggatttgtatggatgctttttactcttaaaaaagtataaataaatagttgtgatatgttgagaaaatgatgtagagttttattttccttgttttatgatggggcataggaaggtaccacagcacagcctgatggaagtcagaggatggattgtgggaaaggattctccccttctactaggattatgggaatcaaactctggtcatcacccttgactataaacacccttacccacaagccatctcacaggctctaaagccatgccttctaggggccttgtagggtcaattgctgccatcacttacttagttttccaggatgaagatagaaccaggacccctttgcattctgggtgagcactgtatgactgagccatgccccagactctgtgtaaaggattaacactgaccagtttttgtattgtctttgtgaaggagtttaactagtcttatctgatttgtttgaattttagtgcatgtgctcctggtacaaatacaaaagatattaaattgaagcagaga

SEQ ID NO: 31075 - DNA, 1215 bp, Mus musculus
aattcatcacttttggggaacaaaagttgctctcttggccaagccaatatatctagaaaacactgagtgagctctatggtcacaagcaggtaacctttcttcttgtgctagtgtggctgaaagtttggaacccagaggtatacaactcaattcacatactagccttctcatcactacttatgtcaccttaggcccctaacttctctgaaataatgaaattgaagtaatactgatttgtcccctgtaggattgtaatgactgatggttatgtaggcatttagcacattattaagttttagtgaatattagctaaaacaaaaagttctcccaagaaaggcaactgtgagaaaacttgtgtgggcacatgtatgtccatgtctgtgagcagactagtcccatcagagcaaggtacattctgggtagaattgggtttaacctgtgactgtattacccttactgtagcactatggattcaccctctgttccatttagagtcctcaggattttcatgtcaaactatgatatgtattggacattttaaaaataatgtgttggtaagcaatccaaatagatttaaagctaaagaaactaaaaacaagaccttttagactaaaagtggtttatcttccaggaagctgtagctttaagttctagccttggatgtcattcattctgtttttagccttttttaaaacaatttttattagatattttcatttacatttcaaatgttatcccaaaagtcccatatatcctccctccaacctgctccccaacccacccactcctgcttcttggccctggcattcccctgtactggggcatataaagtttgcaagaccaaggggcctctcttcccagtgatggccgactaggccatcttctgctacatatgcaggtagagacaagagctctggagatactagttagttcatattgttgttcctcctatagggttgcagaccccttcagctccttgggtactttctctagctcctccattgggggctctgtgttccatccaatagatgactctgagcatccacttctgtatttgccaggcactggcatagcctcacacgagacagctatatcagggtcctgtcagcaaaatcttgctggcatatgcaatagtgtctgggtttggtggctgattataggatggatccccgggtggggctgtctctggatggtccatccttccatctcagctcc

SEQ ID NO: 31076 - DNA, 1155 bp, Mus musculus
tggcagtaatagtgagaaccatgaaaaactgatatagtcagcacctgtgaggaaaagactgctaaggcccttgcaagactggccttctgcgtctgactaaaagaattagtccattttgttcccatcaacggtgtcatttcaatatgtgatgggtagaactgtggcatccatttggcagtctaagtgggacaaccctctggtgataacagaaaaatggaaagaccctgagatttttagccacaaggcaagtgattctgaaatgaccctatctttggaatcattcacgttcactcagcctgtggtccatacctgactgggtactgaggaagctttataaatccttatcgtgtgtctttgtaggcatgttcaagtatcttcttgctatagtgtttgggaataagtttggttcctcctagcaggtaccctcttgagaggttggggagagggaactgggtgaggactgtctttgttgcttcagctgattcgttggtaagtgtgagggtacggggtttgccacagtcattcattatcgttttaaaaggaatcatagtcgtgccaccctcctaactccttgctctgctaactgtatcaggggtaatagtttgccccagtaatggatccctgttcacatttatttaggaattatttcatgaaaaccaagcttactccctgttctaccaatgcttccgatattattgtcagtagcatattccctgtattaaatcatttctaaataaaacagctaaagtgttttctgttgcctacttagcatttccagtgattcttatgacacgtgttacatacatactatagagtagttattacttgaaccaagtcatttgacaaaaactcaaacctcttcccatggcactacaactagaaagtcaataagtttgttatatttttatttttggaagatagctttctactttgtatttcatttctttaccctaaattattctggtatttccccacacacatacccatcagccccttgtctttcagaacacaagtctatcccgttctacttttctatttttgagaatttcatagatgcgtgctgtatttacaccatttccacccttccctctgaccccttcaaatccttgcatgacctttaactccctctcaagttcaggcttgcttggctgtgca

SEQ ID NO: 31077 - DNA, 1185 bp, Mus musculus
aaggtcctagattttggggatttgggatctttctcatggggtggcaagtaagatgaaactagacagccataattgtagggcctgccagtcttatttcaagggggttggcagaccttgtgatgacccatttgtctttgtcttctataacctcccgtagctgagaatggtgtatccataggttacaccggctgcctttactgtttgggggttggtgaggacctcagggtttgggtcttaccctgttggctttaggccctggatcagggtcctctttacccacacaaggtcaccaggctgaaacttgtggacaagctcagacacattcaagagtgcagcctcttgaacagcctgatgactagtaagctgggtctgtgttctgtttgatgtggtttgtaagatatttatggagaatttttagaagagttatagagaaataacagcacctgttctgtgagatccacaaacaggaacagtacttatcttccttctgatcactgtgtcttcagccctcatgggcttcttaccctcttgctcaaatgctcatgttttcaactttccccaactcgtttactgtacagccctgactggctctgagtcctccgtgatctgattgcctctgccttcccagtgatggcatctgcagcaggagcctcaagcccagccctatatggtcttggtttttctcatttcttgacttcagcaggaatatgtgctctgaacagtgtgccctccctctcttttctgagccacagcttctatcatcccctttgtactagactatgtcttactagactctgcatgggggctctcccttgttaagtcattggtaaaatagtgaatcttgattaaaaataattaaaaaaaaaaactagtaggcagtggtgacacacacctttaatcccagcacttgggatttctgagttcaaggccatcctggtctacagagtgagttacaggacagccaggactccacagagaaaccctgtctcgaaaagcaacaaactgccccccccccaaaaaaaactattttatcttgactggggaaacattttttatttttatcctgatcttttactaaaacatattttcacaatgcttcatgtactatttttatcttatttcctttatatatcattgttttcatatttctacataattttatgattatatttttcatttaaatat

SEQ ID NO: 31078 - DNA, 1128 bp, Mus musculus
agtacagtgtcacgtgtgattggaaccttagtatctgttgattgttggctggataaatgagtaatggataaaacaattagaactccttttggcagttatataaatgaattaattttctttggtagttacttattatttatttaataaatacaaagtattttgaaacaaagtctctatgagagcaaaaaaaaaaaaaaatagctcaacaattactttgggtagttgcaaactatgcctgataagtgctttgctttaagaaggcagtaataccaaaaccaacatttgaatccagagctacttggtccatagtcttatcaccaaaactatatttttaaaatagcatctagttcttgaaacatttaacttgtgtgtgtgtgtgtgttctgtctgtctgtgtgtcagatagagagacagacagagagggagagctccatgtgtgtgcagatacagtcacctatgtgtgcatatgtaaacaccaaaggtcatccttgggtattttcctccatcactgccatattttttgaaaccatttcatcactaaacaggggactcatagtctcagataatctagctgacaagaagcatggcagggcctcctgtcggtacccaccactcctcatccatcattggggctgcagctatacattgtcgtacaccacttttttttcttttcaacaccatttctcagtgaacctggagctcaccaatttggcaaaactgactgaccaacaaatctcagacatcctcctgattgcctcattatctgagattattggcacaagctactgtgccaggctttttattcctcctcctccttctgcttcccttttattgaaaatattttttatacacatttttctgatgacagtttcccctccatcagacccccacccccaagatcctcccaacgtcaccttccatccaaatatatatcctttcagtctatggttagaaaacaaacaggcatctaaataataataataaagtaagataaaagcaaaacaaacctgaataggacaaaacaaacaaacaaacaaaaagaaaaagatcccccaccaccaaaatgcacacgaaacacatatagacagtggcccatgttcacacacacaggaatgggctccatctcat

SEQ ID NO: 31079 - DNA, 1257 bp, Mus musculus
gtgaactattataggaaatttagatactacatatatattaaatttatatataataaaccattgaaagcaaggctacctctatagaaaattgaaaacaataatatatattcatctgtgagttaagaacaactgttaatgttctgatatatataccataaattttttaataaaagaaataaaacattaaaaataaagttgaaattctcctttgtcttctagttcctattctttcccattctcagcctgcaaactcgggatcattttaaatgaaagagactcatatttctcacaaactatacataagcaatttcaatgagaaatgggcactatttgtgaatctgccctttaatttgtcctataattttgttttcttctcatcatacttttcctttgactcctatagtctaatttcttttgagaattaatcaaagtattttgctacatcccgcatagaaatcatgcttttctgttccattctctttcatttaattagtaaaataacttatcttttaaaaaattgaaacttgtattgagatgcattgatgaccttgctgtctccatggaaacagcctgagcccacagatactaatgtgtgtggtgtcatatttatgtttttctgatctatttaaacacctttttttttctctgtttgtcttccagatttattcaggagattgaacatgccctgggacttggccctgccaaacagtgtcctcttcgagagtttcttaccgtgtatatcaagagcatcttccttaatcaggtcttggctgagatcaacaaggagattgaaggcgtcaccaaaacctcagaccccttgaagatcctggctaatgcagacaccatgaaggttctgggagtgcagcggcctcttctacaggtagtcaggaggaccgctccttcctaattgtttaaagtgtattgtgcatgtttgttcttctgtgtatcatgtgtgtgccttttgcctgcagaggccaccacagggtcttggatctcctgaaacaaatgatagtaagccatatgaaatgggtgttgaggatcaaacctaggtcccctagaagaccatccagtgttcttcatcactgaactatcttctccagctccaaaattactgttctttaatcaccatttatgacttgggaagagtcataactttagaaaagaggaagagttaccatttggttctatatccaacagggccaaaataagaggaaataacttaaacggacactggggaaatttaggcctgatatagtt

SEQ ID NO: 31080 - DNA, 1206 bp, Mus musculus
agagtcagcacagtgactcactttgactcaggagttattagcctgactgttgcccaaaatggttgaaaattattctttttatacttctgaaggtactaaatgagaacaggaaggtttttcttaacacaaaaggctctagttgccaaaaccattaagtgaatatagaatcaggtaccagccagttatagcagtgaaaacgtagagagaatgatgcgggtagccaaccacacctgcatgtccacatggctgtgtggcataccacggcatgtccatatgttacccactatatgttacaatgctttctaaagttgatttgcatctttccatggaaaaactcactatctggtctttttgtgtcttgatggtaaacaaaaatgagatgcaaacctcctagtttgtctgctgcggcacaaatgagaataaaagtgtcccatgggatatagttccatttcagctttgcttttgttaaaccattaagccagcattccccttgtcctaattgcatctgattctttttaattagaactctctgtgtggtgattcctttcctgcttcagtatttacaagtttcaaatatttgtgcactgttatcagacatcccgcctcagtctgtctgagccagcccttgtgtgcttagcttctctaatcatctttctgtacataggttttctagtcccgtcatcactgtcaggtgtcagtagctgtcatttcctaaaatgaactcatagcatgtctccattcttcctttatgggtggtacaaagtcattgtttaatttcatgcccatgatgtttactaagaaaattaaattaccattggtgacatttccatcataagtgtcccacccactgaccatctctgagtctgtttggggcttctctaatcaacattgagtatatttctgtattagccttccttccattaaaataatatccaagttcactgccatgttataccaacttcacaactaatcatgttttgtttagacaaaagtgccaactgataatttttccttttttttttttctcattaattgtatggtattggtttttataaactcgttgacgcttataacaagaaaagaacagtagagaagctgctgtggtcagaatgtttggtcctgaagacactgactactgacattaggaatggagataatcctttccctgggtgtcataaggaaagccaaatgcctgggctgccttct

SEQ ID NO: 31081 - DNA, 1164 bp, Mus musculus
gaaactatcatacaatggaactaagttagtgagaagctaatcaaacaactttacataaggggaacacttggtttctcaagagcatcttagacagagcacataaacacccttgggactcctagttttagagatagaactgtgttccttctctatacatcaggttccgcagagaaagccttagtcagtcgttcagccttcacagacagttttcctcctcggaggaaaaccctcagaggcgtacctcaaggtatgtctcctcaatgactcagtaaatccaatcaagttgataatgaagattaaacaccacaggttcctaagaatgacgtggtaaccactatcatgtgacccttccctagtacaagactagttagtttcttttatacaaccagaaactcctgcatggtgataattgtgacttctatttgctctctacacatacccctgtccttgttactaagtaaatgtaggcagagtgttagttttattagctagcagttgatattgatatgaccctgttctctctcctggctataaatatctgttctgcctacatcaatttgaatctttttccccctaaggaaattaacatggaaactgtagcacaattaattacatctaaattctactaaactacaagtcaaaacaaatacaagaactggggttatataaggataggagatcataggaaagaattctttccagggaaataatgtgaaatcctgcgcagaggtagaaagtgacttgattctgaagttgttgcccatgagcacatgagtgctgtcacctaactcatccggtgataacctggcaccagtctcctgtctccagttatcatttctccccaagggagaaggttctaatcttgcactcccaagtatatgatcataatgtagattctaaatgccaggataagagaggatctatgtatctcctatcagtccaaagaagtcctagggtttatctgcaaactcttactttctctcaggtctaaactagacaccttctgattgccataaaagattattctgggttagccaatctaatgtgtagatataaagaggctcctgaggccccttcagcagtcttctggataactcagagggactagaaggaagctaacctcatgaccacaggatactcttgatagttttgttactacactaa

SEQ ID NO: 31082 - DNA, 2494 bp, Mus musculus
catgccctgaccctgctgcaccgaagccagactggtgtgggggaccagaccacccagaacaccaggctgcagagactcaaggagatcatctgtgagcaggctgccatcaagcaagccaccaaggacaagaaaataaccactgtgtgatggagtgcacctcactgggtgtgggtggggttcccagtatgcacggccacagactctagctgctcagcatggcctgagctggctgtgctccatctacactgaggcttagtgggtaggcggtggattattttctctttagttttgctttttcatatgaacgctaagaaagtttgcagtacagaatgttgcctaacaaacactttagtctattctcaagggatgagggtgggacagggaggaggccatgccaagttgctggactctgagaaaggaatgaaggaaagccgactgccacctaagttttaggaccatcctgaaatacttaataaggcctgtggcataagcagtcggctttctctggtcttagccttgtcagtttatagtttagtgtagtaagtatatgcacattgctttgtctccattgccaaaatcaagtaagcgcttctcagctggcttcccagcccaaaacagatctctgtgagcctaggagatagcggtcctttatcccaaccctgggacagactgcacactctagcaggattgttcgcaggctgctggtttggttttacaagcttcttgttttattccttctgtattaaaaccagttaagagcagtgactgtccttccagaggaccagggttcaagtctcaacacccgcaaacagaggctcataaccctctgtaacttcagcttcatctgacctgaggccctcgtagtactacatgcacgtggtgcacagacatacatgcaggcaaaaatactcatacacacaaagtaaaaaaaaaaaaaaatgatcataaaactattgctaaaaatagtagggagggagaaaggtgactcactgttaaagaacttccatctcacacaccatccagggtaaattgtaaggagcgtcctcttgctcccatgcacactgtcttactgacttggcttgttgctgtgacaaaacactcctcgacacaagcacctcaagaaaggaaggtttatttagctaacctcaaaaggtacagctcatcagagcagggagggtgacagcaggagcctgaggcaggggcactcaggaagcatggagcagtgcatgctgtgttcagcccgcttcctcctttccgtgcagtccagggtctcagccacagtcagagtgggccttccaacctcaactaatataactcaaataattccacataagcaaggcctataaaacactgaccaaaatcaacacacgcacacaccatctacacagacacacaaaaataactttaaaaaattttgacaatgaaaaagtaaatcaattattataataaacattgaaactactaaaaagttgagagaggtctaaagcagtacaagtattttgtataaagcaatacagctcaggtctgcttggctgaaagcagggaagacgggacatttccccacgcagctgcctctgaagcttcttttttctgtttgttggtttttggtttttcaaggcagtatttctgtcctgaactcactctacagaccaggctggcccggccttgaactcagagatccccttgggattaaaggtttgcaccaccacacccagctgacttgccctttcctgatatggctgcctgcaatgctccaggccctcaagtcctctcgctactcaaggttcataggtcactggacacaacagtttatcaacaaggattcatcttgaatacactagggaaggagagacagaggactggccattcaaggtcactgtcagaccctgagggagggaattttcacacttgtttctaacaactttggactggatgggaataaccaaaaattaaaaactgttttgagatgcttaaatatcgtatgttgtttttctcatgttctttattccgcaaacatttcctagagcctaatgtgtaccaagtgttgctacgcttgggcaagatatatagacagaggacacctttctatctagcatttaggaactggacttgaaagccaacaagttcatggccaaagctgagctggaagccagagccatgcatcgaggcagggagccataccaaagctgcaggacggccttccagtgtcttccaagagggaccgctttggtttacaaatttctctgtaatggctgcggtctcccagcagccactgtctgtctttccctctcctccccaccggttccgagcggtcagggtggttccaagcatgtgtaagagtggatctctgctttgccacaatagtggcagaccggaaacgccagctctacacagaaaagggtcacaggggcctttgtccgggcattcaagcacaagcctttggtgattcactggtatctattcgcccaattacaaagccaatgacacatttagt

SEQ ID NO: 31083 - DNA, 1160 bp, Mus musculus
ttctggaaaaggtttttgcagtgaataagtatgaccctccccctgaggtggtcgctgtccaagatcacatgacccatgttgtcaacagcatgtcgcagccacagaggatctgggacaggtatttattagggccgcacagatagaagtggggggttgggaggagggtggggggagagcgggtaagtaaaagacagtattgtcattttccctaatcgtctcttctgtgactcacttggtccccgtggaagctgctttctcagggctggagagatagctcagcattttagagcactgggtgttcttccatgggacctgggttcaatcccagcacttacatgtcagttcataactgtctgcaactccagtcccaggcaatctgacattctctctcttctgttctccatgaacaccaggcgcacacatagtacccagatggcatgcaggcagagcacattaaataatacaattctttaaaaaagatttgcttgtttatttgagtacactgtagctgtcttcatgcataccagaagagggcatcagatcccattacagatggtcatgagccaccatgtggttgctgggaaatgaactcaggacctctggaagagcagtcaatgcttttaaccgctgagccatctctccagcccagttttaaagatttatttatttttatttatatgagtacactttagctgtctttagacacaccagaatggacattggattccattacagatggttgtgagccaccgtgtggttgctgggaatcaactcaggacctctgggagagcagccagtgctcttaaccgctgagccatctctccagcacatttttttccccaaagctctttattgtcctctcagaggtaagggaccaagtgttcaatcatggcctgttaccgtgtacttgaatgtgctgttcattcaccctttggtgacctaatggtgatctgattctttactctatcatgggcaccttgtgtctagctagcctgagccaaatgtcagtgaatttgaattctaaaataaaaagtgttaacttttctgccatagaatagaaacacagacctttatctcattaacagaatttattattattattattagatattttctttatttatatttcaaaagttatcccctttcctcatttcccctct

SEQ ID NO: 31084 - DNA, 1195 bp, Mus musculus
tgtggtagggtttgaaatagtggttttgtgttgactaagtatccagagaagagagcaaatgcctgcccctctttctgtgtgctgatagctaatgttagctgatagctaatgcagaccgctaggcttaaggcctactgtggtgacaacacgtgatatcagtcatgagcatcaaaatgatgctaatgattgtaaccttagaaactctcaattacaaatgacactgaatgtcaaaaccatccctggaaacttgaggcacagtacaatacagtcaggagtgagggagggagtgtactgaaagcgcccagaacaacatctgctacatggttagtactgagatgagcgttcgttagcactaacacgtaaacagcaaaagaatattacattcgatcatgaattagaacaggacaatgtatcctgtttaagtggaagtgtttgttaagtgaaacaatcttccctgaaaatccctttatgacttcagccttgtctaaattaaagagcttagacaaaactaggatgatactagaaaaatgatacttcagtataatattcctaagatagagggcttcttcagtgggcattcacaggcaacctgccactgcagaagacagggatgggggcatcaaattggagccaatggtgaatctccttgtggtatacacaccaaacacttaggataacagctggcctatgtagtacacgctcaataaatgctatctgttctttttattgttaccttgttgatgatatcaaatatattttactgtatagagagcaaatgcttgcctcctcaccattacgtgtctgggtaatagctgttttgttttctctttgtggtggcttttactcctggatctacgaaccctcagtttccaagaacaaagctaaacatccaagtggagaaaggcagaaaagcctttgctggggaaagcgagcgataaaatagtgcctaagagaaaattgttcctaaagctgagttgggccaggcgcagcagtatgaccctggctcccagctactcaagaggctgaggaaagagggtcccttaaatcaagggaggttagcaacaaggcattccctttcagatgcggcagtgtggggcatcagaaatgtttactcagatatattggtcaaaggaaaggaaactttaggcctgcattaaagctccctgtgggtttctgtcccctcctgcctgtcact

SEQ ID NO: 31085 - DNA, 2694 bp, Mus musculus
taatgtacacagaggtgtggaaaaacctcgggaccacaaaaagtgagctgcaaaaggatgacaagaaggactgaggtctgcctgggacagacagacagacggtgttatgtgagagcggcctctgctgcaggtctggccaccatttcactttagctgatgccaaattaccagagtattgaagcagaaaggctccagagcttcctccaaaaggatgggactcatctgctctcacgagtctgcatttgtagattccacataggcatccctgagatagaataaacaaaacaagcaaggctaccaggcagaccgtcgggcagcctctgcatttgcttttctatttctttgccagaacatcagaaccatatttgttgaattccaagtctcagagcttctagttttctacctgtgtcgcacttgttgctaccgatgcctttttgctatgtacctctttcctcccgtcacccctgcacacttaagcactttgcagcacagccaacattccaggcacaatcaggcactgagtgatccagtggacatgcgaaaaattagaccccaggagtgatgaggccggactccctccagcgtgttggtgttgggagagaagcagttgtccccatgagcagatctgtgagctggatgccggtgatgctggagtagacggctggatcccaccacgcacatttcacgttatttgattagtcaatgcaaagatcacacacttctttcacctgttgctttctgtagttagagcagtcctgcagcgctcattgcacattagaaaggaagaaaacttgaaagtggatcgagaagagggagacctttccttccatctcccacgtgaagccccttggcctgtttacggagatggagaaggaagtgtggcccaatacagctcactctttcagcaccctgagagactgttgcccctgtgaacccagccacacacttccatgggactcctgtgggtttcaaatatgtgtctgtgagaggcgttaagacctggtagccagaagatacttctgagaattgtcacctgtcaagtcatcgatgatgattgattgatacacaggcgtgagtgtgctcaaaccccagctgcggcagggtgaagtcttcttgttccatagatatgggactgcttttgggtgtgcctgggaggtggcatgacacagcatgtttacatacagaaacaggcctggctcttttccgctgatcactctgaaggtctgattgtcctctcttggatccccttgaggaagagtaaccctgtcacacagcatgtggcgcttgtgtgcccttagctggattgtatgtgattgaagaacaagaacattgtgttgctttctttcctcgtccccacttagggccagaccctcattaccctcacctagccatctgctcctctgcaaacagctacacacaatgtttctctcgcacagacgacagccttccattcttccactatgtgctgactgtgctcagactgaggagtggctctccatctcctcggctcactgtagctctttgttgcaccctctgaagatgctctttgatgggtctgaacagcagcagcaaagagaactatcccaatcctctgggtcccctgggaaggcaaagagaactgtcctaatcctctgggtcccctgggaaggcagttaagacttttttctgttacattaaatgcagatactgtttctccacctaagtccccaggtttgcagactgattgtcattctggccattgacagcttcccagtgctggtaatggtctgttctcaaagacctgaattagatgtgaacccattcacagtcccagaagctctgtagctactttgaaatatgtggggttgcctggaccaatgttgctataaataccaagtgttaaaagcccccttaaaaagacagtaataaaaagtacttttttcttccagtttaacagaagaatctgtccctcggggctcttgaggctccattctgattactcctaacaggctataaccttcagttacctagagcttccctttttatgttgggagaagtagcacacagcttgtagttccctgagactggctgatacaatctaactggaccggttagggtttcagaatgtgtatccctttgtgggttttgttgaaggagatgtaagaacagataagagtgcgggctctgctggctcaagctagcaagtgccccagctgcttcctgccgtgcagtagacagaagaaaatgtaaccggcactagttacagttttgtaaaattgcccttctaaaggttctgttttccttctcattgtgtatgcttgttgcacagggccctgtggttggacacttccctgcagttgagtacttcccccaagctctcctctccccgtgttaggtcctgctgttcccctgaacagttttgccttctaccttcagatcgcatacacaccgtggtttcatgtctctctacaaagctcaggagctacaaataagagcacacatatgctgtttgtcctccctacaccagctaaccccttaataggaccatctctggatacatccataaaatcactctttataaaagtcatttctctttgccatttgtttgtttgtttgtttgtttgtttagcatgtggactgtaaaggttttaaaagggcaaataagccattttaccaaggaccaggctccatggaatgtagagaactgcctattaa

SEQ ID NO: 31086 - DNA, 1159 bp, Mus musculus
agaggtagaagagttacagaagccaaaaggcaaggttggcacattaagagacttttccagaactatggactttgatgtgaattaaaaattaagaaagaaaggaagaaattggaaaggaaaggacatagcctgaaccatgggttgggggttgtggggaggagaaagaggggaaccaagtacaccagccaggaggccagaggtgcaaaaggagcaaagcggggaggggggggtaacgaaaatgtctgggttgcttagggaagagcctctagaggaaggtcaggaaagcactgggctgcagaggtcagggtagaaggcagggtgtgcccaccataccctctaattggtaggcactaaaggaagggggttgagtgaactctggaggccacgtctgctttgatacgttaaatatgcaccttatccgcttggcctgggtttgaaatttaacagctaaattaagtcttcattttggctggtggtggtgtgtgcctgagtttatgacctgagtggtccttccatcatggagtcagtgtgctgaggtctagggcctattacatattcctgtgtccattctcttgccttcgcggaagtgatgctgccctccttgctctgtacatcaaaacctcacatattctcttaggccgtctcacacagggatccacgaggcgttatccctcagcaccagctggggtgcattgctggtgcctctgcacagccaggggctttgcttcatcagagtgcaggtcccaggctaatgggtgttccagctgctgagacgtctcattcctgtgcttcatggtaaatggagcaggcaggcacccagtaacatttcccctggtgctcatcacagtagaactcctcaggagcctgacaggaacagtgccctctgcttggaaatcctggaagggagaggccatttcggatacggccagaagtctgcacctctggagagtaattaataatcttctagaagtcccgtgttctctctgccctcccagcagtgggaaccgtctggaacgtcatggcgttgtctctgtttccttgcagagcttattgactttttttcttccatgtttgtatgtaaggtctttgactttgaggtgagcagcgaggacatggccactctactcagctacaacaggaactggagggtgtgcgcctt

SEQ ID NO: 31087 - DNA, 1159 bp, Mus musculus; identical to SEQ ID NO: 31086

SEQ ID NO: 31088 - DNA, 1102 bp, Mus musculus
gggctagagtggtcggtcagctgccttgagtggcagtgctggagacttgatttcaccatctctttgctccagggccaagcctgaagatccgtctctcctggaggatcccaggatcaaagcaattgcagccaagtacaataaaactacagcccaggtatgggtgcttccaggtccttgtgactgttacctgaactctacactcctggtggttcctgttagtcaggtgtggcgggagctgagcctgtgaagccctctctggaagtgtggtttggagccctagaatgcaatatcaagggcacagatctagaaattagttgacctgtggtcttggcataaaagtgcctgtccccactgcctcaatagcagcccagacctcgacccagcatttactggtgttcttggaagctcatccctgtacaaatagaagagctcttaccatctgtggtatgagagatgttctctttctcccatgggtagagtgagtcccaggcagtgacttcttgtggccttgtgatacgcttggagccaccgatagagcaggcctctagagtccgatttggagcagcttgtggctgtcactaggcatctcagaacctctttacctgtgcagttatagactgagatgatagcacagcacatgtgcacacgccacacctctcgtccacaggtgctgatccggttccccattcagaggaacttggtagtgatccccaagtctgtgacaccagtgcgcattgctgagaacttgaaggtaagagcccagctgcaggcctggctctcctccatggcaggtgggtcagggtgggggtggggttctcaggctcccctttccctcccagctgtgtggtctgagcaagtcacttgacggcactcagaatcatgcctgcgttgggggctgtcgtgagacactgaggctcacggtgcacacgcagcgcttcatagcgcctggttactcgtactcaggaaacattgctgagctgctggtgggccatggacatcccggacagacaccaagccactggctctgtgcagtgcctaagcagtcatgaacaggggtgggaatgcctgggcacccgggctgtaggcattaagagtgccccac

SEQ ID NO: 31089 - DNA, 1102 bp, Mus musculus; identical to SEQ ID NO: 31088

SEQ ID NO: 31090 - DNA, 1215 bp, Mus musculus
ttaataaactttactttctaccacttaatggccttcctcttcctcctccttcttaccaatttatgtatgaatatttatctccactcattctcaatttttcagttactggcttttccttgctctataatctcttaggacacctgaacatgaccccacccaaaaaaattgatgaagaaagtaaataaatattattcttaaatcaacagtatttaacatataaaacttaaaccttttatgtaaatctcaagggtcagctgtatcaaatccccaaacttgatcatcttattctgttccaaagatcttaacttgacggtaatgggaactgtattcttttacaaggtactgtctctaactaaatgtccctaagggttaacagtgatcatgagcagtggttgcctcaggtggaagggaagaagcaggaaatactttgacctccagtatgctccctgggtaatagttcactagagttctgatcacatcagtgagaggtaaagcttgcatgtaatccctggttgctccaagttgggtgagcagtgaggtatgccaagctctgaagggttggatgctgcattcactactcatgccagtcagaaaggtagaagacaaatgattggggtgaggccataggtgggactcaagcgttcaggaagaacaggtagagtgacttatgcctataatcttatcgcttgggatgtagaggcaggagaattgagaattcaaggaatctctggctatatagctaactcaagaaacaacctggagtacatgagagcctgccttaaggaaaagggggagggagggaagaaaaggaagaaagaaagaaagagagagagagagagagagagagagagagagagagagagagagaggaaagagaggagagagaggaaggaaggaaggaaggaaggaaggaaggaaggaaggaaggaaggaaggaaggaagagcaagacgcaacagatagaagtctactaagaagcgacctggatggggtaggcactacttcttgtgttccttgctcgtttccccccaatgcttagggagtcttcattcacctaaatcctgattaattcattcacccattcctgttggcacattccaaagaccaggaaaaggccatgaggagagacatagacctgagcaaagtgaacttcaacaactcgtgtgaagactgactaacaacaaggaggcaagtctgaaaagagggagtgactatt

SEQ ID NO: 31091 - DNA, 1165 bp, Mus musculus
aaatggtagaaaaggggtgataagcatgtcctctgtcccaatgttgatgtggccttgactgggcttttcagtcgtatggaacactggaaattcccagtgcttatcgtagagcttaatagctgtcttgactttgagtgctgtgagcaaagatgaaggacagggtaggaaaggaacctcaaggggaaaggacctaggagcgaaggtcacatctgaacagactgccagcaatagccttccctttcggttgtttggatttattcctatcgtaccatgagcccacaaatggctcccggtttaaagctctcttctctcagcaggtctgaaacaatcggagaaagaacccaactgcaagccatctcgctgggccagctcagttggagagggctaatcgctctgtttatatttatgttttccaatatcccagtaaatccatgtatatgctcactatatttaataaccacaactagagatgttcatggtcaaagtactgcctttgcagaggagcctgtttctaaagaaaccatgctgtgaagtaaactcgctactgtcatatgaacagtgacaccaaccacatcggaagtcaacaaaaggaaactgagcttaagattatctgaggaatgtatgcagtatctaggggcgaaacgaccccgtaggctttgttttgtctcagtacagacatcatgtttctgcactttagactaaagcatgaaagaaattatctaaataggcaatcaaaactctctgaaaataatccacttcatatctgatgtagggcagtaatgattgtctgttttaaaaaagatgtattgttgagatattgctttttttctatgctgattcatacctaaattggctgattactttagctgacagtggtactgactttttttcaggttagttgctttgtggatttctttggtagtgatagtagactgaatcacatttagataacccaactatgtaatgaatgtgcatacgtgtaaacagacacactaatggtagattactctttcatgtgctagactattatatttcatagtatgtccttgtaactaactgatatcacagcttttgaagattaaggatcacaatagtatattaatatttcatatttgccaacagaaatatggagttaggtatagctatgttttcaatgcccaatgac

SEQ ID NO: 31092 - DNA, 1352 bp, Mus musculus
tcataagttgataacatcttgaaatttgaattttttatgtaaattttagtagttttactcccccctcccaccaaggctctttaaggaactcatcattcatatatcagatcctattttagcttacgtctttattcttcccaatagataaaagtactctagtgtcttacaaaaatgttcttatctagaacattctatgcatacagcgtcattgtacaaactcatacctcagctgacttaaccaaaattatcttagtctccactccttccacagtaggagagcctctaacatttccaatccacagatttcttttcaagaggaaagggttggcttgagggtttttcaagggttggccttgaaaaagtctatctttctcgtgaattagtaagagttagttggattccctagcttttagcaaacttgggccaaaggaagaaaagccactaagactgcacaagtcatctacccccgacagagtagacacaagtctatggtaagacgaacagagtgcacatggcacacccatgaaaatgacttccatcgttggagtacaatggatcaaagttcgatcttaggcagatgctgagggatcatgctcatgttaatgaggccttctcttgctatatcttacaggctttttgcttgttgtttttgcttttaagaacgttcaaagttgtgagatgactgttttgatcctaaattttattccaacatttggatgacgatgagttttagggtagatttttctccgtttggatttaacctttgaagaagcaaattcctcctctacttgtttgattacagctctctgttatctttaagagaggaaactgcaagctgactagcatgttctgtgaatctgccattgttaaaaaaccttataaacacttaatatttttcactgataattgatcgctgcaataaaaatatattgtgaaaatgcatccacaataaatggaattcttccagatgtctctgtctcgtgcattctttgatgctctaattgattgtgagaactgtggctataataaagagaacagggcaaaacacttgcacttcacattgagggttggtttcactctctaaaggaaaaaacaaacaaacaaaacaaaacaaaacaaaaacattgagacaggatttcatgtagcccaggctggcctggaactcattatgaagccaagaatgacctcggactcctgtccctcctgcccccacctctcaagtgctgagattacaagtgattgttagcatggttgccacagctgagattacaaatgattgttagcatggttgccacagttcatatttaaaacagttcttactacagggacttttctaaccaaatattcaaaaa

SEQ ID NO: 31093 - DNA, 1183 bp, Mus musculus
tcaaaggaatccaagaatggaaggatgccctctcacccagcattaggcttgcttggctcacatcagatgaggtagagggcccgccctatttacagtcaatgaatgctactttcttgacagctaggggctgccctcccagaaaggtggcagcctggcctggttcaagagcagctaaaatgactctaggggtcatctgtgggattggaagccattggtttatcccattaagagttggggcctttaatttcctggtccgagctatcagtttaggattgaggattagcattagggaaaggctatggagaaaccgtgctcaataggggagctgtgggtgccccagtccagagtgcggtgttgacctgctgttgtaaatcgaacttggtcactcttgatttctccgtttgggggcagacagaatcagatctgaggtttcctttgctccagcgctccagagaagaacctcccctgtgagggcctcctactgtgtttttttcagtcgtcttccttggctttttccccaaccacccaggttgccttaaaatcatgcatgcgtttagctgaaagattccggacacctgggagctagcttggcgcctcctccacttctgcagagggaacctttctttgcttcccctagttactgactctggccgctaagaaccaacggctgcgcctccgtcacaacagctgacagaaacaggagcctgcggatgtgacccgcggtctgcagggggcacccggggccctagcggccagccagcgcccgggtccggagcgcgcacgccgggagcgcgcaggagccggaaggggcgggcggtgggatgcgtgcgcgtctcgcagttctgaatccccggaacccacgggaaggaccgcagcgctgccctcccctcttgcccacggttccatcctgtccccaggcccccggctctgcgccctctgcggtagggagggagtggcgcggccagctccgcgctagtgcagcgacgtcccgcgtgtgccttctgggtgagattttccagggacccaacgggcccgacccgatcagcgctgagctccagaaaccttgcggcgggcaggacctggctgctggctcgatggtcgatatccagctttctacgactttgtgcacgctaattcttaaccacgtctgtttctcgtctataaaatggacatgatacacatg

SEQ ID NO: 31094 - DNA, 1176 bp, Mus musculus
cacagtggccggcgcaccctgttcggtccaagaggcattgactgtattttgtacataattgcttatttttcttatttaaggggaaaaaaaaatcagagcaaggtaatgctcttacagtcacttggtgtctctttctggactatgtgagtcgcctggccctggtgatagccacagctccctgccttggttattggatgtcagctctcactagcctcagctgccatgcctttctggcagaatccggttatagttgagatgtacaccacagtgccctcttctggtctcaagccgagatctgagtgtcttctgcagaacctgaaagctgggtaaggtgctggctaagaggcttctcaggacagcaggcctgagatctgggcccacctccagctcctgcaccttggggtcttgtggtcccagaactctcatttggtggcttcctcctccttccatcgtgaagtctcttagcttgaatagtaccagctgcctgcacctctgcctggctcagctgcatcggctgtgcctgtgctctggtctctcacttggaaggagagaaaagcaggagtgttgaggcctgggctcccttctgggatggaaggaaaagtggaaagcgatatataggaaaaccctatatatcatagttactatttattattggtgtgcctgtgtgtgttgggtgggtgggtggggggtggggtgggatatgccacaacaaagatcacaagacaacttggtgtagacttaagttctttctgttcatctttatgtgtatttgggggatcaaactcaggtgggcaggctgcatggcaagtggctttccccgctgcgccatctcctgctcacgtgtttacccacgtccacactgacatgaaggggtcagtccgttctctgccgtgtctccactccgactgacacacagcctcatcgtctgcctcacccagctttgtgggcctgggttccgcctgagtcaggagcccgtgatttaatttcctctggttttcctgtcttatggcgtgctctttcttccagcatgttccccacaacttgctgaaccagtggttttaaggctcagagacagaaagaacattccagagcttgttcctccccaacccctcccaggaagaatgcatccttcaaagcgcctctttggaacccctgagggccttagtagggctctgt

SEQ ID NO: 31095 - DNA, 1336 bp, Mus musculus
atcacagcgcccccttcagcacacagatccctctgcacagagccagttggaacccctacccacctccttcaaatccctccagcttccactctccacccccaggcttccagacagccttcagaccccccagcaaaacccccacagatctgctacagagttccacactggaccgccactaagcaaagagggaattgaaaagggcaggatttgtcccaccctgttccccctcagcccactcacagctcccttctcatctcttaacgttctgaagaatccagctcctggtcgggtttttttctccctacccccagatacgatgcgatcacagcgtctttaccatcttttctttcattgtaaaaagtttcggttgatccagcatttgagtgagtgacactgttgaatgtttctggggggcaggaattgcctttttaagcagaggaaaaagaaaatcaaaaggcagtctcaatacttagaaaattactgtttgtctgtcgctcataatgacataatctgcttagcagaaaatgacaattaatctataggaaaggtcaagtaaatgcattgtcaactgcagaactgagagcacggccgacttaaatgagattgctaagttcatgggggaaagcagtggtcctggcttccatcttgtattcaacttttcactattgcaggaaaaatgcttttcattttaaattctttattgaattgatagggaggactcaattgtgttgttaagcaaagggatttattggaagttgatgagaagataaattgatctgtagtcgtaactggcctactgctaaagagtttataaggaaggaaaagtaattttttaaggagaaaaaattttggctttagacttaaattcagatgttttaaaggaaaaagatattcacagattcaatacctatccttataagagctgaattctatgtgatttcctcagtctttctcctctgtcagaatcttttttttttctttgaccataagtccacctgacagggcactctgagccagcactgctctggggccatcagatcaccaacagaagcaaatctctgacctctttgcctgcagcttttacttaaccctgtagtttctggacgtttgtgcagtattgaaaagacaggagaaaagaaaacaaacctggttataacctgatgctaaaactaaaaacaaggaaatgtacctctctcttcagaattaaaactaaaatcttaaataaaacagaaaacttgatggtgaccctcgggtgagtcttgttcttgttttttcagtttgtttcgtgtgggtttggaatatttaatgatgcagtaccatatgagtttccattaga

SEQ ID NO: 31096 - DNA, 1097 bp, Mus musculus
ctgccaagccagggtgtggctcagcaggagagcacttgtctaacaccaccgcttactacaaaaacaagccttgccttgtttccaggaatggtcttagtctactgagtctacagtcagaatgaatctgggtcagggtgtgaggtagtgtagctggagctgttttgatgaagtttgttagcattcccgggtttcctttctttgcattaactctcagctcagctctagagaagggagcaggggagggaggtaaacttttcctccaagctctttaaaatgtgttcccattccaagagctaaggctctgggtcctgtcctgtgacacgccccctcccccaaccatccccactgtaagcaacacgctatgctctcgggctcccagaatggttagggcactggctttgcttcgagtgcgtatatgggggatgttgtttgttgtttttcagtaaagattgttaaaaattacaaactgggagatttgtttcccaagctaccttacaatcaaactatactgggaagatcctaatttccggttgtttgtgtgttgcgtaccacagatgacatctttggctggcactgttattggattgtattattttgcagagcaaatatagcctttgatttaaaaaaaaggaaacatgggctttatttgttttatttttttaagtggttcttggttagcagcaaagctaacactaaggtaaatggctctccttcgagccttgctttgctgcctctggttgtgttatgatgctacttcatagtaaagtttcctgaatgtgttactctgtaagtggaggtaagtgttcttctgtttctctcttttgacaaatgtaagagcatagaatgagtggggtaggggagagagaagctgggcatcggtgtgggcaccttactgacccggaacatccagacctaagagcatcctgtagtccttcccatgtagctagctatatggcagttttatccttccaaggcagtcttgtttcccttccatgaaggtttcaactgtttcttatgcataatcgaacaccattctagaagctagactgtcttctctaccaggccatcttgtaattgacacatgtatgatttcagtt

SEQ ID NO: 31097 - DNA, 1148 bp, Mus musculus
atgcatagagcattatggattctaactttaattcacaagaattacaatactcttatattacaggtagatagtaaaacctatctttgctaatcttttcaaatataatttcatcagatctcccttgtgcaacttaacttttatataccatctcattttcattttcttattattgatatttaatacaaaagatacatacgttaagagtaatcacagaaggagtcggaaagaacctgaatcagtacaaacgtacagctcagggaaggaaggaaggagtgagagaagcggacagagggaggatagacagacagacagacgaatctgtctaggatgtctgagagggttactaataattatcagtgcataactagaattctcttgcctgtgaatcattgttctcccgtgggaacaagcttcacccattctttttctggcctattttggaaaagttatttaccaatctggaagcacattattcagtgccattcatcccattgcttagtgaggatcagacactatttaccaaaccaaggaagaactcagagacaggtaggaacgaacaggcgtgagtgaatgattacagggcactgtggtggtgacagaggtagccacctaagaactgtagcccagttattctttactaaaatggtaaatcccaaagaaaacctgaatttttacagtaggtaactgttcccttgttgggcagagttcgatttccttcctccttactattttggaaagtatctatgggggtgttttatcaggtttattctcttagagcagatgtagacctcggggtgctaacatggttcacatcttgaatgtctgcaattttgtaatctgttttagggaaactgtgttccgtgagtgctcaggtggtctccatgtcttcttgggtgtaatttttgtggtcggcatgttccccacagggctttccctaacctggccctaaccgtaacctgctccgagtcagcgttcggtttcatgcttgtcagagctcttgtctgtgagccttttctttcgtcggcttctctctccttccatcattgggctttatgttgctatcctctgcttcaggttccttctgatccctgctgtgattcccttttgacatatgcatcttttacattcaatgtatagtttggcttttg

SEQ ID NO: 31098 - DNA, 1121 bp, Mus musculus
ctaacttagtagggtcctattttatttactgggaatacacattatttaggagataatcctttaaaaattcagttttcatatctttttttttattttatgaaaatacaactgttctcatcagaaaaagataatagttctgacttgttggtttgtgtttgggcagttaatcccaaccagtgtaaatgaagaggggtgacagagtgaggaaaggaatccctcttcttctgtattgaacaactcacatttggaacaggtgtctagagaagatttgaatttgtaaaattggaaaccatatctgttttctttagatcttctaagtaaatgtctgcagcatattcactagtagtagttcagcttcctagtgctcttagtcatgttttattctgtgtctcgttttaggtgaagtaaaaacattaatcatggaaattcacattgtggtatcaattcatattttgagtcttctttctcctgctctctcttcttcctacaggcatctttaggtacaacaaagtactgcagttatttcttaaagaacatgcagtgcccaaagcctgactgcatgtatcttcatgaattgggagatgaggcagccagcttcacaaaagaggaaatgcaggtagtaaacacatttgattaaccaatttagtacaaaacaacatttcaagttaaaattatgaagacaaagacaaagattggggtttctgaaaacccaatatttcttaaaagtagcatttttccagtgtatctcataaaatgtctcttctgtggacatggttacaataaaatgagtctgtggtcagctaagttagaaaactaccttagtaaatcagcagattcatttgctgcaatatgttccagaggctttactgtgcaagcatatattcaaaagggagcttagctgaccgcaggaaacccttccaggagtctacttttaggagaaggtcagtagtatgagggccaaggaattaaagtaatttgttggggtgtttgtttgtttgtttgtttttgatacagggtttccctctgtatccttggctgtcctggaaatcactctatagaccaggccatcttggaactcacagagaccttccagcctctgtttcctgagtgctgggattaaa

SEQ ID NO: 31099 - DNA, 1115 bp, Mus musculus
gaagtaagtcctcttctgctttccctgtcagtgccatagtcttactgtgtctgcccgtcttatctgagaataatagttggccctggtaaattctaagactcttctgaaaataataaagttttggagaaagtatgaataataataataataatattttttaataatgtttataaaccagtttacaaagctaggtggtggtggtgcactcataatcccagcactcggaaggcagaggcaggtaaatctctgtgagttcgaggccagcctggtctacagagcgagttccagggcatccagggctacacaaagaaaccctgtctcaaaacaacaagaaaaatccaatgaccagttgtgatcttaggcgtgtctgaatctttctgtgtttcagtttcctcgtgaaactaagggcttgacctaaaaatccttttagtgatggtagcttgtgacgtggtaatgatcctgtcacccttaaggctgatatgagctgtgactaggtttgggcttttttggtttttggttttgttttgttccccctttatccctttcctgtggctgtgtggaccaattaactgaagacaaagttacttgaccctaataggaaatcttaaccagctgtccaagttggtgtgtgtgtgtgtgtgtgtgtgtgtgtgtgtgtgtgtgtgtgtgtggtcagaagaggagtttgcaggactcagttctctccttccactgtgtggcttctggggtcaaactcaggtcagcaggtccaagagtgagtgcctttagtagctgagcgatctcagtgctccccaagtagtaactcttgttcattcagaactgctgttctgtgttatcattctttactgttgtcattctaagctaaatttagggaaagaaggagaatttgactaagtgtaacgagagaccaagtcctttgtggtccagtccctaattagtggctcttaacctttctctttcctccttcagttaggctaatcaaagttactctgagctcatgttttcttgtaggctttaaacattcatctgttaatttttaattccactgaaagacttacaagattgttgggaaagaaaattgaagcttgtgtcagctagaatgtttgcttcagtag

SEQ ID NO: 31100 - DNA, 1160 bp, Mus musculus
aacatttaacatggaggcgtcatacttaatgattttctttgatactttgtagttctttctgcaaattgaatagccaaagtcttcaaatgaatagattgtttgtataaggtttttaaacatgagttatttaaagttggtttaccatataatttttttgaaacttgcatctacaaacctttaatttgattaggatgagagatataatcaaacaccaaaatacaaaataaaattgttttgtgacacttgtcaacttccttctaaatggaaatactagaggtagcttgcagcccattactttgtttttgttgttctgaaagaaggtcttaactatagctcaggctatcctggaactgactgtgtaaaagaagttgtcttcaagcacagggtagtcatcctgtttcagcttccttaggctggaattacatgtgtgagctaccatgtacaccagtcctggataactcactattttgtaaaagacagagggcattgccaaaagatgagctcttagcattaggagaattttacttacttgtttggtactaggctagactatggacgttaagtggccccctgcatattagacagtggcttcaggagagtgtttctgtataaaggattttgtgtcttaaaagaatgaaaaataattcatttaatcagtttagttttagaagcttttctttgcttccttcccactccctggtttaaagtgaggcagcacttttcacgatcatgattttttttttaatgtgactgcagtgattcttgactcaactctgttattgtctttgtagactgtgtgagatagggtaaatttgtgaaagctttagtttttgctaaaaattcacatagttttgtcattacctatattatcaccttgactttttgtaaaggaagtgtagtgagctaagttggttttgaaacaaaaacagtagggaaataggttattgaggtttttgctgttctagaaacagtataactagaatgtactacatacattccccaaaggatttttttaatctaaatggaacttgtaaatggttttcatcccactggaatagcatgtatcagataaaacttggtaacacattctaacattttataaactttatgttcccatagagttagtaggaaaagtctacaaatacccattcttgaaaaaa

SEQ ID NO: 31101 - DNA, 1231 bp, Mus musculus
tgagaaggtagtactgggaaagatgaaggtggtgccacgtgttgcctcatatcccctagttctggataactagataagaaacacttcagtttgtcatgctaccaggcttcattgtttttgttcgcatgcatgctggccatgactctacttgcctggcctccaaatataggattaaaggcatgtgctgccttggcaaacgaggctgcgttgtcatgaactgacttctgctaggagcactattttcattacttaattataattttatcattctagcccaaaaatgttcaacagcatgagaaaattcagaaagccagttcagagggtgttgcgatccaggggcaacaaggaaccagacttcttcctgagcagctcattaaagaagcatttatcatcagtgacctttttgatattggggaattgtcagctgttgagcttctccttgctggtaagttgacatttagctggaagtgtgatatgtagtcagaatcatgaagctagaacccctatcttggactttggttttcttttaaagatttatttatttcgcatacctgagttcgcattgctgtcctcagacacaccagaagagggcactggatcccattagagatggttgtgagctgggatttgaactcaggacctctggaagaacagttagtgctcttaaccactgagccatctctccagccccctaacttggactttttattgtttgggtaataaatgggtttaaaatgtttattttatgcatatgtgtatgcctgagtatatgtatatgcactatactcatttagtagttatgggaggtcagaagagggtattgaatactctggaactggacttacaggtgaatatgagccactttgtgggtgctgggaagtgctcttaactactgagccatctgtctaaccccttaacagattgtttttaaagatgtcatttacttgacagaacaattcaaaatatttaatttttcttgtattaaagggcaagcttaatgttgttgatgaattgccctaaggtgggccttgatgtagtaatttaccaacagagatgaagttgcatccctagaatgcatggctcaaggcaagtgctgtcatgcagtgggcaggaaggcaaggtttactggttttttttttttttttttgagtgtcttttggagtgggttatttggtgatgaatgactaggtaaaatataagataattttaataataattaaaaccaggaaga

SEQ ID NO: 31102 - DNA, 1177 bp, Mus musculus
tcctgtgcaggtggtttcctgaaatgacggtgttacacggtagaaagcaatgtggtcacgcgtgcacgtgcctgcctttgctgcagctgcctgctttgttccttactcacatttgtaaaacttgtgaaacacagattctttacttctctttgacatagtttttgtgtatgagaagtaggtgactcattttatctttagagagcatttatttatattttagaattcctgtatagaaaaaacagtgagtgcttctttttctaatttctgctgtctatgaaacttattggaagttgttaactgaaatttagggttgttgtttttagtttttatgcatataatactttaacagcaatacagatattttgttatatcaaataatgatgttaattagtcatcattccttttgaaaatgctgtgtttatgacttttagatatccatgtgtgacggatgtgagaatttatttctgctcttttttggtgaagtgatgtaattttgtgttttcagatatgattcaccaccttccactgttgacagagagacagtacgtttcgacaattcactctcgcctccaggactctcagccttggaagcttcctggactgcaggccactgttaggcttgcctgggccctggcgttgagggggatatcccagctaccggatgtaacaggtaaggaaggaaggttggagagaactggctctgccactgtacctagcgatgcattgattttcttcctttaaaagtttttaggtgacttattttatgtgcgagtgttttgcctgcatatatgtctgtattccacatgtgtgtctaacattacctgagatccaagaattccctggagttaggaatggtttctagttatcatgtggatgtggggaatggagcctgggtttttttgaggaacaacatccagggctcttaaccactgagccatctttccagctctaaatgcgtttgttttcaaatatcaaattttaaatcagaaagagaaagtgtaaatatgagcacgtgaaaatacaagttgtttgataaaaatttgtgttagcacttttcattccagcactcaggatgtaggcggatctctatagtttggggccagcctagtctacgtcgagctccaggcaggcagggttgcatagagagactgtctcaaaaacaacaataacacacccc

SEQ ID NO: 31103 - DNA, 1180 bp, Mus musculus
gagccaccatgtggttgctgggaattgaactcaggacttctgaaagagcagtcagtgctcttaactgctaagctatctccccaactccttaaaacattatttgttgactcattcatgaattagatatattttagtgtaatagtactatgctgttctagaaaggacttaacagtggctttgatttttgtcactctagtaggtcatttctctgtttgtagtatttatgttcctgggtttgtgaaagaatttaacttccattctttccatgaccaaactagtgatctaccagctaaaagacagataccttctttgttgtggtatatattaaatgtatatagtgtatagtgggttgctgatcgcatttcgtagctgtgacttggtagtgggtgcccctattcacatctgtcaggacagcttgagttaatggggttggaggccagtatgggcagcatagcaagatccatttttcagaaaataaaacagaaaagcataggtaaacaaataaaatacctatcttgttgttttgtgttccaatctcagagtgagaatgctcgcttggccctctgtgaacatccccagtggacgcctgttgtggtgattctggggctcctgcagtgcagtattcctccagttctcaaagctgagctactgaagacacttgcagcttttggaaagtctcctgaaattgccgcttcactttggcagtcgttggaatacacacaggtggtaccatgaactctctcattgtatactttagaggatggtaatgctatagaaacaagagctcctggtggaaatttacagtattccagggcttcctgtgtaggtatggtgtgggagcctagcattgcatttagtttgttttcttggctcacttcacaacaacgaggttaccgaagataggttattcaagtaactctaaagatcttaattcttaagatcagtgagatacttcctgtgtggcggactggaagcttcagacatactgtactcattaaatgcaggaaatagatacttgtgttctctgtactgttcctttttccccatgccttcctgcctgaaactaggagggcaatgtaaactatagctttctgttatcagggcctgttgggtaagctttacagatacgttctcagcagctggatggcttttcactggtggacacacacggctcctaagc

SEQ ID NO: 31104 - DNA, 1099 bp, Mus musculus
agatacagatgtggcttctgcattctggcttttctatttgagaatgggtctggctacgagatctagactggtttagaacctacgattcttctgtgtcctctccctcttaagtgctgggctacaggtatgagctgcaatgttgagctttaaattaagtacaaattatcatatggcgtggaacgtaaacttgatgacagtcgtccccgccccccatttacctccttccctttttattctttgaggcagggtctcattatataatcttggttggcctgaaacaaagactggccaggcaagtcttaaacttagatcttcttggctctgcttcccaaggactgggattgaaggtgtgttccccacacttggtccactttcttttttcagaggaagctgacttaaaactcagggacatactacctacatcagctcctaagtgcactgtgtttgtcttggggtctctggtgtgtagaaagacgttgctaatttgacatttttctgtcttttatgacttcagagtgtgagccagaagctgatggctggatttgtagagtgcttggattatgaagacacggaagaatttgtacgtgtagaagagggtatggctctgattaacgtgtgtttttacttaaatacatacatggcataatgaggaaaaccttgaaactcttaatttctagtgctgatataaaagagattgagaatttgctagaataaaaaagagttttaagattgtttaaatcaaagcaatgtaaaagtcaatcaagaattaagtaaatgtggtgcttcaaacacatgctaccttatattaatttgtgattttgttttgtggattctgtatttaggctcagaattagaaaagaagttagctgcgatccgtcatgaaacgagaatccatatcttgaatcttctcatcacatctctagaacgcaatccacccaatcttgctctctacctgttgggctttgagttaaagaaacccatcagtaccaccaatctacaagacccaggtatagctgtaccacacatgggcaactatttaacatgtttgctggtataagtggtcatttattgactcctgggttcacaggataatttactt

SEQ ID NO: 31105 - DNA, 1171 bp, Mus musculus
atccacctgcctttgcctctcaagtgctggaataaacatgtacaccattgccacccagcttagttcttagagtttttgggtggtggggtgaggttcaacacaaggtttctttgtgtgtatccctgactctcctggatcttactctgtagatcaggctggcctctatctcaaagacatcctcttgcctctgccttccaagtgatgggatcagagacatgcgccaccacttccccccaggtcctacattcttaaggtagttgtaaggctttatgttacgtgagacttcctgagttctggcgggagctggtctcactggttccccttgtactttaaggtgctggatgatgaagccgcacaagagttaatgccagtggttgccggcgctgtgttcaccctgactgctcacctaagccaggctgtgcgcacggaacagaggcagccgttggtctcaggacctggagaggcccagtatgctttcatgcttgatagttctttgacctcatctcctgcagcagagagccggccagtaggctttgcgtctatcggagattcttcgcttcacatcatactgaagaaactgttggactttattttgaagacaggtttttccatctacatttttctaagcattatgactttgttctgactttgagtgaaatgttttcccttgactgcacacatgtctttgtctcctaggtggtggcttccagcgtgtaaggactcacctgtacggctctctgctttattatttacagattgcccagagaccagatgagccggacacactagaagctggtaaagttagactgatttttactcttttctctttgtaaagatggtaacttcagaaatctaagtcacttctccattttttgactcagcacaactacaatcagtaagtcttgacatagccattagattgctgtaaagtggaggacatgtgtagtttttaagagttacaagattagtatatagacattgcaaggaaataacactcggatgatattctagttttatagacttgaactgcagtgtactgtttgtagggttggacaatgtctcttttctctttgtaccacagtacatgtctgctggggtcttataaaatggcagttgttctatagtaaggctataacatttaaacaatttctttattcataggcttaaaaat

SEQ ID NO: 31106 - DNA, 1039 bp, Mus musculus
actcttggtgaaatgtatgtacacatactattaattatatatttaaattactctggtgataacaattttaataaatatttcaattaaaaatctctaaagattaaaattttctgatttttgtttgtttctttctttctttgagagagattcctgtctgtattgtatcttttccttcttagccaaagtttcaaagatggcaataaattataagaacaaattgattagcaggataaattataatcagttgtcttggagtccatgattaattttaacttctgaagagccatacattgtgttattagtgtgcatgtgtgacacatgcttttaaagttcattgtctggactcattgatctggtcttttgtgtacatacaaaaatggatttctgctattattggatatgacatataattagttgctaaattgctttttactggacttttctgttttaatccttgtagctaagaaaactatgtgggaacggctgactgcccctgaagatgtgtttagtaaattacaacgagagaacatggctatcattgagagttatggcgctgccctcatggaagtggtctgtcgagacgcttgtgatggccatgagattggaagggtaagatatcagctgtgtagaattgctactgaaaagtgtatatttatgaaagtatatactgaatcagctttaaaatgtgtgttgcacatagagaattgtttttgatattatagtgagtttgctcatctactatgatttgtaggttctgctttgttactttatattttgtttatgtggcatcttaactcagaatttctccttaaaaatcacctttgctggctggctggagagatggctcagcaattaggagcactgactgctcttccgaaggccctcagttcaaatcctagcaaccacatggtggctcacaaccatctgtaatgagatctgatgccctcttctggtgtgtctgaagacagctacagtgtacttagatatagtaataaataaatctttgggccggagtgagtggggctggagcgagcagagg

SEQ ID NO: 31107 - DNA, 1219 bp, Mus musculus
ttctctaacaaatagtgtctaaaatgtaaatgctatcatttttaatgtaggtttggcttcagaattaaaacttgacactggggctgatgagatggctcagcggttaagagtgccgactgctcttccaaaggtcctgagttcaaatcccagcaaccacatggtggctcacaaccatctgtaatgaaatctgatgccctcttctggagtgtctgaagacagctacagtgtacttactataataaataaataatttaaaaaaaaacaaaaaacaaacaaacaaacaaaaaaaacttggcactgaagattttctttatatcgagaaattgagattctaggtatattcaatttccaactactcaaaaaaaaaagtgaaattctattatgaacattcttataagaaacagttcttaaagccctccaagtaaaggcttggctgttggtggttttggtagccatccacatattaaggctttgactctgactctttcttcctctagatgctggccctggctctccttgatcggattgtctctgtggacaagcagcatcagtggctcttgtacctttctaacagtggctatttgaaggtccttgtggatagcttggtggacgatgaccgaactctacagagcttgctgactccgcagcctcctctcttaaaagccctttatacgtatgaatccaaaatggtaaggttgtgtggatgctggactttataggccagtaggtcttctcctggtcctgcagctgtgcttactgctagctcggccactggtgttccctgagcatttctgttatataagctgccattatgttaagttttacatttggggatttgtgctaacagtgcagctttcagtataaagatgggctgcaatgatcctgagaaggttagagggcagtgtcctgctgccagcttgctcactgaggaggatgttgaggtggcatgatgccagggttcgtgggaagggaacagtgccttaagtactcttgtctttgtcatttccttccgtccagatctgctgcagtctctccatgttaaatttcttacataatgtcacactagtggaagtcttagactcgccatccatttattcatacgtatttactaaatacctaatatacaccaagcatgatgctacacacactagaaatgggcacagcaaacccaccgttgacctgttgacagaaactatatttgaattgaataatttgcagt

SEQ ID NO: 31108 - DNA, 1182 bp, Mus musculus
tagagccttagctatcgttacttattatgaaatacttctgatttctgatttttggaaagttttaacttttattattgaaagtaaaaggtttttcttagactttttaggtttcatcttatgtatatagttgttttgctttcatggatatcttgtaccccttgcatgcctggtacccaaggaggccagatgaaggggttagatttcccaggactagagttacaggtgattgtgagccaccatgtggttgctgggatatggaccctgatcctctggaagagtagccagtgctcttaaccaccgagccatttctctagcccctctcttaaactttaaaaatacctttgaaagtacctacctactttaggttgtgtgtgaatatccttgagatggtgttgctgacataaaaaatacttagcagtctttagaagatcctgttcttcaaaactgtcatggcaggagtctgcccgtgcaggtaaaaaatagaaaataccaggagcattctctggtttatatggttttcatttttagcacgcaacgatatttacacatgttctgcattttataggtatgttaagtgaacttgatgtagatgtaaatgaaggatccttaatggagctccatggacacattgcaaggtttcaggtaagtgatgtattttgtaaatagcagtgttaagggggctgcgcctggactagagcaggttactgagtctccgactaatcaagttagtgtcagtcactaacctgcggggctgccgctacttgattttcccggaatcacctctgacttccattgcaggtgaagaacgcaagtgtgtcacagagcttttatattagtgtttcacattcattattctatgtaaatgttattagtgagtaagccataaacagttgctcattttactttggtttgttgttcgtttgttttttgagaagagtatttctgtgtaccccgtgtgagcctggctgttagactaggctggtcttgaacttgcagccgtcttcactcttctgcttcctgtatgctgcacctataggcatgcctccacctgcggctgttgctctttacacagtgttgctgtcctcatgcagacagttgttttacccagcccctcaccccttgcttgctcttggcttgttgaggtagggtgtcatgtatgtggccagtctggccttgaactct

SEQ ID NO: 31109 - DNA, 1121 bp, Mus musculus
ggttgatttttatctcatgcctgcttgtgtgtctgcaccctctgtgtgcagtgcctttggaggccaggagagggcatcagatcttctggaactggagtttcagaaggcagttgttagccattaagacatctctccagcttcaatactggtgtctaaatgttattaatcatagtctacatgacctaaattacagatcatcgtcaatttttatagatagtttaagattcataaaagtttgttttcccagggtgaggcttatccattgtactctgcatgtgctgacccctgtcatttccccaaatgtaggaaactcaactgtaatgtgtggtagtggaggacttcatgttctcccctttgtaaaacaaatgaaatccatagaaaatgtattcaaatacaacaccgttttgtcttgcctattagatacccaggttccagtcgttccgtattggcgcctgcctggcttgggcattattatctacctgctgaagcagagtgccactgatttctttagctactatgacagtcaccgtcgcagtgtcaacaagctgcagaatgtagaacaacttcctccggatgagataaaagaggtatggaccttgtaatgaactgtgaggcttgaaaagtcactgctgcaccacaaaggcccaggtgctgggctcgggctgtggaataacaatgatctactcactccacgctgctgagggatctgcagggatttacctttgccatgtaaccttgtgagcacagacagaacagcccagtagctcttttcaagaaaataggcgtggctgcctgataaggagctcccaggaatgtcttcaaaagctgcagagaaacagggctcgctgttgcagatgtttttgcgtaggacgtgggaggagtctccagcatcttcacgcttcagtgaagtttccaggcagatgggacggctcgtcagtcttgatcacttaaatctgacacatatccaccattctactttctccagaagatacctggcaaattcatgccagcttttccacctactcttggaaaaggtttttgtttttatctagtagaaccccaagggctggtggaccactaggaaattggaagtgtcttagacttagacttgcagagacaaa

SEQ ID NO: 31110 - DNA, 1345 bp, Mus musculus
cattataaaatctagtagtagtttacattagagtaccttttgtcatgtctgtgtgggtaaggtgagcgtggggtagtggtggtgctgggtttcaaacccaaggccttgcactcgctaggcaggtactctgaactcaccttactttatgtaagaaagactgcattactggatgtcccagggcgggtggtacccaagggggtcttccaattctcctcagagaagcggggaaggtagtggaggaggggtttgtaggggtagggctgggaggggagcagggatgggtaggggggtggcagtcggatgtaaagtgaatacattttaaaaagattaaaggaaaaaggatagtgtagcagtgttgtgaatcagagcacagaaggcaatacccgagtagcagtgcactaacaagggcgtctgtactacctccagcttcagtctgatgctgtcaacgctttcggagagtcgctgcaaaagaaacttcttgacattgaagggttgtactcaaaagttcgatcccgctatagtttcatccaggctctcatcagacgtatccgtggcctgctgaggctgtccaggaactgagaactgactctcttccgtggaagagatgaactgaggagaaccacctcttttttatagatgactttatttctaaattatgaccaaaagatattttgctatttctttctttatatatggacatcttttctgtaaacctctctcatttctccctcacttgtgaacaataaaatactttttaaaaataaacaaatgtgtggtcattcttttgaaatgatcgaaactcttcacataaaaatgtttgatgcttatggttttcccgtggagagattctgaacagcagtttgttttcagacattctgtatccttcatgcctttgtgatgcttcgatattctagcatggagtgggtagtgaactacaccatgctcgtgccatgaaaactaatgacccaaaaagtcaacctgtcccttagaattagcctcagcctttcctgcatttcaaatgatgacagtctgtctttgtttctttgaaaatatcatcctgagataactcagacccaaaaggacatgcatggtatgtactcactaataagtggatattagccaagaaagtacagaatacccaggatacaatccacagaactcaagaaggttagcaagctgaagggcccaagtgagggtgctttaatcccacttgggagggagaagaaagcaatcacaggagggagggagggagggagggacttatggggagggggaggagaaaaggggaacatggtcaggtattagctaaggtattggcgggggtgggggtggggtggagggccag

SEQ ID NO: 31111 - DNA, 1152 bp, Mus musculus
gctgggcctggctttcagagaggaaatgtaaatctaacactgatagctaatatatatagatacaagccaaggaaacaccactgagtaggtctccagaggaagccaaagccttggcaaagccctttgtcctttaaagaagagctgtgaaagatactggcaagtctttctagtcttcctatctatagctaaattataatgtttctttttttcctctttaaagatgccaaacctggctaaaaaacttgaagagattaagaaggacctggaagccaagaagaagccccctagttcctgatgcctgcctggcactgcaatctggacccaccagttccatcctggggggcctgtctccttcacagccacgtccaaagctgtgttcctctttggtctcagaccctgcgcgttgctgaggctccagcacgggccagaagtggagttagctttccgtttccagcatctccccgttcccgtatcttccgtccacctgcttctgagacctaagcctggaaccatggtgctaggttagcagccgcaaccatgacaggactcactcgcctgtgctctgggattcctaccgcctactgtcaagaaatgaatggatttggatagctgctggggactcactgtctagcagtgataacaggagcttgctagacaaactaaactgtgttaaagtcattaaagtcagtatcttcaagccagtttctggtgaattaatccatttattatatattgttaccaaggagctccatggttgatgatttaaccagtaaatcatttgctggtcattaaccaggaaactattttatgcattctataaaaagcaaacaaactgggaaaacttaaaacatgcaaagtaactgttgtcttcgtacagttcagtctatgcagtctatgtttttccttaatgatatatttgaactgaatctgccgtaaaagagccattctttatgctggcacttgataggatgggtggataaatgaggagctgttgataaaataatgttacttttttttttttaaacattaaaatgtatcctaattatataacttcatagtgaaccccctaagagaagtgtggtgcaaatgtgtggtaaagtgagtctctctgggatctgggatctgatgcttcccccacccccgccccccacc

SEQ ID NO: 31112 - DNA, 1111 bp, Mus musculus
gccaggcagtgatggaggtgggagaagatcagaaatgattgacagaactcagagcattgagctgaccagaacaaactgatcatatcactgcacatctcacgaggccggaggttctcagctggcactgctaacattttgggttggataatccctcaccatggagggctgtcgtaggcaccgagggggaggttaggtgtgcccctggcctctagataccagtaagagccctcactcagtccatggcaaagatgattctagacatgacaaatgttctcgggggtcaaagccagccctggttgagataagatgttctcttagctcaacgtttcaaaatgcccggtgactttctcattgtttgtcggccggtctgtaattccttgagtttggaaagatggctgcttattgagcttttcgtttctcatctcacgtagtattagtcatgtgagaaatgcaatggatgactttaaacaaatgcatgaatgagtgaatgaatggatggacacatactgagcctctggagaataacctttcgttgactggcttcatataatttattatatgaaaatacattatgtatagatatatatttctggctttgtataatatattctattaagcatcaggctggcatcctctggcagaaggcagtgggagaatgacttatgtgaccttgtctctgaagacggttggggtcctgacactctctctgccttaccagccgctactgtagtcacacaggaggcctcggctgggctcccctctgcacactgcaggcttaattatgagacttcttttcagttctgtgaaacaacaggctacgataatacacggaggagaatcttctcactgtgggatacaagcaacattgaaacattgaaaccttcaagaacaaagcaccaaggacagttataagaaaccctgggagccatgggagactatttgccatagactcttgaagtttcagcactggaaaaagtcacacgtaaaataaaaaaggaaacatctttaccacaaaatctgactgtgccttgcttaatcccagacattttttttttttttttaaattttagcactgttgaccatggctaaatgacaatcctttttctgtctt

SEQ ID NO: 31113 - DNA, 2402 bp, Mus musculus
ggaggggaataaaacatgttttggaggagcagtggggaatgtgatgagacttttactgggattcctgatcaaaccagcctgtttttcatttccagtaaaatatacagcttattcccaagggagagcaaaaatacagtctattggaatcattggaccttctcagctccctagctaatttattaattagtttattgaaggtctgactatacaaggccaactctacttatttggtagccctagctgtgagcagtagtggctgctgttatgtcaacatagggtgctgagataagcaattagctatagccttctgccttaagaatgcactctcctgggggctcctggctagttaagagcggttagtgaccaaaatctctctagaatgacgttaatctttacataagagcttagataaggtaaggagcagcgcactcctgaattgctggatgactaaactttggattttctctcccctttcacatcaatttcatgtctctttagataaaactgactagttttatttataaaatgttaaattctaggagcctaaaggaggaatcattccagtaggcttatttctttttttctcctttagactcagacatttatataacattgaaacactttgagactccttctggtagtaaaggagatttaaaaataaaatcatagccataagcgtgttagtatcttataaagagagaacagttgtcttagtacctatggagtttcttcatttgctatttgagtgagccagccttcgttgtgtttggagaatgaagaatattctttggaatgcctctcaaaaacccaccatggatgctgattttatagtgcaccaaaggtatcactggggtgagatgtactgtatttggacagatgggacctcatcccttcaaaaacattcttgttaccatgttctcctgagctggtaatagactcttgctgggccagtaccaccccacctgcatggtgtttttatcttaacaatcattctttgcatacatgtgacaacttcaaaatgcattctgtgttcttataatacagtgccctaaaacggtattcctaggacctgcagataagagaaacttatctctaactttttctttcatgaacaataaaatgaattaaaacatacaaccttaaatttgatggcctacactttaagtattaagatgtcttttgcttttaatttgccatctatacaggattacaaaaactattagaatctttccatagccaatcatgcaataattgaatgtacctcaaatttttaaagggtaggtgatgggatagggacttataatcacattagggataataatattaaaaacctaactgattttttttaaggcattgtagcattatatagcagggttaaactattactaagaacaatcagcctggctaataactattaatcagttgataattggttggggtgtgtgtgtgtgtgtgtgtgtgtgtgtgtgtgtgtgtgtgtgttctcccatgaactcttttttatcctgtggctttttcactttcaactagcctgcccctgtagtttttctatgtccaagaaaacaatcacaaaacagtagtttaaatactttgatatatttggctagctctgctgttttaatgcagcctactagagttggatatcctacacttaatcttaaccaaaaggccaagcagctatagagttggacattctgctaggaagtggaaggcacatgatcagtctatgagtcaatataatgcaacagggtgttttgagacctttgttttcacctcttggcatactattttaaaggcttgaattttaccctttacacaattttcaatttttctttcaaagtcttctgttatagttggctattgcagagtgtatattgtcttatcattccagaacttgggtctgctttctacagtcattatggtaccaaaaccatatgattctttgtacagtttatcccagtgttccttgtaatgcagtagaggctattttgccttccccctttgttggccattttgtaaacccatagctatgaagtgattgcttgagaaaatagcatataaacatagactaggatagactgaccaggatggtttacagtttctttaaaaaaataataaacaaaaataaacaaaaaaaaaactaggttatttataatgtatttctgaaccacttggcagagaaattcatgacacttaatgttaatatttttgaataaatgaagctaaaatgtctgcttttggtacaacacgcattaataaaaggttaagttttgttttccactgaagtactatttaacatctcagaaaaaaaccctgcatgttctatagttttatattaaaatccatcatttcatatgcactgtatcaaaaacaggttacttgcctgaacatggttagtgtac

SEQ ID NO: 31114 - DNA, 1163 bp, Mus musculus
tgttctggcgtatctcattcagcatcagagcatccacactggagagaaaccatttgaatgtgagctgtgtgggtcagccttcagatgtagatcccaactcaataaacatctgagaattcatactgatgtgaaactctttcagtgtgtggaagattgaacattgttcgtggaacagagcttagggagtccacactggtgagaagctcgttcagtgtagtagatatggggaagctctttaatatctttacaaaattcttagacatgttagaattcatactggcaagaatcatcatgaatataaagaatgtgggaagtactttatgtgtggtggagaccttaaagtacatccaagaattcacactgtaagaaacattaccactgtcaagaatgtaggaagacctttagttgaatatgaaacttgttttgacatcctaaatataatagtaataagaagtcttatgatgtaaggaatatggaaaggcctacagtaattctaagttccctgtatatcagagaagttctactggtgagaaagcctatgaataaaagtaaggtgggaaaatgtttagacgtcgtgcagccttcatgcatagtggcaaattcatacaggtaggacaccctatcagtataaagaatgtgcaaagacctccaagtggagctggggccttcttcaacataaaaaaaatgtttgcttgtgtcgaacactatgaatgcaaggaatgtgggaatatttacagaattagctcagctcttaaagctcatcagagggtccatataagtctcgagatgctgtgactgtgaggactcggtaaaaaagctttgattgtaaatggtgagcttacacaacatcagaaaatccataatcaccaggagtcatgtgcatgtgaaagaggacaagccactgtatgaaaatcttcctgaacatcagaaaactcacattgggaagaccatgacgtcacataaaatgagaactttaatctgccctgggatttggtgaacataagagtattcatatactgttgatgccaagaaatcctttggaacgagaatttgggaagttggttcagagaagatactctgttgaaaatgtctcttatcctcagaaatctaggaagtctcctgacaaccttttcccagcattctaacagtctagattgactgtc

SEQ ID NO: 31115 - DNA, 1177 bp, Mus musculus
gaacacgggaaagtccagactaagtttgcctcatgtggtaagcagctgagcaggaggaggggcttctgagaggtctattatctcaataaagggttaatcattcctcccacatcttcttaacatgtcttcagatgaatccattttcctgagaggtggactcatggccacatgattgacaggcccagttggagtaactcttaacagaggagaccagaatgttcaatgttctttcccccaaacagaccagaaagtcaagtcaccaccaagagccagaaataaaactcagatttcattcttttgcccatgagatgctagctttcacttaagaagcatcaaccgagcccggtatttctgcattttttttcaggcttgtcttaaaagctgaggaggcacagttgtaatgtttcttgggttcaaggcagataatgaggaaggagttcaaattcaatgactcggaagcctgataatttcctgtaatacagtgcctttttagaattcccggtgctccatagactaaataagaggaccctacgcacaatagcatagggagatagggctcattgatgaggatgctttccaggcactgtggtgctgggaatccatcctaaatgtttgcccattttgagcagcgttgcccgacatgtgtgtgccctaatctgttagggatcaggtaggtggtggggctggaagagttatcaactctggtttccttagcttcatggtaagtcccattagtggcatgactcaaatgtcacatgcactttctgtaggtggtgctcaagcagagatctgaccaggacactgataggaaagaggagagcaatggctatttgtttatgagcattctagttatgaccatttgcaatccaattgtattattgctgctgctgtttcaggactgctgctatcgctgtgattcttcggtttcacattcttccccacatggctgtgtgtattctccctcctcccctccttcctcctcttcctccctagccctccttctggttttggatgtagaggaagacacttggagcgatagccttaggttctgattttccttatctttcgttgtctgaaaaattagttgccaaacatacttactgttctacatcatgttaggaagaccaatgccaagagggggatcacacattaagagctcacagacacacagtgttgt

SEQ ID NO: 31116 - DNA, 1197 bp, Mus musculus
tgggtggaaggccttaccgaattagcaatctgtttggattagtagaaatgtattgtgcttccagctccagagaggaaagctaaatataaatgcattgtcaggcagacttacctggagtattttagtactaccatctcccttcttagctaattcactcagcagaggcaaattttaatctaattttggtctcctgtgttatcacatcatcggggcagggtctggataaacaagacttaaacaatggatccactcagagttgttgtctttccctcatttgttgaagatgtttcaaggtggtgcatccatggataaggcctttatagaacccatagctatctcgattataaaatcaaagctctcaaacgccattccctttcctggaatttccatagggtcaactccatcagggtctttgaagaccctgtgaagactatttaaactccccagaatcactaagtatctcatattaaaaaaaaaaaatccagtgtcgaagttcctctcttgatgctgaagagaaaactgaagtgggcggatcttttccttacaggagaatgctgtgaatggggagcacctgtggctggagaccaacgtttcaggggacctctgctacctgggggaggagaactgccaagtccgatttgcagtgagtatgtcccacgatgcccacttagtctttccaggaaaacagactctatgtctgtgagcaatacgggcgagaggaacggtgtgcccaagtatcccaggatgcacttggaaaggctccatcgtcatgacacagaacgtgtcacttgattttaaggtttacaggtgtgtaccaagtctccatggctccaggttgtcacctttaaagactttagggtttcactgggtagactccatactagtgtatttgatgcttaacaccatagtggttatgggggttgttgtatctattggaagtcagagagagggtgcccgtagatgagggactgtcacagatagaggtgtgtggagtgacaggaggcctgtgtgaaggtggagggagtcatctctctgaagaacagtggacatgggatgggggtatgggtggtaaaggtggaaacaaccatgtgggatgtggataaggttagcctctttccacactgagatctggagaacacaatcccagaaatgacttgataaatcaacaaacaggtgagtggggggtggcttttactt

SEQ ID NO: 31117 - DNA, 1189 bp, Mus musculus
tgagtatataataaaaaaaaatattagtacccttgccagaggtggtgatgcatgccccagcagttgggaggcaggggcaaaagtagtgttaggccatcctggtctacttagtaagttcaggcaagtcaactagccagaggtacatggtaagaccttgtctaaaaaaatgatcactgtcctatgccctttataaacaggacagcgggatgacaacccattgttatcttaatatcaagaagatgaggtattttggtaattccaaggttagctcttttttcttggctacttttagttcccccttcccctttccccttccccttcccgttcctcttccccttcttgttccctctctccttcactccctgccctttcccctcctttcttttcttatgagatggcttggtccaggtcttgaataaccttgacttgactatccgcccacctctactttcccagtgcaaggattacaggcatgtaccagcaggcctggattgaaggctggattctatctcgtctacatctgtctgtctgtctgtctgtctgtctgtctgtctattggtgtttagaagagtctccctgtgtacgtagtccaagttggctttgaatgtaccactctcctgtctctgccttcaccttctgtgtgctgggcttaaaaccctggcgtgttccaccatgcccagctacatttactactaaagagctgctttgaaggattttggaccctctcagcaaaggacatctctgaggtataaagtctgggacattattcaaatcatcctaactggatttctcaagccctgatcaaatcaccaagctgttttgcttagcttcttggtcaagttcattcattaattcagaaggcatttattgaatatgtgcagagtctatctagctcagggctagatgtaacaagattagtggatgaatgaagtcctgtcctttaggagtttatagtctttactgaatgaagggaaggcaataatagaatgccactgaagatgtatgatagctcttgtacttgaaatgtgttctcagtctttcacgtcaggtaattgacattaacgtggcattatgctctgggaactgaattatgaagtattttcttttcatatttatttcacagttaatatcacagttcttttcagacatgctcttgtgagaatactcgttccccacaaagtgatgttgt

SEQ ID NO: 31118 - DNA, 1178 bp, Mus musculus
aggcaagcatgtttatacttatgtgaattgtctaattcatgtggaattttagtgccatggttgtatatatccttacctttctggttagagatacagtgcataggcaagaaaggggtgtcacggaggggtctggatgggcagtgagggaaatctggtttatcacagagaggccagtgctcgcttgtctggagtgaggaatgtctgtcaggcttcgaaagaactttctgagtcttgtttccttgctggtctcatgagctggcagcacatttccctgagatttcatgagcaagactgtccagcttaatccttgacctgctccctcatctttatatgatatgggataatgctctctggacacacattagtattaaaagttgcaggggatgggggaggggtggagaggaactttttaatactaatgtgtgtccagagagcattatcccatatcatataaagatgagggacacaatttgagtcagagaacttctgctcgtgagtctgagccagctgtgtgctaaacagaggccaccccaggagacctgcctggaaaactcgctgactggaacacttgagactagttcaaagatgctgatggtggctgggcttgcatgtttctgaatacagccgccagtagcaatggtgccgtgatgtcacagaaaccatgactctcgcttgctccacttcccatttggttctaacacccccaccttcatcttatacaggactgtcacaggagcctggggagagaagagggatttaaaggagggagtgaggcaagctgcagttgtaggcccacccggcagctatgtctgcccacccgcaaggtggtctcggaagaggtgttacttggtaaagggacctggaccgctctgctcactggcaactcagacatgtgggaccgctggaaagaaaaacacccctggaccaggcagaggttgagttctctctctctctctctctctctctctctctctctctctctctctctccctctctctctctctctctctctgtggtgggctgatagtaaatgtgtctgctacccacacatgaacatgatcaggaaaggacacacacagaaagcgcacatttttcttgtatttatgacggagttgtaataaagtatggcagaggctgccgagttggcgatgaagtctgtgggaattgtatggaagcct

SEQ ID NO: 31119 - DNA, 1270 bp, Mus musculus
cagaggactcaagtactagtgctaggtctctttccttccactctctctctctctctctctctctctctctctctctctctctctcctaagtacttattcatgcctctgatgtgccttgtatctgaatccaggatggcagagatcccctgtccctggaaggtgtcatatattactagctagtattaggttgaagttgggggtgggggctttctccgtaggcttggggatggttccctcaaagtgagccactattagatttgcccatcaggggaaaagaaatggggttatatccattaggaaaatcccattttatagatagaggtgcaatcacataaaaatgtggccaggcaggattaaaggtattctaaatccttaccacggggcattttctggatgcaaaggcactagcccatttgaaaattaatattccgtgcctctgggccaagaggtcagctttctgcacgaggagaaaaacagtaactgctgtttgttacagcctgaaatccaggacgaccgcattttctcttggtttctaaaaggaagggaatcttcccgatttttctaagatgttgagtattgtgtaagtaagctttgagtctttgaacctgattgaaatgcaaagcaagggtgactcattgttaggagaagtaaaggccacggaaggtatggtagtttctggagtcctatctgagaactcacagattgtctttgcctctctaggcagaaacagagctacccactgcagcggcctgactgtgcagcactcagctctttggctctctctgaaatgcccgtctcatcctgtctttttcgagcatggctcacaggccttgtgtctgggtgaagggaacccagggtcaggctgcacttctgtttctgtcttttgctcaacagcggggtgtgcactcgtggctgcacagatgaagcccatgctgagtctgtgggaacacccacactcagtgcaccctgtgggtgaccctccctacacagtgcagagcagagcccaggaggggccacaggcatcagtgaactctccttgcctaggatggcaactgattttgctctctttggaaagattctagataagtcagcattgtttaaatccaagtgcagtgcaagtctgtgaactgatctgttgcactgtcttatggcttcttattcttcatcatagctaattaaataccaaaaaaaaaaaaaaatagaaaataaaataaagctttgtagtatacttgtacttagtttggggaaaaatgaaattataatgcatttg

SEQ ID NO: 31120 - DNA, 1208 bp, Mus musculus
atcgctgttgcggaatccacttaggcatgtgtcccctgatggatgaatacatgggaatggtggatactgtcttctgactcaggctctaggctccatggcttcctctctctggtcctgccacacagaaggaaagccctgtccaggataatgagcgttgctgacacccttgctagcttgtcctgcctacctgcttaccccactccctcaccttcctccttcccttctgccctccatccacctgccttaactaattggggctggagttggtcatttttgtacacccacagtggtaccttttacagtcaggtttggatactttgcagctcatccaaagagacataactaaaccctaaactctttttttgttgttgttgttgttgttttttttttttatgattaaaaagtaaaaattgtagtttaaaaaatcctttcctctttcatacaaataagaaatggaaattgctcgtttattgtataagatagaagattcgtttaaagtgtttccccacccccacccccagcttgtaaaagattttatgtaagaaatgtgcttacactttgtattttatttttagcagcagctaaaaggcctgtagttttactctctctctcctctctctctctctctctctctctctccctctctcctctctgtcttcatcatctttgagatcattagagcctgtataaaggggattatggccctgccttctatgtcacacataggatttggtgtcattagtgtttgctgtcatgccccatgagtagctccttacttggtctgctcagggcatcctagggaatgttcctttcccccactcctccctccctaccgtggtggattcccagctggcagatggccaagctcagggccactgtgatcttggcagccctcctgtttaaggggctgccaccctcccttacagggtggtgtatagccagggctatacaaaaagggtggctagtgaccttttctctctcttctctctctcttctctcttctctcttcccttgatcttccttggcctggcccattctgctctttacagtgccagatatttatacatcataaacttaggaaatgcctaaaagagcctaagcaggaaaaatcctagggtgaggcaatgtttgcatgatgagagaggaagggtttgccatagagagctgaaatggggatttagactgatgtgtgcattggctgagctgaa

SEQ ID NO: 31121 - DNA, 1100 bp, Mus musculus
gggtagtacagtgtgtcccactgtcctcctgactggtgctacatggttgacagtatggtaagtggcttgccatgaatgcagctctattcacagagccaactcttgaaagcccgaggaggaggtagctgaaaaggccgaggtaggtaagaaacagccccatatgtcttaggaaggttgagggcagtcatttgcctttcacttaggagggagcttcatgtgctgtggactagctgcccagaaaacagtgcagctataagctgactggaatcatacctgcctctacctaaaataattggcaagtattttgcccactgtcctggatagtgagtcttgcccctttctttgctcactatcatttggtaagaatagatgtacatgaaaatcgtagctcatgttgcccactcgacacagacagacatggttctctatgtacttatttcaaaattgtacgtgctcatgatgttcatgctgcacccatgccttcaacatgaaggatgaattaattagctgtgaactctaacttttcacggaaggatggtctcgtgggaaaatgtggttcttacactcagggaaatagatgctcattttctgtctctgcccctctctgagctgcacaattttgggcccattgtagatcttttctgggctcacactttctcattggtaaactgactaactaatatgtctgttgtaaagatttattaaaataatatatttagccattttcctcgtcatgcttccgtggctaggccttagtggacagctagctcttcggtggcttcctagataaaatgaatgaatcatcgtgtagacagcgacctttgtctcccagctgctctgcctggagaggatcactcccaatcgaaccgttatcacatcgtccgtgtaccctggcttctgcatcagtaaacaccttagcctgatgtcactattgactttcttccttttaaacacaaatgttctagagtacacacagaggaagattcccttagattcttttcccctctaatcttgagggagatgttgccaggttttctgtgtcccctggtgagtcaggggctcaggaacactcacttggtatgacagacaaatatgaaagg

SEQ ID NO: 31122 - DNA, 1226 bp, Mus musculus
tgatcctgatcctcatctttgcggaggtgcttggcctctacggtctcatcgtggccctaatcctctccacaaagtagtccttttccaccatcagtcacaggataggatgtaaagatcacccctcctcattccagaacgaacagcctgacacatgcacgggcagctgcccctcagtagttggtcttgtaaatgtgcagtgtcctagtgcccattgtctgtcgcccccgccttgcccctactgcaccgtgctgtggacatacgggcccactcatctcccacccaggcccctgaccagtgacgaagtcagcctctggttaccccacccatcgccctagagtgctcctgtgtataagaatgaactagagttgtcatttttctcttcactggatgtttatttataaaagatttgacctattcatgcgtctgtggagcagctcctgtctcccaactatatagtaatcattagtagactgttgccttgtggggttcctgttgctgagactccttggatggagccacccttccccctgccctgaacagccagggtggaggatagagtgctactgctcctcagagctggctcccagctgtgtccaataaaagttctcggatgtgaaaaaaaaaaaaaaaagaaaaagaaaagagggaaaatcctaaagcaccctgggtgcaagatgtgcagaaatgtaaggtatttggagaactatcaacaaccaccaattgcacatgattttggtcacatttacttcctgttcctataactacggacaagtccccatttttcctgtgagtaggttgcaaactgttactctcaggttttatttcttttcttctgcttggcaactttacagctgtcactttagaagaatatcctgcctaccagcttggcccagtgtaggcatagaactaagtgctttctttcttgtaatgtaaacctaacagacaagtggaggcacacgcgtatcaacatgaatcattagctctgctttaggaaaacaagtgcatttgtgatgagcaaaccatgagtaatcatggcccaagagcacagattcaacttaccttgaccgacatgttccgccatggaaaaagatggggaaaaaaaaaaaaaggcaggcagatttctgagtttgaggccagcctggtctacaaagtgagtgccaggacagccagggctacacagagaaaccatgtcttaaaaaaaaaacaaaaaaaccccaaacaaacaa

SEQ ID NO: 31123 - DNA, 1144 bp, Mus musculus
agcagatgaagttacccagtgttgacaaccagtactattcattgtaaaacaaacaacaaaaggctattcaacctattgttctggagtctgctgtgaggtgtacaaagttcaggggcttacatatggtaaaggccttcatgttgaaggcaaaactacatgtttcaagttaggaaaagttatcacttaacaaaaggaacatgcatgaatcctcagagtggacttcttcataggcctactcacattgattccattaaacctcacatacagcacttaatgagtcacggtgggaataaatttcaacatgtttccatattttcatagaaactatagcaaactgtcagatgtgtaggatgagcctggagtgcattgtgtgtgacatgagagtcaccaagtgtagctcgtacactacctcacctgtatgtagtccacattaaaggagcaaatctactagcagggtgtttaatagagagcattggactgttacaagctgccaaaattataatctgtcttcctaagaaaacatgtaaggtgaaagaaaaaaatacgtaagataattcatgatagttggcccagtttattctgtaaaaatagatgttgaaaaatacttacattctttgtcactgctgtgtgtgtttgtggccaaggctggccttctttactatgtggtgtgaatttctaatcatccacctctggaatacaggcattaggtgcatactaccatacccaggttatatgttctagggatttaacccacagcctcctgtttactatgcaagctgtctaccaatagagctatatctttagcctccagttttattattagacaaataaaatgtaatttgttgtgcttcagaaaatggtaaaagttatgaggacattggcagtctaagttgagttaacatttcatatatgatttataatcagaattgttagagtaagaataagtaaaaaagggaaacacagggaaggttcagagggtccatcatgttatgtgctgttaacttagcccagtacatgaactccaaagtatattcttacattttagtcgatttattatagttgtgtgaggtattgtaataatgtgcagacattttacttattcagcagttacttagttaatattttcacctgctggacaacattc

SEQ ID NO: 31124 - DNA, 1222 bp, Mus musculus
taaatgggtagtgcatacttttttaatgctcatatcagactaaggaaaacttaatataaattttaaaaaatttgctttccacaatataagttatttttattacattaagaaacccagttcttgccaggcgtggtggctcatgcctttaatcccagcacatgggaggcagaggcaggcagatttctgagttcgaggccagcctggtctacaaagtgagttccaggacagccaaggctatacagagaaaccctgtctcgagaagaaaaaaaaaaaagaaacccagttctttatgtaccatctgaaaactattgactaaagtagtacctaagaatattgacatataaatggccctatctacttcttccccccaacaccatagaagagaatccatagaaaatggaatttctcttcctttttttctgtattcaattatgtacagtttataccctggctttaggacccagttctcttacagaatcccaactgagaaaggctacaaaggcatgaagggattgtgtatgttcctaggaaacttggtgtatttaggcatggcaaaatatttatatttaagtcataaaaagctttattaaatgtaacttatcgtctgtgtgtgtgtgtgtgtgtgtgtgtgtgtgtgtgtgtgcgcacacatgatgtggtgcatctgctctctgtatatttatcgtgggtagactataaagagtaacctttagtttcttgctgggggaagttgtctgacagaactctcagtttgtgtctcacttgagcccttagtctcagcattccagaggcagaggcaaaagcaggtgggttaatggtagttctaaggtcagcctcgtcagtaaattgtgttccaagatagccagggctgcacagagaagccctgcctcaacaaaaaagcagaggaaggaaagataacacttaggattgaagttttctcgtaaatttgcagttgtttttagttttcaacattaatttgccctgaaataatttcttctctcggaagattgattgttcaagtactataatgttggacaacattgcaaggaaagacacaggtgtagatcacgcccagccgaggcctccgtcaaacagaacggtgcagtcaccaaattcatcagtgccatctccaggccttgcaggtaaagccaccttttggatttgtaaatgttttctggttttaactcgtatttttactcataataattaagtttccctcagc

SEQ ID NO: 31125 - DNA, 1138 bp, Mus musculus
actggaaaggaatgacatggcggtgggggggggggatataactggaaaggaatgacatgggggggagaggaaggcggagaagggattttttaaatctaacaattgtaatgaacttttgactattgttacaaagatttaaattccatttggcacagacgtatactccagagttccctacagtgccctcttccctgcttcctagtctttgtacttctcagaaagctcatctgttgtgataaacagtcataggccctttctgggccttgtggcccacacctgtaaccaagcatggaggagatagaaggagggtcacaagtgtgatgttttctcagatattcatgttaacttcttagacctttgcatcacatttctgccatttcttttctgtacttctttgtacctagtagtatgtgataaataggcagaggataaaaccctgtccaaagaaacctgccataggtggcctgcaagtggtgggaaggtggtggtgaagacagagctccgacatacttagaactcaaaggtacattatcccaacagtggagaatggatctgtactttctgccgagacttatctaagccagaggttgactatgattgtgatgttcccagtcaccactcagagaaacggaaaagtgaaggccttactaagttaacgccaatagacaaaagggtaagtgtctgaacatttccactcatgattttatactgaattcttccacctttaagtttctttctctctcttccctctatatataaagagagaagaagcaatagaaaactatagtgtctgtgtggggtttttttgtttttgtttttcgagacagggtttctctgtatagtcctgactgtcctggaactcactttgtagaccaggctggcctcgaactcagaaatccgcctgcctctgcctcctgagtgctgggattaaaggtgtgcgccaccgcacctggcttgtgtgtttgtgtttaaactcgtgcatgaacgctcatccatgcatctacacatggagaccagagattatcctaacatatcttcctcttttgctttccaccttacttttgagacaaatcctgtcattgagcctggagctcactgggctagactggctagctagcaagtacctggaattcacttg

SEQ ID NO: 31126 - DNA, 1172 bp, Mus musculus
aataggaacagaattgtgagagattatttttattaacgaaacctgggtcttttgggtgttaattcctacctgtatttttatcccacagcctgattctgaagtagccaatgctggtataaaacttgaaagctattttgaagaacttctaaagaatctttatccagaaaaaaggtttcctaaggtagaattcaggcatgaagcagaagactgtaagttcagtgacgactcagacgatgactttgtacagccccggaagaagcgtctcaagagcaccgaggatcgccagctgcttaagtaacgccgcactgggccagcgcgctgtgctagagatttctcatcaaaactaaagacagcaaaaggcttgtcagtgatctaagggtttgtgagctctctgctctgtttttgctgtttactggactttggtttctttcataacccatttctttaacctcttgtcaatgaaaataaaaagaagaggaaggaaggaaatgtgtacaagaataaaagaaggaagagaaggtagaaaaagaagaaagagcaaagaaggaaaagacattcttccccttgttggatttcatacaggagcctggagtgagtgctacactaagaaagaaatagagtttgacataagttgagattttagtgtgatctggatgtgtgataatccatttttagaatattaatttcattacccattaattatggccaactgtaaggagatagtcctgttactattcttaaatgaagtcctccccaaacgtgaatggaagcagagttctttgccaggctgcctgccggaaaaggtgtagacagatgctactaagacaccaaatagtgtccatgtaagatggcaactgcattaaaaaaaaatcaggaaaaacaaatgtttggttattgttttgttttatcttgtctgttagagatgctgggcatagcagttctaaagggccattctctcatggattgctagatcggccttttcttcagcttcggtgagggaggaagtgtgtgtgtcaagtgttgctgtttgatccgcccctccactctccccttactgtgcagagctgcaagttgctagtggcttttctttcttttggggggagaagggcggagtggttgggttttttgagacattatttctgcagtattactgtagtcctggctgtcctgga

SEQ ID NO: 31127 - DNA, 1173 bp, Mus musculus
agtactgttgtactagcccaatatttgacaaaatacaataacagttttagtttgccatagtaaatttttagtattaaagcattttaattgtttgactagagaaatttttttctttaggttgacagaacagctgacctgaggatttatttggtcacatgacctcccctgaattaaaatgtagctggacatagtagccgtggtggcatgcacacactcacaatgccagcacttagaaggtggaggcaggagaatgggaagttgaaggtcatcgtccgctgtgtgagccgctgtgggggaggagcagggagacggtgacttctgtgtagcattattccagagctacaattgtttcttgccttaatagcaatagatcccttttatctaaacaacctgtataatactcgttatacatgaccactctaacagtcttcatccgttttctaaatgtgtgttgtgtgctgatgtttgtcgtgttgatttgaacatgcagctggcacttgttctggaaacagtctgaacaaagtttgacagtgcacagacccttggggaaatagggttttatgttcagttcagtctggccttcagctctggcccttctacctctacctccctggttcagggactaaagtagtgtgcgaccatgccctcagctttggggttggttggtttgcttgcttgcttgctctcttgctagctttattatttgtgggaagtggttacacttgtgatttagtccagcattttaagtgtagcagctgtgaaccatttttattttaatattttaaagatttatttttttatttcatatgtatgcatgtttgtctgcatatacgtatgtgcatcatgtgtgtgcctggtgcccacccacctaggctagaagagggcattggataccctggaagtgacgttagagaggatggtcagacaccgaccgtatgggtgctgggaaccaaacctgagtcctctgcaagagcaataaatgctcttaaccactgagccatctcaagctccggctgtggaactctgagcaatacctttctttttgctatcttagaatactgttctctggtagattgtcttccataactgtcacctgagttaaaacagtacttatgtaaattattttgagaattatcactaagggggaggtagggcttaaataaggtaaatata

SEQ ID NO: 31128 - DNA, 1132 bp, Mus musculus
aagggaagccatgcacagccgcatagcctcatgcactcactcacagactatcaaatagtgtgttggggtgggggaggggcacatccttgcttgaatggaggctgtggaaattcatggtgtgggggagaggtgtgctgcggcctgtgaagtctggggaagagaggtgggaggaagactcaaaagaggtggtaaggaggctcaaaaggtcatctggttcccatggtgttctgcgccttgctcctgcctgcctgcctgcttctagctggcatttcagtctgcttttcttgctcttccctatcaccacagggtggaattccagaacaagttctatgagggggctggctccaagttctcccccttctcctttaagcacgtcctggaaggcacagctgaggagtaggtctgtctgtatcctggtgcaggcgacagctgaagaagctctcactcttgtctctgacatcagcccaggccaggtgtcccatgctgcagtccttctgaatggctgtctgcagtgtgaagctgtgtatggtgcagtatttaacaggacttagccacctaactgaggggctactttggtgaatcattcggacttcatgtgtagtcttcatgatcaaatactaaaataactgggaaacggggggggggggggggcggacatgacacttgaccaccatcttcctgtgatagtttatttttattttacttcctttctgtttgagacaaggtctctctagctttaactgttctggaaataaccacacggccaaggatgtccttgactttgaactcaggttcctcctgcctctacttcccaaatgctgagatgacaggcaggaaccccctcacctgaagttcctgcagtatttcaagtgttataatcatgaaaataaatgtctgctttattcactgtttaagatgtcgttattccaaattaatccttaacatttagcaccagcatttaaaggccaacgccaaggccgaacaatggggttgcacaacctaatccccagggcaggattagtttgttttcccttctcttcccccttgtcttgggcttagcattacaagttgagggactctcaaatattgtcaccccacaggaggaagcacagctaatgccctctgtgggaga

SEQ ID NO: 31129 - DNA, 1776 bp, Mus musculus
acagagtgttcactgctatttcagatcttggtgagtgttccagtaaccaagccagtccccaggacactagtctacgttggcaggacttcacaagttaatcattccttaggcctcccttggccctttcatcctggattcttaggtgggaatcagacacttagaaagatgttgggtcaaggttctaggagcaggacagagtgttcctgtcatagtacacactaagtttcccactagcagagtcctcgccatgtcatttctacctccaaagtcatcagagcctgcttgtccacatctggtccaggtgggagtacaaggaaggctgcttctacacccatgagcacaaatacgtctgtgtgggacagtccactgaacgtcgtcatttagtccagcccattgcaggcattcctggaacaggtgagagggtttctacttcccatgaagtatataggcttacactcatcacctcgtaaacaagaacgggcacatttcaggtggcttattttgtgggggagggtgctggaaggggttggtggtgattgtgggtgtctaaactggaattcttttgtccatgttaaaaagacttgaaaactgaaacgtcacggtacagtgttaattcacgcctgtgtgtgtaacaggacactcagcaattatcttaagaacacacagcagcattgacgtgtagaaagagaatagtaaatgcctttgggaacacggttgagagccagccaggacgcaaggggagcaatgaatgtctgtgtctgatatgctcctcccaggttggtgtcccactggacaggtcacaatgcaggctgcctgctttgcctcctcctgtgtttccctgctccagggccacttccagggattacatggaggatcaccgatgtcttttctcatgcccaccagatatcaagtactcatgacttgactcccaaatgcgccgttacagggctaagttaaagccagactttaaagttctgtcacggtggtaaggaaagaaacaggaggtgctagaggaaccaagagttctggtcattaactcagtcatgccgagcaccagggcgctggttctgaaacggttaagagaaaggctctgggctttgctcccatctctgcacagcgcactgtggagcagagaggagggagacaggagtagggttatcagggaagcttgctctgccaggctgctccaggatgccagcttgtctctgactcggttgaggtccatgctctgactttctgcaccctcgtgctaggcgattcgtgttactatacaaaaccgcagaaggaattgggccacctgtggcatcaagactgcaacttgacaatcacggtttgctgatctcaaacgggcacttaaagcctggtatgggtgtgtgatttagtgactgagcctgcccttctgtttgtcagttacgtttctacccttcaattagctgcactgttttctaatgtgctgtagagtttggaaataatttatgcaagtgtttggttcccatgtttacaatttttacagctttcctaggattttaaaatggaaatgtcaataaatgctacgaatcggtgtggaagctgttctttgtggttcattccttgggaacacggtggctttgtagtttgtcagtggtggttttttatgctgaggtgacctttggttctctggttttgagtgcctgctaagaatacctagtgtggttctccaaggacttcagttcacagcattccattcctgggagctggcagaactgtccccacttgcagcagtggtaccatgcccgc

SEQ ID NO: 31130 - DNA, 1776 bp, Mus musculus; identical to SEQ ID NO: 31129

SEQ ID NO: 31131 - DNA, 1688 bp, Mus musculus
gaacttccacagctgatcagcctcccttgcaggtttgccaagtatctgcttcctgtggaagcaagaccaaaaggaaaccaaccgagtgggggtttggaggagtcggaagtagcatctccaggcaagctgcccgaggaagggaacaagtcgcaatgttagaagatgccataaagtcacatggacaactcatggtactttttctgggttggcaatttgatgaccactttggttcagtcaaaatgtgtgtacttttgggccaaaagccagcacttacacacacacacatacacatacacacacacacacacacacacacacacacacacacacacacacaaccaaaacacaaacctaagctaacaaaatgtaagtcagtctcttctttcaaaggcagaagattaaaccctacaggtggatagggatgcaggggcagcctttccccgggaatctgactggtccgcacaacacacccactgctcagtttcctgagaagagagatctcaagacattttaataacagcttgagccctcttctcctctgtaggaacttaggttaatagtaatattaacaacaagacatgctaagactctttggtaatctagaagagcttctagtgagaacctgatggtaggtcgtggggcctggtgatttcaaacaaagccatcgcctgcgttctttctccttctggtgctacagctctgagggccttcacctttctgtctgaaatacaactgtggcttttgcagtagaagactatgttggtggtttcattgtgttctggggtctggggtgggaaagaaaaagaaaaagctgtacttgggagggggaagcttcatatttatttggttattcaaaatacatatcagagtttgggtttccagtcttagttgcatttgttgtttatttgttgggctcacccaactcttgacaccatagcagagcatctccgcaaggtccatcctccggaatgaggctgttggggtgtcctaacccaggtccttgtgcttcactgacagtttgctcacaggttatgtttgaatgtcttatggaagcagacgttattttccgtgattcttaggactacctgtctgtcacgaatctgcccacggtagtcaggtcccctgagctctggactggaagtggaactgtgttcctgccagcctctgtaatgactgaagaaatacagggttttgaaaacatgaaggaaatgagagtttccccccattcctgatttagctattatttctttgtctgaagtctgccatactcactttgggccagagagaggttacctcacagtgtgcttctgacgtcacatttctcggcctccgacattatgacattctgcatcctggtgcctgaaggaaactctgggaaattgtacactaacagggagttgaaccatgaagctcttcgtcagatgaatgaatacttttgattggacaacagataatgggttagagtttgggctggggtggtggtggtggtggtgctcagcctaatcaaaactgtgtgtctgcaagtttgaagaaaatggagacagctagaacaagcccccagactgcaatcactggctccagaattgtctttgcccttctcacctgttcctggaaactggggcagccagtgcttatctgcacactccagatgagaaggcatacaggagggggcccactgatctttgtca

SEQ ID NO: 31132 - DNA, 1333 bp, Mus musculus
ccctctcctctgtgtgtgtgtgtgtgtgtgtgtgtgtgtgtgtgcgcacgcgcgcacgctccaggccctcgaatgtgaatgaggctattttagcctgtgtgtgtgtgtgtgtgtgtgtgtgtgtgtgtgtgtgtgtgtttagggtcttggttctctctgttctggtttatttcagcacagttctgtccttttcttcatctactagaatttgacagacctctggttttcctccattctctgtgctgtggggatttattgctctttgttcggcttactgctatttctgtgggatttggggatagagggggaggggcgggacactaaatgctcacattcaacttcgtcacttaatgtcaaaaacatttccagcgaacagagtgtttcaagtctcacagaaagggatcaaggttagaaaaccagctccctttccttttaaacttttacctccctttgagtcaggcttggagacacacatctgtaatccctgcattctgaggcaagaaggtctaggcctgggcagtgtagagagacatcgtctttaaaaaccaaaacaagataaaatatcccttcactttaccccctttgaagaacactgatcagagacccccgtgatcagtgtcacagccaggccttcagctccatgtgctattctagaagctccttctgccttccttctttcagattgtgaatgtcaccattgcttcttcgagggtggctccccggaggggcccagtgaatattatctttgctgttaaaggctcgcaaggttttctgaatgggtcggaggtgagcgatctgctgaggaacctgacggtggtggagttcagcttctacctggggtacccggtgctacagatcgcagagcgtgagtacttatggcttcttcgaggccttggggaagggactgccagcgttttttgccggtggatgtctactttaaaatattgttaactttaagtagagactcgattcttctagagtgcttttgggctcacagggtctggatgcagaggattcttcttgtactcactcacgcatgggaagtcccttccgcaacgtcccattgaccacagccagtggacatataccgacatggtggcccctccagggtcttaggtttatgatcaggctcaggccctgtactacactccttgcggtttaatgagtgtttagtgcaatgtacctactttcatatgttaaacacagtaggcttactgggactttccccctcaggacatatttgactgaatgccagaataaagtcaggatgtctcaagcccagccagggcgggctccagagcccttctctgccccgtgcctccctttcctgttt

SEQ ID NO: 31133 - DNA, 1195 bp, Mus musculus
aaaaaaaaaatgaatggaaagaactagatttgggggtgagaaatatttcatatcctgtataaaatgttattacttgggcatgatgaagagtttttccttccatctgtagtggttagcattcccaacagctgctttgaacctcagtgcagctgccctccttctgtggagggagatatcaccagttcattcaatagcatctcagagactttgaaaatattacttctgagagcttttaaagcctcatcctttgccgtcggatgcacagctggagacattctgttatttgttgagaagaaggtgggaactagaagctcctgcccccctgcgtgggccacagttgctccctggtcttactgtctttctcagtgtaatgcccaaatttccattttctagaatacttcacagcacttagatctttctactcagtccttagtatgggccttattttttcaaaacaagttctagcatgcttcatctcagccatggcttcctgaagtggcaccttcctgcttcatactagcactaaaatgcatctggtggttggattttgtttgtagtgctggccagacgagctgtgcaggagtacatcattacatcaattaaagaagtgctgagaatccacttcaaccgtgcggtggagctaaaggtgagaccctgagcctgggagtctgatgtctggcatgctttctggctctcatggggtgtggtaaaagccctggcctctgctcttggatttttctctctcactctcctcctggtaaactagttttccttggcatctccgttcacatgtcgttttaccctgtgtggtggggctgtgtttgtagaattggaatggtctgtcagaccagaggcagcatagtttggggcaaccttaactgttttgctatccttgacttgctttaataagtgactggggcttatactagactccaggggaaggatacttgtgtctttctgtgctttcaatagaggattctattgaaagagatggattcctgtactgcttatgctatgcccactgacggtatccccttccagatgagatcagaaagctgtgctctaactagtcctggcacgagctaataagatatgtggtgagtgtaaactgcatgccagctctcaaaaaatgcaccagatacagcagtatctcactaataattttttgtagtgactacacattggaatgatgttt

SEQ ID NO: 31134 - DNA, 6040 bp, Mus musculus
agctgcagtttttagccggtctttctctccctcacttagtatcattggcaactgtaatacctacctcacaactaactgatcgccaggacccagggtggaaacgaaaatacacttgcggctgagggctgaggttggacctggagccagccaagagagggtaaattctgagcacgtaatccagggtgaatcctgaagctgtagtctctctctgcagcccctgaatgccttcgagcctcaatggagggcaggtttcttctgctgtctgctaggtcccgctggtgttttctagactccatttacatagcttatgttatggacatcacagtttgtgaactctgtattgtttgttacttgggcttatacttagttccttttttgcaaagaattgttaatataagtgtaatcacctcccttattctgtaatatttcatactcctaacagtgtttgaatatctcattttgtatctgtgcagtattgaatttaaaagccaatttgtacctttgcttggcttgtaggtgctaaacaatactgttttctgatacatatttctttaactgtctgtgtggataacctctgtccctgctttctgtgtctcttgcttgattttgtgaatttcccatgttgcattttgtggcttgggccctctgtgctgtcatcaatactgtgttcataatattcaagtttctgggtccatcctcagtcagcaacccagctaatgatctctggactctgctcggaggtttctacctcaccccacccctctctcatcctctatcgagcctatcagagctcagctgctctatcctgaaggatgtgtggttcactccttccagttatatctccccggtgtggatgggacagaccatcaggaatccatatataccttgcccatttcgtggtctctccctccctcctccctctcccctcctctccttctccctctctctcctccgtcctccctcttccctcctcccttccctcctcccttcctccagcctctctgtacccactcatcctgttgttttcagtgtgtgctttgctgatatttgttgtggtcatgttccccaatgtaactgtgtaaaaagatttgtgtttctttccataacgtgacatttgagaaataggagcaatttagtaagttttcataaagccaaacttaccttatttggagaaacttttatcatgataccaatggatcaaaggagaggagggatgtaaaagtgtcctttccaaaccagtttcctcttagtggacagtaagctcgcggacttagggcttctcacttcagttgtcagtaacagtacttctgagattgtgttttatattcttttctttcttttaaaattcaagttgtgacatttttttcctagtggtatttgtgtgtgtgtgtgtgtgtgtgtgtgtgtttgtgtgtgtgtttgtgtgtgtgtttatgcattgggatcaaaccaagggccttgcccatgtgaaacaaagtcctccaccagcaaggtacatctaagtcctggactaaactttaaagtaaaattttagtccagtcccagtggtgcaggcctttaatcccagcactccagaggcagaggcaagcagatctgtgagttcaagactgcctgatgtacagagtgagttccaggctagtcagagctgcacagtgagaccctgcctcaaaagaaattgcatttaattattattactatttacactctgtcattttcctatatgtattttgctgtaagccatcttaaatccttgatgggatggggtggctcagtgtgttctctttccatcaatagacgtggtagctcttacagtggtagctcttatagtattgctttctcatgtgtctcaccagcatgctctcagatatgatgttcctggtctgtaaccattgttgcaacattttattcaagtccatagtatttcattttaagttttagttcttttgggaatttagtctacaaaattatctttttgtgtatatgatactgggaatgggcctgtggctcatgagcactaggcaagtgtgctctacctctgagctgtattctcagcactcaaattatgttatgtaagtgttaccagatcgagtctggctgctcaccccatgctgggcagataaagttaagagatgtggtactgagggaagagggtgattttattcacaaaccttcgtagaaaggaaggatgggggtgtttggagcctgctcgctggggagctaacttggggtcagtttacactagtgggtgatggctgaccttgggcactctctcgcggtgcgtgggccagagaatgcgcagctctttgctttgtcttgtgttttcatttcttcatgtctcagaaacagagcagtgtttccttggactttacttttcaaattagttccacagcacacagggaaatgactcccggggtggagaggtcctgagccctcccccccccttgtgtaatgagcgaactaggcttcatgatcacgcccccaaccgatagttcaagtggagccttgtcactttactgcacaaacttctctagctctaacacgagaattctctgaggactctcaggaatcgcaaccggtttcctccagccctccccccacctcattctgagaccattatccagtcatttgacttaagacaacaagttattgattgtccttattatcttttcctcattccatggcaaatctgtttccaagtgttggaagttctttccccctcagaaaccttctaaagggtcagttttccttacctctctccaccttcagacactgccctggtgcacacccccacctctccctgccttggtatacacacacacaaaactgtcactgcctttgtgcacacttctcttatgtatttcataggcacattactcaatgatgtccaggttaattgttgagtttttttgtttgttttgtttttgttttttggtatgaggtgctgggtaggctcttatacccatggtagccatggtagccgcatttaaatattgatatagttggcctttgaagatttcatttactctctctcatttatttgttgacacggtctcatgcagcccgggctagtctcgaactcactatgtagctcaggctgggtttgaactccttatcccctggcctctatctcccatgaggtgggggtgtcggtgatgctaccacatctgcctctaaagtggcttgtgtttccctgcttttaaatacgttttacttatttactatacgtgttgtgtttacgttttacttatttactatacgtgttgtgtttaggcttacggatgtagtgatgtgtgtggttcggtgatgtatatgtggaggtcagaggtcgcctccctgttgtcagttctcgccttccatatgtgggaggtggctttagacttgtaatcctgctgctccttaagtgctagggtcacaggtgtgggacacaccaggctctctcctcttctccctgcctccattccagctgcctgatcttttggaagcaaacctaaggatattgcagttctgtttctcctgccgaaattttcatcggcctccatcacgcagggcaagcatcctacgttaggatgcacaggggcagagcaacaggtaaatgggggtaaggaagaagggctgtggcaagctgtcccaacagtggtggttcctcactttgggtttctatccggggatatggacccagatctccatattgttccgtttttcagaagaagccagaaatacagatttttgtgagatatgactttggtgattaggtattaccttttttggttgagttttaggaacaaaaaggttagagtctgctgttgtggaacatgcctataattccagcacttaaaagctggaggcagaaggagccagagttgaaggccagtcttcataacacagtgagttagaggctggcccagctactagaaaccatgactcaaaaaaacaaacaagacagatgccaaaatttccaccaacttgaattttttggaatatatttcatcttattactcttgtttggttggttagttgtttttgtttttcttttgaggcaaggtattctaggctggtcttgaactcagtatgtagtctacattttggatcctcctgcccccacctcctaagtgttgacattactggcatttgctaccatgccccacttactcagtgctagggattgaagatgggacttgatcatgtaagcaagcactctgcctcccgaggcacatcctcaggcctagccctggactcagtctttaaatgctgttgcctcttctgtaaacataatcactacttccctcactgtgcctcaaagcctggcaaaattacaattgtcaagagtcacaataacccttactgaccctgaaaaggtggtttgtagacctccagcttatacctcacgctccatccaaagctttggttttgagcaaaaccattaattattcctcgtggcaatcctgacacttagaagttagaacacttcttgtcagatactgaataagttgattcagaatatgctaattttcattgttttgtttgcttggttttggttttataggttttatgattttgttttgtttttgaaacagggtttctctatgtaatggagccctggctgtcctagactcactctgtagaccaggctggccttgaactcacagaagcctacctgtctctgtcattgcctttgtgccccacactctacctgagtgctgggattaaaggtgtgtgccaccacttctggctctgattttgttttttttttttttatttaaaaaaaaaaaaagtcagggtctcactgtagccctgactggcctggaactcattatgtagaccaggtaggctggaggcatctgctaggtctataggtgttcatgttcaccaccacactcatgatcaccacaaccctcagttcaggtcctttatttaaaaaaaaatgcttacactttctttttttcctattgagggtgctgtatgatgcaagtaattgaatcactgaagtttagagtcaacttctgttcatgaagtgggttgcccatcaaggatgctctccgtcccacatcagtgtgtcccgattttcctcactgtgtttttttatatatatataaatttattatgctagttctttcctgattattttgtgtttgtgttgctattctctatggggatctctctggagtactgctaacttttaagatgaatggttagttgtaataactggagatggcctgtctgtctgaatagaaaatcatagctacaaagtgatgtgttatggagctccatcatttcatgtttaatacaaataaaagtatttttggtatttcttcattagagttagttgttagcttcactctattcttacttgttggaagctgaagacttgataaagtgactcagtcttttaatatcttcacaccttgcatgattgattgcattcaatgtttttataatattgaaacatccttaaatttataataaatcagctctgtgtgactatggcatatactcttggcatttttttttttctgtttgcaattcactgagattcataaataaaactcatttgtatcttatggtatgtatagtgattttctttttaatttttttggtttatgagcaaagtataaattttattttaagtagcagagtttctgtaaattgattgattagttatttgtttgactttttattcagggactcactctgtagcccaggctagactggaattcctgatcctttggcctcacactctcaggggctgggatcacaggtgtggccatcactccctgctccgttttcattttaaaatgcatttatttatttatttatttatttatttatttatttaatgcatatgagtatactgtcactatcttcagatacaccaaaagagggttttggattctattacagatggttgtgagccaccatgttgttgctgggaattgaactcaggacctctggaagagcagtcagtgctcttacccactgagccaactctccagcccccaatgtatgtatttttattgcatgtgcatgaatatttgaatgagtt

SEQ ID NO: 31135 - DNA, 2347 bp, Mus musculus
gattgagtatatggagttagagaaagagaaaggatgcataattagttagaaaggatgtataccatgctgaaaccattctgttgctatttaggaccaaaacattttcagacagtaggtaggcttttacattcccttgctccgttacctaacgacttaaaccagttccttgcttcccccatccctacacattgttcctaagtctgattttacctccccaataccagccagtatcaggtgttcttatagtccttggcgcctttgcatctaattcattggttctagacgaactattctgtcagtttttaccacctagtaggcaatacctgttttgtctaatattcaaagtgcaattcgcgtctagattatccacacaatttcactaattgaaaaatatcaaatttactattataatgtaagagagaaatataggtcataacttcggcacgactttaagtactaagcaataatggagtcgtcagacgcctccgcttaccgtgaaccagtatgagcttgggagaaaggaactggaagaacatgaaaaagcaggggcatgtgtagacattagtgaaaattaacaatgcacgttatttgcaaatgtcagcaattatctgtacatggtaagaacgaaaaataccttcattgaaataaagctacagcacaagacaacttacagattgtgaaacagcgagaatgaagagctacattcttgcagacgagctgtaggtcgtacacgaatgtctaaagagacattcaaaactcgaatagggtgcagagtaatttcttactgtgaggaattgcccaatgtatggaaagatgcatagttggctctcacatgctaaatgccagtagcgccctccttcgcttgaagtcatgacaaccacagtccctactagacctgttcatctttttttttttttttttttttttttttggtgtttttgagacagggtttctctgcgtagtcctagctgtcctggaactcactttgtagaccaggctggcctcgaactcagaaatccgcctgcctctgcctcccgagtgctgggattaaaggcgtgcgccaccacgcccggctctgttcatccttttaaaggtagatcttttataacatcctttgccaccttgagatgatttataggtaatataatctacatttgagtttattcagacttaatttagtgccctacttgtgttataatggaaacttagaaggtcagaactctgtaatggacataaactgttaagtactcaggcatgactacgctatcagctacgaaacatgttaactctcactaggaatagctttggcttaagagtccagcaggggcaacttcctgagatgaatgaagtacaggaaaatgaaagattagagggatgtgtgacggaatacagtattagggttcaccatagcagactctgcgctttatctgtctatggtgaaggatagggcgcaatcactttaattgtaatgatagataaataagacaggacaaactacagtttgtctcagaggaatccaaggattctttttcagacaagttgtaggtcccgcatacatgtccaccaggacattagacagtcgtaaagatgcagaacgaacagtttgtgtgtgggactgacccacccacacacagcagggcacttgttctgcctcaggctgcatctactcagtgccgttaataaactttagatacaaaccaacaaccaccattctccagtatactacagtgggaatcactgatctagttaacggcagcactcttggattaattcaattgttatttctactctttaacaacagaataagccagatccttgactctcaagcccccagtttttaaaaacaaggtgttccttgatttataatccttcttgtttatgctgtgttctttgatttataatccttgtttgctcaataaaaagaaaaaataatttgattcatttgccctcatttggtctgtttatggttctttctttttctaaaatttatttattttatgtatgagtacactgtaactgtcttcagactcaccagaagagggcgccagatccagatccctggatcccattacagatggttgggagccaccatgcagctgctgggaactgaactcaggacctctggaagagcagtcagtgctcttaaccactgagccatctctctagaacaagcaagcaaacaaacaaacaaacaaacaatccactactgacagcagaccgaaaggcaagacaggcatggcgacagctaaggctgcagtggattggcacagctttggattacaaacttcgggagaggtgttagaagccataaacacacttttcctcctctcttggtggtaataatgtt

SEQ ID NO: 31136 - DNA, 1149 bp, Mus musculus
ttctctctgggtttctctttccagctccccacccacatcgcagaggcggggcacacagggacagaagcaaaagcagagaccgcttccatcacaacagtctagaggttctctcaacggtctcacctctgggatctggtccccctagcccagatgtcaccggctgtaaggatcccctggaggatgtgtctgcagatgtcacccagaagttcaagtacctggggactcaggaccgtgcacagctttcctccgtctcatctaaggccgctggtgtccgaggacccagtcaaatgagagcaagccaggagtttttggaggatggggatccagatggcttgttttctaggaatcgttctgattcgtccacaagtcgaacctctgctgctggctttcctctcgttgcggcacaaagaaatgaagctggggccatgaaaatgggcatgccttcaggacaccacgtcgaggtcaagggcaagaacgaggacattgatcgcgtcccgtttttaaatagttatattgatggggtaacaatggaagaagcaacagtctcaggaattctaggtaaaagggccacagacaacggtctggaagaaatgatactatctagcaaccatcagaagagtgtggctaagacccaggatccccagaccgctggcagaatcactgacagtggccaagacacggcattcctgcatagtaaatatgaagaaaacccagcgtggccaggtacatctacccataacggcccaaatggctttagtcaaattatggatgaaacgcctaatgtctctaaaagtagtcccactggttttggcataaaatcagcagtcactggaggaaaagaagcagtctattctggagttcagagtctgagaagccatgtcctggctatgcctggggagaccactactcctgtacagggcagcaataggctgcctccgtcacctctgtcttcttccacaagccacagagttgcagcctctgggagccctggcaagagctccacccatgcctctgtgagcccagccagtgagccctcgaggatgatgatgatgatgtcagaccctgctgagtgtaagtcgcctaggggactccctgggcttgagtgcatagggaaagacaaacacaacaccacggcactgaatcgcctac

SEQ ID NO: 31137 - DNA, 1166 bp, Mus musculus
taaggtggtggcgagcattgacgacactcggcggagagtcccgcttacaggaagcgctcaccaggtctgctctttccggggctgggtggggctgatttgaggacgcctctagtgggccccccaggatgcgtcactctcctcaggctcatcaaaactccacccgagcctcacgaacgtccttacttcctctcttcctggtagcagccttgcagtcccgagctcgggggacctcacgtctagcctggaaccgagggtaccgcgccgcggcggacctgcccgcctaacgtcgctcgcttcccattcgctctcccgcgcggctgactttaaatctgaccccaggacctcgtcgtcgaggtcgggcctcgcgacaccaccgccggagttggaaagcgaaaccgctctgctctgcgagcggcaccgcccgcgtccgcccctgggaccgcgcgtaagtttcgattctccgtgaagccgagtcccgcgcagcggccggagcagcggcagccatagcgcgccatgacggatcccgaggtattctgtttcatcaccaagatcctgtgcgctcacgggggccgcatgaccctggaggaactgctgggtgagatcagcctccccgaagcgcaactctacgagctgctgaaggcagcagggcccgatcgctttgtgctattggagactggagaccaggccgggatcactcggtcggtggtggctactactcgagcccgcgtctgccgtcgcaagtactgccagagaccctgcgacagcctgcacctttgcaagcttaatctgctcggccggtgccactatgcacagtcccagcggtgagtgcagcgggaatggggaaggttctctaattgcctagtccggcgccgcggggcagcttcctaggggaggcgggaaccgggtggatatggctcactcggctgcaaaccccttctccctctatccctcctaatctctagaccagtggttctcagccttcctaatgctgcgaccctttaatacagttcctcaggtttgtgaccctcaaccataaaattattttcgttactactccgtaactgtaattttgctactgttatgaaatgtaatgcaagtatctgtgttttccaatggtcatattcgactcctgtgaagttagacccccaggttgaaaaatctgtagc

SEQ ID NO: 31138 - DNA, 1925 bp, Mus musculus
agtagtagttagttagcttatgagaccactctctgtgagtagcttgttacgttgagacaagctgagtatatggttttaaaaaggtgagtgaaaggaaaaacttggcatctctgaaggtgtgtaagtctcagagttaggtctcccttgtattttaggaaacaaagccagggcagggttcttactatcttctgaatgaacagcaattttgaacataggactgggaaagttttcatgaaatatatatatatgtatattttttctgagacagggtttctctgtgtagccttggctgtcatggaactcactctgtagactaggctggccttgaactcggagatccgcctgcctctgcctcccgagtgctcgtatcaaagatgtgtgcaccactgctcagcatacgtacctgtttatattgcgcacacatgaacacatcgtagggatttattgatacaagtataaagcaggtcctttgaagagacctcctaatggctagcctctccatcatatctcagcctcgtgtctctgagctgtcatcacataaacttcttttttctacaacaaagtattgtcaggcttccatcctactttcagaaaacagacatacatctttttgtgtatcagattacctgcttgtttgtatgctctgtaattttcttctgtaggtctgaggtacacaagctagaacatacagacccatcctcatagagcagggactgcacagaggaggaggtggaggaatttttagaaacaccattaattcttcttccttcccagcctcctgctgcagatggcagatgggagttctgcacagaaaggagagggaaacctgtacagagtaaaacagctgaagcaacaggaccagaggctgaacacagccttcatctctagccagtcccaaggtgttcctcagctctgtatctctgagtcctgggacaagtcttcccgagaagatggccagtgtgccatcttttacattaggatcagatatgattgggccaaagcacaaaacacagtactggtctaacagaactgcaggaaacaaaactgcaccatttccttatgccagagcttcttgtcttgttctggtgttccctctttttcagtagcacctggttctctttgccaaaggtactaggtggatcagatatgactaaacctgctatagttctgtgaatcattcttatgaaacttattttgctttaaatacttggaagcaaaagagtgggatgcagatcaactcctgggagctgttgacatcttcagtgacacactgttcagttccagcttcctgaaagacactcattcacagtcatggacttcccagtgagacattgtgagtttactacttagtagtctctgacattttccttgagagaagacggtctgtccccaacagcagaattttagattactgttaaaagtttttaatctacaggattgagacagaaacatgaaggcttgttaaagagaagcacattcaattctgttaggagggataattgtttctgattgtcttgacagggcatcaagttcgtactgtgttctctcacagatgacagcctggaaaagaagggcttggctggggaatgtgtaatttatacagtctatcatagcaatgtactatttaaaaatagtctgtagtgtatacttaaaaatggaaaaaacacttttacaactatttttgtacaacaaaagaatcacataccactgtactatatttaaattaaaatttattttttggtttttgtcatgtgtgttcatgtttatgcagctgtgttcacgtgtagaggttagaggtcaaactgagtgtcttatctctttccaccttatattttatgaaacatgcctggaaagttaaggtatatgcatatgctagataccatgactacacatttgccaaatctagtggaattatatttaaaata

SEQ ID NO: 31139 - DNA, 1166 bp, Mus musculus
tataaggagtgtgagtgtgaattcctgtcattatccagatgttgaagctgctaacgtgaaagtataatttaataagaaactaagaaaataactttgttctgccatctcccacatgattcttttaattatttcacttatttacataggggattaacttttaaaatgacaaagcctaactaatcttttttttccttcacagagttgtggctctcaattcacacaagtctgaaaaaaagaaaaagcggtataaagattccctttctctggctgccatgatacggaaatttcaaaaagagaaggatgcattgaagaaggaatctacccctaaagtcccagtgaccccatcatcttcctctctgcctaagcccccttgtgtcacaacagcccttggggatgacatcccggacttaggtctgaacagtgctgacccagacctccctatttttgttagcacaaatgaacatgaactgtttcaggaagctgaaaatgccctagagatgctagatgattttgactttgacagattactggatgctacttctgacggaagtcccctctctgagtcagggggagaaaatggaaataccacccatcccaccttcccctctcaggttgtgcccaaggtggtacctacacttccagagggtctacccgtgcttcttgagaaacgcattgaggaccttcgtgtagtaagtgtaatgatgcttttgctttttatttgctacacaaactcttagtctgtagttttaagacaaaaacagcccacagtctcaacttgctgttttccataatctgttttagatgctggctatgtacatagatgcattatggaaatgtacctgaagttacttggtggaagctattttaacatgtagctgttttattttattatatatttttccaattccaagggatcaaatcctgggtttcatataacctagtcaagagtcctgccaccatgttggacaggagtggagagaacaggcattcttgtcttgttcctgatttttgtggaaatgctttcagtttatctctttttaacatagttggctgtggatttgttgtcttttactactattatgttgagatctgtctcctgtatccctagtttctgaaattagaggcttttgccaccatgcctggtctgttattgctgttgctacata

SEQ ID NO: 31140 - DNA, 1276 bp, Mus musculus
ggcatatgatttttatatcagtacttgggaggcagaggcacatatatctttgtgagttcaaggtcagcctagtctacagaaggagtaccaaaacaggcaaagctataaacagacctatatcagaacaaacaaaataaccaaaaattaataattttagtcatcataagaatttcttagccttttaaaaactaaatttaaaatttgtaaattaactgtatttttttttctaatataatgctacttatgctaggaatgtagccccaaaaaagaccccaaagctcctgcatccgtggtggcttcaggtggcggtccttccacgagctccagcacatccatcgttgcctcagccagctctagctcagcaccagcccaagaaaccatctgccttgatgactccctcgatgaagacctttctttcccctcagcctcactggatcttgtatctgaagctctagctgtcatcaacaatgggaacaagggcccctcagttggttcaaggctaaatgtgccaactacaaaacctcgtccaggactgagagaagaaaagctagcaagtatcatgagtaagttaccactggctactcccaaaaaactagattctactcagactgctcactcatcaagtcttattgctggtcacacggggccagtaccaaagaaaccccaggatttagctcatactggtatttcttcaggccttattgctggttcttcaattcagaaccctaaagtttccttagaacctttgccagccaggctactccagcaaggactgcaaaggtcaagccagatacatgcttcttcctcttcacagactcatgtctcctcctcccaagcccaagctgctgcctcctctcatgctctgggaacatcagaggcccaagatgcttcttcgttaacacaagtcacaaaggtgcaccagcactcagctgtccagcagaactatgtgtctccattgcaagccaccattagtaaatcacagaccaacccagtggtgaaattaagtaataacccccaactttcctgttcgtcccaactactcaagacttcagataagccactgatgtatcgcctccctttgtctaccccatcacctggaaatggttctcaggggccccaccccctagtttctaggacagcaccgagtaccactacctccagtaactatttagccaaggctatggtgtcacaaatctccacgcagggtttcaaatctcccttctcaatggctgcatctcccaaacttgccgcatctcccaaacctgccacatctccc

SEQ ID NO: 31141 - DNA, 1199 bp, Mus musculus
agggagcactaggtgaggacagcagtgcaggccttgtgccagaggtgtgaacctgcagagtcccagtggaagtggctggaatgacttcctagtgactcgcggagaagcagagaaggggaaatgtaggttttggactttgagacttaccagcaagaatgggcattgaacatctaagccgcagactacagtactgacaaacgagctgtgtacacagaaatactcaactatcacttgcaaactttcagaaccattattagtaactctttggattatatttttcacctcagtcttaatttccttgatttgttagaacaaataaagagacagtcttgcatccatgaatatgttaaatcaatttagggacattgctttatttcttatctgttttgacccctggtttctacacagtccacagcaggagcatcattattggctaatgcctcacctctgactctcatgacatcacctttgtctgtaacaaatcaaactgtgactccttttgggatgctgggtggccttgttccagtgaccatgcccttccagtttcccttggagctacttggctttggaacggacacagctggagtgacagccacctcgggatctacctcagcggctctccatcacagcctaacccagagtaagtgctgctctactttaaatgggatgaaccatctaataccatattgctattgaaatgcaacatgtaagagaaagtcaaagtttgggggtttcttattataatcatgactgtatctccataagttaatgttttaagtatgtgtgctgtgatattagaaagcccttggcgctgggacttacactggtgttagctaaggcattatttctaagtttgatccaaggggttcacatcttgagatcactgaccagtgtgttttcctctcagatttactaaagagtttacagccaggagctcagcacgcggcagcccttcctcactctcctctgcctgctcacttacagcaagcgtttaacggtaagcaagctgctcattcctactgtctataagagtttagagatgctgcgtaaatgttcctcaagtggggggagtggagtgacaaaacgccagggaagtgtttcctttgactgcctcctcagtggagtggagtgacacaacaccagggaagtgtttcctttgactgccttctcagtggcagcagcacgttgaagaaaaagga

SEQ ID NO: 31142 - DNA, 1102 bp, Mus musculus
aatcctagaattcaggaagctgaggcaggaagatctcaggtttgaggccagcctgaagtatttagcagcaagtcccatgctagtctctactggactaacaatgagagctgtctgtttccaactgtcttattgtcttttaatgttcaattaattaaaaatctattggacttccatatcaggtgtccctgacagcaagttcttcaatgtcacttgctgccatatgaaaataatctttaaaaagttcataaagttcttcaaaaaactggggccccttgctccaggctccttcgcgcctcttctccttccggtttggtgcagaatgggttgtgagctgtgtttttttctttttgtcctcttttgttactaacatttttctttttctttttttcctttttcttttttaaaataaaaagcatagatttcccctccttacccctccttttacaatggtctcttctccgctctaagtcctcccacttcctagttcaagtttcatttgtgccccgactgcccccctccctgccccattgcattgtttgtgtgcggcacctgcagtagaaaatcccagctctccaggtcggtctgggagctcctccaccctcctcctgtctcaaaaaagaaaaagaaaaaaaaagagagagaaaagaaaaaaggaaaacaaacgaaagtaatcactgatataatttcttgactgtagaaatttactttaccaataaaacaaatgaggaggctatgtaagccccagtagatattttggaaagatattgggatgttgcagagaagtttgacttgaatttagcacgttaaggttcatttgaaaggtctcttagagaaacttgatcagctcttacgccagcaccaggaaacttcgtttcacaggcctgcttatacttcataaattgctgtactggggtgtctgttgaggaaggcagcctgtacttcattttctctacccagagagaagtccatgtgtgttagtgtctcttcttgctgatacttgtgtatttgtgtatttgcagacacatacatattcatataaatcaatcgatattaaaagtcaaacaataattgtaggttcttaaatccatcgattctgaaccat

SEQ ID NO: 31143 - DNA, 1377 bp, Mus musculus
cagcacacgtaggtcccattcgatggggtccttgattcaggaatattaaactgtctgtttccaactgtcttatctttgaaattgccttcactgatgtgatgtctaagctgttactgtatataaaggtgatcctcagtattcacaagcaataacagtcagcagcgctgtcctcgggcagcagtgctggaccacagctggagactgtttgcgagccaagtgtcatgctcactcagagcctccaaagtaaatgcaagcaataatctctactaaaatcaaattatagttcttctcctgcttctgagaacaaagagtgaaaatcatgattttaaaacaatctggagaaaaggtttggagaaaagaagccaagttaatgtataataacaaagtcctgatattttgaagaaatcaagaagattcaattagtacattctttcatgcccaccacccctttgatggatgttattagcccaaattatcttgttttgtgtcataaacaataaataaggcttatttgggtcccagcactggggaaagaactgggcatatacctgtgggtatatattgactgtgggtttgacacctgcttggaaacagcttattgaaagtgatcttaatccagaatattttttcccaaagcagatctaaattgtttactatgcagagatggaaagggtaggcacccctattctctctcctcttgttgtcctctcccacagcccttcccacctctccttgattcaagactttctaaaatgaaaatcctactgttattgcgactgccattggttatgagaactctgttctttgggaatgtctctagaactcattgtcctacttgctgctacattggaagatgatctttgcctgtgttggctgactttaactgctttatttgtaggagactttgtcatgtcctttgaccctgtgtagaagaactagggtactttactttaggagtgtactataaaagcacactggtcctcgtattgttagagaagtttgggatttgttccccttgttggtttttgttttgttttatttttcaaattgaaagtagaagaaagaagtctatagtccaggccggacttgagcactgccctgtgcttcagcacggtgcttctgctgacccacgttctctgaagggcactttgatttctagttgtgcatgtgcggctctttgtttggttttgctttcagggtgcttttggttttgtaaaaacaaagcagagaaaagtacagtagtagataaatgatcacaaacatgttatgcaattttattttataaagttttaagggaaaagtttatctcgttgtaaataagttcttatctctggtaaaatgcttatattactcctctaaaccatgctcaattcaggc

SEQ ID NO: 31144 - DNA, 1201 bp, Mus musculus
attcagatgggcagattgggaagtagtctttgcacatgatgctggcttccctttctgaatatctgtagaagttaatatatatgtgtgtgtgtgtgtgtgtgtgtgtgtgtgtgtgtgtgtgtgtatatatatatatatgtagggcattatatatataaagcatatgtgttggttattgcaaacataataaactctgtggactccttgactatttctggatgtaatccacttctctctacccctcaaatctttcagtagtagtgtgtgagaaagcatcaggataacaagagcatttgttggtcgaggtgatacgatgccctatgcagacaagattcagtactagtgctagaaccatggggtggtgtctgaatacactttggaggaggttggcactcatgtcaatattaaaagacgttttcttctggaaaatgatcttgaaattgtatatctgaaacgtcaataaacttagatttttagacagtgaggaaacacttgtataatcaggacgtacttgagaaatgttcagtctgtttattgccagatgatcagatttgctctgatttcatgattgtttaaatgtctttcctgagcaaaataaaataactttcagtatctaagacttgaggggggggttctgttttgtttttgtttttagatgtaacatgttgaaaaagactaagttgaactgatcctctgtatatctacaaaggacccccttttaagtaaaattttagttgaaaaaggagacttgtggctaaaagaagaggttcctgtagcaaagctgttgttagccagcttaggatcagtagtgagtgttaattcctaaactactttatctagggggaagtcatttaacctttgtgcctcagattacccatgagacaattgggtataataataatcacctacctcccagggatatcagagactttactatttcaaaaatattttgtttttctaaaacattctatataattatagtattatcttcctgcagaggttgaaaaaaacaaatgtttttcttatagtggatataaagagcaccctatggtctttaagttaaaaaaaatcactggaattttaatttagatgtatatttgatatttaaacataccatatttgttgtgtggtataattattagtttcagattaaatcaaaggggaatgaacactaagtttcttaactatcaatagatttttt

SEQ ID NO: 31145 - DNA, 2737 bp, Mus musculus
cttcatttctttcagtcttcagtcttgcctttggtgtgagctcttaagttcccacttgctccactacagtataaattacctgttgttatatctagggagagaaagtgaattgtttccatatcctcttctcccttactttgccatctgctctcagttcccatcaagttagtgtaaagatagtgtggggagagtttcatcttagtggaggatacatatatatatagagagagtttagtggaaatacctttgagtagcctgatgctaaatgacacttttcttatgcacactcaacgtaccatttgctttaaggtggctatttgtgatctccttgtgttgtgatgtttctacttgtctgtctttcctatgtatttccatttcatagcagctagtattcaaactttgtatacattttacactgctacccaaactagtcagtgacgtgttttgaagttttcatggtacaaattaaggttctatacatagtgtagaacttggtggtcactgatgactggggtttcttctcttttcatttatattcaataaataaatagatttcataggctgagagtctgtctcactgggcactcttgcccagcatgtacgtaagctagagctccacacagcagtgcacagtaacagtaagtagacttcatttttacatagcctgggataccagtgtattttacatagcctgggataccagtgtattttacatagcctgggataccagtgtattttacatagcctgggataccagtgtattttaagattcttcagaagaaatgcagattttcattaggggctcacagcagtctgccttgctgactgttttcatacagactccttacaacagagctcttttgccaaggtctgagccaaccagatcattgaatcctagttaggacctaagtcctaattttaggttcctcaaaagaaaaacattacttgccccgactttgctacaatattctggatttgtttgtttgtttgtttgctaaatctggttgttagatccttgttaatagtgctctggttagaattcagttaaggttatttgtctgagataacacgagagtcagcagcagtccagactagccactgtgtgtgtgataatctgtgctgaagtttccacaccagattgtattttctgtacttagaaccatagactttcctcctgttatacttatctctgctgtttacagaaacgttatgccctactagaaaattcactagcaaaattaccaaggatttgcccccatttgggctagaaatataaaaagaaaaaaaatatttttcttagttgacaaaagtatttggtttaaatagttagaaagttgagccagctttggtcagttttcctggcattttggctctgactccatcatagattgcgtgtacactttgacatgtgttcatcagggaccctctcccagtaaagattggttttcctcccacacagctttcaggacagagagccaagcttttcagtgacctgttttcagctgtctttgaaagactatcttattctagaaaatgctggcgtgctaaactgttcttggaagagagtgtgctagtttgaccctcctcatggtgtctcttgtcctgttaaacttatcagacttcaaggaaaggaagagaaatctctggtgaattttgtgccccaaataatgaacttaagtctaaccaaggtgactaagagatgggtgttttctctctctactcgtgagcaaggtttatttatggttgtaagacttaccatggaactgcagacctatttgcccagaaaataagagtcagaattttagtcatgttaagcacagatttcgaaccctttggtaaagttagataaggggagacttttgtttagtagcagaaggaaaaataattatttatacagtgagtatccaccctgcaaagccacttcccagtatggaagcagctcctctttagtcccttctgccctacacagatgctaccatgtttgcaagccagtctccaagaaggagccgaggagttgatggtcctttagaggagaggcctcagttactgggttgcatctgcttgtaggaaagtgtgtttgctaacttgaaggaatatatgctgtacttcaaataagtgtgtgacttaatgctttgggattttttttccctctaaaactggacctgaacacagctttgagttggtatttgtaataatctcaggacccgaaagattgtagcatttagtgtgtcttaaaaattatgtactgtaccagccatggagttttgtaaatatacctgtctccctttttttgtattattttagtaaacaataaataaataaataaatttaataaaagggggtgatgatgatgtgtgtgtttgtgtgtgtgtgtgactgactctgtgtgtgtgtgtgtgtgtgtgtgtgtgtgtggctcttttggaggcaaactggtgcttgttgaatttctagttcagttcagcaggaatatagacaaactgctgctgttgacccttacaatgagcaaggaggaggtccttcattttgccctctggtggttcatgtagtactagcaaaatggaagtcaggagctaaactcttctcctctggccatattgcctttgtgttcttggtctagctccaacattctttgacctctggcattaaagcttccacactttgaagattcctggttttagagctcttaaaactttcctaagagagagagagagagaaaaagggggggctgattata

SEQ ID NO: 31146 - DNA, 1130 bp, Mus musculus
cgaaaaacaacaataaacaaacagaaaaacaaaacaaaactagagaactggatgtgaggctttactagtaaaggggctgcagtttgccataccagggtatgagttcattttcttctcctaggctgcggggaccataaagttggaggtcggtacgtttaattttgacatccctggtagaaacagtaagatctttttggcgtgacctatgtccagacatccacatactctcctgccagacacctttcctcagagactcggcggccatcagcttacggcagtccaaagggacgcagtcagaagggccgagaggattcggcaccttcccttgctctcctggtcccctgaggtgcctgtcactcgcgtttccctccaagggtggtcggtagagggcgctgtggggcggagtgggcgggggaacacctcgcccgaggcagtgagggaccaggctctccaaggacagaaaaatggcggccctggggtccccggcgcgcactctgcggggccttctgagggagctgcgctacctgaacgcggccaccgggcggccatatcgcgacacagcggcctaccggtacctcgttaaggctttccgagcacatcgggtacggcatccgcggctgggtgggctccaggtcgcgggagggcggatgagggggcggtctgcgcaggtgatagagggtctcaggacaaacgtgtctgagtcaccctgtcctccacctgcgggtctcaccacagactccagcccttcggctaacctgcggtctgaaatcccctactggcccagaagccgcgtggggcgcaccttcctagggacttcgtatctgccacccaccggggtggagctgtctctgacgatttcattggtttgtctggtgcatggggtgtggaatggagtaaggagcgggcgttgtgtgaagtgggtcctaggggtcgtaagacttaaaggcgtaagggtacaagcatcccctctcctcatcctttctacattaaagttttaataggaagcagtgtttttgtgatttgacgggtgtgtgtgtgtgtgtgtgtgtaggtgtgtgtgcgcgcgcctgctcgcgcgcgtgcttttgcttgcttgcgtgttggtggggaatgaagatacagaatttcag

SEQ ID NO: 31147 - DNA, 1084 bp, Mus musculus
tagagctccagtcttgggcttttgttatctccagtcacaattttctctgggcttatacttgttaaatcagtattgttaaaaaaaaaaacaaaaacaaaatcaaaataaaaaaaaacacaaacaaaacaaaaacccgagcactctgattttgttcacttttgtttttatatgcaagaatctttacagtcaacatgtacttctaggtgctgtattgaaattgctggcagagtctattctatacaaactgaacaatctggccccttgttttatttgtaaaggttcaatgtatctatgcctgcctacttcaatctgcaagggagtttcagaaaggccccgcattcgccgagccgtgagttatcactaacttttcagatgtgttaatgaatgtggaacagaagcagttgtgtttaaaaggaagtaaaagaccaccaaagtatcctatattatagtagcaggcttgaacattaaatggattattccaaattgtgtcacaaataacctactagagactagcctcagaaaacctattgttgaactgctctgaagctatgattttaggaatattatcttaaaaatgtatgtgtcctagttgcaaattagaatgttctttaaatcttcttaatcaagttaaaacaatttgaacaaaatcttaccccacggtgtttagttggattaagttaaactctacaatataagacgacttgcaaggggtaaagttggaatttttgtttgtttgttattcacatgtgaaaatgtagaacttaatttaagaattacttcctagttgaaatgtttggagtgttctaggtatgtgaactgcagaagtttttacaatctcctttggtttgtttcagttgttttttgcttcagtaattcatcagtaggttttcctttaacagtgataccaatttaaggctaaactacattttttagggcacaccattctgcatagaggaaactacccttgtgagtttttcttttatttcttcagaaattctaagcaaaaaaaaaaaaattgtaactaacatttgtattttgttactctagttagctacctttcctttctctagagtctttaaacttt

SEQ ID NO: 31148 - DNA, 1207 bp, Mus musculus
taaatataaggtatgattagttaaattttgcctgctttatatcagttctttcaaatcttttgaattttttcaaaatctttatctagtgaatgtcctattttttagggtactatacaaaatgattgttcgtatattttgttttgtacatatgtaggttattggcaaaaaagcaaggttggctgagtcattttagtttctagatatacaagtaagtctcagattgctgtagaagatgctctaatttcgttgttacattagttggtttttgtttttctttggaggtagaaggaagacactgactgattactggcccctaacttgcagtcttcatgtctcagtgtttcaaatgctatgattgcaggaacgttccactaaatgtgtttgtaatactactacaattctgcttcctccacacctgcctctttcctccctcctttccttccccgatttgtcgtttgtctgtctgccatgagatcctctaacctgagactttttaagattaatttttcttttgtgagtttgttgtttttgttgtttttcttgagacagggtttctctgaatagctctggctgtcctggaactctctttgtagaccaggctggccttgaactcaggcagctgcctctgtctcccaagtgctgggattaaaggcgtgcgccaccaccacactgcatctgttgtattttatctgcatgtatatctgtgtaccacatgcatgcctggtgctggatgagggtgtcatagcaaaaagagggtgtcacacctcctgtaactatagttgcagatcattgttagctgccatgtcggtgctgagaacagaaccaagtcctgtgaaagagcaaccactgagccatctcatcagcccagaaaaatgtttctcatgaggatgcatttaaaatgaatctaatgagtggtaaacaacgcagctatggcagcaaatatctataaccctaacatctcaagagtatcaggctggagctggagagatggctcagtgatagcctgagttcagatccccaggattggtaggagagaatcagttcccacatgttggtctctgtcctccacatttactccatggcaagtgtctgtgcatgtgaacaaagaaaataaaatataataaaacaagaaaggccatcacattccaaaaagaatcatagttttcgtccccttctgccccccttttttggtttgtgtttttcctct

SEQ ID NO: 31149 - DNA, 1159 bp, Mus musculus
aaaccaaagattaagctgttatttttttgctttgtcaattccttactgacttcaaactattagaatattattttcatgacaattacagtagattgtatccagctatttttatctgtattatcgtagccaaagctacatagggatttggaaactatattattaactgctttgaacaaaaaacaagaaaccccccccaggattgtattagtaaaggaaaagaggatagtgggttggcaaatttaccaatgtatattaagaataccatttaaatgaaatgtatgagtacaaatcatctgagtcctgatgaagataacctttcatctgttgtcttggcatcacagggagatggaatgtaaaggatagtttaagccttgacctccaacagagctgccactcaaaggatttactatattttcttacattgttttaagaacatttgtgtgagcattgtttttcttccttttgtttaggaagtttatcggaactctatgccagcttccagcttccagcagcagaaacttcgtgtctgcgaggtctgctctgcgtatttaggtcttcatgacaatgacaggcgactggctgatcattttgggggtaaattgcacctgggatttattgaaataagagagaagctggaagaattaaaggtacattgtttaaattaatgcccctcactttatcttgcgtaacctgattcttttggtctgtattggttttttttcttttttctttttcccctcggtttcattgataaggctttggcttcttcttcttttttttttttttttttgcacctctggctgatcttgaacttctggtagtcctcttgtctcagtctccctgtactgtaattagttaggctttgaatggtattgtttattctgatttggcggtattgagactctgttgacaatgtagtataataccattattattaattacattattaaatgtcattgaggaatgatgtgggtgggactagagtttagtagcatacttgcttttcctgcttgtaaaaaaatcgtcgtggtgaaacaagaggttttgcatgttttctacaattctggaaaaacaattctagaagtctaataattgtagcacctcacaaaattttaaattatattaatgctaattgtactatgtgggaagccagatatgg

SEQ ID NO: 31150 - DNA, 1089 bp, Mus musculus
taatccacagtataaatcatacattttcatgttcacctttagtgtaatgggaatattctgagtttggaggaagctacaaaacaccttagtatagcaggaaacttcaaaagatgcaatgagagcagacattaattatatagtgagagctaacaaagggttagaatatagtggagctgtttaattcccaaaattcaggtcacataatcctatggagcataaactatacttaaaattactttttccctccttgacaactattattaggtaaatataggagaaaaactcggaaaccctagttactagtcttaaattttctttggcttactccacataaattaaacccacagaaagctgacaaaatctttgttagactgagttaccctttccctgaaatcacaagctgagtttcttaataggctttcaatcagctttttattttgtgtatttctgtctatgttcttagtagcccttaaagtgatttttaactaggtagggatttgtgtgtgtgtgtgtgtgtgtgtgtccttgtgtctctgtgtgtgtctgttggggggagggcttgcgggagaggtcaggaggccaagctcttgagtagctcaaattgacctcatattcatcctttagcctcagcttcctcttgagtgctgggattataggtatatgacaccctgcctggctttatgaattagatactttcctctgtgctaggcttgttaaaaaatagccaagtaatagtagtgtatataaacaaccatttttatgttgctctatggagttttctgtgtgggagaatacttagccacagattataaagtgataaactgaatatcataggataaataacataaatttagatgaggaaaattttcagaaagattctttaaaactggtttgaggtaatggatcaggcttgaataactggttgtaattaaacaagtatggaaatacctgtaggcttcttacatttcaaaactgggtttgtcctcagtgcagtggccagaaacattttttttttggtagtgttctttatgattctaaatctgcacactaaatctgagaatcgggtggtttaggcaataaaggatctag

SEQ ID NO: 31151 - DNA, 1173 bp, Mus musculus
tgtgagtttagtttttgatggtaaaaaaagtccattaaaagtcttggcagtttgctgttttcttgcccttgctgtgaagtacttatatctctgttactacaagtaggttgtctatatgaaccttgtcttggcaacagttcccataggtcagtgaggaccttcagcaattttgtgcttttgggggtgttctgtcctatagtagacttcaaagtcacactacttgggttcagaattctttgccaaataatttaattacatcccgttgtttttccatatttcattagagataatagagacatttggcttattaggctttcactagtaacaagtaacaaatggtgtgtaggaggatatttgtaatcttgtacaaacattagttcatgtctttgttctttttcagttatcactgacctcagggacttgccagcatctaatgtcatgttcttagtgatcatttctatcattaatagaagctttgaagatggcttgtgtagacttggaatgtggttattattatttttccttgtataatgcttattaagcaggggctcctgaaatgataacttttgaggggctgaggctcaggaggcttgtcataaattgaggccagcttgggctagggagagagaacttgattccaaaaacaaaaggggaaaaaggcttatataacttcaagtagaatgcttgaaattggtgttgatttttcaagctttttaaatcttaatttctgttgccatagttttgtattacgacaaagtatttgaaaacaatttgtgggctggtgagatggctcagtgggtaagagcacccgactgctcttccgaaggtccgaagttcaaatcccagcaaccacatggtggctcacaaccatccgtaatgagatctgactccctcttctggagtgtctgaagacagctcagtgtacttatatacaataaaaataaataaatctttaaaaaaaataaataaagtgaaaagtttaaaaaaaaaaaaagaaaacaatttgtgagaaggaaggtctttatttttagctcacacttttgtgaagtgaaaatgagatttcagttcatggccacttttttgttgttgttttttttaagacagggtttctctgtatatccctggctgtcctggaactctgtagaccaggctggcctcgaactcagaaatccg

SEQ ID NO: 31152 - DNA, 1129 bp, Mus musculus
caatatacaaagccttataccaatgtaataaaatacacaaatgtaacaaagtataaccttaattttgtatcaatattcataaatccatattaatgtaagattatggctataagcagttttttggtttattcaggagtagatttagcaatctatctttcctattattcctgtaatagtcctatattcccccccttttctgttttcagcccttctccccctacataagaaaaaaaggataaaagaaaagggaaatcctcgaatttaacctcctataccatgttttctcactggtcaagaccatttagtaactgtaccaagccctttataataataagcatcctccactcataagaactaccaaaacatacccacatcagcttaatggaatgggactttgttatattaaaatggcttcctgtttatttggggcatagtatttctttcttggaggccaaggagatttggagaatggttagtcttaggaaagctagttgtagcatttgttgtccagtctctgtactctgagaaagtttaggcataagtgaaatcctgactgaatcagaatgtagatggatgaattgaggtcatctggggtcaacagctttctttgaagctattctggaagtcttttgaacaaacaacattgaggcagtttggggtagtatcaggtgtctcagtatccctaagggtgaatcttgtcaaggccactattttcagtgttatttttttgtggacatataatcttttacaaagttgtgtattaacatatgtatggaatgtgcaaggtgcacattgcaattagctaaggaccaatattcttttctctttatttgagcaggtaaaagacatctgtttttcttaggctaatttggattgtaaagaaatggcaatataaattctgtgccataaaagaatgccatggtaagccttaggatgttgtagctaacaatatttatagactatacacggatatttaagtctcagtcagtctcagagctgtttcatatagagagctcaacatatacattacctttttttaaatttccttttctgtggttgagatcctcaggagggtcaccccccccccccttacctgatttctatcaatttggaagaactccagggtttt

SEQ ID NO: 31153 - DNA, 3407 bp, Mus musculus
ctggtctagccttttttgaaatcatgtagccagcttgatcttgtgatttaaaagacaatgaattgttccctgtgggctgaaagtaaggattgacgcataccctggtcactgttgcctaagtgaattctgagaataaaattctcatcattacaccagaagtgaaaccaagaagagatgatgatgtctgcgtgtcataatcagcatgctgttcaagtgcacagagcatgtttctctaggtaacgtgccctctgagttctccactatcaagtaaatgacacaactgactgtagatactcatacagacttctggctacattttatagttaaagtattttatagtttacatttaatctggtactttttaaaaagaaaattgtttataactgacatcttcaaccacagcgattgactgactcttgttttagaagctgtctccccaaggcaggcatgttccactcatgctgtgccacagcctgatgcatgtgtttcccttattgttgctttccagtgaacctgaaagaatgtgaaaggaagtcaagagggaatgggaaagggcgagtcctgaacctgggccatccgcagagtccggtgccgtgtgcgccagagcttggaggggcggtgagactgatccccgccgcctcaccaacactgtcttgatatgaatgcttcctttgtgaccgggccactcacctggcagtaggtgatgccggcactcagcagctctgcaggtctggatgctgctcctgggtccgcagtgaaccttggtcagcattttgagagggagaacaatacccctgtgcccatgttcactggctggattttccacgtgttgctggttttgtcagtttttttttttctttaaaacaaaccccatgtaaaataatgtgtactttaattcacccattgcctggctaagatgtgaaactcagttcagaagatggcttcagagccaaagggcaggggtgggcagtgcgggatggtcctggagacagagggctttgcagggatggaagcaggcttcagagacatgagcaagagaagacaggaaatgtcaatttccctgacagttttgtaaggtttgggttgggtttttactggggtattttgttatgttgtgtctttacgacaggttcttaccatgtatccctggctggtctagaactcacaatgtgaactgggttttgtttggttttggttttctcttgtgccaccactgaactgtggaggacccgtggcgacctgtggtgactcctcaccgcccatgtttggtttgcgctcacagcatgctcttgtgtatgttgaatgtccttgtagaatgttgttctcacgcttcttagtcatatcctaggcgtgtgcgtgtgtgtgtgtgtgtgtgtgtgtgtgtgtgtgtgtgtgtgtgtgtgtgtgatttgctttgcactaataaaccaaatgaattttgtctcattgtctttgaagctaacccatgtttttaaaagtgagaggtatggaaatgggcttttcattattatttgaaaagtaaattcactgtagcataaaaataaaaagggctctgctgtcttctctttagttccctctcaaccaatttccaaatgactctcctggccccatccccacctctggctccccaccgcagatccatgctcaggcactcaggactcccagaaagctcagctctgggagccatgcccctgctcgctgcccgcctgcccgcccgcccgcccgcccggctgttggtccatggattgctcacgctgtcagtactctggctcaggttatgaggaaggacgtggaagttgaaagtgacttaactgtgccatcctctagctttctatgactctgacacacacacacacacacacacacacacacacacacacacacacacacaccatgtgcccttcaaagcagaagtcctattcacactgcctccaagtctgttggcttcctgccctccacatccctctcttgtgttactgcccatttaacgctggctttcttccatgggttacctaggacacaatcatttatagcccccaaagcacccttcacccctttaagtgtgtattttaaccaaatgaagttgacaagaaaggcatatgttggggctgcaggattcctagtgtagtagaagcattgtatagatagagatgttgatatatatgtttgtgtatatatatatcaagccaaatttctgatagaaaagtatagctttatggatgagaaggaaaaggagccctctagaggttggagccagcctcgatgtgtccaatgagcaagacacgccgtgcttcacgcgcagctaaggccccaggacccggccctggcctcacctctgcaaagctggggggccccgaaggctctgctgctctctgtgggtccccagcaatgaaggcataggagagtgaggagacagagatcataaggactggaatttttcatccctttttgctctggccacctgttttgagctacagcctgattatatcacatttccaaaaagtagtaccatgaagatggcgagagagatctgtcacaatgcttagctttcgactgcctgtggcttcaggatgctcaggacagaaagacacactccccaaaacaagaacatggagaaggagacctggcagtacccatccccaaggccaaggaatgaggctccctcccccaggtcatctcacctagatctttctcccccaggtcatctcagctcagtcttgatagcctctggaaagccctggcctgtcgtgttccttcactgtgtggtttctgtaataaagtgttaatccatgttaacctgtgtggggattatcgcgtgcaacagtattttctcgtgtacctctttctcctctgtgacgtgtccctcttttttttatttataaatgtctaatttggttttttttttttaaggacaaaccagtgtgtcgtagacctctatgtaacctgctccttagtctcattataggtatgttataaggatggatattttacttggctttagaatgtttttcaagaaaactaattcttaactgatgaagttgttgctactaaaatgcttgttttcatcatgacgtcgtgcgcttctaaattaatcatcattttcgttgtagaaaaatggagtgaatttatattagtcttggaaactaataatagcattgtaaatttatgagatgattttaacagaaaaattatagaagaatatagttattttaattgtaatattactaactgtagggtgaggcggggtcctgttgtggtgaactgttatagcttgttactcagtttctttttgatcattttctcggtctctgaggtgaagcgagttattaattgaatctgtaaactcacatatgcatattgtatatgtgtagcgatgtgatcacactgtcttggaattacattaaact

SEQ ID NO: 31154 - DNA, 1815 bp, Mus musculus
tgattcagaggaaaagggggcgagtggccagtgtccctgactgtattgcgttctccccttcctcgtaacaaagttgtttgcagctgtaaaagccagcctggcttggttctctttgtctaagaactggaactgagcagccagcgtagagcaggtcaggaagggaggttagcccagcagacaggagctccctggactgcgtctcagatgttgcaaacactcattttgaacagtgtgtggtggaggagtgggttgggtgatgtgagtggagtttacgttcttggaaaccagagtgaggtgcctaggaggcttagggaagtattgctgctggttcatgatgatgatggtagctgggtccccacctgcccctccctcccccgggttctcaacatctggctaagggagggtaggttgtgggcgtggctcttgctggcctgccatgtagctgctaggacagaaaacagaaagaagattgctctgtgccctcagctagcagacagaattccataaggcaagctctcctttcatggcccagcctgagactgcacacacacacacacacacacacacacacacacacaccccaccagctactggatcacagcacactccatcctgggtctcacaggctttgcccctcactcatgtttttccctcttatttgctttacaaattttcagtggagaagcctaaagattaagcaagcctgagatgtccttaccaaattggaaaggaaaggaaagctgtcccttcctatagccaaagaaccctcacaaagacatctggagatggacagatgcattccctggtcctttctgggcaatatgacttcagtgaccttccatttaccttacctttctatcctgccttttttttttttcattgcagttatttcaaaaccactcatcttcaaagaggagtggagtagtggccctaaatgttgctactccaaggaactgatatccctctagcactcctttgtgattaattgatctcatgctactgtgggaagctagaaaacaagcaagcaaccttctctgatgaccccacactgtatcccaggctgagaatgtgtaggacgggctggcaatggcagtatcggcccacttgccttagtctccacaaacagacccagacaagtcggtcaagccactagagaaccaaagatggcaagataaggcttaattgcaaaaggaacctcatgaactttggcactatggctcactgtagtaaccgcccgaggaaaggtttcccgagtctttggggtagctcctgagaagtagctccaaccagaagctcagagctgccagaaaagaggtcctggaggttccctgtcacagaacctccatgctgcctgacttctaagctagaacccctccctgccccaatcctttgagtgtccctcatcacagacccatccaggagagcattatactaattgtctcttgctgcacaagagcagtgtccctcatggaaggactcactgacatttgttgagtatccacacacaatatgccaagccctttctccatgtcccctcagagatccatccatgggaagaagtcaacacccactatgtgacagatagaaaagctggccctctgaggaagtggcatgtgtgaaaggggaacacgatgcatctcagagcccccaggttctggttttcttaatccgatgttcccactccctgtatgccaaacactgtgctaagaattgctgacgagccctaggacagcagccgtgcaggacctgtgcagaggaggcgcctggcttgcagaccccggggcctgcccaggccacctagctaataagaaggga

SEQ ID NO: 31155 - DNA, 1220 bp, Mus musculus
aaattaacctagctctccctagacagtttgatctctgcctgtgagagagagaatgagctgagggctggaggggcactagtggggtggccagagatccattgcactgagaaaacaccgccatggacaactaaggctccaaagaaatccaccctgagcctgtgcacctttgttgcattccgcatactttctccagccttgaacagtggagtgagtgggtaggagttctctgtcctaccgagaaactctggagccgttgatgttagagacttgtcaggtccaggacggggtgaattgtttgatcctgatgtgagtcctagctggcccttcatccacatcatcaggtacaaagaggcctctggtcagcagtccagcatcctccagcccccctccctttcctccctctttggccctgttcaatctactgtgaaaggctctcctcatgatagctgtcctccttcagtaacgaagcttacttagcttttagctgtgaaaaactctggaaacttgcccaaccattaattcttacaaagtccctaaactggatgtgtctcagtgcaccctgggccaaaaagaagatatgctagacttgggcatggtgtgacccacttcagccgagggctcactgggagtggactggatgatgctggcctgtggtagggtgctccatttttctcttcctggtcagaaccatattattccgagaccagctctggctggaagtgagagagcaggaaagccatccattcggagagggatacggagcaaagcctttggagcccctgagccagaggctcccagagcctctgcagcatggaattctgtcacagaagtctctagccgctagatggcagcatttcccatgggactgtctcgtactaagtcaccatactaagtcgcagctgacagtgggcctggcttgccctgccatgggcaacacctggaaggccagcactctctggagctgctgggccgagcttgcccttcatctcctcctgtctgcttgtgctgaagcttctccctcttccacatgtccttccctttctcttccagaccaggaatgagtgttccttgctgctcataaagttagtattgtactgactgtttgtattattgccactgtaattatgattattatcaccttgttgctattttagtcagggtttgaagtatacatttattccaggtatctttgtgttttcttcataatatttaaatttatt

SEQ ID NO: 31156 - DNA, 1115 bp, Mus musculus
gccggcgcgcgcacacccacgcgcgcactcccaagcacgcacacacaaagttgtggccgcctccaccgcggagctccggtcggcggctgcgggccagcgcaccgcgctctcgcccagccccgctcgcacggccgctcggctcccctcgggccgcgctcggcccccgccgacgccccgctctgcccttcggctcggccctccccgcctcgcatccgtgccatcggcgctcgattgcgcgcggactccctggggctcttcccggctcgttcgctcgcgcttgcccgcccgcccgctcgcgcccggccgcgccgccccgcccccgccccctccccctgctcctcacgggcaacttttgccggcgcccccgcctcacagccatgcggagctgagctccggcccgggccctggccgccgcagcccgccccggctcccgccctcgcggacccgcccggcccttggcctcggcgccttagccgccccgggccggccgagccccccgcgcagggcccgggccgcggctacggcggcggcggcggcggcggcgacgcgcccgcccggccccctcccccggcgccggccaagtgaggcggtgatgcgggcgctggcggcctgggctgcgccgagagcggagacacaggctcaagatggcagattcccactgaggctgagggggccgagctcgcgcgccgcgttcccttctccgttgccatgaaccgcggacaccccggccccgatggcccccgtgtacgaaggtaaggggcacccggcccgcgatccccccgctcgctcggccagccgcggcccccgtagctttgttctgcccgcggcccctcgcccggcagcccccggccgcagccccgggccctggtcctgggggctcgcgaccttccccggtgcccccatcctgggtccagacgggaccggagccggcctggagcaggatcttatttccagggcagagaaggcggctggggggtgtgtgccggtgggctgctgcccaaagaaaagaaatgggggcggcgtgtgggaaaagacggatccgtgactgctttctgtttatttgtgataaatgaaggtgatgcggtcctcccccattacctttaaacgatctcctt

SEQ ID NO: 31157 - DNA, 1123 bp, Mus musculus
acactcattctaaatgttaagttcagacagatggaaggaataaaacaccctttgcttttttttttttttttttttaatttttttgagacagggtttctctgtgtagccctggctgtcctggaactcactctgtagaccaggctggcctcaaactcagaaatccacctgcctctgcctcccgagagctgggattaaaggcgtgtaccaccacgcccggcttcaccctttgcttttgccatgtgtgcgagccaaggcatctttcgccctttggtgcaccgtgtgggttgtgcctaaatgaagaaagaactgttctcagaaaacaaagagtaggaagggcaggtaagaagaagcagaggtggaatttgttggtgatcccgactctacctctctctccctgcttggaaaggacaaagagctgcggtatccctgtgcagataactggatacctgctcagcctcccatggacattccgctcccacccctctgactgtgcctgcaaggtgaaccccctggggaggccctcatggtgtttgaaacaaaagtgggggaagagattgtgggaagtggggggggggagctaggggcggggatgaatcctttctgtccagtattccaaagaccacccaggtttggtctagcacttaggaagctgatccagaaaggtcaggagtttgaggccagactgagctgtgtagcaagactctatcacaaaagttaaaaccaaaaacagagaaacaaggctgggtgtggtggcatactgctttcatactggcactcaggaaacagagggaggtggatctctctgagttcgaggccagcctggtctacacagtgagttccaggacagccagggatacatagtaagaccctgtctaaaaacaaaatacctcttcccacaaacaaacaaacaaacaaacaaacaatcccaaagaaaccaaaatccctctgggcctctggtctagggctggtgagattcctgagttgattatggcttcctggaatgtctgaggtaagtccagggttcttaggtttcttacttagaccctgtttcttggaaaaaatacccactatagacttatgtcctatagtcttcaaactgctcacagatacccaagtgggtccc

SEQ ID NO: 31158 - DNA, 1213 bp, Mus musculus
gccagcctcctgacaagtgttttctgactgtccgattccaggccatctctcccaaggtcctgttcatgctcagataaaacctcgtccagcctcctgaaaggcttcatgatatttaacattgtccctctttccaccttccggggcctcaggcagctcaagtgtcctctgacatcttgtcatacctcaaatgccaactcaggttcctggaggccaagtcagtaccaagggacaacaacaaatgcccaggagatggtgggtttctcgctgcggtgttggtcaggcctcacagcacaggccaccttgaaaagatcagagacatccaaaggccactgggagtcgggatggggtggggctctgaaagccacagaattcaagtcaacggtgcttacaaagcatgtctgccacacagaagagacaggaaagagccttttctatgaacaacaaatggaggacccaagggtccctttggtcttaaggaagccatgacaaatgtcttccagccgcatcccttttagattggggctatcttgcacatctctagttatactgacctgtgtcctgctctgcactgagacctatacctttctccaaggccaggacgaaaggaaatcaagagagactagaacacatctgagggagaccctccctcttggggttgtgaccataccaaccctgctcttggggtccacaccctagctgccacccctgcctgccctttcctggtgtgtccatcctctccctccactcgacaagtctcacttactctttggcttctgctcctttttgctctttcctgaccactcaaagggcttcgtggcctccccagtggagaggctttctggagaaactgggaaaatatgggatgtggtttaatcagagtgcaatcctgccagcgttcatggcttattggatctgctctgtctccagcctggtgggttagtcatctgaaactaatcctttattttcatgaaatccttaaagaaccctaagatgatgtcaggcaggagggatatctgcctcaggtcatccaatatctcccttaagtctccagacttaagggagaccccacagaaagcaacaggggccaagcctcctatgttctactgataagagaacccacgctgagtcttctttgggtagggagcaccttggagttcttcctagacaagtgctcatatcctgctctcccccatgagtgggatgtgctcccatc

SEQ ID NO: 31159 - DNA, 1107 bp, Mus musculus
atgggaaactgaagtccagaactaattatcagcagactccagattttctctggaattggagctgagaatagaatggattaggtgacttctttggatgccctgctgaatagagaggtgttgatgcctccacgagtgaggaaaagggcagagaagtggaatggaagagggaatgtggtggtgaaagggcagaggctgctgcatcacccattgctaggatgtgctcttccagtgccctgtgcagcttgtctgtatcgtttcagggagctactttgcgagagatgccgcctattcgcaccactacagtaaatccgacacacactctcacatgatgttcctggcccgggtgctggtcggagatttcgtcaggggcagcacttccttcgtccgccctccagccaaggaaggccagagcaatgccttctatgacagctgcgtgaacagcatgtccgacccaaccatctttgtagtttttgagaagcaccaggtctaccccgagtacctcattcaatactctacctcctccaagcccccagctagcccctccatctttgttgccctaggtaacttgttcactagccgccagtaagtatggccaggatgcattaggcgtttctgccacatctgtctgtctggtggagctatttggaaagtctttctttcttttttttttttaaacaaaacttttaatgaactcttgtttaatattggcttctcagtgaaattacatttttttctcccctagtgctggggatggaatacagggctttgtgcttgctacaaaagcactctaccactgagctacaccccagcccttttaaaatgtttttattatgaggcagggttttgctaaattatattctgcctcagtctcctgagcagctggggttaaaagcctctataaccaggcccgacttgaagccacaatcttaatccttgtctgataacagttttaggttttaggtccttttaggttggcttatgatcttaccagtattgattgtgagcctaagtttgacttataatgatgttagtattgtatttttaactctttgctgactttgatgtttattaagaccaagcacagaatttatacatactgttttatga

SEQ ID NO: 31160 - DNA, 3130 bp, Mus musculus
gccaagcaatgctgagtcagtagattattctgaatcttatcttttaagtcccagttttcttgtttgtgactgtggattaaaaactactcaatgaagaaacagcattcttcaggtattatgttatgtcatacttggttaattattaagttacaactgatgatgaatgcacctttcgagagtacttttaagtaaaaatatacacccaggacatgctatctaaaaatctgacaaattcctaacaaggtgctgaattagaatcaggttttatccttgaagtgaaagaaaaagaaatgagcttcattgtggacagatgagtgagagcatccatcagcaagtcatcgatggttagttagcacagcagaggagctagctttcggtttttctcaaagaggaattagtatagtactcttctctatatttggcctactctttgggtactaaagataaaagaggtggtaaatttaaaatgatttagcagctacccatggagttaggggaaaaataaggtgatgaggaaaaaccttttcaaaggcagttgtgggctaggtactatgacagcccagggagagagagaagtcagaagtagtatagaaaggagatgtgttcagaaatgagtgtccacttgcttcagatgtcctgcagtgtgagacagtccttgggaatcggtgggaatcatgatggcctagtatactgctgccagagagacaccatagcaaatgtgcatttttgctattcacatggaaacatgaaacttcataatgcaaatctaaatctctctcaaaaattcatttttcccattataaaactaattgctccctatgtaaaagagaatgtctcgcctttcatatgtgcaaggccctgggacttgatccctagcaccacacagagatcaagaggagctgaggcttctagactgttacgggtgtcctagactttcatctaatacaatctcaagaattacacattacagcttttgtctagggagagctagctagtcaataagggtgaccagtgtaacccagagaggatagatttgcctagagacaccagtggctttaggatctctggtatcttgttttcttacatggaccccattctttgacactgcggcctctgcttgtcttgtagacactgtccatatatgttattgaagctagacaaaaagaattatactccctgaattgctgttgtgcgtagttaccctcagccttactactaaccctttccttattttgctttcatgctgtaagtgaaaacaaatatttgataccctttctataaacatttttttaaaggtttttaagaagcaaatgtccatttccaaagcagctggcatatcatcagtaccacggctttattcttctatagtaagtctcccctctttactggggagaaaaaaaattctcactggagaaacccttaggttccctgtcacctctggtgcccttctagtttcttaaggctttgtcttaactgtgatattacacttatgtttaaaacctcttaaaggtgtattcgaggattcttccaaccaatgtatctgctctgcactattcattaatggaaccctggctaccacgtagcccctgacctccaagtagtttacctatgcaagacctgtgacactctggattcattttccattacagaaagcagtcattaatgtgatttaatcataaagatttgtcttcaagttttttccttttttttttcaaaatatcagctatttccctctgtattttttaccaaaacaattatcataagtgctagaatatatactattttgcaggaataaaataaccaagacataatatatttctttggtggattttgttttgtaagaaatgccagcactaactatatagagttgattctttgcctagaataatttttttcccttttaagagtcataagtaacattttattttcacaaagcatgcatataacttacacaatatagtcagggacctgaggtgtaacttgctaagtgaaccccaaggttattttatcttgcaaaagaaacctaaaccaaactaagggccttacagtttatggttagactgaatcaaatgctgtaacctcagtttttccaaaaacagctcttgactgcacaagcaggtcatgcagttgttaagtatgaaatagcactgataggaaatgcatgtgcatctttgcagactgtatttcctttggaaaagacttttctacttttaatataattaagccataacagtttcatgctgtggaaaggatgaaaaggttcattttaagagattatatagtatgaactttcacatttattgtgaaacatctaactttgccagtgttcagcaagttttcttttggggtgttggagggtggtaatggggaggggtagtgttggttttaggggttttaactatgtgaaatttgaaatcaggacagttgttggctatggtacttactagttttgtagtaatgttttgctagcctgactttccttactggtttttatgtccatggtccccggtgactgttactcttgtttggggtgtgtgcatagtagtgtctcatctgtgtgtaggcagtcagtgtatgcacacggtgtgacagtggaacggggtgtggctgggagtggggtgctggagctttaagagcatttgtttttattcagaacagtatttcccatcttttgcctgcaggcagggaaagtgtacagtatttattttgtttctgttttactctgaatttgtaagtctctaagtagcttatattattattatagggaagataagtgacttgcttaaagttgtatttagtattcttactttctaatttctgtattttaaaatattgaaattaaaattgtattacttttgttctgatttttttagcactcagtgtattctttgctcattttgtctaaaagtataaatgttgaaagttgtataaaaatgtctgaaagaaaaaaatctgaattctatatacaattctgacttgttgttccctttttctgaatctcaagacactagaatgtagaaaactgttttgcattcttactatttctgaggatttaaatgtgaaaagtaacatcttattatttcactagaggtaccactggggaagagtgatggccaagagggaagactga

SEQ ID NO: 31161 - DNA, 2474 bp, Mus musculus
gccaatgttaaagaaccacataaaagagtcctcatttctcatttcttttgacattgtggttttcttctacaagtaacgaatctggcttgttttattttcatttttctgggtcccaaagagaacagctttaatgtctttttcctgcttatagggaaagtataagtttggttaaaatgtcatgtttgttgtctttccaaaaacctttataattacagagggccttcttcaatactgctggtgttggaagagccaacatctatcacaggcttttattatctagacatcatttttttaagaaatacaatttgatttaggatgttcaaatctgcataaaagccgtaatatataccatattaagttgtataatagcaagcatgttggaatagatctttgtgtgtgtgtgtgtgtatgctacttttttttttttaattttctgaagaattaatactgatttggagtaaaatgggtgcttttgcagtttcttccatatgtcttggctagtaggatatggaggttaagtgactgggtgaactttaagataataatttatctcctttatgtacaatttttacttaaatgcaatttttcagtggcttataatagtttttagtatctccattttcccctcatgacataaaaataagttgatattgggggtctgatgataccacattttacaaattcctacaaagacaatataggcaaataacatgaaatttatttttatggagaaatatggctatataatggatttgttcttttcaattcagcaaggcaggtagacttttacttctgtattaagcattaagttgaaaggaaataattatgcaccattatctttcatagttgcattcaaaatacgtatttccaaagagaaacatttcttattctgtctcttttacaatatttaatgggataaggaagttacgaattcaccttctggtccagattgtctggaccaaagtttccattgtattttgagtgtccggaagaaggatttttaaggagttcttcatatctgtagatagcatccctagcccctgcctacacaatgccataactagtggagagagggatacagtcagctggttgttgtatttcaacatgcagaaatctgaatgtgactgatcactcacctttccacaatatatcactgtgatgtcttagtttcctgtcttattgttagatcacatatttttatttgggttaaaaaataatagtgatgacttctttttccagttatgatctagatttgttttaaacaactcaaaatattttaattattttgctttttggccttaaaagttaaaatttattcttatgaattaaaattatggccagtatcttccctgtgcccttaggctgatgaacactaattttgggttgccacatatgtagtgttttaaatgacagttttgtggattcattttaaaaaatcattttagcctattaatggactaaatgacaaaacttttagccagttaatatagccactatgaaagaatccaggtatatttcttcactgataaaaattcagctacacagccaatgatttttctagtcaaacttcttctaaagttctccatctgtggtgtgtccttttatctcatagaaatggctggactttgaagtgtgactactgctaggatctgggctcagtaataggtagtctctgtctttcccatattctcacaagtagtataccgcagcttaagtcagaagatattggcgatagcattagttagctataagcaaataaaatgtgtaaaattgagaaacagcgacttgcacatgcagctttaatagtagtggtgaccctgtcttaattcagctaagtgacccttaacctgggatctactgtactgtaattttcaacactatagaatattatgctccccagtattggtgaatggttagcaatacaaaactggcagcttagtagttcaggatctttggaatacattgaaattcataaatgaagttcatttttgaagcacacaattcaaatcattaactcagacgagacaagtccatttatatggctaaatacttagcttgaatactcttctgtattttactaatcctaattaattccttttccatgtattttactgtacttatccataagagatcagcaggtattatcagacactcactgagtgctcagaaatagtgaggactgtgaggaacctcaagttcagttttgtctgtccgtttgtctgtccgtgaaggtgtcttctccaggaggtttgcagtgttgttttgacttctaaacaaagttgagcagaaggtggcccatttgtaaacagaacaaacaaaacaaaacccaacttcattagtttcaatgagatataccactgtagaagtggaagtgtttaaaaacaaaatactcaagttctttaacatttaagaaaaattctagccgggcagtggtggtgcacgcctttaatcccagcacttgggaggcagaggca

SEQ ID NO: 31162 - DNA, 1231 bp, Mus musculus
tggtctgtgagttgtatcatgggtattctgagcttttgggttaatatccacttatcagggagtacataacatgtgtgcccttttgggtgtaaatgtatgttttgcatacatagatcacttcacagtaacaaagttgcactttaaggctgaattcaggttgggttcatttggccatgggatcaagatcacagcaggggaatgtcaacacctgcaggaatgtggatcatgtgtagggactttctgggacgctgctgtgatgataaatattggttgttgacaggatttatagtcacctaggagataaacttctgatcattctgtgagaatgtttctagattgggctactgtactctagaaacctactctattgaaggtggtgccattctatgggttggggtcccagactgaatagacaaaatgagaccactgtttggtaccagcacctctctctccttctccttctctctgtctctgcctctgcctctctctgtctctgtctgtccctgtctctctctttctatctctgtgtctctgtctgtctgtctgtctgtctatctgtctgtctgtctgtctatctatctatctctgtctttccatctctgtgtctctgtctgtctttctcttagctccctggctatagatactgtgaactcagttgctcagtctcctgctgcccccaccccccgtgatggatgatggtaccttcaaactgtgagccaaagtaaaccttctctgctgttgtcaggttctctctctgctgttgtcaggttctctgtgtctgtgaggaaaagtcactaatcaaaaatacctgacagcttaaagcaggaaggactttgcacacctttaatcccagcacttgggaggcagaggcaggtggatttctgagttcgaggccagcctggtctacaaagtgagttccaggacagccagggctatacagagaaaccctgtctcgaacaaacaaacaaacaaacaaacaaacaaacaaacaaaaaagcaggaaagacttattctggctcagggtttcaggccatagtcctggactgtattgattctaggctggtggaagcccatcttctaatgctgggaccctttaatactgttcctcgtgtcatggtgaccccccaaccatagaattattttcattgctacttcataactgtaactttgctactgttatgaaccgtaatataaataactgctttctgatggtcttaggtgacccctgtga

SEQ ID NO: 31163 - DNA, 1176 bp, Mus musculus
atgtggttgctgggatttgaactctggaccttcggaagagcagtcgggtgctcttacccactgagccatctcaccagcccccacagagtgtaggttcttatttacattctggcagctgagttgagatgatctctacagcacttcactcccgatggttcctgtgggcttaaggtttccttgggctgtgttagagccagagaggctgggacggtgcccaagtgctgcattctggagagctgttctccggggcccagtccgttgtttccttagagaatctagaacttaaatacttccttgaccctaagttaaataagtggccaggttattcatgtggcaaattcatttggtaaaccaggtctgctttaccctgccctggaatggattcttagccagctgtgccagttcagtccagaaggaggaggctcccggcagcgggagatctcccggaggtggacgcagaatggttagatgtttttgtctctgggctaaacccggtcatgtccctcattcttaacaatgcttgtctttgggagccagactgggaaggagtgaagcagccaggggtgccagggcgctgacaagagcagccgtgtccttggcagatctcagaatagcattggcagctcgtggtgactcatcgcctgcaggcctgctcacccgagctcctgatcttagcgtgaaggagggcgcgcccagctcttcctcctgtgccggggggtgggggggtgggggtggggtgagggggggtgcttcagcagaggggaagtgcacaatgcaaaagacaggacaggtacctgcgagggtctggaccagagccagacctgtttaggaggctccctggcaccctctgcattatgttttgtttttttgtttttggaaaagggggttctgtaattctggcctgcccagtcccattgaactaaggctacaacactcctgtgggaatctctgtgtgttccccgtggcacattctgctcctcttaaaacctttggttaattggctttctttcccacccacacccccactttataaaactattttttttttcctcttccctcatgtagcaagaattctatttattcacaaaaccacagctgttgggttttgcttctggggctaattcctcagccttccaagggtagcctttatatactgctggctatggttagaaaagg

SEQ ID NO: 31164 - DNA, 1147 bp, Mus musculus
tgctaatgttaaacctagcatttatctttagttacatgttactaatggcattttagaagcaaaaatctacacaggggtagtttcagggaatccagtgccctcttctggcctcattgggctaatgatttttgggcaacttgacacaaacctagacatatttgggaagatagaatcttaattgagagaaagcccccgtcagaatgtccatatatgtatacatgggcaggcggtcctggattataaaagagagaaggctgagcacgtcatggggaccaagccagtaagctgcactcctctatggcctctgctccagtccctgcctccaggtacctgctttatgatggactatgatcaggtcgggtaagctaaattagccttttcctcaccagtttgtttgtggtcatggtgttttatcatagcaatagaaaccttaagacacagacaaaagacttctactcctagaataagtttttagaaaaccactgtcccatttactgtttgtctgcaccacaggctttgtggttctgaggcttgcagctgagagcccagagaagatgactgtgttggctagggttgcaaagagataggagagaggcacacacgtagtgtttttccatcccagcacgtggcctggccttccctccagcctactctggttctaggctcccatccaaggtgtggtggtacagtgcatgaggcttgtgaggtggtgtgtgaaaactccccgtggcccctgcacctgccactgggctcaggactttgcagaggtagccacgtcaccgtgcgggtatatggcattgcctgatcctagcccctctctgtcgtagttttctacttttagtgtggggtgggtgtggtgtctatgtgcatgtgtgtgcaggtgcgcttaactagtacgtgaatgtggagtccagagttgtatgctgagcgtcttctcttgtcctctaccttagcatttaaaactttttttgtgtatgggtgttttgcctgcatgtgtgtgtgtgtgtgtgtgtgtgtgtgtgtgtgtgtgtgtgtgctgtgtgctaggaggccaggacagggtgttggatcctctggagttggagtcactggcagttgtgagccaccacggtggtgctgggaactggtcctatgcatgggcaggcag

SEQ ID NO: 31165 - DNA, 1099 bp, Mus musculus
gcatagcctcacaagagacagctatatcagggtcctttcagcaaaatcttgctggtgtatgcaatggtgtcagcgtttgggggctgattatgggatggatccccgggtgtggcagtctctatatggtccattacgtttctttttaatctttgggtttgtgtgggtatattatgctcatttgtacatttagtgaccgcagctcctaggttcatgtgtatttgcacatgtgtgtgtgtatgtatgtttatatgcatgtgtgtatgtgtctgaatgtgtgtgtgcatgtgtttgtgtttatatgcatgtgtgtgtatttatctgcatgtgtgtatgtatgcatgtgtgtatgtgtgtttatgtgagagtgtgtatgtgtgcttatgtgagcgtgtgtgtgtgtgcgcgcgcacacgcatgtgtgtacgtgcatggctgtgtgcagaccacaggctgacattgctttccttgctcatacagaattggactgttagttcacatcgtgctgtgatggctgtacgcatcccttccttcttgtcctaattcattcttccctctaacaactcgttttgctcccagctctttcagttttcagtttccttctgagttttccagcagcatttattgaagaacccccgtggaaccagtgctgtaagcctcccaccacctttacttacgctgagagtcaaatccatcttacttgtatacttggtatctatggcccctgggacagtacggccctcttcttccagggccaaggccaggtggagcaggccatgcatggttcctgaaccttgcagatggtccctgcactgctcacaatagttctcctgcagtggctgcctacattgtcaggctgcatggctccacactagtgtccggtcctcagctctcagattacctagcagcaggaagccttggacacagcagtgctcagcaacctctttggagcctgtttttttctgggctgtctcctccccagcccttcacagtcttcctcttgaacgcccctaccctgtcttctctgcctcaggtgatgggcctaccctgttggggcctttcagggcccttatcttagacactgtctgccaggcccactggc

SEQ ID NO: 31166 - DNA, 2674 bp, Mus musculus
gaagtcaaaatgtcttcgctcaaatccatttgctaatgctcaaatcatgacgctctaagagaagtaagttgttcattttaaaaacttttttctcttcacagacaagttgtacaattctgtttatcttgccgttaatagtgagggaagtattttctcttgtgcaaaggagacaagctcactcacttaatgaatgacggggtcccacaggagaggacggactgggaagcttaggagggcccataggccttcagttcactcgtgtggagttctctaaacactaatggagccttggcttgtcaggcatcctacaacactgccagctaccccagacacaggcaaggaaggggcgaattatttttttacactacagcagttcctggagaattttataacatttgtgaatgtactgaaaggaaaatgaacctgccagcatctttgttgggcttgtcagcttatccctctaacgctagataccggttttggtcctggacccttgttcttcagccttaatcaagagctaagtgatcaggaggcagaatcatgttgtattgatgagaagactatggtacggagctctgataccacatttgcagagagtggatcaccattaaggcatcagagcagagctgagtccagatgatgctacaggcctgcggtggacgaaacacacctttaccaaggtggaaagatcacactgtgcgatggctgggtcactctgtggcttctggaagttctcgtcctctctagaatggctgttggcttgttctcctccgacttcattcacatttgactgactcctaggagcagtcttctgtttgtggactattatatttcagacattccagtatggagctttcaaacccacgttcacagtctgggaacgacaagaccctctgagaagctgttctatgtagccttattgttggaagattggtctctgtcacagccgcagccaggttcctgaagttccctcagcagaagatggaaagacaaaggctctttgttctgggggtatgaagtgtatgtattgaatcatgttagtggattgttagggcctgaggcctgccctttagaagattgtagtgtgtatgtcttcaagactatgaattctataagaatcaatactttaaggtcattctgtacatacattttaaattatgtaaactaggaggaaaatgtacaattttgagggatacctaattcacgttgggttaggaaatattcttccacctcttgctttatgctccaaggtatgtattgatgaacttgcaggaatactacagatttctgaccattttcctgttcagtcactgacataaagggaaaacacaaaacataggaaggtaggggaaacaaacccccgcttttgtaataaacgtccagcggttgtttggttacttagtccctgcttaagcttgacattgcctctcactttccctttctgtgtggtgctggggtggactctgggtcctgcacatgcccagtgtgtctcccaatgccctgcactcccagcccagccccacagttaagtacagcggtgccttgagttccccagcacttgtcactggaagcagacagcccacagccttgccaggtggagctgctcccctgccctaggtcctggggggcctcattcccattagagggagcaccccctctctccctctgaggcagactgctcagtggtgcctgcagatgaagcctctgtcgcatgtggctcagaggttcgtcctcctcagtgggttcatcttcatgttctcatatcagcccgtgccgccttttccaggttagtcttgagcacctacccccttctccgtggctctccaggctctgcctgaaatggagctgtaaacactcagaacaggatgaaacgatgtttttctctctgaatctgagtacgttctccatctacttctgcccacctgggaaggaagtggctttaacaaacgcctaggcatttgcctcattttcttattaaatgtttgcctggaaggaagggtcagagctggcgagctggctgggtgggtgaagtgcttgctttgaaagcatgaatacctgagtttggactctcagtccccgtgtacacatctgggtgcagcggcacacagttccagtgctcaggagacattggaaacaggtctggctgagctagagtgctgaggttcaggaagagagcctgtctcagaagacagtgacgggctggagaggtggctctgtggctttagagtactagctgctctcccagaggacccagattcagttcccagaacccacatgacagtcacaaccatctgcatacctccagagtcaagagatacagcacccacttctgaccttcacaggtactacatgcacacggtacacttaggcaaaacacaaacacacatggatactacttaaaagggggagggggtgtgatagaggaagatagccagtgttgacccctggtcttcatgtgatcatgtacccacacacctatgcacacgtgctaacatatatcaaaaatagcagaaaaggccacagtaaaggctggtttgaaaatggattaaaaattaatttgggggaaaatcgtaggaggctttcacacactgaaataaagaatgactggatgggaaacattttgcccttaagtgtgtctgtcctggaatttaacaatagtagttacatattcctt

SEQ ID NO: 31167 - DNA, 1100 bp, Mus musculus
accctgtctcaaccctcccctatccccccccccccaaaaaaaaaagagaggactctttcctcttctggttggttgctcaaaagctctgaaagcaaagaggaagggcctgtggaacagcagcttccagtgtggagggccagttctggtagtgggtagcaagagtttcagagggaaatgggtgagagctgccctgggtacaaggtgggcaggaaataggtgagagctgccctgggtacaaggtgggcaggacccattgatttttgaagcaggtaggctgtgacaggagtggtggcttcttgagaggcagggagacagccaagtgtctgtaaggatgtggattagttagctctctctttctctaggttcccagaaagcctggtgggagagtggactggatagtggtgcagaccatgcaggagtggtgggtactgttttatgttttctctcctaccagcctcttttttttttttttttcttgtctgtggactttgattcaagcattactagtacagaacatttttatttaaaacatatttatctacttattcactcatgtgtgtatgatgtgtgtgtgtatgtatatattcaggtaggcagctgccctactctcccaagtaaggacattacagcactgcctcaccatcttcagcacaagaaacctttaaaggcttgctatatttgggttggaacaagttgtaaatctctctatagaaatgaaatagtggatgacccatataaccccagcactgaggggaatgctgctgaggcagagttccttcaagttccagaccagcctgggcaacagagtgagacaatgtttaaagataaagtagaagtttagaagtaacaatgtaacaatttagggctctccctcttcagttatgtggcagggtaaagccatcttgtatcagcattcgtagtgtacttctgttcttttttgcagagtatacacacacacaccccaccccaccccacccctgtttgtgtgtgtgtgtgtgtgtgtgtgtgtgtgtgtcccagtactggctctgtagaccaggctggcctggaactcagagatccacctgtctctgcctcccaagtactaggaataaaggccc

SEQ ID NO: 31168 - DNA, 2503 bp, Mus musculus
gagccacagagacagaaagtgggaacatcaagcagataccgggtaactctcactctttttttaaaggaggggaaatcgcacactgtcagttgagacctgcacatattggggtaggggaaaatgacactcaggtgtgggggtgtgggggagactagagtaaaagagtcagacttcagaagatggaaggggtaggaaagaaacagtgttcaaaagccctagcctaacatgttggctacaaatagccaaaggggaggcactggcaaggtggactaagggagacctctggtccgccatgcactccctccctccctccctccctctgtgccacacggtttacctgatgagcaacaggatagaagacactgcttgacagtgccacccctatcatggccttgtttcttacaggcccaacgaaggagccacttctgggagctcattgaggagagagagaacaacccctttgacaacgacgaagaggaggttgtcacctttgagctgggcgagatgttgcttatgcttttggctgcaggtggggacgacgagctgacagactctgaggacgagtgggacttgtttcacgatgagctggaggacttttatgacttggatctatagcagcgttgcgtggcgcgggcactggtctgcggagcctcagacagtagctgtcccctgtgctgtgtggcagtgcgtgtggctctcctaggcaggcctctcaaactccaggtgctgtgatcacttcccagggcctgttcctctaccctcacctcccccaagagtgtgttgttttctctgtttcaaaagttacaaaaataaatcttaaagttagttttttgtaacatgaatttaactgtcagacagttagtgtaggtttgttgcgccatctgtcctcagccaggttgtgttcatggactttgcacactcattctgagacccctttgaggttcaaaggaaaaagcactgattgctttggggtccaaggataggggcaattgggaaaaaagggacctaagtcgctctctgcgctagatgtgggagggctccccgaggtttctgggagatctgcaccttcatggtttagagctgttccctgccctgtaatcccctacatgtgcttgtcctgtgggtttgggttcttgttcagttgcacgcaagaaagactactgggtaaccagaaccaggtgcaaatgtgttgaggttaacctgagaaaaatgtaaaaacacagggaggatgcagtggcattccatcagcgcagagctggcagctaactcccaagggtcgatggacttggtgggcgagcacgagcgagcatgtgagcagcttccttcccatctgtgcataggtgcagtattcttagctttagtgggcagatgtgggttagtggtttcagccacatgtgtcggtagatcttaaaggaccaagcagtatgtcagtagttgttaacgtagcagtagctgtctgtctgtatgctagagaaacgagatcagctgtagaggttaaacgacctgcttgtccccctctcagtacaagctgggtcttggacacactgatgttttgaatgttttacagtctagccttttcagtcaggcactttttggaaaaaactttgtcctcatttgagggggcctgttgtgaggttctgtgcttgtttttgtgggtatctgcctcattccatccctgagctttgacaggaagacaggtggattccaaactgaggtgctggttgtactagaggtatctgtcggtttgcagaagtaatgaacccttccccaccgaagaaaagggagggtgcggccacccacgaggcaagcaaaagttaagttgctaaaattccttggcgggaatttcacctttgcattttgttgctctctttcctgaaataacgtgggagatgctctgatctgtcctctgctttgcttccgcggaactcacccagtcttaaaaacacatcatcattgcagaggcctctgtattttgcagctgcccttttgtaagaagcacttttcccaaataaaacgatttaaaaaaaaaaaaaaaattggtcttgtgtgatgacctggcttcagaactacagatggcagagttgctcatatcgttcttaatcatgtgtagattggctagaagtgggcctcttcaagatggccaggctgccttcatccacaagttcacagtctctctcctagtaataagtgcttgcagtgaggcctggttcagtcgggctcctaaataagacaggtgattgggaacttgaaagactaatctttttgttttgtttgtttgagtcaggatttctccatgtagccctggctgtcctggaactcactgtgaagaccaggctggcctcgaactcagatcctcctgcttcttccttcctaaatgctaagattagtgctgttcagcaccacaccaggcttaaaagtgtaatttttgcaagatttatttattcacttttttttttttttttttttttgagacagggtgtgtctgtgttcccctggctatcct

SEQ ID NO: 31169 - DNA, 1526 bp, Mus musculus
ccctggttgtcctggaacttgaaatttgaaatgtagatcagactggcctcaaactcatagagctccacctgcctctgtctcccgagtgctgggattgaaggtgtgtgccaccacagccaactctcttttctttttctttggaagcagtctcctgtagcatggggctggcctatagaactcttgctctttctgcctccacctcccaagtgttcagtatcctaaagtttggaaatgaaggctttaatccttcattttccaccccaaaactgaaacatcacctgagttaatagggtctttggtgcggggacttgtagggggtggagctctgggatacagagaactggatactctttcagatattgggagttgggtcctcccagcttgactagtgatgtgagcactacgggggtgtggagctgtgcctttacccggtcagacgggaaagcttcggcaggaccttggctgtggagtctccggactggactgcggtggcctcactgtgcctcttgtctcttcccttcttccagtcttgcattgaggcccatgagaaggacatggagctctcttttgctgttcagcgcagcaaggacatggtgtgtgggatctgcatggaggtggtctatgagaaagccaaccccagcgagcgtcgctttgggatcctctccaactgcaaccacacctactgtctcaagtgtattcgcaagtggagaagtgctaaacaatttgagagcaagatcataaagtgagactcctccccaatcttcgtttgtgctttctattttcgggaagagtttagtatcttgtgccaacctccaaccagaacgaccacatttaaatgcatgtattttatcatgaacctgggtgttctaattgggatttctttgtacttcagctagccgctaggttagttggtctgtctattttatttgaatgaggaaaccctgtgtatcagtagagtcttcatgctttttgaggagattgtgttaatggattagatagacagtttaggcttcctgaacaaacatctagctctgaatgtatgtttcttggtgtcttacactttccactttcctataccatccattaagctagccaaaatctaccatcctttaaaaactgttctcataactgaacaaaagccacataatccaaacagagcaaagttacaagaaataaatttatttaaacgaaagaaggagtctgtgtgaaatgtcttcttttggttttgttttgttttttacctaagtctttttttaaaaactggctagccattgagttgatttctgaaggagtttgtctttcctccaaagaaaggttcagatgtgactggaatccctttctgctaatgttcatgtgcctgtcagttaaggtgacacaccagggtgtgtcttgaagagcgggcctagtggagggaatgtgcattgcagcctgttcattgtttcccaggtcctgccccgaatgccggatcacatctaactttgtcattccaagtgagaactgggtggaggagaaagaagagaagcaga

SEQ ID NO: 31170 - DNA, 2262 bp, Mus musculus
gcagttaagagtgtttgttggagggacctggatctgtttttcccagcactcatatcaggcagcttatagttgcctgttaactttggccccggggatctaaatgctgtcttctggcctctctggacacccacacatacagatacacttaaataggaataagtctttttttttttttttaagatttattttttctatttatattgagtacactactgctgtctttagccacacactagaatagtgtatcagagcccattacagatgttgtgagccaccctgtgtttgctaggaattgaactcaggacctctggacctggaagacctctggaagtgctcttaaccgctgagccatctttccaacccaggaataagtcttgacaggtgctccctgctcatgttcacactgaagtttgaaaagagtctgggagctccatgtagcacgattgtaactgcttacttttctctgtcagatacgaacacagcaagccactgaaacaggaagaagtgactgctactgatctgagtgcaaaaccatccctcgctgcttcctcaagtctctcttctggtgttggatcacttgctgaaatgaattcaggcgaagctgagtcacgaaacccaagctttccaactgtaggagcaggttcagaggactgggtgaatgccattgagtttgtccctgggcagccctactgtggccgtagtaagtattgtgaggaccctgtaaactgcaatcaaagggctaaatgacaggccacagtgaactcagtgtcagccttttctgtttgagcttaacctactgtcaacacattagattgggttatttaagatttaaagatgaagtaaaagaaaaattttgaactacaataaaatgaattcttgtttaaaaactgaagtgtctccgaatgctgtcccctgcttgctcctggtggtgctgggatcaaaccctgggctttgcacatgctaggcaaatgctttcccattaagctacacacttagcccacactctgtcctttgatgttgtgtttttttgacacagggtctcttatggttcagattcctcaagtagttaaggatgaccttgaactcctgactctcctgatgtgcccttactaaccagtacttactaatactacatttcacttctaaagaagttcacatgcagaactgggctgggtgccacacgcccgtaacgccagctttagagaggctgaggtgggagggttgctgagttcaaggccagcctgggttatcagatcttaccagaaagaacaaaactgagctggacagtggtggtgtgtacctttattcccatcactgggtattctgagataggcagagggtgagttctaagccagcttggctgtataaccctgtctcaaaaaaccaaggggaaaaaaggaaaaaagttcagtaggcttgactttaggtttcattaaagttgttgttggattttttttttcctttttttttttcctttttaaaaattattctgttaccttatagttcataattgccttatgtatttggacctttactaccatcttaaacattttcagctgccccttcctgcactgaagtacccccgcagggttcagtgaccaaggaagagtcagagaaggagccaactacggtggagacaaagaagcagctttgcccctatgctgcagtgggagagtgtcgctatggggaaaactgtgtgtatctccacggagactcgtgtgacatgtgtggcctgcaggtcctacacccagtggatgctgcccagaggtcacagcacataaaagtaagtgctcagagcagcttgtgctaaatatgaggagccaataaatggtggtgtatgtgctcctgcacggttctatagagtgttttgtcaaagatagacctgtatagtccaggcatagtgaagccacaggcaggaggctctggagagcctgactgtggtcatacacccttcctacaaagagaagttctggttgcagaacctcagactatgatatttaaaaggtagttcacggtttttggggttttgttctgatttgtttttttggggttttgttctgatttgtttttctttttttttttactaatagtttttctgagattcatatttcttataattcctttgaaacacatttccttgctttttaatatattcatagcatcgtctagccattactataattctaagttaaatcattttcattccccaaagaaaacttacatccacttagtagttggcctctgctcagcttttccttgagc

SEQ ID NO: 31171 - DNA, 1234 bp, Mus musculus
ctagggtccaacaaatgctcacataatgctgtcgctgtttgttggtgtctagaaactgctaatcacgtctgcctataatcccttaaagttgctggcctagttttgcttttttcatatgtggcttttaaggaattaaaagtgtttccttaacaacattgaatataactggtagcctgacaactttgtagtctatgtggtttctttatctttgatgtgctttgaggatagggactgaagttagtgaaaaatacagtcctaggactgtaaaacaagggcagtggccagaattaaccttcaatgaacaagataaatgtttaaaattgggggcgctgaggctacagcttagtgatagactgcttgtgtgtatgaggccctagttaatcccgcaccttctcataaggatagtctttcgttcagggcagctgccttgatgtgtgtgctccctactgttgatccaaatccgtcttccagcctaggctgacaagttcattgctatagttgtgaacacaccaggagactggtggtaatgaattcttcgagagttggctttagtcttctaatctagatttctggttctttgtcttacagatactttatgcatggggtttgtaaggaaggcgataactgtcgatactctcatgacctctctgacagtccatacggcgtagtgtgcaagtattttcaaagagggtactgtgtttatggagaccgctgcaggtaaggatttgtttataaactctttggttaagggtgggttgaagaatgaaaataaaatagatcattctagtagctttgtacatataattctagtagctttgtacatagtattctaaaaatgcttatgatttgaaaagtacttattgctagcagtctaagaaggctcagcaaagatacaatgcctttttatgaagtagtctcagaagtcacaacattgtcgctttcactaacatctggacagagtcactaagtccagccacattgaagggaagaggtattgggctccacttttggagaagcatcttggatgcatttgaaaccaccacactaggtaagacttgtagccagtatcacagccacatacagataagtagatagatggatgagtgggtggataaatggatggaggggtagatgggtggctgaatgaaaggataaaaacttctatactaggtaagacttatagtctaagtatctcagccatatacatacaggtggatagatggttgggtggata

SEQ ID NO: 31172 - DNA, 1344 bp, Mus musculus
tcatttttatgtgggttctaggaatcaaacccagccttctttgtatcaacaaagatgtcttgccgccacccctttttctttattcttctgaggagaatgtgtgagatgcagaggctaatataactgggaatggcttgggacttgttgatccttcactcctgtctctctctagtgctgagattatagacatctctagatgtcccccacagggagggagggagggagggagggcttgctggatgagggaaactttgccgatcccctgccttccgcttgcttttccctgtttcctctttttagttcctcagcagactgactgactattctagcctccactgaggggctttttaggttttacttttttttccctctttgttgtgacaggttttctctgtgtagtgtggctttggctgtcctggaactcactctgtagacgaggctggctctatctcagattctatctgcctctacctgcccattgctgaaattaaaggcctccaccacaatgcccagtttggggtctttaaaaaataaacttgggtttcacttaacacacggtgaacttgagcttccttcatggccagggaggaccttggttttaaatgctgaattacaaattcaggccaagccctgatccctaaggttcattgaattaatggagttttctagctcttacctggagcagtagtttgtgggccactatgtttaagtctaatatatatatatatatatatatatatatacatatatatatatatattttttttttttgaaggctgtggatctacatggcccagagagaagaggtagttagtgtcctgcttcagcatgaggttctgaattctggtttccttgtaagagcccgcaccgtgagctgaaggttcagtcaaagagcctggctctaaaacagtagaggaaaacacctgctcatgtatacaaacacaaaatatctttgggtattctggcttagggaggctaagacagtagaatcttgagttttagctagcctgggatatgtggcaattcatgtgccagaccagggagggctacagggagggttcactcaggaaaattatgtagatgaggtaacctttgagaacacagtatgaaaagctctaaaagggtagagggttatgaacagggcaccttagcttgggtagcaagggtgtttgctgattcctagggggttacttgtcttccatgcactgtggcacatataccaacatgcattcacacacacaaagagcaaaacagaggacacaagcttaaagtctcacatggtggccctctcctgtaattgtttttgtggaggtggaggtaaaaacagtaggatttcgggggtct

SEQ ID NO: 31173 - DNA, 1373 bp, Mus musculus
caagaaataaccctcatcttggcccaagggaaaacctcctccctacgccccagtcctcccaggatggaccccttagctgggcaggtggcacgcgctcacaacagctccggaagggaccagccagcatgcagaatgttgttactgtggttagttgcttctgggacctttaaatcttagatattaaaagagaagaagaaggaaagtgtttggctcttccttcattcagctctcctgccccatctcatcgcctctgggccagctcattgactctgtggagccaggagttaggaagcgcggcagccacagaaacacttctgcccacgccactgcttcttccgcactggtctatgacgccacctggtggcagagactggactttactgttcttgactacattttctttttttttctcctagaagccgtatagctccattcatgccccaaaagtctgtggcttttagagggacacatttaaaaaaacaggaaatcttgttaactggtaataaaatgttctaagggtcctgaagtttctatttcctgtggcccaaccatgacacttaggccactgctgtgagcctgttcctcttgaccaacaaagctaggagaggtttctgtagttgcttctcttttatgagagagaggacccgaatcagctgacctgtggggacagtaagagtctgcaggagccctgtgtgcagcaaaggaaggttctcgggctggcctcggggctgccaccccgatactgtgaatgccaccaaaaactgactacatctggatcgcctctgacctgggcaggattaataggagtgcgtggctgggatgttggaggtagccagagaaagcaggtgagcacagcacgggggctcagggaccgattccacaagctcctaggcttaggtaactttctgatagcaatattctgtgtatttttatattgcccccaagtgatcacagttagtattttggaatatacgttcttttctaacttattttatattatactgttttacttaagaacttcaggtgaataaataaataagtatatctttatcaacattcctagtgagtgtataatattctattttattgatgtttttgtatttgacttaaacaaaacctaaaataaaattgggggaatgtgctaggcggtggtggcgcacacacacctttaatcccaacacttgggaggcagaagcaggtggatttctgagtttgaggccagcctggtctacaaagtgagttccagggcagccagggatacacagaaaaaaccctgtctcaaaaaatcaaacaaacaaacaaatattgggggaatgtactaggctatttgtatgaagaggcttttttcttttcctttttcattttttgagaca

SEQ ID NO: 31174 - DNA, 1215 bp, Mus musculus
tctcctgagtgctgagattaaagatgtgtgccgctatgctcagctggtatttgttgttggttttctggtttgtttttttgttttgtgtattgtttttgtgtgtgtgtgttaaagtgcatgtgcagtgcacatgtgattgtcagaggaaaactctcaggagcctgttgtctccctacactgtggcttctggaaaccaaccttgggtcatcatcttgtgtggtaatcgcgttcaccgtttttcctatgactgccattctgactgggggacgaggaactctcgtgtggcttgacctgcatttctcaggcggctggtgaagctgctgagtgcttttttcttttttgtagaggtgttgactgtgctggtttgagaaccctttattctaaccagtgcccctttgggatgatcccggtgctcttccctagcctctgctgttgaagccctgccctcacccacgctgagccggccttttctctctgtctgtccctcctgcagcactctgtccaaatgctgccacgcaatggtggcgctcatctaccccttcagctggcagcacacctacatcccggtgctaccgcccgccatgatcgacatagtgtgctcgcccacgcccttcctcatcgggctgctctccagctcgctgcctctgctcagggagctgccactggaagaggtgagccaaggagccctgcagcctgattcctagggccacacagggagcgggggagtgctgggcaggagtgggaagatgccagggcttgctctgtggcaggtccttcccagagtctctcctaagtcatttcccctctaaatggcatggcctgtataagcagccatttagaagccatcagacatagccatctgccccatcttcctgtccccctacactgggcagagaaagcagtagttggaatatgtgcttaactggtgacagagtaggcaagagcttagctataatattaaaataaataagtaaccacagggcgtgactgggaggatggttcagtgccaggcctgatgagctgagtgcaatcctctgagaggcgcatgctgaagagagaacattggctcttgaaagttgtgttcttgacttccacgtgcatgctgcggtgtaacacacacacacacacacacacacacacacacacaaacactctaaagcaaggatgtgggtgtcaccctcctgcaccccagcacccaccaagcaaggtaggagg

SEQ ID NO: 31175 - DNA, 1104 bp, Mus musculus
cgtctgaagatagctacagtgtacttatgtataataataaataaatctttgggccagagcaagcagggactgagcaagcagagttgacctgagcgagtggggttgaccagagtgagcagaggtcctaaaaattcaattcccaacaaccataggaaggctcacaaccatctgtacagctacagtgtacccatatacattaaataaataaatctttttttaaaaaagagagaaaagggaaacgactttacgcccctacgaagccatcagctgtggcccccttgagctcccacactccatccccccaatcctggagtcactctggcaggtccactgcaccagaactgagcacgctgacttcggcagagctgaggtgcttttcttattcccgtagatcttggatgaggtggaaaagaggagaggaatctcccctgccctcgtgcagcccctcatgaggagcgtcatggaagcccctttcccagccctgggcaaaaccatcattgtcaagaacttcctgccaggctcggggactgaggtaagctgttggattcatttcctctgccaggagagcaggtggtccagccagccgcgtccccatggctggagaggctgtgtctttcagcagggcatccagttcagtggtcagtcttcacccaccctcagtccagtctgtccagcccaggctcggcccctggaagcagccagcaagagccatgctggacagcatgaggtttgtccgcagacatgcactgtgcctcattggcttctttcaaagctcagtcagtcatcagtgttatttagatctattcacatcttgggcctgcatcactttctaactttttcagtgaagactgtcttgggtgtacttgatatctaccctaggcttcaaagcctgtccttgacctgtgaggacctgggacctgatgacaacatatgttttcctctctcttttcacaccatcgatcccagaaaacatcagagcactggtctcttccggccttggatctctgttggcaaccagttgcttctagacacagaagagatgagggtgcatccggagcataccagatcaacccagttgtccagtgctgagcagttgttgggaac

SEQ ID NO: 31176 - DNA, 1163 bp, Mus musculus
actcacaaggcttgaccaggcaagtcagacctcaggccaagaaggcctttgtctgcctctctccttcaggcactatgggccttctgtggtgcccagtgagtccactgcccatgggattagaggccctgttctgtgctgacacagctgccgggaagaagtgggggaggatcaggcactgtgttggcctgttgcttcccatcaacagtctgggggacagcctgaaaaatcccacctttaaggtgctccggtggcttccctttgaggctacagtcagggtccggcgaactaccgccagttgctgatttttatgaatgacattgtgggagatttttaatgaatgaagtcttatccctctacttaccctacgcacattacatgctgtatatgggcttggtatggtttagaagctgcagcagagagggcatggcccacactgccgtggatactatctggctttgaggaagaactttgctggctcccactaggtctaaggctcacatccttgctttcagaggcttcggatgcaaacatcttcacgatggtaccattttcccccaggaccctcagaacccttggagccccaaataaagactcctgtcaggattcgctgctttttactgggcctcagactgaggctcactcccgtatcctgctgtcttcccttttatcaaacaagaagctaccaaaagcccactcctcccacaaactccctggcccgttatctgggagactgctggacccttctctccaacagtggcaccaggaggcattgcctggatgcagcctgcacatagcttctgccaggctccttggcatgctctccagagttgaataccatactctggttgcttctcatctcagatcttttcattagtcaaatatcctgtaagcaaactagcctggtataaaacttgaacagaagcagatacccaccagttgccagcagttacacagatttcagtgtcttgaaagtatcaggacattttcttggacttcactgcaggtagaattaggctgctaagaaggctgatttctgtgtcaacgtgataaagatgaccgcactggccacagcagttcagcactccactggtggaaacttcctgtgctaagcagttccttgcttcttgtacacccatgatgaatgggagaaccaaccacagggc

SEQ ID NO: 31177 - DNA, 1413 bp, Mus musculus
tatacataaaataaatttttttttaaaaagtgatagcttcagtgttgtggctggcaatttatatataatatttacatctgagtcctggcaattctctatgattggccaagaactgtaacttacaaacccctcctgtgtttatatctctgtgtctctggtacagggtcaaggcagaagttgcaaagactagggaagtacctggaaggcaaccacttgggaggcccattcctttgccgaagactcatccagcagtgcccttgggaaggagtccctccgggagcccccacaccctcatgctggaggccagagtggacatgctcagctccaacatgatcatcagtggcccggctgcagaccttggcgctaaagaagccagcagaccctggaagaagcagcttaacagtgtcccgaactctggaccatccgcccgagccagagcccagccccagcccctcagcataaaggacaagatatccaagtgggaaggcaagaaggagccacccgcctccgatcccgccaggcaaacagatggccaagaggaccacctgccatcctgcaaggtagagagaagaggcagtgagctcaccagaactaagaatggaatgaggcttgaaacagagagattgcaaaatgacagccgggcaagaactgtgtgtcaggacacagaacagttgccaggcccgaggcctatcgatggacagccagagctcagccagcaccgaggtcgtgagctgaaacccagcgatctacgctttcaaagtgaccatctctctgtgctgagacaggtcaagagactagagaaggccttgaaggatggctccgctggcttggaccctcagatgccggggacttgttattcacctcactgtctgcctgacaaaacagaggaagacctgcccagtcttgaaagccacgagaaggggggtgtcttagcagctggccggagagctcaccacctggaggtcagggagccgggccctgagatttcagaggattggaaaggccaggagagtgtctataggggctccaggtggtaccccccaaagccttttatcaaccctgtccccaagccccgcagaacattcaaacatgctggagaaggggacaaggatgtcagcccaggcatcagcttcaagaaagagaagagaaacctgcctcccctgccctctctgcctccccctcccccaccgctgccttcctcccctcctcccacttccgtgaatagaagactgtggaccgggaggcagagacccagtgctgaccacaggtaggtgctcaccagatgactctgctgctgcccgtgttcctgtgtaactgcctcctctccacctgctggctcacattcacctcagggctcttacataaggccagtcagtgtttgttctgtgaggcagcttgttggtctacctggaa

SEQ ID NO: 31178 - DNA, 1236 bp, Mus musculus
ggttctgagaaggaagtcagggggtttgggagggctgcctggtattgtctaagtcacatcatcacttcaggcactggaggcacatttgagctatctggggtctaccagtggacctagtattctctgaatccagatgttagttctgctacctactacctgggtctagggaaggaccactggggcagggctctgaatctctgtccttgtaattctagcacttgagaggtagagacaggagggtctatcagaagttgagggccaagctaggtgacacgagacactgtctcataaaattaaagccctagccaactggaatcaaaatttcctgcccaaattcttgtttgagagcattcagtagcaagggttttgtgaaatgcccacctctttgccttgtcacaggctgcccactgtcccctagaacttctgcaggtgtcccaattgatgctaggctgggagggttgacacagacctgaatggtacagtctcttccagatatttgtggataactttgtacacggagatctacaccctggaaacatcctggtccagggtgctgatggagtgtccccaagcctggagatgcaacagcagcaggtgaatgtctgtgacacactggtggctaccatagcgcctgccctgtgcccactgcgcctggtgttgttggatgctggcattgtggcaaaactgcaggcttctgacctgaggaatttccgggcagttttccaggctgtagtgatgggacaggtaagatccactggggttgggcttttaggctcttgggaactgaatatattgctccttatcctgtgtcactggtgaaagcccaccattgccagaatgctgtggttagattcgagtggaacaggtgtgggcatcatgacaatgtgtcctcaggcttggcagcgtaaggttggaacctttaggaaggcattttcttgtgtattttgcatctgtagtttcttctctcactctgtccgcaaatttgttggcatgacaggagtctacctttaaagaaaattttttattatttcatatgtgaagtgtgagtactggtgcacatgagacccagtgtgcatgtgatgggcagaggaaggctttgcgagtcagtcctgtcttgtgtccccacacttaacacttcacacacttcacacttctcacacttcacacacttcacacttcacacacttcagaggctgagctcaggccatcaggcttaggtggcgagcacctccatcc

SEQ ID NO: 31179 - DNA, 1168 bp, Mus musculus
tagagtgctctgcttctgtcctctgagcacttctctgtgcccttgcttcttggaaaggagctttggccgcacattgcctgttggagccatctgctgcatttccgttgtattaggctgtaggccgtggatgatattgcagcagacagggctccaagtcaggagaagactgcatccacttgagactcccaaatgtcacagcaggaggggagggtgacagtgagaaactgctgagatgaggagtgtgtatgaaatctgtggcctccacttcttatactccatcataaacacactcattggcttaggctgctacctctaaaagagtcccagcccctgggtagtgagtagattgaagtgggttgagccagtggttaagggcggatagtgctcatgctatgtgtggcaggtgttagctgtagtgattacattgtttctcctctcaagctttattttgaaacttaactggctgcatttatgagtacagacctttgaccttgttttcttttgatccgttgtcaccagggtcacttttcatatccagatccttcacagtggacagatgaagaactgggaatccctcctgatgacgaggactgacactgtaaactctctggacgagtaggtgtgccctaagtttttttttttttttttttaaggatacacagagtgtcatatgcattggtgttttccctgcatgtttgtctgtatgagggcaccagatcctttggaaccagagtacacacagttgagagccgccgtgtggttgctgggaatcagaagcaggttctctggaagaacagcaagcgctcttaactgatgagccatttctccagcctctaaagctttttcaaattctgacctgttttgcgcgtttgatggccttgaacaagcctagcctgacagcacgccgcaccgccgctacttctgtgtaaccggtttcatgtttgctagcctgtgcccctttattccttcttcttatcatatattaaaaacaaaaaaagtatttttagggttaggttatagtttcggaacactaaccaccaattgaataaagacaggccagttctgcacagggaggtccctgggttcagttgccagcacaaagcaaagtgtaacaaaccagagaggaccaggcttgttggttctttcttttaataccagcactcgggat

SEQ ID NO: 31180 - DNA, 3216 bp, Mus musculus
tttgcaaatagaatatccagttcgtacttatatgcatcttcaacaaagattctctgtgacttgttggatttggttcctgaacagcccatttctgtatttgaggttaggagggcataatgaggcatcctaaaagacaatctgatataaactgtatgctagatgtatgctggtaggggagaaagcattctgtaaagacatgatttaagacttcagctctgtcaaccagaaaccttgtaaatacttcctgtcttggtgcagccccgcccctttgatcacacgatgttgtcttgtgcttgtcagacactgtcagagctgctgttcgtccctctgcagatctcacctgtccccactgcacacccacctcctgcctcttgcagacctcagcatctagctttagttggaaacagttcagggttcaggtgacttcttaaaaaaaaaaaaaaaccctacctcctcagaatgaggtaatgaatagttatttatttaaagtatgaagagtcaggagcgctcgaacatgaaggtgatttaagatggttcctttcgtgtgtattgtagctgagcacttgtttttgtcctaaagggcattatacatttaagcagtgattctgtttaaagatgtttttctttaaaggtgtagctcagagtatctgttgttggaattggtgccagagtctgcttaatagatttcagaatcctaagcttaagtcagtcgcatgaagttaagtagttatggtaacactttgctagccatgatataattctactttttaggagtaggtttggcaaaactgtatgccttcaaagtgagttggccacagctttgtcacatgcacagatactcatctgaagagactgcccagctaagagggcggaaggatacccttttttcctacgattcgcttctttgtccacgttggcattgttagtactagtttatcagcaccttgaccagcagatgtcaaccaataagctatttttaaaaccatagccagagatggagaggtcactgtgagtagaaacagcaggacgcttacaggagtgaaatggtgtagggaggctctagaaaaatatcttgacaatttgccaaatgatcttactgtgccttcatgatgcaataaaaaagctaacattttagcagaaatcagtgatttacgaagagagtggccagtctggtttaactcagctgggataatatttttagagtgcaatttagactgcgaagataaatgcactaaagagtttatagccaattcacatttgaaaaataagaaaatggtaaattttcagtgaaatatttttttaaagcacataatccctagtgtagccagaaatatttaccacatagagcagctaggctgagatacagtccagtgacatttctagagaaaccttttctactcccacgggctcctcaaagcatggaaattttatacaaaatgtttgacattttaagatactgctgtagtttagttttgaaatagtatgtgctgagcagcaatcatgtactaactcagagagagaaaacaacaacaaattgtgcatctgatttgttttcagagaaatgctgccaacttagatactgagttctcagagcttcaagtgtaaacttgcctcccaagtcctgtttgcaaatgaagttggctagtgctactgactgctccagcacatgatggaaggcagggggctgtctctgaagtgtcttctataaagggacaatagaatagtgagagacctggtcagtgtgtgtcagctggacactccatgctatgggacttgcatcttctgtcctcaccatccccaagacattgtgctttcctcagttgtcctctagctgtttcactcagacaccaagatgaattactgatgccagaaggggccaaaatggccagtgtgttttgggggttgtatcagttgactggacaataactttaatagtttcagatcatttatttttacttccattttgacagacatttaaatggaaatttagtcctaacttttgtcatttgaaaggaaaaattaacagttcctataagatacttttgaggtggaatctgacatcctaattttttttcttttcagtgggtttgcagcgagggtcttgtatgcactaggcaagggttctaccactaagccacatttcccaggaaataaaatgttaacagttaaaacatacacacaaatacacaaacaccttattaccactttagtaaagtgagagatgtgcgtcctttgtctcagtctccacgatttcagctgccccttgtatgaataactcagtctcgctaaactgtttacttttatttacctggtttgactagttgcagctatataaccagttgtgcatgaggacaacagccagtgtgtttgttttgtttttggttttttgtggtacattttttgtaaagaattctgtagattgaagtgctctttgaaaacagaactgagatatatttattcttgttagcatcaaaaaacattttgtgcaaatgatttgcttttcctggcaggctgagtaccatatccagcgcccacaattgcgggttcccatctaccatgtccacaggggagacagacgggaagcacatgaggggtgtgtttacagagttgtaggagttatgtagttctcttgttgccttggaaatcactgttgttttaagactgttgaacccgtgtgtttggctgggctgtgagttacatgaagaaactgcaaactagcatatgcagacaaagctcacagactaggcgtaaatggaggaaaatggaccaaaataaggcagggtgacacataaaccttgggcttcggagaaaactaagggtggagatgaactataatcacctgaatacaatgtaagagtgcaataagtgtgcttattctaagctgtgaacttcttttaaatcattcctttctaatacatttatgtatgttccattgctgactaaaaccagctatgagaacatatgcctttttattcatgttaactaccagtttaagtggctaaccttaatgtcttatttatcttcattttgtattagtttacataccaggtatgtgtgtgtgctgtactcttcttccctttatttgaaaacacttttcactgggtcatctccttggccattccacaacacaactttggtttggctttcaatgtcaccttatttgatggcctgtgtcccagtagcagaatttatggtattcccattgctggctgctct

SEQ ID NO: 31181 - DNA, 1165 bp, Mus musculus
caacattccctagcaaccagtccaaatctgacagaaattaaacactggagaggttattcctagtaagagaaaaatatcagatgtaataatattcaggagtctaaggcagaaggtcatgggttcgaggtcatctatatagcaagatattctttaaaataaaaaagtcaatgacagaacttacaaagtcaagtagctggggctaccaatatgactcaggtggtggatggggcatgccttttatcccggcacttggagacagaggcaggcagatctctgtaaattgagaccagcctggactacagagctagttccaggacacccaagaccacacagagaaaccccgtctttaaaaaaaaaaaaaaaaaaatgaggctagagagatggctcaggggctggaggttaaaagcactgattgtcttccagaggtcctgatttcaattcccagcaatcacaaggtggctcacaaccatctgtaatgggacctgatgccgttttctggtgtgtctgaaaatagcacagtgtactcatatacaaaaagtacgtaaatcttttaaaaaaaaaagcaaaaggaaagtagaaaggtggctgtgtgaggcctgccaaggctgtgagtttgaggctgccccgcagcgtggtacccagctgggacattctccgtagcttgttattttcttgatgtggctgaattgttttttgtggattccaatgactcaaggtttaaactagtgacttatgttacaaggtttgtaatatatttagctgatcacctttcagtgagacccaaataaggcttttctgtcttgaagttctttcaagatgacgttttaaaatcagctcttgtcctccctctacaggagaatttgcagccttcaagtagccagtccatcatggcagcatctactctttatttcttaagtcttgtgttcatacagtttgttaacatcaaaacacagttctgttcctcaaaaaattttttaaagatacaaaattttcaatgcataagttcatgtggaacagaatggaatttcctattcaacaaaagagggaagaatgttttaggaaccagaattctctgctgcccgtgtttcttcttcaacataactatcacgtgcatacaagtctgcccattcccaagaagaaagaggagagaccctgaattctgccc

SEQ ID NO: 31182 - DNA, 1232 bp, Mus musculus
tgttctttacccattttcactcagcaacacaactgtagtgcctttgatgccagccatcacctatatggctcctagttctctcttagttctatggcattgaagtgaagacatttggcacagtatatatcaacaatattgtcctcctttgtacaacaccaggactacagagatttctgtatcattttgggcttgagaaagttgagaagatataaatttccttggtgtccatcatagggagtcccaggaacagggaaagatgctatccataaaaacagagatactggagtggaggacctcatatcctttcaggcattgaattgtccccttggggttctaagttgtcacactgacttttttccccaaaagaactgaacattttttaggaaggaaagattgaacattcttccaagtaggctgcacttccctctgctggatcaaagcttcatctcataggcacaagtgatgtggtcactgtcttctcatgtgtaacagggcccgtgcagtagccttcacctccttgggagggagtctaggtcatgaggaaggggttgaaccatgtaactgggaaacactttccctctagccactggctgagatgcactgtttgtactgctgtgatttttttttttttctctatccctccttctccatcaacaagaagtgagtgcagcccctggcaatgtgatgactaattattttaggaaacctgagtgagttactgtggttgctgtaaacatctaaacttgaaatctgttttgtgcaaagcaaagacagtgtttgcatgcaccaagggaaaactggtggtagaaattgctgaacaatttgcttctaactgtagtgggaaatatcctttttgagaaatacgatggatcaatgtaatttttctcttcatgtaaagctgttattgaagtaacaacttatcttattttgcagtcctaaagtaataaataaaacatttatggcttggaataaattgagagcatcccattacctgtagtagcaggcaagttcacattcttttaaagcctcaggcagtaacatcagcagatttttttttttcttccttattttctaatccagaagcttctaatttctttgtgtcaaagagcttccattctggttctgagtaggtgtcgagggaccctttctgatatgactacattttggagaacctcttgtaaattgtatttatcattagtgcccagtagggaccgtgctgtatagaaagaaca

SEQ ID NO: 31183 - DNA, 1194 bp, Mus musculus
tcttgatctgctcagccttagagccatagaatagaaaacagtttgagtaccgggtttcttctgtgtatacagatggtgaaaattaactggtaacaaagactcccgaggaataaatttagtatagactaaaggaaaaaggattgtagcatgaaaactgaatgtcccttctcatagcctgtggccctgcaggatgtatgcttataataaaaggaactaactactaccactggtaaggaaagccaggtttttgtcctaatgtaaaatcgtcattgagtaactgcatactttggttgtgatgcttgtagtgactctgttatggagatcatggatgagcttgtgctctttggctggatgacaaaaaaaaaaaaagtatgcgatcaacagctgaataaagaatttaattgaaaatgtctctttctttttcaggtgtttggcaaccagctcattcctcccaatgcacaagtgaagaaagccaccgtctttctcaatcccgcagcttgcaaagggtatttcagtttgtgacttactgtatttagtttttctaaaggcaaaggacaaaatctccacaaaggcaggtggtggactgtgtgctacagtgactgggactggttactgtgcagccacagcgttagtctccgagtggaagtcaccgtgccgcaaattgatgttcatcaaacaccaaggatttatatcagcttgagagcagtcctactgggaatgattgctctcctgctttgcataaccgtgttaggctgccatcacaaaggagtttgagagatcaagagcacagtgggctcaggaggacagtgtagtctttacaaaggagggaaccttctactggccttagagaaagttcactctccccaaacaaggctgtggcctggtagggcagtcacctaaggacggggaagattgttcctcagtaagtgctgcgcggggcttttgctagaagtggcatatttgttgcttagttgatggtacccgttgtatcaccctgaaatgcagggtactgtgaagacaaggaaaggttgtggaggaactcagaattgccctgtctgggggaaaaagccacaagcaggaaaaaaaaaaaagtttacagtgttagttaggttgtggagaatataaatgcaaaggcatcatcgaccactttaaagaaacagtttaaaaattacctttaaaaaatagaatgaaaaa

SEQ ID NO: 31184 - DNA, 1111 bp, Mus musculus
tagctgcctttgaatttctcatataaatatcattaagaaagggcctggagagatggctcagtggttaagagtactggctgctcttctagagttcctgagttcaattcccagtgaccacttggtggctcacaaccatctaatggggtcctatgccctcttttggcacacaggtgtatatactgatagagcacttattcattaaattaatcaatcaatctttaaaaatatatatatcattaagaaaggcaaagcatgcatcattgtattttaaggaaattgtatttcagtaagacagctaagtgaaaatgtacatagaagttagatgttttaatactgtttttggtgtgtgtgtgtgtgtgtgagagagagagagagagagagagagagagagagagagagagagagagagagagagagaaacagagacagagacagagacagacagagagtcagagacagagagaaatttatttgattttcaactctgccatttgtgtggagcgactttgccacttctacctttgattcctggactgtcttgagttttgacctgcattggactggagtgcagtaatggaataatgttcatgagacgtgcacaaggcatccaaaaaagtgtcacagccatgttgtttgccttgcctcagaatttacctttatgattggaagagatttattccctcattcatttgtatactaatccatcatttacttagtgagtgcatttgaaatatcccatctgtaatccttgaagttggctgattcaagaattaataaggactgatagctatttttgtaagtttcttgagttgtcctaatgaccattttgaaagctgtcctcctcgtgtgttgaaaacattgctgatgaactggtgtgtatcaagtgctagcggaataaagatgggcttctgtgcttgggagatgtagactggctttacattatccttgttagtcatctatcctaatagatatcctttgcttttcctttcctagtaaaaattcagctctcatagaaatacttttgatctgtctctacaagtttaaagatttggaatgagccctagtgtttaaacttaaaaaaaaaaaattgtgtctttttccagaagagcat

SEQ ID NO: 31185 - DNA, 1336 bp, Mus musculus
tttgtggcttaatagcagtggaggcccttagacatgtcgctgtctgtgacagggttttgaagcatgagcacacactctctgctgtattatttcagcagccattacaggagagaaagtcaactggcctggcaagatgagagggacagtgaccttgggcaaatctgtagaacagaagtgcgcaaatagcctttcaatgactagtccttcttgatcaagagagagagaggggaatgggaggtagtctgctgcctggcactttaattcattttagtggctggaagttgggtgatactgtaaaattagaaaaggaataggactttttttggtgctatatagagaaatgaaaatggggaggaataaaactccttttagagattcctctagaacgtcagcatggcgctgcctctcagaaccatgttgacttaaattctgacaggtttacagcagagggtttgtttgcatttgcagcaggtgcctgtgtggtttgctgagtttactttgcttcttaatgatactggggctcactgggacagggcagggttttataaattgtgcatagatggagctgcaaagtgaaaagcccataaaaaagaaaatatatgtaactgacattgtatctgggtaaattaagcaaggagagtttttttacatatatatatatatatgaaagtcaggcaaacccaaagttcattttccttgcccttcagaaatgccatcagccatgagaaatgggggattctgtcctcttgaactgcctgcataagtggctgccaggctttgggtcagagataaacaaaatcaacttcatttatttgcccaaaacttggataaatttttgcataagtctagaatataatctttcctgaaaaaaagaagtcatggtaatcaaggaaatctgtttttcctagtttttttttttttttaaacatagtgtccctgttgccttaaatgtaaaaacctattttgagaaacaaccccagtctaaaagttatagcaataaaagaaccctaatctatttttgtttcaagtctttacctcatgacaaagtcagaaggataattggtaagttttgctctgggtactactgcaaaccgatgtatcctttctgtgtcctcaatggagtattatttacagacctgaaggaaggtgggcttaaccccaaggctaagtgtaaatgtttcttgaattgattctttctgtggtacaagttaacacctgtgtatatcatatctgtatatatctgaaccaagttatgtgcagaggttgataataactatatttacaaaagaaatttttacaattaaagttcacattttaacatgagcctgtgtgctgt

SEQ ID NO: 31186 - DNA, 1253 bp, Mus musculus
ccactgctgcttctttgggtttagtcttaggagttctgtgagtcagagtcagactctgggatgaactgttcagaaaacctgtatgtcttcgtttgcctttgttgcatatgaaaataagataactatgtgtccccgtatggccttagatgttcatctgcttaaagacagaaactaattagatgatctttccaccaagttcaaggagtcaagttaggatcgcctagtcgtgagagggcaagtctgaaccttctctgttcgatggagggaccacaaaggaggaaagaattcttgaaatccttcctaaagtaagctatgagttatagcatccacccaccctccccactgcctcccagtcctcttggtcagtgctgaagggtggtgctggccctgagcttatagactcataagcattgaatatcctcttgaactaactaacaggttcaaataggtaagggaagaagtttccagtttctctaagagctctgtggagggatggtacacagtcagtcctacagcagatacttctgatgaattctgaaatatagccagggcccaagctggttaactcaggttgcaatgtgatgttaacaggtctctttaccaatgtgaaactcccacagacatctctgaagtagagacaacattccttaggctaagcaaggaacctaacagatttgtcagggaaaacataacagtgcctcccatccaagagaatggctggaaatcccagactaacaaccatgcctgcttcttttggtctgtgatgggactgcggtcactttgttctttggggctgggatactttggactcatgcactatgttggagggcagctgtgaaccatattcagaaagccatgtgaatagctagctagccagccatcagacatccatgtctgtagctaaagagcagccaggttgatgcccacagcagagagaacttcaaagagagggtccatgcctcttagttctgggttcttgaggcttattgcttagctcaagaatgttcactgtagctccttgataaaaaatccaagagtaaagaggttggtgtgtgtgtgagaatgccaacagacactgatgagtcagggtaacgtcttttctgtaaatatataagtttaggcactgacataaactgttccatctaattgattttttctcctctgcagtgtgggtttagccatcattccagtaacacaatgtttacagaaaacagctgtgctcagtggctgaagtttctcctgctttgtcctta

SEQ ID NO: 31187 - DNA, 1179 bp, Mus musculus
tgtcagcttcgccaagtgctgcattttaccatttccactataacaagagctgctggccgctcttaggtagcacctgcattttgccgccttctaaccattttacatgaattcctacctaatactatgagtgcagttcagtagagcatcatagaaagaccagtgactggagcaggggcatattgacatcacatgcagagtcaggtattagaaacacagcatctctcttggtttccacttatgctaaagccttttgcattgccaagacttttactttacacatactgttctgtaacaggagaatctgtgtacttccttctccaagggaaaacttacctcttttgttttattaaagacaccgggatttcagtagactgtgtatagattaatgatgagctttagaatgggaaatgcttatgggagctttagagtgggttattttgtatatgctagcaacctaaaaatgggttaaactctttctatccgtatatgaaaaacagtgatattatcataggttagtagcgataggacctatcacaaaaagcaggcctgtttattcccttatcaaagttgagttgtagctatgttagcagggcaggggttgtatggctcattcattgaagtcactgatggtgaaattccatgttgataattgaagaaatgcagttatagaagggcaaatgcttcttaaacaaccagttgctagaagcttctttgatgatgaaactgcagtcttttcatagaggagttttctaggtatctaaaatagcttaactcagaaatgatgtacagtgagagttcagaattaataaaagcatattctatatgcctcgttctcacatggtggcagcatacagcgtgagggcgtccaggacctgtgctcgccactggcatcctgtttatacttcagttgtcagctccagtcattaacgccattagcccctgtcagtggatggtcgtgtgtttgagtttctgcacgttagacattcacacctataattacacacatgctgtgtttatttaccccttagtcttacaaataaaagaagaatttatggttgttttggttgtcagaagtgttttaaagtggagggaatctgcattctcttcctgacgctcctgtttatgaggagtcagaggttctttctggtcttgggacttacctgaggaaagttatggtaa

SEQ ID NO: 31188 - DNA, 1115 bp, Mus musculus
ccaccaccctgccacctaattgtctgggtctcagttcctggaatgacgggtttctggagtgcgagcccagataaaaccccctgctggtccttcacttgccagggcggtaacggcctggtgaggactggaagctcccagttccctgctgtcttctgcccgggtttcatctgtgctgctggagcttgggagggtatgggttgcagccgtgcccctcaggtcagagtggggtgggaagaagctagttgttggcatccccttcctcctcatcaaaggactgcacacctgaggatgtgacatcagacaccttccggctgagagcagtggacatctctgggtcctctcgtggggaaagtgactccagatcccggcatcctgcatcttcttcctcctcaggggccagtggtctcttctcttcctctacaggtcccctggccagttccaccccaccaacctctgatgcccagtcagtgtctacccccaacaaaggtggaggctcctgagcagagtatcctgaagcaggttgggaaggccccatgtcatgcaggctcggctgtgagtcatcaaatgcagggccaagataggatccggtagctggagatgcaatgagggactgatcacttgcttcccaggcgtcagatgaccccagacagtacatcccctgtgacacgtaggagtgaggccatccatccattggggcttgagctagtgcatctgtaaacagaaggagcaggcttggaggagccacagaacactcatcatgggcagtaaggggagctcacagaactgtcctgttgttatgacactaatgcagaggcactggagaagctgagacaaatggaaaactcctaaaaaccagggacgggtagagggggtctacatagctgagaagcctcttaggccccaaggcttgactctagaaccatttctcaccctgactttccatcagctcctggtagttgtcactgtagttgcagtccagtggctcctgggtagaattgacactcatgtcctcaccatccatggaagaccaagccataagtgtagcctcagaaatagcaaactgttccatgacacctatgagaaaaaaaatgtaattttatttagagtcctcagcc

SEQ ID NO: 31189 - DNA, 1371 bp, Mus musculus
tggaacactggtcagtacttctaacacctacgatgggtccggccttgtcactgtggaaactgaccacccactcctctggaccatggccatcaagagctaacctacagtgcggcatccatcttgtgcctgtgccttcccttacctgcccactggttcgttgctcagcatgaacagccacataggtgtgcagaaatgtaaacttctccatggggaaccatgagctttcaaggtgttggggttaaggtatagctgagtggcagagcacttgttgcgcatgtacaaggccttgggttcaaccctccacaccacaaaataaagatggtggtgtttaaagattccaggtaatgctataaatgatatctcaatgttatattgagggaaaaattatggtctatcaaagcaaataagctgtattgtatggctaatatagctaatgaggatcattacattatgtaattcagttttgatcattttaatttagttaatcagtccatttaccttaaaattctttttttaaattttgaagcaccagaagcttttttattgtgttgccttggaatctggcacttccttaagtgcctgacaacaagggctgcctcctctgagtagctcctaacatcagactccggtctgtaatgtacaatagctcctcgagtgctgtgatagaatggcaccagttcactttgacatcatcttttcaaagataagaatcattgacttaattgttaggtttaaaagcaagcagctaatgggcttcgggtaaatgagaaatggcaattcaggattcattcaaacattaacccctgaaaacgtgaaagcacgctctctgagctctaggaatgtgggtgcccttatgaaaattgtgacacactcaaaggctttggcctgaggaatcgatcatgagcctggaaattcagtcacttttaacctatttcccactaggagcaggaaagatggctcagcggttagggacactagatactcttccagaggtcttgaattcagttcccaccaactacgtggtagcttgcatccatctataatggaatccgataccctcttatggaatgcaggtgtacatgcagagagaatactcataaacataaaaataaataaatttggagggaaaacacacttcacgctaaaaagcaaaatattactccatggaccatatctactgacattaccagaaaattagtgtgactatggagataaatgaataccacttgctgaggagtcaacaactgaagcctgtttctgcattccagtccaccatgactcgctctctctgctgtatggtgggaggaagtactcactgagtgtgtgaaagaaccacaggtataaactctaaatgctaacgtgttgcaggtg

SEQ ID NO: 31190 - DNA, 1189 bp, Mus musculus
attggttattactcttaagttttaaaatgaattaaaggtttttgcacaatatcataattaaatgcttccttcctttctgctttatgactggtctataacctctgactgtatggacatgtcagaaatcagtgaagccatctgcatggaaggaacgtatgaatgaagtgctacagtgaaacctgctgctctgctgcgttagcaggcacgtggtacagactaaaccctaccatcaagtagatcttgatatccagctctgccactttccagctcagtggaccttgaacaaggagcttgttttctcttttgagcagcaggtttgatgaatgcttttgtttttgcttatcaaatgttataatactgcaagcaccgtttgggtatttgatactatgacatgtctttgtattgttcacacttgtgacttctaattgggctttccttgcttaggttgacgtgattgtgacactgggaggtctcggtgggcgttttgaccaaatcatggcctctgtgaatacccttttccaagccactcacatcactcctgtgccgattataataatccaaaaggactctctcatctacctcctccaacccgtgagtaaacagcgcccctcatcagcattctgctcacagagccagtgttcctgcctgcctcagtctctcacaaagctcccttccttgaattgctctgttttatccactgccttgtgactgaagagcacaaaggtagaaaaaaaatcagattttctgtgggttagtgctttctgtttttgtttttggtgttggttttattattattattattattattattattattattattattactattattattattttatttttctcagaaaagaaagaaaatcttgtaacttttaattgaattgcctaagaattaaatttagcacttctgcattttgagtggctgagtgtgaatgacactcaagaaaagcctcaccagggaagcacagcttagcaagcatttcagatgggatcctcatggatttggagtgctgtcattatgattggaaactgggtttgattttcttagcacttaaaaggaaatctttagcttttactattcataagttgcctgcttattaattttgctccctcaagtaattctctaaaaaatgatgtcactcctcttcaatggtaagcatcacgaattcttctgccagtgtaa

SEQ ID NO: 31191 - DNA, 1187 bp, Mus musculus
tttgcagcatcacagtgctgaatccaagttccagggagcttggcaacgctaggggttttatatccctacataataggacgttgtatggtattccgtacttctaagagtagtccataaatactgaacagaagtagtctaaaagtacaggacacacagcaagctctcacagttgtatatccaacaagttgtccttttgtctgaactagcatatactgtttttagcctcatcatatcatgtcttttccctttggaaataaggatatagtattggaaataaggattttcccttgaaaataaggatatagtattggttaaagtttccgagaagctcataaatatctccttaacacacagtgtgccagagagataatttccagggaaaagctattgcacccagcttctgcacttatgttaggaagtatgatatgatacgggctacataggaagaaacaatgccagcttctctgtgacattcccatggtggccttggattgagagtgtagctctggagtaagcattcttgcttagcacgcacaggacatgggcaacaccccactttggaaaaggggggaagaacaaaggaagcaatgttacctcacatgtgtgagatctaaatcacggtgactgccttttatggactccaactcagctttcttctttgggctcattttatgtatcacagccttaattgttcaataaatcataggctacattataatactattttactctttatctagtgattgtacacaagcagttgaaactttcagtagtgaaagctaattataatgtagaactgaaatctgagcactcttgaagaagcttggaatatattgacaggtttcttctttctttttgaaaattactttaatttcttttatctccattcagcatcttaacacaagcttttagaaaatgaactaattttcagaagactgttctttcccacaatgttagaattctgcatggtgatagcatcctaaatttttactgaagtttgaaagtaattttttcctttttaaaatagcagcactgtcaagcccatggcagaatgatgcaaataatcctcgtgggctggaactattcctatcctacacatgtaatttcagatgtagtcaatctttatgcaagtttgaattctatgtacctgaatcaatacttcacacatgcctagatttaaaagttta

SEQ ID NO: 31192 - DNA, 1338 bp, Mus musculus
catgcgaattatttgctaccaagatggtgcccgtagggtaaaatgaggaacatctctgcaggatgatttattgtatgtttttctttttttttagcctagccagaacatcattataattttaaagaccataagatggcttttattagatgataactaaataaactgaactaagtagccagaagacagtaccttagagactgatagttgtaagtttataaaaatacaaatgtaacttatatttccattttcctctttgcccctttgtttattttccccagtagaaatgttctgtccagattttttttcccctttttagttaagccttgcttgcattcaggcttgtgtgtcagccctgtgtgccaatatgccagattcattttgtttccatccctgcactttggttattcctcgttcagtttcttgggaattgaagcagactcattgggctacatttagtacaagaaccacatgtgtgatgttaaaggacacagtctagtgatgccatcatccttgagtaaaaactacctctagattgtggtaagcttttactgtcccttaaaacaggagccactagtaccttacgaatgcagactgtaacttctatggcattttctggtgtctttctggctctctgggcttctgaaagttttcacgtagacccttagactcctctgtcaggaccattgctttccagcgttgctgctttcactcgctgtctcgcagactgtaccactgtaagtgccactgcaaacatctttaaacggcctcctccttggcttgtcaaggggaaggccacctgtaagatgtggtggtgacagccttcctgtccaccccaggctgctccttaccagctgttctagccgattctcttcagatcagctacagcccacctcctccccgccccgcctcacccctccaggctgtctcagtggtccagggcagagctcactgtggccttactgatctatctctgcagtaactgttctccctcagttgcgatggaagcaggcccctgcgatctgttcagagcctgagcagtttgcagttccgttgtgctttctgaggtcctagattcaggatgtagttaagtcgataactgagaacagatgagatgcttttaaagaacaaactcttccttacccagctttgtagcttaaagtaagttttcaagttcatggctttattaaaatgaactttgactttttaaaatgcttatatctcatttcggttcttttgtttattttagtaagaattgaaacagactataagtagttttcctgtttgtttgtttgtttgtttgtttgttttttacaaagttcaagaatgtaacaataaagg

SEQ ID NO: 31193 - DNA, 2565 bp, Mus musculus
aaaattaggaaggttgagaactacataactaaagtatactacaactatatctagttttaattcattaataaagcaataattaaaaaaaaatagccaggcatggtggcttatacctggagtcctagaatctgaagcagaggattgctgtgagtttgagatcagcttaggatacatggtgagttcaagaccagcctggattacagtgtgagcgtcttaaaagaaaagcaaacagcaatagctacaacaaaagggacagccatcccagggcaataccagatcattccagtccacattatctactctgttagggagtggtttacagcaggcaaaatgtggcaaatgtgacatttcacagtcatggaggaaggtaggagggaattcttcaatgaagaccagcggaaggcatgctgggagagaagagaactcttcccacttctccccaccaggggtgagaatccctctacttcatactcctgctttctcccctcactgccctctcaccctcctccctgctccatgactgggaaggaagctggcggtagaagggctggcacagagctggtgaagaggtgttgctgtggcagctcagaagggaagtggcggctcttacgtgcatcttcacagtacctcttgctgatggtttgccgcaagacggtggtgtccctatccaagcatgaagaacttctcagtgggacagtgtcacaccaggtttcctcatggctatggatggatggcagagaccgtgctagacattaaagaaagcaccaggaataatgtggttcggaagggttgaggaatgaggcagcttttggaagctgaacaagaaacgggaactagctttcgtatcagacacaagaagaggctactgtgtcattcagaagatagagtagatgtagggatgcaggggagcatccttccagaaggtggcgcctttgagccctttgctttagccagtcacacagatgccagactctgtacagactacaagactgtggctttaaatctataaatctgcattgtacaatgtagtaagaaattgaattcaagttcgtaaaagaccccgtgcaactccaaatctgagcaagtgttcccttccccaagcaatcttgtctagtagctactctgccccgggacaacttactttctaggtccaggtggcaatcctaaggaagaaagttttatccctagcgttcagcatttggaaactctccacatcggttctccctgggatatgcgttctcagcttcggggtgtctaaatcttatactctccctttaccagagttccttcccatgttcacaccctgtgtttagctggccttgtggattctgtctttcatttgaactcagactgctgtgcctttatttggcaaagtgtgataaacctagtctggtagagagcctggttctagagggctttactgggtgttgtggtaccagcagagaaaaacaagagcaggtgttaagcaactgtggtacccaaggctttgtgctaagctcttcttgtacggttttatttaacagatgtggaatagtgagattttccctcccctggtattactttgaaaagtctagtattgccaaagggggtgggattggccttcttagccagttatgtctgactatagaggcagcccgggcagctgcgggcactgtcttaagatttccagtgctgtgataaaaccccaatgccatagcaacttggggaggaaggggcttatttcaacttagctgtccagaacatagtccatctccaggacaggagctcaagcaaggctggaacctggaagtgggagctgatatagaggccatggaggagtgctgcttactggagagctgcttatgccttgttcatcctgctttcctacagcatcaagaccatcagcccagggatggcactgcccacaggaagctggctcctcccacaccagtcaagaaaatgtcccacaggcttgtacacagaaaaatttgtttggtgttccctcttcccaaatgactagcttgggtcaagttgacatagaacttgccagcactggtacagcttcctcaacggaagctgcctggccctgttaatcaggaaagggactcaaaatcacctgcattttaaatatttacattcaaaagagaatatgcatcaagtcagataaagccagcaaaagcctaacctgaaaagcccaaagaaatgacgtctcattttgcgggcattgccaggtggccgtctcttctcaaatgaaccctggtgcattggccacggttaagtgtaataatttcaaggtaatttctttgaggtccaagtgagctattttgctgaacattaagctggtggtcattttcctggcagttaagaggcgataagagattgtgtaaaagagtctcattaaaattaaagactgtgactccatgtgccccaggacaaccttaaggggacactaatttgttcaacatttaccattaagtcattgaaagcatactgatgctggctgggcctcatgttgtacaggagtgtaaagctttaatgtccttgcaggtattagtgtgcagtttcagctcatttccatttttttaa

SEQ ID NO: 31194 - DNA, 1173 bp, Mus musculus
ttaagcaacagttgaactttgtaggtactatctgtcttattttgtgtgtgtttagaggtgttctaaaaacccgtggtaacagggcaagttttctacatttttaagagcccttagatcgtggatatttttttctcaagaaaaactgatacatatccatgcagcctccgacattctctttcttttgcatctagtcgacttttaatgggctgttgtagcaactagtttgtgtccaaataatatttcttttggtgtcccataaaatggaaatgagaaaaggggcaaagagcctatttgcccagtcttcttcaatgacacctcagtctaggccagttttctgaaggttcctgtctggcttagccagggaagggagagtgagtggcctgtcctgcagcaatggaaccagcacacgtggatacaagcacccaagaatccagctaataaatgcatattgggcttattgcttttgttttttattgacttctacatgctgatgtcccatgtatgtagtcttagacctgtttaatatctgtaactatcagctataatattgtggtgaccaactgctataggattttgcctctgttttaactacaacatattggattgtatgtgtctgtgcctccatgggggattagagccagagggaatgtcttctttgctctgtttcttttatatttataacaaaaatatggatactttctagtgaatgcataagttagtgtgcttttcttattttgctttaaatttcaagtttttacactgctgtgataaaatcctcacagatagcatcctctggatggcacagtacaataaagccaacttgcagctgctgttactctggaatcatgtgggagacactgccatattttaaaccaactttatcacaggaactctatcatgatacagagacctgtgacagacacattagaatccgaagtcaccatcaacctgatcatcagttatggcttctcttctagagaacatgattgtctagtgaataacacatcttagggtaatcaggaatcttgggaaatttgctccaaaaatttttcttgattttatgtaacaataataggctttgtgtaagtaaatgggagcaattcttcctattggagcacccaaaaagaatttaatcactttatttttttaattacacaaaagttctctcttgaa

SEQ ID NO: 31195 - DNA, 1215 bp, Mus musculus
agtgttagcttttccaagtgttaagtgaagaatttctaaaacttacaggcaactagtgagattgcattgcttttcttaccttttagctaaactcttctcatttttctgggaatttcctaagcttgttctctgctgtgtcttcttttgagtttgtctgactattatgtaggtccaatgctctgtttcaacctttgatgactttagaaggtaaagaacgacaacagtctcttatacttgtttttctcaacgttttttcaagaacaataatagttgaatgattttggatgaaatgtctaaatatattttacatacataccatagagtgagtttatttccatgtagaaagtgagaatgtgtgaaatacctatagacacccacagattgtttctgtcagtgtcttgtcctgttaccaaccccagaaagtagaattgaccagttctctcttatttcatcttcaggtttgcctgcaatgagactttactctctacacttaaagaacattctttctgagctgctgtgaataaatttggaatgattttgtctattttcaactaatggagaactagctgtaacttgaacaaggattactgtactggacaacttcagaacattgctcacaatgtcatcaaacaggagtcagaatcctcatggactgaagcagattggtcttgaccagatctgggatgacctcagagctggaattcagcaggtgtataccagacaaagcatggcaaagtccagatacatggaactctacacgtatcctcttgcttgagctgtagttggtgtgtctagggttggattattttgtgttatggtgtttgaattattaggaatgttatgtcatatttccttctttgtttacctataataaaattctaagttcatttttatatctctttttcagcagaggtattttggctagatagatatttaaggtggtgctggctagtaaccccagatgtttgtgtgtgtgtgtgtgtgtatgtgtgtgtagcactcatggaggacaatttgaaagaatcacttcctcctgacatcacattgtgggtctcagggttgaacttaggtctttaggcttggcagcaagcacttctacctgctgaggttcttaccaacattatcctccccccactcccgccccaccatatcattagcttctatgtatgtagatttagccaactatagattgaaaatatttgaacaaaaaagtct

SEQ ID NO: 31196 - DNA, 1122 bp, Mus musculus
ctatgtctgactggagcttgtccttcctgtgaccctggttatgtcagaactcctcagagtcaagctgtctctgggatcctgagatcctggtgtgactaagctcctgggctcctgggatctttggagcgcctgggagtggagcttgctctgggtgttgtgggactggctgtggagtttgcacccaaggtctgcacagggaaccagcccagaccagaaggaacctgtgccactggtctggtggagttcctgcgtgcggggtccagctggtcccagttgttccctgtgttgggacagatcctcctcacctctgatcctgtgctcgggcttgctgtcttttaactttaccagcattttccactttagttttattgggaatctattgctatataaacagaaggaaatatgtttatgttaattactgttacgtctatggtatgtgttactttccttaactttctccaagtcatgtttataactactgtactagtgtgcatcagtccaaccaagcccggggtgctggagtccctccttccaagtcaaaaaaggggcagactcctgggggagctcagtttgttggcttggagttatacaagcgattgaaggaatttttgaagaattatttgacaaatcttcttaaggtaagatgtctcgatggtataagcatataaaaatgtccattttgttcacttttttcttacgtgcaatgatttttttgtgactgccatctctgtcatatttgctgctttagattaaaattgtgcttacactgggttagctcttgctagatccatatcctatgagttaggggctcattagctcaaaccattgcttaggcaaaggtgagtctttttcctttcattttttttcaaaatagggtttctctatgcagccttggctgtcctggaactcaatttgtcttggaactcagacccacctgcctcctgagtgttgtgatttaaggcgtacaccaccactaatggtgaaatcttttaccttagcttctgcctttggtttttagtagtttgttctgtaacaaaggaagtgggttgccttacactcagccatcaggtgatcaggtagcttcctcacctggtattgtgtatatgatgtcttcagtctaca

SEQ ID NO: 31197 - DNA, 1164 bp, Mus musculus
atataaactcagcagtagtacttgttttctttctaactgaaactattcattggtctttaagattaaaacagaactttcttagttccatcatcctccatcaaagaaagatggaacaggggaagagggtacaaacagcaagaacaattggatcagagcttccagcaacccagacagatgagaataacagaaggtgcacttgggagacagcacaaacaattcagctatgccttactgagagaactctccaatcttagccacaaaaggggagaaaggcaagggtcctggagagaacactcggagcaccctgctcatacagagaacctgagattggttcccagcactcgtgcctggcagctcacacctgcctctaaccccagctttctgtacctacacacattagatagtcttaacccttagaaaggtaaacttacaaagcaataataacccaacaacccagctgtaagatatgtcttaccagaggagctggacgtctcatcttttttctcttcttcttctttatcattgttctctcccccagtttcagtccctgcttctctgtcactgtctgtatcctttgactccagcacactgatggtgggggtgctgggtctgctactgttattcggaagtcttcctcttctgcggccccctgggcgtttaggtggtgtctttatacgctcagcagtaagagcagcagcaaactccttagctccctcctgtaaaatgaaaaatagaggcatcagagtaaagttctaaatattttggtggaatagagtaagacgacattgcataacacaagttgctcaagactctacacagtgtccattatcagtcattagatagcaacacacctatctattttccatctgcttttgatactttcaagattccaaaaatataaaaatagattcaatattttgttccaatgatgcaaaatcaggcaagacagttctacatggtgagtttgtaaaattaaattaaaatatagtaaatgaaaatatatttcaaaaaataaaggtatttttctctacatatacatacagtacgtttaaaagagaatatcaaaagacatattgaagtgtattaagtcagacttcctatttcaaggcttaaaataatacatacctctttaaaggtactatttaaagaaaacaagaacacaaa

SEQ ID NO: 31198 - DNA, 1149 bp, Mus musculus
ataatcaaaaacttagtttttactctaaaaatgtgagcccttattgcagtaaaaactagcttgtggtatagtatacataattcccataatgagatcacatatatgtaaaccttctactatttaagatttacagataaaagtatgtgtttataaataaaaatatgttttaaaagctgggcacagtggcacttgggaggcagaggcaggtggatctttgagtttgaggccagcctgttatggagtgagttccaggacagccagggctacactgagaaactctgtcttgaaaaacaaaaaaaccaaccaaacaaaaattaaataaaatcactcagtgacacatttccaggatttaactatacagagtacatgggcttttctctacaaatatcaacagtaaaaatgttttgttgatatcagtttgcttgggattaaaagatcatattcaagctggttagataagtgattataatatgaaatcattgcttttagaataatcatgggccagactgggaagaaatctgagaagggaccggtttgttggcggaagcgtgtaaaatcagagtacatgagactgagacagctcaagaggttcagaagagctgatgaagtaaaggtaatttcataaaaatgcatatataattgaaacgaattccttctacccccaagttaaatagatttacttcgaaatggtacattttcagtcaaggtcatgtttacagtaaagtcgactgagacctgaaagcgatggttcttgatttgtcttagttaaaattacatcatgactgtttggtgctgtgctgggtgcctctaatgccagcacttggggaggtagaagcagaaggacccgaagttcaagactggactgatgagaggctcatcaggtaaaagcacttgctgttaaatctgatgacctgattttgatccgtgggaccttcatggtggaaggagagaaccaggccccacaagtcctctgacagatagctatagaagcgctgtagtatgtaatgcacaggcacatgaatcaacaatgtaataaaaaataagctcaagatcatcctgggatacatggattctttctcaaaaaatgaaaaaaaatcatgctcattaatggtaacatttaaattaaggattactcagcctgctgggaaa

SEQ ID NO: 31199 - DNA, 1156 bp, Mus musculus
gccttgcggtgcggggtggtgcgggtgcttcttgtgagcgtttgccgagagagttgtgtggaaggtggggggcctggagggcgacacgactggagcaggaggaggaggaggaggaggaccagctaggagccggtgctcgtcgctcgtcgctcgtcgctgatcgctggtcgctggtgggcgatcaggcggcaagagtcgtcggcacgttggggttcgggttccgggttccgggttccgggtcggcggcgagtgtcggttcccggcgcgaccggcaggtgtcgccgtggcacgggagtccggtgtgaggcaggcgggagggagggagggaggaagggagggagtgaagagtgttgggcgggcgtattagggagcgtagctgttggtgttgtggttgtgtgtgcgggcgtgcggtgggtgtgaggtgaggctgcgctggtggtgtgtgggcagtgttcaggtaggagtatgggggcgtgtcgggtgttgtgtcgtcatcgttggtacggttcaagtagggcgtagcagcgcccgttcgctgccggtagtggtggcgcacgccggtaggatttgctgaaggaggcagaggcaggaggatcacgagttcgaggccagccggggtacacatttttttcaccctccgctcctcaccctttcctcaacacacttcttacacactcacccctgcgctcctcctcttctttgcactcttcaaaacacccgaggcccaacacccgacccggcaccaccacaactccacacgcccacaacacacttgcgtgcctcacacccttgcctcacgcgctctcaacagcctctgcccacaccaccgggaccttcatgctcttcatgcccttcatgccccttcactcccttctccttctccttctccttctccttctccttctccttctccttctccttctccttctccttctccttctccttctccttctccttctccttccccttctcctcttctccttctccttcgcctcaccttgcctctctttgctccaccaacgaacacacggaacacacacacacacacacacacatgcacacacacagagcacagtgtgccttctcctcgcaaaacatgctcgcactggaatccttggacagctcccttgcgcctactctgggcaaaaggtccacc

SEQ ID NO: 31200 - DNA, 1251 bp, Mus musculus
tttattgtttgttaaacattgatggcttctgaaggaaacggcaagaaaattcgtactttttctcccccggtagaggtcctatttcagctgcgtgagaagctttgacctccaatttatttttgtcctctgtactgttgagtcgacaaaacccagtaacttcccaagctgactccgattctctcgttctcaagaaaatgcggggtcacattctcagatttctcttgatttaaaacttactttcttaattcaccgcttttaatactctcaggattcctgcaattgtagcgggggggaggggggggagagcgggggggctattttgcataccgattacccagcatgctttgaaccagacgttatccggaagccctgtaaggtcgttgaaatgtaaatagatttttcttctaaattaaatacttttctgtggttttattattacgtatgaggtatgtatttggaatacacaaacatatttttaacagtttatgctcataatccaccatgacttgtaaagggtgaatattataaaccttatatatctacaactacaggcctaactttcggttggtccgagagtagtggtgtttacaactaattgatcacaaccagttacagatttctttgttccttctccgctcccactgcttcacttgaccagccttttgttgaatgagctattaacattccctcctgtcggtggacaaccaaacattttttaatcactttaagaaatgattataacatcactatctaccagcgtaattgactaagtataagcacatcacctaccactttaagaagggaaatccctttgtgtcagatccttctgtttactgagagccttaggtttatgtgttaaagtgacccatccatatacattcacctccctgtccccagtgtcaaagagagggcaaaacagagcaaactgtagaggaaaaagcaagatctgcaggttgcaaagttatatgcatacgggtttgctctcactccacataggaaatgagtgtgtctttttcgtaagtctattttgaaacaaagttaaaaagatgaaggaggaaacgtgcaaggctgttaacctagaaatgattctcctttctaagtagggggaaactctggtgttcttatttatttcttggactctggttcatgaccttggcttctccaagcttttcttttaaaaatggtaagattgtgatactgaaataaaattctgcttctgttctgaaatgattggcttttggaaatcagaat

SEQ ID NO: 31201 - DNA, 1419 bp, Mus musculus
tgtgctcaatagttctcctgcattggtcagtgtctctgttagactgaattttgtagagactgggagagtgaagataattttattatagaatattgcccgttgttggggaaggttttaaaggggctaagtccccacctgtgagtggggctaataactcctggtagttcaggttgcctcagtgcctggttcagatagagtggcaggatccatggggttttaagtactgacacctcctctttttgttttggcaggaaaactaaagccagtcatcaaatcacagccagtacccaagaacaacaagggaccagtcaaggtggtggtgggaaagacctttgatgccattgtgatggaccccaaaaaggacgtcctcattgaattctatgcaccctggtgtgggcactgcaagcagctagagcctatctataccagcctaggcaagaaatacaagggccagaaggacctggtcatcgccaagatggatgctactgccaacgacatcaccaacgaccaatataaggtggagggcttccctaccatctattttgctcccagtggggacaaaaagaacccaattaaatttgagggtggcaacagagatctggagcatttgagcaagtttatagatgaacatgccacaaagaggagcaggaccaaggaagagctttaaaggcctggctgtgtgcagaaggtggaggcaccaggcactagtggacagcattggccaccaagcatgtgagccatcagtgaaatggcaggatcttgacttttttttatattttgttaatgccacctcatgctctgaatactgaatagccacgagtgacttgatgatagtttagatcagatttttatggaggatacatctatttttatcattttgggtcttctttttttttttttttttttttaactatttacttcagtatctcttcagacaaataagttttggatcttctgtttaagaatcttttttttttttttttaatttaaactttaaaagtctttgccaaatcatgttgtttgccttttattttcttgtttagcttaaaagtagataactatcggtatgtttgttttttatttcttcctgctgatgacaccaagttgagggctcactctcccctgacagttggccaggatgttgtttcagcctgatgttagagccatgtccgtgtccaggttgaacagtatctgatgctggatggacatagccattccagtatctgacacaccgtgatgacaggtagtaatggagtgtggccactactggttcctcaaaccagtcccgctgctaaaataaaatgatctcagacagccttagaaacttcggggtgtgggctggtgagatggctcagtgggtaagcgcacccgaccactcttccgaaggtccagagttcaaatcccagcaaccacatggtg

SEQ ID NO: 31202 - DNA, 1175 bp, Mus musculus
tacagctgtttgtgtgaatgctatgccctcagcacacagcccccagagaaaaaaagtgggctcggtgtgacagctcaccaaccacgtctttcgcctgagtctaaattctaatctgaggcttccctgctctctagtacaatctgaatgctctctagtacaatctgaaggttaaaggtgtggctgcgtgtggccagctgcagcgccttgcctggccatttattagctgcaattgtatctcaccttgtcatctgtaaaagggatttcagggctcttgtggacctcagttaactgactatggaaaagcccgcatggttcagtccatgtgtatagttactgtttaagaccattaagctttttctcattgggtttggagttccagtcagaagaaatggtgtgattagatggggtgagtgagctcacacaaacatctgtgcttgacagtgactctgacggcacgttagctagagctcccttttcattgtgcttgctcttagtctatgctgtctttgacacagggctctacagaagcatcagccattaaggactatgtagtgaaacatgccttgcccctggtgggccatcgtaagacttctaatgatgctaagcggtacagcaaacgccccctggtggttgtatactacagtgtggacttcagctttgattacagagctggtgagagaccctaccaacacctttatagggcgggggctaccatttttagacatcttgttctagaacccttaaagttagtggtatgggcatatttttgcctctagcatcggatttcgagttctgagccataaagtaccctttttccttcctgatttagtaaaaggggagttaagagtcaaacctagggctaaagagttggctcaacaggtgaaaacagtgccaatcctgaggtattatactatgcattctataataaaaattaaaacaaacaagaaaatagacgataaaaaaaaaagtcaagcctagtaccttcatagagatgatgtagcagatctggtgctgaactggcttctcagacagagctgtgttgccagtacccaggtctcctggggcttagttggagttctatccttaagccagctgcttacacagtgttgctataccagaaatcctttcctatctggtcgaggtacttctgggtctgggccttgtcggagagcgtc

SEQ ID NO: 31203 - DNA, 1198 bp, Mus musculus
gcagtttgctccagaatatgagaaaattgccagtactttgaaggataatgatcctcccattgctgtagcgaagatcgatgcaacctcagcatccatgctagccagcaaatttgatgtgagtggctaccccaccatcaagatcctgaagaagggacaggccgttgactatgatggctccaggacccaggaaggtgagctccaggatgtgagctgttggggaatggtacctaaggaaaagcacttaaggttgacctctggcctctggcctccatacaccggtatatatacatttaaaagaaaacacacattctctcacgcatacaaatggtcgcctttatctgtatctgtcatagttactgttctggtcctatgaagagactatgaacatggcaactcttagaaaagacatttaattggtaaggaaggtccttgcttagggtttcagaggtggtggggagcatggtgagaggcagcacacattggagcagttgctgagaggtccgtcctggtcatacattgagtctcatgtttttctgttgttttattttttagaaattgttgccaaagtcagagaagtttcccagcctgattggacacctccacctgaagtcactctttcattgactaaagataactttgacgatgttgtaaataatgcagacattattttggtggagttctatgccccgtggtatgttaacagtcagattcatgatattatgataatgagtgttgagaattctgctaagcattggtgaagggttgcagtgcacagccagcaaggttaatacagagcaaggttaaggtagcgtctgggactaagggaaatcatgggaggggtgtacatggaaggaaacaagtcctcactttaaactttactctgtgtgtgtgtgtgtgtgtgtgtgtgtgtgtgtgtgagacagcatgggtggtagtaagagaacagctttgtggaatacttgctctctttccatttttgttctggggagttgaactcatgttgtcaatcttgcgtgacaagcactttcacctgctgaaccatcttgccagtctgttttttgatttcttgagaactttctctggaaccataaggccacacaaattgtgtagtgcaagctggcctcaaactcccagagatccatctgcctctgcctcccaagtcctgggattaaaggcttgccccaaccactcttttgcc

SEQ ID NO: 31204 - DNA, 1199 bp, Mus musculus
gtctcggatgtgggaagagcttccgcctaaagcagtacttggtgagacatctagatatccacacaaggaagagaccaccccagtgccctaagtgcaaaatgtgcttccatcatgaacgtacccttttcagccaccacctgaagaacagttcttcccagcaccccacatgtgacacgagcttccggacagatagcagtgttgacctgtgccagcagattcaagagaggccagccttctggagagaagacaccaacgtgccctcaagacagaagccgggtcccagtctggactgtgaggactgctgccacatgggtagcaagctgaagggcctgcagtgtggctgcatcctaggtgaggacagaccccactcacacacagagtatggcaattgcttcctctcacagtcgaagcaggcaggtctctgcaggacacacacaggagaaaaagcctctcagtgtccagaaagcaacaagcgcctctgcctgagaggcctacagaatgtccaccaacatgggcttcgtggagaaaaaccagtcttctgtagaaagtgtggtcaaggattcaccaagcattgcggactcacagaacacacccgaatcctcagcggggagaaatctttctggtgtgcccagtgtggaaggaacttcagccaaaagggacagctgctgaggcaccagcggcttcacttagaggaaaaacccttccaatgcacaatgtgtgagttgcgcttccatctgaagagcaggttgagggcccaccaactacaacatggtggagaaaggccattctcctgcagtgagtgtggccgagccttcacccatcagtgcaagctccgtgagcatctgcgagtgcacagtggagagaggccctttcagtgtcccgaatgccacaagagcttccgcctgaagggcgtcctgaaggcccatcagcgcatccacagcaaggagaggccattctcctgcggggaatgtggcaagggctttataagacagtctaagctcacagagcacttccgcgtccacagtggagagaggcccttccagtgtcctgagtgtgacaggcgctttcgcctaaaggggcagctgcttagccatcagcgcctacacacaggagagagacccttccagtgcccggagtgtggcaagagctaccgtgtgaaggctgacatgaaggcgcaccagctgctgcatggcgggcag

SEQ ID NO: 31205 - DNA, 1203 bp, Mus musculus
tgcgggcagtggctgcggtagctgctgcccaggcggcctgcggcggagcctccttgctcacggcgcgcgcagcaagccctactcttgcctggaatgcggcaagaccttcggcgtgcgaaagagcctcatcattcatcaccgcagccacaccaaggaacgaccatacgagtgcgcagagtgcgagaagagcttcaactgccactctggcctcatccgccaccagatgacgcaccgcggtgagcggccctacaaatgctccgagtgtgagaagacctacagccgcaaggagcacctgcagaaccaccagcggctgcacacgggcgagcggcccttccagtgcgcgctctgcggcaagagcttcatccgaaagcagaacctgctaaagcaccagcggatccacacgggcgagcggccctacacatgtggcgagtgcggcaagagcttccgctacaaggagtcactcaaggaccacctgcgcgtgcacaatggcccgggcctgggggccccgcggccactccaggtgccaccagaaagagactagggttgggctggggggcggggaggaatggactggagttggggcgggttagggttctcctgccccaccgttctcagcgcacctccccgccctctcctcacctcctgctggaaatcggcacaggaattgcactccagacagggtattccaaggggtggacctgggtaccccagtactgtccaactctagtggacagtccagctcatctcatagggtggacccagtggccagggaaggtcccagagggacagcaaggcagcaggaatcgttgggacacacctcggacacaccactggccactggggttacagattctgatcagggaaagcgaccagagagtctccaaccccttctgagaaaaggaaatatgatccatcctgaaggtgaggagacatcctgaaaaggagagcaaatctgcggtgtggaagctgagggaagcgctaagggtaacatcctcatgacaacactgcctcgcgctctaatagcgctttatacttttttaaaaagtgttttctatccgttatctatttacacccttagcttatcccttcgagttaggtggggtagggttttcctgatgtggtaactgaggagagtgagacacaggtgagatagttgtttagcaagaccacatgagaacagtgcggccaagccgcaccagggct

SEQ ID NO: 31206 - DNA, 1117 bp, Mus musculus
gaattgagctgcaggcagtgggcatggccactgtatctgtatattctgtctttggtctatagcctagaatcccagagactcttactgtggtcctggagtcactggcctcctgtctgcgagaccttggtattgtgctcaatggcattgctttgtgtttctaggtatttctctgagtccagagcaggccccaagtccagctagccctgcccaggaggaactgaatcaaaggcagacacctgagcagcagcaagaggaagcaaccatgattccacctgagccaggcactggtaagtgagaacagctggacagcagcaacaagccagatgttgaactgtgcggagtaggctcttgggagctgaaccttgaacaggtaggtttagtcttttcagtgctcagatgtctgaatagcactgtgggggcctggacacacccatctgcctggagtaaggggaagagtgtgaatgagctttctaccgtggccatgtctctgtctcacctcccagtgtggcactaggttggcacactatagtttctcaggattctttctgaaaacttgagaactctgacttttctctttcatccaggatctgtgtctgcttctgtttacaggtgattcctgctggtccttttctgagactgactcagagaatatgagtgtcatacacagaactgggcttactatattctcttattcttctcttactgatgacctcactcctaacccttgttgccttccttccgggggtttctctgcatttcccccacagcacatgacttctcctctggtgttccatccaaccagtataaactcaagctgtatgcatgaaatttgtgagatgagacctggggcgggaggagaatgcctccacccattgaaaaactgggactctgttctgggaccttccctaaccttctgttattttgagactgatgaaggtgacagatgtagaggggcggcctgggcctacatgggattggcaatgtggcctttatagctctattctcatctcagaagccctccagatggagcctgaggatctgttcttcctgccagacccttgagtatgtctagggcttgctgaggaaatggccatactccgtgatacttgtgtcaaga

SEQ ID NO: 31207 - DNA, 1203 bp, Mus musculus
catcgccggcttctgcagaggattccgcagcggtcttggggccgcggtcgtggtctaggccgtggccgtggtcgaggccgcggggctcgtggaggtaaagctgaagacaaggagtggatccctgtcaccaagctgggccgcgtggttaaggacatgaagatcaagtccttggagatctacttgttctccctgcccattaaggaatctgagatcattggctctttcctggatgcatccctaaagaatgacgttctgaaaatcatgccagtgcagaagcagactccggctggccagcggaccaggttgaaggcattcgtccctattggggactacaatggtcacgttggtcttggtgttaagtgctccaaggaggttgccactgccatccgagaggccatcatcttggccaaactttccattgtccctgtgaggagaggctactgggggaacaaaattggcaagcccctcactgttccatgcaaggtgacaggccgcttgtggctctgtgctggtgcgtcccatccctgcccccagaggcactggcattgtctctactcctgtgcccaagaagttcctgatgatggccggtatagatgactgctacacttcagccagaggctgcactaccaccctgggcaactttgccaaggccacctttgatgccgtctccaagacttgcagctacctgacccccgacctctggaaatagactgtcttcaccaagtctccttatcaggaattcactgatcatctagtgaaaacccacaccagtctctgttcagaggacccaggctccagctgtggctaccacataagggtttttctttttcttttttttttttttttttttttggtttttcgagacagggtttctctgtataggcctggctgtcctggaactcactttgtagaccaggctggcctcgaactcagaaatctgcctgcttctgcctcccgagtgctgggattaaaggcatgtgccaccactcccagccacataaaggtttttatacaagaaaaaaaataaatgaattaagtccgctaaaaacaaaacaaaccaaacaaacaaaaaacctaaacactgagtgtttgctgggtaaataaaaaatgactgccaatgactgtggcaataggctttgggtgcctccatgaaacagaacaatagattatttagtctggtgtcaggaatcctgtggatgtttg

SEQ ID NO: 31208 - DNA, 1175 bp, Mus musculus
caggcttatcaatctcatggataaatatgttacatgtcaacaatgataaaaacttggcctcgtgggaacagatttttggtttttttaaacaggatggaactaggtagccctgactggtctggaacttgctatgaagaagactaggctagcttcaaacttacagaaccctgcctcttcctcccaagctctcaagaccaccatgcaacaccaccttcccaatcagaaatactttcttaattatagacaatcccaaaccagtgccctgtgtgggggcacagcaatgtcagtgttcaggaggctgaggccagcatgtgctctacagaggccagccagggctatagcaaaagtctgcctcaataaacaaacaaaaaatctaaaacttttaaacgatactatcttttagtatgcattcactccagtaatgcctctcatatttagcccacgtactcggtagcgtctccaggcccctgccaaaccctccaaatgggtgcctgctatgtgagagaaaggtacgtagaggtctcatgaggaatccaaagacaggcaggctgaaagcgagacctaaggaagatggtgtggtgtgcctcccggtaccaaggaccccactccacctttcgaactgagcataaactgctggaatccggaataagccaggctttgggactctggtttcagatgcctggcttagctgtctggccactctctctggcacgattagaagctctgaccttgggaaagatctccctaccccatcatctaaccccttccagagggggcaagcccttcagacgcccagagaacccccagaatggcccatctcttctgccccaaggacttttaaagaaacctctcaaatcccaaacacgtgtgtggcagtgagacaacgagccaaggctccaaaaagccatcctattttctaatccccgaacagtattttttgggttctatatttatattttcaataaatgtaaatagatcattgtttatacctttaaaccaattttaatggtgtaaattccaaatgtccttcctcccagcatcttctccctggcctccataggcctggcacactacctaagctcctgcaggcccccaccacgtcgggctgtgctggccgttgtgctgccccctggcggccagcaccgagagggcctcggaggccggcgcccacctgg

SEQ ID NO: 31209 - DNA, 1177 bp, Mus musculus
tgagctcaggcaggatgtgatggttcttgaggctggttttccccactgggtcttgtcctccagcagcttcacagtatgaccagcaggaggctgagaagcctgcttcttcaacgagatccctgttaagctctgggtttcatggctagttgtctgatggtaggattcatgggacaggaagctagatttgccagaaggaggaatgtggacaaatgtatgtatccgtgtgtgtgtgagtttgtgtagcacaaagtctgttggtgaggttgaagccatgttgtacttatccaggataaaggtgttctagaaagtagataaatgctttctttctaactttggaacagaggggatcgtgatcaagacagaggagcaggaggaggaggaggaagaggaagaggaggacgagctgccacagcacttgcaatcccttgggcagctgtctgggaggtacgaggccagtatgtaccagacccccctacctggggagatgtcccccgagggcgaggaaagccccccacccctgcagttgggcaacccagcagtgaagaggctggcacccagcattcatgggcatacgcatgggcatgggcacgggcacgggcacagtgaacggcacctgggtgagaaccgtgggaactctagccagcagcagcggaatcggcgtggtgagaggcccttcacttgcatggagtgtggcaaaagctttaggctgaagattaacctcatcatccaccagcgtaaccacatcaaggaggggccctacgagtgtgccgagtgtgagatcagcttccgccacaagcagcaactcacgctgcaccagcgcatccaccgggtacgcagcggctatgcctcccctgagcgcgggtcagccttcaatcccaagcactcgctcaaaccacgtcccaaatcgcccagctcaggcagtggcggcggccccaaaccctacaaatgccctgagtgtgacagcagcttcagccacaagtcaagcttgaccaagcaccagatcacacacacgggtgagcggccctacacgtgcccagaatgcaagaagagcttccgcttgcatatcagtctggtgatccaccagcgtgtgcatgcaggcaagcacgaagtctccttcatttgcagtctgtgcggcaagagtttcagccgcccgtcgcatctgctgcgccaccagcgg

SEQ ID NO: 31210 - DNA, 1167 bp, Mus musculus
cttttatgtgttgttcctaatagagtatcatcgatgtctagatcagtgacacttttggaagagatttgctcttttggaatgtgtcttcttgcttccaaaactgagaaccttttagtgtgaacgcttgtctcttggattgttttgccatctggagactgtgaccttcaatcctgtctttccttctctccttgaacacaggtccagcagctggacatggaggacgatcgctcgtcaccactgtcattctccagtgtcccacacgaagagtctgtgcgtcaggcccctgctcgactccctagagaaactgtgttcccttcttgcattcttcctccaaaagaagttcctcctttgtctcccactgcctcccggcaaggtgtcttgccccagactgacagtactactaagcaagagacatccagccagatgtcacatgttcttcagaaaggaccttcactcctgtatcctgccacttctgagcaagacacacctcaccaggtatcccttgcttcccaggaagaaacccagtgctctccttcagcagctgctcaggggatccccttcctctcgcactccgcccaccgtcaggaagctccactccactctcctgaggttcctgagaaagactcgctgactctctcacccacagttcccgagaccgacatggaccccttgctccagagtcccactttgcaaaaggacactcccttccatacctcttctgccgcccagaaagaacagccactgcccactgcagagatcactcgattggctgtgtgggctgctgtccaagcagtggagaggaaactggaggcccaggccatgcgactactgactctggagggcaggacagggacaaatgagaagaagatagcagactgtgagagaacggctgtggagttcgcaaatcatctggagagcaagtgggttgtactggggaccttactgcaggagtatgggctgctgcagcggcgcctggagaacatggagaatctgctgaaaaacagaaacttctggatcctgcggctgcccccaggcagcaatggagaagttcccaaggtacacacatttcattggggtcttccagaggcatctacagggaacgtggtttagggattctgtcagttgaaagaaagtgaaagtggtagttgggaaaggaaaaacaagaaa

SEQ ID NO: 31211 - DNA, 1149 bp, Mus musculus
gtatgttcaccgtgtcttaccagtgttagaaagatggtcagtgggagaagggcactcccagccatggaccacacagccctatgggaggttgagttccaggtctgtccaggcatgttggggcttacactcagcagtaagaaccctactagaagcagcccttaccttctgaaaagaccctttaagccaaggcctgactttttcctgttttgagccatctgtggtacctgtccaaggtggtaactccactatagtagtgactccttggcctggctaagaagaatcatatggagctgtagtagtgttagatctgaagtcacaggaagccagggcctcccatcttgggctatctccattacccacagatgcttctgttggctgcccgttgtgtagtatgttcattttcaaaatggcttcactggttccacctcacatctcatcccaccattaaccatgactttggaaagcaggcagacaggcagttcttcttagagaataggaaataaagggctcagaggggacacagcctctctccatgagtactgtattgtaggagctgggaagagccgcagctgataaccagttctcctggaacaatggtttagggaaggaaaggttttgagatcttaccctctgaaaagatttgtgccacacccatggatcaggccatcaagtcacagaactcctgcatcagcagctcgagctggacagcccctgtgtgtgcttatgcatcactagacatgcaggaggtagttggattgccaggtaactgggtaaatggctctcaggcctgcctggagtatcttcacagtggaattagagctaggtccaagtttctgtcataacagtgctgtccccaccacacatagccattcccattttgttaaagcagccactggtctcttgcccaaatgggtaatgactccctgaagagggcagagaccatggcacccattcagctccttctgcatacttttattagaaatagactagttaagaaaattgtttctatgtactgtatattttgtacctgtttacacttctaatattgatataactgatattttgaaaaacaaatgaacagaagacatcctgttaaaataaaatctaaccagcaccaaggctgtttcatggattccattcttagatatt

SEQ ID NO: 31212 - DNA, 1148 bp, Mus musculus
tgcagatttattttatcttgtgtgtgtgtgaatgttcagcccatatgtatgtatgtgtaccacatgtgtgtctcatgcctgaggttgtcagaaggtgtcagatctcttacaactggagttacggatggttatgaaacaccatgtgggttctgggaacagaacctgggttctctgcaagagcaacgtgctgttaaccactgagctgtctctccagtccccgagagtaggtttttaaaattaaaaatggtcttttagtactggaattcttggtttatgagccctatataaacagggctaggtctggcctaggagccatactttgtcaacctctgagctagtgagggaactgatgatatggtgactactggctgataatgagctcccactaactggtcaggaacaccaggtgagtggctgtaggtttatgggtttgccactggcagctgtctgggtgcaggtgcagagcagacagtcaatttctcgggattacagtttcaccaagtacagtgaatacagggaaaggagagtgtataagaagggggcaactaatgatggccacagggacaggaggatgaggagagtgtgaaggctttgaggatcctatagactgaagacctgttggactggaaaaatcaggagcaggaaggagctgtggagtccatgcttgaaatgtggaaggaaactaacagtgccaggacagtgaagggagtaaagccaccacatggatatagcagtcttagctctaaggcagggtagagagagagagagagagagagagagagagagagagagagagatttagattattgattagcaagggtcagtgatgagtaaggacacctgaaagcccaatgtcaaaaggacatgggaaagaggacaaaacagctgctgggcagcagcacttgggaagagccaaggctcagcctgagcaagacagatgggtataccctggtcctaggatactgttgtatgttaggttctataaagcaccacggagaccataggaggcaaagagaagagatgcggactgataagggcatggaccatctttgctatcccgagtgagaggagggcagggacccgagatgactggactgaggtgggaagaagagcctgatgacaggttccaatgaggtgggctatgagga

SEQ ID NO: 31213 - DNA, 1146 bp, Mus musculus
ttaattccagcgcatgctaggcaaacactttaccatctgaccaacatccccaattcgacttcttccatttgggaaagctctgaagggagcatctctccactcagagcgagttctcatccgcatcaaaacaaaaccctgtcagtgaggatggccttttgaggctagttggagagaggcctggaaaacattgcaggcaaaggcctaaaggagccagctatatttagccttgagataaagagccacctatgctgccccccagagtcaggagtggtgtatagaagagcctgaggtggagattaggcagatagccttggtgacacgagccacagcatttatgctagatttattgtagcctatggtaattaatcctgtctgtacagtatccctgtggactaggatatgatccactagtacagatgagtttgctaatgctcagatagggcagccatttggctgaagtcccatgactaatatgtggtcattccgtgcaccttaggttgtggctctcaaaaggactgagcagtctcacaaaagactaatagaaatgctgtggcttgacagtatcctctgaatttcacctgttaggaacttaatgcctagtgtcatgtttatgctttgttggaaagtcattggggttgatgggtgactgggggagtagtcttgtttagaaggcctttctggcttgctttctctgtttccccatcaaactgtcacgtaccatacgatgtggcagggaggccttcaaccagcatggccccttgaccctggatttctcagcatctgcaactgtaagaagtcaatttattttctttataatcaccctgtctcaggtattctgttatagtaatcgaagcacaggaggagggaaaccaggtgcctacttctagtgagaaatgaagctgacaaactgaaaatgcatgcagatacagctgttgaaatatcttgcctcctgtctcctttgtatttctatgttaaaatacctaagatgggtcacttataaagaacagattttggctgagtgtggcagtgcacacctttaatcccagcacttgggaggcagactctcttgtgagtctaaagcttgcctgacctacataagttctaggacaaccagagctacaatagtgaggctgcctctcaaaaagc

SEQ ID NO: 31214 - DNA, 1173 bp, Mus musculus
tgataagtccggcaatcgcaaaggcaccatctttcgggtgacgtcaagaggacatttgagggcaggttcccagaggcctccagtgcagtcaccaggaagcacttagctcgcccagcatgatgttgaatgacctatgtagaatgttcactgtgggaatcttgccagagattccagacccaggattgttagtgagaacaggtcagtcagtccactagcacttgacccagttgaagacacctagaaagaaggtgtatgttcagcacaaactgcatcacacagattagcctctatagctggtctttgttcctttgtaggttctttttcccacggtttatccccctcctgtttgtttcgctatcactagataggagagaaaggatagaggggagacagagatagagacctctgaatccaatttctttccttttgtttcttcttttaccctgctaccaacaaactgcaaccaacccccctgaatgaccgccaaccccacctattgaggctctagcatttatatacccactgaaaatccccagaactccagatgtcacacaatctcagaaactctgcatctggcagaaccatgcctctgctaaagcataaggcaaatcacagtcagctgcttcggagcagccccgtagtcccacccctgggattaaaacaaaaatagtcttaaaatgcttttttctttttaaagaaaaagaaaaaaagaaacaaaaattccagaattctcaccacaagcctgtgttgacctctaactggttaggtagaaacccttttgagatgcacatttccaggtgactgcctggggccacctggtgctagatattttgaagggcagtagtgccgttgcctaccctgttggctctttattacagaacctaagattgtccacattttgtgtgctaggaggccaacaagaaatgcaaaatggctccctgctagaggtttgtggaatacctgatatgttcctgagggatagtggccatagtgggccagagccacaagttaagcctgggtagagagtctgctgggttgcccagcaggccatagagatggttgggaatgcacagtgagccaagaggcaaagtacactgcctctgatcccttctgggcttccagatgtcggcagtcagtggagatgctgtccctggccagatgtgtgactggagc

SEQ ID NO: 31215 - DNA, 1261 bp, Mus musculus
aattttacattctgtttgtgttatttgcatggttaatttctgccatcattgaagctcgtgcctatcagatgttggtcattgtctgagttttcatggctgttttaatgatcacttttaaagtaagagcttttgcttttatcttacaaagccgcaggaagcaggtgagcatagtcgctaaaggtgtggagtgtagatgtaaagtgtttcctgaaggccctgggattctgggctccttctgagcaggaggtccctaatgaccacactacaatgctatttcgatgctaagtggcaatagtgggagggctggggtagggagcatggtgaggtggatctgtcagactgcggcctagggggctttgtggacatcacttctgctgcatgcttctgctgcgtgagcctggtggtgggtgtcacagctctccgcagtggaattgaccaaggctgtaccagggtttgtggacagttgaagccatgaagggcaggtaggactggaaaagtggaggtgggacctcctgccagcagctaggaacctggacccacactggagctgagatcaggggccctaagcataggtcaggcctatgagcgcctgactcacctgctacctggctggcaggtggaaaagggtcagtgtctctagatcttcaaggcttcctgaggtttttgttgctgttcctcccccgccttttgatggtgtttaatttctgacataaattatgtcatccctgctgaagagcattaagtgagattttatttaattttatttatttatttatttatttatttattgctatgtgggttgattaaccccagttcagaaatctaagatggaaaatgctccagagggcaaagcttttgagcactgtgatgccacgtgtggagaagtccacatctgagctcctttaaatgtttgtagtcaaagtacaacataccaaaaacactgtaaaagttaccattagctaggtatatacaaaagaacacagttgagtgtcatctctaaaataactcattatgtacatgaaaacattcaaaaccaaatattcaaaatggatctgtccccaggaatttgggataaagaatactagaccttggctgtttttataagctgatgtccccctttcaatgccacagtgctagagttccaggtccttggacattcacttcttcactgacagagtgaatgtagggcttgcctgcgtacttaggaatgtagtttcatctttccaagttacacccatggtgaccttgtttctaaaaggtt

SEQ ID NO: 31216 - DNA, 1160 bp, Mus musculus
tccttgcacggcttatagacgcagacagaaagaataggatgctgtttggtgtacctatggggggtctctgcagtggagatgctgctggtgttaacaggtacacctgctgtggattgtaggtggctctagcaggaccttgctatttagtctttgcagtgggtagaatgatgacacttagttcatcagtggctctcagtaaactgacagctcttgcatggtgctgaggagagagtctgctaagaagtgggttggcaaccatctacccagtaggaagggctgctgagcttgcaagactcaagacctaactgaaacctgatcgggagttccacatcttccaggaacttccagagagttctgaagctcacttagccagggacatggctagcttctggctttgcttctctgcctgtgaccaggaagtaagttattcaggatccactagagcccaaatagggtgtggctgagcagaaaaagacaaatcccgagtgcctggctatccagactggtgctgtcaggtaccagtcggtgaactcttctcctttgtttagagacagccaccatgccctcccctctgcaccgcctggagaactctctgagggggatcttgcctgtgaggcccttgcgtttcacctgcgtgactggccctggccccagtcccagcccttgctccagctccagcttcagcagctctgatggagaagacctaagaccagagcctgcattttggcagtcacccctccagcgtgagtctgctggcatgggggtgggaatggcagtaggctgctctttgcggtgcctgtcagtactctgatgctagcttacttatgacgcagagaaagaccagcctccctcctgtaaggaccctgttcgtctgtgccctgtctctggcgcatctccaagagtcaacagcaatagctgttctgcggaagaccgtgagagaacagagcccagggactgcagcagcctcagcgcaggtgagcctggagtctccctggatgacagccacatgtccccagtgggccagaggtccagacttcaacaatctccgagtcccactgtcaatttgctggctttcattaaaatgttcctctaattttttatgctttacagcctgtaaagctgagccagagagaaagcgagcctgagtcaagagctgtgct

SEQ ID NO: 31217 - DNA, 1191 bp, Mus musculus
cttcagccaccatgcccctgtggcaggtccttgcagcaggagctgcataaccttggtactgccctcacggacaagctagaccggcttgcagcagccttggcaggcctgactcaggaagttgcaaccatgaagacccaaatggatcaactgcgaaggcacccacggagccttggcccaaaaggtcagggttcctggcagttggccctcccccagagacctcgctgggtcaacagactgggccacagacatctaccctactggagacagaagggccccaccaggcccagaccaaagattctgcggacccaggcagaaggctgcaagactagtgaccgcccaggactctctagagggaagggcagtttggtgcctcagctgcctccagaggcttccttggtagaatcttccaggcccacctgtagttcatcccagcagatctcctctacgcctggaggccacactgtgctgactgcacaccctcctctggagcacactgcatgccaccagaatcccctctccccttcagtgcctacttcagtgcaggtcccccttgtggcctcacctgcaaccagtgcagacacagaacctccggctgctagagtggcagccatcagcattccaaaccagcccaaggaacctgacagcctgctaggggaagccctcagcagagacctctggggaggtgaccaccgggacccaaggtggggggcccattaactgtttgtctgctcagccttgctggagattctgggtggcagggatgtcctgatgggaccctctggagtccagccatcccaggctgtctgctttccaggggttgtatcttccttcttacctgttcatcaaccagccctctcattgctgctgcaagtctggctctttgcctctgctgtgccaggcctccatggtgtctgcatagagccacgacagaggcattcctcagctgtacctctgactttcttggctcaggttcagtcagttgctcttcctccttggcaaagccatctaggttccaggtgggtgtcatgcataccacatgtgcacagagccagctgcagagggcaccacaagggcaccttaaccagctcctgatctcaagaacactaaaaggctagccgttgtctgtctagagtgaatacttcacagatctcatttagggagagcctggtctatggactaagctgaattttc

SEQ ID NO: 31218 - DNA, 1131 bp, Mus musculus
tgttttggaagtttagtaattttgaccattaaaactatgtttctatatttgtatggtcagccagctttttatttgactctgtacttggcctgctagttacagtttggaaagtccttttgaaggaggaaggtactgggtagtcttgaatttattttggatattacaaaagattacaggtaaacttaagtcactattgagttgctctggaagggcagcccattgtacttaggatcccaactgtgcacttagcagtttcacgcatgattagcctgtttccatctagacgcccttagggcggaagccacatccttacccgatgcatccattcactgggggttcacatgtgctgggctggagtgaagaaaatggacctcttgaggaagggagcttgggaggccaaactgccttgggagtccaggaccgttggaatttggcccttcctctggaagggaaagaccagggaaaaggaggaaaactccatttggttccctacgcactaaaccagtcgctcttgcccaggaaccctacctgcagagccagtgtgactgctgtagctacagactggatccggacagccccgtgcggatcttgaacctcctttgccccgatggccacacagagccagtggtgttgccagtgattcacagctgccagtgcagtgcctgtcagggttggtctggcctgggaggagagggcagggctcctggtgggcagggctccacagggctagccgaggctgggttggagttctccttaaggaggccttaggaacatgcacagcgcacgggcccacccttccttgggttttgctagttcactctgatcctttcccttcctcgatattctgcttctctcctctccaattacacataaacttggttcaaatctcagtcttccactgaggtcagtacccataatgccatccctcaaatgggcctggcagctacacaggcttgcagggagcactctggaagggcccgcatatgaaatacctggcaggttaagttacagatttgatgtgtactaactgaagtcacaccatattgccaagtgtggggaagatgcagtggaaggacactgacacaccctaggtgggggctagagctggttacacttccttccttctggaag

SEQ ID NO: 31219 - DNA, 1210 bp, Mus musculus
ctccagctctcaacttttgccagcaagtaggatttaacagtaaactgttggtgatcagggggtcagtcggtacctcagctgttcctcacagataacattgtagggagctctaccgtggtggagtttttcagaatccagaggaagagcaaagcttcttctcttcatgttcttcttggttttcagtgttaggaggtagtaagaacaggtctgctcttcagagcctcaggactctgggaatgtggtgagggtgaagcccctcctcagttaaaagcatctctagttctttttagctgctgcttccttcacatccaactgggatatcatggagacagtcagtcccctctacagccgcagtgggtataaggtgacctcgggattccacaggtagccgtgtacaatcagagatgctgttctgtgagtttttcctctttcttgatgatccttagatttgactgagccagtttggtttaactgctatctggagcttgtggatttgatgactttcagcagggaattcattcctgagcctcttggtgggctttccggggggaaaggtgtcttcagaaggctgcagacatgcctcgtgtctcactccaacagtgggctgctctttgttgcaggagcctcctgacaaggagtgggctaaggcttccaggacggccggggagctccctgcaacgtttgaggacttggccgtgtgtttcagtcgggaggagtggagcctgctggacaagcagcagaaggagctctacagggatgggatgcagatgagctatgagctgctggcttccctgggtaaagctttccatcggctgttttactccactgtcattggtcagagacctcagggcagctgtggcagtctcccatttttgacctttccttatgggtagagaatgagcctgtcttctgtgccccagagccctgcctgctttggttcactgtactgtctcacctcttcattcatcttcctgcccatgcatgccccagtcttctactcccattagttggctatcagccatatgctgggtgtccagagcactcgtggcatctgcaggcctttgagtgaaactgaaacagctgagttccataagaggtttggaagagtaccctggggctagtggctcctgatgtaggaccagtcagtctgggtatgagagaggggagtcaagaagccttcagcgaagtattaaaagggacataaatccag

SEQ ID NO: 31220 - DNA, 1157 bp, Mus musculus
ctcttacgcctcccagggccacttctctcccctccatcctctcagaacggggacagcaaacttttatggttgcatcaatgtaagttatttgcctgactgtgtttgtgtgttatttactgccgagtgctacattgtgctttgtccttcattgtagaattttttcatatttttttgggggggggttaagattttttttttgtacttgcttcgattcttcccaaactctcttcagtggagctaagacactcctttgctgtctttccctgtggcttatctcagcacttggaccttctaaacgagttaccaaactacttacttagccttccacacagctgtggcttagcgactccctggtcacgttgtcacttttcagtgacacatcttcaagtagcttcctaacacacagtggatgcaaaagcttctttttaagacactgcagatttgcaggggcctccatggtacccagaagactgagggatgatttgattcgtgtgggattccagatggaaaccatttccttagcgtgatgtgaaagccctgctctgctgtagttttactaatactgctgagaacctgagtggtcttcttactcctacatctctgaacacagcgtattacttctcctctgagagcctttaatgtctaccccagtggctcagcagtcagagcgtcacctgctcttgcagaggactcagctctgttcttgtctcacacacggatgactccctgacacccgacccagatgcacccacatctgccgctctcagccacctgcaactccagcctggggcacattacccctctggtcactcgtgcacacatgcccactacagacatgtgcagcattaagtaacaattactgtggaagtctagcccattgttctaaggtatttcgtgatttgcctgcagagggtattagtactttctgttccctccgtagtgtcatagctggggcaggtatcctcctgcgattttctcggtgatttcttttatcttttcttctgttatttctcaaaactcttctctgttttgtttctttttctctattttctgcttttgttccctaacaattcagttttgagttgcttttgtttgtttgtttgtttttaaattttctatttttctttttcaaatatgctaacaactcttctaataga

SEQ ID NO: 31221 - DNA, 2124 bp, Mus musculus
tcagccggaccaaactcctctaataaagggaagcatggcttttccgataaccagaagctgtgggagcgaaatataaaatctcatcttggaaacgtccacgaccaagacaattaagtgaagtgtctgagactggggtgtgggtgggtgcagttagaaggagcagtctcctttttgtaaagaatggtgtaagactagctttggagccgtttttctttcttctttttttcttttccttttttctttttttttttttttaagattgagtggtacactaataaatgagagtttgcaattagaggtaatttatgttttatatacagatttcaagacatttgctaattttgtagtttcacatgattagtttccaagggttacagataataaagaaatcacaagtggtacctttctaagaattgcatatttttttagacacaactattagcacattaagagggaagccaaaagttattgtctgcttcaaactggaagcagttcctctcctgacttctccctcgttacccgactgtccggctccctgcagcagccttaccgagagggagattggcttgagaagccagtgttactgttgtgactgttggctgagaggaagtttagatgaggttcaagtaaaccctttcctgcgggcatttcgttttgtttcgggccattctagctagtactgcttcgctctcagtgggtaccgatgcttgctctgtaaaaataaatttttttcattaaaaattctttttttttttttttttttttttttttttttttttttaacaaatctacttttatttatttactctccattagtttaaatccgggatgggtacagcatcacacggattctgtgtccaatggcctttgcaggaaggttgcttcggaatttggcacgaaccataccgctgtttccgtgggcccgagttacctttccccagatcactctggttttgtttggtttacctccaggagtcactgtattgttttttgctttatacacataagcacatctcttgcctaagtagaactccgtttcatctcgggcataaacgccttcaattttaagaagagccgtgtgctctctttggttccggagacctcgcttgtagccagcaaaaatggccttgcaccacagccttccagacatacttgctgttagaagtcctgttcccagcaggcctccacaggcgccaagatggcggaaagagcttaaaaattcttatatgaagaattgagtattatgactagcccactctaacggagtgtgtctccgttgaggaccttcagaggacactatttgctaccaaagtgaaccagtattctgaatgtgcttctcttggtttctgttctagttcctagaagcatttccaccagaacttgaggcaaaacataaggaagctgtttcttttaaagtacaaacaccaccaaaaatatcagtgtacatagtgctttatgtattggctggcttttattttttaaaaggtttaaataacaaaaaaggaaaaaaaaggtgtagcattgtatgaaggcagatgaggcgacacaccttctgtgacatttgaagcatttgtgttactaacttactagatccggtttgaattgaattcacaaggtttcttacttgtccaactccatggcttattttccgtacatacaagctgaccagtggtttcaaaagcacatttagtgactgcaataggacagaaatgcttctctagacacatcttcattgcgagcgtctcgtcgcatatgctcttagagttctgtgtgtaggatgtttgttttgtatttttgtattgtatatgggctttttaaatgtgacagttaaatgcatctttaatagtcacagacaaaagagatgataaaatgtcctttgaaaatggcaatgttgagtttggaggcagcttcggggagtttcctgggtggcgatgattcactgggcagtttttaatgtagtgacttcaagaagcagcctgcggatattcctaacacttggttcactacagtttagtttacttcataagccccaagtaaaacgatggaaatgtacatagcactattagttcatacatgatttaagtatatcaagatacataaatttaacatttatgtctgcaaact

SEQ ID NO: 31222 - DNA, 1196 bp, Mus musculus
atcctacacacagaactctaagagcatatgcgacgagacgctcgcaatgaagatgtgtctagagaagcatttctgtcctattgcagtcactaaatgtgcttttgaaaccactggtcagcttgtatgtacggaaaataagccatggagttggacaagtaagaaaccttgtgaattcaattcaaaccggatctagtaagttagtaacacaaatgcttcaaatgtcacagaaggtgtgtcgcctcatctgccttcatacaatgctacaccttttttttccttttttgttatttaaaccttttaaaaaataaaagccagccaatacataaagcactatgtacactgatatttttggtggtgtttgtactttaaaagaaacagcttccttatgttttgcctcaagttctggtggaaatgcttctaggaactagaacagaaaccaagagaagcacattcagaatactggttcactttggtagcaaatagtgtcctctgaaggtcctcaacggagacacactccgttagagtgggctagtcataatactcaattcttcatataagaatttttaagctctttccgccatcttggcgcctgtggaggcctgctgggaacaggacttctaacagcaagtatgtctggaaggctgtggtgcaaggccatttttgctggctacaagcgaggtctccggaaccaaagagagcacacggctcttcttaaaattgaaggcgtttatgcccgagatgaaacggagttctacttaggcaagagatgtgcttatgtgtataaagcaaaaaacaatacagtgactcctggaggtaaaccaaacaaaaccagagtgatctggggaaaggtaactcgggcccacggaaacagcggtatggttcgtgccaaattccgaagcaaccttcctgcaaaggccattggacacagaatccgtgtgatgctgtacccatcccggatttaaactaatggagagtaaataaataaaagtagatttgttaaaaaaaaaaaaaaaaaaaaaaaaaaaaaaaaaaaaagaatttttaatgaaaaaaatttatttttacagagcaagcatcggtacccactgagagcgaagcagtactagctagaatggcccgaaacaaaacgaaatgcccgcaggaaagggtttacttgaacctcatctaaacttcctctcagccaacagtcacaacag

SEQ ID NO: 31223 - DNA, 1229 bp, Mus musculus
tggcggacgctttccgtgccgtctgactacctatggcaaatccaaacttggacatctttgtaggctttgttgggaggtctgcagcttcgtcttcagctgatcgcttttcagcgctgcgactggaactttcccctccattactggaagaaacagtcttagttttcacaggtttttctgcttcttcttcaggtcctccggcggctccggctcgctgcggcttctctggcttctcctctcccgccttcccgtccgccatcttcctcgccgcggcctccccctgcagcccgggcaagaacctattttttttcttgaagtcctttatttttaaaagtattactttgggggctgaagagagggctcagggttaagaacatttgctgttcttccagaggacttgggtttgattcctggcacccacatggtggcccacacttgtggaactctaatcctaaggcctgtgaggacaccaggtacacacatggcacacagccatacatgcagacaggacactcatacacataggtaaatgcttttaagaaagatttatttttatttatgtgtatgtttgtgcatgtctgccatgtgtgtgtggtgcccatagagattaaaagatggtcatatctcctggagctggactttggagcagttgtgaaacaccagtgtgggtgctggaaactgaacttggtcctctcgaagagcaggaagtgatcttaactgctgagccctactccaaccctcaggataaattcttagctcctgttttaaggttccatgttccctgtagtatctctagaccttccagtactttcccctgcttgttttcatagaggagggttttcttaagctattatttttaaagttcatttctatataaaaataaaaccttgttggatgtggtagcatactcctttaatctgagcactggcgggtggatctctgtaagttccacgacagtctagtctacctattgaattccaggacattcacgactatatagaaaccctatttcaaaatgatgatgatgatgatgataacttttttaaaaagcctttgaagccaacaggaatctctgtacatggctggaatcattgaagggtaggtgacactgtatacattggtgtttggaaggaagggaagcataccaacacagacacagacacacacacacacacacacacacacacctttctgttcctggtgcagaaggtacaaacccagccagggctccg

SEQ ID NO: 31224 - DNA, 1875 bp, Mus musculus
tcagggccaccacaggggcttcctttggactcaggaattagtttatttagcaaggggaatgaaaggcaatgctagtagtctgaggagctttccaaggaacggggtgggggtggggggttgtggggtgagtcagggcaggggcagggcgggggaggagaaggttgtctcagtggtaattcttaatggtgtgtgcttttcagatgccctgctgtgaagggtgaatggcccagccttgatgtccctggagaccctgcattccctctggccccacccatctgtatgaccatcctgtgctcgccctgccatcatgctgtggaatccataacccccagagccaacctggtttcagtttctggtctcagtttcccctgtgttcccagctattagcggccctccatgttgggcaagccccgtgctcagtcaggccacagtgggagcttacctgagcttaaattcccacacttggcacttccctctttcttccaagcagatcccggtcaaggagctggacctgctgttatctattttcatccagggagcagaaggcaggactcagcccagtaccagaaaggacttgagtctttgtggagaagggacatgtggcccaaaatctctaggctttttaactctgtctccaccgtgttgaaatattgggtcagggtcacaggcctcctccagctctgaagtgaatgatatccatttagtctctgacacttgtagatgtgacattcctggaggtgctgatgtcttaaagaagcagtcacaccaaaaacccggcacagtcaggatcaaagcctccatgtttagcctttagcagcagggaaatcacttggcatgggagggaggtagtgtgtctttggaatgttctagtcactttcctctccctctgtagataagatcgcccactccctagtacctgtcagttggggtacaaccctttttgccactcttcattgggttgtggtggggcagatcccagtaccattgaagagatttggagttgaggttgggggatagacaaaggtgacgtttctggggtactactagcactatgcctccctggcttttgagaccctctgtccctaagctcatatggttctgtgccaagcacagtgagacagaaaatgtaaatgacagaggatcagcccagggcattcctccagcccatgccctcacctctctgagagggtgagtagggcattcttgcctgtgttgccagggcttgctaggacagaggcctatataatccatggctcctaaccagtggctgtttgagttcccaggggaagaaagcccagtcttgattatctattgactatttatttggtctccctccccttataggggggtcgttttgggagtggcagcagaatacactatagctcagattgctgggcattaagtgtgctagtggctcagatctgcagctggggcctctgtgggcaacccatcccgtcctaccctgactcctgaagccttcctgtgggggtggggcatggtgagcatgactcctgttgaaagccgattcctgtctaataaatcatggtgatgcaagattggtttagttagccaaatgtctggcctctgctcagtttgccagctgccacatggttttgatttgtctctttgtcccctctgctcagatgttttctgtttactggtagctctggggacaggaaaaggggctgctcttctgagacttggcaccgaggaccctcacactttcttgagatctgggggagagtttggctctgccctgtgcatggcccagtacctgtgcagtgggaggaagaccaaggcttattcaagtggcaccttaaccactgacctttgctctctgaccttccctgatcctgggtgtcggggaccatttct

SEQ ID NO: 31225 - DNA, 1217 bp, Mus musculus
cagattctagcttttgtcacgtttcacaagtcctttctcaacccaatttccatgccaagggctggctctccccattaaccacttacctgtctagggcttatttggttctcagggccctggagaaggcaaactgtccaggtaggaagtagccgtgggggtcttcgccagcctgtgctatcttaatgcattgcaactcctgaggatcctgctagaaccagtgtttgctgcagcagttctaggaagggaggcaccgccacaacccccaggggaatgtcccgaggtgggggtggggggacccagctcttcttttcaggtttcctgttcttctcccatagacccagatttgatctgtccctccaggcttctccctaacctcgtttccttcttacctgaggcccttgcttcagaattgggcagtggactatccggcctagaattttacccttggggtccattttaatgcaggccaggcatttccgccttctctggggaggagaacagggatgtcagagtggagactagcctctggcatgctctggagtgggcgatgtagtgatttgaataagaatgtcccccataggctgacatatttgaagatttggtctccagttggtagtgctgtttggggaggttttgaaggtttgaccttgatggaggaagtacgtcagtggggcaggctttaagattttaaaacctcgaaccactcccaattcactctttctgcgttctgtttacgaggaaggctgtgagctctcagcttcctgctctggccaccatgcctgctggcatccacatctccctgcctcccaccatgatggacttttattcctctggaaccctaagccaaaataaacctttcctattattagttggtcttggtcatggtattttatggcagcagcagaaacataactacatccaaggggcgaggtgacatgcgagccagatggacatgcagcttaccctggcataggagattttagaagttctcttctttggacagtctcaagaagtagcccagactggtctagaacttgcagttcacctgctttaacttctcctatgctggcatttcaagtgtatgccacccttggcttgcctgcagactatggtactttacctgtgcaggtatcattcctgtgtgagcatgcatatgtgtactgctcatgggcaatataccacgtgggtgtattcacaagtgcctgcgttaatgtgca

SEQ ID NO: 31226 - DNA, 1103 bp, Mus musculus
tgatgcctgagaggggccgtaggcctaggaagacaggcctggatatccttggcaacagggtgtcagtggtccgggtggggtacctacactgatgctgctagaggaacaggtaaagatcccagagggatagaggagacagtgatctgggctctgtttaggaatggactttcccctaggtatccagggaacccattttagaattcgggggacctggctttgagctagttggcccccagccccagctggtttttctaagggtcaactcagactgccctgtaccctggaaaaatagcaatagcagccccatctaccctttgagtcctcaactaaacaccagtgggaagagaaccgttccatcctctggtgttaacgccttaatgtccccagtatttactatgagttgcttcaggtcattttttgattttttgttttttcttttggaagtaggtgtggtatagtcgttagtaaatgaatccctgggcagggaatatgggctggccggctgcaccttggtgaacctgctggttagggcagcagcagaggtgaggctgttcctctctctctctgtctctctctggtctctgtctctctctctttttttaccagaacccttctgcaatgcctcctgcataggtcccaagatgtgtagcgatccatccctggttagcaattccatcaatttcttgcatattatcctcccaggacattgatttactcctttaccagcctggcttttttttttttttttttaatctgcctgctctcccctaagtataggccttcctggtggttttgtttaaccccatgaccctccccaactcttctcagagctttgggggttatgtgaaaggctgactagttgagggtttagctgcagggaaggtcctgggtagatttcctttttaaggttcccagggtgtggatgccagcctccacccatgcacctgggtactggggcactgttacctccagaaggcactacttctatcgtagggcgagtctaattgttagacatttcttacttatagtgattggattctgctttcctatgacttctgcctactgggtcttgttttgttccttggatcgaaacagaaccgttt

SEQ ID NO: 31227 - DNA, 1344 bp, Mus musculus
ggtgcacgagctgtggccagagctgccccagccgtgcagcactgcgagcccaccagcgtgtgcacacagctgcggagctgctgcgctcgcagtcggcagtccgggatggtgtgccgggctctgagtcacaagctgagattgcccagagtgtggttgtgaagccccaaggtccccagggtgctaaggaagtgctgtgtggccaggagtgtgagaccttggctgtgcccagcgagcagcgccagttcatctgcaacgagtgcggcaagagcttctcatggtggtcagcgctcaccatccaccagcgcatccacacgggcgagcggccctatgcctgcccagactgcggtcgctgttttagccagaagcctaacctcacacggcaccggcgcaaccacacaggcgagagaccctacctgtgcacagcctgtggccgtggcttccgtcaaaagcagcatctgctcaagcatcagcgtgtccatcgtggaactcaggcccctcaccctggccccgaggaagagctgtagtgtgccctgtgcagctatggtggtgggtgcgggagtgtgtgcctgtagggtgtatgccaggaacaggagatgctccccgagttaggctcatcaaagttctgaggcccgaggatggtattctagaagcatctcaaaggaagtctaaaaagtgcctcgtaggggcagtgagatcaaagctgtgggtgtttaagatgggctgtgattgttagtgtgccattcagaattggcccccagccgtaggcaccttgtgaggagctgttgggggtcctagtgaagggctgttggggtctctaggaaagccactgtgtgtgaaatgacctgggacagatcattggtagcactagcctatcacatacgctacaagatggtcagtgcggtggtccccatgggagagacggtcagagactccaggataccaatagaacaaaggctgtagctaagaaggtgtaattatttccccagctccaaggacagtgccaagcagccacgctggatcatttgatggcccagactctgagcatcttgctgcttggagcactaggtacagcagactggcctaattggcagtgtgtatgatgattggagggtgcggtacagtcaggtggtctcatccatagcttggctgcttggggaagtgactattcaagaacaggctgtgccaagtgtgtgtgtgtttgtgactgccttgggtccttacccttactggtattggagaaaaatgaaggactgaatattccacatggtgtcactgttctttctgaatcatccttacccgagcccaggtgtgtgagctccaggtgtgtgagctccaggtgtgtga

SEQ ID NO: 31228 - DNA, 2276 bp, Mus musculus
accatagagccatcttctccagccccataaagattatctgggctcacttttttttttccttttccttcctttcctttcttttttttaaaaaagagagacaaggtttgtctgtgtatccctgggtgtcctggaactcactttgtagaataggctggccttgaattcagagatctgcctcggcctaccaagtgcggaaagtaaaagcgtaagccaccaccatccacacggtcctcctcattccttaaactactccccaggcaatccgtctaaatcaccgtttccggttacagacccgcccacttcgtgacgtagaatcccggagccgcccggaagctccaccacctccccccagagaagtcgcggcgagagctatgggtccgggctggtcgcccgcgcggcgtttatggccgctgctgtggcgcagggcggtcttccagagagccggccccgcaatggcttcggttccctggcttccgcggctggcagagcgatggcttcccgcgaggcccgcgacctgcctgaccccgagcctaacgcgcggcctgcaccatgggcctcagcccgaggagcggaccgctggcgacgctcgcctgcagcccggacccgcaggtacgcgggcaggacacctggtggcccggcctgacccaggcggccctgggctttcctgtgcgcttcgggggcaagagaaatagccattcgcgcagacgcagagctggaagggatttgggaggtggtcggcaccaactttgctttgcgtacccgagagtcctagagggaggctaaggtagcgtgttgtcgtcaaaattccagtcatagagcgggcaacatccggctcttggcttcacagcccaggatccaccccgtctcacgatctgcccagggtcgtagcaggtggactggttggtcttagtagcactagtcctagcagcctcgtttcttcatatctgttgaaggctgtggaccaggtattgtcttgagaacccgcctaccatacagtatagttaagtaacctttttaatctgcgattcgatttaacgtgtgccctaggatattgtcctctccctcaaatcatgccgctggttgttgtgtagcatctctgcatttgtggagtgttgttcctttcagtactagtaaatagaaagacatttgcttctgcttccgtttggtaatcgcagtatccagtgtccgtaatctgaaccttctacctaggaaagctgagcagtgctttagggaactgttgtccgggttcagttttaagctggtttttggttggttggtttagtttgtcttgaatggagatggtattaggggttggacccagggccacgtacatgccaccactgaagcacaccttcagtcttttagtttaaaaataaaaaatctttagaccttgtctttctgagttgctcagcctaacattgaacctgggatcctcctgcctagtgttcaccaaagcattttagatataaatacacttgtagggggagcagttccactgtctccaggagacttcgtgtcagtctgcttctgtagacaaatgtaggtctgtattctcctcagccatctgacacaagcgtttctgcattttcagatcacattggtgccaagtttgacatcgatatgctggtttcacttctgaggcaagaaaatgcaagagacatttgtgtgatccaggttcctccagaaatgagatacacagactactttgtgattgggagtgggacttccacccgacacttacacgctatggtccactaccttgtgaagatggtaggatgctctcctttgttgtgaacctttacctagagagtgacacacagaggctgcagaggaagcccactttctagaattcccaagagtgatttttatggtttctcagagtaaaatatttgggagcaaatacttagctctgtcgagcccagataatttctaattcgtgtcttttgtgacaaggaaaattaataacatgaaacaagccagaagacactaggagtctgttctagagtagcacctatgtgatagcctctagctagtgaaaggctttaaaaattatttaaaagatttggaggtttatttttattttttatttcatgtgtatgtctagtgtccacaaaagtcagaggaaagcatgtcgtcttcctagaaatggagttcaagggcgctgtgagctgccgtgtagttgttgggaattgagcccatgctattaacctctgagtcaactctcaagcccttaaaatcattttgaattaggtgggtgtggtgggacatctttaatc

SEQ ID NO: 31229 - DNA, 2627 bp, Mus musculus
gaggaaaattcaggaaattctgactcaggtaaagcagcaccagcagcagaaagctctgcagagtggaccacctcagtcaaggcggaagtaaaggctcaggagacagccaccacagaggcagatgccaaaccaaagacagatttgcttaaccaacagacgggtgctgacccatccagaaccacgtgcacgagtttttacctagctggttgtttccgaggaccaggcactcgatcctgtctctgtgagaatgtatactttatgctctctgaaatatatgacacccagctttaaaaaaaaaaaaaaaaaaaaaaaaaaagtgggggtaaggaaagagaactctgcacttcccttgtgatatcaaagtataacaaacgtgctaatttttcttaatatccctctataatgccagaaattggcataaatggtacattcactaaatttatcaaataaatttaaaactagattgttcctaagtccaattgttgaaattggatcaaagtagaattgtcagaggaacacaacattaagccattagaatagaagagctgttgtctcctgtttctctaacactaacatggataacctaagggaagtgccagccgctgttggcagggtattaaacgtgcatttttactcaactacctcaggtattcagtaatacagttaaaagcaaaattattccttttttgaaaattttatatactttataaaaactccaaccgtttttttaaaaaaaataaaatttaacagttatcagctgataggcaagtcattgaaaaagtaattttacgtctggctggtgagagtaaagttggaaaaataattttgcattttttgagcctttgaaagttggaaagtccactaactgttcaaagataaggagcagtgcctattctcaagagcagccatgccatgtactcctttgttcctatctgggaaggttgttgacggtactgaccaagcaggcaggggctgggacggccagtgtacaggacagctagggtaaaggacagctagtgtacagggctccaggagacttggggatttgtgtttagctatgtgtgggaatttgcaaatgctttgtgctttgactgtcaccacgaaaaggaagaaattcatgtcagtgaagaaatgcagaatttaaacaaaatcagcttgagtttgttttaccagatgctcagcttgctaacacacttgagatcagaccatactctgagcagacatggaaaggattgctttgtgaagaccagggggagtcaggtggtatgacagggccgaagggcaacaaaatctccatttccttgtgcctggcactgtctcgagcctaagctattttaaagatgttttaaacagtggaagaattaagtccaccaaaagtcttccatgaaatgtagcagagtttctgtctgccctgcattacctgccagcgagtcaaggtaggggatccagcaaacggttttgggaattcagactgtggaaacatcggacttccctttgcccttcctcaacttagtggcaaagccctgtatggatacttgtaggtgcgggtgatcctcaaggccatgctgctttctgagttgttcttgttgctttgttcataatgtggttacagtcatattacactgaccctgagggtattatgtaacccttcagaaaaccactttgcctcattgtgtttcaggattaacttctacatgcctttaagtttttctgagtatcagcatatcatttagacattgtgaaaatgaattcctaaacattttcataaaaccggttaattttgtagttttagccaaaaagtgccccctttttacaactgaattcatctagcattttcatatggtggatttaaactgcttaaaaaagaaaatgtgaccggctctcctgcttgggtctcaggggagatatgcttaaggccagagctcttcctcagtatttgatttttccagtgtttgttttttaaaaaactgacaggtgctacatttctatctgttggtttcaattctgccatatttcatgtctagcctttagagtggccaatcatgttttactttcatttaagcactggtagtctggagtacctggtactgagtaactctataattgtgttttgtgttcaccatatacagatcatttctcatctgtagtgtgccccaaatgcagcttcactttccaggtaccctgatgcagaataaagttttcatcataaaccacagcttctgtagtatgttttcagatgagtgagtgttcttgagttattttctatgataatcttacagtaaacagtaacctaccagcacgttattttttcaggccctgattcaagaatgtgaaccttggttgtcctatttaacacaaactaagatctacagatttacatgactttccataatgttctaaatataaatattgtacttgtgccacgtatttatagaaatgctatccttataccctagcacccagccacttactattgccctcagacatatttggaaaaaaactggggaagggaggcaggctgatagtctaaatagagaacttgagtcagtcacggggtcagtgctacctgaggcatcatgctagaatttcaagaataaagataggatgctgaaaaacagggactgaat

SEQ ID NO: 31230 - DNA, 1217 bp, Mus musculus
ccttccagtgagtagacttgggagcaatttacccagcagtcttagcaacagaaagtatacacatagtttaagcaatccagagagtcttttccccttaaaataagaagcatgctaccttgacagcattaccctttctctgaaagctaaggagagaccatggatgtgttagcctcacaacttaggagcccagagcttctaacatgttaccgcacttcatgtaccactggagttataaccaagagcacaggcagtggacatatccagctcttttaactatacaattatgggtcgggccctttaatgtccccagcgttctgtgctcccattgtaaagtgattattctttagctagatgtagtatgggttggctcagtggctgtacatgaagttttagattagagtcaggcaccattttaatactcagtaaatagtgtgctatacctgactggcccatattaatcatagcctctccataattcctttccagaaggcatttaattctgcagctcagtcaatcatgtgcagatgtcaggctggtttgcctaaggtttgtcagtgacacccgaaagtatcataactggctggtgatgggtctattacagatcgctccagccgaagcaccagatgctaaagtgcggatggtgattatcactggaccaccagaggctcagttcaaggtatgtgttgtggagggcacagggaactggagggagcaagatgatgatgttaccttccccagcccctgtgtatcagtggaaatcccaaagatcagacttgagccacacagaattatttcacaaccatgaaccaagagcctttagttttgagttttgtaatggtgttggtttactgtcaccactgagatggttgggactttaacactggcagagacacacctgcttgctaatgaaccttgtaaatctgtttttcaacatcccattctgtcttggagatggtctaatcttgagttaaagtagccccttttctcttactttcacctagcactgtccttggattttggttagaaggttagagctgtgatggcatgagatctggctttaactactgaacatttatgtgtatctatggacctatggagctggaagatctctctgttctgaggtgatggagacaacctggcagctagacccctatttcaaatcctagtttggccattcaccatttgtgtgaccttagacaagttactcttctcccatt

SEQ ID NO: 31231 - DNA, 1234 bp, Mus musculus
ttttttaatattgttgtctgtttagggtttaagtggggtcagtatagaccatttaaaaatttagtctagatgcttgattatgttacttcctttaggtaactttaatctaaactccgaaaatattggagaaaattgagctcactcacacagatgctgatctgcctttggggagggctttactgcgtccacctccttatttcaggaaacacagttgtcagcggcttctgactaggattgaccagaaaagtctaggtgcttcctggcagcaccaaacatccctttgctcactcctcctcggctcactgtcagggatggaatgaggggctcaacaaatgtgccacgtctacaacacagacgtatgaaaccatgtgcccagttgctgctattgagggatgggagggaggtcactacaagatcggatttgggtctttggtgcttgatcccacactttctcataatgctgagccagccattgtgacagctgaatgactgtcacctgtcctcctgacattcttgtttttactctcctgcccatagattgcaggaactgacgctgtacaatccggaacgcaccattacagtgaaaggcagtgttgagacgtgtgccaaggcggaggaggaaataatgaagaagatcagggagtcttatgaaaatgatattgcttccatgaatgttagttctggggtggggaggtcattgttctgatggacagccaagaactgtcttttgctaggaactcttccagtgcttcaagtgttgtgagttgtcagcacagtcccaagtccctgagatggcacacaagcctttgcgctgggcctagctgtcagtgattactaacaaattaggtagcttccgagccttggcttcttgatacacaagggatgattaatacctgtctaccaaagggtattcctgtgttaatttgaggatgtgagcattagaggtaggagaattaggctttatttcccgccaacagtttgtgagccacagctttcttctctgtatcaggtagctggtatctcctattgtacatggaaagctgaggtgggtggactgcaaggtcaagtccaccctgagaatgtagaggtccatgtcttgaacatggtacaggttgaggggccagtgtgccttctgtgctagagtgcttgcctagcgtgcctcagccctgcactgcagagccataaagcagaaacacaggcttgaatattaccgtgttacccacataagcctgcg

SEQ ID NO: 31232 - DNA, 1141 bp, Mus musculus
tatatccttcagaaactggtctgtaaggttcaaatcaagcattttttgataataaatcctttaaaaatgcattcattggtattcatgtgattttgccatcaattaaagatgaaaactgattttgcacagtaatgagatagatgccttgttggctgccgcatgaagaattagatcttggcagagtggttgaccactagatcttggcagagtcaggccatagggtggcttcaggttttgcacagcggatcggtgctttgattctctcctccgtgctgcgcatgctgcatcacataaatatgtaggacaaaatggcacaagtgtatttaggcccttctaaaagttgttggaaattctgtcccaatcccaagccaaaaatcatttaatgaattttttttttaatgaaactcaaattgacaactcaaacaccaatttctaaaatcaaatattcttacacagtgcaattcagaatatgccagtttgatgtatgttggggaacgatggtaggaaagtgtcaaaagtcgttgtttcctcaattaaggtttatgtttctaagaacaatggctctgcacataaccctgcatctgaggtgctggaggcagtgtccgggctgtaaaggaaatacacacagggtgcgtgcgggtcaaagtgcgcatgtgtctgctctgaactaaggctgcagtggttacaggatccatgtccaagtgctcccagaaacacaatggattcattccacttgagattaggaaatgaattttggtcacctcctgtccagagaccttttctattacaaaaattttcacagccctcacatttagtgatggggcccatgtgaggttgtgacccatagtctaagaagttggatcggtttacctggctttcatctaacaatggagagagaggccttgtcaccttccatcccttacctttgggaacttagtacactgttgcttcttggtgtagcagcttcagttcctttctagactgctaatgagatctgtcagataatggagtcataagctgaacttaaggtaggcagatggggcaaagcagaagggagtgtttttgttgtatctgatgatgcggttgctgagtggtgctggtggatttaatgcattcttgccgtcataactaatcattacca

SEQ ID NO: 31233 - DNA, 1186 bp, Mus musculus
gaggattcccaagtagtgcagacccagtcccctgtcactaacaggatgctttagtggggtgtgtctggcacacgatgaaccaatgttattcacctttatactaacctaaagttgatgcttgataaagattatatccttcattcttcctgcgactgctccaggatcctgtgcaggacctgcccaacatgcagttgtgggttctcctccactccctgctgttgtggcagtttcttgcctcattgtttttgatgaccttgatggttttagcagtagtaaatatttcgtagacagtcttagttggggttagctgaggtttctctcctggttagtctgagcttatacatttgagaggagatgtcactgtcagtctatcgagtgtacactgctgtcagcacaacttgccactgcatagcaatcctggtgccctgggagaagcagtgtgggtagtgtgtttgttgtaaagctacttccttgcctctcacagaccgctgggagactgtcactgcaagtctggagaggtagcttagcagttaagattgcctgcttctcttgcagagtgtcctcgtcactgttgaaccaagagcccaggatcttgagagaactacttgtccatgaagcagtgtctgctctgtgtagtcatctggacttgagaccacttattttgtattttagggaataatcctaatctttccccctctccctgtgacctcctttgattgtgtttattcctttgtaatttatgtgtgggggcgtttggccttcaggtatatctgtggtccacatgtgtgtgcaccgtgtcaacaggtcagaggtggtgttggagccttagaactgaagttacacacagttgtgagtcaccatgtgggtgctgagaaggaacccagggcctctctgttgtctcctctttgaagcctatcatacatcttgagggcatggctagtgtctacagggcagatagatggataagtaagtgggataatgtgtttgcctaattctgtgtgtagagatgagtggagagtctctcctgcctttaagccttcaagtgtgactatctgagcaacttgttccagacagcatggacgcaaggactcttactcagacatgctgagtggcctgttggattttgctcagacaaggcccccccccccccccccactaagttcaaggtcaatcctggcagattatg

SEQ ID NO: 31234 - DNA, 1099 bp, Mus musculus
ctattaatgatgtgacttcattgtgttgggttcttcctggcttgacaaaacacgagcaaatctttcatcagtcagagctttgtttctctatcataggaattttatctgacttggtgtttaagcagtgtttgcttagaaagagaacctttgctcgggccgccccttcactactggagacagagctttgcagcgcatgacagaatctgaggcccttgccaagcaggtttagtctgggagtgattgctcccaagcttaagggtcacctctaccttattgtatatttttagagtattatcactgacttcttattaatttttaactttaagtttccctggctttgtccccaggccatgcatattaaacaactgaagtggctctaagttgcttcattttttgaggagtagttattttgcatcagtggttttgttttttttttttacaaattaaaaacattttcatctaaaagatcttggcatgtgagttagacccatggctccacccttagaatctcacaattgtaacgtgtgtgtgtgtgtgtgtgtgtgtgtgtgtgtgtgtgtgacatgctgcatttgttttacagtgtgtgcaggccgtgccatgtcgtggcagtcctttgtgggtcagaggacctttggggttggtccctgcctgctaccttgtgtgagactccctgcaggtggggcgctctgctggtctgagaacttctggatgttgttctgtctctttccttctcagcactgtactttacgtgggctcgcacacttgtgtggcaagtactttatgggcacgaggcaagcataccctgttagtacccaacagctagttgtaataaatcaaagtctcatggtcaagggaacatgttttaattctagaacttgagaggctgtgaaaaatctttttcccccttatcagtgtaggtgtagtgtttgagggtttgtcgattgagctagcaatagataagaacttatgtctatgaaaaagatgtgggcctctgaacaactagggagggtttttataacctggctgaggagagaaggcaggaatagtacatgtcttctcggtgatcaaggagacaccaatcacaaaggaaaccaga

SEQ ID NO: 31235 - DNA, 1471 bp, Mus musculus
ttttgaagacatggcctcaattatgtagccctgactggcttagaactggctgtgcaaaccagcctggcctcattaacagatactgtcttccaagtattgagattaaaaacctgcactactctaatggctagggtttttttttttttgttttgttttgttttcacctgactgtggttatgtgatgtactaattcagctctcatttcttacagaagaaggtcgccctctccttactacagtcgctacaggtcacgatcgagatcccgttcctatagtccaagtatgtaaattttacttctgtagaattgaaaccatctttctaagcagtggtgtactttgggatatgtggttgctgttaatattgggaagatattagaccagtcagactgtaattaattctctttgttctatttcaggacgctattgatactggagtgattgtgcccgaggactttgctttttcttctttttgattttggattcccaagcttccatgcttcctagtcctttaaaccaaaaccaaacaacctggtttatttaatctctgcctgaccagttgtgttgctgtttccaccctttgttatactctaaaggtgtaattgtcttttcagtagtgaacatcctgagtgaaagggagcccgggttctgctttgtggttcttctttgcctttacagaggattgacttcttatttgaggacagaaaccatcttttgaaaactttttctgatggatattgtggtagacattagaaatctgtggtatgataaactgctttttaatcttcttggggaaggtaaataacactttaagtaggtcagtcatgccagctttgtctggagtggcatggagcagttgaatagttgagtgtagaatgtttgaagctctaggagaaaatgtgggacatttcttttgaagaatataactttgaacctaagaattaagtcaccttttagaaattaaaagcttgtaattcctataagacatgttgtatttgaatttacatgttaaaccttataaacttaaagtgtgatttttatgttaaatttacagaaacttaagtattcccttaatcactgaaggacaacctttatttattaactagaacaattgtataacttgctgttagaaattttggtattgggacattggttacatgggttattgtataggatcctaaaatacatgtggggaagagtaatttcaaataaaagttaatttgaaaatgggattgtctctttatttgataacagtgggaaatataactggattaaaagccgttttttgttttatgattgagtgttttgcttgcatgtatatatgtgtagtgtgtgcataggcagtgcctgccttgggagctagaaaagggtatcttagctcttggcctgttaacagttgtgagccactatgtgggtgcttgggagtagaatggggctctggaagagcaaacactcttgtctctccagcccagtag

SEQ ID NO: 31236 - DNA, 1167 bp, Mus musculus
ttcgaattctaggcttaaggattcagacttgaatccagcgctcactaagggccatctatgagctcttcattttggaaacctatgattaaaaagactggcacaggagcagtagaatgcaacttgaattatttatggcagaaacccttttcaagaaatacaggagaatgattgtgccattacaaaaaaaaaaaaatccagttctgggtgtgctgtggcacatcattaattccaggcacttggaagccagaggcagacagatctctgaattccaggtcagccagggtgtaagtaaggtcttgcccctcaaaacaaaacaataaaaatcgtaacaggtccataaacaacttaacttggtccgcacatatatcaatttaggaagatgccgagatgttttgagacagggttttactgaagctcaatcacgtgctttccttaactcaggaacctttcctttcagcttctcctcggtactggaatttatagccagaggccaccacacccagtgttcttttgaaactgggaaagagggaaaggtggctctgttttgctttcatttctctctttcagtgtctttactgtttactcctggctgacctcaaactcagatctatttgcctctgcctcttgagtgctggcatctgtttgtcaccttaataataataaagagttatctgctttatcaaacctatccaaaggtaagagaaatgtccttaatgtcctttggagaaattgagaagaatggacataactcttatagttcttattctggcctcttaaaaacccaatttttaaaaaaggagtcctagtatgaagtcaccttgctacggaatgatttgtcaataaaagtgaaaaattaaacaaatttacctgtatccgctggaattaaaagttgtatttgtgtgctgtagaagatggctcagtgaggaaagtgcttgctatagagcatatgaacctaagttctgaagcctggccaatattctaaaagccaggcttggcagagcatgcctctaatccaaatgtttaggatcctcaggagtccttaggcacttcagctaatgagtagatgagctctgggtttagtgagagaccaaccctatctcaaacagttaagtggagggagatacatagagcgagatgtctaaccttctgtcaacgggtatatgagcg

SEQ ID NO: 31237 - DNA, 2843 bp, Mus musculus
gccgggcgtggtggctcacgcctttaatcccagcactcggaaggcagaggcaggcagatttctgagttcgaggccagcctggcctacaaagtgagttccaggacagccaaggctatacagagaaaccctgtctctgtaaaaaaaccaaaccaaaaaaaaaaaaaggggggggggcagatactggggataaggaaaactcagctggaaaagtcggtttgtttgttgggtttttgtttgcttgtttttggttggtttgttttgctatgcaagaaagacctgagttccatacctaaagagaacaaaaccaaaaaaactcaagaacaaaaccccacaggcaaagccaggcgatgacacacgcctttaattccagcacccggaggacaaaccgacccaacgccaaacagcaagctcttgaaacccgccaatctcccgcgctaggccaggcggacacaaagcctcccggggcggaggcggggttcgcgacgacgtcatcacaggtccgccccttgacgtcaggcgccggggacaccaggaggtttctggcggcacgggcgccattttgcctgaacgtgcgagctggtgggagtggaacgcactggccgttgtagccgtcgccttcttcctccccacagtccgaacagcgcggtgactaggccgtcggccctcgagccgagacatatctcttatttagttctcgggagcgcctggccgacatgagtgatgtagaggagaacaacttcgagggcagagtgagtacaaagccgcgggagccgtcttcggcggcggcccgatgctccggggctcggggacgagcgcggtcggtcgggcgaggtggcggggccctcaggagcagccttgagggccaccgcgagcgcgtcacgtcccaagatggcttcggggtccccctgcgtgcccagatgccccactagcccgcagcgctcctttctggcggctgactggtacctggcctggtcctatcctctcctgtcgctccctttcctctcagcttcccatctctgctccgaggtgcgggtccccggcgcggtggggcaggaggcggcggggcgctccctccggccggatagtggtaggtgcttcctgcggtggcatctcgggccaccaccacccctcctccggccatcgcagcggggtctcggggtcagaagtgcgcggggctgctgtccgggcggggaatcgctggcgcgggactagctggggcctgttgtctccttggctctctgttgcagtgagcggccgcgtctccgtcggaaccggcggcgtcgcgtctgtaaaggcgaaagccttgaggttgaaggtgggacgagcccagtgaagtggttagtcaacgaccgcagcgacccttaagagtccttaagacgagagcgagcggggaagggaaaactacgcaagagcctttccccttaatgtcctctttcctttcgcttctaaatgaatgtggaaatgcagtgacgcctgttttcctaacagctagatgttgggttctttatgtctcaacttccaaagctttccttcctgtgaccattcctctgaaaactcctttacagatctttatggctaaactgccaagacatcttactttaaaccttacgtaactgaacaaatttcttgcctcagttttcaaaaaagaaaagaaaaaagctaatcattgttaactcaaaagattatacctgaaatttacagaccctcccccgtttttctcacccattccccggaaaagggactcaagactttggttatctgaggtcttgtgagtataaaccgtatattcacaaagcttgagtatattattagaacgttaccggtttttgagttttattccgaagttaccctagtattggaaattaatggaagtgagtcctggtaaaaccatggaaggaaaaaaaagggaaacaaaagtcccatggtactcgagggctggcagttgtgttggtattctagtggaggaggggcgggtggaaaaaagccgctggagggctttgctgaaggaaagaatttgtcccttttggaagctcgggatttagacacctgtactctgtcagtcaagtcatatacggtcagttagggttttgatcttgagaaaagagggtgcattttgtttgtttatttttttatttaatgcactaggacaaggtcataactacatttaactttgattggattatttgaatgaaatttgcacacaacgattgagttgaacctgcttactatttttaggattgttttattgtactaacaacttttaaagactatgaagtaaatatttcacgtagttgtattacttgtgaaactaagtaattaggaaaagacggttggggtttgggtgtgttgttttgttgttattgttcctggtttagtctgtgggacttgtaccagtgttgctctgatggctctgattgctgctctggttctcccatttgtcctctagtggaaggagtagtggataattaccaccttcccacaaattattgaagattcctatccacttttcagtttatttaggtattaacaacctagttaacagatagggactttctagctccctctcttctgccattagtagtacagcagtacctgtggttcagtttacatcagcgctttcagggtcagttacagctctttaagatgtaacagtttttgttttgtattcttaaattatgattgaacagacttgtaattacataaagaattagaaggctagaggcttgtgggggggttcatattgatttttgttgtttttgagctttgtgggagtggaacccaggccttttgcataccaggcaagtgctgtaccactcctcttcttaaagcagctaagtatttaa

SEQ ID NO: 31238 - DNA, 1099 bp, Mus musculus
atcactacagtatcagaccctctgctttcttaaaacactcaacaagattaaaaaaacaaaaagaatgggcgtgattccgttctgcatgtctgttctgtggaacatcaagcagttgttttctggtgggatttctcccacactgaagtccactcgatggacatgcaccggagccctcttaggcctcagaactaccttttcggttgcgaactaaaggctgataaagactatcactttaaagtggataatgataaaaatgaacaccaattatcattaagaatcattttaggagcaagttacacattgtagaggcagaagcaatgtatgaaggcagtccaattaaagtcacactggcaactttgaagatgtctgtacaaccaacagtttcccttgggggcttcaaaattacaaccacctgtggtcttaaggttgaagtgtggttcagggcctgtgcacactagtggacagcacctagtagctgtacaggaagatgcagagtctgaagatgaagatgaggaggacgtaaaactcttaggcatgtctggaaagtgatctgctcctggaggtggtaacaaggttccacagaaaaaagtaaaacttgatgaagatgatgaggatgatgatgaagacgatgaggaggaggattttgatgatgaggaaactgaagaaaaggttccagtgaagaaatctgtacctgataccccagccaaaaatgcacaaaaaccaaaccatcaacttaaaacctttaacaccaagatcaaagggtcaagagtccttcaaaaaaccaggaaaaaactcccaaaacaccaaaaggacctagttctgtagaagacattaaagcaaaattgcaagcaagtatagaaaaagtggttctcttccgaagtagaagtcaagttcattaattatgtgaagaattgtttccagatgactgaccaggaggctattaagatctctggcagtggaggaagtctctttaagaaaattgtttaaacagtttgaaatattctgtcttacttcatttctgtaatagttgatacctggctgtcctttttataatgcaaagtgagaactctccctactgtgtctgataaatgttgtccag

SEQ ID NO: 31239 - DNA, 1225 bp, Mus musculus
tccttgtcctcatcctcgtccttgtcctcctcctggtccttctcctcctcatcttcttcttcctcgtcctgctcctctacttccttgttctcttcagcaatcagtataagcccagacccatctctcttcgtgttttggctgaggttacttcaaggcaagggctaatcctaggcctgcttcattttttttttttttcttgtgttcgacctaggattcttcatgctcaagggttggcccagggccaacatatattattctttgggcctgggccacttccgggattggggatagtcccagtcccataactcctattagggccacagccactttaggaatcagtataggccaaggcccacatttctttttctttgggtctagacctcttttcaggtatatgggtagtgacaggcccacatttctacatcagtgggccagacatccttaggtttagtgattgacccaggctcaaaagtttggtttttttttttctcacaataattcaagtgttggggacagaccctgacctacatcttttcttctatgggctcaggcctcttcagcacaagggacccagaactctgaagggttagggctatgtccagctgaacatcttcacttttttcaacccaggcttcttcatgctcatggactgacctaggcttatattttcttctttgggcccaggccacatgaatggttgaaaataggttcaggacccatctattgttctttgggccctggtctcctcaaggttatggaaaggcccaggcccacagttcttcttggattgggcccagtatccttcatgtacagggatttgcccaggcccacatcccttttttttttttttttttttagagccatagcaacttcaggaataggaataggaataggatttggcccacatctcttctttgggcctagtttatttcagggttagaagatgatcaggccaccatctcttccttttttttttttttttttgcctaggcccctttaggaatagggatagtcccaggcccatatctcttcttctttgggcccagaccacttgaagtttagggatacacccaggcccatatctcttcttctttgggcccaggactcttcaggataaatagtagactcaggcccacattatgcttctttgtgtctaagcctcttcaggaatagggataggcccaggtccttatctctcaattttttttttgacccaggctacttc

SEQ ID NO: 31240 - DNA, 1160 bp, Mus musculus
tcattgatcaatcctctgaaactgtaagcatgcccccaggtaaatgttttcttttgtaaattgccttggttatggtgtctcttcatagcaatagagcagttaactaagacacatgataaacaaaatgacacatgctttcaatcccagtattccagaggcagaggcaggtggatatctcagttcaaggccagcctgagctacataaaaagaaaataaagtttctctccctacccttttttcataagatgaatcattgctacagtttcagagtcgctacactagtgatgtttcctaccagtcagtgacgagcgtttttggccagatccttggtggagaatcacccttaaagctacatgggcccttggcacagcataatgctccagcacatttccaaggccctctcagcagaggagtggcactgttatgtttaaaaataaactgtgtgtcttagaaaacatctgtgtcttcaactttacacagcaggtattgactgtctgtcctataaaggaaaaatatttgtatttacacattctcaagggaggcccagagaaaatcttgggacaagcttgtgtgtgcctctgagggctacagtgcaagattacccagcgttccctgctctcctcttcagcagcctgccttcctattgtcttttcagttaggcattttgaactttgtgctcttgcttggctgggtttttattcaaggtaattccatgtagcctgattaggggcacattcctccagatgtttactaagggtttttacagtaacttctctgctcagtttgaactttgaatcctttactggagaccatgagtaaatccccatacggaagaatagggcagaaccacaggaagaaattggattttgtacttgatggtgaactagtagaccagtggacttcccaggggggaagcacatttgtgtacaggaacactcacttagagggtgataatagagattatcttattcattttaaggttagtaataacacatatcacagactggataaattaaggaaaagaggctatttggctcacagttctggaaggtttcatggccacatctgccgttggccttcatgttggtagagtgtcaggaagcatgtctgtcctttttccctccctcttctaagatttaatcctaatgcactccaaagcc

SEQ ID NO: 31241 - DNA, 1442 bp, Mus musculus
ggattattttcatttgtcgcagtgatgtgctgatgccgactaatgttgcatattagctatggagctcgggtggaagcatggtcatgcacacagagagtgccttatcctgcaaacttaacttagagaacatttacttattttcaaatataaaatttcaaacctattacttcagttttgttttttaagaatagtcagcaaaaatatgcctgtgcaaatgtttgtgatatttaaagatgtctctaagctgcaagctgtttgttaatcatcagatgtgatttctgaaacaggaagtgatttgttagggtatttgttctctgttatgtcaaaaaccaaatccattgaacagtttacaagatttggaaataattgccagctattcatatatatacacacctgatactcattatgtaatatatactatataatgttctatattcttcagatttctgttaagaagtacactttttttttagggttaggaactgcattgacacagcgcactgatttccagtcaccttggttgatgccctcctctaggatccctgaatggtacctgttcctccataaacactggcactcagtgacgcagctcgctgaacttagacagccttagtttatactgctgccagggtttctttctttctttcttttcttttttttttttttttttttttttttttttttttttccgagacagggtttctctgtattgccctggctgtcctggaactcactctgtagaccaggctgacctcgaactcagaaatccgcctgcctctgcctcccgagtgctggcgtgcgccaccactgcccggctgctgccagtttttcaccgtcagaagagtcatacttgaaagggtttggtgcttaaatattgatgagtgtctttggtgacagtcgatagacacctgacttctgattttggctttccccttatcagagttatacatccatctatatgaagattgatttagctatacatagacatgcatataaaggtacttatatatggtaagaagcaatattatacattgctttaaattactttcataataaaacacctaagttaccgtattgtaatagtggtaatctgcaggcttttacattttaattctagaatttcatagccaaaattatttttctttctttttttcttttttttttttttttttttttttttttggtggggagggagcagcaaagtgttaacaaagtggaccatacacttaataactttgtaaactacatgtatttgctaaaactcatggattctcattgtaacatgagtcagagcacaatatttgcatgacaccttgtaacttagtgtttcagcacactgtaatgtaagcttgcagagaaagttcagttctgtgctcacaggaaatgttccatattccccagtgtaccttcatgctgtcttatgaagcctttctcagctgctt

SEQ ID NO: 31242 - DNA, 1138 bp, Mus musculus
tagctacatatctttctcatgttaaatataaaaatgcataatgtctagagtatcatctgtatttaacattgtttctgttataaatggtactcatgagccatcaacatagctacattagatttctcctaatggaatgatagttttgctcactataatataaatgccaatattaagaaaatacaactgtttctcagtgaaaaatcaccaaatttgaaactcaagttcccatctgagtctatagaaaccatcaggcctgacaaaaagattcttcctagatgacatgatcaaggaaatttatacttctctcatggggagagtctaacataacagactcatttataatagctttactgaagatgaaagggcatacagtggtgttcaataattggtactatgtaaaaaaatgtacacacacatgcatgagctttgggaagacacacgtgtatccataagtatactaaaagatgagtgtccatattcagcgttgagggcatggttatttctttataactaatggttacatgtattatttcattttcaaatgtgcaaatgcctgtagaaatgatgtctctgaacaagtcatttaaccttaggcaatggagtatatttactgccctacagtagagttttcaccttcagtcttacagtgcttttactgtacagtctccatttctgttttttagttaatatctgatgtcaaatacagcaaaagtgtttgtttttgtctgacttgatataattgctgaccatagctttctgaaatagatatcatcataaaccaaataggactaagccctagattccagagtctggtaatttataataagtttaaaacacttcttttaaaatgacaaattgattattaaaacttatttagaaaatagctcaagatagcagtaaaatccagtagtaggacgttgattatggccaggtactaacctggccaaaatgctgatgatgccaggcctagtagtgcaggcacctaggaggccgacggaggaggagagcaagctggagtctagcctgggtaacatagcaagaccccggctcaaaacaaaacagaacagggcccagggctattgttgtcagagtatgtacctagcacatatgagatccgggcaacacaagaaatgatcct

SEQ ID NO: 31243 - DNA, 1132 bp, Mus musculus
gcaagccccttcctaatttactcaccagaatcaagctgccttaaccttttgtggagcgggaagggcaggaggacagacaaaggacttggtcacacacaatagttagcttctctgtgatgtgctttctaaactttggggattaatcagtgcagattgatggtgttgcccaagtttgtccttgtgttagctgttctgcagggggtcttcatggatctcggtggaatttttctcaagcttctatgatcaactagtgtgctggctggcaggatccctggcctagagcgctgccatgggaagctctctcctacttggcccctcatcttgcttcaagccagcccctgaggtagcacatcaagagaaagagaagccaaaacctgggcttgaatccacagctagcactcatccaacatcctgctgaccaagcgaaccatgtggtcaggtcaggagatggcgaagcagaattcacttctgatgtcacagagtgccagagacgaggacatagatacaaaatggatgaagagttagggatactgatgaagtctgtcagccatggcgtgagaagacagtgggagaactaacccgggaagaagatgaccaggctcacagtgaagaagacagaacttgctccctgatcctgtgtctcctgcccgtgttctctcatcctttcctcaagcactggaacatttatttgatgtttgtgtaggaacatttggtcttgtctgcggaaccaagggtcttttcaccataggcattttgtgcatcttggcagagttacaacatgtcttactttcccttaggagaaattaaagattcctactggctatttactcccagaaaggatgccccagagtcttagttctaaggatagggtgtttctaatctacattttcttttttttgtcttctaatactatggtgaaaataataaagtaaatattgaaatctcctcaaatttctttatatcctgatggttctggctgaccgtacacttataaagaccacaccctgaagctctcacaaagatcagatgaaacgcttgactccagggtttaacttgacccaagggttgggaggggatggtgcagtcagtcattatgtcattatgagggcagagaaagagaaaggggccacat

SEQ ID NO: 31244 - DNA, 2910 bp, Mus musculus
gaaaggtgtgtcacacttttcacgtgcttttaatcattagtactcaaaaggagtaaaatcactttatttacattgtagggcagccaggtctgtgtacagactatcacaaggctgaaagagaacttaatttccacaatacagacataaaccttcagatttatatatgttctaagtgtgctttcttgtttcaatcattgcagggaactatggtcctggaggaagtggaggaagtggtggctatggtggaaggagcagatattaagcttcttcctacttaccatgggtaagtagtttttaagttttacaattattattatcttgggagaactagctgcaggagttaaaagcattttaggatcatgttatctttccttaaaatctggttagatggataatttcataacctatttttttttactctttacttctgttgaaacaggcttcactgtataaataggagaggatgagagcccagaggtaacagaacagcttcaggttatggaaataacaatgttaaggaaactcttatctcagtcatgcataaatatgcagtggtatggcagaagacaccagagcagatgcagacagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaaagttttgaaaagctattagccaggatcatggtgtaataagacataacgtttttcctttaaaaattttaagtgcgtgtgtagagttaagaagctgttgtacatttatgatttaataaaataattctaaaggaaattgtgtaattatagactttttattttaaataagttaaggagtgggtagtataattaaggtccattgcaaagctgttgttgtatttgtgtaagataaaaatgctggtcagatttaagtgtgttgtctgaaattcatcaggaataaattacctagttaacttaagggatatctctgcaaagagaaacacctttttagatcttttagatgctgcttcttcaatgcaaggaaaggaaataaccccagcgaggtactcttcagggacacaggtctagtacaagagaactcttgacgactaatcgcagccagtcttaaaaaactgtgctgtatctacaaagctttaactacagtagttgataaggatgccaacgaaagctgagggtgtagagcaaagtagttctaagcttcagttaaacttctttaggtaagaacttatttactttttctttcttaattttcctcccttaaaagataaactaataaactcttcaatggtcttttcagtatagttcttatgtagtttaacatagcttataaattgagtttaacaataaactcaagataattttataaaccctgttttccaatctgtcatttacttaaattattttggttgttttccctttttttccttctttctcaccccctccctttccatgaagattcaggtgcttaacatatcatttttttccctgctggaattttagcattgatatgaaccatggacaagtatattctgctgccacaaagactgtaaagtgcttcatttcaacagctgaggcaagccaagtgatcattaataaagcttttcttgcttccttcagtggtgttggtagtaaaatggtaggtaaaagttaggctgcaagttcaataaatgagatttacctatcattccacccttgtgtattcattcacctatcctggttcaagcagtttgagtcaactaggcatttaaaggcattgtgtttattgtggtaacaactatacatgcttatcagggatgagtctgacagtgttttcttacagtagaagtttctgtgcaacagcagcagcaaaaccctctatgtaccctgtactaaatagttggggtaaaatgtggtaattttttgcccattgtcctgccctaaaatgttgtaggttggctattgaaatttcctgaaacagccctcttgatttctaggctttattgccttttcagaaatgtgatattgagcgcttattatacacatcagtgagtctgctttaatcctaaacccaccactgaagttacttaggttctgtggacaaacatgataaacttcttcagatactttttttttcctttggcaggaaggtgtcttgctgcaggtaactaatgaagaagtggtcaaccacagagtcttcaagaaataagaaattctgtaccatctgaaagtagttcttgttggtgccttcatttaagaagcacttttaagaaaagggaatgttttctgatttaaaacttcatttagtacaggttcttaataaaattacaaaaatgctgattgtaaagggtaacatcaaattagcaaaggataatgtattgttttaggatttgtgagtagacagataagagctctattttaaatacaagttttataaaataaatacttttgtatccaaattacttggtgtaatgcttacacataagtgtgaatcttgttctatcaacatcagttgtctacaagatcgacactataaatgctagactagttttgcacagaactatacatttagttctcattcaatactaataggagaaaaaagcattaataggcattatttactgtctaataaaatataccttactatgaattgtgcactgctacaacttgatgctgaacactaatggtggcattttgaaaccatggattttaaccagatagtgttttgagttaccacttttgcagaacaccaaaacactgatttttattccaattgtgaatgggtagcagtggtta

SEQ ID NO: 31245 - DNA, 1183 bp, Mus musculus
tggagcacgaggcagatcatagtcagctactgtggacagtctgaagcagccccatatcccatgcctgggattaaaacgaacacacatccttactgcatttctgtgtttttaaagttggttctctcctttcaccatgtgggtcccagagattgaattcaggtctttgggcttggtggcaagtgatgttacctgttatgctatcttgttggccctctcagacattttattcgtaagaatcatgggaaaagaaacagatttctgggcctcagggctcagtaggcctgtggtgaaacctgggagtctatttcccattctccgaggctggcgtatacctgtataagtgagacttgtacaaattattgataagccagagactcccttctgtgcaggagatggaactcagagcctcctagagcatgctggacaaatactttagtgttgtactatacccccagtttttttttttttttcacaaacttaaccccttcctcactgatggagaaatctaacgatactctagggtttgtctgtctgttgaccctcctaggttaaaagagaagccacctatgtagctccatgtccctcctgaattccatccagcacctttgttctgtaactgtggacaccactcagttcttctttcatttttttttgttttgttttagctttatttctttattttctatgtgtatgtaaaggtatgcagtggtttgaatgactgcagtttgtagaggctcatatatttgaatgcttggtctccagttggtagaattgtttgggaaggatttggggttgtagctttgttgaggaggtatgtctctggagatgggtttggaggtttctgaagactcccatgattcccagtgctctttatttctgcctgtagttgtggatcaagatgtgaactctctgttattcctttgctctgtcatcatggactgtaaccctctgaaaccataagctaaattaagtgtttttcttttcttttaaagatttattttattttctgtgtgcatgggtattttgtctgcatacatatctgtctaccacatgtgtgcctggtttctttggagtccagaagaaggggttggatcccctgaaactggagttatagacagttgtgaaccaccaagtgggtgttggtaattgagcctgggtcccctgagtgagtaacaaatgctct

SEQ ID NO: 31246 - DNA, 1149 bp, Mus musculus
ttttgttgttgttgttttttcttgagacagggtctccctgtgtagctctggctggcttggaacttgctgtgtagacccaggctggcctaaaactcgtagagatccgtttgcctctgctttccaagtgctgagatttaaaggcgacaccatcacgcctagtcaaaagaactggaattttaaaaaagtgtacagattattattattgtgtgagtgtgaatatactgtgtgcatgggccaggatggggaaaaccagaacataaaaacaaaaccggaatccagcagtgtaaatctaacccccccaccccccactcagtcctgtaatctttgaggctgtaatcctgtggtctccaagggacttgggcagccccacctctccagctttgccatccacagcacccaaagccaccctaggccccctctatctcatatctcatatgctctcataggtggatattttatggtcctggcatctccaatatcctcggatctccatagcaactagagactgaccttcatcaatagccccttagaccctcacttgtagtactctgaccttgccacgagatgccaagcctctcggaagacgttttctctgaaccctcataccttcaaaaccagtaatacacacagaacactctaccgttgccaagttctgctcaaggtgtagtctgatcttggaccacagatgtctcagctttggtgtgttgaaatacttctttctcgttccagcgaagcctagaaggattcacctcagtgatgccgaactcttgttagcagtagctgtttcttcagacagtcctagcctgatcaggcctagttctagctcacagtccatcatgtgggtcacagtagcaggagcccaaggagcaagtcacaggacacgtgtgcaggggtctgaggataactccccaaagtagtgtttctcctgcagtcggcccccggggattgaactcaggttggcaggcttttgcagcaagtgcctgtatctgctgagccatcttgctggtcctattctgggttattcagaccagtccttgaaagccaaccgaccagctgactgtggacagcgggagaagtgacctcttaggcctggtggttgcccgtggacactttgatgtttagcttgaagagccccatgtccagctgtga

SEQ ID NO: 31247 - DNA, 1237 bp, Mus musculus
gttcccctctgttactcaggctttgagtgtgttgtgaaaaccaatttcctctttttattattttccccctctcttcttttccagttcatcctctgggcttggacacagtagtgatgacagcagttctcatggatgtaaaacgagcccagctctgcaggagtcctgagaaggaattctggggctaccaccttaggaacgaaattgtgcccagccagaaagaatgctggctcataatagattcttacccaatgccactgtcagtatcccaggtagtgaaattcttaaagtggtggggtattagtactagtagttttatgttgtctaattctagccaagcttctgtgtgaagctataaggtctgtgaatgccatacggccctttattgccatcctatacttgtaaatacgatcctgctctcaagtgaaatgagttatatgagatatatatatatatatttggtcttaactggattttaaagagtttggcgtattagtagcatttaaagccagatagggcacccttgctgtgtcaatgaggaagttactgtaaacacagtgttcgactgaagctagagtgcagagtcgcagcactgctgactgcctgcctctctgacatgtggctcttgtttcgtggggacttttcctctggaaaatactttgccttcaggtatttgattgaaatatttaagagtatttaagctttccagtatcctgtatcatgtgtaaatggaaaatatgtcttacaaatagagatgcactaaaacaacaaaaacaacaacaaaacaaacgtttacatcctaggagggaaaaaaaacaaaagtctttgtaattttgcttaaatttgccagacacagatttagaaatacattctcactgtccaaaatcagcttaaacactggctctggcgatgagtcattgtgcaattagaatcatatcttatgatttattttctgtcattaaaaaaatgtacattaaaaaaaaaagtcaccaggtagcttccatgaggaatagctcctcacggttcattttttcagttagaagaaggtttttatgagttaattttacccataaatatttcagtaattttggagtggaagttgggttgctaacatcagagctcatgttcatgttttagaagccctttctttctaggtgtctctcaaaagactggcttaattggaataaaatagctttttttttttaagtgtcccaaagataagatatcttggggtccacca

SEQ ID NO: 31248 - DNA, 1200 bp, Mus musculus
ttttatttttgttttattttgttttgcttcagctttaatttttaaaaataactctagagaatttactttggaagtgaacagattacttaaagttcctttgataataaccagctgtgttcgtaaacctcctcctagctagtaaaatgccacttttatggccttcctgaggaaattaattgaaaaccgttgagcaaattttcacttttgtttgagtaaaaatgttttttctttctaagcaggataaataaagagcatttctactgaagaagaaaacttaaatgtagctttctctttttgcctgcagagaagtcttgtgtctgtctgcaagtgccttggaacatggaatgcctgagtgcctgctcggagccaccttcctttgggtgaacattcctgcctcagctgccattcgatgtagtcacgcactaaagcactctgatgtcagattgagcaggcagtgatgggttacattagatacaagcagtagagataagacctgttgctgttttgcaaataataattagttttaatttacccgtttggtttgtatggtagaattcactgtgattgtacgtgaatcttagtcattgaagcgccggtgagggttgctgtttctcttagtcgctgggtgtaagttatttttagagtgccacaaataatttcctagactttgtacattttgagtcaataataaagacttctttaaagctgtagagatgacttagcctggtattttattcttcatagagtaataacatgttttcattaaagaagttgtatagactcacgggtttacctgctgtaggtaagaaagaataaaccggtgcttgaattacagatagagggaaagtggcagcctgctgtccgctggcgcacagatcaaaccagagccgggttgctgaaagcccttcagtatcctaatttgatgatgggcttgccagtgttttctaatataattttatttaaatttaatgaaatcaaagattcataagaaagcccatttaccattaatacaatggtataaacaacttgggcatgttttcagagtccgaggcaggcaggtattcgctgacctctctgactctatcactgcactatcacaatcccaccgctaagtagcagtcctggccgaaactcctgtgcgctgctctggaccaaacggaagagacagactcttgcgggatggcagcagttggcagccag

SEQ ID NO: 31249 - DNA, 1300 bp, Mus musculus
actgaagagcgtctcggttttgctcttgatcctactttaacctttgccagctcctagtcctttactaaagcattgaaaactgtaaaaagcctcctcagttcaaatgcccataagcagagccccgatcgaatggaatgacatcccattaaaccaactactaggcactgagaaagggaaaaagaaagggggctgagtgagggggtcgagagggagggacgtgggaatgcttttaagtaacaatggggaatgattttcaagatatattggggggaatgggagatgcgcaaaatggagcagtaccttttgtgtttgaaaaggtagaaaagcctaatgacttccatactcatgtagagaccctgaagatgacactcagatccactaacaggagaaccggggtccaaccgtgtatcaaaccagcaagatgacaggcatgcgaaagaggattctcatgactgcctttctcatatgtcttatttttgaactatataaatatgtataaatatattacctattcagagaaaggaaaaacagtaggatgctaaaagaatggagacatagaccagaaaatctggccatgggcaatgtaagttgaaagaatatatgtcaataattcaaaaaactgaaattttagtttttaaaatatttttttagattgattttatgttatgtgaatgaatgcttgcctgcatgtgtgcatgtgcatcatgtgcatgcttggtgcccaaggaagtcaggggacggtggaccctctagaactggatgattacaaatgattgtgaaccaccatgtgggcacccaggttctctgcaagatcaacaagtgctctcaactgctgagccgtatctccagacctggagcaaagctgagtagagcttccagctctaccaacccctcaagggctgcctggcctgcgcacattatttgaccacccagtgcctgctccacaagagttgggggtaggattgagaaagttagaacaaggacaaggataccacaagaagatctacagagtcaactaacctgggtgcatgggggaagctctcagagactaaatgccaaccaaagagcctgcaggggctgggcctaagccccctacacatttgtagcagatgtgcagcttggtcttcatgtgggctccctaacaattgcaccaaggactgtctcagtctctgttccctgcctttggatcccctttccctagatggactgcctggtcaggcctcagtgggagaagatgtcccaagatgggttagcacccaaggggggcttccccttctccgaggagaagaggagaggataa

SEQ ID NO: 31250 - DNA, 1181 bp, Mus musculus
aaacctcaaaatggaaacccgttctcccaaaatatttagatgtctgcattctatattttaatttactaaaggattagtattttttttttcttgtttactgtgttaggagactgcagtagaaagtttagggactcatcgtcacagcacattttaaatcaagcagtaatttcagttcacacattcgttctgttcatattcactgtaaatgctatcttgtaaataaagacattcagcacactgtgaaaatgtatttgtgcacctgctttttaaatacttccactaaaaatgaaaaattagatctgtagatagtggtattagctctgttaatgaaataatcactgccattaaaatctgaaggaaacactccgagttacttttctacgcggaacttgaactgcacaaaaactaaacaagcaggtttgttttacacaagccaaggaccagtcttttattattattattgttcaggtttttctaaattttttatgagaagaggaaaaaaatctcacataactaaaagctcacaactgaaaaggtttcgaggagatgaaagtgttaggtgttctgaaagggagagaaaggaaaggagggagggagagagaggaggttcccagactccctgtggcaaatgaaaaccagttgttgagtatcagcaatgcctagactgtcgtattttaaaatctgctcttaagtctgcatgtgactgaaaggacaggtttttggtatttgttgaaatgacaggactaggaaaggccttaaaccttgaccttgacgaaaaaagacaatttgtgaccttgacttttgacagctcatgaattggtctcagccagattcgtagatcaagggcgccacctcgtgttgacaagcttccttgacgttcttcagcttcaagggaactgagctctgacttgacttgttttaaaggtttagtagtcatattttttttttttgctccaaaaggagaatatttgaatatatgtaaattatacatgtgcttgtatatatgtgaatataatatatgtttatacatgtatttgcatatcagtgtttgtgtgcttgtgtacataattgtagaatttgtacagatattattaattgctgacgagtgaagatactgtaatttaagccgatttctagacttggggtacaaaatgctccttatgcggtgaattttgcttcct

SEQ ID NO: 31251 - DNA, 1161 bp, Mus musculus
cagtatcaaaggacagaaaacatgcacacatacaatgtgtgtaagaatctttttttttttttttttcagattctatttttccttccctacccacttctccctttagcctagccgagtctcccacacgtctcaatatgcttccttctgcctttgatctaggatctgggattggctcaagactctgccaccagcaccaagaccccaattctcctaggaagcctggcccatcagatatacaggatgatgtgttcaaagggctactcaaagaaagacttctcatctgtgttccagtatctacgggaggaggagcccttctgactgcgccctgaggacgtggacgctgttaggaaccaaactctgtcctgagcttcctctagctcactctagaagtaatggtctaatcaaaggtcgtctgtctgcttttgattgtctacatcacagcaatccctgggaatttctatccattttaaatgctgccgctttcatctgtttagccagcacacccaatggtttcactaactagcccagttgacctttttgaagtttgagccttgagcaccttcaacaaaattgagcactctgattaggatatccactttgcaaataaaaccaaatgttttgtcaacatgatggtaaaaaggaaagaaatctgttacaaagacaaattagagggaaatttgtcctgttaaccacatgctattattccttcattcagggttactgacctactgtccagggcttgataggtaaggcagcttgttggcccttgttacagtatcttagtgtaccctcctgttacagcttccacactcagccggcttgcttcagtatttttgcttcctgtatattcttatacatgtttttgactccagaaaaatgacacctttagactgtttcagagccaatgatgatatttcctttaaataattattacattattctaactatagtcatattattttggatttaaataaatttctatcctgataacatttttttggagctttttgttttgtctcttaaggttgtttttgtttgtttgtttgttttttacaagcaaatgggggaaaggtgaaaagaacaaaggagggccaaggtcaaagggtacagagcttagagctggcgttgtcaagccagcagcttgctgcccttctgaagact

SEQ ID NO: 31252 - DNA, 1202 bp, Mus musculus
tttctcctctaaagtggacagtgcaggtttttctcagggatgcccctgttaatcagcagctcttaatactacataattgaagattggatgctccacttggatttgattttatggatttgtttgtttgtttgtgggttgttgttgttgttgttcttttggtgtgttgatttttctggatggtgtgatggggttgagacaggatatctctttgtaatcctggctgtcctagcacttactgtgtggaccacactggccttgaactcagagatcttcttgcctccagagtgctggggttaaaggcagatacctccactccaggcctttattttagatttttgaggtaggctcctactctgtagcctagttggtctgacacccctctatcccaagctggtctcagactagtgactcctctgcctcccagttctgtggattttagatttatagtgaaggaacaaagaggtggaatcccttcacatgttaatgagtcacacttgacctgtacatcctgacatttaatatttttctttgacctttgacaggtcaggccttgacccaaaactattggctaaaatcctgaatatgagctccggacgatgctggtccagcgacacttacaaccccgtacccggggttatgcatggggtcccctcatccaataactaccaaggtggatttggaacaacactaatggctaaggtatgtaactgcagaggttagctgggagggacagacgaaatatgtaatagtttcatcttcccctgcctctccccactcctctctctctctctctctttctctctctctctctctctctcacacacacacacacacacacacacactttcaacaaaccttgcttctatccaagaaggcaaaatgtttacaacagtgcatcagttttccactaaaaattagtgtaaatttggctttgattaaaaaaaatctttaccttggtcattttatttctggctaaggatgcactgagatttttctctgaggcttgggtttatttatagtataagctaataaaattttgttcttcatcataaatttacattaacttaaaaactccttagattgggagcagtgtgatttccaagttgttaatgctcttgtgttaagtgtgcgaagggatttcatgtataaattagtcgtttaaaggcatttatttgtttctgttttggtttggtttgattttg

SEQ ID NO: 31253 - DNA, 1204 bp, Mus musculus
ggttctacctcctctgtgcctccctgcttttagcgatgaaattacgagtactgaactctaagattgactcagttcttcctgcccactcctaacacatactcacattcactcattcttcctgaaccctgctgtctgctctaccacgtactttaccatttattgctcatttgctcatctgttccctttcatatagcatatcattccaacttccaaattagaatgtaaatccattccttagagagcactgctgtatggatcattcatccttagagttgaggccacagtcataatgccatttattaccaagcaaaagagaccctaggttctgctgaggacagtgtgttaggttcagagggaaatacactggatacattcccttacctccaggagagaatccacaactgaatggtggttggtacattagttggttggttggctggtttaagagagaaccctgtagaatcaggtaaagaaaacttttttagaagttataacttgaaaataaagaatcttactaatgctctctgtttttagtctgcaaagatctgcaacaacatgctgttggctataagtatgattggaaccgctgaagctatgaaccttggaatcaggtttgttgaaaagaacattttcatatactaataattttcattgtcttccctatttgattttttatgttagaagaatgacgttcatggtaataaatgagttggttcaggagcgtgttgaaagtgtttcattactgagttttgatagactttgcttattggacaagcaataggcctctagggaacatcagcactctttgccacagccataaatgtagtgcactgtgcactgaagttgtgttatgctttgtatattggagccccatatcttctgttctacttaagtagaaaaactgtaaaattcaaacctactttggcaatgttgggacagatttgaatgaaacatgattcaaatgagtcatgaattcaagtgctatgctaccatgtgactagttttatatgcctgttttaaacatacttctcagaatctgtactagcaagatcttggtgctctgttgtcagaacaatcaggcttccattcctaaaggtacaattcatgtatataacttttattttagcttgcttggttatcctagattagaaagtatcttttaaaaaatacaatgttcactaattgtttacttagagtgagtcca

SEQ ID NO: 31254 - DNA, 1196 bp, Mus musculus
ttctgtgaccccatgactttacattttagatttcctgggatattaatatttcaaatgttcttcaaatatgccaggaaacagatcttaatttttgtttcaggaaacatatttaccatgttaccagattccatacacctgtcttgaacatttcctgatttttcttttgcatttttcaacaataggagtccaaaaaaaaaggaaagaaggaaccagaacttggtggtgattgccatctgtcatctgaccctggttcatatgatgctattttttgaacatatctcttttctatagttatgatttagatcttttttcttttaagattataagtgtatcattttcatctccccactcccaaactctcccattacccagcctagcttgttttcgaattcatggcccctttcattaattgttgtgtagatgcatatatacaattcctaaatacaaaatgttcagtgtgcatgttactcatgtgtgtgttttcagggctggccattttggtattggataagcagttgtgctcttccctggggagactgtttctcccactaagtattcctaagctcgatattgttctctgtttaggcctggtctcccgagcttgccttatccatgttagcatggcttgtgatcaggcagtcgtgttggtgagacttttgggctgtagcttctgctactcctaggagccgcgatctcatagcaactcccgttcctctggctcctcgaatccttctgttcccttttcacagtggtccctgggctttagggttaggcgttgtataggtgtatccttggggagtggagggtagagagagagtctgggtctcccatggctttacattttagatttcctggaacagtcttatctcaaatgccaggaaacatatctcatttttgattaggaaaacatgtttacgaattgaaccttcttacctagcaattgaagcactgactagataacttgctgatgatacttttctcctttgagtcatttatacttctctagcttgcatagaattggattttattggcttgtgtggattttcttcacccttgtcctcccaccaacagtggatcttgtacatcttaagtagtaagagctggttcttagtaccaggttgcaaaccactgaatgatgggtctccagttgtggaatttgtgtgtgtgtcaactgtaagtctgtttttaaaatagga

SEQ ID NO: 31255 - DNA, 1100 bp, Mus musculus
tatgcagatcatatggatgcctggagcctgtagagaaaaaagaatgcattggataccctggaactggagttacacatggttatgagccaccatgtgggtgctgggaagtggacctgggacttcccacaagaagcaagagcaaagtgctcttaattaatggctgagccatctctccagctcttacagtaagaactttttgaaaataaaataaattgagacgaatctcagcctttagaaaaactcaggctatatagttgcctattactataagcttatgcatctgtctgtttatcgtagtatgcatttgactacaaaatctttaaggaactttttcttttgggggattcatgttaggaagttactggggtagctctcaagttgaaagaaaccaggtttcagtcctggtactgttttgggctctttctccttgctgcagaattctcttggttttgttgccatgtggatggggtactctgttcatgtttttttgttttttgtttttttgtttttttttaatttgttatcagaaggaggaggataaaaaactataccggtcagaaacaaaacccaactgtgaatttctctctgtaaattgtcatcagggtcctgtaggtgccagtcagatctgaggtgccaatcttagtgaggctgctgtacagcccctagtacaggtgagtggctgtgcctgaagaagaaccactttgggggtggctggaggagaaggtgcagggtaagtgttaggacatgcgaaattgtgtctgtgagggctagcatgttgtatgtagctcatggctgtgcatgctgtcaagaagtagggtgtattaaaggatgaagagctgaaaggttaaagaaagatagataagaagtagaactactgtaattctcacaaaacagatggagatttcacttaacagttatcagcactcaagtaaatagttgcctttaccctatacatgggctcactgcatgctataaatgtatttactctaaagttttagtgcttgaagttcactacaataaagagattgccaggtgggtgcaaactgtaaatagtaatgtgtcctttacactcatgcaaatatggttggctatccttcctt

SEQ ID NO: 31256 - DNA, 1174 bp, Mus musculus
gtgttagtggggagacttcagacttgcattgcctacttgttcccacacggagccgggcttttgtgttttctttcgtcctgtgtctgacagtagttagtgcattgcatttggttttagtttcttcattcgtctttaatctagaacagttctgatgcttcatctgttaaaagaaacttttatgataataaaatcgagagtcttataggttgctttttaatctggatttatttctttccttattagcctcaggctactaagaacctgctttatattttaaaaaaacgttgctgttcaattgtagaaatttttgactttttctgcattgtctcagaagtttttcttaagagtctcagtctcttcattcaagtacagggaagctgaaattgagttaactttttgcaggtaaagaaacctattgtgataagaaactttgtttttgctttggataaaaatcagctgccctgatttatgctgcactcacctttctgaagcccgatggcgggatttgtgcttttctgtgcccagcaggatctggaagtggtgttaaatgattccctctgaagtgccactttcagatttacatcctctcaggagcggcctctgtaaaacagaaacaggctgaactgcaagagaacgagctccaagcgtgtatggagcaaacgaaacatgtcacactagcttctgtctataaaaggaagtgggaaatagattggtttagtctggttatttttgaaacatatttaagaagaatttaataatcaaatgatatcttactgtaatacaaccatacatgctaaggaaacagatactttaatatgctgaacttagagaatgtgtactttcaaaaatgtttcttttagttgttaaaaaaaaaatctcacttaactaatgtcaccagttcttttcaaacccaatacactctgctccttagcttcgaggtgttgtctcagtgtaacaacagtcttgctggcagatcttcatactcaggaacagcagatgtttataatcgtattctgctgtggggaggaaggtagttttggttttgggtttttttttttttaaggtcatcagtgtttagattaatcaggctgacatttcttgctggtgggtcatgagctgttgataatagcactacatggtgattcagttgttccattgaatcatcagggaaacc

SEQ ID NO: 31257 - DNA, 1201 bp, Mus musculus
gatagggaagtgggataggatcaggaaagtgttggaggaagagtgagtctgatcaaaattagttatttgaaagtcttaataaaatgttcttttaaaaaatgtttccattgttaaaagaatatatcctcttgaagcaaatagctatattttacttgcttatatttattcttagtgaaaatgatatgggtatgagaaatttgcagtatagcttactaaagacttaaactttttaagacccagtgaataaaccaattcccttatgaaattactagggtttcaaacttgcttacactttaacttcactgtgtcagcatggccagtgtacttcacctgatcctaggctttcccaattcgttatctgaatgagtatgggtttactttgaactgtaattgatctgaacttgagtaaataaatgtaagatttgtcaactgtttcagtaccaggccacaggcctccttgacggtctggctattttgacctgattctgattgttgcttagttgcatgaagtactcattcagtgttgtaaacttgaatattttcatttatacttagaaaagtgaagaaaggctcattattaatagattccagtactattgatccttcagtttcaaaagaattggcaaaagaagttgagaaaatgggagctgttttcatggacgcccctgtctccggtggtaagtgctgtctaaaacacatgtgcactgtgtcatatagttttctgcttatccaaagtagctagctgtcctgcttttgtgccacccaaggtatttaccattgatttcagatgtgtaaagattcttagtctctcattaagataacaacagaacagactggcatgatgtttagtgctttcacatacagcacagtaagttacctgtaaattcctgtaaaggtgttagagcttagaagagtcacatggtttgggttgagttgttgtgtggtagacagatcactgcctagaagttcaagaactgggtcagggaataattagtttggggctggaactgtagttgagttggttgaatgcttgcctagtgcatatgaagtcctggtttgatccctagcactatgtaaactacatgggctggtacatgcctgtacccatcacctggttggccgaggcaggagaattagaagttcaagtccgtccgtcagtacataggcagtttgaagccaacttagagtgactgatgtctta

SEQ ID NO: 31258 - DNA, 1130 bp, Mus musculus
gcttacatttgaattaaacaattctcctttgtgatttctttaaaggtagcatcctccccagcagaagtagccgaaaaggctgacaggattatcacaatgctgccctccagtatgaatgcggtagaagtttattctggagcaaacgggattctaaagtatgtatttctcaagggtacagtttttcttgctgtagctctgggttttacgttgttaaagctgctagggcatttaaactctattggttaaattttcctgtgcattttctaatttcataaagtgaacagtggtttcctgcttactgtgaagagttaatttttgcactagagtcaagtatgtgacttgcgggactccctcctccagccttgcttaacttgcattacactttctcactggcagaatggttaggagccttttaaagcttgcattctaaattgtacctactctttaaaacatgattttcttctggtgtatagaactccagaaaagggactctgtgaaaaataaaagcaaacactgaaaagcacactaacttaagactttattatatagtaaaacgttatggactgtcctctgggctggtccatctgcagggaggacacgaggaagctggaatctagtgttagcagtagccctttgggtgacgtgtaattcccgtcagtgtttcctaccagtgtctggcttccctgacactgtaagcctgctggtgaattgctgcttcctgccaaacccttgtggtgtggttatgtcagagtgacagtggttgcattccagtttccggctttctgttttgtattcctaacttactttgctgtcgagtttaacagagaactagtacaaagtcatgtgccatgcagacacttgagtcaccacactgatttctaataatgcttgctaaaagaaaggaagatttgctttgagaaaagcgtaatacaatgagatttgaggtttgggaaactaacacacttgtaaggaaaagacatgtggatattagacagaaaactgataggataaatgtttaggcttcaggggttggtagagtcagcggccccacagtgtgggtggtcttgaggcggcctggctgactcgctacccagcctgctccagttgtgccctgctttatttctccagga

SEQ ID NO: 31259 - DNA, 1178 bp, Mus musculus
gttgaggtttttttcttaagcatagagcttcaaataatttgcctttaggatctcactgtactcacatacactcatggtgagtcggaacacttgagaggatttgaaacttaaaaatggctgagcttagttgtcacacagagtctcaaaaccacagtcattgaaagagaaaggaagaataagacctgtaaatgctagggcaagtggagctctttctaattctttcagtagattatcaacttttcaggggcaagtactgtgtcttgtgtctttttaaaaccctgtcagtatttcatgcagtgcacctttagtgagtggtatttgttcaacgtcactgtgaaatggagaaagtgtatttaatgttatttccaaggtgaggcaaagctttcttaccctctaaagcacttgtttatgaggttaagccaatttttttgattattatttttagcatatatgaatattttgcctacatgcatgtatgtgtaccacaaattacttttttatttataaatgtattgaaatcagtgtgttctaggtcaatggcttctaagactccagttggattcattggactgggaaacatgggaaatccaatggcaaaaaatctcatgaaacatggctatccactcatcctctatgacgtgttccctgatgtatgcaaggagtttaaagaggctggggaacaggtaaggcttggctctggatttgctttagattttgtttttaaatttttttttttttttaatcaaagaagcaagtacttcttagaagcatacccaacagagttgtaaaacctaattgttgctgtctttcatttttaatttaatatcaggtcaacatctggatccacatcaaaagagcagcagagctgccgagaggggtctgttttctgctaggtggccagggcattgcctgttcagtcatttcctgagataatatcatctttgattatgttgatgaaacacttattttgtggaattagccttcttgttagattaagtcagggataattgtcttaggacaggaatctgctttgggacttaagctttgcccgagtccctgatcaaatacttaaattttgtcttaatgggagaagttgttccctcagctggtttccacatctgtgaaatgtgaatgatgactaacttctgtgtcattagattatcaaactcagaggagaa

SEQ ID NO: 31260 - DNA, 1124 bp, Mus musculus
ctctgggacccctggccttccagctccctggcttcaccctaagcgggggctccctcagacttcaaggcctaatttgtgttttaactactctagtcggtggcatggcggtatcctagaaatccagcaaagtttgtcacccttgaccagcaagcagagcgaactccattatgaaatggagttgtgctgcctcaaagtggtggacttttgtcgaaatattaaccacaattctttgcctcaaagttgtgtctataacctaaccgactactatgctgtgctgcaagtatggaaagtgaccaggttttaagcttttagagcgacatgaatatctgagaactgcttttcacatgaggatctcccaaggccttagaatgagtaaattgggacttctccaacaagatccaggaagtaccccttgtttctccctgactcttggattttctaggacatcaagacacctctttaattaagaattggttgaaatggtcattaccaaggcttttagaatgcagtttctcatttgctgtggacatgaccataaagaaaaattcccatgagggttttcatatgctacttgtctagcagttaacctgttgggaacatgtgttgaaaaaaaaaattggttgatttgtgggagataccgaaggatttttttttttaaatgtaaaagtttattttaacaatgtgctggttagcactatcatatacaggactagcaaacaaaacaccgttgcctttgcttagcatgcaggaggctctggattcagggtgcttgtgttcacttgttttaatttttgtgtaagaaatatgttgggagttgatttctgagcagctcccagtctttgccctcaggaaaaacttatgaaatttctttctgctttggaagagcatttgtgtgcaataggtagcagatgacagataaggaattgtgattagccagatgcaaacacatgattttggatataatttttttctttttaaaaacactttgaagggagcagcagttttcttatcagtgtacaacattttgagatctgattagttcaggatgatatatttgctgtttagtgtttttacaaggtgactaatgatagtttcttgaaccattcatgtaccttttaagggtt

SEQ ID NO: 31261 - DNA, 1185 bp, Mus musculus
agagcaagctacctgactagtaagtcaaaaaatattatccttttaaggattaaaatgtattcagtggtgtaggaactagtaaggaagctataaccccacccaaggccctataagcaactttaatgaaaccccttaggtcatcagtaactctgaacgtagatgaggggaagaggacgagaatcattgggaggaaggggaataggaaggatagtaggaggtgcatatcacaaaagtacactgtggatgttgtgtgtaattgatgcgttaatacattttaaaaggataaggaaagcaaggtatggtggccccaccattgatgtctggagtctgagataggagaattgagagagtgagactaacctaacctagttctagtcagcccggcgacataaaactggtcagtaatggcagctaatacacagactgagaactggggaaaagaactgaacttggtgatagaaaaattaccttgatagtagtggttcaagtgagtctcctgtgtgaggagaaaatagataatacaaatactaacgataatctctcttttaaattcaggttcagctggcggagaaagagaaagaaataaatggtctggcttcatatttggaaaatctctccagggagaaggtattgagcagtgcactcattgtgtacagcatgtaaccgatttttgctttctttcatctgacttctctttgaaagctttcctccaggtcttcaactattacctccctggtagtaaacagtaatttgtgtaccattctcacttccagatttcacatctgccaatttttgaaagtatgccaagtgttgaaaattgctagttttctcgaaaaaaaaatgaaaaacgaaaagaaaattgcttgtttgatctccatcacatactttgcattagataataagctaagtttagaatatgcaaatgtagggaagaagtgaatttttaattgggtatttgctcaaacttagatgttttcttgaagtgaatttgttaattaaagggaaaaaattgatactgtttcttgctaatataaagttcaaaccttgaaccaaactaaaattttgacaacttgtgtcttctgtgttaatttgatgctgactagtgtgtacaaatgtatttaacagtctggtggctgaatttggaagatcttaaggagtagatcctcaggttggatggtgtaactc

SEQ ID NO: 31262 - DNA, 1554 bp, Mus musculus
agaatctagaaacagagaaagtaaacgtgtgaagactttgaggataaattgtttagtgtaaatatcagctaattaattaattcaacttgtacactgacaggtgctatatcaagttaattagaaaatacctaattctttattttcttctttctttaaaagctttgatgttcacaagaaatgtcccctctgtgaattaatgttccctcctaactacgatcagaccaaatttgaagaacacgttgaaagtcactggaaggtgtgtccaatgtgcagcgagcagttcccgccggactacgaccagcaggggtttgaaaggcatgttcagacccattttgatcagaatgttctcaacttcgactagcttgtaataagaggtagtacaatttagcaattacaaaacaaaccacatctcagaggctaaggagatgccaggtgtcactttcaggttcctcctccacactttcctgatgatggagaacttctttagcgtgtgctgtcactagggccagggtacagctgtgactacatacaatgaatacagttttaatctctgttaatcttgtctgctgtaagaagagtgcttctgggtttgcatctctgtctatcctccagttagcagaagtgtgtgaagaacacaagaattattttaatgttaccgaattgcaaacataaacatgtagtagttagatcctcagcacaatcacacttacaagtttctgtacaccttggcgattgagcatgaccactgatatgtaataaaaagcattgatcataacagttctgtgaaataattctttgaatatagaaaaacccttactcaatgaaatgataaattttaaaatcgtacttagatgtggagctgcaagaagaatgagataagtggtgtgaagaaaccctttttatatgggaacgctggcttatggcatatttagataattttatgataacattttagcataatctagatgactatttttaaatgattgagtttgtatttataactagctataattgtatttaactataatggaccaaaataaatcaaggcattatctgttctcattaaatgacctttgtaaatgattcggggcataaaatggcagactgtgtaccatggtctttctcacattttcctgatgagcatacacgttggacataacgttcctcaggaagtgctcagaaatacaatgcacaacccagacccaacaactgtgcttctcagtcacagctaacattatagaagacagtgtggggggctgtcatgtcactgtagcattcacacacgtgcacgcgagcgcgcgcgcgcacacgcacacacacacatacacacacacacacacacactcccttttatgatgggaatgttaaagtactttttgctgctttagtagtcactaaaatagaggcccattctgagcaaactaggtattggagatgttaaataaatattcagagttggtagcattctagattgctgtctgtaaactgctgtataccatgctgctggtatttatagaagagtttgtgtattaattgaatcatttgaaaaggtat

SEQ ID NO: 31263 - DNA, 1198 bp, Mus musculus
ctttctactcacaaatactaactccattatgtaaggcatgataaccagtttgataatgaaggtattattttggttttatgtgagtcgatgtgttgaaaagcttcaatcacattacaatcttaaaacatctcagtgccagcccctcctctcccagttgacatcactgcaatgtggttaaacaatatgcaacatgcccttcatttattttgttttggggaaaatgtgctgaagaacctagagcttgttttgtttagcaccttatatcaacgtaatggaaatgggcgtgatgattacatgtgcaaatgtacaaaatcattaactacaaagatacatcattccaaaagtacagaaaaggttaaagcatgcatttaattatttttcattaaagggttgctgagtgcttcccctgaaaaaaggtggctgttttcaaaatcagcaactgctggtgaggatttcttggcacagttctgaccagcacgctactgctgcatcttcctgatcatctcggcagacactgggggatggaaattgattgtgtggtgccgcaggccctgagctgtcttgtaactcttcccacaccggcatttgaatggtttgcggacgcgaatctgtgttcggtgaccattcttagcatggtactttatgccattcacattctgtggagaagataaaaaaaaattacctattagggtcaccaaatgtcctgtcacactcgtgcaaacctcagcatgggtcagattccagcaaagcagctcctggatggatccagagggtgggcttcatgtgggtttgctggtcctgggctgtgtgtgccagggctttgtaagaaaattaatggaacacttcccttggtttcttgaagccttgcttctcagctactaaagttttctgcttggaagagaattaattggaaattctgtgaatatttcagaatgaccaatgaacacaatgttctaaagaatacaaaaagtagggtaaggcagactgaatgtaagacataagctgtggtaagtaccctctaaacctcacctggaggctttggcagagttagctggccgtgcttcagcataggtgagtgctcagagcccatgggcactgcttttgatgatgtactgcgttcagacagcatgcttttaaacctttatttatataaagtcagtcccatgaaaaacaacatgctgagtagatttcttagcag

SEQ ID NO: 31264 - DNA, 1096 bp, Mus musculus
agactcaggataataagccacgaggagaaaatgctctaaaggtgacagtgttctcagccatctcttctattctgaggttgttaggaccttatttatgacttatgatctgatgtcactgggatcaaaattaccagtgtcaaattaagttttaaatcaactaaggacacagaaggccttagacttctaccctatgaaaatagaacaatttttaagagcaaaaaatttagattcacttaaatatccattaacatcaagagtgctcaaagagtatatctatataatatggaatagtatgcagcaattagaaagaataatattgtctaattgtttaagcagttttatatagtcttatatgttgagagaaaaactaacttaaagtatgtatttgtataggaaacgttgtgaagaagaaactgagatgagtgagactaggaggttgtatttactctatgcaagtttaaaaattattttccagcatttaactagtgacttcaatattcttggaatgggattactctctgtcagacgcgtgacttcctgtaagtaagtaaaggtttcacaggcagaaggaggcgtagaggagcctcgctgctctggatagtgaggggaattgacttggaaacagatctgcgtttgctgcccatttgagggcacagatgtggagaggcccggaggctgtcggtagctctctgtccttgtctaaaggaaaggcatgttctctttccaggaccacatcctttttcatcctttacttctctccagaaaatgagagcatagcccagcaaccattgttgctgttgttataaacattgtaataagcactcggctgcaggatccttaaaggattcccccctgagtgggttgtcccaaaatgcaccacgtaacgccatgtcaattcagtcttgtttgggcaccattaaaaacatagtagttttacacagctctccaggcaagaatgacctcattaatgagaagaggcatataacagttaaagcctcaaacgctcatgaaggtattattttaaaaccttttaaatgccaaacaccaggctgtttaaatagcttgtttcatgtaatatttattagttattaagcct

SEQ ID NO: 31265 - DNA, 2087 bp, Mus musculus
gagaattcaagtcttaccattggtgacagggaggaagcctcaaggctgaagcaggttggtgacactcagaggggctttccagggactgtctggaaaccattgccttctgtttagaccagtatccgaggcagaggcactgctcccaacccttgagaaaagatcctccttcctccctcacctttgttctctgccttctccctctgccattgacccttggctctctaccttcagattttgatggtgtgactatgactatgctagctatcgaagacgtgctttctgagttacacatattcatcttatttcacgatcatctaatagacagtatgtttgttcacactgagttgggtaaagtgctgaccctcaaatatgtattatggaatctgaaaatcagaactaccaatgtcagaaatttatgtatggttttcaaaattcctttcattttacactctaaatcagagttggaagaaaattgcattttcttgggtccaatgagatgacttggtaagttaaaacccttgctatagaaacctgaggatctgaggtcaatatccaatcttttttccctcattttgtaactagggctaacttgcagtatggactagggctggtttagaactcagatattcacctgcctcagtctccctggaacgggattaaaggtgggtgctaccactcctaggcctggggttggtacccagaagccacatgatagaaggacaaaactgaaagttgtcctctgagctacacatgtgcactgtggcatgtatatgcttgcattcaaacaccatacacatacatacacactcacacacttcacaggtgcatacacatacatgcatgtatgcaccacacacacttatatactctacagacacacaaacacacatcacacacatgcacacacataccactgacacacgtgcacacagcacagacagacattcagaaagacacatagacacacacacataccctgcagatacatgcacatacaaaataaaaatttcttcttaaagtaagtgctagaaagttgagatactgcagtcattttcactatttttaaaaagaccagctgcaagcagggaccagataatggatgcttacattaaggataaaatcttttggcaggagacaggtgtactgtcttgggtcactaaatgtatatcctgcctagcatcaaaaaatataaataaataaataaataaataaagagagagagagagagagagagagagagagagagagagagagagaaagaaagaaagaaagaaagaaagaaagacaggcttctgatggggtaattttttttttgggggggggtctggttcacccactgacacctgaaggaagaggttctcaacctgcgggttgtgacccagttgaaggtctaatgaccctttcacaggggtttcctaagaccattgggaaacacagatattttacaattcataacagtagcaggattgcagttatgaagtatcaaggaaactaatttatgggtagggtcatcatagcaagaagggtcacagcataaggaaggttgagaagcactgtcctaaggaaagagctgttgattgtttgccagtctgcaaccgtgacctttctaaggtagaccatatatgtggggatcggtgggaatactatatgtactatatactataatatatactcagcatatgtatgatatgtataaatggcatatatattgcagctcatttgtgggagataaactcaaagacatagtagagagattcatatattcagaaaagtagtacctaaatatatactgttatttacatatgcatatatgtgggtaatatataacaacatatattgtatgtatatatgaatactgattttctatgtattgctattggtggtcagaacatattttctgttatgttttctatctacagcttttttcattttaagtaggcactcaggagtatacacactgtgattgctggctttcacagttggaagtatcagagcacagcgagtacacatttctttgtcctttcctactgtcttaagaaactgagcaaatagtttttttttacttattcagcttacaacatgagctt

SEQ ID NO: 31266 - DNA, 1175 bp, Mus musculus
gtaccgccagccggggactgaccatcatcacagaacacaccctagagggtgagcacagcagcgtgtgtggccttggctagatctggttttaaccagggccatacaactgctgagtatgaacttgaagctcaggatggacagttgtatgaacctgaagtacttcatctctggaacactgtattcaatgttttcatccaaacagcaagggtaatgaaaagagatcaggtgtataaaataaaactggtggtgagatgcctcacaccaagccagcacacaatgaacctttctttgcctcaaagagaaacggataaagtttgtaatgcaagttgtgtgtgtcttcacacttgccctacccccttccaaccctgactgtaagagacatggaatatcattgaaaaacccattccctagttcatgttctctggcttgccttttctgctgtctgtcagattcaatccatcacaatgtaattatattatccatcgccttccctaggaataacaagtgagggcatgggagtttgctttctgcagtttctgtatcgtcggagactatgctgtagacttcagctctgtggctgaagggcacaagtaataaactgccttactatcctgtgatggaagtagggtgccttagggattgcatggtggtgacggtgatagcagacttccttgtggtcctccccttagacgttgtctgctctggtcactggaggatgaatgaaaaccttatcattctactgtgtgggagagctcaaaggccagacttgcagcatggctgggtaaggtacaaacagtcgtgagactttctcacaagccttggtgaggtgtgggtggacacacatggctccgtgcatcggaatgctaaggaaacccgtcctcacctgcttcactgggtcctgggtagatatactaacagaggtagagacactgtacgtccaagggtgcctaacattgccgagaaaggcttcaagagtctcaatgttagggatactttaagtgtggcgtctcaaaagcccgcctcttggcagtagctccttcctactctataggcttgcactttggcgttgccaggtatagacactaatcctaaatattcaactcttttggcttattacattcaaactaggttaatactgggaaaaccacaggtttgggggccctcatacatttaaa

SEQ ID NO: 31267 - DNA, 1136 bp, Mus musculus
gctgagagacttattttcagtctggtgttctcacctgcttttcaaacccattctgattcctcaaaccccatcttcctcttgggcctctggcttatggaaaataaaagtcagatcaatttccagaaccctgctgctcctcacccttctcctcctgcaggaaggactgtgagctgtgaagacagcagcctgcacaaatggagaaggatggggtggagtgagggtggggtagaaaatgcccaagagcttagacagagggcaagcattcgagttccaccagagaagcagtgtatgggaaagtagttatactgggcagggggtgggaggacagaggaagcaggtatctcacatccagttagatcttgaaggtcgctttcaatttacttggatacagcatgatcaatagtcaaaagaaagatagaaatagaagttgggtgtgcttgccggtaaataatctcacctgactgcaggtaggagaaactaaaagatggcagctggagccaatttgtggaaggacttccaagccagggggcttgatgttatctgttagcgcctggcagtcactgagccagggtgtctctgagttgagcattctagagcacaatggcagcatggtctaggtgggtggaagtgggctggggagtggccagcagcaagacaccgtctaggagttgtgtggcactccagagaacacacagaccatgcatggcacctgctgggcacaaggggaggctggcagctatgcaaagaggattgttctcagcaggagccaggaagctgctggttttgaagaagacagaggatgccatgtctgcttatgttagatttggttccacagggacacatggagctgtagacagtgagctcaggtcaggctactccctttggccttctcagtcaagagagagacaaggtcattgctgagaggaaaggccacccacagggtcacctgggaacctgagtatggtcacagttttaaccaactgctagactgaatgtaaaaaaaaacagtcatttgttgaggaacagtgccctctctgtaatctcaagtctcttctccagtaaacaaggttctcctgatgtccgcgtatgagacctatccaggtagatgtaaggggaaagacctttacgctgggaat

SEQ ID NO: 31268 - DNA, 1151 bp, Mus musculus
tgagtgctacagcaggagaggggaagggccagctctccagctctgatgaccccagggtcaggtctcctaccttccacaggtggtgaggggtcaaggggaagacagggtcagctccaatgcttgtatccttggggcaattcacctgcaactccagaaatgtacagggcttgtggcagctcagatcagagacgtttgcctggccttcggtgacaacagacccctgctgctgcaagtacaagatgtggcctccagtagcagcacaagccaaggtcccaggtggtattattggctacttgaatcaggctgttcctaattaccctcgagtctccaggtctgcccctcttgctgcgaccacgttcttctgtttccctttatgtcccatttctctactacttacttgctcttcttagtgtgcctggggtggcctgagtgtctgcggctgtctcaggagaggtctcagaagtgtcctgccctgctcatgtgttatggtgctgggcagggatcatcttgggtatggtctgcctaccctgcaggcctgtgaggcactggactggtggtcatcttaggctagctttctgtccaggccccgtggctcttgtctggaggtcatcttgggcttgctccttccctggcccaccccaaggtatggaggattgtctctcttgggtttattctcaccaaaggcctatggtctcaggaaggtttctagtctccagcttacactccatcctgggaacctgtctgggccttgatgaccatctcaggttccctgttcaggcccccaggcaccagactgagggtcatctaaggctttcttttttttttttttttttttttcagggaatcttaggctactaaacattcatctattcacaaatcagaacactcaacatagatgtagcctctctcctctctgccacctactgatgtacatgtgacatagcagccacacctgcaaagcttctaggaacaggtctattttcaaataaaggggaaaaaaataattctccagtgagccaaatcatacctgagtgatgcgtgctcaaaacctaagtatgctgtagaatttcaaagacgcgtgtgccaaagagaaatgagccccgatgtggccgtttagtcagaagaacgctggtgaatgtatattcccaaac

SEQ ID NO: 31269 - DNA, 1169 bp, Mus musculus
atgggacaaactcatgacaaactggtatctcttgctgatggacagagggacacaggtagagcagctaagctgaaagtgcccagcaggtgcaaaggggaaaaagaacaaggtttgaggaggaagtagttgcctgtcccagcctcatctgctgagctctttaaggaaggtggtgcagaaagccgtgctgtgctttccctgtgtggtctgccctccacctctgaggccagctcatcagatctgacctgcctgagacaacccaggtaatttggggtttgatcagaggtctaatggtagcaaacgacacagcgaccttcttcattactttggccaaggttgaagatggctgtgacgctattatgcaggtgtgcactagaaaacccagtggttgtttttattattgactgtagtccagcatcacggagaaaggccaatcctcttaggagcattggacagctcaaccatgttgtcatcttaccaccagagggcacagcagccctctaagggttttctcctccggcaatggataaggagcccagctatgaaagctttgcttactgggatggatgggggcagacaagaggacagtagggaatctgccgaggtgcccgcacgtactttagtgagtttagccaaactaacagcagaaataatactggattttgagtaagcagacttaggagaatatttgttttaaaattcatgtaacagatttccctttgaagaaacacttctgacatgggtaatttctcaatcaggggtcacttttatgaacagcatgcagaaaaatagatcttcgggaatgtttaagatcgatcagtaaataacttcccagaagaccaccctatgtctattaagcctgagggcaggggatcctgagcacactttgggcagaaataagtcacgatcatgaaggatggactgcctgtctcacctgtcccacagaacctaacctaagctagctagtgttgtggagatgagatttgcagtaaatgaaaatggcagcctagctgggggcagacacccgagtgtctacgtaaggtagtaaagtggaaatagtctttgctcattcttgggatgcctgaacgctagctaagcatctgataaacgctgtggagacttagcccaacacaagctccagtgtctgtaggagtcggcctcacaagctgatg

SEQ ID NO: 31270 - DNA, 1129 bp, Mus musculus
tttctgcttcgatggcaaagcctgggaaaacactgaactcagaaccagagtctctggactgctaagtctggtgtggggctctagaattttcatttttcatgaattctagatgatactaatgctagagcaccataatttgaaaaatgtttcagagatggcagagagggtgaggggagtgtccagaactttctaatagaaatggcagggaagctggtcaggaaggatgtctgtctgtcctgccctctccctaccttgcctgagatactgagatgaactttgaaaataatattttttcctctctttaattttagaggtctcaaatttctaaagggatttttgacagaagtgaagaatggagaaaaggatatccagacagcactgagtaagtgtgcctcatattctgatagatctgcaattagacttgagatagcaaccctggaaatgggacagagtatatggagacatttctactttgagtttatttttttttctttttaaattaatttcacttgtattcactgcttcttctatgctttcttaatagggctctataaggactgatgatgcatgtggtttacctggcatgtatgagtccctgagtgtgatcccttgtcataagaaggaaggagtagagggaggggagctaggggtctgtgcagtgcccgggtcagctaggtctgatgtgttaaagatctgagtatcatcctaacccacatgagatgagttcttctaaattagtctatcggagtccatatttgaagagaagctcagtttagagcacatgaaagaaggtggacagggaactcatggggagttgctgtggagtgagatcaggggccacctgccatcctgcattgttccacatgtccatcttgtagtgacagagccaagactgcaagaaaggcctttgtaagaggagattgagctgtatctccagcacggtgctgtaattatagcatgtaggtgcttactaaataaatactgctatgtgggttgtgcgttgatgcatctatgctatgaagctagacttcgtagcatcctcacagtgtactgataacaacatggctgagttctcactccagacctgtggaaatcacattagtttggtgttattgagatagggtgtcac

SEQ ID NO: 31271 - DNA, 1064 bp, Mus musculus
aaaagcagctggccatactggacacgttatatgagatccacgggctggaatctgatgaggtggtgtgacagccacaggacagcacctcctaacttcagggaataaagtctgctaaagtgttgtgttgccctagttaatttccagcaacagctttgatactctccagcctttccttggggagatggacatgaggaagtcctagtgcttttatttagaattgttttaatgcatatgtgtttcatgtgtttaaaaatcaaggtgctaaatatttcaacaggcctactggaaaccagatcatcgctgtcccagacttgaatagcaggcagtaagagcaaaattgacagatggatttgttgggttcacatttgtattgttctgtttcagttactagttttaatgggccacccaaaccgaagcagtatgcaggactattgtataaagccagtgtttaaaatagcttagatgttgactgggcattggagggagtgtaagcccctttgttgaaggacttgctgtgtaagagtttgctattcctacactttcctgagtggatcctttctcccttcctctgctgatggaaagggctgtgtagtgaaaacatttgggcagttgtaggaaaacattgacatggactgccatgcctgttgtcaggtgggacagtggctcaagagaatgacctcagcccatgcttgagaacagaatagacaggaaggataagtcatttgggtgacacataccactctttgccaatgcagtacatttcctatgtgttatctgaattgaacatcatagcagaacagcgactttaaagaggatatttaatcctacttcacaagtaaagcttacagtagggaggtctgctcacatttgtggaatttcttgtttctggtgattttatttttatttattgatttatttattttgcctgtttcattaactcttcagcaaaagagccaggtagcttccaaatgtgatctagatcacctctgtattgaagtcacatgacatgctgtttcaaagaacagagtcctaggacatgcctgaagaacccagatcttacaagg

SEQ ID NO: 31272 - DNA, 1051 bp, Mus musculus
ggaggagtgggctggacttacagtatgctactttcctcttgcaggagtttcatatggatcctcttctctggctaatggaaaggggtcagggctaaggcataacttagacctgcccttgacatagcctgtaaagacagaagaagaaaagtggccagcccgcttgtctctgagggtgggcgctttgggccatgtgcccttggtgggctctgctaccaggaaattgacgttaagtatggccatgataggcagctgcaggtgcctctgtgatctctagtctagggactagcactctgagagcgtgtcagtccaggtcctcacaaagccctaagtgcccactggagagctgccttgctgggcagtctgactttggtacgttcattccacctgaattagtagttcttggtgtctcattgtagttaaagctaattttttttgtctgatttttcagttactttctaagaaatgaaaaaaaagaacctgaaagtgctccctggagcccctcccgagagccctggtatttctaagccaccctcaccctgacagatgaagaaccggtttgttggttgacagaatgcttaccttctctttgttgctaacagtttttggattatcttcctagcataatcttgagagtgggggatgtgtcttgctagagagcagtagagttgactgagtagtactggcagaccactcacagagcacagccccacctccgttccatcagtctgcccttcaccctcacccagtgaagcttggctccccacgggctgatgtcagtatgtgtgttgaactgaacagaggctttttaattgtgataagccttatgtcttttgaagataggtctgtttatagcgaaaacctactgacatatgctgatttgtcaggaggaatatctttaagggaagaaaccatcttgtaactgaggcagagctgacagctcttgacacagcccagaagagaggccagaagggtactgtaggaatgtagtggcttgttactatgtccagatcattctaagcgtaagagcatcccccagtgtcacttaaccatc

SEQ ID NO: 31273 - DNA, 2094 bp, Mus musculus
agccaaaacgccagggcttcaggcagaagccatgttcacatttgtagctgttaggttggggaaagtcagcgtgggagagcatgtcctccgattgcgtacagtcagtgccgtcaacgtctgtctgtggagggttttcaggtgcaggtgtatggtgaggtcataagtacagggcactttagctgaagaactctaaagaaaacgaatccagctgtaaagatatatatgaaactttttttaaaatgtattccctactagaccactatgtccttcaggcacagggctatgtcatgttgtgtttcttttttttttttttcctttttccaattttttattagttattttcttcatttacatttcaaatgctatcctgaacagttcaaaccacagcttctgatttagtcacaagtttacgatggttcaaatccctaccctcatggttcatttcactaccagtcgtttgtaaattctaagctgtctggatgtagaagttctgagcaactgcagtatgttttggaccatcactttggttgatcatctaacgcatttgggcgtagagagccaaacctaggatgctttgtgatactgtgcagtctgcatggttgtgtgcattagaccctcctgtgacatgcacatgaagtgctgtgttgacaaatgtgttctacttccatgtgaccctttgtaacctgcagtagcttactcagagttacacaataatgacataactattcactagctgcccaatggcatttgaagatttaagccatgacaaggttatagatatagtacattagttgagggcccttccctccctgtggattctcctcttctagccctgtctagactatcctgcagaccatttgcatgatttcttgctgtacagctgcatttgggaactctaaggcatgaacacccagtcactggcaatgcctctggtacagatgtcgctcgcatgcattgatctctcttctccattgtctatagatagatagcctttaatggaaaggaaaaaaatgccactgctctgcaatgcaaagttttcagaattcttgtaaatcgtgaatccttgtgtcacttctttagggtgaaaaatgtttctagtcaagctgtatgggaacatcctgcttattttaaatgtcttatatatttaaagtatggtcagtattatccctttacacataccttgggcaaggtggtcccctcagccttaggatggatggcttcatggcacagccgatctcattcacagagagcccggtgtatgtccattcagatgtgtagatggggccagtgaagggtgatctagatggctgatgagccagcttcatggtgtagggtaacggacgattccctgtgccatgagaatttcactagaatgtcactaaacagcccaactacctcatgtgaaattggctgtggacaatctgtgtttgatgagaaatgtgttcgcagaaatttattctgtttgataagttgaacagtgcagtgtctctatgaagaagaaacatgttataccagatgccaaaggctaaactagacatagatttctcagattcatttctatgttaatgtttattccagtctgtatcctcataaaggtttgtagttttgtagagccacatgctttgggtatctgtcacaatcacctcttgtcccctcagtattttgactgaacatcataatgctgataggaatcaagttaaactacgaaagtgtcaaacagcttgtggcttcttaatttaatggacctttacttagaaatgtattggagccttctaggaccacttgttgagtgaaaatcttgtgtgcagatgtgtctgcttctctgtccaagttgttgttcctgtatttcatgaaaagtggggcaggggtgagggttttactttctttggagaatgtttgaaaacatctgtcagatttttatattcattagttacaataaacatatttttagagtattttattaaacgttcttcaaagggttttgtttgggttttgcttaactatatgtgccaataatatgtattatttatggaatgtccacaccatgccagtgatcataagtccttgagtattgacacgagtcgtcctgctaac

SEQ ID NO: 31274 - DNA, 1193 bp, Mus musculus
ccacacatccatcgtccttgccagcctccttccctctgctgttgtgtgtgtcccttccagggtgggcctgtgcgcacacccgagcctacccgttccacagtgagacagatgtgacccctcccagcctgcggaggcaggcattctagtggcagccatagcatgggggaagggtctttgggagttaggagagacacttgcctttgactgcaggactctgataagtcatgtgacttctctatgaaacagggcgatttactcttctagctttgaacactatcctaatgcagctgcgtaggaaaggaagtgtgtgttcagaagagcaacagcccaggacacggagggacatgggaaagagatactttgtaattttgccaaagatggtgtctttaagatgctggccatgcagctactttagaatatggtggccagcagatatccagatccctggagcctggggtgggctctatcccaggcaactgatgagattctgtcactttgagaggtgggtaagcagaggtcccagaagatggcttgtctcggttgaatgtcagtgtcaggcagagccgctcctcgccccactatgctgaagggtttggaagtggtatgcagggaacccaagaggggagactagtgtgaagactagctggaggggaatggcagtgaacactttgcttgtcctatcactcaggaaagtgacagtgaaggcttggtaggtagcagacagagacagtgagagcaaacatacagggaaggactgatggcatgctgaccgatgtgaccagctgaaatctgaactagccactgacagcactcaagaggcggatcctatcactgagtgatccacggagacattttcctcctatctgtcaggttactttcctctgcctggtgatggcactgagccaagcagtcttcagacatcgaagaacagagccagggcgcagcgtgaggcccagtgcagtgcctagcatcactagggttcagtcagaccgaagggtccacttgggactcctgggctctctgcagcacagggtacattctgtgtttccatgaccagagcacaaactgtctgctacgtgaggaaattgtccttcatgctaatgcctgaactaggttttcagtgcgcttaagtcagactgggtctggggctaccacccctgctcagtataggcagaactgttctgtagcacaat

SEQ ID NO: 31275 - DNA, 1223 bp, Mus musculus
gacaatagaaaacattgactttccttaatgggcttaaaacttggacccatgtgaaatacatttccaagaatctctgctatgcagtgatctctgttgacatgagttatgtatgttccttcaggattactttggatgattcattagagaatcttgtctttagactataaagcacttgttgaacaaggttacaatgtagcaagcaaccttgttttggaatgtattttgctacattgtgctcttccctggtctggtgctttcatttcacatattttgctcttaatagaagtagggttcagtgctggggatttcatttgctgttttctccattgacctcttgagctgaagttattcttattagaaagtcagggtaggcgatctgtgtcttgtcctggcttaggaggttgtttatcttgtatttctaggagaattttttcctagcagttaatcctatacatgcctaccatttaataggtctccctagcagctgaaatggctgtcttctcaggttagacttcagaactttagctgtgtattataaaacttgtttgcttacagaaagtggttaattttagtatgtttgaaacagtttttctttataaataaatttggaaaatcatgagcggtttaggacttgactgcttgtgattatgattagccataattagagttctttgttctgcttcttaattttgctgctattccctctgtagaattgaagctaaggtggtttaggtattcagtgttgtctgtaggtctaggtgggagaggaattgggaatagaatatatacacagaatatataaggatgtataacttctgcctcacagagggtatcacacttgagagagaagatgtacatagcagcagtgatgtcacatagagtgaatatggaggctgttgggctcacgggtgagcaggtaatgaggaaaggaccccccaaagtctgaagtaaaccaaaagcaacttcgttcactgcaggggggggggggtgggatgggggggtgcttctaactggtttagagtgttggtcaggctaggagctgacacaacaaccttgaaagggcaaaagcagtcttcttttgaagcataaacccactggcaggtagaaggataaattgtactgtaattggcctttgtgtcatttaaaatgacagacttacccattaccccactaggttcctgtgatatcaatggctttgttggggacacagctccaacaaagga

SEQ ID NO: 31276 - DNA, 1146 bp, Mus musculus
ccatgccattgttgatgggaaaggctatgaagagtttctcttcttttgttatctgcttttttttttttttttaagataagcagcttttttagcagtttcctgtagggcattgtttctttttgttttctttaattaaaaaacaaaaaaacttagaatggttattttatattcatgtcttcttagccatactacactaaattttttcgaactgtcttagacactaaactaatgttgacacatggggaaagattatgaatttcaaattacacataactgagttgttgactttggatcagaatcttgtgcaagttgagagctatggtagtgtgtccgtgcttactcttatttatgcctctgtggaccgggagtgtaagatgtccagaaggagaagtgaagagcactcagtcatcgtcagcaggacttcaggtgtaggtgctgagttttatgcagttggggaggtgtagtatgccattcattggtgggttgaggttttgtcttttgatttttcagtttgatggctagttttgctgtactgagttctttctctctccacagaggatgtgctgagtaaagatacgggggaatgtgcaatatgccttgaagaactgcagcagggggacaccatagcacggctgccttgcctgtgtatatatcataaagggtaagcgtggtaggcctttaactaagttgatatcacagtaaaatgattattttcttagttcaagcattgtagttagggctaaaaggtttcttcttcatgcaaactcttctgttcaacttaggatcttaataatgctccacctccctttctctcctctgctcagatcaaatttgaacatgcatctgttgtacctaagtggctgccatttttaagccacttagtgttctgcaagtgtttttcagcttggtcagcaggtgtctgtgtagcagccacttcaaattacaactgggaaataagacagttggactgtctccaggtttgtatttcaaccaaatggcaagctgagatcccagcttgttgtacatacatttttcttgcttcagagtaatataggaccaatattagcttgaaaaacaaagccaggtatggcaaggctcttgttcagttccagcactcaagaggatgaggcaggtgggtctctgagt

SEQ ID NO: 31277 - DNA, 3212 bp, Mus musculus
ctcatagtcaccggcatctttctgttaacctcagacaacatctctgtgttcttaacatcttagttcttaagtagtgagaccccacattatatttacagcataagaatttacttacccaatagtcttaattaattatgaagctgcttactgtttttatttgaggaggtggttttaagtttgagcgggtgtatgtacatgtgtacatgtgtatacttagttctcaacatttattgtggaaaaggagtgacttaagttttgctgattctttttttagactatgttaaactttaactgatcattctgtttcttgctttgttctacagaatagttttataaatttctgaagcagtaaaaggggaggtgtgaaaggctactgtgataaagcactgttcatggggaagtggatattgtatttcatttgcattactgatattgaccatgacttagagtaatttatttttatacaggttttcttgtctttacaagatgcttgagaaatctagaagatttgaagatctgtctctggaagaaaatgagagctgcaggcttattcagccaggatctgagttctgggacacttgggtccagagaaggacaggaagaaccacagaactcagcgaaccaaacttgcatataagggacacacagggattttgaaaatgctgcacagcctgtaccagtcactgcgtagatgacactgataaatgttttgtattcagacgccaaagttaactcatttcaaagttgatttcctttttagtaagttcttagagctgctgttttaatgtgtttggttttggtttgtttgttggttggggttttttttttgtttgtttgttttgttttgttttttagtttggggactttttattttcctgaacataatgtttctgcattcacctattcttaacttgaaaaccacacaatttctttcttacaaagtcttcaacatgaaccaagaaaatgtaatcaaagcagtataatattctgtgaatggagagtataattgaagttcttccacttccaggccccacctccccctacccccatgtatgaaaagtaggtttctgggttggaaagctaaactccgatagtatgaattaaaggttaatatataaaagtgtcatccaaagagtaaatcaaggtacataattacatttagttcattacatgtagagctgtctactcaactgcagtttctgaaatccattgtttcttctaaaaggaaactgtgcaatagcttgttagcagtgaccatcttgcagcagctatgcaactttgaaaagttttgctggtccccgctccggggccacagtgactctgtcctagcaggtgtcttttgtctttctgtaattacttcattgtgctttgcatttccaggaggtttccctatgtttgggtaaaatgtttagcaagttgtaaaacatcagaccttctgaaaagggtgaaataaacacttctgcagtgggacttggagtaatctgagggacattttatatacttttaaaaatcagaatttaattgggatgccagatttctagcaacttgcatctttagttttccagataatctggaagttagcatttgataaatgattttttaagcaaatataaagatttttgttaatttataatttattaatgtgttgttactgtaattgaaaatgttgtggatacttttaaattcagtctttgtagaaagaactgtattaagcaaaattatgtgaataaatattccccaaaaatacatctaatggttaagaatactggaagagagctatcagggctgcaacagtgaatgtctttttaaataactatcaaaatgtcaagaagtagagttcacctttagtctctgggggggacacagccctgctgtcctgctgtgctgcgctgtgctgcactgccctgccctgggtgtggaaggggagtctctggtgctgctctgccgctcttcactctgactgtgcccagctctgttgcttgtacctctccctgctcacagggcatgagcacctgctgctatggtgctcacaagggcatgggcaggagcacctgctgctatggtggggtcgggtggggactgtcctgatatgggaagaacttgcctgctttcctatggctgtagactacatagtacctctgcagttccactgtgatcgcctgttagggccagtggtctgatcctgtgtcacagctgccagcacagctctgtaggtgtccttcagccagggctaaggaggttactcttccttcgagggaaataggctttctctaggtttttgtttggttttatgaaatcggaatccattttacttgttctttcagttcgtaagctttgctctccccctgactttccccagggatgagctcttagaatgtgaatacccactttgccctttccgctggtgtattgtctggaaagactcacttctgctgccttctcttcttggagtgcagctgtgctaattaatgtttagactccctgggaagatgacctgctaagctcaacttgttggtgtctcagcctgagttcccccttctgtcacactgtcctccagcagtcttctgtgctgcctccaagctcctgtggtgtgcgagagctcacggctgcgtggcacggccgtggacacttgactgtgctgatgcttctctggacagtggttcctgaagtccactcagacagcctggttggtttttgtttttatttggtcagattttataaagttgacattttgactttaaattttatctgtacaattacctaaaaagaataaattagaaatagaagaaaagagagaaacttagatgttccagtttctattcacagttactattctgggaatgttctactataagtgatactttatataatattgcttataatacttaacaggctgtatgcagacattgagtagcatccatcataaagttatagaatattcagctgaaactactgaatatggagacaaaataaaaattgaaagcctcagttatcagttatccagctggccatagccttctggaatctttgtaaatactctgcagataaggtcacaggtgtggagagaatgaggaacgtgcttgggtttctgcagtccactctgtccatgtgaatgtattgtcaatgttgatcctgctttaaaccttttcattctctctttgccagtatatttaagagaagcactgttctttgtaaaatcattctctttcttt

SEQ ID NO: 31278 - DNA, 1631 bp, Mus musculus
tgtataggtttgggctttcctgggcagacttctgcattcttaaatcttacatggttagtctggtttccacttagatactagactgcagcccagaataaccatccttagcatatctgcagtatgcacagaaaatatatttccaactgactgagttgccagaaatggcaaaatcttttccagatcgtatttcatactgtgtttctaagtatgagtgtggtgaggtttcagagcactcatttcctactggacacggtgattcatgccaacactcaggaaacggaggcaagaggatagccacaaggtccaggctggcctgggctacctagtgaggtctaggttagactgtctcaaaaaaaaagcaatcattttaatatgttacagcaagacatactccttttagtaagaaggattgtggattcgatgtaaatagtacctgctttttctgtattgacttaagggaaataaggggagttccccagtaggaagctaaagatgagcgaagtatgaaactcttaaaactcgagaactggttgaatttgccacctgactgatagccacactgtgtatggacaacatgatccagatggcttactcttcacagaggaggctccatctaaaccaaaacaaatcatcggagcatacagagtgactcagaggcaaagggtgctgttgtcacaagcactgtgtgctggctgcaggtctctgctgcacttcgccatttttctataggtttggtctaccctagggtaaactccacactctctgacagtgagagacgagacacggagcatcccttgttattcagtatacagagattttaacttgactttaatattgtagcatgtcagtcctttggagtccattctcctacctttcctagagtatataacttctgatattttcttagctgtgtgatataaccagttacctgaccacttttaccctgttctttctccatcccccaaatcctgctaagtttcgatggctgttgcttggggtacccctgaaatcattgattaaattgttggcgagaatgtacccaactaatactttatactgtagtctgtaaatgcacttaagctagaaatagacttttaaaaaaaatcaaagatttctgttttaaatgggaatacctgctatcctaagtctgttgactttctgtgagaaataaaagtccttgaacaccagaaatgttaatatttagtttcagttcaacatacaccatcactgtccttatagggttgttatcagatgttcaaactattcttcatttttgactgtgagtgtgtgtgtgtgtatgtgagtgtgtgtgtgttttcatagagaagcaaagagcagtgtggcatgaactaacatctccacgaaaaaatgaaaaatgtgatactatagtatttactaatgtgtgtgtttcttagctttgatcctgggtcctgagaatctcaagattggacatcaaaagtaacagttctcttatcactgtctgcccatgcctgccatttctgatctaatatgttagagttgacataatatacccatcatttttttttttgaagacttaataattgcctgcgttttgttagcagtaactatggtaccagaactgttttaccagccaagcttgtgcacttctg

SEQ ID NO: 31279 - DNA, 1231 bp, Mus musculus
caggtgtggcatcttgtgtgtgtatgtttggattttcttgtgctgatccgttaattggtgacattttatagtcaaccatcttcccaaattttgcctcttaaaagttttttgttttttgtttttttttttactttcttatacattctaattgaatgtattagattactgctctttaccagcccgagggtttaaactctggctttctgaactgttccaggcacttttaaagtctgtctcttaggtgactaattctctcttcagtgtgtctgatgtgctggtaacctgcctgaacattcagtgtcagtcgtccatatgtaggtgagcgctgttctctccccacagactcaccgtgtgaacccacttacttatgttctcctggacagtgcatgctgtggacacaggccttcagttattgatacttcttacagacttcttacagaataaacacgtgcaattggtatttgtgtacaaatactttttaagtgcatgtttaaaaagagcactagtgtttgctgatttctgaaaccagtcctgattgtagcttgtttgttggccagggagactttgtacggaagttaaaagaagataaagccccacaagtggatgtggacagagcagtagctgagctcaaggcccggaagagggttctggaagcaaaggtaagtcttaggatgctaaggcagaaacgtcagtaggtgtaggcttattcctctttgtttaatctctccaggtaggaaagatctcaaaagctttctgaacaagtgccactcaaaagctttctgaacaagtgccatttggtctttttttttttattattcattgtgccttttcctccttctacctaaccaacttcttgtcttctctgagagctgctcaaggctgtgtagctcagtggtggagcatttgcctagcacattagaccctgcttcaagaacgaagtgcagcttacaatgccccgtagtctctaaagcttccgcactacctgaacccaaactctcactgtcccccagtcctagacataataaaatacatgaatttcctagaagacatcatgctcctctttaagaattcacctgggattagatttaatagttttgttataatctgtcttatatttaacttcagaccttttcaaactgtaaacctgctagcattaaatttaaatagtccaagaggtcagtttgttttgttttggattgggggagggttgtctgtgtctgtctgtgcttca

SEQ ID NO: 31280 - DNA, 1155 bp, Mus musculus
aatcatatctgctacgtgagtagcagtgtctgcattattcagcttcccattgctgtgagcgacacatctcaggaatcaaaggcttattgggctagagtgtcaggcgttattgtctatattcagcctgtttgctcagacctgtggtgcaaatgacatggggagggacactgttgcctcaacacacacacacacacacacacacacacacacacacacacacacagacagacagagagagcgagagcgcgagcgcgtctcgtggtgtttccatcacttccagcaacactgtcaactggagagccaatgagccttcaactctgagctgctggggactttaagatccaaactatcacagcttctttactgctgctcaaagtgtttgtggggactgaggcctccactttagctcctcaacgtcttacatctctagcattttatactggattctaccaaattcagatgtgttagaaccccgcctacctgtccaattactctcttcttgtttgctcttataggagctggcattgcagcccaaagatgacatcgtagatagagcaaaaatggaagatacgttgaagaggaggtttttctacgatcaggcttttgctatttatggaggtagggggtgaatgaagccacagtgaatgatgggaagcatggcagcatggggcagacagggtgctggagaagaagctgagttctatatcttgatcagaaggcagccaggacactgtcttctgcaagcagctgggaggagggtctctccacgctgagcagagtctgagcttgggaaacctcaagcccaccccaacacttcctccaataaggccacacctcttagtagtaccacttcctttgagccaagtattctaaagtgtgtctttggggccaaacttatctaaatcacactatgctttgtcaagagcttggcttgctaactgatgtttattcaattgtgtcagatcccataaaggagagaagtcatgtaatttacatttttgttgttcaagagttgatatttgcataaactcttagtactccccactctgttaattaccctcccacccccttgtaaaatttatttctttgtttatatattttttttctaagacagtttctctgtgtagccatggctgtcctgtcctagaactctgt

SEQ ID NO: 31281 - DNA, 1213 bp, Mus musculus
cttttcagccataaagaaaatggagactccatctttgacccatgcctctatcttgctttaaacgatgtgtcggatccttactatccatctaaaagtgcacgggccatcattttcataaagtccaaatggacgcagtgagatcccacctgtctgcacggttttgtgctgttctcagttctgatttaggaattaaagactgatacttctcctttagtggtagctattgctgatggttggactgtctcgtttgagctgcaggagtgtccactgagtctctcagtacaccttagcactcttcggtaacttccttgctcactgatatgacaggatacttttaggctcattctgtttgcttcatgtctcagacctggagtcagccgtttttccccaggcagacctcgtccttgttagtggatttttcctggtcatatgttgggctggtgacctgcacttagtgtggttggagcagtggtgggacgaagctgtggatagtacttgatcttgtgccttgttctgtaacgtttgcactcattatcttctctctgtgccccttagcttgataactatggacaacaagaacttgcggatctttttgtgaactataatgtaaaatctcccaccactggcaatgacctgtcccctccggtaccttttaacttaatgttccagaccttcattgggcctggaggaaatatgcctgggtacgtattgtttttcatttatttgtttatctaacacacttattaaaattgcctgtgacaaaaggtaaacttgagggccaagaggaaggctgcgagtgggggttgtgttcgcagaagtccatgatcctcagaccttccagtaagcttcacaggataggcaggtggagagtgctttatgtcattgagtttgcattatatttagaaatgattgaatccatccattgcggtttgcattttgtgctatgttgtaactagagttactagtcatgtgtggctttttagcatttaaaaagaagccagtgtttctgaggatcgaatttcaacatttgtttcactttcattaacgtagacctatctagtggcccatggtgctggagagcgtgggtctagcccacactcttaaaatataagacagcttttatggggtggtgagatggctcagcagtgaagagctggggcccagagcgagcagggtgggggtgggggatgagcaagggagaagggaaggggga

SEQ ID NO: 31282 - DNA, 1197 bp, Mus musculus
gacgctttaagcagagtcatttatgtggttgctactatccagcatcttgtttcccttctatgtgacctttgctagtttcctattttaaaggatatattaatctgcttttaaaaattacttttatttatagcgctactcggctactgctacatagaagggactactgttgagaggagttgtcacttctgttgttgctgttatttcgttgttagggctcacacccaaggccttgagcgtgccaagcctgctttctaccacagcttgtctactaggccagttattggtgtttttttaaaagagcaatctcctacacaaacctaacccagaaatctttgggtaatttctttaggaagctagtcataagaaaagcctggggtttcggccctttatctagaggagtgagcagccagaaatgggaaccttgttgacagactcagttatacagttaggcatgcagattttgatcttgtttttccttccagggagtttacaatggcagagattgagcactttgtagatcccactgagaaagaccatcccaagttccaaagtgtggccgacctctgcctttatttgtactcagcaaaagcccaggtcactggacagtctgctcggaagatgcgtctgggagatgctgttgaacaggtaaggttctcagggagctgatgaagatgatgccagtgagcagtggcaggacttggcagcttggttgtgcactgagtagtaggtcaggcaagtgcctgaactgcattttcaaccctgacagttttcgtcttttgtggtactgatgagcaaaccttgctgagcaagtgacctagctctaagttgcagttccagtccctatatactatttgttttatatagaatttactttgtggtattagtatcaagagagaaaattatcttaaccaggatccaattattctgggccaggatctaatgttaaaccgtttctcagatgggcctgggaagtggcccagcaggctcaccggctgtgaagtcctatttatggcttgggtttgattctaggacccacatggtggaaggagaggaccaactcctgaacaactgcgcacacacagcatttaaaaattggtcttagtctcaactgtcctgtatctaactgattctactttaacaatttacacaactttggaagagacagaaatttactcagggaaaacgaacaccaaggga

SEQ ID NO: 31283 - DNA, 1119 bp, Mus musculus
taaccttataagtctttgttaatgatattcacttgtttgtttattcgtgtgtgtgtgtgtgtgtagtatgtgtgtgtgaaccagatgcccacatcaaatgtcttctttactgctctgtaccatactttttgagataatccctcactgaaaatggggatcactgatttcagtatgactggcagcgcagcagctttgaggggagctgctgtctcttcctcagtgctgggactgtaggcacggacagccacacgtggtttttatgtgattgctgagcatttgacctcaggccctcaggcttgtgggggatcactttactgaccgactcccctcacccccatctggctcattttgtgcataaacagagtttggggcactaatgctggcaggactgggtggtggctttgaagttggtatggttgagtgtttcaagatgattttcccaattcctgaagttgtactgcgtctgattccttgactgtttcatacaaaacagttaacgttgtacagtttgagcccaacaagggcgccgtgggcaaggcgtacaagaaggatgcaaagctagtgctggagtatctcagcgcctgtgatgagtgctacatttcagagatggagctgctgctgagtgagaaagggtaagcgtctccctcaggctctgagagcaagggacaagatgggttgttttagaaggcctttgacaggtaagtgctacctatgtcttaattgtatttaaagaactctctttgttagaattttgacattatattctagaaatatatttgaaacaaataggatctttttgttatctttatgaccagtgtgctgagtttatttcccagcatctcagaagaacaagcaggaataagttcttttctaggtattttcatggcagagactatttgtcttgagttagattagaagccaatctaacttttttaataagaggcatagaatactctgtaatcacacacataattataaaagcaacagaaactagtctttaaagaagtacaacaaaattcagtgccaaatagtgtgcaagctatagtaatagaaaattattgaacatctgtaaaagcagtatattgtgattactgataatgattagttcaaaggaagacc

SEQ ID NO: 31284 - DNA, 1056 bp, Mus musculus
gaattatcccaggctgaaggaggaagctgtgatgtaggcctctgtgttgctcaagtagaaggttcccttgtagcaggatatttgtaattgcctgccgtcaagggggtaattaagctttaagcaggagctagcctcgactctgtcattcggtgctttaatggaacacatccagttgctcctatgttgtgtgttcttgccgtcaaatgaaccttttatacaagtcctgtttatgacatgccttcagctctcattttcaatgcaaaatggcctgcaaaaagctggcttgcctgcctcagaacatctgctgcctttgattttgagttcatgcacagcgtaggagggttgggccatttactccctgtatgctgatagaagagctggtattttgatagtgaagtggtctaagttacctactgagtgtaactactttgtgctttgtgacaataacaattacttataagctaacatttgaatttctttcttttaaaaccatctagttcttcagtttccctgctgtggttgctccattcaaatgttctgtccttccactgagccagaaccaagagtttatgccatttgtcaaggaattatgtaagcaaatccagttgggtgatctccatgggaacactgtcttgcagactcagttttactgaatgtatcatttgtttgagtaaaatcatagattgactatgaataaatgggattttagcctctgcttatattataacagagcagacttgctcagatgtcttagcatggggtgagtcaggagtcagacttcagaattccttgctgctcttagtggccttggttccctcttcccaaaaccctagtggaatgtagcgccctgctgaatctacagcattggagggatcccaggagtgctggccctttacttctgcatgagcagctcagggctgtgcagtctccttccggtgcagctgttctgggtggagatagcagggcaatctgggctgctgcaggggacttagtaagcacccatatagctgggacttgctgctctcatctcagggtcctttgtgtttgctgagcttc

SEQ ID NO: 31285 - DNA, 1144 bp, Mus musculus
gctgagctgtgcagggagctggtaggcttgagcctttgtggaattgaggaaagaccccagcctgggaggcggtgagcataattaggaaaacaaacacagcttgtaaaggatgatatcatgtgtgtatccatggtgtgcagtatatcacagataggcagtggtttgctctgtctgcattgctgacatcatgtgtgtatccatgatgtgcagtatatcacagatagacggtggtttgctctgtctgcactgctgacatcatgtgtgtatccatggtgtgcagtatatcacagataggcggtggtttgctctgtctgcattgctgacatcatgtgtgtatccatggtgtgcagtatatcacagatagacggtttgctctgtactgtatataagggttcctgaattcagggcaaatgcccaccacagatgtcaagttggctaatgcttgcacttcttttctcttcccaggtctctgagctgcccaatgtggtccgcgatctggccaacggcaacattacctgggctgatgtggaggccaggtacccactctttgaagggcaagagactggcaagaaggagacagtagaggaatgagaacagctggcagcttatgaccatcgtgctaataaataactcatcatgtccactacacagagcattgtgactgcatccagggacggtttttcctcagtggctgcttggttttactcccacaattaaagttgaaggaattctgaacacatttataatccatctgttgtgtttccattttttttttttttttttagcaaagacttttctctcagatatttgtttagatgtgcttgtgtttaacacggtacatcttttaaaagtaacagttttattggggtatagtttgtaagctacaaattattttaggtgtgcaacttagtgtacttaacaattatacatccatagtccaactttagaacctttatatcgcaaagaattcttatgcccatttgccgtaagcctccgttgacccctcagctcccagcaggcatacgtctactatctgtagatgagcaggtgatgctctgtgccagagagacagctatccccaggcaggtggtggcttctgggaaaggctcagtgcatggagaaggctgtaggagttttgtctacc

SEQ ID NO: 31286 - DNA, 1177 bp, Mus musculus
ccaaataggccaattggaagagcatcccaggtaaagggccaccacaggtgagtgctctggtgttggggatgagactcactcattatgtgtagtgccttcctacagataccacgataaattgccacaggccggaggaggggctgtaagacatctgacatctattctctcacaattcttgagtctagacatcaagctaaagtgctgtcggggccgtgctctgcttgaaggctctgaggagaacgtttatcttctattgttgaatcccatatcttgtaggtgattttctttcagcatttattggcttggagacacatcaccctgatcttcttccatcaccagcatggacttctctacacccgtgtctctgtccttgctgtaatttattgtaaggacacaagtcctacttgatttagggttcaccacaatccagtatgatttcaactcatttctgcttgagagacttattgccagtctggttccatccatagacactcagagtcaagacttcagtatgttatcttgagagatataacttacctgtaggaatgaagaagagtttatagtttcactggctgacctgatacttgggctactcataaagatgagaacccaagccaggaaccttggaggtaggaattgaagcagagaccatgaagcaacactgtctcctggcttgcttctcatggcttgttcagtttgcattcttttacaacttaggaccacatgactggaatagtactgctccggtgggctgggccctccaatgtatcaaaattatcaatcaagaaaatgccccatggaaatacttacaggccacattggtgaagacaaccatgaccttaattgctaacctgggcctaacctctaggcacagtgcatagcatgggcacttgactgtgcaggacttccgtgagcttcctgtccagcaccacagacagctccgcgacactgagttttctggagaattcctgtaggttgtctgctgtgaacctggcagatggtggtcctatggggtctgatattcctaatatttagggcttcctctttgacacaaaacaggaaaaatgatgttttttccccttttgtatggcaacaatcataagaacaatgataacgctttggtgtattctttattgaacgttttttaaaatgacattgttatagttaattgaaatat

SEQ ID NO: 31287 - DNA, 2230 bp, Mus musculus
gccaggagtcagttgtttggtaaatcagtacagttggcttcatgttaccacaggcatgaatttgccagcctctcatttaattcatgttggtcatgtatagctgtcatttgcctttcaggggatcctgaatgggcattctcagggagtacttacaggaaacagtctaccttttcagtaacagaaggcatgtagaataaccattatatctacatatgattaaaaaagcattgggaaagtaagaggcattgattatctttcatttatcctctaggaggttccctaaggactataaaaagaagatagggcataactcaatatttttaaaattttgcaagttggattttcacacaaaaccacaaaaatatgaactactttaagttgggcataataagttgagagaatccagtgacaataaattaattggttaatgggagaaaaccattaattttctttggccagtaaatatttgaaaagagaagaaactaaagccacacaaaactgtgaaaggcacattaatgttgtgctgagactattaagaattccttgttagataccatttcatgtggctgcagcatgctgatatatccatggtagttgacattgctaggagccctgcctgggttagctaataaggtaatgattcattctttagtttgtaccaggtttatatgacttgccgaattgcctgctattacttaaacaaaagcaatgcagcactgactttgaaatatacttggggacaaaatgtaactggttttgtttcacactccccatttgagtgtgtatggttcccctgtgtatggtctcacagtcttgccacacaggtctctaaattgccaacttcctccctcttgtctcaactgggattataggagcacactactgtgccaggcttaagtgtatattttaattgaaccttctcttaatgtagttaaaaacttaactcttaaaatggttacttaactggtcagcctaaaataacttaccttggaatataaaacatcttggaatggtcaaaagactatactcctacttccttcaggttcttggaaatgttggcttttcaagggccataggccattttgttgctgggggcatcacctaatgcagcagcctgtgtcatggagaacaggagatacagccagtgagcccagacacgtgaagtctgtattttaggctccagtgagctagactaactcggaagagtagtctccctccagtgctggcatggtagtcctttagtcaacacctggccttttgactattgccaggagatgtggctattggaaaccatgctttctccagtgattgccagtgctcttgtgtcttaagaactgagtgtttgtaactagacctgcaggagcgaaagtcaaccagcatttttcaggtttccagcaggcagacattgacagtagctgcactgctgttgaggtagttttgatcgtagtgtaacgacaaaggcacagataaggaagagaatacaagctgtgagtctggagtagagtagaaattctgaagctgcgtgtaacaggatgtagagcaattgtatatgtatatctgatttataaccaacatgaattgtccacccccaagtccttcactagctctcaagcctgaaaacagttctctccttttgcggtaagaaacagttggctttcttgggcagcaaagtagagtgcatgacaggacttcctcagtctttctgcttttcacattttgtactaagcagttaactgatttttagaatagctttctttagaaattcaaggaaagcaaattaggaaaacacaaatgagaagctattacatggctgagaaacagggcacttaagtctgaatggagagtattttgacatcagtatttaacctactaaaggcatgagtttagacaagttagaattgtaatctgctattgacatttctaagtgaagctataacattctttagctggtaggcaggtattattgaagctgtatattttatagagaaaattttgagggagttaacagccagtggctctcttccttccatgttgataaatttagaagtcctgcggccagcatcctgatttatacccacaggcagtgtctgctgcagcctccacagagggcagcctgttaggacagaagctgctgcctcctgcctgtggtgctagctgcaccagcctgttcatgtgttggggcattgcttaggatccctgaaacatttgcacactgtggttctttaaagag

SEQ ID NO: 31288 - DNA, 1434 bp, Mus musculus
tatgaaataggttatttgataactgagaaactttaaatgtatcatgtgagcataagagtctggattatctaacattgttagccctgtgtatgtacagtccagaacttcactttttttagaaaatttttttgtttgtttatcttgtttttggtttttttgttttttgtttttttccgagacagggtttctttgtatagccctggctgccctggaactcactttgcagaccaggctggcctcgaactcagaaatccgcctgcctctgcctcccaagtgctgggattaaaggcgtgcgccacctccgcccagctcagaacttcacttttaaaagtaatctgttcccagtgtggtatctcaaaattgtgctgagattatcttagtatatgtattggattcctgtacttccaaagtcctggaatatagtttttttagtataattccactgcacttaacactaatgttcatgttggtatagaaatgtcttttaaatcctattgttgagcaagatctgctctctgtctatggtattacacagggaaagctgtgactgcaggatcagtctcattcttctactaggtgcatggactcccttcccactgacttacactcgtctatctagaatacaggttgtccaggcagctggtcacttaccaggtgtggacttacgttgctgggcttgcaaatgaattgctagtccctcattgtgcgggtctatgtggagctttaatcagtaaatgtctccacttcctatattacattaacgttggctcatgcatataaccacctgctgctgatgtacttctccatcttaaaaagatttagagtggattaaccaggtcattacatcttaatttaataacaagcattactgtagagtgattgtgtgtaggtatctaataggtgtgttttttttttaacttgatgtgtgtatgtttggggggctaggattaggaaggtgaactgtgcaggaattgtctgcactgtgcagaagagcagatcctagtgctgctctggcattaatcccaggaaccactagcagtagtggggcgccaccaatgtaacatgagcacaggtgcctcatggcaaacatggctggcatgttcaactgcataatgctctggcactgtattttgaatgacattaatttattaaataaattgtatataatcagtatctgttggttttttggtttttgtttttttcttttgtgatgggagtactctacctgtgcttttatttgaggttttgccagaacagatttaagtacttgtaggtggtttctcaaaaatctctttgagatacagagagagagagagagagagagagagagagagagagagagagagagagagccctcttcactgctattttactttcttcagtcccatcctccaacatcagttttggtttgaaaatactaaatagagaatttgt

SEQ ID NO: 31289 - DNA, 1167 bp, Mus musculus
tagaaatagcatcctttgaatccagttgctgtgccgtctttgagatcatgagagtatgttcagagagtgatacccattgccaaagagggcttttgtttgagttctggatttcttacgtttcagtcaggtgttggctgttaattaactaaaaaatcttgcttttgcaatttaaattctttaaagaaccttaaaattgtctgctttttcatttgcttattttctaggatgcttatatctcgtatggaaggcaaaaagtttaaagcacaactgttacttttctgcagcctagttactttaagtgttttagacttgaacaattctgtttaatttttgtacttatatctaaagtttattggaagttcacatagatataatgcatatcaaaggccgttgatttaaatattgtgttctaaaagcttgatctacatattctaactgaacttttttctgtttagttctgcagaagacctactgaacataagatgttgcaacaaaatctacctcctgtattttccctattcatgagcttcccaggtgcaaatttgagcaggatgtttggagaatctgttgaaaaactgtagctcaggatgacctagcaaagattgtgagcctgtaacaagatattcagagcggctgtgtgggttctgttctgaatgctgcagataacagcaagtgaactccctcctttgcttttgaagtattcatttgaccttccatcaagacggacttttctaatctgttcttggagatattaatggaatacaatcatgtccactcaagaggaaaggcagatcaataccgaatatgctgtgtccttattggaacagttgaaactgttttatgaacaacagttatttactgacatagtgttaattgttgagggcactgaattcccttgtcataagatggttcttgcaacatgtagctcctatttcaggtaagtagtttatcttgtttagtttgtaataaaagtgttatttaaatttctttattactctgggtgtgtgtgtacactcagctatgccagaacaagcagtggaaccagcgcatctcactggagatgctgcagtgaggcttcatcagtacagtctttcagtgttaaagctttggggttttaggtttgttttgttttgttttttaagacagaatcttactgtgtagccctgg

SEQ ID NO: 31290 - DNA, 1202 bp, Mus musculus
attgttttggctttccggtggggcagaggaaaagggcgcggtgagccagatgaaggcggggtccagccgcgggcacccgggagcccgcagagccgctgctggagcgggcgcgggcactggcgcgggcggcaggccgtgacggcccagcccaggaggcgcgaggaagcggaagcgggggcggaagcgagcggcccggatccccgcagcgccacgcccccgccgtgcgtgcggccgcgtgagtgcagcccggcggagcggcgcggtgagctgggcgaccggggacgaggtgagcccggccgggcgcgaggctggcgggcggcctttgtggcccggggcggcggcggcggctttcaaactggggcgcttccgccgagcgcgcggtgtttccggcgcggccttgcgcgagctgcggggctcggggcggcgtcctttctgagggagagctgttttgcccggctcgtgtcgcggccgccggagaagggcgaccgcgtccttgcccttttttttttttttttaaaaaaaaaaaaagtattattataattctttttcttggcacatcggcagtaaccaagagttagccaggttagccggggtcctgttgtcctcggcctgcttgtgctctgctgtgggaaggggaagctgcactttgaaacctgtttgctttagacggaaatcatgggttggaactggacgctaagtcggccgactgggcgctgctgtcgtgtgctctcccccacttcccgccccgccaagcgcctggcctagtagctcttaagattccttttttttatagctacctaaaggaaaagggatgcgtattctccgggctgtagatctctagaatttctttggtggcctctctttaagttaagcaaggaattaagatagtaaacttgaaagactttgctttgtgaacagctatatcagctttgtgaaaacgaggggggaaaaaaaagacagtgctggtcacgtgttgtttatacatgaatctgtaagtctggctcactgagcagacactgaggaacggccctatcagcggtgtgctctgactgaaattatattttcttcctgtgagttaatacagtttattttagtttcttcatttctttggagttgtgaattcttccccagatttgagtaatatagaccagatcttttgcaggtgagaatgacttcgtctagtcagactgtggatgaagctt

SEQ ID NO: 31291 - DNA, 1176 bp, Mus musculus
aggatagtgtgaggacacgatgtagccacaagtgtctcctggtttcaatggcggatccgtcaggattcgccactgtaggatttaaatttaataaggtttacaggattaggattttagttgctgcgcccaccgattgagttaccgtcatttctgaactaagtttgtgttgggttttccttcacgcagcagctggtccgggttcaagagagaaaggtacggaggtaaagcacgtgggtttgcttgaggtgcacacaaaagccgtgggggatctgaaacacctctaggccagtctccacgagataatgacaggtcagccattgcccgccagcgcatggctggccaggccgcctgggtagaagtacaagtgcaggaacgtgctggtttctttttttattatttcccacaactgggttccttattcataatctatccattaaagatctcccggatgctacttctctacacgagcgcctctaatagctatccaggacttgtatggaatggttcctccacacctgacctgctctagggctcctgcctcctgatccagctatcatgaacttttttttcttttcctgttccttgagcatgatactgttcgtgcccaagctttccacacatctctttctctcttaagcctactctctacattgaagaaatgaaaccctgtcgatgctcagaacctatctcaagcatcgggttttcccccaaaggcttccctagcagacaggaaaccccttctcgttggaattggcagaggcatggatgtctgcccctcacttggcagtctcggtatgccagctgacttatatgagacacacagagtctagaagttattaattatcgagatggccaatgtaatcatacctgtctgagcctggtgcttcagcccccacctcaacctccctctgctgtgtctgtctctgtagctctcagcaacttctattttactgtgtaacctagagtatcatgtgttttcccagtagaaatgtaagcttcataaggttctgttttaatcactaccacatctccagaacccagaagagcaggcactcaataagtatgtgtttaatgaataaacaaatgggtgactgactggaaatgtagtgaactgagctccaacaaacctatagttcttttagagcaaacgttctcaaagtcctatcttctagacgg

SEQ ID NO: 31292 - DNA, 1224 bp, Mus musculus
gactaaaacaaaggcagggctatccccttgagttgtttccattgcttcttattgtaaaccaagatactcagcaaggtttcttttgcttatttttctcggttttgcactcatttcccctttcccaccctgattcttttcttcagtctgcagggctgggagttaaatccagaaccttgcaatgctagattccaccactgcacagtgcctccagacctctttccctttaaatttcaaggcagtctcagaaggttgcccaggctacctttgaacttgtggccctttccccacaacttcctttgttactatggactatcaggccttttccacacacagtgtttgaacctatgggcttctctgctagtgtataaagtagttagagacaaacttgtcttggccttcatttatatatctctcagagcacataaccaatacatctcctagaagataaaactctgttgctcaatttaatgttgaagaacagggtgtaagtcccatccatgtcttgctatttatggcctgccatgtcagcatttaatcatgtgcagcccctctctattgcatctgcctcagtgtggcttaggaaatcaaaggacaatttcaggactttctgctttcactgtgggctcagggggatcaaacttagggtgtcaaacttgtgtggtaagtattttttaaaaaactttttattggttctttgttaatttcacatcatgcgccccaattctactcaccccaccccatatacttctccatcctggcaaccttatcccccaaaagaaaaaaaaatctcatggtggaagctgtagtgtgtcacaatgtgtctcacagtatacccttttgtccatacttctttgcttgcaaatgctcattgcagtgagtcattggtctggtatgaggcctctggcttctgctacactatcaatactggaactgtattatgattcctcttggatatggatattctgttgttgccctgtgtcacggagatcctatagttttggatctgtaggacggggtccctttatgcactctaacagttcatccaatgaaggggacatgttggggagagctaattcaaagccctggatctgggcctaagctcatcagtccagcggcaagcaattttaagtggatttgttggctacttatattgaagttaatataagaactttgaccctgcagatgctgtccagtggttacaaatcctgggtcagtaactccttg

SEQ ID NO: 31293 - DNA, 1173 bp, Mus musculus
attttgtttgatactctggtgccagggtcaaactataacacctttagaagaaattaaaaatttcatttaaatgactaaatggttaaaccatagttgcagatctccatttaagtgaagagacatgtttccagggaaactcatgggtgtttgagtcatttatatggtttgtctatggaaagggaaggggagaactatagagaggcctgaggctagggtaaaaagtagggaaggaactctctgagattttccgtaatggcagagaactcagtgagtaggagagctgttgactgccggtatccataggaacttctcatttcttcctaacaatgagatatatgcctgctgggccacataagaccctgctcctaggggtgactgtgggctttgtgtttatctgagacttggaaaacagaaatcccaagggatgagttaggaatggtatggaacttgcttccttcctctttgatgtttttcagccataatcgcatgaaaacctatgacacgtacgtggggattggatggctgatccctggaatggacaaagggctgctgggcatgtgtgtcggcgagaagcgtatcatcacagtccccccttttctggcctacggggaggagggagatggtaagtccttctcttcctcagagcttcactcgttcattcttgtatgtttcttttcattggtgagtttgtgtgtgtgcctgcttctctgtacatgtatatgagtgcattgcgataggggccaggagagaggttcagatctcctggagctggagagtcaggctgttgagagctgctgtatgtgggtgctgggaacccaacctaagtcttctgacagagcagctagtgctcttaactcctcggtcatccatctctgaggcacctctctagccttattgtctttacctttgtctgtagtgatcagttcatctgtgtccactgagaaatatcctgccttttgctctaggtcaactatagtacaactatggtagccattggctaccacacgtggttgtttacattgaagcaaaaatgaattaatattaaaattcagttctggccacagcctcacatctctggtatgagagagccacacattgcgaagggctctgtgctactccacaacaccctttgtttccattgttacagagaggtctgttggacactgctaggca

SEQ ID NO: 31294 - DNA, 1152 bp, Mus musculus
gtctcaccctagaaacatccaagagaaacagcaccatgcagaaatgagatagaaaatatgtaaagacccataacttatgggttatgtgtatcatttttatttttatctaatttctgtttattaacagctcatttcggataaagaacatttaaaaaatgaggctcttggttttaaagaacatgaaagtataggattttccagacagaggtttggaatttgcatcatgcgatgcccacagttagacattagggtgagacactgtagttacacaacatggagagcagagcgtttgtttccttggcttgaaaacttcaaggaatgaggaacaccagcagagatggcatgagtggtgcttaaagcacttcctaaattttatgtctggaatgaattgtttttctatttcactccaggaaaagacatccctgggcaggcatccttagtctttgatgttgcattgttggacctccataaccccaaggataccatttccattgagaataaggtggttcctgagaactgtgagaggagaagtcagagtggggacttcctcaggtatcattacaatggcacacttctggacggcactctctttgactccaggtaaggaagctactgttcactcacgagggcatctgcctaagtgatgtctaactatggttggccacggtcgaaatataccatcaatcctgactcattttagtcatcagtacagatctctgctttcagacgctgagtttgttccaaggtggttaccacagggtgtcatggtttagatggtttaggaaacaggaggaatttatattcctagacacccattgttctcttccccactctgaatcccattgcggactctaggatgtggagtggtcagagtgagttgaagagatacagtggacaaagagcctatcactgctgccctagcttcctgatgttggattgcgttggagctctctgaatatcagcttcagtttattccttgaatacattctccacgttctccatgatggttgagttaagctattaaaagtgctgtgtaaaagctgaagacagctgaatgcattccactcccttgtgaatgcatgccgcagaggctaattactctacctcttcctcagcaattacacagctggctttagtgcacaatgcgtgtgg

SEQ ID NO: 31295 - DNA, 1113 bp, Mus musculus
tttgcagagttgaacacgagctccccagacaatgcctgtcaaagggaaggctcactatgaaattgcaacaaaacacaatcgtttaaacattagttattttaggaagtaggaaacatgaatagtactctgtacacatgagctgtgggtgtgagtaggaagggaaaaatcagagtaagactagtagtgtttgtgcttaagtaaggaaaggtgagggaggaaatacaagtatgtgaataccaggggcagatagggaactaactgggaaggagatgaggcaacgcccagcagctgcattgtatggctgcgtctcacacccacaccccttttatcatgtgaccatacagatagtaagtacaatgtgctgttcctgcagatgctcctgtgttccccattccaggggctgtgtcctcagattctatggttgagctgctctggggtgtggagttacctgtggcctttggcatcgggattctgagtaatttccccagctgccatgtgtgtcccttatgaatgacctcatcttttcctccttctgtcttagctattcacggaaccacacctttgacacatacattgggcagggctatgtgattcctgggatggatgaaggcttacttggtgtctgcattggggagaggcgaaggattgtggtccctcctcacctgggctacggagaaaaaggcagaggtgtgtattacccgctctccttactaactggctacttccacgttgctcagttcagtacttctagacacaaaacagggagtctaaatccagccgaagactccgtcccactgatgcttttcatttctagagctattggtttgcaacagctttccacccccatatcccttttctttctgaccaatgtaaaatctgtgccattaatgaaagaattgcatggtgaattctaccttgttttaccaattcttaacattttactaatatatgttaaataatttttattttaattttacatgtatgaatattttccctgcatgtatgtaaggatactacgggtgtgtagtgtctgaagaggccagaagaggacactggatcccttggaactggagtcacagacagttgtgagctgctgtgtgggtgctgggagct

SEQ ID NO: 31296 - DNA, 2252 bp, Mus musculus
gttctggagaggtcaacctcaggtcagaagctaaagctgttctggtggctgaagcctattggataccttgatcccaagggctcttgaagtcctctagtcaagggatttaaaaacatttcaatagtattttggttttaaaagcatgtgtgtgggaatatgcgcatgtacatatcaggccccccgaggaacccagaagagagcatcaggttcccctggggctggaggtgcaggtggttatgaactatccaacctgagtcctggagctaagtgctcttaactgcttatccatttctccagtctgtagtccaggggaattttcatctgcatctaagaaatccaggccatgttctcaagaacaacttggtttgcaagtgtggactcttatttttcagttcccccacccccccattacccgccctcatgccatagtatttcaggcttggctctgcgtgcccaattctgctgttctcacatttgtcctgtcccctttccagttctcagagtacattcatgcccaagtggcaacaggcaaagggaagctggctcctggctttaatgctgaaatgatcgtgaagaatatgttcaccaaccaggaccggaatggagatgggaaggtcacggctgaggaatttaaactgaaggatcaggaagccaaacatgatgaactgtaagcctgacacagatcagtgtgtgccaaggagtgcatgacaccaagcgacctgtcgtggcggagcatgctgtcaaggtgtgaagctttctaggaaggtttgagagtagccagaattaggtgggccatgtagtacctggtgcagacagtggggggtggctgatgcccacggtgaggacttgggtggatttccagtgacagtaaagagaatctgtatatagtgctttggcacaaatgcaattggtctgaagcaccaattgcacttgtgagtcttctgggaggttgtgttaataaaggaaaattatttcatagaagatgtagctgtcatggaggaaacagaagaagtacccaggtgtctacctaaagaaacgatttggtttaaaagtcttgctagtgtcttcaaaaaagttcaccatgggcagaaagataaaggcacacatgtttcagcaagtgtccttgacagcagccattgctcttctcagtgttctgtgcaagctctggtgataccaggccccgtgcgacagccatcctgtcaccttccctacaaatctccattttcatgctttccagttcactctctacactggcagccctccaattggtagtgtctgtcacttaaaggttaacaggagtctcctggacaggaaaaacacagaccaaatggaagctgtctttagtccatgagtagaggatttgacctgcattttctacataggattggctttctctttctccactctattcctttggggagatacatgatggctgggtctcactggtcggccaacagaaaattctactgtgactaaagtggatgtgttatcccaacaaatgaaggtgacactttctgttctccccccccccatttgtgtcttggaaggcaatttgaggtctcctgctgtagaaaaggctagcccattcccacaccatgtggtagctatgctcctactttatgtcctcagataccaatgatgttggcactcactctgacgtaatcaggacatttccgtttgaaatggcgttttttacaaagttaaactgttttgtactgatgttgccctgagatagttcatgcaaatgctgtgcactcattcagtggaatatagttggaaaactgacttctttttttctgacataaaatgttgaatcatatcatctggctttatggtattttatttgaaagtccaaaggatattatgagaatgcactgtgtggttgaagtccccttgacaaaaacttggcaggacagcagaaaacttgtgcagggcagtggggcatctgggtgggggtgggaggaagctggtactggcaggaaactcactagataatctcatagaaagggctatttacagttgtgggcagggcctaggggagcagaaaatgctgagatactgtgaagatagggttgcttagtaatagctggaagctgtttgccactcctgtgtctcgggtttaaggtgaatcagctggagcagagctgcctgaatgtgtgtgttgaggcaactagttacacacagagcatggctggcattgcagtctagtgaagaataagagatagcatctcttctcatcttcctgtctgctg

SEQ ID NO: 31297 - DNA, 1129 bp, Mus musculus
tatatccctctgtccatatatctttactagcagtgttcatttcaatgaatcattggtctggtatgaggtctctggcttctgtgacaccattagtactggatcctcacagggactcctcttggatatcctgttattgttctgtgtcatggagatcctgcagttttggatctgcaggactcttgtttttgttttctgagacaggtgctgtgtagttgtctggctctgaactcatgattctcttgttttgtcctgagtactggggttttaggaaagtacctccgtacctagccccaacctctggcttataaacccctgcagtttcacctataggctgatgctgttctttcctttgaacataatactcttaagtgtgttctcagtccttagatcactaaacttcacgttaaatacttttgctctttcacatgttacttattacaaaaacaaaaacaccaatggagagtaaggataagagatttttgtatcatttaaccttgcctttctgtcccttctggttgaactagagactgctcttcacagtgagcagtcagatcatacatggtgtctttagggcacaccacttagttgcctgaaggatctgaagtttacatgttacagtcaggttcaaatagatcacagtagaaactaaacctacaaaagccaagcagcaaagagatcaggaatgggatctggagaaggtccctaactttgcatgacttagtcacagaggaacctactgtgactggtctgaatgtgatgtctcccatggtattggtccccagttggcgctgctgtcttgtgggaggtacggccttagtggaagcatggcagtcagagtgggctttgagagtttaaagactcctgccattgttagtttgttctcgctgctttgagcttgtatttcttcctgctgcctctgcttcaccatcatgaaccctaactccccagagctgtaaaagcccaaataaatgctcttgtccatcagtgggcttggccatggcattttatcacagcagcagaaaagaaactgatacatcctgctatacattgtttctgaaactttttataaggaactctttgtgttcaataaaagaaaatgattttcatagtccttagtattcttatagga

SEQ ID NO: 31298 - DNA, 1182 bp, Mus musculus
gtctgtcgcccagcgatcatgatgctgaggcaggaggctggcctcaaaagtgaaggccagcataagcttatacagcaagaccctgtctcagaaaattaaaatcttaatcagaaacaagataattatttaaagataatttgagagtatgtctatatttcaacccttttatatgaaattagatttatattctacaaatctaacatcatgtggctaaaattaacattatctgtccttctctacatgttaattttatttttgtttttctgttgattaggtagacgagcttttagaaaaatacatggactcttatgatattgttttagtaaaagaagaatcattggaggttgtcaactcaattttacagaagacattataaacaagccatcgtgagaagacttcccccaggggtacacctgggtcaggcactgtccattttgaggaaagactctttcttatttataaaacagtcttgctcctggaacttttcccttttcccaacagacgatcttcagacgtgtggaacctgtgaaccacggcccctcttcccacctccgtcactatactcagcagaatttttaagtcattaaaaattatcttaaagccaaaattagaaagatggctcccttttccaaagtgagttttgtagtttggtgttctgcagtttctagggcattctcccaggtgggtgtataagggcgcagaagacgctctctggatgtattatgttcctgattttaaccactgctagctttgaaattggggtggagtatggagacatcatcttctgaaattgttttatttgtttattttgtctataaaatacatttgccaggaagttgtgtcttaaaaactgttggtgtccgcatcgctaacattgcaaatactctgtgtgaagcactgagaataaaccagaaaaagaaagcttttctaaaattctgttgtccagatcatattcagcctgtcacggtggtgacgtatgtctttaatcatagcacacaagagaaaaatgcaggggagtcaagaatttaaggtcagcctcaagtcagaccagcctgggctacatgggaccgaggagcaaaagcaaaaaccaagtagtgtgtatttttacatttatcctacttttttcttaaatttattttattatgtgtaagtacactgtcactgtcttcagacactccagaa

SEQ ID NO: 31299 - DNA, 1235 bp, Mus musculus
cgacagaggaaaggattttgctacgtttataaagtcatcatgatacaagccatgtgcattctcctctacccagctctgtaacaatcattctgaaagaagcagactttatttccagacgttttctgtcatattttaacgactgaccttaaccatactttttctagacataatctcagcttccattaggcttgagactgatggtcaggactctgtgaacagcccttatcccaaccacatccctggccctgctctggacatgggtggattgtctccagaggctgagcagggccctgagctagtaacagcactctgcaggggcagggtggcctcacctgcagacggagcagctgatggagcctcgcagccatctccctcccgccacactcttcaaggaccaatcatggggcaggtgctcatttcctggctggggcagagcaggtgaaagcaagagacttcagcggagcaggcagcctgcaagtccaataaaggccttatttttcttgtataaactgtcttacatttatttgtaactgttgtaagagtggacctagttctccactcagctgtcttgctagcctcctgactgacttcagtgaactaagaagccacagggctcaggcacacatgtgcgtatttattgtgtagctgatgtgggagaggcttttatatttgctttctgcttttaattcatctggacagttggttgttctgcttttctgttaatcgtttgtgaccctcccgattatataacagtctctgcagccaacttctgaactgtttttatcacagtgttatttattgctgtttttcaataaagtccccagcatttcaaataaataaataaataaataaataaataaataaggctgctatgaacatagtggagcatgtgtccttattacaagttggaacatcttctggatatatgcccaggtatggtattgctggatcctccagtagtactatgtccaattttctgaggaactgccagactgacttccagagtggttgtaccagcttgcaatcccacgaacaatggaggagtgttcctctttctccacatcctcgccagcatctgctggtccctgaatttttgactttagccattctgactggtgtgagatggaatcttagggttgttttgatttgcatttccatgatgattaatgatgttgaacattgttttaggtgcttctcagccttttggtattcctcagttgagaattctttgttta

SEQ ID NO: 31300 - DNA, 1207 bp, Mus musculus
cagcatacctacaatccaaaactattaaatggaaacaagcatctcatccaatttaacttgttgaacagtctaagtagtttggtgaaatcacatgccatcttattctgtttcacccaagatataaaccatcttttagtttttccacactgacaggggcgtatcacagtgcctgtgttcaagtacccctgatttagttattgttccatggtatattagtagtgatatgggaagttttaatacacttaatattttcttgaagtaaaaatttcaatgtttataaaaaagtgtgtactcataggaaaacataacctacagtttcaagctattgacatttctggcatctactgagacctgtaaacagggtgccttatagatggagggtacaatatccccaacctggcttcaaggtgattgatgcatgaatgcaatggaaataatagatttttatgttaatatagtcccactgtaatgtttattgtaggattttgtatgtcaagtgtagtctcccctcccccagcctgaaacctgcttgctcaggggtggagcttcctgctcattcgttctgccatgcccactgctggaacctggggagccacacacgtgcacctttctactggaccagagattattcggcgggaatcgggttccctcccccttccttcataactagtgtcgcaacaataaaatttgagctttgatcagaataactgtcttggctacatttctttctctcgctacctagcccctcttctcttccaggtttccaaaatgcctttccaggctagaacccaggttgtggtctgctggccggacacaacagtcaagggctgtcaagaaagtatgttcaatgaaagatattcattctttaaaaagaaaatactagtgttcatgggaatagatagtccatttttctttttctttttagtctttcaaacgagaagttacagataccagtgaaaggttttaaaaatattagaataacattttgctgtcctgatcctgaacatttgaatcaaaagtaggaagaaaggcccaacaacaacaacagtaacaaaatgacaggaatcaatatacacttttcattgttaactcctaatattaatagtctcaattccccaataaaaagacagactgaccaattggattagaaaacaggatcgtctttttttcccatccaggaaacaccctaccaccaaggagtgacatc

SEQ ID NO: 31301 - DNA, 1175 bp, Mus musculus
tctttccactgagtctcaaggttttctgcgtacgcagtggcatctaatgtagaccgaatctctaacttggaagcaatgtggggcttgcaatccaatgcaattcactgctatgaaaaagctaagtcataaattgggaataaactaaaatatatatatatatatatatatatatatatgaaacactggccctaatgggaataattacagattgtaagatgatttttctaaaagaaaaggttggattggcctatgcttctaagactaaagttactggaggactggaggtataaatataaatattggatacatagtgccatttattgagcgtcaagcctttctaagcttttagtttccacaattcgttttgttctttttctcccttagatatgaagcatcgacaaatgaattggttaatgaagagttgggaatagcatatccaatcattgatgggatccctaatatgataccacaggcagcaaggaccacacgtcaaaatgagaagcaagaagaagctgagcaaccctagaccctgattgttaaaagcataattactgagttctcttaattctgtacacctttaacacagggagggagagttggggtggaacagtaattctgcctcggcctgcttgactgttcttcccctgccctctttagcaggactattctgatctgcttttctggaggagaatgtcccacagggctgcaccagcacagaccacagacaggctttgactttacagtgtgcttttgccaaccaccatagcaatgtgtgtgttctcccacctttggaaccagaaaggtctaaaactctttaagtgtagttagtacaaccatagccgggacagcacgtggattaataagagatctgcagcaacatctgtgaaaactacatataaacccatttgatttataacaagatctgtttgtcttatttctctcaggcttaggaccaggaagcaggctatggaagctttttcatgcatgttatagccttgttttttgaagatttcacttacaaccactgtcagaggaagcatttcagtcatcagctgaggcttgcttcaaatcccattcatttgaaagctggtgatttcaagtattgtttagtttcaaggtcaacggtaagcttaagtgctaagaaaattctgacattgtaaacttgccttcagcac

SEQ ID NO: 31302 - DNA, 1118 bp, Mus musculus
gcaaaaagacaactaacatacccgttggaccaaaagccacctgattgattagtgcctgacacagaacccactgtaaaccctaaaagaagaagacgacaggacagaaaccttcacaagccccctttgttgcaaagacccccaattagagcatgagcgatagaaatcatgtcatcagcattctgtgacagcgtgtcccttaaaggtgtgaaatctgaatccttcatctctaggctccttctagtgtgcatgtttcttggtgcttgtctataggtgtaaattgaataactagaaaagccacactcattacatgaactcttagctgagcacatgtgagtgttaaaggtgacaggcacacatttttgtatatagtatctaaactagggtatcatctctatcaacacagaaacagttgtgtgatgtctgtcttgaccatcagctagcagatctagatatcctgtgagaatacatgttagcattttccatgggcatgcgtgagaggcagcctcccaaacccgaatgaagggcaggtcagtgtgcactgcagagctcaggaaggcacaattgacacctcctccctctgtgtgtcttgtggtcaatgtaattaatggctaagcattaggaattctgagacatttactcagatacatattattaaaacagatacctccttactgttttcagaatagcttattactatataaaacagagtagctgtaatgccagaaagatctatccatagcccttcaaaaatttatttcacattttggtaaactattataaatttgaaattaatacattccttatttttcatccagtttgaggtgataaaataaattctaagctgaatttatacatgtaagaagcaaaatattttaaataagacaattattatctgggtaatttttaaaattatttttaagggcattaattttgactcacatgcgttagaaatcctgtcataaatttcagagtttggttgtcgtttgtggtacaagtaggctagatttcctaagcatgttttattgtgtaagggaaattaatatatgtttcctgaaggaagcacctggggccgtcttgtaaacctgcatcaatgtggaacttgtacggccatgattttg

SEQ ID NO: 31303 - DNA, 1245 bp, Mus musculus
ccagaaatagactcacatccctatggacacttgatttttgtcaaagaagcccaaacaatgcagtgtaaaaaaaaaaaaaaaaaaaaaaagaaagaaagaaagaaagaaagaaagaaagaaaacatcttcaacaattgttattggtatattggtatatttgaatgtctgcatgaagaagaatgctaatagatccatttttttcatcctgaaaaaaatgcaaatccatgtgggtcaaagccctcaatgtaaaatctgacacaccaaatctcatagaagagaaagtgaacaactgccttgaacacattggtagagtagacaaattccttaacagaataccaattactctgacagatagagcaacaaatactaaaaagaaccttatggtactcaaaagcttttgtaaggctaagtactccattaataagataaaacagtagcctatagaataatacatgaataatgtatctgacaaaaaatgaaagaactcaagaattttggtgccttttccgagtaaccgccaagatggccgaagtggagcagaagaagaagcgcaccttccgcaagttcacctaccttggcgtagacctcgaccaactgctcgacatgccctatgagcaactgatgcagctgtacagcgcccgccagaggaggcgcctgaaccgtggtcttcggcggaagcagcactcactgctcaagcgcttgagaaagaccaagaaggaggcgccacccatggagaagcccgaggtggtgaagacacacctgagggacatgatcatcctgccggagatggtgggtagcatggtgggcgtgtacaacggcaagaccttcaaccaggtggagatcaaaccagagatgattggccactacctgggcgagttctccatcacctacaaacccgtgaagcacggccggccagggatcggtgccacccactcctcccgattcatccccctcaagtagccgaggccaataaagactggttttggtccctggggggggggggggggaagaagtttggtgccaagaagtcaaataactgaattaaaaagttgggtagagagagtcaatgctggtaattctcaacagaggaatctctaatggctgagaaacacttaaagaaatgttcaacatctacactgatcaatgaaattcaaatcaaactaactctgagattccatcttatacacttcagaatggatatgatcaaaattgcaaggtatagcacacactggtgagtctgtggat

SEQ ID NO: 31304 - DNA, 1198 bp, Mus musculus
aatgacactgaaaaactaagtttggttttgggaccaggtatcctctgagtctctcttgtattttgttaatagaatctggggcctgtgagtctgtgcatgtgaggcgctctctcactacatatgatggccacccagactactaatatattcagcttcttatattagataaggcctcactatagtcctcagtttggatttccttttttttacaaaacaggtagatttgtcaagatttaggagctgaagttttaaaatcaaatattgaccgaataagtgttataaaataaacattctgcatgctattaacttctgtttactagactctggtaaagaaccagaaatattttattagcttagtagcttcattaagttgtatactgaaaggaatgtattatgaaaggaagttgtgtagagactctttgagattttcaaagtgtccttctgtcaattgtgaagcctttcctttttagtgttatctttgggcaagtctttatacttgccacttccgtctcaaaataaaagtccttggcaatatttctatatcctgtgctttttttttttaaagctcagaacataatctaatatgcccagaatttgagacactctacctctctgctttttaacctttgatttggttaaatttataatggtgaaatgttaagttaaatttcaaataaatatttatgctgttcctgttagcagtggtacagaccacagtgatacagtgtagagggcacagcttacagaaaacactagaaaccagagttgttaaaaggcaggctcttttcttctaaggaaggaaatgacacctgtttaccccaaggctggagtagcatgttgtctaacaacctggtgatctttcactgttctctggaggccagctttcatccaaatccctcaagcaatcctctcagtctctagaacccatctttatgaatccttcctcccgtgaacacggtttatcagttaatagaactcattctttaggtgaaggtcataggtagagctgcactttgcaagggaattttgatgtagccatgcctaaagctttgtcatgatggttgttatgttgaaactttcctctaaagttttactgtgtttaaatctgaaagaaaataaaccgattggtaagtcttaagaagttttgatccagaacctgctaaatttatgctgacctgaggtttttttttaacctcac

SEQ ID NO: 31305 - DNA, 1136 bp, Mus musculus
ccacgagaggcgggtggtggggtgacaggaggcgggtggtggggtgacaggaggcgggtggtggggtgacaggaggcgggtggtggggtgacaggaggcaggtggtggggtgacaggaggcgggtggtggggtgacaggaggcgggtggtggggtgacaagaggcaggtggtggggtgacaagaggcaggtggtggggtgacaggaggcaggtggtggggtgacaggaggcaggtggtggggtgacaggaggcaggtggtggggtgacaggaggcaggtggtggggtgacaggaggcaggtggtggggtgacaggaggcaggtggtggggtgtgtgctgacaagagacatcccgaggcaatcagggctgcaccatttggtctgtctaccaaatgatggcaaccatgttcagtcttgttgacaaaggtgacacttgctttaggtcggaactcagtttatccgtggcatctctggaggagaaagaaaaaggacaagcatagggatggagctgatcactgacccttccatcctcttcctggatgagcccacgactggtttggactcaagcacagcgaatgctgtccttttgctcctgaaaaggtaaatgctacaagacattttcatttatttactatcaggtcacttacatgtggcactatggattctttgtgcaggagtaaacaacagaattttttcctcctttgttaaagggaaagaagaatggttaataagaatatacagaatgatggctgtggtggggcgaggttgctgttctaaatagcatagggtcatggaagatcttgggtgtggacaagggacctgggcatgagagtgagacctggttgtagctggtgacagtaactggctagagaagacagctattggccccaagactgaacatgcctaatatgtcggaacatcaaatagatacaagaacccagttaccttagggttgtacctaggcatacagttacaacaaaacaccgtagactaggtagcttaacaacagaaatcttcacttctgtgaaaacataccacctgtggtctgagagatgtgcagacattgcttctgaagtggagcccaggagtcttccctagggaccctcagagcatgtggtcattccgatgtccctagtc

SEQ ID NO: 31306 - DNA, 1193 bp, Mus musculus
ccactcacaaacacctatgcggacaaattcagtccgtgtccagaacggaagctgattactatcttgtaccttccccggttggatggtgggcttgcaatacaggacttactccctgtgtatcaactaaggtttttaattcatctcatgatttttgtgtcatgatccagctgttaccccgtgtatattatcaccctgcatccagtttagaagaaagctatgcgggcttttttttcaaaaagagaaccaattactttaaccctggctgcattcatgggaataggtatggcagtaggagtggggacgggagtgtcagctttgatagaaggaagacagggaattcagtctttgagggatgctgtcaatgaagacctagcggcaatagagaagtccatagacgctttagaaaaatctttgacctccctgtctgaggtagttttacagaacaggagaggtcttgatttgttgttcctaaaggaaggaggactgtgtgctgcccttaaagaagagtgctgcttctatgcagatcatacaggaatagttagagactctatgcagaaactgagagaaagattagagcgaaggaaacggggacgggatgctcaacgggggtggtttgagtcgtggtttgaatcacgaccatcttggttaacttctttaatttccgctgtagccggaccaatccttatgatatgcttagctttagttttcggcccttgtataataaatagaggaatggctttcatccagagtaaaattgatacagtaaaactcatggttcttcaaaggcaatatcaacctatagttcaggtagatgaagagttaagggacaccgacctctaaaattctatgattagaattagtctaaacagaagaagaggggaatgaaaggaaataaaactgtaattcatgtaatgtatgttaaatagccccaagagttgtttctgagctttgaaacctggggctgagaacatagcagaacagaccaggacatgcccgggcaagcccatcgcctccctagctcccacccctctgacctaagttaaatgttacaggctgctgatgtttaaatggaccaatcatgtgaaaccgcgccaattcctcccccagccccactccttttctataaaaccccctagcttccaagcctcgtggtcgaatccactgtctcctgttgtgtgagatacgtttcgacc

SEQ ID NO: 31307 - DNA, 1099 bp, Mus musculus
ataagatgcctgaaacgtgtgcactacagaaaggtgaaatgcaatctgagtgtttctagggccagactttggaatgtttcctttaaaatccaaataaagtgatttaaatggcaaactctgttaaccagaggtcttctccaggggtcaagaattgctagggcaggaagcaatgtttaactctccgtcacttgcctacaattcttggtttcctcatagtcctcaatcttcattttagtcttctggtttttctgtttgtttgttgttttgtttgtagaatttccccctccctccaaggcctcttccaccaaagttctgattttccccagagtggtaaggtacttattgtaaggatgtcgaggctcactagatgttttcttcagtggggaatcacctgcttaatattcccagctgtagtgatagcaagagctacagaacttttgaagaactgcccaccattttccagagcagccccgccattttgtgctcttatagaaggactccatcctaatctggtcactttggtgtgtatgaactgggagagggagattttgttttcatttgtttggaaaagcatcctgctgtgggaacatatttttaaaagcttatgtatcttgtcagcaggagtcagttggccaaagttgataaccctgctgtctggaagaagcctatgatttctagtgaagggggttacaaagttaagtttgaagagtagaaaggagaactatcagttctggtagacaagtagccatgtcagaggaagcaggcctagatggttatagagattgtttctgtagagggccccacttccaggtaggaagcacgactgggttcactcagtgatttgaagctgatttatttaaaattgccttttcagtgcttctaaaacacaaaacagcatctttctaacttatggaactactttggacaatattaacatgttttattttaagatgcaaggcgtggtgattattaggtgagggccatttttaactaacccaaaagtaatggattttgtttcgaggtttcattcagttcccacatccttggctcacaggggagggtcgttttaattggttgcatttgttacttgatttcttct

SEQ ID NO: 31308 - DNA, 1235 bp, Mus musculus
aagtacaaatttaaaatctttactatagagtttatcaagcctcagttccttacatataagtgaacctaacaagtcctgctcatttcacctgctcttttcctttaaaactttttgcctcctcacacattcctgcacttaaaaaaagggtcacctggaaccagagttacctgtggttgtgagctttggatggtgaatgctgggaatagaactcaggtcctctgaaagagcagcaattgctcttcctaaactactgagctaactctctagccctacatcacctcgcttttacatactcttaaaatctccaatggcaaccactcatttaagcagtgcggacccattccctaaagctgtagtcttacattcctttattctttcccacttaaggaatgttcttagaaaatgctgacggtcatcaggtgagtgtaatacctagaacagacccgtgagatgggattttatgagtaagttttagaggacagccctcaaactcagttaccgagtcacccaatgcttgttccttgctagagtgggggcgtgtttacctttggtgctggctcctgtgggcagcttggacatgactcggtgaatgatgaagttaatccgagaagagtcctggagctgatgggcagtgaagtaactcagattgcttgtggcaggtgagtgaccccaagagctttctcgtggtagtgatggtaaagagctgcagagtggatcgggcggtgggaaagcctgtgggctcactgagccactgccatttaaagaaatatttttgttgtttgttttctccccacctctttaagatagtactggtcagtgtgccctattctggccttaaactcggtatgtagtgggggcttcctccttttacctcctgagtgaagggactgcaggcacgtgccaccgtgcacagctttgctttaggaagtctcaactgcacggtcacctgtgtagggaaagtcagactgaagtagatagggaaaggaagggatttaggtaaacagacgagcaggaggataatggacctcttatagaaaagagagggaagaaatgaaaaagcaatgtgacaggtgcttatttgggtctgttctgtttttctttcatcccaaagggagcatgtggcagcttgttaatctcttttcacagattttcacttgatctgtaggcacatgcatgacctttgtcacagcaatacaacattgtaatctatgtttgggctggtgagatagttcagt

SEQ ID NO: 31309 - DNA, 1117 bp, Mus musculus
gatctctttcctagccatttactttgtttatcccttgcttcttatggcaatcctgggtgctcacagggtagacccttccacagactctgcagaatttaggtaataggagtaagtctttatttccactcatccttggtttctttctgaaatgatcaatagaataggcagacatgattggacatgtattaacttctgtactttgggagtaacagctcacttttttctgtttgtttaaaatggtggtgagagagtgcccaagctttttatgattttgacacacccacacatttatatatacatgtatgtatgtatgtatgtatgtatgtatgtatgtaacttgtaggataatagtttttgtccatttggaggcaaaatattgtcctctaatcaggtatgcactgatgacccagtagagtctggctaggaagatgtcttgttacagaaacttatataagcactgatttgtaattcttaaagactcctttctccatttgtcttgaatagtggtgttgttcagatactgtcttctgcagcttgttggaatggaagctttctggaaaaaaagtaagtgtcatagacgcttcagaagccgcgtgatataaatacttagcaaggctatgaaagacttctccatagtccttggtttcagttgaaagggaaagctgacatttgcatgaagtttgaaatatccagtaatgatcaattagaggatcccagaacagtggtatttgctcattcctcactggggcagatttgcagagagaagtagtccctcgggagacctagtgtgacccaaagccagaactctaggctgccccaaagtgctgttctcattggtctgtatgggtttatgatttgttcttaaagtcaaaattctccagtggttctctgattctatagtttgctgaggtaatttttcatttctccacaggagtgaagtcatgtagaggtcttagagaggcttcattctggggttccatggattcagtcaggctcagctctgtctaaaaccagaggcagcaaataggatgtctcttttgcccttatctcttctgcagatggcccctcagaaacctcatgcagcagaattaccttgccaggaattaggattttcagg

SEQ ID NO: 31310 - DNA, 1158 bp, Mus musculus
cttctctagatagccaggtaagtcagagtacagcagagacgataactcaggaccttaaggcaaaacaaaacaacacatatacccacacatcccagagagtctcagtggcgactcactgtttttaaggtgagatttgtaattcaggtttgaagatttagctgaattttcaggatgaatctcagtccctgggttatcttgttagaggaaggtaaatatttggctttgtttagttttacgttgcactgtgataatctgcatattcatttacttcacaaacactgaatgtttgctgtgcacccatcatgttgcagactgtaggagataactagtttctatccttcgttctgtgagttgaaaatgtacacagatatgtaacagatcatagtacatgttatgtgcttccatggaagtaggagagaagcagcacacttgtaagacacttaagagtgtaaatgttggggcatattttaggctagtgagtatgtgagtcagaatggtcagggttaatagaggatagagacttgagaatttgtgagtggatcagggtatgataggtgtaggagttctagagtgaagactgtcagggcttggatcaaaagataactagcctcagtttagagagatagctttaatgaccttatagaaatacacactggcattgagacctgagaggaggccattgagctggctcagataaagaatggcaagggccagggtggaagttgtagacgtatcaagttgaatatgtgaatggcaccatcagtaggtgtctgattaaatatgagcaaggctggaattgggaaccttgccacagtttctaatttggatagctgtataataggtaacagactataaataaaggtggttcattgagggaagttccgttttgaatctgttactttggctggctggctggctgataatacgcaggcagttacttaaagcaggaatttgacatgagtctcaggaaagaagcctcattagaaatctttggttctgcctgccagcctcaattgacagtgagtttgaagtcacttaaagtgggaaattgatagaaatgttaaaagaataaggaaaatatactttcttaggaggacttgtataattcaattgcaaggcaagccattgtgatgagaattagagcattgttgccacccg

SEQ ID NO: 31311 - DNA, 1152 bp, Mus musculus
tttgcagaatactgaagactgtgaacatgttaacattgaaaatattgagcagtggtttgactctcggagtagtggctcaaactgtcaggtgttagctgacattgtaggtgctgcagaccgggcgaaggtcactgagcaaaaaccttctaggaaaactaggaaagcagaactgaatccagagaagcatattagtcataaagctgcacttgaatggactgaaaacttgctggattatctagaacaacaagatgacatgctactctctgataagctggtattgcggaggcttcggaccattataagaagaaaacagagaatacaaaataaaagtcatctataatactcccttctgttgctatgtattttcatctttgtgacttctatctgcagtggaatttatctaaagccaaataaatgttacagatgattaggattagatgatgttttggattacttaaattacacctctttaatgttggctctgattgagcaatgacatggaattcatttgtcagtgtctaaactgttttatactaattagatcatagtatactggaggctgagatatgttgtgtactgaatttcaacatgtctagtgatgggcaatgcacactgtaggctctcaataaatcttgctcaaattgaattttgatgactttttctgaatatcagtttgtaaagtaaaaaatattggagatgagttcacatttccatgggtgagactcttaagagggttcagcgaagattgttcttgaaggattttgctgtgactctgttgaactagataacagtggtgtaaacccttggagacaacattgctttctggcaaaatttgggcagcaagctattgagattgaccactggtgattacaatgaaggaaaaggtcaatttaaaacatcccaagagaaaggcatggggtgtcagccttattctacctgacagaagttctttaattgtgtggaaggtaaaccagccttttttcacaaattttaatttcctaaagaattagtgtttagaaaaattaaaaggtaagtgttattacctgtcatgtttattctttaaaagggtgtcagcatttttaaaaacctcataggtatttatgtaacactaaagtacaccattgttttcatggggtgtgttttttgtgaagt

SEQ ID NO: 31312 - DNA, 1180 bp, Mus musculus
agctatcagggccaaaaaatatttgagtacataggtcataggcactaagacaaaacctatgattaccattgtggtaaattgacctgatattaaatagactatcaaagagtctgttatacctgctgactgatatatttttcaaaccctatcagtgaagtttcttcttgaagtagacaatgcttaacatagagacacataactggtcaagacataaagaataagattctggatttctcatccttaaatgaaatatctccgtcacaccttctcatctcaaggctcaatcatcattttgaaattagatgaaaattgtctttgaaccagaaacaggcagtgtagacagaaggcatcttttctggcaggacagttgaaagattttagttcacttatttcatttgtaattttaattgattctttctctctactgctttggtgtgctgttctttaattttataccaaggatgtcaagttgattattatgttattaatatgggactttagatatatatttttttaaatctagtctatggccataccaccctgaacatgcccgatctcgtcagatctcggaagctaagcagggttgggtctggttagtacttggattggagactgcctgggaaaaccgggtgctgtagaaaaagaaaaagaaaaaaaaaaaaaaaaagcctggtggtggtggtggcacatggcttttatccaaggacttgggaggcagaggcaggtggatttctgacttcaaggccagcctggtctacaaagtgagttccaagacagccaaggctatatagagaaaccctgtcttgaaaaaaggaagcaaaaaaaaaaaaaaaaaaaaaaaaaaaaaaaaaaaaaaaaacaaaacaaaaaacaaaacaaaaaaatgtggttaagagcaccaactgctcttcagaaggtcctgatttcaaatcccagcaaccacagggtggctcacaatgatccatagtgagatctgatgccctcttctggtgcatctaaagacagctacagtgtacttagatataacaataaataaatctttaaaaaaattctaaatcacttagatctataaatttgggttatatatccctttattgtctctaaaatgccggaattgttttcattgtgtccaatagttttcaatatttgtgtttttattttcatacagttcaaagaataa

SEQ ID NO: 31313 - DNA, 1135 bp, Mus musculus
tatgcccacctccctgctaccagtatcttccttccctcgagcctcaagtttctagatgtttaagcatatcctctctcactgagtccagacaaagaagcccactgctacatatgtgctggaggtcacggatacgcatatgtgtgctctttggtctatgttttaaactctgggatcttccatgcataatagtgagttgatgctattcttcctatgggattataatcaccttcccctccttcagtccttcccctaactcttccacaggtatcatggcctcagtccagtagtttgctgtaagtatctggacctgtttcagtcagctgctaaaagatccactcagaagacacccatgctaggcgcctgcctgtaaatacaatatggcagcagcaataatttcagattatggtgcctatgcattgaatggatcccaagttcgacctgtcattgtatggcctttctttcagtctctgctccattttcaaccatgtttttcctttacacaggaacatttctgggtcaaacattttgaagatggattgttaaccccatccatatcctgtgggccctgtgaatctgttggaggtgatctctccaagttccattttcccactgttgggctttttgttttgggagcctctgtcatccaaggactctggtatcatttagagggtctcgctatcacaataccccagaagctgcttattttcattcatctcctgccccttatactcaattattcctccctttcccctccctctcctttttcccaccaagttccctccctgtggggcattgggctatgcacagacagtctggtctccagtctagctgagttctgaacacgagaagggtgatagttcacctacattacatggtaggtgttccctcatgctcctggacctctggatcctgcctaagctacaactcctagcagcccccacaagagaagcatggctaaaagtcaattaggcaatgtgccaagtttctgaccttcaggctaaactccttctgagttacctagcaacaaaaaaggtagcagcatactttaaaaggtgcagttagatccctccttgctctcttattcctcactctcttactctctcacttctctcattcatttgttctcttacctcca

SEQ ID NO: 31314 - DNA, 1163 bp, Mus musculus
aatatgcagaaactaagtttggaggaacacgtcaaaaccaggggaagacactctgtgggtttcagcagttcacgaagtaagaagataacaaggtctttgacggaagattttgaaagggaaaaggagccttcaactaataagaatgtctttataaactgtctaagttctggcagaagtgaaggggacgattctggattcacagaagaacaaagtcgccgttctattaaacagtccaccaagaagctgctccccaagtccttctcatctcactataagttttgtaagtcggttcctcagagccaatccacttcattgatacagcagcctgagttctcgctggcaattgcacaataccaagagcaggaagccgccttagggagaccttccccatcttgctctgtggatgtaacagagcgcgcaggaagttccttacagtcgcctctgctttctgctgacctgaccacagctcagaccccttcagaatttttggccttgactgaagattctttgtctgaggcagatgcctttcctaaaagtggaagcacggcatcacactgtgacaattttggccacaatgatgctacctctcagcccacttccagtcttactgctgtctcaaagacaaagatggaatttgtggggactgcgccctgtgtgatgtctccagggaggtacaggctagaaggtcggtgcagcactgaactgcattcttcaccagagacccctgctggtaaccggagggaagtgtcactacaaagcactgagctctctgttgggaatgggagtgatccagagacccatttaccggcccatcatcaaagaggagagagccccttggcacacgctggtgaaccagcgctgaggacaggctcgcccaggacactgggctcctatgaccagcacaaggcattggctgaacgctttaaaggggtccaccctgtctcggattcaagggtaatcccttcctctggggatcatgtttttaacaaaacgtcttatggatatgaagcgagtgctgccaaaggtatgcagattttcctcgtgcaaaaattatgtacattaatcttcattttatttgaacaattatttttacgccatatcgtgaatgaaaggcacgtttcctttgtatttataatttctgttaaatctttgctttggtttta

SEQ ID NO: 31315 - DNA, 1145 bp, Mus musculus
ttttttccattttttattaggtatttaactcatttacatttccaatgctataccaaaagtcccccatatccacccacccccactcccctgcccacccactccccctttttggccctgtaattcccctgtactggggcatatagagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagctagagaaaattaattcttaaaaaaaaaaaaaaaaagaaaattaattcttttgtttctaggcaagcctgctcgattattgggaactagacagtgttactgatatcaggcaggtgtgaaggcagtgtgaaaggaaataaaactgtaatttatgtaatgtatgttaaatagcccaaagagttgtttctgagctttgaaacctggggctgagaacatagcagaacagaccaggacatgcccaggcaagcccatcgcctccctagctcccacccctctgacctaagttaaatgttacaggctgctgatgtttaaatggaccaatcatgtgaaaccatgccaattcctcccccagccccactccttttctataaaaacccctagcttccaagcctcgtggtcgaatccactgtctcctgttatgtgagatacgcttcgacccggagctccgccattaaaaaacctcttgttgttacatcaaggtgttgtgttctattcgtgattctttttttttttttttttttttttttcatttttttattaggtatttaactcatttacatttccaatgctataccaaaagtcccccatatccacccacccccactcccctgcccacccactccccctttttggccctggtattcccctgtactggggcatataaagtttgcaagtccaatgggtctctctttccagtgatggccgactaggccattcttcggtgcacgccgaatcgggagctgagtgggggtttccccactgagttctttcaagtgcatattgagaagtcctgtttaattggacagaccatcttagtatttgagag

SEQ ID NO: 31316 - DNA, 1174 bp, Mus musculus
caagtaagagaaaaatcttcaagtatttgcccttacaagagcagccatggcgatacaaacgattcagcatgtgttttcacattatagtcactgaaattgaacatcaaatgtacaaaagcacattatagcaactcaaggcgaacagcaaaagctcactctcaggggctggggagatggctccgtggttaagagcacatgcagctctttgggagtccaactcccagcaccaggatcaggcagtgtggatcaggcaggcccaggggctgctaggaaccccagctccagggggtgttgacacctctgacctctgtgggcactgctttcctgtgatccaccacatcccacacacgtaattaaaacaagaaaataagcaaaaaaggattgtactttcacacaatagtcattcagattgaacaacaactcagctacctagttagctgtgttgcttctaagcagatcatgctgtgtcttaccctcagcttgtttgtaaaaaaatcacaagagtgagctgtcattactgacgcctggtagctacacttataaagctaatatagaaacctccagaatcttcaaagtgggaaggattcagaagatgatgaactaactaactaagggacaaagaatgaagttacccttagagcttacacaatgtggggaccgttcacgttccatggttcagagcttacagcatgacagcattgcttaagcgttccttcgttagtgaatcaacatctctctgctgtgtgttaatgtgctggctgtaataaattaatttactggcagaaatagtcttatctcaaaaaaaggaatatattaaaaaactttttatgctgctataagtctcctttcttttccttcattaaaaatctcagagtgagtatagcatactttccagtggggggaaaaaagccagttcattcttctcaattttccaacccatttttttctaagaaaatttgtatcatctctgtgaggcttggcaaaaacataattatcctattcttttaaataagcagtgataattgcactgggttacctgaatccctgccctaagtaacagggacaaatggttgctcacagcacaaagatcaagtgctgggagcatggggtcagcgtctttacacaacacctaatggaactgtcatttttcaggattcccagtcaaagtcagggt

SEQ ID NO: 31317 - DNA, 1111 bp, Mus musculus
tgcctttactacttaataacaatacctgcagggactactacatctcaatgtttgtgtattagtgtatctttagcaccaaccactgtgactaccctatgagatgcagccaactgggtcagaagctgggcactgtggcacacacctgagaggcaggaggatcaggagtttcacatcatctttggctgcatagtcagtaaaaggctagcctaggttacatgagacaaggagaaacttaataagagctccaacgtgaaacttcaggggatgaaaatgcaatatcatagctgttacaagatacatatgcttgtaaaattttccaaacttcacatcaaaaaggaacaaattttcttttgtgtaatttatatcttgagcaatacatattataaaagcctaaataggaataaaggaatgaacttgaatgcataaaagatgcaatgaaaaatttgcctaaagattcactttcactagtagcttaggaatgactgtggtctttattgctaagacaggtacctactaggtatccttgactggtctggaactcaccatgctaaccaggctgatctgaaacttgtagcaagcctcttgtctctgcctcctaatggaattacttgtggccttttctggctttgttggtttatttcataagcctaggctgatcttgaattttcaatatagtgtaggctggtcttgaactcccaaccctcctacctccttcttctaagtgttggagttataggcatctgccagcacattaagtgtcttagtcattgttccattgctgtgactagacaccataaccatgataacatatgaaagaaagcatttaattcaaggcttgcttacagtttccaaggattagttcattatcatcatgggtaataaggagcatggtgacagtaagacaggtgttagagaagtagctcagaatctatatatctatatctataccgatacctatacctatacctatagagagggggggggagggagggagagagactgaaacagagacacagaaactgagggagacagagagatacagactctggacttggcaagatcctttgaaacctcaaagcccatgtccagtgattccctttcttcaacatga

SEQ ID NO: 31318 - DNA, 1305 bp, Mus musculus
gattttccagttaaatgtttattatctatgaaattctatgatcaagttcctcccacaggtgtactgcgtttcttttccatactggccatagataaacagtttataccatctggctgtataacagccctttaccttagttttcttcttgacttaaatctgaaatgattttatatgcacatttcatcttgaaatatggtactagaaatagctcttcaatcctgtatttagtgtattcatttttttttctagaactttccaaaggtgggggggggagggggagggagggattgagggagagcatgcgaattatctggaaagtattgtaacatagtaaaatgatttttctattatatcattggcctcaaacttaatattttcctgcctcagcctctaattgtgcatgctggggcaggaaattcatgttgaattttgttccttttagaaaagtatttagaaaattgtgtgcatgcatgtctctctctcggtgtgtgtgtgtgtgtgtgtgtgtgtgtgtgtgtgtgtgtgtgtgtatggatatggatagatagatgtgcacacattcgtgtgtatgtatgtgtaccatttgcatgtgcagaggtcagaagaggacattagatagtctggagctgaagttggttgtgagctgcctgatgtgggtgctcatatttaaacctgggtcctctgtaatagcatctgcctttaatggctaacctctctttttagatcttttgttttgacttttgtctttttgatgtgtgttttgttttgtatttttttgaaaccgggtttctctgtgtagccttggctctcctggaactcattctgtagaccaggctgaccttgaactcagagatctgcctgcctctgcctcccaagcgctgggactaaaggcatgtgccacccctgcccgtccttgatgtatgattttgtgttacacaggctagcttcaaacacatgtaaacataaacaagactggccttacatttctgatcctcctgtacttcccaagttctgggattacaggcatgtgttaccataatagtgcatgcctaacttgtttgtctccctccccccaatatgtattattttacttgcttatttacttaaatttgtatggtggcaaaaggacgtctatgcgtctgtgttcatgtgtttaggggacaattttgtgtacttgtttatacttttatgtgtgttttacttcagctcaccaggtgggggcagcaaatactgcccctctgatggaccatcttaccagtcccattcttttagaaggacaactatgtgggttaattgatatttgag

SEQ ID NO: 31319 - DNA, 1099 bp, Mus musculus
ttgggcagttggtgcacatgcagctgctgtctatcctcaggaggcttgcttaggaggcacatttatgtttaaaagggaggtgccatgtacttttgaaatgtcattctagcttattgatagctttaaattctgttttatattattcttaatgtgtgttcagatttgacaggaagttgtggttgaattcagtatttacaaggaaaatgtaatgtttacataatctttctatttaccatcttatgttttatatttaatttatatatttctacgttagctacaacttttttatttttttgtacacagacgtgcagtgtgcttcacaaagtgaagttacaaatggaaaagaagttgcaaggaatcaaaattattctaaaaatgcaactaaaataaaaatgaaacagaaaatttccgtgaaaccacaaaatggctttaacaagaaacgtaagaaaaatgtatttaatcctaagaaagccgtagaggactctgagtacgattcaggttctgatgctgggagctcactggatgaggactatagcagttgtgaagaagtgatggaggacggctataaaggcaaaattcttcatttccttcaagtttcttcaattgctgaactgactttgattcctaagtgttctcagaaaaaggctcagaaaataacagaactccggccctttaataattgggaagctctggtaaggcgtgtgtgtgtgtctgtgtgtgtctgtgtgtctgtgtgtgtgtgtgtctgtgtctgtgtgttttaatttacagtaccgtttatagtcagattgtcttcagcccagggaagcatagatgggtggccttctcctgtgtagagtcaaacattactttcattgtaagccaatagtatttcaaatagtgtcatatgacctaattttgaatgaattaaggggtgattttcctgaaaaaacccaagctgattggctgggaatgctgtcactcatccttttgcatagaaacttggttcatttcactgcagaagaagaaattagagcttacttttgagagggagttgtttgctagccagttctgatctgttactgctgagacaccatgcagaaggcaagaatgtggcaga

SEQ ID NO: 31320 - DNA, 1192 bp, Mus musculus
ggtgttgtattccctgaagctggagttacaactgggacctcaccttgctggtgctgggaattaagcctggaccctttggaagaatagccaatgagtgctcagaattgctgctccatctcttgaatcccttctattttactttttaaagacaagaatgtgtttgcctagtgtgatatcaagctcatgattcttttgttttggcctcctgacagctgggattgaaagtatatataggtcttatgtagcccattctggtcttcactcgttgtatagtagaaaatggccttaaactcttgatccttccgcctctatctcccaagtgctagatttacaagcatgtgccacaggaacttagaacttaccaggcataatgtgttttgtgttcaagtattcacagtgtccttttaaaacaggaaatcttttcttattcttttttgacttaaaacctttcaattgctttaaagtgttcatatctgaactcatcagaatggtccttctgtcctttcccacttgttgaaataatcttgtgttcttctaagctgtgacattttgatcttatggttaaaagttctttattacatctgaaaagactttctaggttttagcattctgcttatggtacaggtctgtgaaattccatcctttctttttagcaattagaatgtctttgctaataacagtataccatgtaaaggagagactgttcctatatagcagatacttttaccagttagacagtcatattcactagagtacaaaacaaaactccctaatttatataataaagttggctaaagaaagaaatagcaatttacagaagtggtatcacttcactgaaaaaatactacttgttttgagctttaaaaaatatttttctttgtgcatgcattcatgtctgtgtgtttttatgtaattgtgtatgggtgcttgcagaggtcagaagagtacttgggagctagagctataggtgattgtaacttaacctgatgtgggtgttgagaaccaaacttgggacctatgcaaaagcagtaagtactcttagctcagagccatctcacctgctcttggcttcaggttttaaggtacttgagaggatctgttaacactgaaaacaaagcagaaactttggattttctccagcttcataatataaatgttatggattcagaaatggatttaatgaattgttgag

SEQ ID NO: 31321 - DNA, 1151 bp, Mus musculus
gcacacatacattactctagaactaaacaaagccattattaagcaacctggcagaagaacaaattatgtttgtgggtttagttctaaaacttgtaatttctttaacatgctaaaagtctagtcaatataatctatttttctagactaaatatcactttaataatacattattgtatttaatctgatcatttatagaattcaataaaaattttgatatgacccaatataaaaatgttttatgtaatttgtactgctaaaagaagtaaacaacaaacattgagtaaatatttatgagatttaaaaaatttttatggattgtgttttagatttactttttaaaaatgtacatagctttttaagagtcaggctaaaaggtaaggctcatctagatagttttggattttttttttgtatgtatggtcattataatccaagtgtcagaaattagaatagaaaattaataaaacaagtataaatctgtgatatttgttgtttcttcatcagtttgtcactcaagccctatcagaaggttgggttgaactggctggcgttggtgcataagcatggacttaatggcattctggcagacgaaatggtaggtgtgcaccattgatagaatttgtaattcaacatggcataaagagatatactgctatttaagacattaaggcatcttcccttgctggtgttttgctttcttgtgtttttttttgttgttctttggttggctggtttgttttgtggagttaccaaagccgggacatgttaggcaagcatcctgccacccagccacatcattggacattggagtttcactgaacccattacagtagctcacactttcttttacctttctttatgtttattgctttagttttagccctagtcctccacaactgaaagaagtttatctttctggttatgattatatatcaatgtaaatattacaaaagtatcagcaaaatcatttcagtgtttgagttaatttttcctccaaattacatttactttaggctaagctcaggaagcttgttgcagccattagtccagggattgtcatatatgaacttcactgttagtctgatgtgacctcaccctttcttcaactctacttgtaaaaagtatttattgagcatgagttaaatgctgcc

SEQ ID NO: 31322 - DNA, 2204 bp, Mus musculus
ccacattactaaaaacatcaatgggcctgtgaaggagagcgcggaattcctgattgatgaggacatatcaacttggtgcattcaaggacattcacatcacggtgaccatggggtttctgagcatttgtaattttttataatttcatgttgcatttcacatagtatggacaactttttgccactaactggattctccagatcctcacatcctgaaaatgttgactaatcatttttcaaagcagttttctgaatggggttagttggtgattgtttgtaacaaatatgctaatgctttagaaatgtcagtatttttgtaattatttctacctccagatatatatacatatatatatatatatatagtgtctttcactggataatgtgtgtagatttacatgtgccttatttgacaatgtttatgtcttgttttgcttgtctgatttgaagtttttattatgttaaagaatgcagctgtataggttgttcagtcttcattttattgctatttgatgcagatgttcaccaatgtcagtaagaactcagcctgaatcacaaggtggcattccatccactaatgtccccaggtcctcttcttcctcctgttagaacacatttgtttggctaagcactaagttgttttccagtgagtaggaactgaagcctttctcctgctctggggggtcagttccttctttcattttcttattgcacctctggctcattaactctgccttcgcttgtgtgtgttgctatcagcttcctctcccgcttttgcttctcttaaccattgcccagtcacttctgctccagttttctcttacacatttccttctgctgaatcaccaagatcagcagatgttggtggcatatttctagtccagcagaacagattaacttaaagatactttcacttcaaaggaaactggatgtgacttcataccaaggtaatgctagatactgcatgaaaataggtcattaactttaaattcttaacaaaatataatttaccagttcccaggatttccaatacagaaccacctgaagagaagccattgttcaattccagttcagtgtgggtgacaaagtgaaatttagaagtaaaattgtctatttggtatttcagtctttattaacttttcatttaaattttgcctgtcagtctatattgctgtttttattatacatcagattctttgtataacttgtgagttttatgtgctttgttttataatgtaaatatcattataaataaacttatttataaatgagagatttgttaattattgtagctcatacttttcaagacacccccagtgctgaggtgctaggtaaacacttagatgggtgacacaatcctacagtgctatttttttttcaggtatctgagactctgaactcctgactcagtagatttaatattgaagatatatgactgtatcaaatttatctccccactacggggctgccaggaatttgcaggtgttaatgctacctccttgtgatcacagtacccaggtcgcttagtcaagttgttggaaattgtaccttttaaacccacagtgaatttcccttaacttttctgtgtgaaatgtgtctcccacagtaggctcattggttgtggtgttgttatatctgaattttttctaatgaaatgtagttggattctccctgtaatattttattatgtcttgggtttaataaaaatatttgtgatcattaagttgtatttcacaccctttgtaatggtttttagccctcgttctccttccccagagaagtatgtaatattgaacagaaacaggaccatcttatgtttaagatattgcttggcaatggatagggatttggtacataaaatgaatcctcaattgtcctttcattgggccagtgtcattaaacatcacagtccattggtaggcttttattttctcctttataaaacaggatttcttggcatagacctagctgtcttggaactctgttgactaggctggtctctgccttccaagtgctgggattaaagatgtccaccacccatcatgaaataggttttatttttttagtataagtcatatatgtgtaataagacaccttatgtgtcttgtcttggacaggtgactcgccgataggagttccaatagagtcaaggtgtgggtggatcagaagattgggtttctatttgtgcagcctgtaaagaagggatc

SEQ ID NO: 31323 - DNA, 1197 bp, Mus musculus
aaccatctaaagcattcacactaacatagatgatacatttatactgttctaatcttcatagccattcttaattgcggcagagttaaatagtacagctgttaaagaaatactaaagaaacatcacattttttcagttatttaaggccttaactactaacaagtgtattacctgtgtttttggtcaaatatcttgctattgcgaggctctggtggattgtaagtccttccacctccaaaacagggattttgccaaatggaagagctgaaacagaagaagtggaggctcaacttcagagcacaacaaaaaacgatgagagctcagaacacaggaacaaaaaattatttaaagtcactgaaattcttaaatacagaatttgtgtgtgtatatgtgtaatgtacatatatatgaattttaaaatatacttactttaaaaaacactatactgtttgatctctatccaagtccctcaaaacatctcttaaaagggacaatttcacattctctggtgcagtctttacatgttgttagctttgaaaagtcagagaactgatttaaaaaatcatgtttatgggtggggcctgtgtagctcagttggtagagtgcctgattgttatgcacaagcccctgcaagtttctgggttggatccccagcacagcaaaaatagggtgtactggttaatgccagtaactttagcacttgtgaggtgaagccagggcgatcatgagttcaagatcatttaaaacttgacactgtgtttggacaatgtgagaactggtctcaattaaaacaaataaacaaacaacaacacaaatgcttcctgggataccacaggctgcattgtctcatgatagactgacttataaatttactactttttaaaagacttatttttatttgtttctgtgttatgattgttttgcctgcaagtatgtaattgcactgcacgtgtgcaagtgcctttggaggccaaaagagggactgagatcctcttggaactggttacaaaagtctgtgagcagctacgtgggtactggaaactgaaccccagccctctgtaagagcagcaacttttcttaaacatctctcccgtgttttaaagcttcatcaatgtcatggtctcaaaacagatcacatgggttactttaaaacatattccaacaattacagagtttgacttacacaggagctaagaaag

SEQ ID NO: 31324 - DNA, 1199 bp, Mus musculus
ccactagatattctcatatgataagatatggcaggttaaactgctggaatggtactcagtttagtctgaagaaaagagtaaatattattgttattattattataattattatataaatgttttcaaaatattcctgtttaaatatttgaggtttatgaatacttttgtgtagattgtagatttcctgtagatatgacattgagaataacagtgctcactagtgatgtgagtgagccctatgctgtaactgatggcttttcaaaaagctattgatagtagttattgtagactgcttttggaatttcattctcagcttctagtccatacatctctttacactggatggtccttacatctctctgtcattgattctactccatcaagaacacacaggagccacatgaagagaaaaatctctacattattaatgagtgggtaataactctgaagtttatgtctccagataatttacacagagtatgtgactgagacctcagccaagagtagggacactatggtgtttcttacattttgatattagatccacttgtggcaagaattaggtctacaatgtggattctggatgcgtttctgaccaatctccttggagactcagtctcaggctacgactggatggatggcggtcagagaagggagagaggtttggtgttgtgtctctcactcttcaggacctccgatagataaaacagcgccttggctatgcctcagaaaagaatgtcaagacagagggaagcacggaggctttgttaagataaggcagggtacataatgtagactgattcgtgggctttcagaaagaggacattcttacgtgcctccatagtggctatgtgtattttaaagttattttgttcaaaggatgagatttgcaaccaggtttaaaggttaattaagcaagttttaaaattatgtaaaacaaaaccaaccaaccagccaaccaaccaaccaactaaccaaataaaaaccaaagcatgagaaaagtgggtttacttgcctggaagagtaatggagaaaaatccttcttaacgaatgtcctgttgtgcctgaagtgtttggtggttttatgaggtactgtggttagctttacggatgatagaggatgccagtactgttaaatgcaaggccacattctgtctctgtgtaaacaagcataattagttgattttaatgtctctgag

SEQ ID NO: 31325 - DNA, 1101 bp, Mus musculus
ttcataactgacaggaagtccagccagctcaaagacatggctctagcaggcttgctttttcctttttttctttttttttttccttctgcttttctaaaaacaggttatattctaaaagctagcccccaaggtctatttccttatttgtccacttactcctcctgctgctgactaccaaggatcagctatctattaaagtccagcaatcaaaagtcggtttggctaccctaattaacatgtctaattaaaattgagtaccttgtcctaacactgatttccccttttccctttttaaacttccatttgcctctgtgctgtctatctcctttctttccagaaatagtcttttgtccccattttgatataaatattcccccacccctgtgttccctccctcttcaaatcttctatctcctgtcactgtctcttatttcctgccctttgccaatctggggaaagtctcttttgtgctgagaacttgaccttgggtgtcctgagctgatatagatcccttcaataaccacccgtaactccagtttcaggggatccaatgccctcttgtgaccttctctgtccctaagcatgcacacagtgtacaagcatacacgtaagccaaacactcacagaagaaacaggatgagtaaatctgattaaagagttaaaagctaaggtctgttttgctcctgcctgttcaacatttctgacaaggagcatccttggctgcattatctctgactgagaatgagggttggagatggagaggcttcctccttcttttacggctttaacacttgtgaataatcaatgacatttatttgtttgtttgtttgttgttgagacggggtctcactatatagttctggatcacttggaaatcaccatgtagaccagaccaattgtcttcaaactcacagagatttgcctgcctctgacagttgagtgctgggattaaaggcgtactacacaaagactatcctaaacttactatagtaattgtaccacttatctatcatctggctatcttctttcttctttcttctttcttcttctcctcctcctccttctttcttcttcttcttctttgtcctgggaatccaacca

SEQ ID NO: 31326 - DNA, 1140 bp, Mus musculus
ttatgggacccagtgttgtataccgacccacggcctacttgaaccgggcacacctgggaggcaggctggggctgaaaaagacttagatggtgggagattcttggagaccaagacacgattctgttcaaggcctgccagtttactaagagagtgtgcttataagggggaaggcccatccctcaccagtccattcttggtgtctggagccagcctgtaggcgacatacaggataggatgttcctccagaatatctcaggggcctctcagcaggtagcagtgtcttcagagagcagtggcagtgacagagcaaaagcgcaatctaggtcagaaggctccacactaggtaatctccttcttagtggcagcaaggtcaaagtctagatcagcctgcttcagtctggagcatgaaaacattgacttcattatgggacccagtttgtagaagactgtctcagtgggacaatagtaagttgttttacttccttcaaacttcaagcaaaaggagatggtctttcggagactaatcttgtgctttggctgcaaaactcatgagatgttaggatgtgatactaagaagaatttcctgtccttgttagatagcaaagatgttgaatgcattatctcagggttcactatcaaattagatagttaaatggagtctttaatggtagatatctgtctggggttgtcttagttgactggtgctgaaaagatcaaggatgtcctctttggagaatgtatgaacaaatgtactgtgacaatggcaggaagatgaagtcttacaaataggtaacaaaacagctttacaggagccataggctgcaggccaaggcatagctcaataaagaaccaagccgaggtacttaatgatttgtgagtgcatgtaatagcaatgagatgggcattgactatgttaatgagcaaaagtaggtcttcatatatgaagaattgtacagtgcacagtaatttcttaccgttatttttgttacaagaatataaataacagtgttatttaatttgtattaaaatatttttgttaattaaaaatgcaataaaacaatggttaattaaaagtagcacatttctgaagaatttcagcatgatgttaaattgtacatttttcttaagctggaatattgt

SEQ ID NO: 31327 - DNA, 1107 bp, Mus musculus
accttaactcaaagattgggaaagaaaaattggaaaatttgtcctttatgcatcatttacagaccttaaatttttcatcctcacagaacaaaaggtattaatagacattagtgatgaagaaaagtctcccctaagacactctgaaatagctttttgtacaaagagcatggcctgtcacatcattgatagcaaatggaacaaaatttgtccttaggcaacttgaagcttcctttaaaggagagtatatggctaagacagatatcttatgtcaataaaaagaatggtaagcacatggttttatagactctgcaaatagccattcaaagtgatgaataaaacattactgggggagctcttttttttttttttttggaaggggcgagttttgatgagaagatcttttgtatctctgactccagaaaccattgcagtagttaactctacctccactgaaggcggttctactttatagcatgtgtgtctctcatatcagttaagagcatgttattaatgccgtgccacccgttcatagattctaggagtgattttcaagaatatggatttttaattgtttttgaatgaccttggtttatagtgctcatctgtatgcatctgtaactctgttggttacctgtttgtcacaagcttgccctaagtttaacagcatgaagaagtaagcatgtatcttttcacatatttttgagggtaaaattcacaagcagcttagtttaagatgataggtttgggacctctggactgtgatgggtttgcaatcaaccaggcggccagagaagtctttcttaattgaagtcactgaagacttctgtgggtctgcaccgtgtgcctccagcctcactcacaaggctgtcagtatggtgatcatttactttatggaaggattgggatgagattaattaatggcaaaagcaaatacatgactggatcagaaagaaatacagaatatagaaccatttgaataatgctaagaaaaatggttgaaagtactagaaagaacagcagctttcttgtttgaaggggttgttctaggttcctggacctgctctctggtggctgagcagctgcctcattcaacctcattactgagca

SEQ ID NO: 31328 - DNA, 1217 bp, Mus musculus
aacacatttgtttatatttagtttgtgtcagaatttgaaacttttctcctttaattttatatgtaatagcaatcagaacaaaatccttaagatatacttacatatttataaatataattcatatgatatgattcatcttcataatttgtataaatttatagaaaatagttttattttatatgagaggtagtctgaatacctttcaatatccagatcaactagaaataaagaaaaattaatactaacttcataggcacatgagcttcagttatttcattatagtatttatttatttatttgcttgtctgtatttaagacaagatctcttatagcctaggctggccttgagtttacattgtatctgagtataacctttaatccccgatcatttttttccattctcaagtgctaacagctatattgtcaatatcacatactaaattaatatatcttaaagtgatatcagaagctaacatgccttagcatttttttaactttattccaggaaggagaaaatattttctacttggcagttgatgatatagaaacagatacagagcttttgattggctacctggacagtgatgtggaggcagaggaggaggagcaacaagctctgaccatgaccaaagaaggcaaagttgaccactctaagggacagttggcagctggaagtaaaggtactgcatcttcgtttggtgatctgaaggaagagacattgaagaggaaggtagcttgaattatttgaattatacttgtgtgttatgatgtggtattgttaaaagagtgtttgtcaaaactattcttttcctctgaataccaggaaaagattgtttggggtaattcctgtagggtggccagggtaaggccactctggttcttgttgtcactgtggtatgatacactgtctgtcccctcctgcactggttctgacagtggccagtaagaaggtcactcaggctctgaagatttcatcccatgtacatgtgaggaggccagatctgtagggtggccctgctgtgtcctagagatctgtcttctgagatcttctgagaagctggacattagggaaatctttctagtctggtcacaggagctggtaggattgttaatttgtccttgtctggggatcaaaaactttaggtgatcatagatgatacctgcagtctaggagagggatgacagttggttgtcaactggtgtgaaataaccattta

SEQ ID NO: 31329 - DNA, 1099 bp, Mus musculus
acccggaagaaggtgggtggagctctgtcagtggtggggaatagggtgcctcacctaccgcatctgcgtagacagcagtgttttcatgctgtgcctctactgtgagatcccctttggcagttcacagtagtctatgtctgttgggttcttctcctggtcaagctcagagtgagctgacgacgatccattttctaggaaaagacttgctttgcaattcagaacttattgttacttctgatctgaagcattaccattcaaaggaaaactgcagattgaatttgattttgtaactactgtgaagcataataaaatgatttaaaaaagtttttctgataacatttttggtttctgtttaatatggacaatgttaatgtttgttagagaagacaaaaaaaatggactgtatcagacacaactagtttattttgaagtgggggccaaagctcgttccttgcttgtgaactcctgtgttgtacattgcacaggtcaccttggctgtgaagaggactttgcctgtccacagtgtgaatcgagctttcccagtgaggaagtccttactgagcaccttcagagcttgcaccagaagcccacaggggagaaagagttcaaatgcgagaactgcgggaagaaattccctgtgaggcaggccttgcagagacagtgcgtatgctcagggtggttcagcttgtgtttgaacagtcagattatttactgtgcttgctatgtatatctgtgtctgtgagcatgcgccaaagcatatgtgggaaagtggcaggtagcctactgtgctatgagctcatcttttccgagaggagcgtgctgagtttcaaatgctctgagcatgaggtttacaggtcaacatcattcctgctaagcccttttggtgcatttcatacttgccattaaatatcatgcttaatggtttaataatggtttatgtatgcataatttagccagtgcttgaggttattcaccaagtttcacttatttgccctctaatttgcttaaaactgtttaactgataaagaattcagtgtattgataatggaaggctgggaagcagcacctgtttcccagtgagttggaagactagtttgaa

SEQ ID NO: 31330 - DNA, 1136 bp, Mus musculus
actgtaaaagaagatgaattttagttctggttgggttttctaacagtgtaggttgccagtataatacattattgtggttgattttatgattttacattatactatgcattaacagttatttagtaaggtatgggctcaaattctacaggaatttagttctggaggaatagtctgactaacgatagcaagaaatcacttgatgaaaggtcaaggaaatagggtaatcaagttatgagttaacatggtcattcttttccctataaaaagaacatttgatttacttaaattttgttctgactttttgtggaaactttctctctagagactattttaacagatggaatagagaaaagtttatttgatatatgtggaaactgatgagctgggaactctcaagtttgaaaagaaagacttgaatataacctcgtagaattctcaattactaccatgaaatggtgtggaagggatcctgggtcaacctcagttaatttgtgatggtctttcatccctgtcctaggtgatcctaagagaaaactcatatgctcggtgtgcaatagaaaatgtacctcagtgtcaagcctgcaggagcacaggaaggtgggtgagagcctgtctgttggctggaaggccttctgtcaccatctgccgcagtcacttggtggatgttataccaagacagggcttagctagtggggacgacatgttccacagtacagaagagtgagctaagagtagtttgagttgtgttgtttcatcattagctaacagattctttaatgccaggtgtcatgtctagctgagtcccacagagcacccaccacattttcaagatttttttcagttggtgtttgctcaggaaacatacatcagtgatatgaaaacagacatttttgtgcggagagcttgccttttttattaacatgagtacatttgtggttcagtttggtacagaatgagagctagaagatgatttttaaaagactagagctgagttgataacaatgagaccgattggcactgggatgtctcagggctcctcttagcttattctactcttgacaggaaagtgcatatcgatagctttgtgtatccctgtgtcattggagaaataaatgatcataatcatagaaaatgta

SEQ ID NO: 31331 - DNA, 2364 bp, Mus musculus
caagatttcctgaccacaccattgttaatgtaattggccatattgcttatgtttaagattagatcttcagactcagtcattgtatgtataggctattttatatattccatcatttttattgtggtcctcctgtcctgtgaagcttcattgtgaacttagtgcattcagaacagagctgtactgaccttgcttgctctgcagttgatagtttacatttgaagcgttaatgcctattgtaaaaggaaaattatatctcaggtagcatatggcccacaataaattttatgtataacgcaagttaatatgttagctgcgaaggttttttatttttttttaacagttcgtatatttactacatacaaataaggcaggaatactgcatgctttcctgtgaggattttctgatgatacattagctatatagtatgtcatggcatttccaatgtacatgaaggaaacttggcccaatactagcaactgtccacatgtttatattttttgcttcatctgtgtataattcattattttccaacacttggtttaactgtcagtttaatctttttttcagattcatgagatatttgattgtcaagaatgtatgaaaaagtttatttctgctaatcagctgaagcgtcacatgattacccactcaggtgaattgcatacttcgtatacagactgaaatcgctgcagaagaattacttcaccttgctgaagaaattgatgagtaatcagaagccctcgctataagttctagcttagtcaaatgatttttaaattcttcattttctagagttgggtttgtttatgaagcaaaggttgtttggctgaggcataggaaaggtcttccagaatcaccatctaattcgggaccttggtttctttattcttgacacgataccctggcactgattattaagttaacttatgtaatacactagcatagtgcctggctattattggagaatcaacttttgtgtttgttatgtttctagatacttgtgcattctatctatggtacccataaaataaagaattatgttaatatttgggggaaatttcttaaggtataagttcacttaaacaattttgagtaataggcttttttttttcttataacgtgtctcttctgaagatgggaagctctgtcacatggcgcctgcctggtgctctctgatagcttctatcactggcagaactctcagcattaaggacttgattgacataaacacacctttatttttcatatagaaatagaatttatgctttgaatttaaactttttttaagttgtttatttattatatgtaagtacactataggtgtcttcagacaccccagaagagggtgtcagatctcattacagatggttgtgagccaccatgtggttgctgggatttgaactcaggacctttggaagagcagtcagtgctcttaaccgctgagccatctcaccagccccaaactttttaatttcaaaggcttaactgataaaatagatctatagaaaataagcatttgcatgttaatttgtgaatgcacacatgtctaacacagatgaattacatggaaggcatttttgtgcttggctgaccgtgctttagttagtttatgcatacgacaaaagtacaggaaaggatggatcccctgacccttggctttcatttctgcatgctattgtctctgctcattcttcctagaaaagcggccttataactgtgagatctgtaacaagtccttcaagaggctcgatcaagtgggcgcccacaaagtgatccacagtgaggacaaaccctaccagtgcaagctctgtggcaagggctttgctcacagaaacgtttacaagaaccacaagaaggtaaagatgcttattggcatctgttatttattgtttcactgctagggttttagttggtccttaaccagatttggcacatctgtggcattcggcatgaagggaccagtgtagttagagatgatcctgcttctactttgttaacactcagtccattgatctctgccttctcttcttgtctccagtctgaaaactactctctcagacaaaatgtccactgtgtgagtgggtcgattaaatagttctcagcttctaaccagctccaagaaccggccgttgtagcggatgatatttgtattctcctctctgtgtatttcaatgctttgctcacatcaccgtctctccgggtttcttgtagtgcactttgctaggtctgtcctttcctccgaatgtgttttaagctatgttagcttcctgtggtctaaatcaatctgcttactgagtggaaaggtttattgggcttggttaaaaggcttgagtccatggtttgtttgtttttttatactcgtg

SEQ ID NO: 31332 - DNA, 1195 bp, Mus musculus
ccttgtcttgaaaaacatcctttcaattttctaaattacagcctcaatttagagctatttggctatatataaaacgtgtgtatcagttgttgtgtagctaacattggttaaataccaatgattctgtttaacatgctttataggctatttctgaaatgcatagatataatccaatttcatttatatgaaacttttattaattgaagctatttaaaaaaacaagttaaagacctttataatgaggagaatggtcataaaacagattgatacaaaatagttttacaaggtctgataattagtgcatttaattggattcatggatttgaaggacatgcagcaacccctgggctccatggtggttttggggtgttggccctgttgggctcgagggcataccctagtatgtgcttcctgtactatggtgctcctcctgcccaactgtgcctgtaccacctttgtagctgtgagccctggtgagaagcagtggctctgaaggtgtcctgctgtgttacatttttctgacatgggcattttctttatttgtaggtgagcgcccctatcaatgcccgtactgtgaaaaaggtttcagtaaaaatgacggactgaagatgcacattcgtactcacaccagggtaagacccatattctgtctcatttctgttggtcaaaaggaagccatatctattctaaaggaaacatatttaatatcacatgagaaaattgctataactgaagttatgtcaatgtctagcttaaaatctgaaggtaaacttttaaaagaaaagtcaatggaaaacaactcaaaccccaaagtgtcctgactttccaattttgagtcaatatgcaaggtgccaaactgccagtatgttagtcctagaaaatgtctcttgtagagaacatggtgagtgtaggtgaatgagttccggggtgtaccacatgcaatgtgtcatttctctctgagctgttacagcatctcactgccttgttctcttctgtatacctgttccacatgcaagtttcaggctcatgtgttttaaaagtgttatgtgccagctgtcctgtgatcacacatgttcccctgcttactgcccagcacaagtgcctacaaccctagaactaagcagggggtggctgcagaagaaggatttcaagtccattggcagctacatagggacctggaggccagcttgacctt

SEQ ID NO: 31333 - DNA, 1217 bp, Mus musculus
agatttgatatgtgtgtctcttgatgccttgggctgctcctaactctgggttgcatactctttgcattcatattctactcatcatggttttctagcagcaaacaaattgtgattttcttcaggatatcttccagtatctgattccatgtgctcattggtatttcttgtgaggttttgaaacagctcatctcaccctgcgcatttgctgcagcgcgctgcacacctagaggagggcatcttccccctcagcagccactcacttttctgtggaggttcagcactcagccaatcagccatctttccatggaggctcagcacacagccaatccgcagtcacctttccatggaggctcagcacacagctactaggtctctgaccttcttggtgctctcttccctttacctgcaggagaagccctaccagtgctcagagtgcagcaaggccttcagccagaagcggggcctcgatgaacacaagaggacacacacaggagaaaagccttttcagtgtgacgtgagttgggaatctccttttcttccctggtattccgtggtaaccagtagggatgtctttgtctgtgtatgcgtttgatttgtgtagcctgctcctaactctgggttgcatactctttgcattcatattctactcatcatggttttctagcagcaaaaaaaaaaaaaaatgtgattttcttcaggatatcttccagtatctgattccatgaagctgttcttccagggtgtaaatttggcagagtttgagacaattcagttagacccaagtctttgacaagttagtgacagttgaatcagtaaaatgattatgaccaaaatataatgcatgtgtgcctgaaattctttttaaaattacaatgtaaaaactatatttaactaatcatagatgttaaatacaaactgagttttcagaatatgcatataaattagtttaaacaaaatgctacttaggacatcttctatctaggatatttgaattgaaacaaaataagttgacattgctgtttacactatttttgaagggaaaaagtactactgtgcttggtaaacttaataagagcattgattgggggaaatggtttcatcaccagtggttattggttatatcagtggatcaacccaaatgttaaagaagacaccagggtgcatgtccttcacacacacacagacacacacacacacacacacacacacacactaaa

SEQ ID NO: 31334 - DNA, 1515 bp, Mus musculus
ttggtgacaagcatcattaagcttctgtcccacctagttcccttcatcatatttaacaaaaccaaaaaccaggttctcccagacttgaaactatcctcgaagctgagaccatgcttcagggatgctcagaccacgggtttgacaggcaggtaatctcaggaccatctctgggccgcttctaggtcacctcatccgaggtcctgcacagtacggaccttgtaggtcaccaggacctggaacaagacgccccaaccactctgcgcttgctcattcggtcagccagcgagggcggagccagggccggatacaagtcgctttgggcggggctttaacccgtggtgcaactgggcatagggcggaagagccgatgtggagcggaatgttgaagagacccggctctctaatgtgggaggggcttagggaacaaaacggaagcctgaggcggccttagggagggattcggagttacaaagccagccggaaactggcgacgtaggtggggcttagggctcattacgcctgcgcaccgagcaaccggcgggctgcgtagttatttttgaaccgggtggcggggaatagcttagaagccattagggcgccgtctgcggtgaggttggtagtgttctccgttcgatctagtgatggcacagcagctcgcccgagagcaaggcatcaccctgcgtgggagcgcagaaatcgtggccgagtttttctgtgagtgctgagcgcagcccccgccgccagagagagctgaggctgagccgggccttaggacgcgcgctaggacggaaccacggatcctcccgggggcggggaacgctgcaccacccagcgcaggcctgggcctcctggaacctaacggggctgacctgggtcatcatcttactcgctctctgaaagctggggtctgtgttgacatcctctgaccacatgctctgtatttacacttagcaaacctgcgaagttggacattgctgggttaaaggttttccgtgtctttttgtgcctactctgctttctgggagacttaaacgttattacacggttacggctttatttctttcgttttcagcatttggcatcaacagcattttgtatcagcgtggcatttatccgtcggaaacctttactagagtgcagaaatatggactcaccttgcttacaactactgaccccgagctcataaagtatctcaataatgtggtggaacagctaaaaggtaatcacgttttcagtgtgtgatcttacaggtttgtgtcccaagtaacttaaagcaacatgccttctcaaatgtcattctcaactgggaggaagcaagcaatggagggaatccccacctctttttaagtaggctgaatgtcttgatgttaggaatctttaagctgctttaagagtgggttttgtaggttaaccagttgcagcaaattggaaattttacccgattaaaaggatttcgccattctgtgttttgctttgtagctcccaatgaaatcatacaaaataccaattctaaaa

SEQ ID NO: 31335 - DNA, 1601 bp, Mus musculus
ccgcaatttattaccaattgtgaagaagtccgtctacgctcatttacaaccacaatccataaagtgaatagtatggtggcctacaaaacccctgtcaatgactgacgagacggtgaggaaaaggatggaattgtcattcccaagtgtgcttttccagaaattaagtcaaatagagttgctacatttccttgtttaattttccggtgaagaaagctaagatccgacattgataaatgtgtgttattgttccatttcttgggttcttcctggacttgtctgagtcgacaagagtgctgcacattgttaaggggaatcaacagattttgttagcattgtggaatgaattcctttaaaaatggtcattgtacatagaaaaacttctgttaaaacgctaactacttcccttaacattgtaactggaccaggatataaagaagcgtttaaatgtaaacacagcagaagggatcaaagcttttttagttctgagggtcagtcaggaatgttgccaatccggatccagtgagagaggcagggaggacagctttactattcaaaagttctgtactttactctcattcccaacttaggttcgtttggtctgctgatttacactgacaaagatttggtggtgcctgaaacgagggaagaatcaggaccccagtttattaccagttctgaagaaatccgtctacactgatttacaaccacaagccacaaagggaatagtattgtggcctacaaaaccccatcaatgaagagacggtacacataccatcccccatcacattataccttctgctgtatttatatttagatgcttctttatatcttggtcaagattcttctgagcaaaatcattagacaaagtatttagctttttaaaagaagtttttctacctacagtgaccattgttaaaggaatccatcccacagtgaatctgttggctcccttaataacgtgtagcactcttgctgattctgtggtaagttcaggaagaacccacgaaatgcagcagtaagacacatttctctttatatagaccccatattgaaatacatgctaattatttgattttgttgtatatatcttgagctcacaaagcagttgatgctgtttaatttctgtaataaagaactcttattttaatgttttataaaaatcaagctttaaaagtcagtgatacaaaaaaattaagccttgtgttttaaatttgtgttacagtatctttgatatttagtttggtgctaatatagtcagatacttcagtggattgagtggatggattgtgttcattttgattatgtgatggggatggttttgtgcactggaaattcagatgctgattgctgtgctcagagatcttgttgtaatctggatattggcagttgcagtccttgttataatagtaggccaggccagcatagccgggtcagaacacatgagaacactgcccagttagcacaagaagcttgtaataaaaataccatgtctgtatcatttatttgggaacaagggtggtacagaaaagcctccaaaattacttttacattttgtagggctttattaaccaatcagacatggtggaaaccaatctttacac

SEQ ID NO: 31336 - DNA, 1135 bp, Mus musculus
agaagctaaaaaccagcaagtaatcttcctgagatgggtccaccatggacggaaaagctatgatggatttgctcctttaggcaaggtcaaggaaattacatttcaggaaagattcctgctattaatatgctttgtgttattattacatatataaccattactaggtatggacctaccctttccagcagatttctgcaaacctaaaaaaatgtgctgtcttgtaataatactatatagaaaaagcaataaagattctatagaacccctgatttgattcaaataattttaagaaaattttagagatggtcatagttgccttgctataaagatgtaataaagtgagaatcaagaatagaatgtgctcttccacaggaggcctacacgctgccgtctgtgccgccgccatgtctctagtgattcctgagaagttccagcacattttacgagtacttaacaccaacatcaatgggcagcagaaaatagccttcgccatcactgccattaagggcgtggggcagagctatgctcatctggtgttgaggaaagcagacatcgacctcaccaagagggctggagaactcacggaggatgaggtggagcgagtgatcaccatcatgcagaacccatgacagtacaagattccagactggttcctgaacagacagaaggatgtgaaggatgggaagtacagccaggttctggccaacagtccagacaacaagctgcgtgaggacctggagcggctgaagaaaattcgagcccatagagggctgtgccacttttggggccttcgtgcccccggtcagcacaccaagaccactggccacaggggccgaactgtgggtgtatccaagaagaaataagtctctgggcctttgctgttaataaatagtttatatacctatggggggtgggggaaagaatagaatgtgctcattccccataagagtaagtaaagactgcataataaacaaatacaatgagttttcatatttacactaaaaagaaaaatagatatcagaaaatttgtgttcaaggaaaaacattttggtacaaggataaagatgcatgtatgcactacaggaaggcaaggccatgaaaaaaaaatgttgcttttaacttataatgtcatatt

SEQ ID NO: 31337 - DNA, 1401 bp, Mus musculus
atcacttaaagaaatacaggagaacactgctaaagagttacaagtccttaaagaaaaacaggaaaacacaatcaaacaggtagaagtccttacagaaaaagaggaaaaaacatacaaacaggtgatggaaattaacaaaaccatactagacctaaaaagggaagtagaaacaataaagaaaactcaaagtgaggcaacactggagatggaaaacctaggaaagaaatctggaaccatagatttgagcatcagcaacagaatacaagagatggaagagagaatctcaggcgcagaagattccatagagaacatcggcacaataatcaaagaaaatggaaaatgcaaaaagatcctaactcaaaatatccaggaaatccaggacacaatgagaagaccaaacctacggataataggagtggatgagaatgaagattttcaactcaaaggaccagcaaacatcttcaacaaaattattgaagaaaacttcccaaatataaagaaagagatacctatgaacatacaagaagcctacagactttctgaccctttccgggcgttcaagatgtcgaagcgaggacgcggtgggtcctccggggcgaaattccggatttccctgggtcttccggtcggagctgtgatcaactgtgcagacaacacaggagctaaaaacttgtatatcatctctgtgaagggaatcaagggacggctgaacagacttcctgctgctggtgttggggacatggtgatggccacagttaagaaaggcaaaccagaactaaggaaaaaggtacatccagcagtggtaattcgacaatgaaagtcatatcgaagaaaagatggggtgtttctttactttgaagataacgcaggggtcatagtaaacaataaaggagagatgaaaggctctgctatcacaggtccagtggcaaaggagtgtgcagacttgtggcccagaattgcatccaacgcaggcagcattgcatgattctccagtgtatttgtaaaatatattcattaaagtctctgctctgaaaaaaaaaaaaagcctacagaactccaaatagactggaccagaaaagaaattcctcccgacacataataatcagaacaacaaatgcactaaataaagatagaatactaaaagcggtaagggaaaaaggtcaagtaacatacaaaggcaagcctatcagaattacaccagatttttcaccagagattatgaaagccagaagagcctggacagatgttatacagacactaagagacacaaattccagcccaggctactatacccagccaaactctcaattaccatagatggagaaaccaaagtattccacgacaaaaccaaattctcacattatctctccacgaatccagcccttcaaaggttaataacag

SEQ ID NO: 31338 - DNA, 1135 bp, Mus musculus
cagggcatggtacagagagaacagtaacaaagccatagctcccacacatgaaagacacaagtccacgactaatcctgaggtgtttatattcacaggcatacatgtccatggcttaatttcctgtcagtaatagtaattttagcacacattaagttaaaaatactaaaatgacgttgtcaaagattttgttaataaggtttagaaatttcagtggcagatttaattttcctgcatattgttttagatacaaatgacattatctcatcatcatcacagctagagagatgttcactggctacggccattttactggttttgcagaggacctgtgtttagttcacctccaacacacacacacatacacacacacacacacacacacacacagcggctcacatcctttctagttcccattttctcctaaaaaaaaaaaaaaaaagaatgcacagattgggggtcacagattgggggtcacagattgggggttgctccgtcttagcaaaggagtgtatgagttgaggctggtttatgtgtggatatgggaatttcctagatttttaggccaagctgggtttcccacactgttttggctgggctgcatgcctttgggaatgtcaggtagagtaggtaggctcacagttttatgctggactcgatgtgagcagttgtttcagatgctcctgtgcctgggcctctgtcatggtgaacactccccttctcccttccgccgcttttgccggggctgtgttacacagcatcatgaacatacactaagtgtgtggagggatggttatagctaagtgggggatccttgtggaggttccaggggctaaaatgacatcattaggtagaggctagtggtctgctaagaaaagtgttcatagtcacaaggattggacacggggatgggctatgagtgggtttctgggggaatgaaactaggtcaaggtggtttcagtctggtctgcaacacttaactctccagggtcaggaagttcaatcagttggccttgcagaattgttaccacacttgcgccttttgtttttccttctgtaacttgtttatgataaagtagatgatgactctgaagcacttcccgtgggctggctgctgtgagtgtgctgcctcagggcg

SEQ ID NO: 31339 - DNA, 1193 bp, Mus musculus
cattttattttacctcacaacatttctttcctgagagacccagagtctgctctacagctgcctaaaggactccgggaccctaccatgtcacctgtagtctgcacctcagtttccatgctgctctgtgagaaggcatcgttatacctggaagctttcccatagactaactatggaattcaaagtggatggaaatgggctttgaaaagcagccaaaaacatttcactaaaaatttcactaagaagcatcattgtttatgaggcttagacaaatatgcttgctgcatatttactaagtgtcataactgagaaaagctacctcagaatttaaaaaactgctggtgtggtggtggcaactttaatcctagtacttggggatgaagaggcagatagatatctgagttcaagaccagtttggtttacatagtgtgttctaggtccacagcacctatatagtaaaactctgtctcaaaaaagaaacacacaaacaagaacaacaacaaaattacaaaagttttgggaatatatttgtagcagtgtatatgtgtgtgtatacatatacatatacacataatatatatattattgatgatcaactataaagaagacagttataagaaaaaagggtaaactaataggcaaatgaacaaagaatgagtattttcattgtaacaattcattgataaataggaaatcttcatttttattaagttagaaaaagcaaaacattaacagtaccatcttatttataaaatattaagatttaagaagtgctggggagatggctcactggttaatagagcttactgctcttgcaaagaatagggctttagtttctagcacccttgtggtggccctctatagcctgtaactccagtttcagtgaattgaacatgctttagtgacccccataggctcctgtgtgcatgtggtatgcaagcacacatgcacacacacaaatcctaaaaactgctgagtaaaatagatcttaggaactatttgttcattattttgttggtagcgtgctaataaaagtttctttagagcagaggggttcacaagtcccacccctaactgatgaaatctgataaaaattgatagcttctaggagagggggaggccatttctttcatggtatgttaacccctggtaggtaaactacacttcagtgaatggtcctataccatgagtctata

SEQ ID NO: 31340 - DNA, 1148 bp, Mus musculus
tcatcttggtaggccatgaggaggctaagatgaggtctctctctctctctttctctctctctcacacacacacacacacacacacacacaccttgcctcacagcacccgagtccactaccgctgcctgataagtgcagctgcacatttgtgattctggggaggcgcctttgtgctgcctcacatagcactggactggatacatgagttctagactccattgcacccttctcagaactttgaatatctgaaatttgattcttaaaagaagtgccagaacacagtgcaggccactgcagagaaaaaacagttcttgggacacctaagaatttcaatacaagccggccatggttatgtgtgcatttaatatgagcattctcagaggcaggcggatctatgcagtgagttctaggactatgtagagaggcctctgctctagaattccctgcagctgaatacaaggcctgctgtttaactccggcccatcctgcttcagaagctgctgctgaaggatggctctcttcctttatttagctgcagtttgccagctccggtgacttcgcttcttcctgcctttggttatatttataccaaagtaaaatctcagacagggtgagcatgaagggaaccgaggtgctcttgtataaagttttgcctgggatagaagtgcccagcaaacactgaccctactgtccttataatcaatgccctttggggatccgttgggccctccctttatctctccctcctcccattttctgtgtgtctttccctttcaataaaagtggcttattacatgatttctaccaacatttttagtactctgatggcagataagcaccactctctctcccttttggtgcttcctagaaaactgtttgctatccagctggtgatcccaaatctcttgggatcactctccattttttgaaaaatgtgttgactggcttgcctggtaatttacctcctgttcctcatatatatacaattagttgtttaattatatatatatatatatatatatatatatatatatatgtgtgtgtgtgtgtgtgtgtgtgtgtatctggaatgccctaagtataacaaacatgctattaattgctgtttgagtttttgaagttctaaaaataaatcataaatttaggta

SEQ ID NO: 31341 - DNA, 1103 bp, Mus musculus
gcctgaaaggacagaagttcaaggtcgttgttggctacttggggaatttgagatcagcctgggctacaagagaccttatctcaaaaaagaaaaaacccagaaactcaactcttcttcctaaaaggttgttttcaaaaacaaatacacagaacccctaattgtaaaaaatgcttttcagttctcagttttaatcttctaacataagaaacatttctgggggctagagaagtggcccagtggttaagagtacctgcttcttttccaagggtatcaagtttggttcccagcaatagtgtcagtggttcatgaccacccataacccttgttccatgtgatctgacaccctcttcagcctcggctctcacataaaacacagatgacatacattcacacagacatacacatagaaataaaaataaaatttaagaaagtaagagttgtggggcagtggaccacaccaggaaacttggtaaccaggcccctgtcatgtgaccacactccctacataggaatatgacctatggtcatgtagatcagaacagagttctccatgctgatgcggtatctagaggccctgagggtttagccaataagaatcctttcccagacattccttcctgcaaaaggtatttaatccatggcccaccttgaggaggtggtttgcacccattttccacaactaataaacaattgccactgactaaggacaggctcacatgacacccccacccccaccccatctcctcagcccatggacacaactccatccccagctcccctgatccagcagctttagatgtccaggagtttaggagccctgggctccgggctcctcattgcaagttcctggacccccaacattttatccagactcctctgttcagtttccagctgagactggatacctgggagtccccagctttggcctcccacatccataggctgtgttttctcacctcctgagttgtatattggtgtttccagtgagcccattacctgaaagtggacataaggtcaatgtaatctagtaccctgcgttttgtctgcctggctgagtttccataccactgtggcaagatggaaggtggagtgcctcctgtttt

SEQ ID NO: 31342 - DNA, 2871 bp, Mus musculus
atggcaacacctaggttctcttgccaccaaaacagttctcaaagtatttagaaattatctggcacatgggagtgacagggatttttgcagacaagaagggtggaaggcaggctgctgtttgaggagctgggggtgtggtattccagagtctagtcatcaatcacagagaggccacatatcatgggggtcttctggtcctgcactggacactgaaccctggctcaagtttgtattggtttggagtcctttctaggtactctagtgagagcctgttctgcttttcagtgattgcacaggtacctcagtctatgttaggtttagtctagtttagcacttctgctaaaactgcagggtgctttctgttggctgtaactgaagcatgaatcactcagaattattaacctgctgttaatagtttacagattagctctgatttctattactgccctgctatcattgctgaccacctcagactcctggacttcatggaggaagaaccaagtcttaacactctttttcccagtgaggttatgggttgtgagaccaagggaatccaagcctgtggcccagctgcatgtggtacccagctcctgtgggcagtctgtagagaggaaaaggagaagcaataaggaagttctgtagaggaataggaacactcattttgtatggagaagatgtaccacctagagatctctaagagacatttacatagtttagaatcaatcaaacagaaaagataacatctctctcaaagactccacaggcttccttgagacagacttatctgacatttttctttggcttatctttttttgtttgtgtttttttttcaagacagggtttctctgtgtagctctggctgtcctagaactcactctgtagaccagtctagtctggcctcaatctgaagagatctgcctgcctctgtctctaagtggattaaaggtgtgtgccaccaaggtacacttccaaataataaagataaaggcagtaagttaaaatggttaattctgacaactgccagcatttgctgagtactgcttgtaccagatgcacacatcattgcatttaattttcttagcaatgtcaggagccctgaccctttattacttcttttgcaaatggtacacagattttttaaatacataagtatgtaagtaagtaagtaagtaagtaaatcaataaatgcctgaggtcgcacatagtgggactacagttcaggctatgtgactcttaagatgttattatatacatcaccctgtgaagtttgccctgaatagcagaatccaggatggagctggcagaaaagaatggcatgcacccgctagcctcactgaataaaaggtggtccccattcaggggctcattttcacagttggcccctcaagcagtatgagctgaagtgtggagtggagggaatttgcaagaagccggggaggggttaaagagaacaggacaactgccccagaccctaggtggggctactgtaaggacacagatgattgcaacattccatgtgccctgagatgctgggaaggagccaggagaattagccaatctccataataaatccaatgggcaggagctgttggccctggcagccagagaagtccttactttactgggtatctaagaacacctgaggcacttgcttcagaaagctggttccagaggtctgcaactaggcccagataaacagcttaaacgcttctgtggaagactttcctgaaataccagtagtgatggccagcctctgcctctggctcctgcccatctttatttctgcctttaattaaaatgggcctatttagaagaatgctactttctgtccatgaatgacttttcaaagctctgactaagccctgaatgattctctttttgatgacagtagcctacagggttgacttcctttagcatgagaacgttctattagtggacatttttctttgttacaaaagttcaagttggtttccatgacaggcacttccttctgtaaagtgctacaatgctagacagtctgcacttgccacgcacaggcatgcttctacctggtgctccttggtttcagtgcaggtagtctcaggaccaccttggggtactggtgtagcagagccaacaagggattttacaggtaaaacccaatgaagccacacagcctgcccattcgcctgtcctgaacactgtagactttttcctcagcctgacttttatctcctcagatcaagatctgtctgacagagatgtgagctacttgctgtcttatttttttttaaagggccacatgaaaagaaagatggaaaaaagatattacgagcaatgcttgtagcttaatgtaacgcatataaggctattgagatggtttacatttggggcgctgcatcactgaaacactgaatcttaattggaccagtgacatttgagtgctcaatagtgacagtgacagcaccatatcagcttcagcagtggctgtttcagtgcacagagggatctcagacgagggtactgtcaagcctctcaagtacaactctgacaaactccattttcattttccccaattcttggcttctggtttagctgaatctaggctctgagcacctcaagccagagctactgtatcatccctgaagcaacacccttgtccccaaccttccagtctcatctggcctgaccagcccagtccagccctaacttatagctctgaaaggccgacttgaacaagatgcaggggtttcccagggtgcccctggcaaagtccaaagggtttgcattcaaggccctctcacagttctgcatcataataaaactcaaccacaaaagaagcttgtttctatatagtgtgcatcaaatgccaggtaccaggtgagacacagc

SEQ ID NO: 31343 - DNA, 1686 bp, Mus musculus
agcttcacaggcagccctgcccctttctcctcaccagcatggtacctgcccttactgctagagcagctgcttgtagagggacattccctccttcccagttttaactggtggaccacagtggggggaaaaacattcaagcgatataaagacacttgggctctttgcagatgcctatacttccaacactaccatgtccacaaaccaccctgggggagggcccttccaaagggaggcttgctagtttcagcgtctagcagttgggtcctcacttttactccaattgtgaaaatagcccacgtaccctcgcagtgtccagtagggatcccagaggcacataaccaagaaaggattttgactttgtcacagtgactatttaaaataatctattcgaagtccaaaccaaacacaaagcctgtgatattttaggttattaaggtaactgctaatgaaggattttaaaaagtgtcctcaaaaaggacttagccccgggagttgtttataaaatttcccccacttgtatacagtgtgcactaaaagaaaatgtattttaatatctaatgcctgggctctgagcgtcatgcttcttggtggtaaacatgcagtcctgttcctaagtgactcagaggcatcagaatttctccacgttacccatctgcttggcactcggaactgagcgtgtgaaatccatagcactgcccacaacctgttctcactgcttagctcccagctggattaaagacacctgctcaggcgggagagagagagagagagcgagcttttaccttggaaaaggtaaagatggaaatgtacaccaaaaaagacaatttttacatttaatggaacattctttttttttacaagtatatttttctactgatagtttcagaacactaatcttatattcactctaatcttaaacatgtttctttaaatatttataaggcagtttattacagaatattttcatgcaatcatgtgcacattattggtagcaaacatagtatatcctttagtactttaacatatttttgttaaaatacttttaatggtaagaaatgaacttgaggtcccaggaggttttgttgccttttcattgattagagacaataaatatcttgtaacttcctaaccagatctgagctgtgctcacaataataataatgaaatcagattctttgatgctggactcaggagggaaatcattagccaactgttgacttacttatagctagatgtctatgtgagaaagtataatatatatatatacacatatatatgacatgtaagagtcacttttatttatctgtctttgttcacttatgaagccggtaactgcagcagtatgttggtgatgtcatgatgcacagaagtcccatgtggagtgtttttcccacactgacaacttggcttcctttctgtgtgttcagtctgttgtctgaactaacactcccgcgagcactatactctttatactctgatccccctagttcatcttaaatttgtccgtggccctggcaagatagcgtacacaagattccatgactccagagcatcttgaagaaacatacatattttgaaagaggggaaatgtagcagatagttcacaagctgcgggttgtagctaaatattccatttctttgaaatcatgtttctaaattctttaccatcagaaagaaaaggagtgt

SEQ ID NO: 31344 - DNA, 1181 bp, Mus musculus
tgactgtcttggaactcactttgtagaccaggctggcctcgaacttagaaatccgtctgcctctgcctcccgagtgctgggattaaaggcgtgcgccaccatacccggcaagtttttattcttgtggacaaaatattttcaaattctcttaatcttaacttaatggataatttataggttggttttctagttcacttattggagatgtccccaagagacaaaagttgagtaaaggagcaaatgtcagtgtatgacttaccctgggtgctgtgtacctcatacttacgccttaaagctttaaatggcgatgctttgttaaagaatcccttgggactggggagttggctcagtggttaagcacactggctatccttccagaggtccagagttcaattcccagcaactaaatgtggcccacaatcatctataatgggatctgatgccctcttctggcatgaggtgtacatgcagttagagcactcaaaagtaaataaagcggagaggggaggggaggggaggggaggggaggggaggggaggggaggggaggggaggagaggagagagagaatttctctaccattgggggcctgggattctaggtcagtggtagagcagttgcctagcttgttccaggcccaggctcagaatttgatctctagccctacaaaacagcatcaggggcaaaatctcaatattgaagtttaggcttcaatttctatggttaacagtgaccgttaccttaatggtgatcaagagccattactaaaacaagcctctgggcgtgactgtgatgggtcatctagattaggatggataaaaccattccatgggctcggggtcttcactgcatgtaaaaaggaaaacagctacactgagcatggtcattcttggttcattcctgactgaggatgccatgtgaccaaccacctctagctctggctgtcaagccttccccatgatggactaactgtacccaggaataaacgcttcctttcttaattttgttccaggaacaatacaggtaactggcactaaaataccatctttaaaataccataatgacacaaaccactccgagtcaccatttggagactaatgaactgtgttccctagaactccagggctctacccattagacatttcttagaagttctctggaaggatgcagctgacaaagaat

SEQ ID NO: 31345 - DNA, 1113 bp, Mus musculus
aaacagagaactattcatgcaaataaacccccagtgcccaggcattttctcccagcaaaattaaggttctatatttgtctaattatttgcttgcttttttctctatcaaggttcaaactggcctaaaattttctagatgctcagactggccccagcttcccaaaagctgaactggcaagcatgtgccgccatgcctggtaaaatctgagatttgcacgcattgcaaaaccagtcctgcaggtagtttccttggcttgcccatctagagcaagtgttttcctgggtgtcaaggaaggggaggagggaggagtggggtgggggggtgcggagtggagaaggaagggaaggaatcatttcatcttgatttttttttaggttagcacagcgtaatgggcttaattttcatatgagtgtgtcctcatctggcttattctcctcccacgcggtcctcagaagcctttcaaggtctgacctatgagtggactttccatcacctctcactcctcattcggaatgggcatttgggcagtgtgggaccggaagtaagaccctgctcctgagagtgtggaagagaaagcaccatgagacaagactgggtaaaaccaaagacttcctcagccacaaggcaattagggaaccaggatacatcttcaaagggaggggcaggggcaggacctctatgccagtcaagtgttttaacttggtgacaaaccgcaatgagtgaagggaagcaggggtggactggttggagactgaactcggaactgctttggggatcctgccacgctgtcttggggaggggggggcaatgtcacccactcccttcaatctcttgcatttaccagccttgcccagcacttgtgaagttcttgctgctgtcttatctgggctacaagccctttaagggggactctgcctttcagggggaatggtaaatgtccgaatgaagacctgactccagcatggtgtctggcacaacaccactctctcttaaaaggaaaaacaaaacaaaacaaaacaaaacaaaattattcaacactctggaaattttgatctaagaacctgcgtgaggaaaaagaacctattatatttttaaaaataaaacctttattt

SEQ ID NO: 31346 - DNA, 1158 bp, Mus musculus
atgttgttaggggtaagagatgtcctaacttgaggtctttatgaaacagtaagacacattagtaatctctgtggtgctcttttagttttgattgattttctctttgcttattgcttgtctactgagttccactttttcatagactttgtatgaacactcactactagccagcacactggaaattgggaaccaaagttgacttagactctgaccttatataagcagaggagtttaccaactaagtaggaatagataacatttacatttttatggagaatgcacactagggaggagttgtggattgttacaggtgtaacaccttcttgtgtaatacttggtaagattatttatccaagaatagacaggtatcagagaaagggtttggactcttttgacccagtcactatggtgatggccaggttaattacagtccagcccagggtcaggagagttgagctgactcatccagtaaatacaacaaccaaaagtcaggccaagccaggttatcaggttggggttcgtccacacgggcagcagacaacagctcaccctggagctgctgaggtgatatcactctggctgacacaagggctgttggcagctaaaagactttcttttctaatctgtggctttccagcaaggacagagcccagggttaaacaaccccctgacttcacaagagtcaagcttgcatctggtgccactctcaagtgataacttcatgaggctatttcctctagtagaataggagagatagagccatataaggctatttcttctctaaacttgacattcattagtttcttcctgtcttcaaattacacaaggtgtgatttcacattggtggctcctgtcttttctttctttccttcctgtctctctcccttcatcttttcttcaatcctggaaactgccatttgaggcgagataagcatgatccgccttggctgcagagagacgcaggaggtatctgtatcttggtggtctagtggtttgcagaagtatttaagagactcaaggtcaagtagatagagagagagagatgagaaattatttaaaagctgctactgccaccacaggagccatgatctatggagccattggcctagaaagcccttgactgtcctgtcagagactgctttattttaaagtctgcct

SEQ ID NO: 31347 - DNA, 1134 bp, Mus musculus
ctgaatatgcactccaccactgagtactgctccaactctgagattcttttcttaagattagacaatgcatgagacagccaagcctgccctaacctgaaataaagtgactggcaggtacttttaagctgtgtgctgtgaatatttatgtgctttagtgcacacaataacaatgtgctggattgggagcttgaatcaattgttgttatatagcaaattgccctcagaacttagttgtttttgttgttgttcttgttgtttcgatgtttggttttaaacaatgagcatttattatgtcaagaattcagaagcaggctagcttgatgatttgggctcagaatctcttatggctaatatggtaccgcagacctgtaattccagcactacggaggctgaaacatgaggctccctggaggaaaaccagcctgagttgcctaatgtagctagggctacaaatctgatcttatttcataaataagtaaattttgctggggagaagatggcttcagtagataaatcacttaccatgcagacatgaggaccaagtctccagaactcacagggaagtcaggcagaatagtgttcatctcccacctcagtcctcccacggggaggtgagaagtggtaccctctgacacctcagtcctcccacggggaggtgggaggcaaacacaggactggtataagcaacagaagacagcaaaggggactgagcttctgatagaaggtgaagaactaactttaggttgtcctgtgacctctactcaaatttctgcagtttacacacaccaatgagcataaacacacacacacacacacacacacacacacacacacacacacacacacacacatacacgccaaacaaagaaaataggggcttgaaggatggctcagcagtctcagccaacagtgcttgctgctcttccagcgtgcttgactttggttcttggcacccacattaattgtctcacaattgcttttaattctggctctaagagatctgacacccttctctggttttaatggcatttacatgcatatgtacatacctacactcatacataaacataataaaaaatatatttaaataaatgaagcctaatacgtctcggtgtatttttaagctggaagaat

SEQ ID NO: 31348 - DNA, 1298 bp, Mus musculus
aaacacttaagttaaaaggtttttgttagccgggcggtggtggcgcacgcctttaatctggcctggtctacaaagtgagttccaggacagtcagggctatacagagaaaccctgtctcgaaaaaacaaaaaacaaaaaacaaaaaaaacaaaaaacaaaaacaaaaaaaagggttttgttgtttttggttttttttttttttttttttttttttttttttttggcgccttcctttcctgcggcgccttccatccgtcgccttctcgtcttgctctctcaggtccctccggaggaggccgccgcgcgtctcccggggaagcatggcgaggaaagcggtgtgcatgctgaagggcgatggtccggtgcagggaaccatccacttcgagcagaaggcaagcggtgaaccagttgtgttgtcaggacaaattacaggattaactgaaggccagcatgggttccacgtccatcagtatggggataatacacaaggctgtaccagtgcaggacctcattttaatcctcactctaagaaacatggcggcccggcggatgaagagaggcatgttggagacctgggcaatgtgactgctggaaagaacggtgtggccaatgtgtccattgatgatcgtgtgatctcactctcaggagagcactccatcattggccgtacaatggtggtccacgagaaacaagatgacttgggcaaaggtggaaatgaagaaagtacaaagactggaaatgctgggagccgcttggcctgtggagtgattgggattgcccagtaaacatgccctgtgtggtctgagtctcagactcatctgctaccctgctaaactgtagaaaaaacccaaaccattaaactgtaatcttaagagttgtaaaaaaaaaaaaaaaaaaaaaaggtttttgttttgtttttacctgatgtattctcaggatttagaattgaacctggagttctaaattttaaacaaaataaagtaacatgtatttcagagccggactctttaaagagggtccaagctgatatatcagcatccatatgagtggctcgtagctatttataacagatcctaatgcataacagatcatctctatgtccctagcctagcagaatttctagttctgttctaggggattccacaccttcttctggactgggcaggtacgtccacacaggtggcattcactagatagacacacatacacatgaataaaaacatttttaaaaacatgattcagtatatctttaccagccattaccatctttggaaatgctcttcttgaagcattagtgg

SEQ ID NO: 31349 - DNA, 1159 bp, Mus musculus
cagcctggtctacagagtgagttccaggacaaccagggctacacagaaaaaccctgtcaaaacaaaatgaaacaaaacaaaacaaaacaaaaaaaagaaacttgtctcttttccctttttttctcttaatcttccctcattctatccttcggatgatggtgagaaaatttaaactttggtgtgtaattaagccagtattaaaaatctaaaatgtcaaattaaactgaaataaaataactatagggcagcaagcactaagagagcgttttgcttttcacccataatcattacaaagcaagaaaagtgcagacacctcaatcattagcccatcaaaacctcgcaggaggcacaatcccggtaaatcaggatctccagggagcctagcctgtaaagcagcagcaattaccttgcttctctgaagtcagcccgactggaggctgagtgctgccctagcctcactccaggtgtggaagaaccggtgttattatcgctacttaagtgcagactgtcagattctgcgctaagaacgaagaaaaccagtgggacttgtcagtcaggtgcccaactaaagtttcccaggttatgcgcatagcagtgaggaaagcaacagcagtagtaaacagtgccaagggagaatggatcaaaagtttgactggagtgtggtgtggtgatgcaggcttgcagtatagctacttgaaggttaccctgaactacccaggggagtcctgtttcaaaactcaaagcgcaaaacaaaacaaaacaaaacaaatctgtctttccttggtcttaaggcttaggcacctccccatcacccaccccctcgcaccctgcaccttccccgcaccccccccccccacacacatataattatcgtatttgtttgctctgtatgtgtgtatgtgtttccagggtgcaagtatggagaagacaacaacctacaggagttagttctctccttctaccacgtggagcgtgggcgttgactgctggtctttaggcattggggcaagtcagtctatttgaattttcgtagctgctgagatgctaaagtggaagtttgggatttgggaggctatcttagggccgtggagcatttgtaactgtggcttctagagtggcagtatttggcactagtcactatcacgctcagccgatcttt

SEQ ID NO: 31350 - DNA, 1142 bp, Mus musculus
ttttgggggtggtggtgtctttcaatgaaggcttagagtaaaacatccagttcctagtagatttataaaagggaagagttctattaatatatttggaagcatagtctggagtgttagaaaacatcacttgggcagaagtactgagcggattaagcttcttgacattacatagttgaataagacatttaatttctgtgttagggacactagatagtgttatttaaactactaaaatttacctcctttatgactgtaattcacagaagtacatgaataagttgagtaaataaaacacatcacatagatgaactcaaaaaatggtcaaaacatgaagcatgattttaaattattcaattttcatcacaaagccaatttatgatcttgcctgtaaactagcataagtcatcaatggaggacatttttatttatagccaggattacgtttgtcatttacttcagaaaactttttcacaatagtagtcaaccttttttttagttacgtccaagtcttccatgggttgtactgggtattgaacttagaaccttgtccttgctggggaaaattttgcattacacatctcaaacccttagatcactctttaaaaccagagttgattttaaataaggttatatatacatatggggaaattttgaataaaacttccagttagtgctgtgtggtggtggttggtagacttgtaaacaaagtacctatctgtaagagtggaaacaattgttaacctatggtgtgtcctgtgtctcgggaacacaatgctggaatgtaatgtttttctacataaattttgatgcatttgtctatttgaagaacttgaattggcaaaatgtcattaaaagtagaccaggttttttgtgtttagcaaaaaaagaaaagcaactctggatattagtgcagttaagaaactcatgtatctggtaagtacagtaaaagaaccttgtatgctttttaaaaaattttttttcagtagatgaatttatattttgtggtaaaagtggccgaacccagcattttgcaaactaagtgaaagtagctctcactgagctacactcccaaccacttgatgagtttagtaagtttttttctgattatgtaggcctcatactgaatattgggtggggaagca

SEQ ID NO: 31351 - DNA, 1198 bp, Mus musculus
tgaatatatcctgatggtgttccattttcttagaattagtcacatgtttaaatattttacaaaaacaatttctcagctgattttgtttttttgactatcaacacctatggcttggaaattagagcatgtctgaaatgttaggcatgcatttaactatcaacttgtcctttagactaccaataattcaatttaaattggttctttttttgtgagtttcgtaagttatcaggagaaataaaggcaggaaaattagttaatgctttaaataccacttagtgccataagttttctattttcctttttttgagagggttctgtgacaattcagggctgtgcatgttactgacaccctggtaatgagctacatttgcagccccctgagcatgtaattgctaaaagaaggtcttagagtgtctgatttgtgaagatgctttgaaaacaaatacttgcaagagcagacctagaaaaaggctttctatccatactaataatgaagtacttcctactggttacatgataatattaaaaacttgggaatgtgtacacatacttggactgtgaatgttttgggtctgtggaaggtttttttttttttttttttctgattaaatagctttgcttgtttggattgagtttggcacatggtctctttgtaatccagattggccttgaatttgtaaacctgccttgcccagtgtagtgttagtgttgtaggactgtctagttcaaatagccatcttaaagttgtttctagaataagtgccttttgttttcctttcagaattacaattttatagaatcaagatttcactattggctcatcaagattatatagaatgatacagagtgaatttcattcttctgaggggcatatttagtgaatgtccagtgctttcttatttatgaaagctgctggtattggctttgatgtcttaaaagccaaaaatatatcccttgattgaactatctgtaagtttagaattttgtagtaagactgacttggaatggtacctagtgatttctgtgccagttgtagaatgcttgtagatgaagtttgagatatttactgttgaataagaatgttttagtttagctgggcgtggtggcgcacgcctttaatcccagcactcgggaggcagaggcaggcggatttctgagtttgaggccagcctggtctacagagtgagttccaggacag

SEQ ID NO: 31352 - DNA, 2097 bp, Mus musculus
tgaagaaaaaggtgaaggaggtgaattttcagttgataggtaagtattaaataaggttttattgctttgtcatcttatagttagatcttaacataaaactgtaagttggacagagtaggtggagtgattactttgtgtatttcaggaaatgtaaatgcatgttatttacatttttgataacatgttttaagttagctatcttagtagtaatttaattaagtcagtgcccagtttcttttccttcctgtgagtttaaaaggacagtggtattggttctccctcatgtcacatgcagtctccatgcgatgattgtagtttttgtgtgcatagataggtgagtaacgtatgatatgcaatgaggcagtaagtgaatgtggtctaaccggcaatgctttaaagactaccaaagcagtttttaattctcccatatatgagtagaaataaacttggaattttctacaccatatgtttagttgttgggttatgagccagtacgcatattctgtatttttgagcttggagtggattttgccagtttctggaaacattagaaataaattttttaatttgtttgtagaccgattatcgaacggcctatccgaggccgaggtggtcttggaaggggtcgaggaggccgtggacgtggaatgggccgaggcgatggatttgattctcgtggcaagcgtgaatttgataggcatagtggaagtgatagatcgtaagtcttatattgattgttgcatgtatgagatttaaatgtgtttatttaataaaaacaaaatttgaatttctagaactaaagagtataatgttaactcagttttgttagttctttttcacattacagtggcctgaagcatgaggacaaacgcggaggtagcggctctcacaactggggaactgtcaaagatgaattaacgttggtattctgattttttttttaaagttaaataatttcagtgaaaccaaaactgctaacttactagtggattatcagtaacttaaattttgttcctaaaggaagaatggatgtatattaatagtatacaatggaagaattagtacataatgaagtatattaatagttttattttgataatggatgtgtatacaggcctgaagtcctgtgatgaggatgctgggaatattatgactaatagttctaactgtagctattgtagtcttgtccttacagagtttgataagccctcttcctctctttctctgtttttgtttttgtttttttttttggcgatgggctttctgtagttgaggctagccttgtacttggtatgtaatttacagccatctcctactgtgtctgacttagaaagctttgttttaaaagtgtgtaggctaatttaataaatttgttttctcaggtctactggagagtaaaattagtagaaattagtaaatatataaaaatgtaaaagtttttactttggtatgaaggaattttggctacatgtaaatggacctagatgcctttcttctttctttccttagagagtcacccaaatacattcagaaacaaatatcttataattgcagtgatttggatcaatcaaatgtgactgaggaaacacctgaaggtgaagagcaccctgtggcagatactgaaaataagtaagtgggtttgtgtgaggaaatattactctgtctgggtgtttaccagtaaggtaactgtaatttaatgcagttatttggtcgtaccagcatacaatgagactttcttgatttgagacattgtcttgtgtagttcgggttggtctggaattcaggattctcctgtctcacttgttagtactgggatggaggaagtgtactaccacactgttggctggataattgtactgttttcccacaccttagaaaggtgtatgtatttggaaagaatgtatgtatttttagtaaagccttttagagcgaatcataaaaaatgacctgtaactactcaaggatgaaggaaaaggaacaaagtactttgtatttgaacttacatgataggatctagtagtgatagtgttctactctgaataggtaagattattaaaaactgaaccaagtattggttttgttatttggagtgtttag

SEQ ID NO: 31353 - DNA, 1076 bp, Mus musculus
gccttgggaaggtaggtggtcctagttttgaaagaatatagattttaaaaccctcagattacaagtagaatctacaagccttgtcatattggaatagcaatttgaaggcagtgtcttaaatgctacaaatactgctgaagagtcacaagagtggggacttgtcacttgtataccaggaatcaaggattggtatcgcctgcagtcggaggaatttgttaacgagaattcattcttcaagatcacttcctgagccccaaatgaacttattacttgttgagctagatagtagatatatattcatgcacataaagtacagcattcgtgattcatcttttagtggagaaagcatgttcaaaaattttgcactattgcttttatattaattactcaggggcccttacttaatattttaggctcatgctgaagattcagttatggaccatcatttccggaagccagcaaatgatataacatctcaactggagatcaattttggagacttaggccgcccaggacgtggtggcagaggaggacgtggtgggcgtgggcgtggtggacgtccaaaccgtggcagcaggactgataaggtaattttaagatgcctttccgttttaagcaacttaagacttgtgattactggctagatattttggaggaaggggcataaacagaactaaaaaaagaactaacaagaaacaccatttgcaacaaggtttcactgtggatttctggctggcctggaactcattatgtagactagactatctttgaactcatatctgcctgcctttgcctgtggagccctgagattaaagccatgtgctaccacatctggcctttttttttttttttttaaaccaagttaaccatttttaacttaatggttagagtagtgctgccaataagttgacttaaccatacttttgaatttttattctctacctgtcagggtgctgttacactttttgcatgctggtatttatttttactctaggtatctccttactgcagaataagtcctggtatagaacgattttgggattgcaaaagttctcctgagacactagtctattatt

SEQ ID NO: 31354 - DNA, 3216 bp, Mus musculus
atggtgacctgggctacaagtggcaaatcttgtctgaaaggggtgggaaggaagtgtcactctggtagaacacttaacctagcatgtacaagccatgggtatgatccctagcatgtcaggtaaattacagtatttcactgcagaaagaaatgcattgcaaatatatgtagtagttttattctggtttatgatttttttttaagtagaagctttgatctattttgtgtagtgtattaacatgaattttttttttttttttttttttagaattcggtgtctatactaagtacagacactagcaggctattttcaggattgtggctaattttgtgtttttgtctttttttccttccccagtcaagtgcttctgctcctgatgtagatgacccagaggccttcccagctctggcctaactggatgccataatacaacactggttcctttgtggaccctcctgttcaaagcttttgcatgcttaaggatcccaaacaactaagaattaaaaaaaaaaaaaaaaaaaaaggactgtcattcataccattcacacctaaagactgaattttatctgttttgaaaacgaacttctctagctacacagaagtaacaaaatatgttagtcagttttgtatttagaaatgtattggtagcagggatgttttcataattttcagagaatatgcattcttcatgaatacttttgtattgctgcttgcaaatatgcatttccaaacttgaaatataggtgtgaacagtgtgtaccagtttaaagctttcacttcatttgtgttttttaattaaggatttagatgttccttcaattacaagctggttttaaatattggacataatactggttttaatacctgcttttcattttcacacatggtcagctgggacatgtaaacttctgacttacaagattttctgctgtgtggaatactaaccactatgtattttaactatattttcatttggaagttgaaaattttcttttcacatcttatgatagctaatatatactaaatctttatacagaaatgtcagtacttgaacaaattcaaaacattggtttattaacctttggctcatgcatggtttattaggttccgattatacctgattcacctatatttacttttaaaatgtatgacttcctcattttaaaagtaaaactaaacacagcttttggaacttgtaaactacttattgttcatagatacagcctgtgttcagtgaaatcgttttgtgggtgtgggttttatctttccttgaacaagatgggcagagtaagttagtcaatacctaatagtttaacttgtataaaataagaggctagccatttggtatttgtgtatgaaagcccccaaaatcaaaatgtttatccatagtcaacaatctatttggttttataaaaacgaaagggcacgcattggtaagtgtgttgggatggaaaagtatcttaagttttagtatttcaaagccagctttaatttggaacagcaccaccatccataaatttcaaaacaagttatcttgtttatgaacttatatgttatgatttggtattgagttgttagtgttacatatcagttttcatttcctctactagaaaataggtaattgataaattctttgaacagaagcatcactgcttattaaaaagttagatatatagaatgattaaaaatccaggttttctaggatatttttattcacatatattgattaaatagggaaggaattttattcaaagctttaaagactagtcgtcagtttttttttttttaaacctctgttgtaattacaaaaatactggagatcttttttgctagttaggtgattggtttcatgtacacatctaaaagctactatatagtatatttactcaatgcatttattaatcttgttgccagcaagtctgacagcttggaaacaagggtttttttgttttttaatagacttgagctggtggcttacatgttctgtattagtgctgcttgaagttttacatgttcagatccctgcttttcagaggcaaggattagtccatttagacttggtgacccctttgagattgtagcatatgctcccttaagtcagtatgcttaaactttaaagtatcttacttcttattttaatagtaatatctttacagatttttagcaatgtgttgtagaaaacacctgctcttagaagcacaagttttactcactgagtcactgtaaacagaaaacacagcagcatttattttattgcacattcagagtaagctgaatatgaaggtggttaattctgtctgatacctgtgaatttcctttcagaatcactttatgtcaagagctaaacgtaaactttttgttgaaaataacaatttattttcatgctcatttcctaaaagataaaagcaatcaagtgggaacccctttatatgtttcttggtttccctttttcattatcgtaagataattcttgtttaagatttttgaatgtttagatatcattaaggtgaggtttttatttgataagtctgctgagtcctatacttgctaggatacctatcttgattttcaagagtgggtataatggcttgaatgctgttaaaggtaaacggcatcagttggaatttgtgggacatttccaggtgggctaaagggagggtatagttcttagttgaatactatttggggttgctgggagatcttgaatgtaagagcaggttctatagttcatttattcgcttcaggatatgtcatttgcagagttgtgaatgtatttggtttatttttggtatgggtttgcagagagatgactgtgcattccttctgattgttatttttataattactagagatgactgaaatagaaaaaaagtgttgtactgagtttgcaagtggagtgtaagtattttgtgttgaaatttaaaaaaatatcttaagagcattagcaggtggaagaaaccaggtgttaaaaattaataatgcaaagctacatgaaccttactgatgttgaccttaaaggtaagacattttaggcatatctgtggacaaactgccagacattagctaattggtatagtatacctatgatacatgcagttttgcttcccccaccctactttcttgtactgggtattcaaccagggccttgctcatgctgggcaagttgcttaactataaccacagtaaaggaaaaggtccaggaaatataatacccct

SEQ ID NO: 31355 - DNA, 2258 bp, Mus musculus
taaatagcatcatcctatcttaaaaccagatctctgcacattgaaagatatatcagtgaaatgtaggtctttcgtgaatttagcacacttgtctgggaagggagcataattggggaattgcttatattagattggcctgtacccatttctgttgtgataatttcttggtttatgattgatgtgagaaggcccaacttgcagaggtgccactcccaggggtttgaatttatttcttctaaaaagcaaggtaaacaaaccacagaacagcatggtcttttgcttcagttcctgctttcaagttcttttttctgatttctttcagtgattagaatgtataaataactgtgctgtcagggctgcatttggtcaaagtcttatcacagccagagaaagcaaactaggacacaacttggttccagatggggaatatttcctgttgcttcaaagcccaatgggttggctgtttgtggaagatgagagagcaggccagttaactgttcctctgtggtctctgattctttgccctggcttcttttgatgatggtctgtgattggagtatgtaaatgaaataaatcctttgtgctccatcttgcttttggtcatgatgttttatcataccaataaaaagcaaacatgcagaagttggtaccattaatcttttcaccagctcatacaggtccaatggacttgtatggtcctctcacttaaatgtagaaggcagaggcattggattgcatagcctggcccctagatttaacagtaagttttgagccagtgtaaaacttgtttaagtatgtgcactgcttgcatgccatgaccatggaggccagaattgggtaccagatgtggaactggagttaaacagcatgttgggagtagaaactatatgttgcaagagcaattgctctaaaccactcagctatttattaagttaggtatcaaaatgtgaaaggctaagtctagctctagcatgggttttatccttaccatcactaaagaatattacagaaacgtggcacagtacagtttagtttttttgctttagaagtcaagataatgcagtccagttccttgaactctagttaggattttcattgtacagatagtatttgtcttcagagggccaccattctgacttactgctgggaaatcacatgttcttaggatattaagctgttatctgttgagaattgaattggtggttataattttattgaatatttgtctagctgcccttcagaatccatctactaattaattttagtttctctaattaatactggctaccatgctttgtaatctttgctagctgataaaaatatttaaatagtatttggttttcatttctttacagtcgaccacacttaatggatgcatatactttgtgtcattgaagtgcagacttagttatttttatttgtatgagagcccagttaaggaacctattttctgtgttttacagtttttattattttggtataagctatatatttcaacttgattctttccattactcaaattgcaaatgccaccttgttctctgcttctggggagtccaacccaagttcttgtatgtggtaggctatgtgtttttatgtgctatatcaccgagcagttttagttttagtctgaattgcttttctattgtaggaaagaaggaaggtcttttctgaactcttaaatgaaaatgttttgttgtagaagttctactttctcaagtaaaacatttcataagaagcacaaagtgaacatgagtcctgtagggtagatggaaagtaaaatctttggagggcttcatctttgatatcagaatggtagataactttcaggtgactcctacaaacagatcctagtgagaaagaagcacaggcatttcttttcctccttgttccaggacatgggcggcctgtggttgtaactaaaaagtggtggtgggtttaggactaaggggagaatgcatgggagatggagtttaacactccacttgcctgcagatagaactagaaaagaatctgcctgtggaaaagggacattttcaaagcagttttgagtatccacctaaatttgaagtctggacaaagctcagtgaagtgcttgcctaactatgctctggatcctcccttcttcatactaataaaaagtcagggaggttcccatgaattccctttggtgtgctatacactggtgtttagcttccagagaattgtggaattttattaattaaaaggtagatgtaagttgttggtggaatgtattt

SEQ ID NO: 31356 - DNA, 1578 bp, Mus musculus
gtagtgttaatggagaggatgggttggagatgatgagggttgatattttaaagaaaaaaaaaactgtcttgaacctttcaagtggcactggacgtaatcagtggtatgataggagagcatgctaagtcaggccatagttaggaagaaacatcagcaaggtatgggttcttgtagaccagagataagtggtgttgaaggcagcacatgatataattagttaaatggaataagcacagaggcaattttccatcaaaccgatagagattgacagatgttgaaactgtgtgtgtgtgtgtgtgtgtgtgtgtgtgtgtgagagagagagagagagagagagagagagagagagagagagagagagggagggagagaggaggacgatgagcatgactatcttggggtcctttctatatgatatcagtgttggtgtattgccaccttatccataagacttaagtacctatggtgaagctaattttatccagagacagctggcttgtcttcactgtcacagacctttggagtaggaactgggcagataaaatgaggtacgttggctttctagtatcaagcctcattactcatgagggagtcatagcccatctttaaccgatctagagtcagccgctcaccaccgaagatgagtgggcggagagaacttgatgcaaaaatggaaagagaaatatgttgatgctccaggtcaaaagaatcagttgggtcagcctcatgtggtgacagatcttctatgttggagggtaaatagccttcatggctaggaaggtagttcactggggtgactgtcaaggggctggtcaggttggccagttttgagtcagggtctctgctttctagcaccttgtataggttcactagttgtctggtctcagctgtgagagttcctgtagcttgtggattggcaatatacattgcatcttgcttggaggtagagtagccttggaatccttggcctcttttgaagtaatatggttgtctgacaactgggatcatgtggtagaggacttcatggatgatcaggggctcaggctcttcaggagtgggccatgccatcaggagattatccgtaggtagctggatcttctcctgtgagaagagtagatgtataggttactttgacagcccatttctccaggtttccggaacctcaccctgctgccctgcttcagcctggtgagaaactatgggcctttaaattttggaggggccagagccagatttcactctcatccacctcctaccctatcactgccattctccagccaaggagagattcattgctcagcctcaggccacttgcttccccccccccctcctagtaggaaaggcagaaagaaaaaacttagggcagtctggagagaaggatggagtattggaggtcgagggaaattggtgaactaagccttctagtttgttgcccattacccttttgttgagaatcaaactcagtttgtgtaggataaggcatatgctttacactcactggatcacacccctagccctgttagtactagaaaagaaaaaaggatttagaaatgggaaaggctactcacgaagcacttt

SEQ ID NO: 31357 - DNA, 1695 bp, Mus musculus
tctgtagatatctgttaggtccatttgtttcataacttctgttagattcactgtgcccctgtttagtttctgtttccatgatctgtccattgatgtaagtggtgtgttgaagtctcccactataattgtgtgaggtgcaatgtgtgctttgagctttactaaagtgtctttaatgaatgtggctgcccttgcatatggatcatagatattcagaattgggagttcctcctggaggattttacctttggtgagtatgaagtgtccctccttgtcttttttgataagtttgggctggaagtcgattttattcgatattagaatggctactccagcttgtttcttcagaacatttgcttggaaaattgttttccaacctttcactctgaggtagtgtctgcctttttccctgagatgggtttcttgtaagcagcagaattgtagtctcccctcccctagcctgaaacctgcttgctcggggtggagcttcctgctcattcgttctgccacgcccactgctggaacctgaggagccacacacgtgcacctttctactggaccagagattattcggcgggaatcgggtctcctcccccttccttcataactagtgtcgcaacaataaaatttgagccttgatcagagtaattgtcttagctacattcttttctctcgccacctagcccctcttctcttccaggtttccaaaatgcctttccaggctagaacccaggttgtggtctgctggccggacacaacaattgttgcccaacgtggggctgagaaacggcaaaggatttttgaaagagacgctgctggttcggagctccataaaataaagaataaaggaaattcataccggaaaaggtatgggctaagctgagacagcgttaaacccgagcgctggttcacttaggttcagcagtgaggagctgggtatcaggcggtaggccgtagctctccgaagctacatgaggtgtgagaaaagaaagggtttattaaaaggaataggcggattgccccagttaataaaaaatgcatcataagggaggaaaatgtcccaaaaagtagagagaaatttctctctgggccttgtagcaggagtactctgttaccttttgtgtcttgtctaatgtccggtgcaccaatctgttctcgtgttcaattcatgtatgttcatgtccagtctgtatgaatgaatgttctatgttttgtgttggataataaagatggtataaaaaaactttatctgcaaagccgagagctgccacgtgtttcatacaggaatcagacacatggcgggagggcccctgctggaaaaactgttcgttttaggaaataaaggcgagtgcacagcctctaagtttcggagtaaaaaagctaataaatggttcatgattaatgtgtttgacaatggtaaagtgttttttatttaatgattgtagctacaaaaattattattctctgattggtctaaatgtaactgcttcatttggttcttttttattggtaatgtgctctgagtgtcttcacattcagctcataagttgttggttaagattaataattgttacattgctacagatggttagtgttaaatttgataactcaagtttagagtccttccgacacgtggcataaagcaggccaagaggctgggtctctaaagatatttctagtttaggtaataattaatgt

SEQ ID NO: 31358 - DNA, 1134 bp, Mus musculus
caaaaaagctactctctgagccagctcccaacaggaggccagagactagcctcagctttacaatttgcatttgaataaagtacctagacttccccaaaagaagttctgctttcctactttctcactgtcgagattttgtctttcaagcaggtaaatcaacattctcgaggcggaccagcagatgtgcatccccgcccccctagagcacacaggtggctgctgttatcttttttccaaggacatttccagcacgtggctttcagtctgagttaaaaattaggtttacccagaggactagaaaagtagatatttctatattaataaagattggtttttattttgatagacaggcttagccccttagctgacctctggcttttcacccttgctgttactgcaaggtgtctttagctcaataaggctgtggaaaaaacagagatgaggaggaacgacttccagctcctattttagccacaaatcgtggtgttactaacgacataattcttgcttaggctttgctaaatctgaggttgataattctcctttaggagctgcacagcactcagaactgtgcatactggtttgtgattgtataaattcagtatgggcatcgcttggtgcagaggtactgcaaggaaaggtccagcttgaccatttctgagtttcctgtgagataaacccggtttgaaagaggttggtaccaaattttggctaaaagtgaaaaatatttttcggctctgcctcacctccccaaaaggtaccagagccacaggtgtggatcttaacagaatccacgggaggaatcgggtccatgtccacccaagccaaggttaaaagcccactcatctacggatgagaaaatcatttgatcacctcagttaagcgctgccttattttaacttaattaataggggggagagagattggagacgtactattgaaagggcaagcccttcactgcctcccacccaaataaaaaagccaattggccttgtactacagagctggccgaaccccttatccctgtttcccaccaatcatccaaaaatgcggaggaatatcaacttagtgttattcttattatagtgtatttcacatttgttcagtcaaacttagccagagttccaacgccct

SEQ ID NO: 31359 - DNA, 1245 bp, Mus musculus
tctgaaagccccctgactaatggatgactaccaacgctcctgtgaaacgtcagaactttttgttgactaaacgagtggccttcgcttcattccacttgctgtcccactgcatgagactgcacctactcatcactgcgctgacattctggcagaagaaactggtacttaaaatgatctgaaggatcagatcagccttggcctgagagttcgagctggtacaccgatgacagtagccttgaggttaaaggtaagcagaaggcggggacagcagtacggtggtggacagaaaacacgtgatctaggccagcagccttcctgaagagacattggcccaaaaagctgaacttgaaactttaatacaaagagggctgttgacatctgcagagaaggacctaagatgctgtggctaaaaaaaatcagatgacaaatctaaccgccaaacatgtggcccaaagagcaatgatcctggcagtcaaggagcctaaagattattatgatgtcaaagagaccagctttagatacacccctgagcactatcaagttatggacattgcttgacccacctgtgggccaagaaattaaaaggtgtagttaggtcctttgactactatgttacaggactctctgacttggcagaagaaatagtcaaaagctgcaaggcctgtgctatgaggtaatggacctgcctttgttgcccaggtaaatcagggactggccacgatattagagattggttaaaagttacattgtgcatacaggctccaaagctcaagacaggtagaaaagataaataaaattctaaaagagactggtgcagacttggtgctccttccccatgcccaatttagacatagaaatactcccttttgattcagccttactctttttaagatcctttatggggctcatcactgtcttaaatgatgtgtttaaacctacatgttgttgtaataataatctgtatgctaagttaaaaggcttacaggtggtgcaaaaagaaggctggtcacaattggctacagcgaacgagccgggtaccacaaaagacatctcaccagttgcagccagagatctgacctacatacacctacatcatgcccagaccctcaagcctctctagaagggtccctgcctagttctgtttatcatcccttcttattctgtttttgttcttaacctttggcccgtgttataatttctgttctccacatagagatatagacttctaaaattctaagattagaa

SEQ ID NO: 31360 - DNA, 1166 bp, Mus musculus
acaatcaagctctcccaataaacgtgtgcagaaggatcctgttgcagcgtcgttcttcctggccagtcgagctcgcgcaagaacaatctgtttcattgactctggaaatcagtttggcagttcctcagaaaattggacatagtactaccagaagatccagcaatactagtaccaagcatatatccaaaatatgctccgacatgtaataatgacacctgcttctctatgttcatataagccttttttataatagtccccatgacatagcctgtgggagtcggttgccttgatgccaggtgtaggtcatgaatgtttctgactaacaagaacagaagatttgtttctagggtggcttttcagcccagtcatatatactatttagatttacaaaataaacagctaggacttatctgtttagtctttcttgccagtggctaacttcagcttaggaatttttgccttgtataggagccaggtaatgatgtatgtgctctaatatgttgtataaaagtgggcggaagaagtttatcagtggggccacgtgctgagtgatcgtcactcttcggtccctggcaaggtctgagactggggcctcccgcagccctaaccgggctctccccgagcgaggagatgagttcccagagagcagggctctacgagtgggcagactgggcaggagaagccctgagtctgggcagatgcctccctcgccagagcttggaacagactcacagccagcagagcgagttttaaccatttatattttttaacatgaaccacagaacaataatcattcaaacaacaaaacaaaaacaaacacgaattaacagatttatggacaatttgttttggtgcaccaaaaccagacaatagacagacaggaaatagaatttggtgtctcaaagggacacagatatcctatccagagctaagaatatctccatgggagccagagaggaagtaggacgtctcccattttccttctgttcccaggagagctctgaaatagcttattttcattttttctcttttttttttttgctaaaagatcccaaacaggggataactgcttttctaaaatttattttctctctctctcatgttcagactctacttccttatctccttctcctgggaatactgccagagaatggagaggaggcaca

SEQ ID NO: 31361 - DNA, 1183 bp, Mus musculus
gaaagcaggagggatcgtagacaagaaagaaatttgactagaatcttggccacagtagtaggagagaaagaaaagacgggatctagacaggaatcctgggcaacagaagactgagcctcagtttaaacggctcagctgtgccagactgaagttacttatttgggataaaccctttgagataagaagcagtggttaaggaaagccagaaaaaagactgtcactcagatccccaccccaactacaccaaggaaagtaagagaaatcttgggtacctctggcttctccagactctagatacctgggttggtgaccttcgctgccctgttgtacccccagaccaaggaaggggaggtgtttgtgtggaccccagatcaccagaaagcctttgaagaaattaaaagggtactactgacagccagccttggcctttgcctgacctaaccaggcctttcactctttatgtgaaagagagatcagggggcaccagaagagtccttactcagactttggtactttgaaaaagtggcttacctatccaggaagttagaccctgttgccagtaggtggttttcttgcctgaaagctattgctgccataactctgcttgtcaaagatgctgataagctcactctgggacagcaaataactttagtggtaccctatactcttgagagcattatctgaaagcccctgtctgatggatgatgaccaacgctcctgtggcacattgtcagagctttttgttgactgaatgagtgacctttgctcccccactgtcctcaagcaaccctactgcccgagacttcacctactcatcactgccctgacattctggcagaagaaactggtactcgaaatgatctgaaggatcagatcagccttggcctgagagttcgagctggtacatggatggcagtagcctcgaggttgaaggtaggcagaaggcagggacagcagtaaggtggtggcagaaagcaagtgatccaggccagcaccctccctgaagggacatcggcccagagagctgaacttgtgactttgatataagctctaaaatggcaaaagaaaagtcaacactgacagcagatatgcttttgccattgtaaggagcaatatacagacaaagagggctgttgacatctgcagagaaagacctaagatgctgtggctaatggaaatcaga

SEQ ID NO: 31362 - DNA, 1177 bp, Mus musculus
acagttgttctcttcatgttcttcatctaaaggagaaattgaaataacaccagtactagtatctattgcaatgctgaaaaggtatcaaagtatttttataataaggtcagccattggcagaaataatcagcagtaaatttttcaacattctcatgtagaatgagagacccagacacagaaaagttaaattactaagaaaaattagaccttcccaggccctgattatttgtgttggtccactaccctcacttggaacattttgttagtcttgttgtaccctatccaggagtcaatcaatgtctggtcacagaacagctatgaagactccctcccagtttctggtgttcttgctgttttgaatcccaggtatggaaggttgactatgggtaatctttaaccatttgtaatcatgacttggaacttcagagaagtcatttttgtcttgattaaacatgaatattgtttgtatgattccaattacaggcatagccgggcacggtggcgcatgcctgtagtcccagctactcgagaggctgagacaggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaattacaggcataatatttggcatccagttagtccaatcctcttcctactcatctgcatatgtagaggacagagtcaccattaattgaatggcaaattaggagattactatatcattagcctgatatcagcagaaaccaaggaatgctcctaaactcctggtataccacacattcaagttgaaatcaggggtttcttcaagaataagaagtcatggatcattttgtaatttcattattcttttccacttttcatctggcctagtagatggacagctttagaaataaaaataaatagtaataaaatagagttggcattctctcaaatgaaagacaaaagttgtacattatttgggttgcagttatgcctaaggctctctgttctgtgaattttcatgatattctgtaattatgaaataatgaagcctttcttaaaggatatgagattgtgatgtccaggctacagatggatggaaaaa

SEQ ID NO: 31363 - DNA, 1355 bp, Mus musculus
gagctgccagcaaggaacaaagaaaaccccggtttctttcagattgtgttttgtccgctgctggcttgtgatatttgctcctgggaacacttgatgcttgctttgttctgggaagctggactttaacgcacctattcttcattctacaggcgtggtggacacaggccttttcatcaacatggcagagagagtctactttgggatgcaggatggctcagtgaacgtgcgggagaagcccttctagccctgagaggagcagggtcctcaccttgagtctccagcccaggcacagtggacacgcctcaccaggagcctttgccttaatgtaccttcatgtagctgtccacagtgccagagtggacggctggcatgggtgggtgggtgggggtagtcaaatccagtcttatgaagtattgctatgtgtctttttaaaaagaaatttaaatatatatatatttttactattaaaatattcagtttttttataaaatagaacttgattttatgttttatatgaaaccttaccaaaaacaaaaaaaacgtataaataaaaataagagatcaggactgtctctgaaagctttgactggacctgctggttaaccttctgaagttttgggtttgctgagaaagaacgtttttctaagctggtgcaggtctcctgatgccttatgggaaaccttgtttactgtttactttcttgtgacactcttgtgttttcattgttaccactcccaaatcttagttacattttaagatcaggtgtagggaattgtgaatggagcagcggggctgtagtgacgtgggtacaaactccaggtgagcgagaatgcaccttctcttggatcctggcttggctttgctcctgctgctgttggaagcccccggtggaagcggaagcgcctgctggcagtgcacagcactgtctgagatgtgaagcacttactttttgttgtttgaatgttttctttatgtgaatatcgttttgttcctccgatgacccttgtatgatttggtatcagaagctgtcactttgtgctgttcgaaggttgaaataaacgttactgtgccatttggatcctttgtcttctctgccgagtttgcactcatgggaatcagttttgctcagtttatgttcgatgcgtgggatccttccaggaacccgagacagcctaggcaaacgctcctgctgtttctgacagacgatctcctttagtgaacaaggtctcgcgtgtcctacctttgctgcggagttagttttctctgtctgggtgagggcagtattgctgagcacaggcctgttcactcccagctgctctgttgggttgtatgggaattaagcattagaagagact

SEQ ID NO: 31364 - DNA, 1199 bp, Mus musculus
agtggagatctgtgaggaggttctgataagagctcaggtcagacataataaggatctgaactagaatatgaatggagttaggacagtggtcttcacctgtcttccagacccggagtttaaggcagaggtcaggaagcagagagtgtgcgttgactcccagcttagagctacttaaagaaagcctgctgctccagcaacccaaggcatccatctggggttctgtgttaaaccagtaaggctgatgtttgttttaaagagtttgttttgcatgtgtggtttgttttgtcttcaactctttcatagtctctcttcccaaagttttaagctttatagatcaagacagaagttgtgttgctaattggagttaaaatttaacttttaatgccagcagaagccaatgccatgaagttctgtactgaaattcctaagacattcttggccctgctttcctgtcttttgcccatgctgcccagagaagccaccattgaaacttccctgttattacacagctctgacatgacatgtcctcacttccctcactgttaaccagtctttgtcttctgcttgctgcccatgcctccgctgtctctcctcagcctgtgcactttctcgtggtgcctcattttacccggaagcctttgcaagcttgttccccaaatgtcaacatgatgtactgtttcgtgttgagagctttgcctggctgttattagctttctcagcaggatctgccatgggttctccattgaccactcaacctgcatgcttctctgcctctttatcttcaattctcttcccccttatgatgatctctctcactgatatgacatatacataccatttatttatgaataggatgctggttttgtttgtctgcttccctctcttgagccacccgtccagattttgttcagctggccgtagtggtgtatatctttagtcctagcactcgggcggcagaggcaggtagatctaggtcagcctggtctaagattgagttccaagccagccaggactataaggagaaaccctgttttgaaaaaccaaattaaaaaaaaaatttttgtttaaagaagaaaggatgagggctggagagatggctcagcggttaagagcactgactgctcttccagaggtcctgagttcaattccctgcaaccacatggtggctcacaaccatctgtaattggatccaatgccct

SEQ ID NO: 31365 - DNA, 1199 bp, Mus musculus
ctttgctgcacttgaatgacatgtgctcaggtaattaagaaattaaggccggctgcaagtcacctcattttaatgtgattttgttgtgttttatgaagtacatgttaatttttgatagaacgtctggccttaggtgtttactgtctacggcctcagaatagctgcttgcaaaggatcagccacggctctctgaggccctcttgtggtgtaaatcagcattgcattccatttcaaaaagttaagatgagctgggcgtggtggtgcactcctttaatcccagcacttgggaggcagaggcaggtggatttctgagttcaaggccagcctggtctacaaagtgagttccaggacagccaggactacacagagaaaccctgtctcaaaaaaaacaaaaaacaaacaaacaaaaaaagctatgatgatgtcttctcacaaaagtgttctattttcttcttcagtctaaaagcagtactgtattatttgcgtgctgtattatttggtcccttcatttaaacgtaagattctaaaacacacctttataaatttaaggtggaatttcagtgttggccactttgaacttcggtatattccagacatggaaactagagccggattcattgaaagcacctttaaaccgggtggaaacaaagaagactctaaaattatttcagatgtggaagaacaagaagccaccatgctggacacagtgataaaagtttccgttgctgattggaaggtcatggcgtttagtaggaagggaggccgcctggaatgggagtaccaggtatccgagaccacagactcagtagctctgtccccaggttttgtttgaccatacacattactagagggaggtaatgccattttggaatctcaggtatttttctctgctttaaaactgtgactttaagagacattttgtggagctggcaagatggtttagtcagtgagtatttgctgtgcaagcctgaggacctgcgttcagatccccatcacaacatgaaaagcgaggcctgaggttccaggtctgttcccagcccagggaaggcatagaaaggcaggtccatgctggtcggccccgtctgaccagtggattcctgtaatcctgtaattcctgtaagagaacctgaatcaaaaattaagatggagaagctagagagataaatggctcagtggctaagaggagctgcagctcttgc

SEQ ID NO: 31366 - DNA, 1216 bp, Mus musculus
cgagccattgatattttctaacacagcctaaaacacacacacacacacacacatacacacacacacacacacacacacacacacacacacacacacgataatagctcagccattctctatggctgccgtgggacttctgggaaagctgtctaatcagatgtgcttcacacactaaaacagttatgcagaagtttggctgcagctgagggtgtagataaaggccatttatgcctacctaccacttgaagagagccctgtgttccagctcctttactgaagggggtggggggagggcagagagagagagaatatatgtgtgtgtattcatgtgcacacgtgtactcagtgcttttaacacaaaaccatttttatgtttcagcatatgatggttcaagacatgctctctccatcccccacggagcggcctgaagccacagacatcattgaaaatgccatatttgagaacttggagtttcccgggaaaacggttctgagacagcggtcccgctccatgagttcatctggaacaaaacattccagacagcccagctgctcgtacagcccactgcctggcaactagccctcagctgccctcgaaggtggcagagcaggcaccctgaggaacatggctctccacagcggtggactcagattttatgctttgatcagttggactcgggaccaatttttctaagtcagactggatcacgggcctaacccagtttgatcttaactgaacttcaaggaaagggctgtgtaaaggacacatgaacttgttgcttgtcggtgtcccaagactagctggtcagcttagaaccttcacttttcaccaggcggtagaagagatcctcaaatggtctgaactggaaatgtctttaaagcacaaaagtgtaaaagaccctctcacatgggaactacatgttctagaaacgtgctttctagagatacaagggtgattttggaagtggttgttataaagctgacttcatttttttccctggtgagccgtgacccatctgcactaatttgcaaggcacatagcacaagctgggtcgccatttatgtcggtagtgtcatagtctgcagcagtgaatagcgtcattcttcaggtggtctagggagcgcgaagagcttttttgtactttttacctccaataatgggaaaatgaagcttttaggtattggtcaaaagatctgatttgagagttttgggttt

SEQ ID NO: 31367 - DNA, 1161 bp, Mus musculus
cacagacatgggcttgcttactgggtctccccatctccagctactattgctctctcagaaatcacagacagacagacagacagacagacagacggacgcacgcgagggcacacacacacacacacacacacacacacacacacgaggcatatgtgaacttttaaaaggagagagagaggcaccaataataagatgcaatacatttttttaaatttttaagttattttttatggaatccaggacttgctgactaaccagctttgctgcttagaaagctccagaactcttccggggacggtgctcagaggcactcaggatggtccagcgtttgacataccgccgtaggctttcctacaacacagcctctaacaaaactaggctgtctcgaacccctggcaacaggattgtttacctctacaccaagaaggttgggaaagcacctaaatccgcatgtggcgtgtgcccaggcagacttcgaggggttcgtgctgtgcggcccaaagtccttatgagactgtctaagacacagaagcacgtcagcagggcctatggcggctccatgtgtgccaagtgtgtccgtgacaggatcaagcgggctttccttattgaggagcagaaaatcgttgtgaaagtgttgaaggcacaagcacagagtcagaaagcaaaatagatatgcacattttttaagtaataaaaatcaagacttgatctaaaaaaaaaaaaaaaaaaaaaaaaaaaaaaaaaaaaaaaaaaaaaaagaaagctccagaacaatgaaagagcctgtctaaaaaaaataaaataaaacagggcagagcctgctgaacagcacctgaggttgtcctctgggacaagcctagatatgactcagtagtagagcacctgcctagcatgtgcaaggtactaagttcaaccctcaaaccttcagggtccccagacttcagaaaataaagtcagacaggtggtttgcccatgagcaatgacaggagtgtggttggattggccagccccacctactttaaagcaaggactttggatgtgttctgctgccctctgctggctgggagaattattgccaggctttccagtggatttggaaggcttcttttccccaagggagccagagagtgctcacctttgcttgcagggttgcttacacgc

SEQ ID NO: 31368 - DNA, 2157 bp, Mus musculus
aatttatcatttccagcattccaaaatttacaaacatcacattctttcattagtaagccttagagtactgtagtcaggtaagtatgtacatttactttatttgagtagacaggattttaaagattaaattacttaattgcggttctgttacttgtcttagaaaacaataatacaggtgattaagttgtcacaactttaaaattatctaacattagatcaggccactgccacagacatgattcacacacccctgttgccatacatgttttgtttttagtcttataaaaacatctcatgttccatttcctttctattcttttttcctcccaagttagaatatcaaagttactataaatggtttatgagatatttgaccatcgtgatatttctctttgacataagttatcaaaatatttaacagttaatgtaggttttaatttgggtttccatttgttattttaacctttgtaagagcaaagaatttttcagaatagaagaatctagcttttttttttctccattttctctacagataatccctttctgtcaacctaatgaagcattcaaacaagccatatgactcttttcaagatgaacttgaagattatattaaagtacagaaagccagaggcttagagccaaagacttgtttcagaaggatgagaggggagtatttggaaagctgtgggtacagagaagagtttgattccaggcccaggtatagaatgtttgatcagagactcccatctggaaccaaccattcctacccaagatcatgcagtagttcacagacagaagaccgggtaccccagtggttaccagctcatgacaagataagactaaactctctgagctactgtcaattcaccagggatggcttctcagaaaaaccagtccccttgaaccttagtcagcaagaatacaattgtggctcatatagtgtagaatctgtagttcacaagcgcctctgctcagaacacagtaccatcgaccctcaagtcagtcatagacaaatgcaccagaagaggaaaaaacatgtagaagagggcagagaaaagcaggaagaacggcccaaacatgagaggaaaaggagttctgaggaaatggatttaaataaacatagaagcatccaaagaaagaaaacaaaggcagaaacagaaactgtacaggatggtacagaaaagcttaagaatcgaaaagagaaaaaaacccgagatgtatcatctaagaaagaggaccgtaagcgtaggaaggaaaaaaaggaacaaggtgaagaaaggacagaggaggagatgctttgggaccagtctattcttggattttgaggctccttagatctcctgaggctccactgaaataacagtcaaggagcttggttttatgtgcattcatattcatgtcacttgcatatgtggacagaagtttcaacttctaacaaagtgaacatgaaatatttagtgtgctttccaacatggagattacttttctattttctaaaagatttattaacttttcttacatatggtagaatttccctttaagagagtggctctgcttttattgaccaaattgctgtggtagtggacttattttcccttgggagatcatttatttaaaattggaggattaactgatggcttttgtggaatctatttcttggttgggtttcttttagttttgagtcacatatttttatgctcactgtctttctctatgaagcaatttagatttcctttttttagatctaacttgcaatatattttctgggttggaaagtgaaataacataataattttatcttacatatagttttaaaagtttcagagacttcacacaaaatcagtttatattctgaaaatgtttataataaagtatcttaatttctggatgtttctttgtgtcagtgctctgttctagtgattctcttttggaaagagaaaagcagtaaccactttatattaaagattttagaggttagaacacactaaatggttgtaaaaattctttacctactgaattaggctcacaatttataataaagagctttgattcatgataatttttccaaatgattgaaacaaagaaggaatttacaaaagaaaatgttattactctttcctggcaatgctgtactttctttaaaatgactcaaagccg

SEQ ID NO: 31369 - DNA, 1099 bp, Mus musculus
tagaggtgcttgccaccaagcctggcttaaacctgagtttgatctctgggactcacactgtaggagagagctaacgcctgcagtgtgctggctttatgcagaattttgtttcatatgcgacttttcccgttgctatttgtcaagaaacagagcggagggaaattacttgttatcattctgttaaatgtcctgccccaggtgtcaaattatcatctctcaaaacaggaccacttggctttttaaactcttccagtagagggtggtagaaggttattgtagagtcaggaaagggggacattccctttccctggtgtgcccttagttacaaaaacagggagttgctagggaaaaggtcctacctattgcctatctatgtgcctcagcaaatggctttgttggtggattctctttgcagagtgtaaatcctgagtggttggggaaaggaccctcaggctcccccgctctgagttatgcctccccagccccacccatggagcccagccccaggcaggtcaactgccacctgtaggtcacagccagccacctgctcggtgctctggatctgacagttgtagcatttgaatctcaagtatacaaagtgcagatgtcttcattcattgaactgcgttccagagcctgtacaggtgggcctggtgactggctcagtgtgtgttgccaagcttgacaacctgtgctccatccctgggtccttcatggcgggaggagagagaacccattcccgctagcgctctgacctccacatgcggcatgtactcacccccccaccccccaacacacaaagtttttttaaaacatgcattcattttatcttggatttcaccaataaaaatgttgtgtatgactgttttttgtgttgtgatgtgatttctttgcctgtgactcttgcccacaaagcccaaaataacttgctacctggccctttacagaagacctgtcacaccctgcccaagagtcctcttgtgcccaccattctttattaattacttttttgtatttaattttctctgctttaatcactgctgtggctttgacttgaccctgactgataccgtgctattagacaaaccatttctgacag

SEQ ID NO: 31370 - DNA, 4483 bp, Mus musculus
aaacagatatttttctgaagaatgagtttgtttgcaatttgtaagtgaaactgaattatgggtacattcaagacaagagtgttccattgactgcagctatccaaggaccgcctgttcataagctatgctccagaggctgccgattcactcgtgtgcacggagggggtgctccagatgggaatcacacagggctttcttcactcttggtcttcgtttctgatcaagtaaacaccagcagttgtcattcagtgcaggtttttgtacttctatatggtgatttttttacttaaaagcagaaacagaagttgaccttcctgacatgtgtttaatattcctcctgcttttacagattctgacgttttcttgataattgtaagcttgagagtgtttgtggaagaacttactttcttcttatgtatacataattaaatgaaaagtcttcataggagtttgacaaaatgaattgtggttataaaacgaatttgcttttttgttgttttgtttttcttttttggcctaaggaagaaagctgtgataaatttcaaatttgcatagcttttcaatgttttgctctgctcccgctcttgcttcagagtcggcacactcacctgcatttgagttctgtctatagcccagcaggctgcctgtttaaaatcccatcatgaatttaacaggctgatgtgagaatgaaatagatattactggggttttgttgttgtttgtttatttgttttgcttttattaccaagaggtgctttttaataaatggatattgaagttagggtgttactaatttgatgtatggtttcacagtctagcatactgtcctttgacatctgcctttaagacttggctgagtgtctcattagtttatcatcacagatacgcagtgttatgcatgtgtatagaagtgtgtgcaccagcatcaaacattgtgtgtgtggaagggaagaagcctgtccattctaaacgcagttgccagtctcatcacttcaggtccttacgggcaggctctagcaactttccgtgtatggacctcgttttttgctgttttgtgtttaattagtatattgttcatgcctctcttctgcagtgtctcatctcatagactgtgaacctgtatattattcaaatggctacagataatgctcttttcttttgtgaggtctcttcatttaatgcactgcccagaaagagccatgtgtaagagttgttctctgtttgaggaactaactacatggaaaagacttctgacttaaacccatgaaatacttcatcttgagaagagtgctatgtggaaatcaccaaatatctcgcaactttatttcatctggtgtaaatctgaacatcaacataggaaaactgtcatgagaaaatgaaaaagcataaacacagaagcaacgagaaatgtgactcttgttattttaaaccacagacggacttgggttaagggaatggggacgacagctttggtgctaagttaatcagaaattgcgagcatgcacagtggtatgccagcctgggtgatgctttcctaggagagccggtatttgcttgtaagggaaagaatggtattgtagaaaaacccaagaaatgaccacgtggtcagtttcatggtgatggctactgtgtactgtgtaggttacctgggtcaagactggtccagcttagagtgcatgctctgttcatactcagcctagctcacagtgacttgtgcttcactgtcaggatgctctgtaaagttcctcatccctgtgaagcagggaaagaacagaggtgcctctggactgcaggagaaaggcgtcgtgccaggcagtatcctgtggagggaggagggtgtacgttcgtttactatggatagtttttcctttgaattaaattgtagcgtgtcaggctttcttttttcttttcttttcctttttttaaactttgttattcctaagccaaatttagtttttaggtttctttttttctctataacttattcttgccttcccacctcaagcgtctgtataacatttagactacacataaagtttatgtggtacagacatgcccttgaggttggtggaaaataaaaaacaagacccttcacacagttagctcaggccattttaaggacgaaggctctgctggtcctcctgtgctgggaatctctttgatggcctcttgtgaagctcatgaaactttaacaagtgtttgaccttacagcttcctctgggaggtcgtgtagacccagtgggcaagcaggacaagggcccagaactgaaacttgatcttaaaatttaccatggaaatgaggtcttaggctcttctttaaatgtgtgtacttttatctgtgagagactgactatagcagaagcggattcaaagaagacagaccttgaccaaagatgctgaaatacagtgttgggatccttgtactctggaaccatgccatcactgatgtcatgctcatgctacctagcatgcaggaggatgccatctgtttctttgagccttgttagagaaggtaatgctagaggaagactcagtcacacagataacaggcattggaaacagccgcactatggcttctttgagaccctatttccttttctggttgtggacaaggctgccttaggactttgctaacccaataaaacctttagattctggtgaagccagagcctctccacagtggctaaggttgttgttgatctttttctcctttgtgtgatcatcacagatgccatttctgttttattgatgattatatgagacttttaatacataaatgaacgggtactggtgcctctttatttttaaaaatttgaagaaaaagagccacctcatattcatagagtgtgtattttgtgagtgtgtgagcatttgattggaaataagaaagttattaagtaaatttttcgttttactttttccacagcagctaacgtgtagggagacattaaacccacaccaaatcatgaggggctgaggacccccaatcttcttctctaggtcgccaatcccacaggctgtacagctcagttccctatgtttatgctgtgttgttcccacctcagtgctgtcagcctttgggacagtggctctcaaaagccaagagctcttggtttatctgcacagtacaagctgctggtagactacactagccctctggtttcccagcgcagcctctcatacagtggactgacagcctgcactctgtttagtcagccgactcaggttatcttcagggaaggtatggaggcatggtttgtttcggttcatctccaggatgtatacagtgaagacaaaccaaatacttttcaccattgaactatctgtacattatctttggtaacactagactagtgtagtcttggggaacacaccgaggaaacatgtagcgagaatcacatacaaggcttggtgtttcataagcatgcctgctgacagctgtatgtggtactgcagtgtttaccataaacaggtacaggcttcatgagtttttcatactgatttacaattgagtagataccaaaaacagagtggcaagtgtattttagtagcagttgaggcaattagttttagggtgaatttttcactgttgattttactttaagatgtagccagagaaagttttgtttttaaggcattttaaagctgtagcaggcgtatgcttcattttcttccaaagaggcaaaagcagctagactcgcttacagcacatgcttcgctccatggtatgggtggacacctacacttgtcagtagcagtcttaaactcctcactgccaggcaggggtgggcttctgtaggatttagtgcctgaacatttcttttggaaggggctggagtgaatgtactgggtatgggaggggagcagaaggaaataggactgtgagtgagtgtgcatgtgtgggaattcatcataacccttgaagctagcaagcgaccgctgttggccgagcttcactcatgactgcagcgtgcatgtatctcttcaccatgtcttctctcaccttcactaaggagtcaccagatcatctggctcagatgctcaggatgtattcctttggcttaccccgtgctcctgggttctatggtgtttctataattatgaatagtgttgcactgtaatctatcatatagagctatatgtatggaaatttttgatcagttttttaagagatgtatcctgtttgcaaaggcacaataaaattgcatcttctagattataggcaataaagataacaataaaccttatttaacaaatcagactgatactctctgcttatttgatttggtgggggagggaggatgtctaacatatccagtagtttcagggatttcattttaacttaaaaactctgatatatttaatttataaatttcggactgataaaaaaatagagttttggaaaactataaaaaatgctttgttaatgtgtgtattcctatgtaaaacacatggcttcttctgtgtatattttttaaaatta

SEQ ID NO: 31371 - DNA, 1240 bp, Mus musculus
aggtcatggtggaacacttcttccgacaaggaatgctggatgtagctgaggagctttgccaggtaagcacatgccagtgaggcatagggaaaacaaacaagacagcgctggtggagtttgcagtgtctgcagatgggtcttgggtgtacctcaaactgtagatagatttgtaatattttaattatcatggataagtcattttgctagaaaaattttaagttcttagaaattataatgctataatttagtatctgaattgccctttccttaaaaaattagactcagagttaacattcaaattgttgtttctttatactgagtctgttaggttgattgctggtcatgagtcagagtatggaaagtagtactacttttcctgtgtgacccaggctcccctgtttcagcctccctagtgctacacttattggcatgcaccattcactccggctccttttctccctgtgatacagatgttaatagagcagaaaagaggaaagaaacaaaaatattagtgcttgcttttctgatacagtagagctatatcaaacgaaatttcaggctaaaatttatgtccagtgggcattgcccgtcgtgtttctgttggacaggagcaccatgtattcatggtagtagtagctgctgtgtattatgtgttttctccaggccacaccctgcttttcctttctactacattgtgagataggagttactgttcctgttccacacacaagaagtatacccaaggaatatacccagggccatccagggagcatgtgtgaaggaacagggggatttagtccccattcatttctccaaactccattctgttgcatttttatgttgttaaaaaaaaaaaaagaagaactcagaagatataataatgtaaagggcatcataaaccagtctataatctaagcctcttctgtttgaaacagtttaaatccatcgtagtgggtctagctttgtgccttttgaggtgtgtgtatccatacagacctcacagtaaactgtgtcattgaaaattagtttgttttcaagtaacagactcaagatagcagcttaaacaaagtttggttttcttttctagaaagaaaggtagtatgagaggttcatagcatctgtcctgtgaagttcttagacactccttgtagctctgcacttagtttccagtgagtcctcttcttgtggtcagacctccagctgcaccttacatcccaggaaagagtgtgtgtttacattg

SEQ ID NO: 31372 - DNA, 1228 bp, Mus musculus
gcttggttcccagttactggaagtgttcaggaaggattaggaggcgtggccttgttggagcctgtgtctcactcaagggtgggctttgaaatttcaaaagcccacaccaggctcagttcctttctttctctgtctgcgacctgcaaatcataatgtacgctctcagctacagcacaatgcctgcctgcctctcaccatgctccctaccttgaaaatcatggactaacattttaaaactgtaaaaaaagccctcaaataaattttttcaaataaatgtttttcaaataaatgttatcccttggtcatggtgtttcttcacaccaaagtaaccctaagatactcagcaaatgaaaatagccaaactggtttctacataaatagccatggagagtaaaattaagttgaagtttcctaagtagttgaatttgaatgtaatctatttggtggaaaatctatgggttcttgttcttgattatagtgatttggttttttgtttgttttgttttggtttgttttttgatgtttttgtttgtttgatttgtttggtttggttttatatttgtttgtttgtttggttggttggttattgggttttggttttttttttgtttttttttttttgagacagggtttctctgtgtagccctgcctgacctggcctcacgttgtagaccaggctgtccttgaattcacagaaatctgattgcctctgcttcctgagtgctggaattaaaggcatgtaccaccatatacccttctgaaagttgtatattttatataaagaaatgactaaagagaaaagctatgtcaggaaatgtgtagacagtttacttctgggcttcaggacactcatataaaacaggtgccattgtgggctggagatggctcaacagttaagagcacttgccactcttgcagaggtcctaaatttagttaccagcacccatgtctgtgtctcaaaaccacctgtaactgcaactctaagggatagcctcttctggcttccctaggcaactgtgctcacacgcacattccctacacagacaggcacacatacacacaattaaaataaataaatggtactaggaaaagtaggtaacttgaaaaactgcccaccacttttgcttaagtaaaaattcaagacattttataaagaacaaaatattggaaatagaagaaagatgaaataaatccatatatatcataaaaacatacacacacacacgtc

SEQ ID NO: 31373 - DNA, 1208 bp, Mus musculus
cacaaaatggtctacataatgttctgaagtgaaattgtatgcttgtctcatttaagttccacatgttcagttttatacgagagagcaaaatgtaacaggtgaatgaaagttcttaataagaaaaggttttaagagatgcagtgtggcctgcagttcagctgcttggtcattttcaggacattcctgaaagcaagagttcaagggcagactagacagtggctcagaaagcaaagatttttcgggaaagtctgggtgttgtagtttctgagacattaccatgcattcgttttaaaaatttaatccccacattaaaaatgaaagtaacattgtaaaagtaaagactttagagttggctgttcatcatcctgcaaggtctgtgtcttgcccttaactttttccggtgtgttattttatgtgaaatggaagttggatgtaaacttgatgagatccaagttaaactaatttagcaagaatgtctgggcgcgtggtggcgcacacctttaatcccagcactcgggaggcagaggcaggcagatttctgagtttgaggccagcctggtctacaaagtgaattccaggacagccagggctatacagagaaaccctgtctcgaaaaaaaaaaaaaaagtctcacaaggaagtgtgaacttcgtactatgtacatgttaaaaaatagttctgggtgtgtactggctagttttgtgtcaacttgacacaggctggagttatcacagagaaaggagatccagctgcaaggcattttctcaattagtgatcaagggggaaaggccccttgtgggtggaaccatctctgggctggtagtcttgattctataagagagcaggctgagcaagccggggaagcaagccagtaaagaacatccctccatggcctctgcatcagctcctgcttcctgacctgcttgagttccagtcctgacttcctttggtgatgaacagcaatgtggaagtgtaagcctaataaaccctttcctccccaacttgcttcttggtcatgatgttttgtgcaggaatagcaaccctgactaagacagggtggaaatgaaagagatcaccagtctgtgtctgggcaaggcaaacttctgttatggatcaggaaggtgtgctcagaagagtcaacttacagagacagcaagtacacctggtttttattcttactcaggtggtaactgtgccttttccacact

SEQ ID NO: 31374 - DNA, 2492 bp, Mus musculus
cactgccctggcacgggtgtgagtggagtctgtaaaaccaaggaccttgttccttatgcagtgggttttaagccgttcactctcccttcaggagccttgggcaaagcacccagtaaagtaaccgatgcccttcctgagcctgaacccgcaggagcgatggctgcctccgaagagggagaagaggaagaagatgaagaggacctggaggctatgcagtcacggctggccacactcagaagctagggccacccagttgggggtctcaactctctggtgtcctcctctaggtgtgtatctggcctctgaggagtcaccatttcttgtatctcttgcactacacctctgctgtgaagcattacatttggagagggttctgtgctggtatatcttcacgatctgcagaggatttaaggattgcttttatgaaggtggtgtaatcaaatgtattattttcaggagcataaatagcagaagtatcttccttgggggagggcaaagaaatccattttctcatgaagcaattttgagaagagtagattgaatgatgaggactctatatttggtgtgtatgtgtaaaataatatattaatggatgtcaataaacttctgctttagctcttggtctcattgtaaatgtcacatgcaatgaactcaagatattaatctcccagattgtctcagtgttggccttggaaagaggacatgctatctccaagcatcgggacatgggagcttagcagaagtaccttcagctccggggccgctggtcctgctcttcacaggctggttgtgggggccactcttgtgcattttgtcatttgtctaaccttcgggttaacgtgctgtgttgactgaatgaccatatcatacactggtgtgtacaagggagtttttacagctggtaggcattcttccccactgcaagtgaaatgcaggacagttagatctgggatcaggactcttgcagtccatccctgcttggagctaagtgtcttgtacccagggacgtagccttaaccatgagcaggaagagctaaccaggaagaggtttggattatgcagtgaaacacacacagcagagcatgctttagatgcattgagaaatagcccagcagtagcactgtgtggagcagtttgaaaagctttctggtatgcatgatcttcacaaatgaggacagctgtcatctgaagtcacaaaccctaaagtacaatagccagtatccgccagtattgtacagaatggctttgttacccaaaacacaacccatgtgctgttcattgcttcctctaatcccttggcacccactgacccggttgctgtctccatgggctttcctttcccagcctttcagtatgtcttccctcacgtggtgatatgcatttacgttcctccgtggattcatgacttgactgttcagcccttctcattgagcagcgttccattttctagctgtaccacagcttgtcttgaaggccacctggactgcttctgagtttgggagtttgaagcaatgtctgtagcaggtttccctgtgtgttttaattcctctggataccagagagctcaaccctgggatcatgtggtcagcacaaacctgtgctgtaaggtaaaccagccgtgcagagcacgtactgtccccgtctcaggaggaagagttctgcctgccatcctgtggctttggcagaatttgtcatgagggatttgtgttgaagtaccctgggcatgtttttatacttgccttctctgtatcttgtttgaaaatgttgacatagtggccttgaactcatgacctgtctgctctaccaccacactgagcttgccgcctggatttcttcgttgttggtgtttgttcattttataacctggattgtttgttttctgattattcaagtttaaggacctcttacagattttgaaccaatcatctatcagattatatcctattctctgttctattctctcattgttgactgtttttcaaagctgaaggtttcttttttacttttaataaaaccctgcttctcaattattttgtatattatgcctttggtgtttaaaaaaaaaaaagtattgggggctggagctcagcagttaagagcactgggtgctcttccaaaggtcctgagttcaattcctagcacccacatgtctgtaactccagttccagagaatctgacactctcaaacaccaatgcacataaaataaaacgaaataaattataaaagtattactacgggggattggggatgtagctcagttgtagagtactgacctggcacgcacaaggtcctgggttcagtcttcaggtaccaacacaggcacgaacccacccacacacacatgcacaagcacaagcattgctcatgcatgcacacacacatgcatgctcacatcctaatccaaggtcatttaaaatctctatgttacctagtaatttatctggtttagttacgtgtatttattgtggtggaatgtggaggtcagagaaca

SEQ ID NO: 31375 - DNA, 1628 bp, Mus musculus
ttgctacttgtggttgagcaggattggaagaactgaacattgggatcagatggggctgttgttcagagacttcgagtagtggtgtgaatatgtgtgtgtggcagctcacattgcaatcccagcttcactaatccagagtctgaggagggtttgaaggccaccccgagctatacagcaacatcacaatttaaactaaatcaacagtgaattaatgcatattgcttcaggtttgaaaactacaagtctgataaaacactgtatactcatccttggccaaaactgattgtaagttcttcagagaaggatggtgtaggtatggcatactggtctccaggagccagaggccctcaaattacatgttgagcattaatttaagttctaagagaagtttgtgtatgtggtgaaattattcttggtgagagattttaggttttaatgaaacaagtaattttttttcttctgttgctttaggtgaaaaatgttatctaccatgcagtgaaagatgcagttgctatgctgaaagccagtgaatccagtttgggcaaaccttaactcttctctgcacaatggagatgaattattggcagctgatcaaactcttcaggcaggattcctgtggactttgagatttcctgttacctcatcttcttttttaaagtacacctgacttgggagggtactgtctctaatgtatatttctagtgtttacagacactaagtgtgtatatgtagtaactatttacagaccacgcatccttatactgtgacttcacctagatcttctaccaagctgaagaccctgctggctctgaaacaatccttgcagttactccccagctgttcgtctggacagctcattcaagtggatttttaactattagggatcactgcgaagtttcgttggattttattttatgtccttcagagcaccctcccccacccactagggtccagaagagcaatggaggaagtgacagctaatggtgcagttctaaatatatattgcataggactggcattatatagcagaaataactactgtataattcttggggttaaccatctttagttaatggaattttaatttaaatgaagctttgctaattttaagtggtaagcattttgcattaaaatattcctataatattttgtcgctgttctttgtcctttattctttgtttactctctcgaaaataaaagggctaaactattgaattagataatcatttcttagtgactaatacagcgctgatctgtcctgcttttgttaagagccatcaccagtttgaaaatgggaactaaccaaaacccaaatagtgactgttaactgctagggttaggacagctgcacctaaagtcctcatctctgtgaagggacagcattggtaaagaaggctaccttgtggtccctctcctgggctgcagaaggaatttgttcattagtgctaagcagacaaggcctagagtgtaggtgttaaccttccaagtaataatacatttctaagtctatcgaaacagttggtgaatatttcttaaaagctcctttgtagatttggatctagaagctacactattgcttagaaatcagctatgtcagaacagcagcgtagggaagccaccttcaagcc

SEQ ID NO: 31376 - DNA, 1200 bp, Mus musculus
tgtcagggctgagtttcatcttaacattgcctttggaaagacttaggaactcacgctctaatgagcctcgagggtatgtgtggacagcagacaccttcaaatctgtgaggtcctagctgcagtgcttctaataagatgtctctctttctgctgttgttggtttacttatttttacttgttactgtctttgctgtcaagatccagttctaggagagattgtctatgaaggttacatgataaacttgggtcaagtacaaaatacacatctctctcatataccctatctagcctgccttttaagagaaaaacagtgattattgtttgttttacttaggtttttttaaatccttccaagtgactagcaagtcattgtctgccattagccatggagagtacagaaaaacaggacaggatttattgcctgaaataatatttatgtggtaattagaagttattaatcaatcttgttgttttcccacttccagattacaattcaacaagcatggtgtgttgcgggtagaaggcttcttaacaccaaacaagtatgacagtgaagcgattggcttgtggctgcctttgaccaaaaatgttgtggggactgatttggacacagcaaaatatatcctggccaatattggagaccacttctgtcaaatggtgatttctgagaaggaagctatgtcgactattgagccacacagtaagagcatctcttagggggcaggatgtgtgagtcctacttgacctctgtttctttctgacacctaagttgcatggattttattttcaccaacatggtgatactatcgtgacattgcagttttctttttatagtaggtttcccctgagatgttctgtctagagtttgttgtggaagaggtctaaggtgtagcatcaccttttggtttgaagggtcaatgtgagttgttagttgcatttgcacagccttaaccagatatataggctcaccagaagctgggatcagacctcgggttgattacaacaaaagattcttaattcgtggtacatagtaaagacggtaagaccagctaggcataccctaagcctcctgagtcccacaatgtcaggctaggttccaggcatttgaatggaaccagctcagatggagtcaattcttcccacatcctggtttgaaaggatagctgcagctgctaccttagtttgagactctgctctttc

SEQ ID NO: 31377 - DNA, 3584 bp, Mus musculus
gaaaaaagttcccataggaactataaaactcagccaagggctggagctgtcccctgaagcaaggaagccatgccattctgtatgcccttccttctcttcagcctcaggaaggagcagtggccttcccggggggcctcagcctcacctcacagggtgcaacgctagaatctgattcctgttgtagggaacccagctctacccaacaacagagggagctggctcaagtacccctacctgacgctgttccccaagattccaccctcaagcccctctctctgctttctctctcaggcaccgcctagaaccctacgatcccgcttcaggaagaaaagtacctcatcctcggccactgaaaccacgtgagatgagccaacagccccggatccacacatgtctgtctcctctgccttaaagagctagtcactagtaccatggaagtccgcaggctgggtgtgcttcgagtgtgcagcccacggacatggcctttactcgctcccctcttctgcctttaagactcttctgttctttcctttttgttcctgctggggagaggctaaagggaaaaggtggtggtggagggtgacctttacgtcttctggggttagtgattttccccaattggattgtcattgtggccgcagtgtttttagatctataagcactctttccatgatgctgctgagatgtacatttgtaatttgtttgttgcatagtttttagtcctgtaaatgcaaacgacgtgatcttttttaaaaacccttttgttgttcttggtactaatacattggactatggtgtacatagttacagcttttggcttaatgtaatgaactcgcaagggctgccagaagttctggtgagagagctgcaaaaacaaaaatgtagacaaatattttaattctaggcaatgtctccaacttccttacaaaggcagtgccagtaaggcatcccttctcctgcaggaaggcggtggtgtgcttctggcggctgagtggttggtaggtcagagcggaggcaggagtgcagtgttccagcaacaggaagaaagttggtgggcatcagggaagagggaggaagagtacggcttcttcagttctgggtccctggctgtcctaataggtttgttgtgctgtacctaatctcacccttcctgccctttggggtcaagaacagaagcttccgagccctttggggagcactggccctgcttcaggcaggccagctcacccttacttagcacggccatttagggaatgaagatcagctgctggcagaattgtgagtatctcagaagggcttggcaagagtgtttctccttcagggaccagcgctgtggccgacttctccaggagcctacatctgagcaccttgttttagagtacacaaggcaaaaagaaaagtctagaactagcttttgttacagatgtgctcaaaacacatgagacactcaaatctcaaatggtcgccagaaggcagggtctagggaggactgaggctaagccacaggcagctgtggctcttgctcctttctggcttgtgtggaaggtgaatgggaaggactgacactcatgctcactccatgtcttcgtggatgttttatacaagccaggactgcagtgagaattttgacaagtctctgacttagataacattgcgttgagggagctgccctctcctctgatagctgagccaaattgtagggctagtctgtgtgtgcgtagagttggtgttttcgttccatggaatgcatgcagcagtcacaacccagttactcctatttggattatatttgttcacagctatgccctgaaggctagagaaatagtgttgtataccacatagaactgtcaactgactgcaaacaggctcaattacaaaccgctctggtaccgagctatgcaaacatgcactgggagactgctccatcagctgggccttggccatttcacaaagggtttcagttgcgagttcattgctgccagatacacctaatggaattttccaaaggtgattttgtatttcagaactaacccaagagctgatgactgacggtaaatagtctgcctgggccccatatccatctgaacccattaagcaaagcatctgccctcttcaagctcaccccacagctccagacaagagaagtgacacccttcaaacataccaacgtgtcagctgggtgtagccaggatgaagaggaacaggtgcaggaaagcctgagagaagcagctttgcagctccccctccaccccccgaaataataaatggctttagagacagagttcaagtcctagtgtattttcatcgttttacaacaggaagtcataacacatcgaggctcttgagtttgtactcagccatgccaaaacccagtttgaagcactcctcagacatgctgtattacttctcgctcaagatttaaaatataaaggtatctaaatcgttgtcttattgtaaatgtaactccttttccttcaagtgttgactaagttgtttcctctcttaaagacactcactgtacagccaaacacagctgtcttacttcttgagaactgtgtttacttttctgacaagctgtgtatttgtatgtagactgacatatgatgtgaatgaccttgtatgtagaagtgcggtgctctgtctacgcaggataaatgaatgtttctagttcgctgacttaagacacaggctgtttacaaatcgctagctcgaaggtctacttgtcgcggctttgagttactctccatttctgcagaggtgaggtgcagtctcctgctcatcaactggagatttagtcataatgcctcctgagtttgtgtgaatagcttgctcactttgctggcctttgatatgtatgttctctgtggtaaactgtccatgtgtttgtattaagtgcttatcaaccacaaccatcacgtagccatcccagttcttcaccttgcacagtatttgaagtattagacgtggtggaagatgtgcttcatcctctgacagtggacgctcgaagagctcatgttccagattgtgactgtgcgcatttcctctagtttctttctgaaatctctctataaatgagtacaattaatagtatactggactgtgtatctacaggatgtaaattgcagtattccaaaggctgaagctctgctgttttgttataatgcctgataaacatcttgaataaagtcttaacatttttcttttaaaaaaatagtgtaatgttgggctaatgagaaaagaaatactttttaaaaaagatttattgccaggcagtggtggcacatgcctttaatcccagcacttgggaggcagaggcaggcagatctctgagttcaaggtcagctcacagagtgagctctaggacagccagggctacacagagaaaccctatctagaaaaaaaaattattattttggtagtttttaaacaattaaataattattgacctagatcagtaagtcattcctcaatggtcctaaggaggactaccaggagatgaaaagatatatgagataggaaagctgtgtcttattccagacaagtttgtcaagaagtacagcatcttttttttaattttgttttgt

SEQ ID NO: 31378 - DNA, 1199 bp, Mus musculus
aagctaaggagggagacactgcacagccttagacttttctagagtcgacatggatggttcagatctctgttacatggcctcagtgccttggcttcccctgtagccaaggacaggctaggcagaggacagcggccacaggctgaagtagaagggctgcaggcacacctcggatggaaagggaacttcttcatacatacagcttttgtatgtgggtaggggagcctttcatcaaagccaagtttttagtttgacaacaaagcagtttgctttagagcctgcctaaatgatgttcaagtgtatgcataactgtttatttacatgtaatttattgaacacttgtcatatttaagcaaatctgcaaaactctgctgcacctcatgccaaccttatacaatcttatacacgagctatcatttatccctgatataaattgaaggcactaaagcttatagaagctgaaataaattactctaaaatatagctaatgcatcccagatcccctgtctaactctttggaatcttgtgtacttcctttgattttctaacaacataggatactcatatcttgatcaacaaatgactgtgatctgacactagtagtaaatactctacccgttcaagtctgagttgtgtgactttgctctctacctgtcaactctgttggtgcataaccctggcttagtaaatgagtaatgaatgaatggatttctagtctttcttcccatctcttcttcctgttttctgccctctgaatctgctgctttagtttctagtctgtgtactgtaaaaacaagagaaccgaccacacttgaaggtctttgtgacctcccagtgaggctagagtgagcctgctgccttactgttggttggttggtttttgagatagagtctcaattagccccagctggcctcaaattgatgtgtaactgaggatgaccttgaatttctgatcctcttgtccctacctctggatgctgggatggatggatgaaagtcatgttatatcacatcctgtttatgcagtgctggagacagaacccagtaccttgtgcattctctatgacactatgatagcgatggccctggtgcctggtgctcatagtttcaaggcaagggatgcagaagtgctatgggcatttttaccatccacagtggctctgcacatacacaagcctgttctaacctgcataggcaatccc

SEQ ID NO: 31379 - DNA, 1250 bp, Mus musculus
gagtgcttgaattacacatatgtaccctatgtctagcttgtgattttaatttaaataatctttctaaagtgttaaattattaatcctcttctacacatgctttttaacctgttacttattgcaaagagaaacaacccaatctctgtaggtctggctttgctctttgggcctatataccataaattatggagcatctgctgctgcctttgcaagttttaaaatgtctttggaacattatctcataggctggctataagaaaaaattatggaaaaagtcaactgcaagaaagaagcgcttgagggaatttgtgttctgcagcaagacccagagtaaactcctggataaaatgacgacatctttctggaagaggcgcaactggtacgctggcgatccttaccagatgtaccacgatcgaacaaacctacgagtatagttcagagctatcatagttcccagctatggaatgtgggtctttgtgtacataatgcccttgcaaagtgagtatgcgttaaactgtaaactgtaccagctgatcggcaagcttagattaccaccattgtgcattaaacattcccagagttggtcatagaactaaaagttaaatttattgtgcattatttcaaaaaactggtaatggctttccttatttctggaatcttggatgaggaaaaacacgaaaagacgctcaacagtgggcctttgtgtggaattgagatggtatccaggtttttgcacatgctaaacagacatcttacatgcctattcccaatatgacacatgctgtgtttaaaaaataaatacctaggaactcaggaacctcctcactgtctcctacctgtaactctctgccccagctttggggagggcaggaattggatgaagcaagagatggtgggactttatgccttggttctactgtgagagtgtgtggtgtgtgtgtgtgtgtgtgtgtctactcaccatcactctctttagtcttggcttttgtttatgtaaagtttctatctctcagactcccttcagcctgaacctttgggttccctttaacattacaaccctcaactcttgtcatctcttctctcttaattgccagggaactctcattgggccatcctgccttttcctcgtaagtctgaatcaatgccatcatgcaatgtagagcttatctgtttgtggctaggactccacccaggctctcttagttgtatcagtaggttcatatggagtaaaaaggtaggtgtgagctgtt

SEQ ID NO: 31380 - DNA, 1199 bp, Mus musculus
tagacacacatatgatgcacagacagatatacaggcaaaacacccatatacagaaaataaaaatacttgtgtgtgtctgtatgtgtgtgtgtgtgtgtgtgcttgttttgggggggaggggtagggagtgtgtctgtcagtgtacttgtggctcacaggagaatttgtgggagttggtttccttctgaatatttgttagggctaatcatagttctacataaaatggcatatagtagtgattgtgtctacaagctgtctttttagaagtaaagttagtaaattagaaagccaggacatgatgagttcagattacactgatttggagttcttagaaagagcagtgtatgctgcctcacacttattattattattattattattattatcattttattatagactcacccattattttgcttagaattgatagtgctttagttgctggatagtagtttttaattgctactttgactggaggatttgaattttgtgttagcttctttctgcagtatattttcagtgacagcactaacactttgatgttacctgtttagctggcaaactctctactgatgacctgaactcactcattgctcatgcccatcgtcgcattgatcagctcaacagagagctagcacaacagaaagccacagagaagcagcacattgagctagccttggaaaagcacaagctagaagaaaagcggacctttgactctgcagtggcaaaagcattggagcaccacagaagtgaaattcaggctgagcaggacagaaaggtagtggaggaagagaatgacctgacatttgaagttaaccttgtttgttctgtcactgcctgctagtggtaaatataatttgtgccaagctatcattagagtggtgttttagggttttttttttttcttttttaaagatttatttatttatttattatgtcagtgttctgcctgcatgtatgcctgagaccagaagagggcaccagatctcattatagaaggtcataaactaccaattggttgctgggtattgaactcaggacctctggcaattgaaggtgtgattattcaaaggaaaagagatacctctgttcaccatttgtttgtttgtttgtctattggcgtggctatgtttttggttttgataattttgtaattatatttatatacagaaaacttagtgtgcatttaaccaaattta

SEQ ID NO: 31381 - DNA, 1597 bp, Mus musculus
gggtacttggctgtggtgtggacttgcagtctcccagtttttagtgttagtagaatcaggtcctcatcaaacagtgtcatctcttgttaatttgtgaaaagactgactctggccaagttaacaagacctgttggatgcagtgtattgaaggtgcatctggtgtatgtgttcgaggaagatagaaagtatctttctttgctttatatcattttattattattatttatttaattaattaatttattttttattgtaggtcatgcagttgctgaagaagaagccagaaaagcccaccagctctggctttcagtggaggcattaaagtacagcatgaagacctcatctgcagaaatgcctaccatcccattggggagtgcagttgaggccatcagagtcaactgttctgataatgaatttacccaggctttaactgcagccattcctccagagtccctgacccggggggtatacagtgaagagaccctaagagcccgtttctatgctgttcaaaaactagcccgaagggtagcgatgattgacgaaaccagaaatagcctgtaccaatacttcctttcctacttacagtccctactcctgttcccgcctaagcaactgaagcccccggcggagctctaccctgaagatataaatacatttaaattgctctcatatgcctcctattgtattgagcatggtgacctggagctggcagcaaagtttgtcaatcagctcaaaggggagtccagaagagtggcacaggactggctgaaggaggcccgaatgaccctagaaactaagcagatagtggagatcctgactgcatacgccagcgccgtaggaataggaaccactcaagtgcagcaagagtaaggcctaggaagagttgtgtaatgtcatatttcatatcaaagaaaatcagcattggtatctgcagggtttgcaacaagggtcccagaattgtccagaagtgagcaggttccaagtcctgtgtgagatgttaacacctgttgcatttaccgtccttacactgctatcatgccaatgaactccaggaggctttatttgcaacttgtgtaacacttcctgttttttaggttttactgatcaggcttgtgagccactcaaaataatgtttgtgatccctactattgattctgcccttggagcaaactgaataaagcaacacaatgaaaactgagtactctatcccttttcaaagctgccatttccagtttgttgtgtgagcaggaagcttccttgagaagcagcatcagtggtaggaacttgtggccacagtttgggtctgtgagctgggtaacctgaatgaagtccaggacctgctgctttgggtgaatgggtcccctcctgacagtcacaatcaggagtgatgcagaagccaaataaatgccagtgtgtttatagttgggaatctagcactcagcgattgagaggcacaggaaacagtctgcctcccacaggaaaagttgtttgttgtgctggggtccagcacacatgcatctctacctcagttctcgagccaccactctcattcctgctgtggtgctgcttcccagtacctgaagctcatgagcctgga

SEQ ID NO: 31382 - DNA, 1099 bp, Mus musculus
gaatggcaggaaaaaataattgtaaacagtttttggtcattcaatcctaaataatacaagaagtatttgcctagattttatggcatatcagatattactggtggtctagaaatgttttgaagtacacattagggtatgtgtgggttatatgcaaatatgtcaccatatcagcatatagtagccaggcatcagtgggattcttggtctatatccccatggataccaagtggacactgtctgcagcaatgggcttgccttatacttggtgttctctacaggaaatacaaggttactttaacatttgagagacattttttctgtagctctcttgattttgatggaaactgattgctttgttagccagctttaaattccatgacatttttctagcatgattagatgctctaacccaaattatgtgctaacatgctgtagatacttcagtaattacttggagattaggtgggcattaattgacttcatggtgctttgctcttctcactgattgtatgaatatgacaaagtattgctgtctttacggtgatctcatctgcttatgagatgagctaaaactatcttcagaggaatagaaatagtaacattgtgtttcagctttattttggttagctgtgtttttactggtttttttttccccccttcatctacctggtaatttgagaaccctcacttgcaacataccatcatattattcacctcttttatccaagaggtatgtataaccttacattatcttgatttgtatataaattgaccatctctgttgagttgttagaattgttaaagtatctgctctatatatgaattaagaacagagaattcactgggcgtagtggtgagtacctttatttaatcagaacactcaggatggggaggcaggtggatctctgagttcaagggcagcctggtctacctacagagggagttccaggacagccagggctacataaaccatgttttctggaagaaaaaagaaataaaagagttcagaggtgggaaaaaacagtgactgctcttccataagacccaggttcaattcccagcacccatgtgatggcttaaaatcatctataactccagt

SEQ ID NO: 31383 - DNA, 1141 bp, Mus musculus
ttaggtttattatgtgagtgagcgggtgttgggttttttggagttcctatgggaatgagaacgccagtgcttttggttgagcaccaggctgtcttagggactgagccgagctcccacactgagactgacatgttagagcagagcttgtagggagctttccggtgtgtgtggaaggtgtccaggtgtactgtcttccccagttctacccattagatgtgagtgacttgtttctgcctcattctcagttgtgacaactgaaactgtctctaggcattgccagtgcctcctggaagaaacccgcttcactgggatgccagcttcccaagagtaggcgtcttctgtgttgtgtgctcaccttcccagttggggagactttgatgatgttcgctttttcctctccagcaccgagcttatgcacaggcactgaacgtgtacacagagttattaaataacagacttagtggtgagtttaaggccctcacacctctgtcttcctctaacgcagtggttctccaccttcctgatggctgcaaccctttaataacattcctcatgttgtgctgacctccaatccataaaagtattttcattgctacttcatatctgcaattttgctactgttttggattgtaatgtaatacctgatatgtgaacccagaggtcatggcccacacagatggggaactgctgctcttactaagattcagtgaggtctttggattttgctctagttgttttggggcttgggagggtgtttttgtttgtcttgtgctcataattaaaacgggagtggagaactagttctaaggccttactgaggttagctaagacaccaagactgaccattatctcattttcagcttttatgaggtgaattttcagcctcacgttttgttacttttcccttacagctgatgtatatacctttaatgcattgattgaagcaaaaacattcatactcaatgagaaatttgaggaaaaatggaatgatatactggtaagcaagcagcttctttaccttcagctaccttactagtaaaggttaacttagcatttctgtggagcagctcctcagagcctatctaccaggagggaagaaagcactgatcatcagtcaccatatacagcaagaattcaggaa

SEQ ID NO: 31384 - DNA, 1205 bp, Mus musculus
ctccgttaacctgacctagaaaattcctcacaggcatatccggaggctggtccttttggctatttttgaatctgtcatgttgacagcattaactgtcattagaatgggagtgctttgaaggtagagcagtccctttaaaagcatcttagaatccctagtgcctcgcttagtacttgcagtaaaggagttctcatttgaaatacattagaaacattagcaaatggagtaaaagcaaagtatttagatcaacctcaggttgaggcccttagttgaaaatatggagtgaaaatttatgtttgaatatttttaaattttcatcaagtcaaggagatgcctaaacagccttctgtccaggctgcagacgtgtactggcctttctcgcttacttgtatattctgttgtgggctttgtactaagatgtaggtgttacgtggtgtaggaaacaggaaccagaacagcctcgcctagtgtcaccctgccaccttggcctgttcgtagtcattcacttctcctcttgttctagtgcttaatgcctgagtactttgagcctcagattgaagatgtaagcgaagctgccctggaggagcgaatcagactcagaaaagtcagagcttctgtggacatgtttgaccagctcttgcaagcaggtgactcttttcagtcagagccctccttcagcatggggaccttgtatacagtccagttagcttggagtaaaaatagcaaacaatgcttactctgcttgctggcgctgtttgtgatttaattgatatagtatgcataattcattttctgctcctagcttcaccgtgaaattataagtgaagtagagctgcaggtttattcccttctgtcctgtgcactggcaaaggaagtacatggcctctgtttctagccttaggtgtgagaaggcagagccaaataaaagagaaaacttgatctttattttatgtgtgagtgctttgcttgcatgtatatctgcatcatttgtgggcctactgcctggggaggccagaagtgggcctctgatcttccttaactgtacttataagattcatttattattatgtctaagtacactgtagctgtcttcagatgcaccagaagagggcgtcagatcttattatggatggttgtgagccaccatgtggttgctgggatttgaactcaggacctttggaagagcagtcggtgttcttaaccac

SEQ ID NO: 31385 - DNA, 1142 bp, Mus musculus
gaaatacttgttagatggatgaatgatttacagaagtacaaggccagaaatgtgtgacaaacacaaaagcataaaaccaaactgtaaaaccaagaacacaactgacagcagcttgaccaaacgtagacacaaatgccaaaaatctgccgagtaactagaaccagatgtgattaaataaagaaggcctgtggaactggatgagtttgaaacacatttgccgtaagacagaaggcagttggcaaatgttgaggccagtagtaactccggtcctgtggtttgtgaggtggtctgtttctaagtgagggtgtggagccgagagtttgggctttatccgaaagctcttggtagagtggcctccaagcagatggttagaaatgaatgaatttgactttaaatttgtctttattctcttcttgtccttttgatttgcaggatggccagccattggcaggactgatccaagatcacatggtttcaggtgcaaacatgaccattcggggatgctttttcacccgggaacagtacatggaactggtgtaccgagggctcacagacaaagtgggacgcgtgaagctctttcctcccgccatcctgaagcccttcccactgtggacaggaaaacaggtaattgggagaatcgcagccagtgtataatttaaaaggaaataaaactcttatataacagtttcaaaactgttctaagagatcctagaccagagacagaaaaatctctaatcatgaaataatgtgatttttcttttgggtagaaaactcaaaggtgtatctactaagaacaggttgcacggcttctgtttattgactctaacataacttggtgtctaacttgattcaaatacagtgctaatggcaatggtgttacacctctaataataagtttcagtgggaaatactaagggcttttctgagttctttaaacttgttttcttagtgcttaaattcaaccttctctctttaggtgataattgcaaacttaatgttaaattacacattcaaggttattagagaccgaattggaattcaaacccaggattttattagtgcctgaagtaaccatataatagtatccatggaaatcaagtaatggagtacactacagtatattcttctactgttgcctgaac

SEQ ID NO: 31386 - DNA, 1074 bp, Mus musculus
gttattagacgcgttctcacgaccggccaggaagaacaccacagaccagaatcttctgcggcaaagctttattcttacatcttcaggaaaagagagcaagaagcaagagagcgaagcaagagagagaagccagagagcgaagcaagagagagagagaacgaaaaccccgtccctcttaaggagcattctccttcgcctcggacgtgtcactccttgattggctgcagcccatcggccgagttgacgtcacggggaaggcagagcacaagtagtcataagatacccttggcacatgcgcagattatttgtttaccacttagaacacaggatgtcagcgccatcttgtaacggcgaatgtgggggcggctcccaacaagtatatagctttgcttcagcaaatacagttttccccctaatggaatccccttttgggtgtcagtcccttggtttcatggggttgtgcacatgttgcacatggtgttgtgagaggttgccgagtctggagtgaagggttgtaaggctgctgatgctctagagaccccaccattggccccacacagcatttccaagatcatccacagcctataggcaagaaatactagtgggtttatgtcgaatgtttcaaactctgacacacacctttgagtatatcaaaaaatccctgagctggactgtgaactaccatatagctctcgactgtaatcccaattagtcaggagcctgaggcaggaggatcacaagttcaaagctagcttagatgacatatgaagactttatcccaaaactaaacagaaaagtttagggaatatttgagctacaggatccaggtctgggatttgcaggacagcggtgaactccagcattgcttctcactgcagagtggcatacagtgtcctcaggatgcatgagggagtgcacttagggcttctgactcctgttgcttttgatccacgtgtccctccgcctcaggcaggaagagagcgatcccagggcatcacaagtctttaggagctattggggttatgaaagccaggattctagaatctaggaaatgaacaatctgcatggctagga

SEQ ID NO: 31387 - DNA, 1984 bp, Mus musculus
gaccagtcctagaagtggagagggcatctgtgagcagagctctggatagagacctgggagagacaaggccagcgtgggtttgggagagaagtgctaactagcatttagtagtcacctcactctgagtgtcatgattgcctgggacaggtctttgcctcttataccatagtcatgaacactgtccatttgattccagaggaaccttaattggacagtaaataatgatgccatgcccctgctatgctttggacaggccaaggtgaattgcccaaagcatcctggtcagcaccatgccatgggacagactctgtccctgttttaagtgttgagctggttcttaggtcatcacggccaaccaggttcctgctcgcgcttcccctgctctcctccagagccggtgcctggagttggagatgcctgtcccggtgccttcccacctagctaagacacggcttgctgtctgttcagatgttacagatgtggtatgacttggatgaagagagccgatggaaataccagaagagggctgccccttgtcccgaccctagcctttctgtgtggcgcccagacatctactttgcatctgtgtctgaaacatttgaaaagaagattgatgacttcagtcaggaatgggcagctcaagcagagaggagttacaagaaatcagagctttccctcgacaggtgagattattgacctgtgacagggtgtgtgagcctccaggccaggccaggagaggaaggcaggcagccttcacctgcgacccagaaggtctgctttgccttcagaagcatagagaagagcttacataggcacacagctctatggcttcctccacgtgtgctgcctcacactcagttgttcatacacatcccgggttgctgagtgagccccttccatggaagataatggtggttgctaatgggccagccacctgggaaagatggttagtacattacagagttgtgcagtgcagaccctgcataatacgggtgtgatttacacaagcagatgcactcccctacctctgagtgcttggtaaacctcaacctatttccagtgggtacagtggaagtggaaaccaaacttctcttgctggtcggggagggaatgtgaatggtcacaaagtaactactgctcagagggcctttgtcactggcctggcaagggcatatgatgttcttgtgacaaacaaggaaccagctagggctctgtgttcccggtttctagtgtagtggatagcctaacacttgctcctgattcctgctgttgtcccctatgtctccaggctgagaaccttactgcagctgaagtggcagcgctcactgtgtgacccaggcgaggctgttggcctcctggctgcccagagcatcggagagccctccacacagatgacactgaacaccttccactttgcaggcagaggcgagatgaacgtcaccctgggcattccaaggtataagggcacaaggaggcatactgcagctgtgccatctgctctaatattcctgggcaaggactcatcttatgagagggacaaggaacagggctagtgagcaagagatctctaagtatggattcttgagcatatttggagccagagtggtttctgtggctagatcttgtagggtttctgtgtatccttctgccacatcatcaggttaccagaaatacctgtgagacctcacacacaagagtatggttcattccaacacagtgccacctgtttgcccagcttcaggagtgtcattcttgtggccatgaccctttaggtacatagccatacactgcagtgtggtgactgctggggaagtggaaaacatggacccaccctgctggcattcctccatgcacattccactctctggcagatcgatgctggatagcttccccaactcctcaacctgagagttcgctccagtgactgcagaagagaggctgagcccactaggctgctgttgggatggcagggctcagtaagagt

SEQ ID NO: 31388 - DNA, 2049 bp, Mus musculus
agagagatccagggtctcactgtagcctgcctgtgtcagaggatgctccctcaagtttgccttgtctctgtttaaccttcctaatgttctgcccctgtgacaggcattgcagttgatcctcgccatctctccctggtggctgattacatgtgttttgagggggtttataagccactcaatcgctttgggatccagtcaagctcctcccctttgcagcagatgacatttgaaaccagcttccagtttctgaaacaggccaccatgatgggtgagtgtgggcagtgacttgggccttccctgggcagatgggcttgtctcaccccttgcatgcagtgagatcttggaatcagaagtggagaggcagccgacagtaaatgtctgcattctgatggaataaagagagagctcctcttccaaacttaaatacagtgccatagcatgagtccacgggggtggggggatgggagggtgttatctccggctaacaggtaccaccacacagcctcagcactgagccctcagtcccccacacctcccccagacccctaacacaagctctttctgtcttacataggatcccatgatgaactcaagtcaccttccgcctgcctcgtggtgggaaaggttgtcaaaggcgggacaggcctgtttgagctcaagcagcccctaagatagcagcattgtctgcccagcctggaggacctgggggtgggcacagctgacagtacagagtgacatagcaaagcagtagccttggggtccggaaagcagatggcctgagctgggccggcttccctcagaaaaggctcctcctacctagcctttctcatctcgggatcaggagcaaggcttcccaagccctcagagatggctgttgctcgacttttgctcccagaggccccagccaggatcctaacaagacccaggactacacagtgggaagatcaccgtgagccacatttgctgttgggaatcccaggtgccaccgttgctgtgcgtatgctagtggctaaggaaacattcccaggggttcctgaagatccagaaagggcatgaaacctgctccatgtgcctgtccctccctgctgcagctaccaaaggagagtcctcaaagaggctccactcagggctgctttcctgggcctgagtcaatggcacaaggcccccgccacactgccattgctgtatggctgcatacaccagaccagaacactcccacagccaagacatctctctgggaccgcagcagctccctaccccacagcctaaagtttcctactggggctattcagcaaggccacgtagcttgaccttcctgcctctacactcagctggatgtcagagcccctagtcacccccaggccctgtactgttggggtctttgagccatgcagtcaggttccctggctggacagaaaagacagaggctttatgaagccagaccgtttctatttttgtccactgttattccagcgtgggctgagtaataaacatggctggaactggctgttagaagataatcaagacttaagtttttaatctttcccttcatttatggtttctgcatctggtaattagtattttcttggcacagatttcaggctcctcttcctacttttatctggcattgtaagggcagactgtgccccctgcccccaactcccagtcttcacctctgaatcctacccatggccagaagcacagaactgtggaaggctgtggggagaatttgtgttaccttagtcgggtaagaagactgcggtgacttcagaaatgggctggcctaaaggttaccatgccagaagagattctgcagtctccttcaggctcatgatggaacctatcctgtgtatacccaagaaagccagcacctcaaaacagactgcaggacatggcatagaagactgtcacagcctctaagggaagcagacagaaggggtcccagaaaaccctgccctgaggacgcagcctgcaggatagatagggcattcattctttgggtgaaaaggcagggtgactacttactcactttcttcttacactagagtg

SEQ ID NO: 31389 - DNA, 1197 bp, Mus musculus
acacacacagacacacacacacacagacacacacacacacagacacacacacacacacacacacacaaagtaataaaatgaaaaataagaataaaaacataaatctttaaaaaattaaaaagaaacaggtagattcaagtttccacttctctggaagatattgacttctaaactcacacgcacctagagcccacagcttctaaccatatgtaattcgttaatgaatattttataatcggttcgtcatactcagtcttcaaagcctgctccccgctccctctcttgtaaaccatgagaagtagttttctcagtctgtcctcactgggtgtagaaacgttacatagactagctcattagatttcaccatagcgctgtgagcttggtaccattatcctatccctcccgttttataaagaagggtgttaaggtcaaaaaagaggtaagaagttccagagggcagagctaggattcagacctaggcttggagatagtagatgaggctacggttcccatgtctttgcagcaaataatgtattccgatccctcagaagatatcccatcagaacttgggtctccgtggtcagccttctgtctcatactacctcatgaggggatgtctccatctgtagtcaagcctcaaaagaggtttcttcaacatccagttccacttagaaaaatccctcttattcctccagtatcatttcagcacctctggtagggactgctcatttctctgtcagcctcaggatattgtccctcttgggctgggcccttcaaacattatcctcagacttctccaaccaggcaggacctgctgtccctacactagtgacatctgccctccagtcccctccagttcctattcagactaagtaagtcactagtcagtaactaaggcgctggagcagacatgttccttcttcggaggagcgcccccaaagctctaaaacctcttggaacacttcgccctagtgcccagtatagagtccaggaagagcgaccaccctgggggtagcaacacctcctccagcaaggaggaatgctgactcctaatgctgactccttttcattcaaaccaccacaagctcggtgacctctgaccacccagtgcctgcccaggcggctctcgccattgtcctgcttagaaccatggagtggatgtcccggggtctgcttagttgagtcttctgaccgctg

SEQ ID NO: 31390 - DNA, 1193 bp, Mus musculus
agggacatgtggcaacatctagggacatttaaatcttactacattttattgagacggtgtgtgtgtgtgtaggcatgagtgccatggcaggagtttggaggccagaggacaacttccagagcctcttcttccaccatgcgggccttgggtcgaacacaggactttaagctttgaggcaaatgtctttccatagtgagctatcctattggcccaggaaataaaattttattaaaaggattatttattatttatttttatgtgtatttgtgcttgcctatgtgactttatgtgcaccaagtttgttcagatgcccatggaggcctgagtacctcagattccttggaactggagttatagatggttgtgagttgcctcctctttgtgtgtgtgtgcgagtgtgtgtgtgtgtgtgtgtgtgtgtgtgtgtgtttgtgttgggaaccaaactcaggtcatccgaaagagtggtaagcactcgtaataatggagccatttctccactcccacaagagacatttttgattgacacacaggaggagcaggaggaggagtggtctagagatgtggctgaatgtctgatgataaatggaaccacccctcccaccaactgtggagctgaacatgtaggcaccaaggtggaacaatgatgcagaagaccttatctctgtattgttacaggctaggattctaagcgtgtgtgtgtgtgtgtgtgtgtgtgtgtgtgtgtgttgcaatgctaaagcaagcctgtggttagctacctagattgtgtggggatggaaatcacttgggcaaggaagagtgggttgattgctagagtggagaaagaagttagaaatcaagagtgtccaaagccatgcctgctgcctaaagcacagagccatttcatagtggctctgtgaggtttacaacaggttctgcagtacgtagacaggaaagtggtctctgcaataaagccaattcgtggacctgtcatctcgcagctcccatctctgtgattggagtgcctgtaataaacatctctaacaagagcccctcatacattttgacctactttaaataattgttttgatttgtgtgtgtttttttttttttgagacaggttcaggctggccttgaactcggtgtataccccaggctctgcatcacacttgcagcaatcctcctgtttcagcttccccggtgccagggtt

SEQ ID NO: 31391 - DNA, 1439 bp, Mus musculus
gggccaacgcaggaagtggagctgctgtagccttgcttgcagggcccggtgctttgagtgtaaggggatcagattgtgtggctccagaagccagtcagactttcagaaaggaaaagtatggaagcctatcagtcagcaaggaagcaaagaagtgtgtgtgtgacttgtgagttagcagagatctgtggctctagttctaggagatccaaagctgtcttctgacctgtgtgcattaccaggcatgcccatggtgggcacatacatacatgcaggtgaacacgcatacacattgaataataaataaatctgaaaaaggatggaagaaaagtcacgggtgagtgggaaatgaaaatggaacgaaaggcgctgttgtggatggtgcggattgtttttgagactggcgtgtgtatcggtgtcgtgctgtctgtttgctgcacagaatagttacttgagggctaactcactgaagagatcactttctatttctgacagatttggaagaggcgggacaatgatgaaaccaaccagcagggggcttgaacgccttgttgggtttttattcccaagggctgtggctgaagatggtaaataaaaatactgaagctgtcgctgaacacagactgactgaaagattcctgccccagtccagtttttatggattctggctgcatcaccatgaaggagcctgtctgccctgatgttctgcgctgtctccggcagcacgttgtggtcgacactcttccctttcagcatcagcaggcagaactcttacagatggatgccttatttgaattgctgcaagtatcaaagaacagacagttcggtagaaacgtcaggtctggagaccctaggagtaaacgtgaagtcagcagcagccttctgtcataggtagtggctttcctgtagctcccttcatctcctgtgggacgtgtgcgatggattaaatatcctcctgtttttaaaccaggctgttgtttcatataccccattgaggcttgttaagggttttgttttccttcttaactttatattatatactcctgtctgtagtctgtcagcttgtgggtgggcactatccttgtctcttcctgtcagcttgtgggtggtatgtcgttaggggtgtatttgtctctaagtcacaaaatatctggctaaaatgataggttttcgtgcctacctagaaggctgacagtgggtgatttgggactgaggttcccccccccccccccccgcacccccaggcagagaagtggaatcattgtagcttgagcaggtctctgccaggctgatgggaagcccgaggcaggggctgactggcagaaatggcttctgtcaagctcagtcactgaagggttggaggccttgggcctgagatgtgggcaagctggcacaccagtgggcagcaggcagctcattacagcagctctcttggaattggt

SEQ ID NO: 31392 - DNA, 1280 bp, Mus musculus
gtgtcaggatgagtccatgtgatcttcagggagcctgtcctccttctctaagctgctgtatccacaaaggtcttgcaggaccacatctgacctgtctctcagcagccatttttcttgtctcattcatctaacctaacattctggaattttatgacagctttggctaacttggtgttttgggagcagagactttagggagagccaggctttctgaagcttttgcctgtgtggtgctgtcttgatgaggtcgtttgtcaggccccttcatgtttctgctttcttccactcatctttgcctaggcctgttttcagctgtcacttttcctttctcctatctttttgccttaggtagaatctatgtcccccacccccagcatgactgtttctctgccactcaggaatttagcatgggacttctgggagcctgccttcctaacaaggtctccaagtacttctgatgccaataaacaggagagctttggttttgaggcctctttggaagcacatgtccttccccttttgtggcttgcccaagctcctcataggcctcactgcttaaaactgtctacgtaggagacccaggaagaagatgctgagctaagctgcagtccttagttgaaaaacctgtcctgctactcgtggtggcacatgcctttagtcccagtactcaggactcaggaggtagagatgggtagatctctgtgagttcaaagccagcctggtcatatcaacacatctagttccaggacagacagtggttgagagagcctatctcaaaacaaaacaaaaaaagaagaagaagaagaagatgaacccgccttggctaggcttaccaaattcaccatctagctgtaaagcaactaccttctgctcagactaaaggggaattatcaaagcagtcttaaaagtaactcttcaattgtagtttagcaatcttgaatgaatgaagttgagagagttgacaatagctataattgttctggggcaggagggctctagttgcaaaaaagagagagttgtgaagaacatcacagaggaagtgaaatggccctttctctgccccatgctttctttcctacctcccaagaatatgtctgagcctgatgagacacactttaaccccagcatgaaagaggccaaagtatgaggactgctgcaagttaaagaccaacctaagctgtctcaagaaaaaactaaataaatgtaacttaggtcctttgggtaaagatccccagacatagcatttttccaacgggggacatgtttttcaacacaagctt

SEQ ID NO: 31393 - DNA, 1138 bp, Mus musculus
tctaaaccaggagagctggtctcagggttcagtgccttaagcattgtcagtcctaatcccaggatgctgtcaaagggaaaagccttcatcctgtacttgtgcactagtgctgtaagtgcctgtggacttacatggttagataccatcagagcctcccgggtgaaggagggtctgccaaactccatgctcttcatcctgcaagtcactatagtctccagttaatcagtccatattctgacttgaaacacaggattcactggaacgctggtcgggacaaagaacattggaactttttgggggtctgtgttcttagagctgtgcttcctatatcctgattctgttattgaaccaaaaaacacctgaagaatctgaggacccgacacctacaaatttgccgttattcccacttcttgatgaaggaatagctagatgaacaaagtgttctgcagaggccttttatgtgtttatgtggtcctcaaagacctcagataggagactggtggaaacttctctaagttctttttccagaagcactttgcttatcagtgtgtatgaaagattttctagctaagaaagctctcttgattcttgctagtttatcctgtatgactacctaaagccccaagcctgtgcctaaatgaagagtggtcattctgagccagcctgttagagctgatgtttctaggcctcctccctaaaatgcctcttggggctgccctcagccttatggcttagcttgattgctctgctggcctattctggggtctgtaataatactggccagtttatttggcagacctgcttccagatagatgtctcttaacctatttcaaaactcacgggccatagtgagttctcagaactgcccagtgtttttgcacagtaggcaggacttaactacaaactgcctcagaatcaacattcatttgaatagataagttcttatctgtcttttgtgtgtgtgtgggggggggggagatgggggcaagggagactgggctacaggtatgacggtacatgccagtaatcccagcatttgaaaggctgagataaaaggtttgccccatgtcccagaggcaggaaggtcttttagtttgaggccagccttatctacaaagcaagttccagacaaccagga

SEQ ID NO: 31394 - DNA, 1162 bp, Mus musculus
agatatataagtgtatatgatgagaataaagtatatactggctgcagtctagccagcaggggtggatctaaaataaatgtgaaagaacattccatctctctgatcatctggggtgcattgctaactagagagcagcccagacaggtgggaagctctttgggtggtgagtatctagcctgctgtgtgtttgacaagacctgtgtcagggtggtgcttcccagataactcgaatttaaatgagacctttgtataatgagcattcgactttcctacctctgagccttttgaagaaattgcatatggaatgttgacagttatttgaaaccttaactcttttgaattcctgaggagctgttggcatccagcccaaatttccttggtgttagagtactgctagaagtgaaagccttcctagttaggggttcctcctttcccagagcaaacagaacaagaggttgggaatggtggtgaacagctcaagagacagagataggaggatcactgtatgtttgagagtagcctaagctacacagcaagcatcagcgtgtcctggctatgtcatggtgctaaatgcagaaaaagccatacattctttttctcatttccagtgtttctgtataaaaaaatgaattatgcaaactgtttgaaaatcatggacggtactttttaaaccaataaactatttttacagcatttttttgccaaaagttgtgaaatcacttgtgtacttggggggaagggagattaagtgcctgccctaaagttactctgctacccagtcagcactggaaatctctcctcttgctgtgctgattattttaagagctgttctggttggagtgtaacggctagactcatgtaacctaagagttgaaactttgaaagacatctggtctcacttttgtcctcttaggcagcttcctctttcaggtgtccttaaagcctgggcttcattagaccttcatcttaagagagttgttttagggattattcaggttggcatattaaacctaaaagtgcctgcaacaccaccgcccgggaattctaacacctaacaagtcaggagaatcagtagagctcgtgaacaatcttccaagaccttcccctaaaggtgaaacagagagacaaacccagctcagtaggatacaatcaataagttagg

SEQ ID NO: 31395 - DNA, 1132 bp, Mus musculus
catctccaagggttaaggtaagaggaacaacttatcttctgttcactgaaggtggtagtttgtgggcaggaccaaacaggtaggtgggaagagggggcaggcccaactaccttgctatttaggccccaatcagctagatgctaactagttttccagggtaacagctgtcctgggtaaaagcctgggaggaaggcagagaactggccccatcactactgtcttctcctagtggccctcatctgcctccttcggtacgggcagctcctggaacagagccggcactcctggatcaataccactgcactcatcactggttgcaccaacgctgcaggcctcgtggtggtcggcaattttcaggtgcccccgccccaccctcccttaatagggcctggatgcctgtaagggcaacacctggaggttgaccaaggaaggaagggagaagtgatggatggggcaggagaggtggggctgcttcatggattggcctctgtctgggccaggtggaccatgccaagtctctacactacatcggaactggtgtggccttcactgctgggctgctctttgtgtgcctgcactgtgttctcttctaccatggggccaccacccccctggacatggctatggcctaccttcgaagtgtgctggctgtcatcgccttcatcaccctggtccttagtatccttttgggatagggaagccaggaactcatcccctagctgaatccttctctcccaggttggggtaggggtgggaccttgagtccagtgaccactgccctagtcctagtctgatgcggcccggtcctttacctcttctacttgcttgggatggcctacaggtgttgctgggtgcacacaccctctaggtgcacacaccctcttaggtgcacacaccctctcgaacctttccttagctctgctccaggtggagtcttcttcctccacgagagttctcagctccagcatggagctgctctgtgtgaatgggtgtttgtcctcgatatcctcattttctatggcaccttcagctatgagttcgggacaatctcctcagacacactggtggccgcactacagcctgccccgggcagggcctgtaagtcctctgggagcagcagcacctctaccca

SEQ ID NO: 31396 - DNA, 1786 bp, Mus musculus
tgaaatcaagggagagagcagggctggaaggcaggagcaggaaaggaccggaataccgctcttgatttctctagacaaattcctgccctctgtgccgccatgagctgcccactgatgatgacagctatgaagagcacaagaaagacaaggtctggtcaccccacccctgctgcacactccccactcctcagcaggcttggctaggcctctgaacgcccccctcacttgggctcccttccaagtcagtgtggtgagggcaaaggtctcagcattgttaatgttagaagcctgaaaagagaccccgtgacagctgctctctgcatggtcctatccatgagtattcagacccagccttgcctaagcctggcgtctttcttctaggctcgcaggcagcagcagcagcaccgcctggagaacctccacggagccatgtacacgtgaggcagctgccagggctgagcgctcagcctctctgataccttccctctgcactctgaatcattaaaggtttctttacccaccctgcagctgcacggctcaccagccgaagcaggggctccttccgaatcctccaccctgctgctagccagaaagatgtcaaaggtgtcaaatgtccgaaggtgccaggctgcaattccctctgccagcctctagactctgggtggtggggccctagaacaaccagggcttgggtctgagtgttcttttagaagtcaaactgtgtcagagcctggcgctttgtagctgtttaaaactgataaattaacttgcaccaccccactccggaaatctctagttaaccttggaacctttagttaaccgtggaatcctgggggtgttctttatttccacatagaaaacttttaacattgtaaaagttgctctctgtatcccactcctgtaggcgccattatcaaggaatcaaaggtcaagccagcccaagtagggcaaggctgtttagagactcttcaaagggggacagtccttgtggaagttttgaaagtgggtttcattcactatgtgaccttggctgtcttggaacccactatatagaccaggctcgccttgtacttaggacatccttctgctctgtcttcccagtgttgggattactggtatgtacacacccttacgatgtatctgaatggcatctgtcactcttagtttctggcaacctcaagaatctttcctgggggaaaggacttctgtccatccctgcccactggatcggaccctccgtgattctccagaacacactgcagacgtgcaaattagaattcttttaatagatataaaaaagtactaaaatactcgtgtggttctgctgtgttatttgccctaaaggaagtgaggggcagagtgaagaacccaagtgcagctgggtgggccttcccttaggctaaggcatgctcctcccatcatccagactcgtgagcccctgccaccccagccccaattcctgcagcagaaggccccagtggtctggctctggcactgggagtagaaggcacctgaagggctggctgggcaagggaggacaggtgacctttaacacagaatactactctggtatgaggggacaggacaagcagcagaggcagctgtggaggccctgtccctctatggcacaggtgggtgttggatggccacttctccagaagtaaggaagcctagatcccaacaatactctctaaaacttgtttttggtacaaaataaatgcaaagaaggtagagggtgcgggtgttttggaggctgggccagccaccctccagacctcagatcatg

SEQ ID NO: 31397 - DNA, 1225 bp, Mus musculus
gggcagtgtggcacataaggcagaggcacaaatacatgttataaagtatttttaagaacctttccattcctattgtaagaggaaagaattgttcacttatttgtgtttttatttcgaagtggctatcctccagctccagcgtctttttttccgtttcctacttcgatttataatgtaatgtaaacatctatactatggcatgtggtgtccgtctgtactctcagtctgagggcaggagctcacgactttatcttatccccaacagtctgaacacttcaagacaacgtcccagaaggtggcccggaagttctggtggaagaatgtgaagatgattgtcatcatctgtgtgattgtccttatcatcgtcatcctcattatactttttgccactggtaccatccccacttaagagtcccttccatcccaccctactcctcaggggtgacctccctaatatgtgccaagaggagccctctcctgtcctcctccacccaagtgctgctcagtccctgtgagggccttctgctgcatcagatgccccagacgcaccttgatcccctgggaggagacagctggactgtagctgcatctcatggtcctgagagtgggttacagagacccagaggaccctgtctgtggctgggaaactgttggtggctggtgggcaataaagacctcttggtatccctaagtgtacgaggcgctttactcctgtgtctttcaagtgtctgtttctttctttctgaggaacccctccaggctggtttctcccaatctagaaccaagatagtgcaaggattgagcacaggtttagtgaagaaagatggcagctcagaggctttgcatacctgaattagatatgccaatcactagacccagctagaatcaataagtcagtcagtctgtctgtctgtctttaaaaggacttttattttttaagaagaatgagtatgggtttagagagatggctcagaggttgagagcactgactgctcttccagaagtcctgagttcaattcccagcaaccacatggtggctcacaaccattctgtaatgggatctgataccctcttgtggtgtgtctgaagacagctacagtgtactcatagacactaaaaaaaataaagaaaattatttaaaaaaataagtatgagtatgtgaatgaagagcctgcagaggccagaagaggatgttggttcccctggagttacaagcccaacatgg

SEQ ID NO: 31398 - DNA, 2028 bp, Mus musculus
gaactgaactcatttgccagaactcttgaaatgagtcttgctgattgttttgctctgttttaatttaatgctacatattaagttatggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggttacagagaagccttcaagctctgagggaaagggccttcttcctaaatttttctgtcctctttcagctcctgatcagttgcagtcactctaatcaatgacatgaattttagcttttgtgggggactgtaagttgggcttgctattctgtccctaggtgttttgttcaccattataatggatatagtgagcataggtgagccatgtaactgcctagaaacaaacactgtagtgaataatgctttgaaatcgaacctttgtgccctatcacctaatcctccaaagtcctaattgcaattactttcccaccagatgctgaaaacatccttgtagtgtgcacgtaaagtacttgtagtttgactgtagactctggcaatgccacagccctgtcagcatgaatctgtaacgtcttgagctctatttattgaatgtgaagcccctgtccttatcctccctgtaactcatttctaattatgtagttctttatcagggagtgttcctatccaatcaatcttgcatgaaacgaaagtttcagttggagctctagcctgactttgaaaaaaaaaaaaaaaaaggcagttacgattaaaccatctccctggtgcttatgctattaattgccacctcaaacagcaccaaatcaaaatctctccacttttcagctgtctttggaggacgtacgtaataaggttttatttagtaaaccaaccctatgcatggtttcagcactagccaaacctcaccaacttttagtctagaaaaacaggcatttggcacccttgtgatatacagagaagtcacagggcagtacctgagggtctgtaggttgcacactttggtaccaggtaacttttttttctttataagaaagagtactccacactgcacaatagctcctcccagggttttaactttgttttattttcaaaaccaggtccaatgagctttctgaacagctggtgtagctacagagaaaccagcttccttcagagagcagtgcttttggcggggaggaggaaatcccttcatacttgaacattttctaattgcttatttattgtattctggggtatggcgtaagtacagagaagccatcacctcagatggcagcttttaaaagatttttttttttcttcaacaccatgaattcctttaacatgtttccagcattcccaggtaggccaaggtgtcctacagaaaaaccttgggttagacctacagggggtctggctggtgttaacagaagggagggcagagctggtgcagctggccatggagaaagctgacttggctggtgtggtacagagaagccagcttgtttacatgcttattccatgactgcttgccctaagcaagaaagtgcctttcaggatctattttttggaggtttattacgtatgtctggttctcaattccaacagtttaatgaagatctaaataaaatgctaggttctacccaaactgtgtctattacttgtccattgttgctttctgagctaaaatttatagcatctgctacccattgccagcaataaagttttcaaccaggactacgataaaagcttagtgatttagaaagcctggcttatactgtgcatgcaccacggtttatggaggtcaggatttttattcacacttggagatccgtcctgggaaatcaacactgtctgaaggctttggcaattaagtgctgccttttggatggcagaagcaagcagaacaggggtcaagaggcttctgtgatggcaggaatttagtctatatgctagataggtattttactctt

SEQ ID NO: 31399 - DNA, 4092 bp, Mus musculus
tcactatagcctaagactcatgatgtaatctttgctggcctaaaattcatgatctttctgcctcagcctgagtgctgggattacagatcatgagccaccatattagctaaatgtacaactttcaggtccatatcttatttcttttcttttttttttttttttttttttttttaaaagatttatttattcattttatgtaagtacactgtagctgtcctcagacactccagaagagggcgtcagatcttgttacagatggttgtgagccaccatgtggttgctgggacttgaactccggaccttcggaagagcagtcgggtgctcttacccactgagccatctcaccatatcttatttctaattgactttaaaactcactattgtgactcctgcacttttattaatggcggtggatgactttgtcttactgacatatctccctgaaaaagatgagtgttatcaaccgagtgtgttgttctcgtttcagctttgatctttactttgtctgcaagaaccgtgtcctccctgctgatttgttcccaatgaagagaaatgaaaagactgtgacctcctctggggtttggtggcaagtctgggctggcagagatgggatagcttcaggttttgcaccggcactttgatgacactctcctctggtgatgttttatttacttttgtgttccttgtatgctgacgtgttccatcatcctttcttccttggagtgcaaacggaagaagcacatggaaaaatggatgtgaccaaaggaagaccccaccttaggcaggccacacaatggaccacctttccacagcctctttatctttgcaactctaggcgcaaactgtagagaggtgctttctagacaagatgtagatggttatgtgggatactgatgggcagagatggggttgaatacttattctctacagaaggctcagctgcaaaccaaactagcaggttaaagagtgttaaagtctggtccatctgatagtctgtatatttctctgaaagtttgcatgctagttgtactagcataaaagggactcgaggcttctgaaagtaaaatcactgtttgatgggattttttaaaaaaatgatcattgaacaagtgtgttcttgcatacattcaccccaataggaacttcctggaaagggacaggttcatgctttgtggaagaaaacacataggagggatttagtatgcaggaaagaggttttctacaaattgagttttgcttttattgcccgcagtagatagatatttagaaactaactgcattcttcacactcctccttgctgtttaagatgtgcagggaataaggaaaatctttcctatcctgtcatatctggtcatgaaactgtaggaaactaaataggttccctgagataactgaagatgtcttggattatgctgtgtctagcgttttattccagtctgtatggttacgcctaaagagagaaaagtctcagctaatctcagggatgcagagagaacgagaagaagaaaagtatgagtcctgtgctgttggggaaatcagtctaaggaagcaatggtcttggaggtcttttccagtgctgactgcagcatgggcttgaaattgaagtatgtattcttggcaggtggcattctagaaataaggccatggctactattgtctcagctgtccacaagtctgttacttttttccaagcctttttcagtctcctttagcttttcctaacacctctttagttccccacttccattttttcttcctctctatagacctgtttgtacatctctgaatgaacaccttccttatagcctgtatgcacgcccatacctatcctgttctagttggtgttgcttctattgccttccatcctcttcctgacatttgcagggttgccttggtctgatttcctcctgtttctcaaggtttactcagttaacagatcaccaaattcagcagctcattttcacagcttgtaacccttggtaataatgttggatgccggggcctatgcatgttgacattctggttgtctcttgcaaattatcctttgccttatctcatggggatggaggagggtacccaggtctctgttgctttgactgtctcaataaatccatccattctttatcctctctgtgacgctcatgttttttttggcctccttcccaagaacccagttctgctaaataactcagccacgttgtctgcttgtcacacaaccagagtttctctcttgtatctattacgtttctctatctatccttcactttctctaatcatctgaaaactccacactataaactaaaaacatttttatcatcacagaagtccacttttttttttttaaagaaattatctaggtatactctccgctaatttttaggaaccagctgaattgaccttaccagttttggaaacattgatcattccagaatgtgccccggtctgaagcttctgtctgaggttataatctagactacagattcctccttggctgcactgcgacactcactccgtctctgcctctgccctcctcgtgtctttgtatcacagcttttcggggttgctctatggttaggctgtccccttcttccagccttctcaggcccttgtgcttggaatatgcatagtggtccttccattccacactgatagcttactgtcactctcatcttggaacttcagtgtgacatagttctgatgttctgtgatctccccccaagaaaactaagctctgagagacagccattgtcattgttctatcagccagagaccttaggggtcaaatttcttgttggaggtgtagctgaaactggggctcacatagctcttcctggatactgtttgctatgaccttatacttgttggcttttgctcttgaaggaccggaaggaaaattgatttttagcaacaaagattgacagtgagtggacagacatgtgaaggattgccagagtctcctcaccctcttttggctgctgacatgttccttgtgctgacagagtacagtagaatttgtgttcacttgagaagttgcactgaaggaaatggttcccaccaaagaaaagttctttttaggagttttgttttgttttgttttttgaaggtagaatacttgaagcatatttgctagagtgtgtggcaatggtccagctgaggtgtctataccagggattgggttggcatgtaagaagcatatgaagtctcaagtagcactcttgtggacttttctgagcttgctctcctcagtgtttggctaaagggcaatttcttaaggggaagctgcttgaggtataactgttaatagtttgttttcctgctgtggactaaagaagccagctctggacaacaactaacaaaatgtgctaacatgtttcccctagaaacagagctctgtgcccttcagagttcctctggtagggatgcactttctcttttcttcggggcatggtatgctttgcacatatcatgagccgttcgaaagcagagaagggtgtgccaggccctgtaccatagtttctcaaaactgcttactaggagggttctgtttggcattgccttaagaaagctgtaaagagtcaggcgtggtgatgcatgcctttaatcctagcactcaagagtcagaggcagaaggatctctgagtatgaggccagcctagtctagaataccaagtttaggcagccaaagttacacaatgatagcttgtctcaaaaaaaaaaaaaaaaaaaaaagcagaaagctgtaaagagatgttgaaatttaaatacatcaagatggctcagtttgttttgttccctgctcagatgtgatactaagtattttagcttagaaactgtgagtttggatctcagcttgcatagcatagcaaactacccatgaagctggcctcctcacactgttaggaatttaattcagactaccatgttaagtgagtgaatgttgaaatttttttccttgtcttgtgttcccagttagattgctactgttagccatgtttggtattgtcaccttttttgtaacttaactgtaatggcttaattttattttttttaaagcttactgtggtatagtaagtatttttcagtatatttta

SEQ ID NO: 31400 - DNA, 4092 bp, Mus musculus; identical to SEQ ID NO: 31399

SEQ ID NO: 31401 - DNA, 1167 bp, Mus musculus
acaacagtagcaaaataatagctataaagtagcaatgaaaataattttatggttgggggtcagcacagcataaagaactgtattaaagggtcacggtgttaggaaggttgaggaccacgggtgtacaacttgagttacagatggttgtgagtcgccctctggatactgggaactgaacccaggtttcctgcaaaagcagcctgtgctcttaaccctctctctagtcccctgtgcagctaactgtggtgtttgagcaccgaactctcagtgcttagggacaattacactgaccccccacactgaccatgccctaccctatctttcaccagtctcttcctgcagcgcggagaaggatggggggcagtgtattgtcgttgttcacaagtatttcatcttccatatgcacaaggagaatttgttaagtgagcaggagtggggaatggtctctgagaaagatggatagcccttatatacatctccttactcgagagccatttccctcttctcattcagaaatgataactgtgatgcatgagtcaggtgtgtgggcatatgcctgtaatcctagtacttggaaggcggaggctgagacttagaagttcaggccaacctgggctacatagcaagtattcaaaaacagaaagaagcaactacaaaaaataaaagtattatgttcatttcactatgtcacttgagaaagtgccaaagagcataagggacgatagctggcatgtatgtgttgctacataatgtaccactggtgtgtgtgtgtgtgtgtgtgtctgtctgtctgtctgtctgtctgtctgtctgtctgtctgtctttacaggcactcaccaccatagttggtttaggggctctgaggattgaactcagggccctgtgcatattcagttagtaaaggtgctggccaccaagcctgactgacgacccacatggcggagggaacagaacagactcctacaagctggcctctggcttccacacacatacacacactcacaaaaaagtcaataaataaaactgtaataacatttttaaaagagcaagacttggctggagcatggcgggggagggggggaggttcatgagttaaaaaaacaaaaaaacaaaaacccaagcctgcagcccgcagccacttacactaatattgtaatagcgaatgc

SEQ ID NO: 31402 - DNA, 1175 bp, Mus musculus
tgtgtggatgctggaaatccaacccgggttctctagaagagcagccaatgcttgtctctccagccctgatggactagaatttaaacaaaagaaatactgatgttttaaattcatcatttaaggagaccctgtgactaggcatgttgtctttaataacagaagtaggggcaggcggatctctgtgaatttggggccagcctggtcttcacaagttgttccataccagtctgggctacacagtgagaccctgtctctaaaacaacacacttcttgatgtgagggtggggcattgagctgagagctgaccatttattgacacccatgtgaaagatgtttcagtgatcttaatgaacacgtgctaaggattttcgaagcgccaaacttcccttcccttcagggagctcagtgtggccccagtcccttctgtatcagactggtgacgtgcaaccccaaagagatgctcaactctcctctgaggatgagttccaaggagctgccaggatattcctacagtgctaagcatttgctctcctgcggcactgtgtctactcatgacaggacttgtgcacctcctctgggaccctacctgtcagtagcctttgtgccatttctaacagtaatctctttggggtatcagaagggatgctaaagaattagtgtagttatttactgcttccagaatggttgcttgtatgtgaatatgtggtatgtcaaagtccaagttagcaaaagtatttccagtgatattaataaaatactttaatttcctacagcccatcatacaaataaactcttctggcccgtatctaggtaaacctctaactccacacctctgaggaacatggtggcacacacatttaatcccaacacttgggaggtagaggcaggaggacttctgagttgaagctaacatgtgtctacatactgaattccagaacagtcagggctatgttgaaagctccctccaccccactccccaaaagagcaaagaaagggcatttttgggtggagtttcggttatcaaccacgtgagctctgggagccaccttgcggaagatctgctgtcagcagttccctggatgctgacgtggaagagtgctccgtgaagtggccgttgtggacagttctgccagcacttgtgtgtcttgacagaggttgtcaggacaggaaggcat

SEQ ID NO: 31403 - DNA, 1197 bp, Mus musculus
tttatccctttgtcctttttttttttttttttttagtgctgttttgttttgttttgttttgttttgttttccagacagtacctccaggactatactatgtagccctagctagactggaactcaatccacatgtagaccaggctggcctcaaactctcagagatctgcctgactctgcctcctgggtgccgggatgaatgggcaaggtttggcatctgaattttaccaggctagcagttggctccctggatgaagccctttgtgcatccattttaggtcaagagtactctgcccttcactggagggctctaagttgggttcagcgcaaacaaatattcctctggagtctcgtttgcgattaatgtgttctgtctctgcccggccaaggtaaatggagcgccccaacccacacttaatgagttttgcctgtgtaaaccgtattaattgtggttgttgctttttaattgtccttaaatttctcgtacgctaactgccctagggcaggagatctggtttctgcttagactgtagacctctcctcccaccgttccttccacccaggagtctcataagccggcaccgaagtctgctcccctcccccaccatctggcagcagccccggaactggaccagggctcagaaaaaataaaaaataagcatgcaaaaacttttgtaagagcctccttgaccaggactgggaggcagaggtagagatattttgaggggttcctctcaaggaggattcaaggagttcctgaactagcatagcaggtgggaggggggccttcagacgaccttggtgggctgtctcagtgtgacaaaggtgtctacagacagaactgggtgacttaagagttgcctttctccagcaggtgaaaaccagagccaggcacctgatatgggaccagagccttattctgcccggagtggcgctacacagtaccttgtgtagtgggcttgttagagactcctgctacagtgtgtcccctgctcctagccctgtctgcccaaaccctggcacaaaacaagctcctcacctgatggtgcatgagcagtcactgtgacagtcacagtggagtcactggtagggttgtccctcctgcagccaggccttctccacgactatggtgccacctttccttgttcatggatgtgtgtgcacctgcaggcagaaggaggagaaaacggacctgacctg

SEQ ID NO: 31404 - DNA, 1194 bp, Mus musculus
atggttgtgagccaccatgtggttgctgggaattgaactcaggacctctggaagaactgtccatgctcttaaccactgagccatctctccagccctacatttgtatttttgtagaaaggatgaactctggggctagagagatggcttagcacttattaacacttggtgatcttcagagaactcaagtttggttctcagcacccacatcgggctgctcacaaacgcccgtaactccagttagatccaggaagtctgctgcctgcttcagccctccacagtcacctctcatgcatatatatacatgaagtaagttctgagcttttgtgaggtctaacacaaggctgtatggtcagtcagtaagatatcttatactggtggcaggaagaaaagaggagatggatggtgagctgagaggcactggcgtgtgcttttccacacgctctaacagtgggagagaaggccctgattcctgtttgccagtttccttgttggaagcactcctgttgtggtcgctttcaaactgccaccataatgcgtctgagcactgagtttgggagggatgccaataaccttcctgggaagtcagctgtggcacctatgtgaagttagaggggaagactctccccacctaagccttctcccccaccactttcaacaatagataatttggtccttttaagtagaaatcaacgaccgaatattaagtatagcctagctcaatggcatggctttttataagcctgctcacttcgtgtaacttcatgttacattgtgtgtgttctgtgtgtgtgtgttctaagcatccatcaatctcatctgtccctccgagaagagcacagagtctgccgcatttggggtacaccttaagtaaagaaaagcagaaactgtcgtctgtaggggatgctctgtatagaccaagcaatgggctgttagagaagtaattaacagctgggttctaaaaagcagtttgttactggccaaatgctggaacagatagcccagagcaccagggggtgggagcaagaccagccctggggtaaagcagatggcgggagcagggtcctactaatttctactgaggatgtttgtatgttattcttctttcttttcctttctgactaatttaatgatttaggagtggaaaaaaaaattaaccgatttatcttgctgtctgaataatgttttggaatgagc

SEQ ID NO: 31405 - DNA, 1125 bp, Mus musculus
tcttggcccagagaactggatgtgttttatgcagtccttgttcatggaagataatttaggctctaggtatatttttagtttattggtttaaaacttaaaaataataataattcgaatgtagccaccatttatttttagtactgtaactaaactctgttaagatgctgttatttgtactctctgagggactggataactccatgtgtccaggaatagcctgttcttgttgctcagtgaatattcctttcagaaccaccctgatcctttccctttgcaaaatcttaggtctaagagacgtcccagaagacgacaatgggaatttcttcttctacctgggccttgagtgaaaactgtactgtttttcactgaaggccccagagggaaggagttgtaagtgttactctacaggtctgtctcaaactccacacttccctcatttatgtgcacggcattgtgccacgaggctggagaccttctagcctccagcttctcctagatattcctgttcatctggggctagcaacagggactccacattggatgaagtctgggtctccacttttctacttgtagacacgttgtgctcaagaatccccccgccccggggtggggtttctgggttccaattgggatgtaaagtgaataaatacattaattaatggagggaaaaaaaaagaattctatgtttctgaggctagagagatggctcagggggcaaaaataccagaagtgtgagaccaaggctgaattccaagcatctacttacaaactaacatgaccacgtgtgcctgtaacaccattattgcaggggccaagactggtaaattcggacagatcactgctagccagccagccttgcagtgaacttcctgttcacagtgccataaagcagagagtgatacagaagaagacaccagatgctccactctggtctccacaggcatgcacacccagacacaaatgcgcaacacgcataccacacacattcacacatcgtctgtgggataccctgaataacagcaggggcaatcccatatgcagctctcgaggcttgatcagctaaccttcccctccaccctggttgaggccctcatcacagcggatgtgccaacatttcccatcctg

SEQ ID NO: 31406 - DNA, 1131 bp, Mus musculus
ttaaaagtctcctgagtgattccatggggcaaccagggtgggaacgttgtttgagatacaccaattggatacggagattgagcctcgtttcccgggatattatgcaagataattgttttctttttatttccttaatagattcaaaaagtgtgccttactggtttctttagatttaactcatatgccacaaaatccaccctcaaattaaagtctgccgttcaacagttttagtatattcagaattgtatgactaccaccaccatcaaattccagaacacttccactattctgcaaagaaacctgtactcattaacactctccctgtttcttccttcccatccctggtaaccagtaattgagtctctggagtagtcctggacttttatgtaaattggataattcaacacatggccttttgtcactggcttctttcttttgcttagcacagtggtctcaaggtttatttatattgtagtgtaaaagagctcacatttctttttatggctagatgatgatctatggtagttcatcagttcatagacatttgccttctgtccacttcagggctgttatgaacaatgctgccacgtgcactcatagacaaaagtgtttgtgtgcacatgtgcacgctcagtctgcacattcatgtggaggccagaggtctacctcaggtgtcattcctccatcctgtatattaagacaaagtctcaccatggtggcccaagcctttaatccagcataggaggctaaggccagcagatctgtgtgctcaaacctagcttgatctacatacatagaaacaagagtctcacttttaactgggaccatagtttagcaagactacatagcccttgagccccaggaatctggttgtctcccccttctcatcacaagcacaagccactacacttggcttgttcacgtgggtcctggggtggaacctgaatcctcctgcttgcattgctagtgttctgctgacagccacagccccatcccagatgcaccatttcccctatctctgatagtggatgagggcaccgatttctctgcatcttttcccaaccctactgaagtctcttctcttcattatgaatatcctagtgagcatgagttttgaacacatttttatgt

SEQ ID NO: 31407 - DNA, 1212 bp, Mus musculus
tttgttgaccgggctggtctcaaactcagagatccgcctgcctctgcctcccaagtgctgggattaaaggtgtgcgccaccaccgccctactggtgaagacagttctttagagggcatgaagatgccttcctttctgagaaggctgaacctataaagtcaagtagcagcttagaccactgtcacaattgttcccaaactggagtttacagtatgcattgtcaatttctggaatgggaggagggacctgctcccccccaggattcacacaagtgaaaaggaattcctaaactcaggatgaacgcaccaatgccagagggctgtgtctccctgaattttgggctttctgtactcatatagatgcaccctgctgcctattaattgtgtgtgtgtgtgtgtgtgtgtgtgtgtgtgcgcgcgcttgcttgcttgcttgcttgtgtgttcactcacaaaggcccaaggttggagtggggattgtttcttgatttgcgttcatttccgctgtagcattgagacagggtttctccattgacaccagcgctccccatgcagctagctggcttgctctctgctttctgaacataccaagtccctgcttcagacttgttcagcgggagctcctccctcccttcctaccctgcaacatgctcaccgtgtgcacatagtgcccatggaggctggaagagggtgttgggtccctaggcctgtggttaactctcaggtggatgctgggacctgaacttgggtcctatgggagagccacacatgctgttaactgctgagccgtagacctttccatcttaaccacttttcatttgtagtccagagacaccacgtgcgtttaaactctgcaagcacagagctctcgtcaaggccccagtaacagccattaattactccttccactaaccaccacgcctcactttcctgtccctctgaatttgagcattaaacagattttatcatttcctcacccaagtcatctgcacaagacccagggctgagaagcaaagagatctttgtgattgggaacttgagtgctaggtaggaggcggtgggggaggggaggcccgctaccaggaagcacggcagggtttcaggcacttggggtgtaccaggcattctgtctctgtcagtgctcaccccttcctttacagccaagaccctcggggaggtctgacaagtcatgtggggcccacacatcaggactt

SEQ ID NO: 31408 - DNA, 1193 bp, Mus musculus
tcttgagacaggatctgtctctgtctctgtttgtgtgtgtgtctgtctcccccctcaggacctaggcttaggcttatttcttaggcttggctgactcctgtctctgcctgtcaaggcctgagattaccaacacacggccacagccacacctggccttttttttttttttttttaagattttttttttttaatgttatatgagttcactgttgctgtcttcagacacaccagaagagggcatcagatcccgttacaggtggttgtgaaccaccatttggctgttgggacttgaactcaggatctctccagccccacacctggcattttcaagagggttctagggcttgaacccgggtcctcgtgttggtacagcaagcactttaccaactgagctatctctcccgcagtattctggtgtgtgcatgtgatgaagttggttatgcaacttgggcaagctgggtaaaggacgcctgggactttatgtgtttcttttacatttcctatgtctatgcaatcacttcaaattacaaagacaaaacacaaaacagcattacactgtctgataacagtgccgaacctataaaaacacggctgtgtgtctgttttgtgcagaaggatgggaggtggcttcacctgatgccataacaattctattttttacgaacagaaaccaccctggacttgaagcagatacatctaaatattagcactggtgaattttgatgattcgatttatcagtgccttgctataaatatttctctgccctcataaatctgtttggatcattcttttattttgaaaataaactgaatacaaacaaaagcaacaatggcgttcaggtattttcacattatcttagagtgttcacaaaattgatctgaacacttaatctttccttgatgaaaccgctgcttgtccactcccagacatcagcctccccccaatgagtccccgatgctgggttgcagaggctaagaatgccatgcatcttttttattgtgacacactaatttcatcttaattgctcattatagtattgcattataaggaggcactatttttaattacctttggggaggctgtttctaaagctgtctgctctctggggctagagccatccgttcccaaggagtcacctgactgtgaactttcaatattggcctgaatagacttctctgcttctcagagtgga

SEQ ID NO: 31409 - DNA, 1132 bp, Mus musculus
tgcctgtggaggccagaagagggcttccaatccctagacctagagttaactgcagctgcaagcacccaacttgggtgctgagaactaaacttaggtcctctggcagagccagatttgcccattaatgctgatgccactctccaatcctaagcttttttaacagtgtcagttctaggggtcacactcatcattgcttaaagagcaatcactttatggactgggcggtctccccaagcctcgctcacagattcctaatagctctcatctgagcaaatcttttcgattctcaatgaaacctcagcgtgatcgtctctaccgtctggctcccaggagtctctcatacttgccctctggtggcctccaaagcaaggaagtaacagatgacccgtggggtgtttcctgggctccaggcactgctccaagtatctgtctaccccttcatgtacagcagccgtagaagggctggccccacttcacagatggaaaaatggaactatcatgaggccacatgatttgttcaacaccatgtacagccaacaaacagcaagaagccaatggcttcttcactgtcggcactgaacatgagtgattctcagcctcagcctgagaagaacacttgacagtgccccttgccccatctcccatagttttgtcaaagccttcaactgcttctcccctacggtttctaagggaggctttgagtgatttcaggttccacagatctcagggtccagctgtcctgtttctatgcttgttagtaattttggtgggactagagacgagccttcccaaagacgaagttcttgaacactgacagagtggcctgcatatttacgtaaggatacgaaagcatccctgcgcagtctggccagtgccaaagactaagtgtaaatcaataaactataaaccaccccagggaaatctatctggacgtggtgactcgaatctgcaatcttagcactctggaggctgagctaacctgggctaacatagtgatatagattggactcaggagacagataattaagtgagcatgaagacctgaatttggatattgagaacgacagatccccagagtccactggccggtcagcctcttcagatcagtcgtcagtgagaaacactgtcttgg

SEQ ID NO: 31410 - DNA, 1349 bp, Mus musculus
agcccatgtgggggcttcagtatactcccaatgctgtgtcatgttcctctgtttatttaataattgtaattggacacggcaattgtttcgtaagtaaagtctcttctgtacttatattttgttctcccaattgaaaagcacatatattcctgccaaccagtagcatttcaacaattactagccgtggctggcgagatggcgcacctagcacgggtgctcatgtagaggactcacgcttggttgccagcacccacttccagtggctctcaactgcctgcagcttcacctccaggagctcccatcctctctcatctggatccagacgtatgcactcacgcatgcgcgtacctagatagtcacatacatatgcctgtaattaaaaataaatatacatataaaggaacaagctcactggagggctttcattcatctcccataggatgtccaggtggttctgaaggggcacacacaggtagtgagggtaccaatacctgcttcacctccgtgcctctaacatcaccacactgactacaaacatttgtcagctgatgaggatgtctgctcatggatcaggtggactttcagatcttaccaagactgaagctaccactcagcaacagcttcctattcagtgctgagcctgaggcaggaggacctactccgaggctggacagatggcatagggttgcaggtgtgcacagagaatagtgtccagcgcacagcagaggctttgtcaaggcaaggttgtcaggatctctctggctggattataggtgggctgccacatttatctgacatctacgtgattctagagttccaaactctggtcctccttcgtgtgggcaaatgctttaatcactgagctgtctgtgaggcctccatcttatgtttgtcagaatgggtttcatgtaacccaggctagccccaaccttgctatgtagctgaggacgaccctaaattctgatcctcctgcctttgcctcctgaatgcttggattatagtcctgtacttcattgcccagtttatgtgatgctggggcctttgtgcatgcctggcaagttacataccagcctgttaactttaattaccttttttttttttttttttttttttgctagggatcaaacacaggtcctcatgaatgccagataagtgatctaccattcagtgattatctttactccctaatgtttaattttgggctgccagttttcttgaatttatattccaaaggaccctggctattaaatttttattttgatcagtgtgactctgagacactgcctccgatataaaatctgcctacgtgtgtgaatacttgatattgtttatttctatttctctctgtg

SEQ ID NO: 31411 - DNA, 1106 bp, Mus musculus
gtgaagttctagtctgcattcaacatagaatgttgaatttgaatgttgaagctagaatctggggtgtttttgtttgtttgtttgtttgtttttaaatctcactcctgtagagtttgtcatagactgatatttattttgttattaaggggaggtgggggcaggatcttgcttttgtagcccattcaggcctagaacacaatccttttgggtcctgatcttagatattgactggtattgcaagtttgtgtcccattacacagctctctctctctctctctctctctctctctctctctctctctctctctctgtgtgtgtgtgtatttactcgcttacctgtttgttttgggggtggactcttgctatggggcctcaactggcctagaactcacaatcctgctttagctttctgagcactggaattacaggcagactgtaaattagattctctagaacttttaaactacatttatttcattacgtatgcaccacttcatgctcctgaaggccagaggataacttgtgggagtctgtttacttcttccacctggggctggactccagtcgttgggcacgtgcccttactgtgttgagccatcttgctagcctaggtaccccctccccccctttttaaagacagggtttctttgtctaccctggttgtcctggaactcactttagtccaggctggcctccaacttagagatctacctgcttctgtttgttaacctgagcactctgccattgacctatatccaacccgcaattcttcttcctccccctccctctccccctcctcctccctctccctttccccctcctcctccccctccccctcctcctcttccccctccccctcctccccctcctcctcctcctccctctccctctccccctcctcctcctccccctcctcctcttcctcctccactcacagagatcgatcctcctgggatcaaggcatgcagcaccatgtgtgtgggaccacacctagcaaggcaaagaggatcttccccaccaatagcatcttcttttccagttagatgcatcatcatcaaggagacgctcacaggcagctgcccctttctggggttagcacacctacc

SEQ ID NO: 31412 - DNA, 2272 bp, Mus musculus
ccaaacaaagcgtcccaagcagactatagaacttggcctcgccgttcattattcatggactttttaccaatacagtctttccttttttacctgtacaggttgaatgatcccaaaatgtctgaagcagagcgccagtccatggagagcgagcgtgcggaccgcagcctgtttgtccaggagctccttctttccacgttagtgcgcgaagagagctcgtcctcagatgaggatgatcggggggagatggcagattttggtgctatgggctgtgtagatattatgcctttagatgttgctttagaaaacctaaatttaaaagagagtaataaaggaaatgagcctccaccacctcctctttgatgacctccccactcgaagacaatgtcctctgtgctgtatttgccaatgaaagtggacaacagctatcctgggtttgtgtggtgattgtaatttcaggtctgtcactcttgttacattgtgtacattcaaaaggaagagagaaatatatatgataatcatttccacttaactaatttttacttctagcaggtaaatgtaggtagcagtgcagggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggtttacctaactactgcatgaggttttttgcagcgtgcatgagtttcagtggccttgttatttaaaaattaaatacaaggagtaaaacttaaaaaaataaaatttaaaaataaaaataaaatacaaagcccaaagctttcccagcgttatccaatggttactggcagagtagcttttgaataatgtctgcctgactcacccttatccatgtgcctcctacgcacaaagccagctctgcagtggaacccagggggcctagccagctacagcgctccactgtatgactgtcctgtcgccctgttaaccagtccagcctgtctctgtctcttgtctcaccagaagacacaccagtaaaggcggggtcctctgcagggcgactgtgtgccctttagacaaatcctgtttgtgtttgttggaagtttttactttttgtggttgtttaaaattttttgattgttaaacatgttcattcaggtgtagatggatttcatttattcactgttcagtgcagttaacctgaattatgttgtcttgttttttaaaatctcaccacctcaatcatactttgtgccgtttatgtgtgtgtgtggtttgctgagacagatcagtatcaggggagccttcccacaccttaccaaccaaattcttaatgcttattttagcaccttgtatttattgtttttcccctcctggcataaaaagtaaagttttttaattgattcatgccacccatatgcctatgttatcaatcctgtgtgttgaaaaaagaaaaaagtagagctgccttggtagttagggtgtggaggatgggtgctttctgtttgtctccaggtttcacactggctccagggaggggcagaggctctgcgggggtggggcagtttttgaaatgtaaatttagaacttttaaaaaagatgcgcagcttctgatcaatttctatgagacttaatctaatcatgtctggctccggccctcttccctgtgagccgtccgtcctctgttggttctctctcccgccatcttgtcctcccctctgtttttcatgacaagcatacagacttgaacacccctgggtgctgtcaagaactgtgaagtccatggtcatccaaatctaccaaaaaaagaagtcaccctccatgtctaaaaaaactgtcgcttctcctcggaaacttgagactccaccagcttccagatacagtagctgttttctttagtctttgatggaaatcttctgaaggaaccgccctcgctgggctcctggtacaccagaggtcaaggccggtggggttttctttttttaattggttgttgagaagtttcagaagttcgttttccagctgtggtcatttcagacacatctgcaccataactcacacatttcaataaagcattttcaagactgttggccactcgaatttctttggtgttgaattaacctgaccatcattcagaggatttttttttttttttaacatctctaatgcagtttttttttttttttttttttttttttttttgctttttgtgctaaacacagagttactggttttgtgtggatgta

SEQ ID NO: 31413 - DNA, 1104 bp, Mus musculus
ggtatccagtgttctcatctgcctccacagacacctgcactcaggtgcatgcgacagttgggaagacattgccctcttggtttttgtttagtatatgtatgtgttttctatatctttttaattccaaactactcggtagagttaatcagagtgatttcatttcctgtgcatttaaaaaaagatttttttttaaagatttatttattattatatctaagtacactgtagctgtcttcagatgcaccagaagagggcgtcaaatctcattacggatggttgttagccaccatgtggttgctgggatttgaactcaggaccttcggaagagcagtaggtgctcttaaccactgagccatctctccagccccctaaaaaaagatttttaaaaaatgaccagagcataatgtgttgtctcacactctctgtcattagacacacactgacttctgaaaggaccgttgtctcctgaagctgtgtaatagatgcatggtgacctgcagtctgcagatcttcctctcctactctttcccttccagagtctcactctataatctagactggccttgaactcatgctcctgcctcaactttcagcaacagggcatggtaaaatttgcctataatccttataattctttttttttttttttttaagaattatttatttaatatacatgagtacactgtagctgtcctcctcagacacaccagaagagggcatcagatcccattacaggtgagccaccatgtgggtgctgagaattgaactcaggacctctggaagaacagtctgtgctcttaaccactgagccatctctccagccccaatccttatcattcttaaggtggaagcaggaagatcaaatattgaaagtcatcctaggttacattgtagttaaagaccagcttatttgcttttgggttctttggaccttcaactgtattagcatgctttataaactttgaacagaaaagcaactgcaagctgggcatggtgacacacgcctttaatcccagcacttgggaggcagaggcaagcagatttctgagttgaaggccagcctggtctacagagtgagttccaggacagccagggctatacaga

SEQ ID NO: 31414 - DNA, 1167 bp, Mus musculus
aagaggtgatggttttgtttttcagtctgtaacaccatctttctttcactcacggtccctgcatctctaactggaggcagttagattgaggaaaggtagaaattactggaaatgtgaagaaaatggaacaagcctgagaaattagagcctgaggaactgactgacctcggactgacaggtcacccacctctgggctgggactgtgtgtccccacacccagctggggatttttgtttttgttagctttggtttttgttttttgggtttttgtttgtttattttggttttctaagacagggtttctctgtatagccctggctgtcctggaactcactttgtagaccaggccggcctcgaactcagaaatccgcctgcctctgctgcctcccaagtgctgagattaaaggcgtgcgccatcactgctggccaatgttttggttttgttttttcttctttttgtaaactacttattctttccttaaccttgagttacgatgaatcgagtggtgttcgacatgtacgtagaatgtttcaccctgggcgggggctaggaggccctcgtgctcggagatcaaacatgcactttactagcagttctactggtggactctcttcttctcagagttcatactctccaagcagtagggaagccatggatcctatagctggtaagtgtgtttctacttctgagtggcaagggcaggggtgtggagctcctttaaagatgatttgtgaggctgatgtcttacttttgcatctagtcctgtgcttggattccttcaaacatttagaagtcttaggacatttgtaagtggacatcatagtagcccatgtactactgcgtttctcaaaggcattcggggtaagataacacaaaagaagggctttagggaagatttcagactggaagaagaccttcagaattccatgattccactttaagaacttaggaactcattaagttctccttgggaggaaagtaggaatgtgtcctgctcatcacgatttgagcacactgattattgaacatactgaaggaggatgttacaataccttcaacaacttcactaaaacaagagtctgggctttactaggccagagtcaagcactacaggtgtgaaggacttgccttgccaagcactgccaagtactttgaaacagcagtga

SEQ ID NO: 31415 - DNA, 1079 bp, Mus musculus
tagggagatgtacttggtttgttttccttacttgctatctagagaaacagaaattagaagagtgtcctaagtttcatatggaaataaaggttttataaatgttaacagttattaaaacctcattgaaatcaagcttctaactgtaatcttaacactcttaaatgcaccctctcacacaactacactcctttaatcccagcggggcaggcaaatttgtgagtaagccagggttacagagtgagatgaaattgtctccaaaattaattaacttaaaaaaaaacaaaacccaagaccttataagagagtagatttattgctatttcaggccatagcatattcgtcacactcttgtggaccgtaactgtatttgtatgtttgagaaggagcatgggtgatctcaatgcaattccactttgttttccagatttgtactatggtggggaagctttctctgtagagcagccacagtcttttacttgtccctattgtggaaaaatgggctacacggaaacatctcttcaagaacatgttacttctgaacacgcagaaacatcaacagaagtggtaggtgaagtattttgctaaaaatgatgacatatgttactcttgatgttgctgaagctaggcactgtcatcctcctgtatggtataatgactacttatatagtaataaaaattactttcaacagcaaattttagagccctaggatgctgcatttcttcaagatacacgcaggggtgcctcatcagaggcagtgggaggttgaaagggcccagccagccgtcttctgcctttgtaaagggttcttgttattgttctgggctgattttttttcttctatgaggagcttttttctgggggaaactgcaactctttacttgtgtactaagcattcctggactgtgtgtacaccacaggccttccttcaatttcatcagattgcgtcttagcttcccaggtcagaactcagtgcttctcagttcttcctttctgatccctcatcccacactcccccatgaatgacaaaaagccaatagctagaataaaatatgaagtctaaacttgaaaactttcaaca

SEQ ID NO: 31416 - DNA, 1177 bp, Mus musculus
atacatccaggcaaatcacattcaaataaaacaaatctggaagaggaaaagggtcactaaaaatagaaataaaactctaactttaaaagtatttaagcctaaggggctggggagatggctgtggttgagagtgcttactgctcttgcagaggccgacttcagttcccagtgctcacagccaggcttggagccgcccagaacaccagtttgattgtggggagggagctaataccctctggcatccttgggcatcagtacccagcttgtgtacattatgcctacttctatttttttatgtaaacataaaacattatttctagttttggtgagcatttgttttttagttccactgtgatgcctaacttcaggtatcaacttgaatggattaggatacactcaggaaacatttttcatgtgacaattaagtctctctatatcatccatgtgtgagtgtgctggcctatacatacatgtggaggctccccacccatccatcgattttggaggcagggctgtataggtctccctgtgaagcctaagttggcctggaactcacagagacccacctgcctgtgctgcctctcagatggcaatcacaggcctctccctaactggaaccttgtttcttaaaaacagaagtggaatagaccaaataactaatgacaaaatgtagcaagagaaaaatgaagaattcaggaacatttcccagaaatgagcagagagacagttgcatcagtcaggctgtagttgtacttgcatccaggctggtcttccaggttgatgttgttcaccttcctgctcatgccctttcctcaacagcaaaaaaaaaaaaaaaaaaaaaaaaaaaaaatatatatatatatatatatatacatatatacatacatacatacatacatacatacatacatacatacagggtaagaagaatagtagaaaactaatacatgccggtgtggtggtgcatgcactgagaggcagaggcgggggttctcttgagtcagaacagccagggctacacagagaagccctctctcaaaaaccagaaacgaatgctcccttattttaaacagacaactgactcaccttacagatttatatacctaaagagaactctaaaacatggtcagtaacaagcagggttccccggagcttttccatctttagacttctcgga

SEQ ID NO: 31417 - DNA, 1099 bp, Mus musculus
ccgctccccaccctgaaaatctgtggttttataggacgagttgagtagaggtaaccaactaagagaattgttggagataaaatacagaactacaaaaacgggagatacattgaagtcagtgagaccagcttctccagctgaatacctctgtgtgtaagtagaagggaagtggataagagacattgattgacttgcctaaggttccaaaggggaagtggaacaaggattcacttgttctgacttctggtccagtgctcagtttgttttctcttctataaagagggatgagatagtaatgccagcctctctgaggatggttgtggggtaaaatgccaatgtgtgtacagttttgtaagttagagagcaatgactgcaggagtgaaaggtgaccgtgtttttatcatggaagaccagagtagaagtggaggttggagcatgagaggtaaaatgcgggatttcaggtcccataaggacagtctgggatgaaggacggattgattatgcctcagttttttttttttttaagatggacagacagacttggtgacctgtaatcccagcagctgagggaagttgaggcaggaagattgagacttacaagacagcctgagctacttgaaaccttgtcttaaaaaactaatcagagaaagggtacaaagagatggagcaagttttagaaaggtgtgcagtagcatgagatgaatagatagatggatgcttttgacaaggaaactggttaaaggctttttgctaaaatgagctcgaaataaaaaaaggatctgatttatcaatggcagtaggaacagaaagggaaaaagatgacaggacggagtctcattgtaagacagcaaagaatagacagggtactggaagaacagcagattcttctagcaaattgggagcataaggatgaaaaaaacacacgctcagcttttgaccctttgaatgaaaggtggtggtggtggtattccatcaaatagaaaccagaggctgggaaatatacttgggggagagaaataggggctggtggcaagcattttacagccatctgcatagaagcctggacattgagctgctctcagtaagacaacacagggaa

SEQ ID NO: 31418 - DNA, 1176 bp, Mus musculus
cccttggttgtagaacttgctaaaggtatattctttggtcctgcctagatctgtctactggaggagattctgtagggtgggcccagcaggctgcttttttgtaaataaagttttatggggaaacagccatatctagtcatttatgcgtcatctaagctatatttgtactgtaatagcatagttgagtagttctgacaaaaccactggaaatatttactattttgctctttacagaaaaaaaaattgtaggtttctgcaataaacgataaaagcataaatatgcagtagcgcatttggaggtagcaggtgttagggaaacccataacaccttgtaaataaggttatcagagggcccgtctgaatgaagatggggcttttaagagaaatctgaactgatgaagacatgtaaagggaagggggcatttaaacaaaaattatgtttaaaggagaaggaagtctagcaagtgcgcaggtcctgaaacttgaagagcttttggtgaggccttctggcaggagggcagtgattggggtaggaagagaggaaatgaggttggcacagttgaccatgcccttctgtcctgtcctgtcctgtcctgtcctgtcctgtcctgtcctgtcctgactgaggacagtttaattgggagtagaagcacatttctataactgcaggtggagggcgggctcttagggtgaatggataacaggctggggttgtccactattgtcctccgcggaggtatctcagaaacctttctttgcaaagtgtcctctgcacagatcgctttattttggtattactcagccctaatgcgtcttagactaagctgttttcttcttgcaggttgagggctttatggagaagaagtccccctcccttagttgaatgggaactccatgagccttgaactaggtggtcttcattagctttcaaaagggaaatagacacaatctaaggcatattttatactatgacccaggagtcattgaatcatatgcacctggtgtaccaaacaagttttgcaaagtagcactcacctacacttggaaaaattcgtggttttttttcctcttctgtttcattaaaagaaaatatatgattgtgattttttttaaaaaaagaactattatattttacatatatgagtacactgtaactgtctttagacacaccagaag

SEQ ID NO: 31419 - DNA, 1172 bp, Mus musculus
catatctcattacagatggttgtgagcaaccatgtggtggttaggatttgaactcaggaccttccgaagagcagtcagtgcttttaaccgctgagccatctctccagctccagtgctagtgtttcaatgcttctgctctgaggagcagcttgtgaaagtcatggctcccccaaggcaagttctaaagtagtgaattcagaagaagataagttgtttctaatggaagctgagttttcagccttgagattaagatgacctctctaggcttagtaatttattataagtggtattatcattattattgatttggtttcttttgagacagagtctctctatgtaaactaaacctagctgttctggttctctatatagaccaggttagaccaggttagcttacagagatgcctatctctggctcccaagtgctgtctgtctgtctgtgtgtttaatacttgctatcaattacagaccctgtcctaaaattcaggccttgaggatggagcacagtgatagaatgtatgccacgcagctcagaagacagttctcccctttcactgtgtgggtcctggggattgaacttgggcatctggcttggtgtcaggtgccttaacactggttgtatctgttagaaactcaagacttgatgtttcctgcctgttttactgaagaaacctttctgctgagcagctggtatccccagattcatccttttcagttctgccccatcagatcactggaatgacatgcagctattacatttgttgtcagtagtctaagttaggtggttttgttattgtttctttttctgcaccaccctttagctgggtactgcggccgccgccgccaccaaccaccccacccccaggatttctctgttctagaactccctctgtagaccagctgtccttgaactgcctctgcctcctgagtgctgggattaaaggtgtgcgccaccaccacattgttagttggatactcttccccagtggtcttttaagtgtggtccaagtactactaatatgggcatcactaagtgggtgtgtcgcctaaaaatacaccctcaggactcatgtaattaagctagacatagtgtggtgcacgcctttaatcctagcacttggaaagcagaggcaggctgatctacagagtttgaggccagcctggtcaacata

SEQ ID NO: 31420 - DNA, 1148 bp, Mus musculus
gaatcactaacagcagagaaaaagagcccttccctattcagaggtgatggaggcctccaggtaccagctggagttgatctgttatgtaaaccaggcattggctccccaacctgtctgtccgctgatctgccctgactgccggtctcactactaggttttaaatttcttgtgaccaggaggatacagctcatttgaactaactgccctcatctatttatccagtcccttgggggtaaggcaaaaatgtggggcaaaccctatccaattgtttccctccctcccctcctacaggaaaaggctacccctgtaatcataagcctgcttcagtgcccaatacccttgggctcctcctccattagccccactgtgctggtcccaccccttccctgtgggtcatgaaagggtgtgacctccttcagttctgccgccacaacgcacgcacccgctgctctcttccaccctcagaggatctgtctgggaggcagctcagcctatgctccctctataatggctaacgcattcgcataaggttcagagacaaaaaactaggctgatctccgtggctgcagttctgaagatgttccgcaagttgtgatataatgcggttttatctggcctttgtttttatttcacctcattctgttaacacccaatagaaaacctcgtgtgtttgtgtctgagggatggaccccgacctcgcccaatttcccacattcctgaatgattctttgcatcctttcctctcagactttaacaaatcactgcttctggtgtgcgtgaaaggttaagagggcagaagaaaaggtaggatttgaagagccgatcaaaagcaaagcttaatcttttggacagcatttttcaaaatggggttaaaattgacatggatcgcattaagggcgaagcaactgagaacccaggaaaccgcatgtcgagaagcacgtaaaacaaaaataaaaacgatacatcctcctcacccattctaccacgtcccctcctctctccctgcggcacaactcactcccagaccgctctgcccacgcatactcaactaaaaaattcagaccacgccaaccatgccacgaggtgtttttattttcatcaatcatacaaataattttctataatatcccagggcaaaccggtgaaat

SEQ ID NO: 31421 - DNA, 1162 bp, Mus musculus
cccaggcagcctggagatgctgagcgccccccagcccccgcgcgcgctggccacgccctccgcgcgggctggccacgccctcgttgcggcgggcgagaggcggggcggggcgcggtgtatataagacgaggggcgggcgccgctcttttgtctcttgctgcagcaacgagagtgggagcacctggagcgcgagctcggaaggagaatccacggtaaggcacagcgccggccttggggcctaccctgggtggggtcgggccagtttatggctggcgggcgcgttccccttcggttgcaacaggcgacccggcggtttggaatcttctggggctagcaggccacgccctggggcttcggagggagggtgtggtggacgagtctaggatcctcggcctccgggctgcgggaacgcccaggactgggaatgccacgttgagaggcgttcgcggaaggcgcgggatccaggacgcgctggtcacccccaagcccctggccacccattatcaccttgtttcgcccatcagagttgtaagaaaatggcagacaagccggacatgggggaaatcgccagcttcgataaggccaagctgaagaaaaccgagacgcaggagaagaacaccctgccgaccaaagagagtaagtgtgccccgggttcccaccccagcgctcctcccttccctgctgtgccagcccggcacccccacccccatccggccactatcttcccaccccgaatctaaggccacagccacccttccagtcacacaaagcactttgtctcttccaaaccccttctctgtccgcaggcctcgtgggtgcctcacccacaccaggtttgtgggttgggtatggggggctgtaaggtagctccaatgaccacatccctcccttcgcagccattgaacaggaaaagaggagtgaaatctcctaaaagcctaggaagatttccccaccccaccccaccccgccccatcatctccaagaccccctcgtgatgtggaggaagagccacctgcaagatggacgcgagccacaagctgcactgtgaaacccgggcactccgagccgatgccaccggcccgcgggtctctgaaggggacccctccactaatcggactgccaaatttcaccggtttgccctgggatattatagaaaattatt

SEQ ID NO: 31422 - DNA, 1128 bp, Mus musculus
tgactgctagcctgtttgttccttatgtctagggcatttgtttgttttaagcatttctaagcttttcaacattttgttcaaatacaaaatgaatcagtgttacgttttagtctctgagaaagtcctcattgccttattaaagggccttttgcatgtgggtgcacattgtataggtttggataaacagtggtgcccatcagccacatgcagtagttctgcagtgaagacggaaggattgttaaagcagccctgtttgcttcggggtctaaaggaaaaagtcaagctctgtctggagcttagactgataccagcaaaggctgatttgaaagtagctggttttccagcaaggtccctgttcccacacattttacctctgcagagctgaggtcctaatggtgacctagaatttgaaaatcacttttccatgaatgtcatttgcattttttcttctttcctgtttgtgaaggagtttgaaaagaggaagatgctttgaaggacacaacaagaaattctttaaagctgtggaagaaatctagacgtgagggccagtccaggctgtcagcccatgcagctgacactggttggtctctcagtatgtgggaaatccaggcaagttttagaatgtcctaaattgagctattttcacttactgtgtaacagagacagataataaatctatcatttgatttgaacttggctgtgaagactttttattgttccagtggctacggtggtggtggtggttgtagtggtggtggcggtggagtggggttgtggggggatggaagggcatgtgtgcttgtgcaggctaatggctctgtggaaggcacgccagacttttagctgaatgagactgtaacaactctttatttcaaagaccttagtggacctttgaatcatagttaagtcatatgtaagccttcactgtctggctcaccagaagtaggagataaatgtatttagtctttagcatgtaggaaagcaaccctgacctccttcagaacctctcccatcaccattgccaccattgtcacagatcggaagctgctgctcttgggaaatggaaagtacttactaaagtgcttcatcgtggctggtcatagggccacctcctcgccatccatctta

SEQ ID NO: 31423 - DNA, 1172 bp, Mus musculus
atgctacttattatgtgatagttctggagcatttcattcagaccctaacttaacaattcctctgttagataaattgggaaaaaagtgtagttgttaaagaaaggtacccagaatgtgctcagaagcatagccttcaggtaagagctttcttaagttattaattcttcagagagagtggtagatacccaaagcattagagaagattcaatgctactaaacaaaggtaccttctgcggaagggaagaacctatatccagaggcagaagtcttgttcagtagtggtgaatatgtgatcttttctgcctgccttttgtcaaaatgcatcctagataggatggcagtgctagggagtaatacttgcaaacagcacagctcatcatagtgacaccttgataggtggaatactgtagaaagcatggctaaatctgtgtggccatcagtaccagttggattcaaacaatctcctcccttttatagccaaaatcacaatttgaaagtctaaacaggtgctcgcttcggcagcacatatactaaaattggaacgatacagagaagattagcatggcccctgcgcaaggatgacacgcaaaattcgtgaagcgttccatatttttatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacac

SEQ ID NO: 31424 - DNA, 1099 bp, Mus musculus
ctgtccgccgtctccgcacggcctgcgagcgggccaagtgcaccctctcctccagcacccaggccagtattgagattgattctctctatgagggaattgacttctatacctccattacccgggctcaatttgaggagttgaatgctgacctgttccgtggcacactggaccctgtagagaaggcccttcgagatgccaaactggacaagtcacagatccatgatattgtcttggtggctggttctaccagaatccccaagattcagaaacttctgcaagacttcttcaatggaaaagagctgaacaagagcattaaccccgatgaagctgttgcctagggtgcagctgtccaggcagccattctatctggagacaagtctgagaatgttcaggatttgctgctcttggatgtcactcctctttcccttggtattgaaactgctggcggagtcatgactgtcctcatcaaacgcaataccaccatccccaccaagcagacacagactttcaccacctactctgacaaccagcctggtgtacccattcaggtgtatgaaggtgaaagggccatgaccaaggacaacaacctgcttggaaagttcgagctcacaggcatccctccagcaccccgtggggtccctcagattgaggttacttttgacattgatgccaatggcatcctcaatgtttctgctgtagataagagcacaggaaaggagaacaagatcaccatcaccaatgacaagggccgcttgagtaaggaagatattgagcacatggtccaagaagctgagaagtacaaggctgaggatgagaagcagagagataaggtttcctccaagaactcactggagtcctatgccttcaacatgaaagcaactgtggaagatgagaaacttcaaggcaagatcaatgatgaggacaaacagaagattcttgacaagtgcaatgaaatcatcagctggctggataagaaccagactgcagagaaggaagaatttgagcatcagcagaaagaactggagaaagtctgcaaccctatcattaccaagctgtaccagagtgtaggtggcatgcctgggggaatgcctagtggctt

SEQ ID NO: 31425 - DNA, 1356 bp, Mus musculus
tgataaaccaacacaataaaatatttatagtagaatgaagtgtatatgtatggacatgaagtgaactaataattgcagcaaagacttagtaattatttaccatggcgtctagccatgcagagaaattttggtcaagacaacagaagaatgtatagcacaagtacatactgcttaaaatattatagacttttattttggaagggtagctacaggagaagtttactagatttaaagtatgcatcttgtggtaccataagcccagaaggaggaggaggaggagcagcagcagcagcaacagcagcagcagcagcagccaggaagctctggaaaggcttctggttgctaggagaagttttagatctgggtggcttggtagatttgattggtttcagcaaggaaggaagaattaacttcaagtgtggtctgtattgaagaagatgattattcaagaaaaagaccccttacactgtttggggcaactttgttaacatgagctttctgctcaacaggtctatccaggaaaatggagaactaaagatcgaaagcaagattgaagagattgttgaaccattaagagagaaaatcagagatttggaaaaaagttttacccagaaatacccgcctgtaaagtttttatcagaaaaggaccggaaaaggattttgatcactggaggtgcaggctttgtgggctcccatctaactgacaaactcatgatggatggccatgaggtgaccgtggtggacaacttcttcacaggcaggaagagaaatgtggaacactggattggccatgagaacttcgagctgattaaccatgatgtggtcgagccgctctacatagaagttgaccagatatatcatctggcatctccagcctccccaccaaactacatgtacaaccccatcaagacactgaagactaatacaattggaacactaaacatgttgggattggcaaagcgcgtgggtgcccgtctgctcttggcctccacttccgaggtataagaatcattaataatttccccaagatgtttttatacctttgctcaatgagccacctaaccagccaataacaatgtcctttttttccattaacttatgtatttattcagttgataacagcttcccttctagtcttcctctcaccaatcccctacccatccccttgtattctgagaagggggatacacacagccccagatactatcagacctagcacatcaactcactccaggactaggcagatcctctcacattaaggccagacatgacagctcagttaggggaacagaatccacaggcaggcagcagaatcagagacatcccatgcttctattattgggggatccacatgaa

SEQ ID NO: 31426 - DNA, 1210 bp, Mus musculus
gtgccaggcttgcactgagatcctcatgcgccaccctgtttaccattgcaactgcccgctctgccgccgcagcatcctgcaaaccctcaatgtctacctctgaggactccctccctgcctgctcatcctctgcgctccacacaccgggacagcatcaacactttgcctctgggttctggcctgagtcttcttttcccccgaaggcggcgactctgccaagcctcaagccatatatccaggacgtgtagcttggaatactctggaagactccagtctgggtgggacagagtaacactttctctaaatcctgtgtggggccctgagatgctgagggtggtgagtatgtcactatgcaagggccctgagactctgtggtgggctcttgtgctgcgcctgccagggcccacccagatgcctgcctctagggctgtccttctctgcttctggctcttttgttggagtttttggtcctttcccccaggccacgccacgccacatcagtgttgtttgaggattttggaaactcatgggccttagagtgatcttgattctttttctcttttttgttttttcttggtttggatcttgaacctttatgttcagccagagcctctgccctggtaggtctgggagtagaaactcgcagatgcccttctgcctgtcactgtcttttaaagactcccaacttgaccaggacctggagtcaggggtttatccctgagtacaggggtgcagctacacctggctttgggaccattcaccttcaggcaccccagctccatggggagcctcgaaaggaacaaccagatgtctactcattccctacatggcatagaacatagcattcctcctgggctctctccggcagtggagagggcattccgcacttttcacttgggtccaaacgaggggctgggcctcaggggtcatagctccatttagtcggtcggactgcccagtttctatgaataaagttctcttgacagctctaaaaaaaaaaaaaaaaaaaaaaaaaaaaaaaaaaaaaagagtcacgaggaagtggaaagtcagtcacaaggaaaaatacctgataattgtgtggttatttctcaagacagtttctatgagcccctaaaaaatagcacatttgcatagcaggttccagaaccgatcagggtaacttttttttttttttttgaacaaacactccctgaacccaggaagcagg

SEQ ID NO: 31427 - DNA, 2107 bp, Mus musculus
acatagctacaaaatgagatcgacatgggattccttttgactcaccccagttgtgactgcaacatggctaaaggtagggagagtttaaaaatctatcgccaggttctgatctccaaggtgcctcaagatgggcccactaatttggctaaggtaaggggtaatgcaggggtggatcgaacctccttcaatgttccttgaaaggcttatggaagccttcaggcggttcactccctttgatcttaccttgaaagcccagaaggcctcagtggccatggcctttcataaggcagtcaactccagatatcagaaagaaacttcagagattagaaggtgtattataagagggagacagttactcgatctagtaaaagaggcagaaaaagtgtgtgtgagagagagagaaaagcgagaggcaaaagaaagagaaaacaggagggatcgtagacaagaaagaaatttgccacagtggtaggagaaaaaaaaaaaaaaaaaagacaggatctagacaggaaacctgggcaactgaagaccaagcctcagctaaagaggctcagctgtgtcagactgaagttacttatttgggatacaccctttgagacaggaagcagtgcctaaagaaagccagaaaaaagactgtaacttagatccccaccccaactacaccaaggcaagtaaaaaatttttgggtaccgctggcttctacagactctagacacctgggttggcgaccttagctgtccgttgtaccccctaaccaaggaaggggaagtgtttgtgtggaccccagatcaccagaaagcctttagagaaatgaaaaaggccctactgatggcgagcctttgcctgacctaaccaagcctttcactctttatgtgaaagagagatcaggggtcgccagaggaatcattactcagactttgggactttaaaaaaggccagtggcttacctatccaaaaagttacaccctgttgctagagggtggttttcttgcctgccagctggtggttttcttgcctgatggatgatgacaacactcctgtgatacatcagaactttttgttgactgaacgagtagccttcgcttcattccacctgctgtcccactgtgtgagactacacctactcatcactgcgctgagaaactggtacttaaaatgatccgaagcatcagatcagccttggcctgagagttcgaactggtacactgatggcagtagcctcgcggttaaaggtaagcagaaggcagggacagcagtaaggtggtgaacagaaaacaagtgatctagacaagctctataaatggcaaaagaaaagtctacactgacagcaggtatgcttttgccactgtacgggacaatatacaaagagggctgttgacatctgcagagaaagacctaagatgctgtggctaaaaaaaaaatcagatggcagatctaacaaatccaaacaggcggcccaaggagcaatgatcctggcagtcaaggaacctaaagattattatgacatcagagagaccagatttagatataccgctgagcactatcaagttatggacagtatttgacttggcctgggggccaagaaattcaaaggtgtggttaggtcctttgactactatgttacaggactctctgacttggcagaagaaatagtcaaaagctgcaaggcctgtgctatgataaggtagaatttctaaaagaaatcttcccaaggtaattgggtccaaaaacggacctgtctttgttgcccaggtaaatcagggactggccaagatattggggattaattagaagttacattgtgcatgcaggccccaaagctcaggacaggtagagagaatgaatagaaccattaagggacccttaccaaattaacagcagagactggcgctaatgattagatagctctcctaccctttatgctcttcagggatagaaacacccctggacagtttagactgacccccctataaattactctacagggggccccctccactggtaaaaatagcctctgtacatagtgctgacatgctgctttcccagcctttgttctctaggctcaaggtgctccagtgagtgagacagcgagcaaagaagcagctcc

SEQ ID NO: 31428 - DNA, 1119 bp, Mus musculus
atattcctccggccttttaaatgtaatcaggtgttcataacttgtttccttctgtagagactcttttttatttttattttttcaggctagtgacatgtaagagccctttgagaaaagtagctcagttcccagcacccatgtcggcctgcgcacaaccactcagaactccagctcctgcagagtctggtgcttccggcctcctcaggcaccagcccctcacatgcacaaatgcacattcataattgcaaatagtgaattagatctttttaaaaattgagcttcgtaataagcagacatagtctggggtgaattctgggtgcggcactgtccagtagaacttttgttatggtagaagaatgtctatatcttcaccatgagtacagtagccactgccgcaagaagctgttgagccgagtctttacctaagttgatatggtgcgatatgactagtggctgcagtactcagcactgcttctgaggatggacagtgtgagggacagtgtgagggacagtgtgagggttctgaagcgcaggtagctctgctctcctgaggagaagccagtcgggaacaatgtgtggcataatttctaataatcacagagagtagagttggcatgtgggtggtaaattcccttcagagtacaggacagttccacggtaaagagttgtcattcctccaaatacaccatcgagatagcagatgtgctatttaaagatggcagggctaggtatgatggcacatggctgtcacccaagcacaaagccgtgtgtgtgtgtgtgtgtatgaagaatgtatttgttatgtgtttggctgtgagaattaaccagtgataggctgtctgccttgagatgttccctgtggcagaggttcttcttacaaaagagatcacagttgatctcagcttattagatgattgcttgtctggtgggcgatgcatacgctaatgccacttatcagaaaaagcacgggggtgtctgtatccgttcagccctcgtctgtctgacatctgctgtgtgggaactgtggagacgtgaggggacaggatgggaaacacagtcttcccttccctgaactctgacatgtaacttgggagaggattacttcctgtgacaccagca

SEQ ID NO: 31429 - DNA, 1593 bp, Mus musculus
aacaggtaaacatgcctgttggctcaggcctgatgccctgaacttgactctggaacccagggcggaaggcgagtaacaactcctaaaagttgccctttggcttctactgcacatccttgcgtatgtgtactgcaattacacacacacttaaaagtatctttctgccgggtgtggtggcgcatgcctttaatcccagcactcgggaggcagaggcaggcggatttctgagttcgaggccagcctggtctacaaagtgaggtccaggacagccagggctatacagagaaaccctgtcttgacaaaccaaaaaaaaaaaaaaaaaaaaaaaaaaaagtatctttcttttaagcccttgttctgagaatgcctttggttaatgtattagctctttggtttgaaagccattaagtttgctttgtaaggacatagtgattaaatgagcattcctcacttttcggtacctagcataaagtctgcatgtcagtttattgctctcaaaagagcaatcacctgacagtcattccctttctatagccagtgaagttagcatcaccagaataagatgaactgggatctgagcaagaggagtagggaaaaaaccataaacacacaacagtgtgcaagttaaaatgtaagaataggagctgtagaggtggctcagtagttcagagcacttgctactcttgcagaggccctacgtttagttcctagcacccaggcctgtatgtgtgtacatggttccagagaccaggaagtatcagactgcctggaactggagttacagctgcttatgacacaggtggtagtttgaatatgcttggcccatatggagtggtactgttaggaagtgtggccgtgttggatgaagtatgtcacggtgggggtgggctttgcggtctcatgttcaagtgtggtcagcgtcagactctcctagctgtagttggatcaagatgcagaactctcagccgtgtgtctgcctggacacttccatgatgttaatggactgaagctctgatactgttaagccagccctaattcaatgttgtcccttatgagagttgccttagtcgtggtgtctcgtcacagcaatgaaaccccagctaacacaacccacctgataatctctccattgttaaatgtctagttttgacaggctcattagctggtagaaaagggtcctgttttgctacatggcagttttaagaagaatgtgggaatctgagttgttgtattctggcttcatttcccccaagtttacaaaagccacttgtgaggaattccatgggtagaattccaagtgaagtctgctaagcagacctcagggtacctggcagagcctgtgtgaactgggtgtgaatgtccagcaggaagatggtcagagagtgttatcttccctatgaatcaagcttcagcttttgggggtcagcactccctctagtggggcagagtgcagctgaacatgggctgggaagctgggatgcctcacagagtaaaggctaacccatttgtaacatcacagtgccagcctggatctcaggactatttttctggtgagctgctctgcattccgtgtcattttcctggctgctaact

SEQ ID NO: 31430 - DNA, 1150 bp, Mus musculus
agagcattaactgagtggattttaacagctccattctctcaggctcaataaaaggttaaaagtgagagccagcagagaccaatagcccctttctctgcttcctgatcccctgagatgtgaacatggaaccagactgtgctaggaactggcccttccaccttgcctcctctgccagggtaaaccgtatctcctgaactgtgatctagaataagcctttctcctcttaagtagcttcttgtctggtatttaatcactataatgaggcaagtaacttacacaggaggcctgcggtcagtggacaagcctactgcgcaatgacagtcctatgccccttacagcttgctcctgcaagagccatcctgtagacctctggggaaagcatgaagacaccttcgtccccatacaatggcttcataaaaacaaggctgttgtcttcagattgcctgctgtggaggaggatctgggctcagggatttacatacatgatttcaggtgaactttgcattgattcttccaataaagagctatttacttcaccattttcaaaacagacatgacaatcagagggagagagagagagagagagagggagagggagagagagagagagagagagagagagagagagagagagagagagagagagagagagagagactttgtcatggaccttgcataatgaggatccggtggtttgaggtcagtctgcctctaagtggccactgctgaagcccttcataatctttgtgagcattgaatggcccttgttagcatggcttgcccacttgtgacatgtttagcatatgaattatcacccaaatgatggggtaagaatgctgtagttccttagggaagcctcaggccaggggctggcaggctccaggaatggactttggctctgcaaagaacacggtgcacagggaaatgcctagcagcctagaggacccaggtcattgctgtgtctctggctggctaaattccacagctgttatttgcagcctgcaataatcatggccacaaaaataaaaagaaaagaaagaattaaaaaagagagagagaaaaaaaaatcatggccacaaagtctgggttttgttggtcagcaaattgtggtagtttgtatctataatcctagctgttctgaaggctgaga

SEQ ID NO: 31431 - DNA, 1151 bp, Mus musculus
atgtagagaatagagaaatattaaacttgttcaagaccaacctcttccagtgtaagataataaatgtatctgtttttcttttgtcgggggatagtttcacttaggtgtgagactattcacctttgtgtctagcctcagtccggggctgcccatctgtcatagtccttgccttgggccatggtatggttgcctgtgtctttgacctgccctttccttagcacactatgaaagcaggtgggtgcaagttggtataaccttcctttgcagcttttagaatgaccacctcaaaagccactgaatcagagccttgtctttgtagggcttgccctccttactaaaggcttcttcgttggacttgagactgctttggggggaaccaggaaagagaagtgattcttccaagtcaccagatggccgttacttccatgggtgggtggggtgagctgcagtgagcggatggtaggaatagaaatgaaggtgatctgcttagacttgaagggacagtgtccaaccttccgccaagcctgttgtcagtttccttcgggatggcgcctcttctgctttgctttgcttccctaccgtccttctcagtcccccaatgcctatcctgctccaatcataagtctgagcaaaagccaaggagacggtgcccccagaacccatttctgaccaatggtcctcactgttggaatccactacaactaggaactctcagctctacactcagccctccgtgtaaggaggatgacggtatgggccatgatttctctgtctccttcatctgcgttgggggtcttgtttcttttcctttttggtttgaaggttgttttgctttattttataaaatcatagtttgtacttaaaagaataaagaaaaaaaaaaacaaggtctctccacccctgtcaaaataaatgtatatgacacatatcaatacacccaagttataaatcaaagggtgactggcatgcagttgtcactggtgagtgtctttaagaaaaggctttggtgtttagcccaggctggttatgaactggctgggttgctcaagctgactttgagactgccatcctcctgcctccgctggtatgataggtaggtgccatgaagtccagcttcatttgctcacccatctgtttgttttaagatttta

SEQ ID NO: 31432 - DNA, 1209 bp, Mus musculus
ctactttcttatagaacctaggaccaccagcccagggatggcaccactcataatggacagggccctttcccatcaattactaattaagaacatgccttacaggcctgtctacagtccaatcttatgtgggcattgtctcaattaaggtgccttcccccgcccccgggctggtaagatagctcagtgggtaagaacactgctcttccgaaggtcctgagttcatattccatcaaccacatggtggttcacaaccacccgtaatgagatctgacgtcctcttctggtgcgtcggaagacagctacagtgtacttaagtataataacaaataaatctttgggctgaagcaagcggaattgaccagagagagcagggctgaccggagcaagcagagatgctaaaaattcaatccccaacaaccacatgaaggctcacaaccatctgtacagctacagtgtactcacatacataaaataaataaatcttaaaaaaaaaaggctccctcctaactgatgactccagcttgtgtcaagttgacacaaaatcagccagtgtgtacactgggtgtagaagtgctgctctctagcaggctaaattttcctggggctgggatggtggctgagcaggcaaagtgcaagcagtaacctgagtttggatccccagcaccaacatagaaatccaggtgcagtggacacatttgtaaccccagcacaggggatgcagagagagacaagttcacctggagcttggtggctagccagtctcgctgagtggacgagctctaggttctgtgacagaccctgtttccaaacagaaagtggaaaactgattgagggagccacctgggggcagctcccagcctctgtccacgcgtgcacaccccgcaggaacacatgcatgcatatttacacaaagagttctccatttttcattttttcatatgtgctttataaacagcttgccacatccctctgctgtgttgtcacttttattgagatggtattaaatttatagtttaatttagggagaatcaacaatttaaaattactgagtttctcaagagtggggtctgctcttccatttatccaattattctgttatgttcctcagtggaattttaaaagtttgcttcttgcagattttgccggtgtcttgaattttattctagttgctctggtgaataaaatcatcctagctgacatgtgctgtaa

SEQ ID NO: 31433 - DNA, 1645 bp, Mus musculus
ctatgcaaatactttgtcccaggcccaccacttacatattttaaagtctgatgactaatttttacatgtgttcagctctgctggtgggatgacttcaatgaggcacttgggcttcccaggacttctcgcatttttgcatgcctttttaaggctgtggaaaagcagaacttcccttcagcgtctcttgtgctctgcttgcttagtgtctgtcattcgtgggccaatgggccagaagggattgggcatctctatgtctggctgggtatactagagtagagacagatggaggaaaaagtaaattagtaaaacctgatgataacgttatataaagcttaaagatcatctctctgttgcttttttttttcccataaaaacaccaagtgtatgcatgtgtgtgtctgtgcatgtaaggtcatttgcctgaggaggccagaggtgtcaggtgggtccccatggagctagttatagtctctccctcttcccctccctccccatcctcctccctcccccctccccctccctccttccctctccctccccttccccctccctccttcttttcttctctcccccctccctgtgtgcatgtgctctctctctctcccctctccacccatctccctatctgcatgatgatttccttggcctagttccttactggcccaaaagctgcccccaattaaatctgccttttgactcttaaaataaaatggaaaaataaaataaaataaaagagttataggcagttgtgagctgccagacatggggctgggaatcgaactcccatcttctggaggagcagtgtgctctcttaaccactgagccatctctccattctcgatatagcatttcaagatagtctcatgtatcccagcatggtcttgaaattgctgtgtagctgaaggtgaccttgaatttctactcctcacaccctgggatcacaggctactcccaacatttatgctttgccggggatcaaatctggtttttgtgcatacaaccactggcactaaatcctaagtgtctaaaaagagcatctcggactggcgagatggctcagtgggtaagagcactgactgttcttctaatggtcatgagttcaaatcccaacaaccacatggtcataatgagatctgacgccctcttctggtgtgtctgaagtcagttacagagtacttatatataataataaataaatctttaggcctgagcaagcggggccaattggaggtagtgggtggggttgaccagagtgagcagaggtcctaaaaattcacatgcaaccacatgaaggctcacaaccatctgtgtagctacagtgtacttacatacattcatacatacatacatacatacatctttttaaaaaggaacatctcattaaaaaaaggttagaaaaacctgcaatctgcctggttctttctttgtattagaagatgtttccacttcatgctaagtagctctgagcagctcaaatttaaggcatttttctgttatgttttctaactattggctctgggttctctatcttgggatcccccttcctttctcttagaaatttggttttcttgaggtctttttgtttcattcttttaattttaaagttagttgcaatattttttgttttgaatttgaaatgacaatt

SEQ ID NO: 31434 - DNA, 1177 bp, Mus musculus
tacacagagaaaccctgtccctaaaccccttcccccacctccaataaaaaatagaagaaagagagaaaactaggtagatagaaccatctcatatggggctggcgagatggctcagtggttaagaacactttttgctcttatagaagacctgggttggttcccagttcccagcacccacatgttagctcacaaccacttttaactttagttctagggaatctgtcattcttttaggacctctgtaggcaccaggcacatatgtggtacacatgtaggcaaaacactcataaagttacaaacatgagttaaaaaggtagtagtattgagccaggtctagtaccacatgtctttattcccagttttcatggatctctgagttcaaggccagatggtctaccaagtgagatcctgtctcagaagaaaaacaagttagtattgaattcagtaaggatattttaatttttgttttcctttcatctttgggtgctaggtcatggtgtaaaatgcatatagaatatcaaatgccattcgacctctttctcctggtatcatgcctgtgatgtcacattataggtaaaaaaaaaaaaaagaagatgtagatataacttaggttgactagtcaattgactttaaagttgattatcctgggctgtctcagcaggccctaataatgcatgatcccttaaaagcagaactttctcctgaccaagagtaaaaaacgcatgtcaaattcaaagcatggaagaaaggcctttcccccttaacctccaccccagtttctccctgcagccctggctgtcctggaattcctcctatggaccaggctggcctccaactcacagagttccacctgcctcagtttcaaagggaaaaggcctttctaattttcctggctttgaagatacaggagacaagaaacgtgggcagtcttaagctaagaactatggtggcctgcatagggagagccatcgtgacaaatacctgcacaggttctgccatagtgacaaatctgtgagtactccaggaaatggtgctggccgttgtagattcagcatctggctttggtgcttggctttcttctctgctgatctcagtttcacgaggtcccctcccctgccccacatctatgttctatatagtaatttgttgatggaagctcttgcctggtccctgctgc

SEQ ID NO: 31435 - DNA, 1202 bp, Mus musculus
aaccctttttaaagttaaaaatgctttgtttagaaagcctctccctttttgaatgttcattaagcagtgtggtgattctttagctctgttccagctttaattctaattctgtgcattggcagggttacttaccaatggactaccttctctaatgacatctcccttgggtcttttggatcaataatcctcagattgcatcatgttaccagcatgtccttgtgtgctttaactttgccctgtttgtgacactaccccagattgagacatgtccttatacattgctttcctctgttttgaggcactttggattgagacatgtccttgtacattgctttttctgtttttaggcactttggattaattgtggagctggatggtctgagccttggctgcatctgtcacctttcccctctgtaagcctcagctttggagaaagtctgcgcatgtacacaatcttcttactctttttacccaagatagaagaagcagagagctcttggataacgttctccaccaagtcttccattacttgagtctgtcttccaattcaagcctggatgtagctgatgctgtttggggcagagatgaaaggactgttctgcatagctggcttaatgagcacagactagaataaaaggtctttgttcagcttctttcctgtgttttatattgcctttgctcttgccctgtgactgggaacccatgtgatcaggcacagactttcctcatctttctaccaaccactccaagtcagtctttttattaaatttgttctttctcagcatgtcattggaatgtggatcgataatatatgggatacctcttctccttagaagtcaaatcgatgtggtcccaacagttttattcaagtataattcatgtgtcatattcaattcaaactgtaacattcggtggtttttaaaaaaatattcatagatatatgtagtgagattttgaacattttcctgtgaatggattcacatgagtcttgtgtatggcaaaatttagataatgttatttaaagttaatctatgctatgatatgtatttataccctttaagttgtgaaatatatgtgatataaaatttcccattttaactgcttttcagtgtgttgctcagtgagattgaatattttcagagtgttgcacaaccttcaccatcattggcctccagaactttgtaacagtgttctcagcctgg

SEQ ID NO: 31436 - DNA, 1149 bp, Mus musculus
ctcatctcagtgggctagagtccactaatctctgcttgcttttttttttttttgttgcaggaactgttcgtggagactatcgcaaaagatgcctactgctgtgctcaacaaggaaagaggaaaactctccagaggagagatttgggtagagtcgctgtggtaccccagggtggacaggggagctatgggctgggctttcttatagctgtttcacaaggcatcattgaagcaaggggaaatttggcttttggtttatttgtctacctggtaacccttccacatgtgtaagcctttagagactgtacctctcattcccttctatgctgccaaactctttttctagtatcttttttttttgtttttgtttttcgagacagggtttctctgcagccctggctgtcctggaactcactctgtagaccaggctggcctcgaactcagaaattcacctgcctcagtctcccaagtgctgggattaaaggcgtgcaccaccacgcccggccttgttctagtgtctttagagtagagagaaaagtgaattttggaataagacaggattgtaggatgccttgaacagcattttcgctggcttttgaggtgagacagttaaaagaatagtgagtgtaaagatggatcttaggacctctgggttacagtttgtaagtgatgtcatttgcataaaattccatgttgggtctgatgtctgaatggcaagagccaatcaagtatccctttaccttgtgtttcagataatgcaatagaagctgtggatgaattcgcttttctagaaggtgagttcactgcctgcacagactatttctctgttgatgatgtgagcttcaaaccttataaaaccttataaaacagatgtgtggttttcctttgtatacatggcagcaattctccctgttttgatagaaaaaaaaggaacattttccattcttggggaattagaaattctacagggaaattgcaagcttaaaagaagaaggagggagtatataaattaccagtagaattggatttagattttgaatcctgtttatatctccaaactaaatattaatattgctcctttataatgttaagaattagaaacaatttgtaactttttttaagattcctttttatttacgtgtatgtgtgttt

SEQ ID NO: 31437 - DNA, 1209 bp, Mus musculus
cttcaaattgagatgttctatgactaatcagcctttgggaaatgaagaatcactgggtctctccaaagactcaaatttgatctttagtccctaggggaagagtggctttcctgtagttactggggcaacccttgggaacatttcaggaatcctggcatatcagacatcctaggtacacagggacaactggcagattgtacactactggtaaagttgggcttggaacacgggcacgttcacttactggggcttctgtaagaacataccacaaacttggtggcttaaaccataggactgagttgactcagagttctagggtttagacatctgaggtggaggtgttgggagggctggctgtgtctgaggactgagggaatgggttccttttgcacgtggtcatcatcttgctcttgtagccttgttcatcttcccacgtctgtctccacagttgccccttttattgagacgttgattatttgctgaacatcttaatggcttcattttaacctaagctcccctcaaacagcccatttccaaggaagatcacatgctaaggaacaaagttaagtttgtagtagttacttttctgttgctgtgactaaacaccaggactaaagcaacttatggagaaaagaggttttatgcttatggttctagtgagttagattccatgatggtggagtggaggcagggccagcggggtagggggcaggaggtggaggtggaagcaggagcagagaggggcaggcagcaggcatggcgggtggagcagcagctgacaaagcagagagagaaaactagaagaagtggagtctttaaactctaaaagcccacagggagtggacacacttccaccagcaaggccacacctcctaactgctcaaatagcaacactggctaggggtcaagtattcaaatgtcctagactatggggacattcaagccaccacattccacttcttggtcccctagtctcttgatcacaacataatgcaaatgcatttaatccaacttcacaacttttttgaaaagcccaaggtccagatcttttctgagccttaactgtaaccctctgtaagattcaaaataaaacaaaaaagcaaattatacacttctgatataaacttcattctgaatatttttgggtgggggggggggatacaattcagtccacaactgcttgcttactgttggctgagaagctaggcg

SEQ ID NO: 31438 - DNA, 3017 bp, Mus musculus
ggtcctagcccctgcaagcctgtctgtttgttagtttgtaggtgccgtgctccacgtctcattcctcattccaagctttgcttgaggacaccagccactcacatcccctttttctatctttccagctttgccaaagtcatgcatgagacggtgagagatctggctccgaaatgtgacgtgtccttcctggaatccgaggacggcagtgggaagggagcggctctcatcactgctgtggcctgtcgcatccgggaggccgggcagagatagaaccttggagcagacgggacttccctgcttcctcacttccctgttttaaattatgaggagatggacctcttggcatttccttggcagagaggaccccgagagactgggacttttgtcccgatattcactgtagagtttgatacccaatccttggccttcctgagaatcagaagtaaggaattgttcacaagttgttcctgctggtcacttcctggcatgttccctcccctgttctacttcctgtacagtcctatgggatggggacagtcttgcgaatatggttgcctcatcttggagctgaatgcgacatttataggtggagaacatcttgaaatgttgatacttctgtcatcagatcaggcattgggagggagggaggaggaggaggaagaggaggaggaggaggagcagtatggaacgtcccctggcctacatggctgtccctcttcagctcaacctgtaggcatcaccctgctggttctaaacatttgctgtcctggaatagaggaacccaaaccaaagctagactcgacacccccttcaagtgtctgtggctttacctcacacggctgaacgggtcatctatgagcagcagaccttggggctaggggtggctttggtagcttttcaatttcttttttttttttttttttaatttatgtttgaaatttatttagtttgaagcaggtcctctccttcattgtgtaatggttaattatgtaagtaatgtatttatatgttcctttgttctgtatatagctggccagggtctcctctgactcggccttgtgagtagatagatcattgtagttcaggatatgaggtggagacactgactggctctagaaatacctcattcacccgcgggaagaagagagactcggaatctcttggtgagtgatgggcagagcgccaccagcctccgggcttcaccttcctctgctccgtgaggtgtatgcgaggcagggatggagacagggtggttcgctgagggaaagaagccacaacacctggctgctccgtccagaagctttcctgagtgaggtctcacccgggatgttaggcaaagaaaaccaaaggatttgtttcaagttctcactgcatagaagatgtgatttttaggtcagtcggcgtttcagaatggtttgacaagttacaggaagccagcgaaaatgtttttaaagtcacatcagatcgttggagcagaccacatgaagcatcgagagaactcgaccaaacctcaggggcgtctcggggtgtttgtacatttatttgccctcctagcagatcccacctccggtgtgtctcgtgttttacacgagatgcacgctgtctgtctgcttccttggactgagctgcatcgagctgccgactagcctttttatacgagttatttattccagactgtttgaagaacgggaagacaccaatgtcctgttctctgctctaccaacacggttcgctctgaattcaaaagttcacttctcccttcaaaatattaaattgaccaccaatgttaaacctggataggtttaataaagaggaaacagccttgtaacactaataaacaagatacgggggtcaaaagagaaagaccaagagaaagctcagcatcgtggcagccatgttttgaacatctttcagacttgtgctgagcagagcctagttacaaccgaacaagctggtgtacagtgaaatgaaggctgcccaggtcctcccgggatgcccagagggaaggtcgagtgattcctgcctgatactgcctgtctggtgtagctccctcaacctgcagttaccgaagcagaccactgaaagccgaagccacctatagatgtgtgcagcactagggggtagccacctatagatgtgtgcagcactagagggtagccacggagtacaaatggattctgactaaattttcgaatcttgaattttaaactttaaaatcaagcaccatctaggaaaggacttttttttaaaaaggggtgtgtgtgtatgtgtgtgtgtgtgtgtgtgtgtctaacttttaaggaagttggctttcaatccagagcatgagacagtgtgctgtgttcctagtactaggctggctactgccagcactaggttgacagctctctctgctaatgctgctttgtgtgatcttcagtgaacctttgactcatctcatatccctgggcactcggtctagtgagcgttttgtcatcatgtacagtagagaactagttgaattaaccatgtgatgttaactattattaataaattttaacttttttttttcaaaatattcagtgtgtgattggatcttttaagtggggcaagttaggacttcctggtcagtctgatcaatcactgatggggtcgatacatttggagtggcctgttatctttcagtgtccgtggagacggattctggaattctgaagcctgtgggggtcggatcctgtgattgctttctatggcggagataagcgccgtgaacgatcagatgctgagagcagaagctgagcctcaagcagtaaagacagagtggtgtgagtccttaaaccctctgcagctcccagtgacacattcctccaacaaaggcacaccccctaagcccctccaaacagcagcactaaccggggaccaaatactcatgagatgggagagagagaatgggactagtgttgagccttgaacccagggccacctgttcagtggacttcacccctggttctcccaacaccactttcagatggggtctc

SEQ ID NO: 31439 - DNA, 1101 bp, Mus musculus
tggccctcctttcgactcttacacaaccttattttctcgaatttgcaaaacttctctgtggaagatcttgaaacaggattggcagctgctgcaagggctaaacagcagttgcaaaaccattttgagcaatgaaccatttatctctgtggttctcgtggtgccgtgagtgttttagaaaaacttagttctgatctctatttggaaaaggagatggggagccttcccttaagtcacaggcttctcccctccgtgttgagatgtgagtctctgctctttcacttcctttaggatcctgtggttgtgtctgctgtgggtgctgagagattagctgggaagccattcactcagtgcctcttccctcagtgggatgaacccaagtccctgtgaggagccacgtgtccttgggagagtccaaagataaaatgagcaaccgcactggcttagccatagatgactgacagtgattggaagggagtcttccaaactatccactggggtgaccctgaagtcctgctgggcagtcattgttgtaaagagccactgacgaaggacagcgtcatgtagacgttggaattctgcagtgctgaagcctgaagccgggttgctacttatcagaaatagttgctgtgttggaactttgggtttttgctttttgagacagcttctcctgtgaccctagctgattttggactcactttctgagatgaccttgactttttttttttttccttctgagacagggtttctctgtgtagccctggctgtgctggaactcaatttgtagaccaggctggcctcaattcccagagatctgcctgcctttgcctccttagtgctgggattaaaggcatgcgtcccctgtctcccatttatctattcacgttatgagcatcagtgacttttttgcatgtctttaagtgcgctgtatgcatgttggggaggccagaagagggcccctgaaactagaattacacatagtcctgagtgctgggaatcaaattttgttctgccagagtggtcctcactctgaaccgtagaaccatttctctaatgtttgagatagggtctcaccgtgtagcctaggctagcctgaaacttgat

SEQ ID NO: 31440 - DNA, 1203 bp, Mus musculus
tgtctgtctgtctgtctgtctgtctgtctgtctgtttgtttgtatatcagcccaatgtaacctacattggacttacctgtcagaaggatgacttagaattgatcctgcctttgcctccaaagttctagaatttaggaatgtgccaggcctggcaggttttgttgggctgtcttgtttcttgaactgctggggttcagataatcttgtacgtggtaggaagtgctccagcacagggacattcaactgctggctcaagagaacacaaaaaagacagggtcttacggtgttgcccaggctgccttagaacttgcaatcctcctgcctcagccacctgagtgctagggttacaagcctgactagagttttttgcaaggctgggttatatttaataacatagaacctattcttgtcccctgccccctttcaggttgaccagtatctctaccacatgcgtctctcagatgagacccttctggagatttctaggcggttccggaaggagatggagaaggggctaggagctaccacacaccctacagcagctgtgaagatgctgcccacctttgtgaggtcaactccggatgggacaggtattgtgtgtgtgtgtgtgtgtgtgtgtgtgtgttaactgtcccaagaatctctgaactgaaagtccactgagacataaaactaatctcagtcaaggcctcttgcaaggtttaacccttagtcaacgaaagctgatgcaaacactgggagatgaatggaaggctatgggatgggaggggatggccgtctgactgcttggaagctaccacagctgcttctgactgcagccagagtcaaaactcttctttgtcagccagccttctctgtgtaccgctgacagccatttgttttctgctcttgtgctgagcagagctttttgcctcagttcgggtttcccagtcccacatagataacacacagtggtggttaaccatgtcgaccatggttgatgggcacgttctgtaggcatattggtcagtgccgttcatagtgttttgattgtttcatgggctccgttgaaaagtcctataagttaaactaaactgggaaggatgtgaagaaccattgtgtccattccagtaacagttctttaaaatattcgttttattcttatgtgtgtgagtgttttgcctgcgtgtatatctgtacaccacataggtgtctgcccaaaga

SEQ ID NO: 31441 - DNA, 1175 bp, Mus musculus
ggtggtaggacccacccttctaggctcagcttaagttctaacccttcaggatgacagaagtgaagttgatcaacaccatgtatctttcgaaattagctatcttttatgtgtatatcccacttcctaagctctagaaggcagaaggtgaactattaagatgggagagggcctgtgtggagctaatagtgtctgtgccctttcagcatccttattgaactacagctccgtgagccaagcttccctgatgttcagcatggtgtcctcattcataaagttatcctgggctcccccgcacacaggtgatggggagcgtgctctgggggggggggttgggtgggatgggatgggtggatgtatccttgaacttctctgtctattctctccttgccccgtccatcctccacagggctggtctgcggcctggtgatgtgatcttggccattggggagaaattggcacaaaatgctgaagatgtttatgaagctgttcgaacccaatcacagctggcagtgcggatccggcgcggatcagagacactgaccttatatgtgacccccgaggtcacagaatgaatgactggaccggcaagagtgtgaagctcttgccctgatctcctccttgctttcctagcctaggttctgagtgcatgtgggtagaggaggagtcagtgaacctgcggagggcaagtccctctaaccgctgcatcagtcctgggctccgaagaacacattttatataaaataaaattatacctagcaacatgttacagtcaaaagtgggggttggatcttctcccccaccaaatggctagaggtaacgcggtccttaggagaacggagagcgatgggagctgaccctcttgacctcccctattcaagagaatgagctgctgccatcctgtgtggggcagttctttgtggtgtgttctgtctgttgctggggctgttggctgattctccatgcttgttggccaaaggtaatgacagctgaccccgtaaaggaggcaccaacttctgtttgacagtttgttgcctgtagtgcacaggtggttgagtgtagggcgcctgctgacatcaggggttcttgtggtaagctcctgaggtaatggcagcctcagacccctgccattgggggccagtggtggtttacagagagggtggtagcattttagacga

SEQ ID NO: 31442 - DNA, 1793 bp, Mus musculus
ccgaaggctccagtttgcaccccgccccgctttcagcgcagccatcagctccgcctcgactctcctcgcccgccctactcagaggcggtcctctagaacccggcaagcggtctaggagaagcagggcacgacggtagctgttcagcgcatgccgggaaacgtagtcccgtcaggacgcgctcctctccagcatacgcacacgctcacacacaaacacacacacatacacacacattccccggggccgcgaggcatgctgggaacgctagcccttccggggcgcctccgggcctcaggttctggcgtctcggcggatgcccaaagactccgccttcccaggggcccccgcggccctgcgaagatggcggcgacagcggccccgctctcctgaagcggctgcgatggaacctcccccagctccggggccggagcggctctttgactcgcaccggtaagcgctgcggagggaagagaccggtcagcgcgtcctgtcagcttcggcgcctgatcgcgtcgcctctcgccacaggctcccgagtgacggcttcctgctgctcgcgctactgctctacgcgccggtcggcctctgcctcctggtcctgcgactcttcctcgggctccacgtcttcctggtcagctgcgctctgcccgacagcgtcctccgcaggtgcggaccgcggcgcccgggggagcatcggggctgggctgggctctggaccgcacggtcaccgccgcctgtgtccccaggttcgtggtacgaaccatgtgtgcggtcctggggctcgtggcccggcaggaggactccggactccgcgatcaccgcgtcagggtccttatttccaaccacgtaacaccttttgaccacaacatagtcaacctcctcaccacctgtagcaccgtgagtggggggcgaggccgagagcgccaccgggtggctccccaggcccaagctcaaggctcccctttacccattgggattctcttggggaacaccgagcctttcccccagccccttaatcgccacctcacgtgtcacccttttcctctttctttctgtcttttcctttctctttctctttttgacatttccttccattcttcttgctttttctccccgttctcagcctctactcaatagtccccccagctttgtgtgttggtctcggggcttcatggagatggataggcgggtggagttggtggagtcactcaagaaattctgtgcttccacgaggcttccgcccacacctttgctgctcttccccgaggaagaggccaccaatggccgagaagggctgctgcgtttcaggtgggtaagcgcaggcatctggctccagttgagtgggtgccctagttcctttcctgtctgcccacttttagccctgccctcgaaattcttaattcctcagttgtctgcttatggagttggacagtttactagtttaagtcagatataagtggttggctgggctaggctgaactcccatactactcgctctctctccctctctcttagttcgtggccattttctattcaggacgtggtacaacctcttaccctgcaagttcagagacccctggtctctgtggtgagtgcatgctggacagggactactctggggtctggaagggaagtttcccacctgtggccctggcttagacctcacttcatgccctcccctcagacggtgtcagatgcctcctgggtctcagaactgctgtggtccctttttgttcctttcacggtgtatcaagtaaggtactaactgtcctccgtttttggtggctgggaa

SEQ ID NO: 31443 - DNA, 1228 bp, Mus musculus
aggtggaaagttgggtgtgaccacacacacacacacacacacacagagagagagagagagagagagagagagagagagagagagagagacatgttgccctccaggagtaacagggcattgggaggacttcagacaagttacagaactgtggagacaacggaggttggcctagggggtccgcacagagtgtgggatgctactggtagctgggaaccggctgggaaccaaaacaaaatttcaagtattggaggatgcctggctgcccaatgtccttggcccaggatactagagggacctgggtttaggcacagttagggaatttagagcctctcgtgtggacgctaatcgggactttttaaggcagaggcaaattacctcaaccaggcaaggcatggcttatacagatcagatggacccgcaccctgtccacacctggatttccaagtcaacaacttgagctagaatagacccagatcctggcgcgcccaggagtcggggtggccagggctacctgccagagctgggaggggaaggcagggacgcggcctctcacctccggcgactcgctgaagaaactaagtcggaagcggccgcgtttgaactccatctccagggcggagcccctggccactgtgatccgactccgatggtttcgagagaacatgctggcagccccttgcccagtacgctcctgggatcagtctctcgcgggcttgggctccggtccctcgacggccgccctcctaccagtacagccgggaatctcccccagctgcccggttcccaaaccccgcccccggagacgacacctgggctgggcagggcgcggcaccctcctcttccacccccgctaaagtcccggcccgtactcgggtgccaagccagtttgggtcgacagtttcattgccagaggcaccctaaagcactccagcagtgcctgagagcttccatcctttcggctggattagctcaccagcacttggggcgggtccccaaatcccctcctctgcagcacccccctccctacctgtcaaactggtgtcctggagctcggaaaacaccggtagtcacactgcactttctggttctagcttgacttgggaccgcccaagtctcacttctacagttgaatgcttctctctcccattcagactcccctgcatggctacctgtccatccacaatggcctcgattcataagggggaggaacttgacattccacttactt

SEQ ID NO: 31444 - DNA, 1171 bp, Mus musculus
aggaggcagaggaatctcctcaggcccctgctgcctggagccccctccctgactttgggtctgagagatgctgcctttcagagactcaagtcactactccctgccccacccggtctgaccagcctgtggctgtggccaccgggcctgagctcttctcaccagggaccaaacgtagggccttcccaagcctcggcgtcccttttctccacacctgtctgtggcccaggctcagttttgtagacaaggtgtcaactaaagccacctttggggatcgtgaggctcaaacacttcctaagtcctgagtgtctgtccccagtgagagtctcaccccctacaatgcactctggtaggcagggggagctatgatccacaaaatggttgcttctggaagggtcagactccagactttctcctgtcccactgtcctgcagaaggccgctggctaccatctggacctgttctgggtaggcatcctcatggctctgtgctccttcaccgggctcccctggtacgtggctgccacggtcatctccatcgcccacatcgacagcctcaagatggagacggagaccagtgccccgggggaacagccccagttcctgggggtcaggtaggagggagcaaggcctgggtcacctgaacaggagtggacatcttttatggaatggaattttttccctcagggtagtggggtaagaaaggcttcccttacaaccactgaaatcaagccatcggaggaatattcagaaggaaaagagatgaagattcacttctatcatttctaaccgatagtttttgcttagtagtctccagtagtaacacgcacacacacacacacacacacacacacacatacacacacacatacacacacacaaacagcggttctcaatcttcctagtgctgcaaccctctaatacagttcctcatgttgtggtgacctccaactgtgaaattatttccttgatacttcataattgtaattttgctaccgttgtgattcataatgcaaatatttgatatgcgatccccaaaggggtagcaacccacaggttgagggaggcgcctcccccccccccccccccccccccccgctctagagtctcacccacagtaggacctcttcttgccctttgtttgaccctctggaggcctctccatggattcacat

SEQ ID NO: 31445 - DNA, 1767 bp, Mus musculus
gatggttatgagccaccatgctggtgccgggcgcccaacccacttcctctgcaagagcagccagtgctcctacctgttgaaccatttctctagctctttcctacccattttgaagctaatgatggcccttacatttcttattgctctttcttgagtatttttgttatgacatggtaaagtaccatgtgatctttgccacgagcatctgtaacagcttgcctatcttgtttctatgcaggagtcaagaagaaagctggttatatcactcccgtccctggtggtgtgggtcccatgaccgtggccatgctcatgaagaacaccattattgccgcaaagaaagtgctaagaccagaggagctggaagtgttcaagtccaaacagcgcggagtcgccaccaactagcagcactctgagccagcccgagaggctaagcaggccaagaggaatgcagtgtttttaatttattctgtcgaaatggtttaaaatgtttgtatttattgaaagcttaaacgggtggctgtgtgcgcgcatggctctacagaacctcaccaggatgcccatcagttgtcctgcctttgacctggtgatgcacaggagacgtcctcacaccgagagtggatgctgaacttcatcaaaaaaaaaaaaaggtctgccgttttaggctctcatttcccaagtgctattccaatacaagttgatgactcatcttaggtcccaagcctttgagttcaactttcaaaccaaaggaaaccttagtagaggaaatgaagggaaaggaagagaaagcagcacagggtttcaacggcactcccttactctctcgggagtgcagccaggagtgctccgattgccctgaggagagctcagctggctgggcctagctgtccccctgtggcgggtcgtcagggaagggttagagtctccccacttgctgttatcctcctgtgagcttgtcctatctattttaattttctagaatcgaaaaagctcattttataaatgatgtgtgtattatcacgtttggcttttgcagcacatttaaacttttaagtttcagactgttaagagagttgtgtgtctgttttctttggcgggtgctttgaggcctatttgtttttgaaaaacaaaacaaaacttgtgcgtgataatcacgagggcagctcgtgccaccaaagaactgtcagcagctgcctgcacgtctttcacgtaccccgttggctttcctgtaagctatccaggagcttgggttaatataagacttagtcggattttcttattaaagggttttcttgcagttgggttttttgtttgtttttaaataaagctcatctgtcgggtgtggaatgcgtttctgaaatgctcttgtctcagtcagacctaatccattactatttcctacccaatgttctaggctagctgttcctagattacacccactctatgaggagctgtggcgatcccagccaaaacccgtttttatcccaacaggcagttctaagccaagagtttattaatctttaagattcacgtgattctgggtgtcttctgtcccctccattcatataccactcactacaaagggcttcttgcttgcaaaaaatcttaacacgtgtacccacgtgtgcggtagatctatgctgtccctgctatgcagtagtttgattgagaggcagactaaaaggtgcaagctgaccttccatccctgtagattctcatgggtgtttgcacttaggctgaagccaaaggagagtgagccatgccaccgga

SEQ ID NO: 31446 - DNA, 1191 bp, Mus musculus
gtctcagtatggggacgttcctggtctcacgtacttcaggtaagggatagtcaacctatacttagaactggcagaaacccccaaaaccgcaaagtgtgggatcccacccagcggggctcacctagctgttgcataggacagctctgctccattctacaggccttggagaaggaaatggtaggtttaacaacggtgacagcaaggatccatgggacattttgcagtttccagaacgcctgtcgccccattgctgaggcagtcccagccataactggctgatagtttaacgattggatttgtgacccaggtcatctgccttcctctgatacacattctaagacagagcagatcttttaatgcaaatctatatatctgaatgattcgtgttatgaacaaattaaagttctgtgtaaagcgtggtggtaggcaacaagacattttcagatgtggctttgattgtacttattcaaagttgaatctgtgctgtgtcatttggagtgtgtgtgtgtgtgtatttattgttatttatctttgcaggcattccaaccttagggaagaatgtggtagtggctggcaggtcaaaaaacgttggaatgccgattgcaatgttgctgcacacagatggagctcacgaacggcccgggggtgaggaagttccctttcctgtgataactctcaaaagccatcctgtgacccctgtgaacactcagaaataacctgcactcaatgccaccaaggatcctggaactagtctctgatagatccgagttttgaataaagcttgcttgtaggcaattagaaattgtcagttatggcttatatggcttagacagtcccaacgagctttcttactcagagttggtgtcctactctgtgtcatttgggaggaaaagaaacagtggctcctgcagaggagttaactgaccagaccggcgagtcatgtcatggtctgttaattcatctaagggaaagctaagtcaagaattgcacggaattacagtaataatgagtttctgggaccaaaggaaagctgtatttccaggtaccttttggcattattgagaaaactcacctgagtaattctagtgatgttttcttagaaaaggtaaaactctttaaagtccatgacataggaaatagattaaatgtgattataagtgaccccaaggaggtccagctgagagcagcgcc

SEQ ID NO: 31447 - DNA, 3084 bp, Mus musculus
ttattttctaaacttgtttgggattgtcttcatgtctagatgaggagagtgcatggcttctgacggtgccttgcaggttctcatttgagactcctcactcagattaatttcatatgtagcttggggcagagatcaaaacaactttcaaagctctgagacacacttggaccttaaagccactgtgtgcattgctgtttccttgcaggtcttgcggggcagtaggaaaagtattcagactacttgattatttcctaaatgattccatgtttttattgcaacttgaaacttctgtttctgtatagaaatgcacagacttcatggcaataaggacgaaggtcaaaaaccacagaatagcttgtgaggggtgggggtgttgtgtgtgtgtgacagcaggtctccttgggcctgtgagagctggagacccagcaaagagagtgagttgatagtaacttggcttcattctgcgcacaggctgcagtgacctctagagcttctatcctacttgtctttgtatcaaaacttgaatttttcctcatcctgtcaggataaaagactcctctactcgggaagtgcctgcttttcatgtggtcctcagatctagtcagctctggctgcctcctcagatgtacatgacatcccagggattctggacacttgcccggcaggcagagctggagttatcagcattgtgtatcagagctgggacttacacagtgctcattggcctcctatatggctttataaaagttagagttgatgaggtttttgttatttattttgattccactagactatactggaaagtattgcttagaaactccagttttaataactcattttcagtatgttcttaagtatactcagaatttcaaaggaactgttttgattttactttgcctgaaaccacatatcactgttagaggaattcaaattggaatactgatttagaaaaaaaaggacagtttggaaacagctcacaacccaggagtatgcagaggtccagatatcagctgttgtgcaagtgtatgaccgtcatctgcagacaggcttctagatgacaccaaggatgcatcacccctcagccccagactccatttactttgatttgctttagtctctgaggaatgaaattctttctcaaccagggcccagtcatttttatgaattctgacaccctcaaatcaaaggtccctcttttctctgcatgtgattcagggatagaaatgccctctccatgactgagctccaaatggagaagtgctaagatacggaggaggcagctcactaatggaatataaagcaaagtcttgttggtggaaaagaatgtctccactttttgtggtgtccccctcctctattttccttctgtcttttaaaatgagaacagtgctagactcccaagccaacctgccttaatcagtgtgcacacattgcactgttgctcacctctgaggcaaaaacccgagaggaggctgtctttctgtctttggctagagggtcgatttgtaacatctgaagaaatcagtctgtcctgggtttatctgcctactctcctgctccccgcagctggagtcagctgtcctgtctgattctgctccctgaactgtattgcagtggcttccaattgcctggagaattctgctttagccctgtggtgcttgaacttccaggactttgaaaaatttggatattgggggctggagagatggcacattgtttaaagaattggctgttcttccgaaggaattaggttcaattcctagcacctgtatggtggctcataagtgtgtgtaactcaattccagtggatacaactccctcatacaaacatgcatgcaggacaaacaccaatgcacattaagttaaaaaaagagaagaagaagccttagacaatgacagactataaaatatagtcttgcttccttgtggtacattttttgtgttaacagctactagactgttattctgctgaccgagtaaagtgacttaccagcagccagttagccagctctccatgacttgtagcaaacaggcacagtcctggtgatgaggtttgtactcttggcttctctctgagccccaagatcatattagatatagcttctcagacatgatgtcattacctcaagcgcataaacaaatcaggacttaaagagtgtaggacctacaagtgtgtgtcctgtcatggtgccagggctcctctgctctctggcagccatccccaggcagtatggagccctggacagtgccagcctgggcatgagcagctgagtacctttagcagccatgttctttcctcctgaggtcagtgagagttctgacaaagaaggacacggtagtcttttgatcttcctgattttacattcagttttgatgcaaggctttgttgggctttggagtacatgtggcagcagtaattttactgaagcaactgcattgaaattcattgaaatggttttctcctcagaatgtatcaaataagtattctgtaaagccattccggatggccagcatgctatgggctggttatagaacagcattctgtgttggtctgcatcaaaaatagtttgcataagatagtcttggttaccatctaaaataacttaaaatattcctcacataaaaaatttatgttgtatttttaaaacttttagggctttatctatttttctaagtcgttaactgtactttttaaaaaagtattttgtatctacttttgtaacttcatcagaataaactatattgaaagcaaaaatgcctttgaagtgtgttaacatgcttttgtttaaatatggaaatgagatttttgattaaatttggagagttgtctttgcatatcatttattatctacgtccttaaagcttagggaaaagttcctaaatgaaagcaagtataataccagagactattccaaaaaaaacaaatccctcttagtgagacccaccccagagagtctcagtcctggcattcttaggggactccagaccttacagttcttgggaacagctggggactgggacactaattttcttacctggaagtcaagtactctgtacccttaaaccctccccagctagaacagt

SEQ ID NO: 31448 - DNA, 6983 bp, Mus musculus
caacggcagctggaagccaggaaggcggcggccgagaagaagaagctgcagaaggagaaactgagcacgccagagaagatcaagcaggaggccctggagttggctggagtcaccactgacccaggtaagcaagggctaccaccctaaggggccttaccctcacctcacagcacactggccacttaggaggaacatcctgatgtggctcactctgtccttcagaaagacgttctgtgaagtacctagatataaatcgcccagagcacttggctgctccagcatgctctgactgtctgaggcagaggccattgcggtagggcccagaggtgggaagtgcgctgtgggtgtctgagctcccattcctccctggcagcaggtcctgcgcccccacacccacacgtgggagaaatgagcttcagctgaaactaaggcattttctggggtcagagagaaaagtgatggtggagaggacacaggttctgcacaggttgtgtctctccaccttgggaatctcaaggggagcccagtgtataagtccagaccaggtttgagctcacctcaacatctcatccatccacttgtcaggcaaggaaggagcttccatctcccgccctctacacccagaccttgctagactgtggcacatgtctcatcttctgctttgccttctgccttccccaggcctgtctctgaagggtggattgtcccagcaaagcctgaagccctccctcaaggtggagcctcagaaccactttagctcctttaagtacagtggcaatgcggtggtggaaagctactcggtgctgggcagctgccggccctccgacccctacagcatgagcagtgtgtattcctaccattcgcgctatgcacagcctggcctggcctctgtcaacggcttccactccaagtacacacttccctcctttggctactatggctttccatcaagcaaccctgtcttcccctcccagttcctgggtcccagtgcctgggggcatgggggcagtggaggcagttttgagaagaagccagacctccatgctctacacaacagcctgaacccagcctacggtggtgctgagtttgccgagctgccaggtcaggctgttgccacagacaaccaccaccccatccctcaccaccagcagcctgcttacccaggccccaaggaatatctgctacccaaggtcccccagctccacccagcatccagggacccctctccctttgctcagagttccagttgctacaacagatccatcaagcaagagccaatagaccctctgacccaggctgagtccattcccagagactctgctaagatgagtagaacacccttgccggaagcatctcagaatgggggacccagtcatctgtggggacagtactcaggaggcccaagcatgtccccgaagaggactaacagtgtaggtggcaactggggcgtgttccctccgggggagagccctaccattgttcccgacaagctcaattcttttggggccagctgtctcactccttcacacttcccagaaagccagtggggactgttcactggtgaaggccagcagtcggccccccatgctggagcacggcttcgaggcaagccatggagcccctgcaagtttgggaacggcacctctgccttgactggtcccagcctaactgagaagccatgggggatgggaaccggggatttcaaccccgccctgaaaggtggacctgggttccaagacaagttgtggaatcctgtgaaggtggaggagggcaggattcccacaccgggggccaacccgctagacaaagcctggcaagcctttggcatgcccttgagctccaacgagaagctatttggggccctgaagtcagaggagaaactgtgggatcccttcagcctggaggaggggacagctgaggagccccccagcaagggggtggtgaaggaagagaagagtggacccacagtggaagaggacgaggaggaactgtggtcggacagtgaacacaacttcctggatgagaacataggcggggtggccgtggcccccgcccattgctccatcctcatcgagtgtgcccggcgagagctgcatgccaccactccactcaaaaaacccaaccgctgccaccccacccgcatctcgctggtcttctaccaacacaagaacctcaaccagcccaaccacgggctggcgctctgggaggccaagatgaagcagctggcggaacgggcgcggcagcggcaagaggaggccgcacgcctgggcctgggccagcaggaggccaagctctacgggaagaagcgaaaatgggggggtgctatggtggctgagccccagcacaaagaaaagaagggggctatccctacccggcaggcgctggccatgcccacagactccgcggtcaccgtgtcctcttacgcctacacaaaggtcactggcccctacagccgctggatctaggtgccaggagccagcgtacctcagcgtcgggcccggcccgagctgctctgtggtgcttttgccctcatgcccgggggcgggttgggggtgcagaagtctctctatatctacatatatggatatgcttatcatatatatgtatttatggtccaaacctcagaactgacccgccctccctcctcttcttccccagcactttgaagaaactacggctgtcgggtgatttttttttttttttgatcttaatatttatatctccacgttttatttttccccttgttttgagggggcttttattttccttttgtttttaaaactttatccttgtatatcacaataatggaaagaaagtttatagtgtcctttcacaaaggagcgtagttttaaaattccatttaaaatatgtatttattgggtttttttaaagcaacaatagtaatgggttacaggtgggcaggaaaggccggcagtgcttcctgcctggcaagcccagcctcctgggggctgcaggctctctcagccatctgccccacaaaccaaggttagcatgtagccctggtctatccctccttcccacaggctggggagccttttgggaccaccccgttctcctctgtggaatgggggaagctgcagacatctgggggcctggcctggaaatgctggtgttagatatccccagaaaccaggttggaagtagacagcttcaagcttgctagtctccacactgaatcctctctgtccgttatttaccaagtcatatgatgtcctggttcgctaggcagcacctcaagctggagcaggagtcgagaggctccgaggagctcttctcgtcccgttgataaagccggtgagtactgggccgaaaggaagcttagtggcagttttcttaaaaatcgccccaaagtttgtcgatactgaaaaagggctactgtatctatagaatcaagaagttgaacccaagctgtgaagagccagtgtgctgtacggtgctctgcgggtgctctgcggtgctgtgtggtgctggagcctggtgctgtagtagtgcgctgggacttttctgactctcggggcaggtggcatcctgccggagctcagccagccaatgtgatggcaggtcacgcatcgtccttattcctggatcttcacacgggacaatggtgcagcccttgcagggcatggcctacacttcatttaaagtgcaagggtcaggcgttttcaacaggttgctatgcttttcctccttcaagggggccagttctccattggatcttttctctcctccctctcccttctccacctcccctgaaacacgcccatcctaaaatcctggtgcattcattcagctctttgaaaatgagaacgttggtgctttaatttctgtgacattgagaggttgggcctgacaggtggcagcggcagtggcagtggcagtggcagtggcgtgtctgcagcaggtcagtcctcaagagtgtttttcagaagccgttagccgtgtagtcaggctgcccgtgcgtgcgaacgtgtgtggtgagtgggggggcttcatcaggacacacacagtggcagccgagccctgagacagcagttagcacgtggctctagccaggtttggtcttaataaactgagcgtagcaatcccatgacaatgctgaaggcaggtccgagtccccaagcttcgcggtgccttgtgccagagccgagagccgagcggccgggtgttgactagagcccttcggaagcgctggcagagagtggctaaaaaggtgtcctgagcatttttgtggtctggttttaactgtaaatagtgaaagatttttttaagcacttttgcctagatttaaacagcaacttgaaaagaataaaaagtacattttaacctgtaattgtgggagagactgtaaatagtagctgaatatttaatgtgctttgtcaatccacctttaccatagtctgtaaagttgcaattattttacaggacaaaaaaaatgaaattattattgcttttgaaataaatacccaagagcttatcaggacttagaattattcagaattcagatttataggaaggcctctgaccctctgtttgacaagctaaagagtcagaggctttaaggcgcatgctaattgctaattttctagttttgagggagagttgggtcctttaaatgctattttgctatctatcgcatcagtgcttttacacaggtctcatctgactccgtgcttaggtagatgcgggggtgccttgaaaaacttcattttaaataatcttaaatatgatattttacaaagcatttggagaatgtgaccgtgtatatggcccatggaagccccaggttggctgatggcttgcgaggtcctgagcgtggcccaggtgatactgttgctggcagtgtgtggatctctcggacgtgaattcagtatgctccaaacctcctcaccctttggtagcaaagccattattagatgaatggagaaaccagtacaagctaaaaagcatgtgatgtccatcccccaagcctgcacagcctttgttcatgagctctagaccaggaagcaggctgccgtgaggtgaggcaggcaagaggctttccacgttggcccttcaggtccgagcgagcgagcgagcgagcgctgtttcggggctctgcgccgcggctgtgcttgagcccgtgctgactttcacacactacatgtataacctacctcaaatctgtcactgaattgagcatgctttagacatgtatttaagacgtaactatgcacagttctatatcccccatcccttgctgctgaaggcttcttaaagagaaaaatcaaaatttttatttttactggcactatcattttttaagtcctgaagatgattgacaagacatttttatcatgagaagaaaaaaataaataaataaagccattgcaactcaagaacctgacggcacgagcaagttttaagagtagtgttatagccgggaagatgatggcttcggagtctgctcccagggtgcccgtctgtccgtccgtccgtccgtccgtccatccgtctccacagtccacaggcagtgcaagcgtttggtgccccgcccccagctttgtttccttccgccttgtttttgttgtccctgcctgctgtgtgcaagaggacttttgaagttctgacctgagagattttcttttagaatataagtcatttgcagcaggagctcacaaaataactggagaaaccacctgtcagtagcaacactgagggtctcacggggattgggggaggggtcagtttgaagtctggtttttagtggggaccgagcagcccagcccagccctccagggtgctgctttgcctctttgctgtggtggccctggcccatgggaagggactctgccttctctggccctcccacctgctgctttaaagaaacagtagtttgcagagctaggggttgttagtgctgagcgacagaagtcgaagggctttgttgctccatagctgatggcggtggatgtgtgagtggtctgacagtagctgaaaatccagtgtcacagagcgaggagacttgactgcctcagatgtcaaagcaaggccaagctggtgggaaactgatatatccctgatgtgcctcaaccgatctcttttgttactgaagtgtgttttctggacttggaagcatttttatgaattgaaatagtctaataaatggtgctatggtgtttcaatgtgactgtccctgatcttgtctccctgaggtgctatcaacgtttgaaaccacaaccaaccaaaaaaacgaggtgggccccgtctctcggcttttcttccctcttttggtgctgtctttgtggacctctgtttaccgcgttgtgtctgctctgagcagggttctgggtctggtgtcttgttgttccccttggtggccaaagctaggctcagagaaggcagcttgctctgcgcaaggacagcagaggcccgcctgtgggtttgtctatctccttagccaggttagagagggagtggtggctttgagaaggggaggcaggacccctgcctctccttgtgtgtcaggtattctcttgtgtcccagggtgctaaccccagaggggacaggctgtggtccagaggcagcgcctttacctggccccggcagggacgggatgcgcaagactttgggttcttgctgctcattggtagctagctcctggtgctcagactaaaggcaggtgctttttttgtccctcaatgccaccaaggccgcttttagttggtgctaaacttctccctgtgtccacataagctgacgcaaaatttaagatctcgacaggaagcttcatttttacatcatccactgtcacaatttttttttaaatacctcaaaacaggacattgtgacaacttagattccatgagggtatgatactcacaggctgtccgtgggatgacttccttggccttgacacatctagggtcattctctgtgcattaagcagtaaaatgccagagtgcttaagggaaggagcgtggtt

SEQ ID NO: 31449 - DNA, 1199 bp, Mus musculus
ggccttgggatggatggtgttggttattggaagcttaagaagcccttttgggtttgatctgagctctcacagggccggtggcgctgagaactccacatagaacctctttgtgtgcttgtgtgtatgcatacgtgtatgtgtgtgtgcatatggaggtcagaggtcagcccttccatcccatgtgcctagagcttggtaggtaagccaagctggatagtcagccagcccagggggtcgctctaccattccccagcttggagatgataagttggtaaagccagctagaaggtgtagactgaggctcccccaagtaccagaggagaacctgcaaggaaagcgggcttggaagtattcctggtcagtgtgaaggaggtgatgctgcacaaatagtatggtttatgtttttccttttcccctctctgttctctctccagacaggctcagagctcagcccagttgatggacctgttccaggtcagatggactcagggccagtgtaccatggagattcaaggcagctaagcacctcaggggcgccggtcaatggtgctagagagcccgccggacccggtcttctgggagctgcgggtccttggcgggtagaccagaagcccgactgggaggctgcctcaggccccactcacgctgctcgtctggaagatgcccacgacctggtggccttttcggccgtggccgaagctgtgtcatcttacggggcccttagtacccggctctatgaaaccttcaaccgtgagatgagtcgtgaggctgggagcaacggcaggggcccccggcctgagagctgctctgagggcagtgaagacctggacacgctgcagacagccctggcccttgcaaggcatggcatgaaaccacccaactgcacctgcgatggcccagagtgccccgacttcctcgagtggctggagggcaagatcaagtctatggccatggagggagggcaggggcggcctaggctcccaggcgctctgcctcccagtgaggctggcctcccagcccctagcaccagaccgccactccttagctctgaggtcccccaggtacctcccctggagggcctgcctctgtcccagagcgcgctgagcattgccaaggaaaaaaacatcagcctgcagacagccatcgccatcgaggccctcacacagctctcctccgccctccctcagccttctcattcc

SEQ ID NO: 31450 - DNA, 1229 bp, Mus musculus
acctgcagacccttccagcttccactttgaaagatgcaagcaggtctaatggtcatcagagcactgccttcatctctttgttttatttattcactgtttgggacagtctcactgtgaagctgggctatcttgcagcacgctgtgtagcccagcctgttgtccatctttccatagttctgctctcctcttgacctcccagttgcagagcttgtaggcatagccacaatgccttgccttttcatagtacttgaattagtttccaggacctggcaagatggctcagtgggtaaaggcatttgctgccaaacccaaggacgtgaatttgtccccagagattcaatggtgtaaggagagacaccacttctacaagttgtcctctgtcctctgtgtcatggcacacggagtaaataaatactattttaactgcttaaataactttttaccctaagcataagaactgtctctcagacttactgaacctaacctctaggtattagcctcccaggccatatattttaagctggggtatactcagcacaagcaggtttgagagttggtaattcaccaatgcagtaggaattaggagctaactagagaagtcactgacacgtaaggtgagatgtcggatttgggaaaggaaggactaagccactggcctggagctttgacggaagggaagacatttactctcctctgtgtgggaagcgcagaggcagagcaagatgaacaagcacaaagttggtggaggtgggacagaaaagcgtgactgtgcataactgtcctcctgtgctctgagaagtggggtgctgtatgatgaaggacacagattgctgtgtgggctcctggctgggacgtggggctcctgagctctcacgctctttcttggttccatttgcttccccgcagagggtagaactcactcgagaaggaacacttctgataaagaagatggagctttagagctcctccgaaggcattttctttctctctttgaacgagagggtcttagtacatagccttggctggcccagaactcagtagaccaggtaacctccaactcagatgcctgactctgccttcctctcccaggtgctggggtcagaggcacgaaccaccacgttcagactggtctctttttggagggaactgaaatgaatgttttgtttgttactgggtttggttttctgtcctagcaaagccccatcctcgacatagagaaacagttgtca

SEQ ID NO: 31451 - DNA, 1168 bp, Mus musculus
agtgagttcagtttccatgagtttataagctctctgtcaatatccagatatccacggtggtaagataggttgcaaggtgttatttatttatttatttatttatttatatttgttgaggttttctttggtcagttttggagacagttccatgagatgctcagaagaaggtaatttaggtctgcatggagccgcagttgcaggtctctgttccgcaggatggggttcatgaaagttgtcaagaataaggcctactttaaaagacaccaagtgagattttgaaggcggcgagagggtaaaactgactactatgctcggaaacgattggtgatccaggacaagaataagttcaacacacccaaatataggatggtagttcgtgtaactaacagatatatcatctgccagattgcatatgcccgtatagaaggggatatgatcatctgtgcagcatatgcacatgaacttccaaaatatggtctgaaagttggcctgacaaattatgctgcaacctattgcactggcctgctgctggtccccaggcttctgaataggtttggcatggacaagatctatggaggccaagtggaggtgaatggaggtgaatacaatgtggaaagcattgatggtcagcctggtgccttcacttgctatctggatgcaggtcttgcccgaactacaactggcaataaagttttgggggcccttaagggaactgtggatggagacttgtctatccctcatagtaccaaatgatcccctggttatgactctgaaagcaaggagttcaatgcagaggtacatgctcggaagcacaccatgggtcaggatgtggcagactacatgcgctacctaatggaggaagatgaagatgtgtataagaaacagttctctcagtacatcaggaacaacgtaactccagacatgatggaggagatgtataagaaagctcatgctgctatctgagagaatccagtctatgagaagaagcccaagagagaagtgaaaaagaagaggtggaatcgtcccaaaatgtctcttgtgcagaaaaaaagatcgggttgctcaaaagaaggcaagcttcctcagagctcaggaaagggctgctgaaagctaaaacagttttctatgaagattttttcataaagacaataaacatattgatcaagca

SEQ ID NO: 31452 - DNA, 1188 bp, Mus musculus
ctttcttgagcaggtagtcaatgcaggggaggatgtccgatttgttgtttttatggatgaccaagtgcaggggcgtctggcctttgttggtgggcagatccacgggatatttgtactcctctattaagaccttaaggcaggaaagctggcatttctgggctgcgaagtggatggctgtgaagccctgagaagtggagagcgcaggatgggggcggggtccacaacccccgccttcaggcttggggttttcctcggtccctgtgtcccttggaggtgttcacaaccctttatccccctacctctctgcttccaaatgggccttctatgagtggatttaggaccacaacatagaaaaggtcactttggcgctccccagcggcagttcatcaggtggcctttctacgggtagtactaggttgagtgttgggaaatttcagtctctgccaccatgctgcacgctttaccttgtcgtcgactatgatctccttgcgctccggattcacacagaaccgaagccagtccacattgcccactgaggctgcgaaaagctcggagtagttcgcgatcactttatggctccacaactcggaggtactaggatcggccagagcagggtgagccggaaggccgagaacaactccgggcttctacaccgcccaccagccggcgcacccgcccacctgtactgcgaggattcggagttggggctggaaaccttcaagtcatgttccgcttgccgcgtgcctccttgtacagatgggcggggctgctcttttgtccctgggcgccttctggaatccgagggcccagtcctgcgcggagtggtgtggctcctagggggtgtactggctttggaacgacgccgcgaggggcgtcgcatgccacccgcccacgcctttggccccagccaggactcaagggagggacgaagtttgcaaccctggtttagcctctattggaatcacagagatgtcacggaaagtgcaatcgggaaatggattgtctccatctctgctcatagaaagcagggcccaagtgtacaggcagcgcgtttgtatatgaagttgtattaactagctccctctgcaattccacatactaaattatgacgtcctccacggagcagcagcataatggagaacaggtacgtcacacaggttgcccaaagcagagcaactccactctgct

SEQ ID NO: 31453 - DNA, 2788 bp, Mus musculus
tgcctgtgtttccacagatgacgtggtctccaattacttcaccaaaggcaagcgaggcaagcgcttaggcatcctggttgtcttctccttcatcaaagaggccatcctacccagtcggcagaagatatactgaccctttggggagggcatgtggggggcaagaccaagagagccaggcccctgggactctgggctaatcgtgcctgggagcctggaaggtgtcttctgccagcccaggtctccctcccctctgttctgaagcctcgttccccaccctcctcaggaggcttgaatgctgccaggggcaccagagagggtagcagagcctgctatgctaggaggctatgtccccagccctcccttccccagagttgggtctggttggatggggcaggcagggaagctggtatgaagctggggaactgacagcaagttctcaggcaggtgaccgtagggaggagctgagggttggcacttccaggaaaagtgcattttgctgttgaaatgtgggtcctgtccaatgctgattccctttcgaataaagattctaggtggcactgtttgccttaataccccaggagttcatcttcttctctgcctgctaaccttctgcctagactaggctagcctgctctagggactcttctggctcttgcccttctggagggattctcatggccctaagtgggaagggaacagggatgagaatgagtgggcaaaggcagtttttctgaggcttctcctcctctccgtgtctccttccccagactgtgatagtccagggtgggggaggggtagaaagtctgtagctgggttagagatgtagaccatctacaataccctatttatgtcttcctttgagaaaaaggagagatttcttggtaaattctatatcaggctcggtgaaaaaaaaaaaaaaaaaaaaacattggcttctaggcagcctaggctgctgctcagagcacacaggccacactcacctgcgcttccggctcctggagggatgtgagctctgtcttctaagaaggtgagcctcatcccgggcacagaccagcatctgttgaccttgcactccaactacatacagtgccttgcaggggctcagcagtatatggaatgaaggtcccctccctgtcgctgaatctcgtacctcacagtgagtctggcaggtgcccagatggacaaggcatggggaagactgcagttcctcagcatcttcttatgcatccttcatctcattggctcttgcatttctgttgcatcttggcccgctagtctctgaatttgttttgcagctacaggtgagattgccagacctgttttctgccactcgagtggatgaaggtataggacagggacggctgcctaccagtgggctcaggctggccccacttgctctgctctccacttctttatctttgttcatcctgcctactgctcagacaggggctttcccaagcgaacccaggtcaactcatcacaggtcaccggctgggtcttggggtcgctggcacagctgatggcctgcttcctggctcacgtttctgagcactggtgtggctgttgtcccttcacagtttctgttatagaggcttctttcttaccctgtgcacacaggggcttctttactgtcttgtggatctcctcaggaagcccagctgtgctggtagcttaagggatgctgtggaggaagtcagagccaatcttcagtcccagctacttcctagctcaagcacagttctgctgccttctgggcacagagaccatttgagcttagtgtctgctctgtttacctgctctttgcagtgcctcgtccctggtctcatgatggctcaggagccaggcagaatattgctttctctttctgcctaagtctatctgatctattcttggtatctctgtatttgagccaccctactgtcatctctcacctccttttgttttgacagtttcctatgtttctctatcctctcaccagctgggtttctttttgaaatgcatggttggccaaatcttttcaggcccccaactctccccagctctccactggcctcaggataaagtccagactccttagaatggtgtatgaggttcctgggtccctactggcttcaccacttgacatgggctctgggccccagcctcctatacacagagaccatggctctagctgctttgatactcttccttccactttggtaatttgccacttttcttcttagattttatttcttccaaggagctttgtcccctctcctctcctaaccccagctgccacacagatgtctaggctcactggcctgcggtatggtctgtctccccactagactggaagctccttgagggcagggaaagcccttgggtttttgtattatcaactacctgattttggcgcctggcccatggaaagcactcaataaatgttttgtttaaagagtgagctgtagtgtgtgaccagggcacatcggggtccagggcagcttcctgggcaggtttcacatcaaagtcacaggtcttcctctcttggcagacgtgctgcccagcctcctggaactgcagcttcacataccccgagtggggccatgagcaagaagcatgggcagagaagcctgctcagatatcagctgtccccactgccaggcaggggctgcagcagacaggaaggacacatggcagaatgcctaggagtttcctgtcctggaagcctcgtccctggctgtgctagggcaggttaaggtacccgagaaccagggcattactttacattgctgtgtcccaggacattacc

SEQ ID NO: 31454 - DNA, 3001 bp, Mus musculus
cttccagaaggacttgtcttgtccccgtacctggggccagcaatgcacaaaaagggcggagctgaaggggggtggcaagggtgtgcagccagggcgggttgggttgggaaggtggtttaactggatattgtgactctgagtaactaatgtgcgaggtacaactctccaagcctgagcatggctcttctgttgtgcagacttgctcagagcagtttccaatttattttatttttgatgagctctttggagttaaggaactgcgattgtttttcccttgtaaggaatgttgtctgcattttagcaaaataagctgaccaaggaaaacagtatttaagaataattttccctgctgtgtacctaccagcagcagggttcctggagaacttaaggagtttgcagctgggtgataagggggaaaacatgagatacaaaccagatataacatgcagctcccatcccctgatatttccatgatgaactgggataccagtggcccataaagctcttgtctcctgtcctgaactcagctcaagagaacacagatttgaaagttcttggatgactgtaactttggatggatgtgagttgtatatcagaaaagcagggcttgatggtgattgtcattagtgactgctatcctatcattagtatgtagctattgtcactcatcagggttgctttgccttcatgatcttcatgggggctgcttctggcttctttcccccctcagctctaaaagacactattagtcaaagtctgagatgggccttcagttgtgttagttacaccttgaaccttttctggacagttttgttttcctaagtcccttcaatatctgattcttaggatgtcttaattcccttatattttctgtgtttccagacactaacaagctgcttagtttgggtttttctcatgccttacagagtgatttccagaaactaaggtgctgaggggtcctgcccgagagcacaacaatcaggcttgctatgtacttgaagctgttagtaggtgttactgttcccacagaccagctttagtgtcctcatggtcctgcctaggtgcactcttagttctagctctaactcactagggtttttgttggtgttctgtggaactgaactgcaccagaagctgccgctgtgagtcgaggtgaaggtggtagtgtctgagggtgagagaacaagtgtcctgtcctgatcgtactccgaggacaagggtcttgggaggactgatagtgctgtggcttctgtgtggctatcactgtggtgaatgacaggtctggaaagatcatgctgcttccagcagtccatcagatcagtgtatagatatgggcagagactggaaggagaggactgaggtctggaaagttgaaagtttccctttttcatatgaactggtttgctgagtttccattttttcttggtgccatggatagaacccagagtctcacttgtgccaggttagtcctacccttgagctgttctcaaccctcccttgatttgaacacagccccagcagttaaagacagatgtccctctttttcctgtttgagtcatcacaaggatggcatcttgtggaagtggcctccctctcaggtcacatcctagtgagtagctcagggaacttgtatggccagacacacacatcaattcaaagcctctccatcaagagagaatgaaactaggaactccttctggaatgactttattcctgtttaagcttttagcttggcttgtcacctctaataaggagaggaggagggtatgtgtaggacatttaaaaagattctttctcttgtagtctccatgaggtcaggctgtatcaggattgcaggaagatccttcagaatctctgtttgcgtagtgcaccttcctctgagcacctatggaaagcttatgcaagcctgaggcagctttgttccatccttcagttttgctctttggaagccaagctgctaggaatggtccaagaggcctgcctccctcccgctgtgctggctcattttatttggatgtcattctttatcctgctttcaggggtgtatgctgttgggtatacctggaatccaagagctagtgtgttgagtcaacctcagaggcagggtgctgactgtaggcttgggatgcagccagtgaactggcccttagtaatgtatggaatgacttattcctgtgacccaactcttttactatccagtgttgtgaggaagcacaattgtacccgagactacagacttagccccaattacaaaaaagttttgggttgttttttttccttggaattcttagattgctgtgtaaattcttatacagcaatagaaagcattctaaatagctgctagtctgcctggtctcagtattcatttattagagactgagttctgtgattatttgaccctattaactttggggggtggggaggaaggaattattcatgaattttggactacatcagaaatctgagatatccaaagccttggtactgtagctcagggtcaggggccagtttctatctgtagtgtacctgacttatggttatcatataaacaagccaggagatattctaaggagaagattgggtcctttttattgaacccaggacctcacatgtgttatgcaagcactacaccaagctgtactccaggcccgtgaaaggttgagactgggttagcactatttccaaagtcacaagacctatgattgcttcattaagattgtaaggttaaccatggcttaaaaataaatggttttggtgaactactaaatgttttccaggttattgttatgtcaagttttttttttttgttttgttttgtttttttttttgctatagagagatgaaggtgcaggcaaacagccctgagcttgcactagcaccctcaaggagccaggaaagaggggaagccagagtagacctcttgattgggactatggcaatgagcatgtgacggcctgaccttctaagtttgtcccctactgccagagggacaggcgtcttc

SEQ ID NO: 31455 - DNA, 1148 bp, Mus musculus
ttgctcctggtctttataatcagcataacagattggggctcatctaactaaagaattcctcatggattaatggacaatgttagcatgtgaatgtggatttagatgtacaagttgcttcttgtttccatgatatattttattgccttgtgtgtgtatgtatttgtgacattagaaatatatagccagtaattgtgaatttctaatttcaggcttttccctaccaagtaaattctacaatatctttgcttctgatatataatttgaaaatgcaatagtagcatgtagaatgcattttctcacaaactggagttcaggttttaaaggagtttgccttgatttcttataaccttctgattgaaataacttgattcaagaaaatccccctatttatatacttatttatatattttgtatgtatgtcagtgtggccacatgcgtccatagtgagtttgtggaggtcacaatattgtgagagtctggctgtctcctttcgtcatatgggtccaggttgggattgaactctggcaacatcggaaacaactttttttttttaagctagtcagaggagggtaaagaacaagctctggtagaagtcagtgttgtcatagtttgatttggagccagcccaagttcttggaccatccttgtttctcaggtcattatttttcctatagaaacagtgctgcttttgagcaggtatctgggtactgtcatcatgaagcctagaaattggggttacatagttatatttactgagctttgggttatcaagaaggatgcctgttgaaagtcagtgtgcatgtgtgaattgaattagagaaagcagggcagtgaccaccttcagcttacacaggtatcacaaagaagcatatttgttatcatttctttgtatgtgtttcaagcgaagctcaaaatcagatttgggggtgtaatctggattttaaaatgttggcaactattcaaataaaacattttatggtacaaataaatcatgcctaatttcctgcctgccagtgtgtctacttggtaaaaaaacgatacctcatttatatcaaagacatgggttgggcactgctgtggactcttgattgctggtttcttttagctttctgtttgtagcactaatgagggtagcagacattttgttt

SEQ ID NO: 31456 - DNA, 1140 bp, Mus musculus
taagttctgatgtgttaaataaaatacacataagaaaaaataagctctgggaccctgagattgttaagagaccctgaggctaaaattttgaggacaaaaggaacgacgaacaaaggaactactgcatataaagttggaagatgagaggttatagactgagaactgtgttcgtgtgtgcctgtgtgcatgcttacatgcagtatgtgagctgcttactaagcctgagaatggctctgtaatcttactcatgttactcttagtgttttgaaatggtcttttaagttgttttttaaaatttttctagattgtatggttttgtgaacattgtcttgtaaactagtctctcatcaaataaatatgtgcttaataaaataaatatgttcttgaataaataatgaatatactcttgggaataaaatcaacccccagcccccccccaaaaactccagaagatattagggctgtgttgtcataaaaatgctacatgccatttagttctttttaatttgtacatatgaatatatgtattttttttctaatcagataggaaaaaggcattagaagatggaggacaacgttctgtgcatgggacagaagttactaaacagaaacatactgaaacagttgataaagggctctcaccagcacaaaagccaaaacttgccagtggaacaaagccatcagcgaaatctctaagctctgtaaagagtgattcacatttaggagcatattctgctcacaagtctgagaatctggaagatgacactttaccagaaggtaaacaggagtctggtaaaagtgctttggcccagcggaaggtcagtaattcttttgtggattagttcaagtatacctacatctgttactatgacaaatagaaaataaattgggtctttggagtcacattttctgtaaattcaaatcggtttttgttaaattactgggatgggagacagatttttttcttatgaataacaaaagcctaataatttactattgtagattaggaatgccagatggttaatgtttgtgctcaaaaatgttgtagtcagggcagttcatgttcctgtagtgtagttaggcaggctaaggcaggagacttcttacaaacactatctcagaacaaaagcttatgctgtg

SEQ ID NO: 31457 - DNA, 1146 bp, Mus musculus
tggagaaagctaattttttttttgtaaatgtattttcttctaagaacaaagaaatgaagaagaaaccttcagatattaagaaatcatctgcatctgctttaaagtaggtgaattcatattttcatatgaaaaattaatatgtccatgttagatttaagttttaagactatatctttaaataccacaattatcaaattatacataaatttaaatattcataaacactttagttttagacatatatagaacttttaactagtttttagtgttttctaattttctttcttttaaatagaaaagagacagatgcttcaaaaaccatggaaactgtcagttcaagctcttctggtaagttgtaatcttggtgtgtagcagtcagtggacatcctcagatgtcagtccttgcttttcacttattttgaggcagaatctcttattgttcactgtgagtttcagagtagccagcccttgagcttctcagggttcttctgtgtatttctaccagtttgcctgaggcatgctgggattacagattagtgctgctatatttacctttgcatggatcttgggatctgaactctgatccttatgtttgtaaaggcaaacactttatccactaagtcaactccctagactgtaactttaaaactcactcaaatgaatgtattttgtcagtttactagaaacttcttgcaaaatggtgttaggaagatatttactgagtctttaacagtggtatctcaaacactgttcattttactgttgttggctttttgttgttgttgttgttgttgctgtttttttttttttttttttttttttttttttttttttgagacaggatctttctacatagccttggctactcaacaactcactttgtaaaccagtttgacctcaagccacagagatactcctgcctctgcttccctggtgctgagattaaaggtgtgagccactatacttggcttacaggagacttttaaacatgaacatttatatacctctccataattaaagaaaaagtgaaccacagagttctactcagagtgaaagatgggatctttgctaccagaatagcctgatgacttggtaatactttgctagtgtggaaatagaggccactcaactttcaattaatattaa

SEQ ID NO: 31458 - DNA, 1099 bp, Mus musculus
ttacaagtgtaaaataataatttgaaaatgtttaaatagaaaagtaactatttgatactttgcaaacaatgtcttataagatttcttctcgttaactagtttgttataaaatgagactattttgggttgttgaaatgactatgagcatctgaaactacaatggtaactcatgagccccgcttctaggttgtggtgtgtgtgacaccacattcttgaagtccacagaaagctcagtaaattacaataccatacaaggtcatacagacaggcttacagtttgctctgttggtaacaagaaatagattttccccaaaattcatttttgtgtattctgttttgtaatttttttaatctgcaaaaacttgtttttatcagaaacagtgagttgtctgtttttattggttttgtttccctttaaaaactcaaaatattgatatgtttagaaatagtttctaatcttaatttgatttaaaaaaattcttccaatgtaatttttttctgccatgtaatacagagagaaaaatatgtgtataaaaaatgtgggagggctggagagatggctcatcagttaagagcagtgactgctcttctaggggtcctgagttctattttcagaaactacttggtggctcacaaccatctgtaaagggatacaataccctcttctgatgtgtctgaagacagtgacagtgtattcatatatataaaataaataaattgttaaaaaaaatgtaggatatggccacagtatttaacattacttttggagtaagcttataccctccctcccaaaaaaaagtgctgttgttatttgctttaaatgttgagtcttttaaaagtaaatgtggttgccagattaccttaaagtataattcttttgtttctcattaatgtaaattctaatcacagattgcttaggggaaatttcgcatttatagcttagtaataacttacattatccttcattaatcctccccatacatatcctatttatgtgtcatttgattatgactttaaataagaatgctgggaaatacctggtgaagctctcaaattaatttttttctgttaaatcttatcctaaaatgtcttgggatgt

SEQ ID NO: 31459 - DNA, 1098 bp, Mus musculus
tttcctttcattccttaaaagcaaaaacaagcaaacaaaactgtctttttaactctggtcttaataatgtaatttatttgacatctcactggcattccaaactaaattgatcatcagcattgaaactctccttcattatagctaatgaacagatacttacttttgttaaaataatatctgtgaagaaaacactataattcttaaagacttccacagtctttaagtgctggagagatggctccacagttgagcacctgttcttttggagaacccaagttcaacttctcacacccacatggaggctcacaacttcgtgcagttacagctccaaaggcagtgccttcctctggcctccatggcttcctgcacatacatacatacatacatacatacatacatacatacatacacatacatacatatacatacatacatatgcataactttaaaatgactgtcatagaagcaaaatatgtaattgaaccatctttacaaacagacctgtgtttcaaatgtggaactgtgtagttgctccttgtatagatgatactaactttttatatactttaaatgtggtaattgagaaagccatgttacatttttcagatgatattttttaaaaatcttcatgtttgttcagacttgaatgtttctatatagttttctatatagttcaatttataaattgttaggatcaatatatagctcactaatgaggcaggaatttgagtttattctttattatagatatgaatcttgtaactgtgaatgtcacagttgtttcttctaatatttgtgcttggccacagactctattctagttccaggagttttgaactaatatcagctgttggtatctccagtgttagtgatatcaaaaatttaagatgggagcatttgaatatgctaaatagcttataaagaaattactatatattgttataatgatctatgatccctagttgttcatcttaaacctctcatgcttcacagggaacagtgtgtttatttataaacttacagctgttcttctgcgagaaccaatttatttgatgaaatgactagaccctggtcgtggcaaatagcacctttttgaaa

SEQ ID NO: 31460 - DNA, 2156 bp, Mus musculus
acagatgatctgcatattagttaactatgacttagccagtggtcatagttcacagtactgattcttaactctccaacaggaaccattatttacatttaatttggatgaatttgttactgtggatgaagtcatagaagaagtaaatccttctcaagccaagcagaatccattaaaaggaaaaagaaaggaagccctcaaaatttctccttcccctgaacttaacttaaaaaagaaaaaggggaaaacttctgtccctcacagtgttgagggagaattgtcctttgtaacattagatgaaataggggaggaagaagatgcaactgtgcaagctctagtcactgtggatgaagtcattgatgaagaagagctcaatatggaagaaatggtaaaaaattccaactcccttcttaccttagatgaactaattgaccaagatgattgcattccccacagtggacctaaagatgttactgtcctgtcgatggctgaagaacaagatctacaacaggaacgcttggtaactgtggatgaaattggagaagtagaagagtcagcagacataacttttgctactttgaatgctaaaagagataaaagggattctattgggttcatttcttcccagatgcctgaagacccttccactttagttactgtagatgaaatacaggatgacagcagtgattttcacttaatgactttggatgaagtaactgaagaggatgaaaactctctggctgattttaacaaccttaaagaagagctgaattttgttactgtggatgaagttggagatgaggaagatggagacaatgattcaaaagttgagttagcacgaggcaaaattgagcaccatacagataaaaaaggaaatagaaagaggagagctgtggacccaaagaagtcaaagcttgattctttctcccaagtaggtccaggaagtgaaactgttacacaaaaagatctgaaaaccatgcctgaaagacatttggcaggtagatacttgaaagtattcattttttctgtttcatgagattacatttaaaactatgaacacagtgccacagtaggaataatgtcattctgttgaaattctgtaaggtggcagttacaaccactccacagaactttgttttccacagaaacaaggtgttggttgcacacatttagtttacagaacacaggttgtcccaagttgttaaacctcaagaaaggatgtcaaaactgggagacaaagtgaaccagccagtgtagagcttcagtgaacacattgtgttatggatggaggaacaagcttttaaagaggagaatactgttcacattacagtgcctctcacttttagcttaaacttaggtttaggacaagcaggaggacaaattatttttttgtttgtttgtttgtttgtttgttttttaagataaggtctcactgtgtgaaccttttagacctggaatgtagaccaggcagctttgaactcacaaaaatcagcctatctctgcttctgctttctgggtactggaattaaatgtgtgaataaccatacctggaagattttggtcttttgagatgaggtctgactctgtagttcatgttggcctagaactcagaatatagacttgaactcaggatattcttccttcccatgtgccaggattacaggtgagagttaccacacttggcatagcataatattttgatggtatggcataatggagcagcttgcttgcttataggacatgagagagaccaaattaatttccatttagaaaactttgaactcagtcgccataatatgttacaaaataagtcaccctgatgagaaggaattcaaatagtagtttattttgtttccttagatgttataaatgaagctatttaatgtgttaataaatgtctactttgtaaaagttaaaaaaagcaagccaggtagtggtagtgtgggcctgtaagctcagcactcagggggctactcaggcagtcctctgagttcaaggcctgcttggtctatagagtcagtttctggacagccagggctgtttgttatacagagaaaccctgatttaagaaaaaagaaaggaaaggagaaggagaaagaaggagaaggaaggaaggaagggagagggggggggagggtgagagagagagaataccttga

SEQ ID NO: 31461 - DNA, 1214 bp, Mus musculus
ctagaacagaattactctttgcttgtgcctatttccattaatctcatgcattgcctccttataaattaacattgactctgtcaggtctacagaacttgactcttaaaaggaggactgtgagggagaacaagagacagggatgggagttgacgaaaggattgtgtttatttcatgcagaatctagatttaagtagatcatgagaacaggactgtatttgagagaaagaagggcagatacaattgaaatacagcgatgtgcagatcacaaagatattatgaaactcgctattttctactaaaaataataataattatgtcacccttctcctttctagagctataccaataaaattttacataggctttagccgtatatctcctacacccattgaatatatctatatttactcatttgcttcttggatcaaggaatcattaactaaggcatagtttaatgagttttaagaatagttttggaatatggagaatatccaatgttaatttgacaaatatatctattttaaataacttcatgtttttcctttaacttttaatgactttagttgatgacgctgaactaaaggattcagaacctgatgaaaaacgcaggaagactcaagactcttctgtaggcaaatcaatgacatctgatgtccctggaggtaaagtaaaaaaatgacatgtttttcttatacccatgaagtcagaagtgagcaggttaaccttgcttggtgttcctgaatacaacttctctaggactttttttttttattttaaatcctggcatggatgtttttatttcattcttgaaggctgggatatgcttcttgttttgttgttatactataattgctgttatggtgaaaactgagttatacttccccaagcaaaaactccagttattaataggaaactttgcttacagccaactactatgctgagttgaagggcttttacttgtttagcagcccaacattgtgctgcttctccattttgtaacttaacagggtgtttctgagatgtttgttttctactctctcactcttcgacgtatattcaaagccgttagcattctggcttctcttgagacgctcaatatatatattacatattgttaaagatacatgtcttaaactgctaggggatagagctaagtagtagagtgccctaggttcaagatcctcaaaataaatctgtgttttgtgacttcattg

SEQ ID NO: 31462 - DNA, 1221 bp, Mus musculus
ccaccagtctcctcaactcaggctccaacactggtgggtggccacgcccctccacctggtctgagcgtcagagacattgattatccctcttctctgttctggaccaacagactcttttcttcaacgtatttgactctcccttggagctgtttgatgagcccatcttcatcacggtaggtctcagatgttctccgtgggtggtggtgggtaacacaacagtaggatgtgatcgccagagacatgtctgtcattgtgcctgaaagcctgtgtctgtgtctgggagagagaggtgggttgaagcttgagtctgggtgattgaaggactcacaaaagctctgccagtggcaggggaaatgcccaggtgcctcaggccagaagcctgaagtgcctggttttaggtcgctttctctgtctatgctgtggcttcagattccgctctgctgctgaggatgggtgtgcactagatgtgtgggtcccacctctgctgtgtgcccacatgattctgcacatgctgtgtgatttccctgtgccgttgtccccttacttgtgaggtgggggccatgttagtgtctattcacagggttctgcgaagtgaaacattgcttagtaccatctctggaatggagacggtgccagctgttggctgttgtcggctgggagggacctggccagagccgcactctcacgggaagatgatctttcctttcaggtggtggactcacgctcccttaggacagatgccctccttggcgagttccgggtaattgtttgtctacttggaagtagttagttcgcacttccccttcaggggcaggctgtgctggaaaacctagtttcagaccacctccctaaaaactccgtaaaatctcccaactcaggaaacctctcaccaaaggtagaactataaagcacttactatctaccggagacagaattcttatcttacagttcaggctgacctcaaatttacgatggtcctgctgcctcagccccctgcatgctggaagtaccatgggctgggctcatgtctgcgctcacttttacgattgagtttgccaggaggggatgtgtgtcataggcaatctctgggactagacagacagaaggaagccaaagtgggtggggcacacatttcctatcacatgcctatagttagggcagaggctggagagcaagcaagcttcccaacccgcaacccccaaccccagcacagagtctctc

SEQ ID NO: 31463 - DNA, 1147 bp, Mus musculus
gtctgtttagttttgaaggtctctgtctgtcttttgtttcctggagagtcctttggttcacatgttatttctgacacttctgctttctgttctcacgggtctgcttctgcagttggttcatcctcgctggctctcgcttgtggtgtctgttcctcatgtgttcactattttttgattgtgaactcatgctctttggaactttatctgagaattctttgaggcctggatggaagtcacattcttccagagacgatgtgtgtttacttttaccagaagtctggagacactacaaacccagattcacttaaaactaaatgttcagccgtggcttttggggtcccatagtcagtctgcatttggctcctcgtctctccagatttttcctttcttgttcgctgtggaagattttccttatgccctcatcatctccagagtgaagcaaagttttaaagatgtctgttggtgtgatggccttgctgggaagatcttgctggttgtctagtttgtcctttagttggaaattgaaatctgtttcaattttgagtctgacagccctgttttccatcaggcaggttatatctccttcaggaccctgcactctgatttcctgtctgtggcatcttctccaatcttcctacgaacatgaacaaagccattggttttcttctggtttagcctcaggtctttggctgggggaaacatttttttttctccctcatattgtttccccctttgttttgacccccaaggccatcttcctgtcatttgcttagccttacagggggccattcttgcttggcaagcactggaagacagaacctaaggaaaattctgcctgtgaatgcacagacctttttttttttttccttttttaacaaaagccatttcagatcaaagaaagatggaaatggtttagagttgctagacttctactttgccagctgggaatctaacagactgggagaaatgaggaggaacccagaaccacaagcacctaccatgggcttttctgtgagccgaagaccactgtgttcactgcggcagccagcagtagctggcaaagtcagagccacaggtccttgctcatgcatccccatggaagagtttcctaagcgaagcaggattgaccttctacactaggccatct

SEQ ID NO: 31464 - DNA, 1193 bp, Mus musculus
ttttaaatgcttggcatatagtgcttaatgcaattaattatgtatatgtatttggtttttaacttaaatacattaaaatgttcggggggcaaaagtaagtagttaactgtttgagaccactctcttccagtgacagatgaacatattcatcttagcctatgcttcttaatctcattgcaaacacttccataaagcatatccttgtttgtctttctggagtcctcattgtccatgcttggagtgttcatggtcttggtagtctacttgcattcataaaccatttctataagctactgtccaagactttgcagggatctgagagtgagtttgttggtatgtgctttttaaaatcaagctatttacatacttgtcttcagattctagtcatttctttgtcattcctccctttactatcctagttattctatccacttgtttatctctcctcccctgataaaaaactattaccaaacattcactaaatgctgagttgctagactgaagttgggaagatatttttgccccttcattttctctcatcgatgtatcttaaatatactgttaactttgatatagccggtagtggtggcgcacgccggtaggatttgctgaaggaggcagaggcaggaggatcacaagttcgaggccagcctgggctacactctgaactttctatctttaagcaaagacagaaagccttggttcctaactcagaccgcaaagactgccatgtcagtgacaatatcctaaaactttaaaaggaggacatcagagctttgagacattgcgttaagaagatttcttcggttacagacacacaaagtacaaaaagacaaaagctggaatcatgcaaaatgtaaagtcttgctgtttggaaagcattctaaggcactcagaggacgagctatagcagacgtcctgctaggccacagaagggactctcctaatgaggcaaaggctgcatgaaaatggatacattgtttgagtaaacacttaaacaattgcattattggtgaagatgggtgtgtagagttgctcaaataatcagatatcaggaatatgcaaattaaagccacaacgagatattactatactcatgccagaacagttaagattaaaaggaagtgtagctaggggaagccgagaacatggactgtgtggggcccccaccctggtcatgggcatgtatcaga

SEQ ID NO: 31465 - DNA, 2436 bp, Mus musculus
ctggcagacatgactatgtagtatgccaaagccagcctcagtttaggatatctatctgccttgctggttgaattattggctcatgagagtgtggcatgtggcaagatgacagtttcactctggtcccatagcttgcagtttcattagtttaggtctggctgagccttgtggggagaagggtagttagctgaaaaggaagttgccccactaggtgagttgtttttctgaatcttaaaaagccaagttgggtcaggactccagtccccatgccattcatctctgtctcttcttttatgaccataactcttggttcagaacataaatcagcaattcttaaggtccctgagagtctcacactcaattccagcagcatctctaaatgcccagattccctgaagtctgaaagtagcctgggtgccctcaccatgggtagagcctcatgatgtgtgagattgcatattcctgtcttgatgacagccttacagctaccatctttcaagaaaacgtcccaagctctacacccttgggcacaaccaccataggactagatgtttctgagaatggatctatcaccatgatgtagacagggtcaactgtagctaatggattattgcctctggcccagctgtcatcaacaaaataacatcacagagacaaggcttgtcttgttcaagcccaaggctcccatcttctgagctgtcccttagcctcacctaagagtgctttctcgaagtcacatctctgttttctggagtgtgggctaactatagactcctgagatcctgtgaaggcgttcctgtgaagttggccagagggactttgcactgagacacttgtagaagctgttagcctgactgctgctgagagtttaattgcattgtggaacactgaccaagatgccacaaaagtgtttccagctccagtgaggagcagagagactggtcaagcaatcacttattacgtttgtcagctattgtgtcattctggaacagctgtacttccatatctcttagcccaccacagcctacgtcatcttgaacacgcctcacccttgccatagcaatctcaaacaccagcaagaaaagtacaccacacagaggtacagctttctacaactggagagaacaagctacccaggtgttctgcataagccttcaagtctcatcatcaggctacataatggcccagaggttcaggaagagtcacagaagaatacacaaaacttactagccagcagagagcccaggcctgtggaagagaagacaaggagatctctcgaagccctcagtctgtgaccagtgagaagtgactccacaaacctgactgactgagaaggaaggaaaggccctttcttcaccagggcttgtcagccttcagtgtagagagtgggctgtcacaacatttgtcctttggggacacttttaatcactccatcttgctgcctgtctagttgccacctctgtcccaaaggaactgacatggatggaatgaaaaccatgtgtaggaccagggccactctaccttcctcaccagagtcctgctgacggggactctcattcagtcacagagtgtgaggatggccgcttgcctttgcccagctctgcgtctgctgtgctgttctctgacaaagcagcttgctgcctctgagccgggaaagcggggtccacagtgtgagggggctatgaattgatgaggtgggactttgttttttcattttgtccttaggcctaaagctgagctggccttgaagacttgagcacagaatgtgtgctggtaggcctcagactctgaccttacctcagatgcctacagaccatattccttcagtttcaggtggggtgagacgctgctgcctggaagtctgtggccttctaaccagatccatagccctgtagacagtatggtttgtgagccttggttaagcaggggctcacttatttttttatcattcatgagggaaaaacataacaaaacaaaacaaaactctcagtaccaggtaacactggtatgggtggagaagagcaggacctgcatacaggagcccagaatcccagttaacaaaagcagtatctcccagtgactctatcatgcatcaggcctgacagtccgtccagctctatggcacccagctcagcaggtcccaagcccaagggtggcagtggccagttttctccttagacctctgagtgcaggcttgggtggcttcaccacgcctccttcagcctgcttttgctgtgcccctccctccacccctctgttccttctctcctattcacttgcatttgcgtcactcctccctgacatgttggaaattgccttttcgttttgcgcagttccacatttgtgggagaaaagcagtgagatccatctgaacctccaaaaggaaccttctcctctcatgctctgctgcaggctgctgcagaagggggctcctct

SEQ ID NO: 31466 - DNA, 1132 bp, Mus musculus
ggctgaagggagagagacatgactccttagaagctcaggcctcctctcccccagcttctcttgtcttccctgtcatccgtctgccaatctccctgtccatggttagttaaaggcgctttttatcctcttttctttcccacagagtttgccagatccggcccggtgcctgggttccaggaggacacgctgcagttggccttcatcgacttgagacaagtaagtctttgtgtttttgttttttgtttttcttttaagatgtgtgactgaagaccatcaggtcttaaggaaaaggggaggggagggggtttggcattggtgattcacactggagacctaagggcttttccctgtgtttgaggccacctcttttatttagctatctgagatccttagcaatggtggagtaaagatttcgtgggtagaagggtaggcagggggtgggaggagggatccatagagtagagggactcaagtgaccctcaagtgatgcgatccattgtgtggccattgacttctgcagacacagcaaaaagatgactcgtcaaacccatgctaagcaggtgcactgatgcagagactgcctgcctagagaactttgtctgtggataatgcggccaatagtgttgaaggaaaatgaaatgctttgctttctggattgttagtgtggtttgttgacttttccttgctgcctcctaccttctgttgcctcctttgtagaatgcagtcagtcatcagcaatggagtggagtggggtgcttacagatggtctgcaaaggttctgaccagtcatgctagcctgatgggaaatcctgttacagtgtcatgatgaaggctgatatttaggtctacctgagctttggcaagcccgtaaaatggaaaggccacccatagggctgtttttgcaaactagaaagggagggttggtaggtaggccctggtgtttggggtataggaagaaaaggtaggtgggggccaagcgggagagccgtaactatgctctgtcatctcttcactctgaagatggatggggttggatagaaagtgtgaatgaagtaagcatcaatgactgatgtttctctcctattaaaacaatctttttttgtctgtttgagaagggggctggctttgtttc

SEQ ID NO: 31467 - DNA, 1202 bp, Mus musculus
cactcccactttctggccctggtattcccctgtactggagcatataaagtttgcaatatcaaggggcctctcttcccaatgatggccgactaggccatcttctgatacatatgcagctagagctctgggggtactggttagttgatattgttgttcctcctatcgggttgcaaaccccttcagctccttgggtactttctctagctcctccattggggggccctgtgttccatctaataggtgactgtgagcatccacttctgtatttgccaggcactgcatagcctcacaagagacagctatatcagtgtcctttcaggaaagtcttgcaggcatatgctatagtgtctgggtttggtggctgattatgggatggacccccgggtggggcagtctctggatggtccatccttttatctcagctccaaactttgtctctgtaactccttccatggatattttgttcactattctaaggaggaatgaagtatccacacattggtcttccttcttcttgattttcttgtgtttttgcaaattgtatgttgggtattctacatttctgggctaatatctacttatcattaagtacatatcaaatgagttcttttgtgattgggtgacttcactcagaataatatcctccagatacatccttttgccaaagaatttcataaattcattgtttttaatagctgagtagtactccattgtgtaaatgtaccacattttctgtatccattcctctcttgagtagcctaaaggtttaagagaagaagaatattagtaagtcaccgagaggccattcttgtgatattttggcaaagagtattgctgcattttaccctatcccaaaatgatgatgatgccaccaccaaaggctaaattgaagtattttggattaaagtgtttggtggaatcaccatgcctgacctaaaagctttactacagagcaattgtgataaaaactgcatggtactggtatagagacagacaagtagaccaatggaatagaattgaatacccagaaatgaacccacacacctatggtcacttgatcttcgacaagggagctaaaaccatccagtggaagaaaaacagcattttcaacaaatggtgctggcacaactggttgttatcgtgtagaagaatgcgaatcgatccatacctatctccttgtactaaggtcaaatctaagtgga

SEQ ID NO: 31468 - DNA, 1194 bp, Mus musculus
acacaaatgatcatggttgaacgtactcagaacatttgtatagaaaggttactgaagtccacttggactgggttttgactgaatagccaatgtgtggtttgtagatgtgtggttgatctgtgagagaactgtgcaggtgcatctcaacgcgcttctacctacaccacagttaaaaaagcatacttaaaggtacaatgaatgagttaattctttactagtatttatgtgtgctgttgtttcaaattcattcctcttttttttccccagaaaatattccagcctatgtagagtgtaaactcaagaaaatgttttctgcataacagtttgacaaaagatggggaagagaagatagagtttaattgttattggctgtgggtgggatgtaacttggggcagccattatgggaagtagaatggagggtcctcatgtgattccagtactctccacttctagatattttattaaaactatgattctgtgtcctgtgatctgcaattctacctctgggtatatatttcgaggaaatgagtgatttatgtcagaaagacagctgtataatcatgttaactgtggcattagtcaagagagccaagatatggactcaacctaagtgaacagtaagggatgaatcactaaagaaaatatgatacactaagtcatgtcccctcccaacacacacacacacacacacacacacacacacacacacacacacacacctctattatattgtggaatatttttttacatcagttgtccttccttccttctttccttccttccttcctccctccctccctccctccctccctccctccctccctcccttccttccttccttccttccttttttccttccttcctttctttctctttctttctttctttctttctttctttctttctttctttctttctttctttctttctttctttctttctctctctctttcttgaagaaaagtcccttttatttcaacatttattctcatagctctttgcagataggacttgttcatgtggaaaacttacaaaaactctacagtaagtctagtgagatcacatttgttgagcagttttaatgcctcttacaaaacattatatagagctaaacaaagtattcaaagtgattatgttgttttattagatattttcttcatttatgctatcctcaatgccccctataccctccc

SEQ ID NO: 31469 - DNA, 1161 bp, Mus musculus
gtctataaacagtagaagggcatggtttgttttaggaaggcttgattgtaagctgtgtatagcctgattaaatttgagcaccctagccagtatatcactgtagaatttcaggggagaggcaatatagtccactgtacttattgccaagctacttaaacccaataaagtatatattttgtaatgtcccttttgtaatcctgaaataaagtccaccagtcattcataacagttaaaaaataatctaactccctaactgtagtatagagagaaataaaagaaagtaattataacacaatatttttctgtgtgttttagctaaaatagaggtgtgtttgggcttgctgcactgtgacctaaccataacaccattactaagaagcatcaatattaaatttccgagtcagcatgcaactctttgtaaagttctgaaccaactacaaagtaaaattttcttttagctcctatggttactacttttctgaaagttcactttacagtttcctgttagtcacagctttgctgatctataatcagctggcattggcgtggcttgatggtcttcctgacatgtcctcaggtcagcagtactcgaactctgtgtcattgccctccgttgtctcccatcatcccaaggaaaagaaatgtgggcgtggtaggatacagtgttttaagagtgaggggaaagaagaacatctacctcatttttactatagtacattgttatgagtttacttattgttataacttattgttataagttactaccttttaaactaattgttgtggctaatttttcagttggtctttattatcttcacttcccctctatacacctccctatctctatatatgaaaagtgtgtatagtcattattgcagaaagacataggtcaacagtggactgcattttgatagtggtcataatattactgcttagtgacatggcagcagtctgtgtaagtctgtgctaggatgtttatacaatgacaggattaccataaggtgtttgttagtgtgcattgccatagatatattgcgtgactttgtaaagtactgtacagtctggtttcagacatctccaatggtcctgggatgtattttccattttgaagctgtgcaaaagttatttgtatattaataatagtattgaagatagatggat

SEQ ID NO: 31470 - DNA, 1174 bp, Mus musculus
tcctccagatgtctgtacatgacaggctgtggacctttaggaccaggagtcttaggggtcattagaccaatggagccatactcttaaaagattcttgagaccctatccctttcctttatctcccctgcttcttgggtattgagatggtgtactttctctgctccatgctcccaccattgccatctgggtccaaaacaccaggtctacctgatcttggatctgaactgccacacttttcttggttaggattttattgctgtgatgaaacaccatgactatggcaactcttatgtaggaaatcatttaatcgaggctagcttacagttcagaattttagtctgttataatggtgagaagcataatggcatacaggcagacatgggagttctacatctggattggcaggctacaggaagagcatgtgagccagtggacctggtttgagcttttgaaacctcaaagtccaccccagtgacaactctcttccaacaaggccacactcgctccaacaaacttacatctcctaatagtaccactccctgtgagcctatgggggctattttcattcaaactgtcataacatctgtgagctagaagtacctttttattctcttcaataagtgatatctcaggcatttcatcttggtgatatacagaaggactaaccgggagaaaccgagagggggcagctcagacttcccagtgaaactcacatgaaggaattatagccacataaagacaaatggatggctggagaaactgtgcatgattaagggaactagagtttggtacccagcgctatcacctgtaccacctatatcactagctccagggtatccagatatgccttctcctggcctccacaggcatctatacttatacatctaacatacattcgtatctaaaataaagtcttaaaaaataaatggaaaaggcacctttaaagtcacaggctttgtcctttctgccaaagcaaaaatctcctctgtattatttctaatgaatgcaagttgtgttaaaaaaagcctatttgttcccttgtaaacactttgttatctaccacacatcagaaattgtgctattaggaccagtgatatagctcaatagacaaagaccacttccatacaaatctgatgacttgaatttaatccctggatccacataaagctgtgag

SEQ ID NO: 31471 - DNA, 1167 bp, Mus musculus
tgtattcttctggaccctaaagccagaaacacttatgttgccaattactgctgtatatttgggatggaatatggccacctccttgaatttcattttcataacctttgatctcttgatgctttcctttgttgaataagctttcctttgtttttggagtagattccctagggattttcttttcacaagttgaatgattagctaggtggggtcttgcttgagagtaccatattcttcattccatttctccttatttcttttagcataaatctaggttcagacattacattccctggtgttctcttttttccctcctcaaattgtgcattttgtatttcttcttgccttgcttgtactttttcattctagatctccatgaagagtgatcactaataactacatgacacagtcaatactaggttctcttgaaatctctgcctatgtatggtattataggtccaaaacttttcaatttagcctcaggcagattcttaggaccagggcccaaagcagtctcattctttgccaaaacatcaaaagaatcatctctagcccagttgcctaatattatttccctctgaaacctcttgagctggatctccatagttcatattgctctcagtgttagtgtcttccaagctcttacagtattcttacagccccacttaaacattcatccacttcgctaatgcagagttcccgagtcagctttactctaacaagcagcatgaccaggtctgtcacagcaatacctcactcccagtaccaactttacaactttgctattgtaaagagacgccatgatgaagacaacttgtttacagttcagagtatgagtccatgaccattatgacatgggacatgcatcaggcaggcaggcatgtctgtggagaatagctaagagttaacatttgcaagtttgtaggggcgaggagggagggaggtagggaggaagggagagagagagtgagagagacagagacagagagagagacagagacagagagacagggagatacagaaagatgcacacacacatttgagagcgcatgcacacacacacacacacacacacacacaggaggggggctgtcctgggtttctgaaatcttagttcactatgggttttgcttttttaagcccttgaaatatgtgactcagggccatttt

SEQ ID NO: 31472 - DNA, 1288 bp, Mus musculus
ttgattttacacaatgcttaatagacttagctttgaacccaaagctcagtcataacgtggtatggcagtcctcacctgcagtccaagcactggaggactaaagtaggagggtccccaagttcaagaatacagagagaaaacataactgaaaaaaagaaagacgtttaacaggcaacgtggtagagccttggccagtcctgactcggctctaccattcacacacagcagggacctacaacctctgctcctgtcttgtgccttccacccaccaggtcccctggacaatgacatgcagcagttggctcgggaaacctccaaggacccagagttaaggagcaaactgcagaagttgaagtcggatggggcgctggtggactgtgggacttcagcccagaaactgctgggcttgctgcaaaaggacaccttccagtctggagcccatgtggacttctatgactgttaagctcatgtcctgtcacagtggcccccttctccccccccccccaagccctgcctaacacacatataagcccttcaacccagccagcagcgagcggtgggcactgccagtcctcggaaggcttctgcagaggcttgggagcgagctgatgtgcactggagttctctgtcccctggaagagtgctttagaggtgggaagagcaggagaagcagaaacactggacggatgaggttgaggctcttgtttgtggtcagtctgtggggtgaggagggtgggctctgatgcacagagaggacggagggcatcacgtctggatggatgctccttgaacttcatttgtttgttgtactgcctgcatcctgtggtgttcactggtcttcccttgactctggtccaaatacatagttatgaggcagatgcaatagagtgtgcgttgtccttcatgaatacctgctaacctcttctaacaggcccaggaatgaccctggttcttcagacaagaactttactgctcttatttttcagagcgaaggcagagagctgtctgccttctttcatccaggtccacatagtggtaggcacaggtccaaagtcatcaagatggatgtcccggaagacctgtgcccttctcacgcttctgtccacactgacccacctgggctgacatttccctgagggtcctagaacccagtcagtgacaatcgatcctcagtgcccagcacacagcagacagtgctgaccagtgagggctgctttgatagccacttcacaccctgcccacatggcggtactatgaaaaggtcccagctcccatgacaagccctctt

SEQ ID NO: 31473 - DNA, 1099 bp, Mus musculus
aaagcccaggagagtggggcacggctgggggatccagtttcctgtttatgtctctgcaccttagctccctggttcaaatatgtaaactatccactgggcctggctgcaggtgtgtgtgtatgtgtgtgtgtgctcccaggctggaaggcagaggtgcccccagtgcattcctgactcctggcccccaccccaacacagtgtgtctggctacaaaggcaaataactcaaggttaacccttcgcaggccatgaagggaagctgtagggaactgggggtcgtggagctgctaactgggccttgaggtatttaagaggagacactagatatgttgctctgcataagggggtgtctcctgagaggggcttcatggcttgagcttggtcttcaggatggagatgagattgggtaaatcagttccagaggggtggtagtgcttatttcagagcaggctggacatgttcatgctatcagcagttctggagcaagtggtaccgtccagcaggctctgaccaataccttcagcatcctctgtggtcactgccgctccagctctcttcttccagattcctttgatggaccgtgccttcctgccctcatcttggacagatgaggtgacctgcaataggtttacttggtacggataagaggaagaaatggtggccccgttgacacaggcatcactcaggtccttgtcctggcctctcccagttgagcccaatagtgagggccctcagtgatctcctcacacaggagacctgaggatcacagatcattggccccacgaggggttctcacaggtggctaaccgccatgcctcagcatgaagaggttgcactcaaggtcagcactgagttgagtctgggaagtttgggttctccacaagctagctgccaggagcagctaaagctctcgtcgggaccaccatgagacatcacttggtacccagagctttgagatgtctggtaccctatgtcaatgttcagctgctcctgctggctgccttcgtgggctcattcccttccccgcccctcgaatgtgcctgttcccctccatctgctcttccgggcaagctcccccactctggaggcgctggctgtgc

SEQ ID NO: 31474 - DNA, 1197 bp, Mus musculus
aaaattaaacactcattatacaaaattaattgacattaattagcaaaaattaaaactttaaacacagcaaggcgctttggggggaggagtggagcaggcaggctctgcatttgtcaccccccccaccacatttcccaccacccacctaccacccccaagtctccccatttccatcatgaagcagggctggaggacttcaggccagatctatatcagtacagcggcatgggcctggcctgcacgtccctgtgaaggggatcagggcaactgtaccagccaccttcatctagtgcttctctaaggatccaggaacctcctatcggccttaggtccctaagatctcagctgagactagggaggggtgtggccaagtggagcaggtgaagctcaggaagactctgcgtgctccccccagatcccgtcttgggtacctgaggttcaggcgctgaaacctttccactctgttccactttgctgtgtgacttcagttaagtcacgcttgctctctgagcttgtgtcctgtgcatatgatgggtgcagggcgggtaggcaccgaggtctgctctgtctgtcacctgctgttgtggatgcctgtctcttggttggctttcgagagacatgcaggactgaatttggggagtggcatttaaaagcattttatgtagctaagggacagagttgctggtggtagaacatcaggccccagggggatgcatcttagggccagagagctctctctctctctgtctgtctacacatctgcttcccctgcctggagactggccccagaagaggcgagcagcgccctctataggtggcaactcccaaagccttcgccatatttccacctgctactttttttggtctatgcttccagggtctcaaagggccttaggatcttttgccccggctgaaagcaaaatagaggactctacctttctggattcacagagctcttgggggttggggaaccatgtctggaggtggagccaggtgggaagccatccgtgcctcactacccctctctgtattcctctctccagccagtgccaatatctgcaacgtggtcctgatgcgatatggggagttagaggaaggaattgatgtcctggatgctgatggcaacctcgtgggctcctcaaagattgcagccagacacgtgggtttcccaggggctaagccctgcacaaatggatc

SEQ ID NO: 31475 - DNA, 1134 bp, Mus musculus
tatgaggaaagacacccacgcagcctcatccttgccctgtcctggagtgatggaaaggaggagagacaaggaaacctgagagaggcagataaacttcagtatatctgcacacaacagaccttggttcagtccccggcacttagagagagaaggagggaaccggaatgtcaatttacaatgtctaccatgtgggactcaggaaatgccactctagagcaagtcctgccatgcaacagtcaacacctgaaattggatctccaacacctgtgtaaaaaagccagatgtgacagtgtacacctgcgaccccagtgatgtgagggacagagactagtaacggccaaccaccataccacagcttcagcgagaggccctttctcaaaaaataaatgtggtgagcagttgaggaaagacaccatctgtcttccacacactactactgcacacatatatgtacctgcacacacacacacacacacacacacacactaacaagtgcatacaatggacacataatcacacagaatacatctaatatcttaagtttaggagttgcagaaccttaaaaaaaaaaaaacagtatagctgaatatgatggctcactcttccaatcccagaggcaggaggattaccttgagttcaaggctagccagctccatagtaagaccctgtctcaatagcaaaaaaaaacaaaaaaacaaaaaaacaacaataacatataaaaatgtttgccaggactgctaagaagtttcagatttaaggaagtcaccatgatgatgtttaaaagactttggataggctgggcatacacatgcctgtaatcccagtatgcaagaagctgaggcacaacgaccaccatgcagctaggctgggctaaagattgagatgttgtctaaaaaagaaaaagtaaaagaaaaaggagggaggagcctataatccaagctctaagcacttttgaaatggagagaatttgaaatcaacaatatcaagagtttaaggtcaggctggagagatggctcagcagttaagagcactgactgctcttccagaggtcctaagttcaattcccagcaaccacatggtggctcacaaccatctgtaatgagatctgatgcccaattctggtgtgtctgaaga

SEQ ID NO: 31476 - DNA, 5725 bp, Mus musculus
cctcccgaggagtcagcttcacccctcggtccccctgagctctcccccactgggggctcccctacatcatatggggaagaccatgctgcagccaccccagcctccccgcttgtgcttctgcccctggagacacgaccagctgaggagccccagcccagcggcaggtgagcgtccacccagaacccttcccagtaggaaagtgggcggggaaatgacccgggagtagaagtatttcactgtccagcttcatgtttgctgagggcacgtggtaagggtctcctctatttggaggcaggtggtcaaggctttgaagccatgcacttctgtaggaccagcgctgactttgattatacataggacatctgtgtggccctataagctgggggtttgggaaacagcacctgataagggtaggggttgaggagtgaggttggagagagtcagtgtgccctggcaggagatgggaatgagagctgtatcagttgtacaaagatgctgtggttggggggatgggagttccacaaagtgatgatacttcttcaggtaacaggttgtagtgggacccacagcatttttctgtccaggtaggatgagttagcagagagctggtagaaggtctgggacttagagaggaagctgaaggcaggctcagaggagaggagaggagaggaagtggtcttcaagtgctttccatacccaaagctcctagaaaaggcttttcagctgcagcaggcacctcactggcttgctttgtcattggttttctgggctagactcccatctgttgagggcagctgagtggacagctgatgcctctgtggctgtggtcatggagacttgggatgagggctcagtgagagtgacccagtaggggcagcagttcaggatggcagtggctcaggatctagccctggtctctgaggcccccggcctgctcaggcatatgtgcagggctctgagcaagcacctgtttttgtgccagaactaaggcatgcctagtccaggtggatggccagggagcattcagtgagggaggcagtagggcctgctggtgacacctagtggtgggtggggctgtaggagctggtggctatggtttcctcatttcctggtgacagtgtcctcatctggcccacatcttgtagtataaccttgatttatactcacacttgcagggtttcttttcagaattggtttcacttcatatgtatatgtgaagtgatagtcatataggactgtccctatttctcagatgagtgtgggggtggttcaggctgagagcctagcactgtagctgcttgctgagagggtacctccatgcactgagggtggctgttgagacaggtggccttggagttgctttcagaccgtctccagtgcagactccagatgagaggacaggtgaaggcccagtgaggtgaagctccctgtgtgggcacttgatatgctttcttgtctgtgagactagacaccagccctgtcctgaggagcacgggtcatcctgagcctgtgccaggggtgctggggggctaagactaagtggctttactttctattctttgcccgaaggcttggagtctctatagggtgagtggatctgtgaggttcccccaggacaggttagctgatttatgggcccgatgcttccagcttatataactactgcaaatgtcaggtgctaaggcatcccaggagagggttagcttagcttagggaatcactaggtttcctggaggaggtgagcttgcatagctttgacacggcagtaggaactaggttagtaggaagaagggtagaggaatatcttggggggtggtgatgaggcacagtttcatgtagcagaggctggccttgagttcctagtgcttctgcctctgctgtgctgttattacaggcgtgtacttctatgtctagctagtttttgtaaaggtcggatggtcgttggtgtttatgactgaggagagggtagttatgggccaggatgcacaggcagagcctcgttgttctagaatctgttatcttacctagaaaggagccactaaaggaattaatggaaagccactaattgtctcttagattagggagtgggtggccagagggcaggtgcagctaggagaggaagacgggtgaggctgaagtggatgagttggagggcctcctagaggtgtgaggggaactaggtatgtccaggaggactccagggaagcagctggactgtagctggcgagatacagggtgtccaggagaaggagaagctggggaactagcagtttagacggagaggcggctggtagaggtcaggacactagctgcaggtctttgaagaaggggagagatgggtggctgtcggctcagaagtcaaggaggggacccagcagatttacttggcctggggtatcagcatggaggtcttggcctgagtactcaaggaaagggagaggttagaaaaggaaggcagttccccacgctccggacagggttgtgggaggaggcagggtccaggtcaagaggttttgcagtcctgtcccaaagctcatggtaagccattagcagagagaggtaaagatgagggaacaccatagtctgtagggctttcttgctcttcaccctgaagttctcacacccacaggcttgactgggacactagctgtgtagaagacaaggcacgggaaatggctgcctaagcctgatcacaaggtagaagagtttgtaggccagttttccatgctggtgcattgaggagggcaggatgctgtcctgagatatcatagagacggtggtataacctttgtgcggccttcggtccctgcagctcacctcctgtttgtctttgcagtccccaccctgtgaaaccccttactgctgcccctgtggaggctagccccgacaggaaacagccccgtaccagcctgagcacagccctgagtagcggactggagaggctcaaaactgtcacatctggtggcatccagtctgtgcttccagcgtcccagcttggctcaagtgtggacaccaagaggccaaaggtgaggtgcagcaaggtgttagggggcaactgagagaacaggccgtaagatgaacagaggccaagtgatgctgggggcagagcaggtaactggtaattccccgtgccacagctcttaagtggagaggacatcttcagccatagagatgggctgctgccaggtctggggttctacagtagggaaacaggtttgggtgggctagctgggggaaggtctagccctcccctgcttagttgcattctattttgctataggattctgctgtgctggaccagtcggccaagtactatcacctgactcatgatgagctcattggcctgctcctgcagcgtgagcgtgagctgagccagagagacgagcatgtgcaagaactggagagctacattgaccggctgctggtgcggatcatggagacctcgcccacactgctgcaaatctcccctggcccccccaagtagcccttcacgccatccctggagggatggtgaggacctgtgtagtgcccgccactgactgctctcacctgagtagggcaagcctgctctcatggtgactctctgcacccctccccatcctgcctctgctctggctgctggaaggggctctttgaactcccactggagccttgggtcttccctacctgaccattctcacacgcgaggttatggggctccccagagaattgcaacaaggttgttagctgtcaagatggagcaggagtgagctctgggttctggggtgagctgaattatctaaggcaacactgttgacagcacagctcaccccatgaggctggtcatttgtttctcctcttgaccaactcttcatctccattgccttctggcacctggagggtctcctaggccactgggacagggatgggaactaagctgcttgcttttctgtgcactgtagacaaccagggcacctacacttcagccttgtgcctataccctaagagcaaggagcctgtgtgttttcgtcttgtctctctgtctagagcatgtacacagggtggtggtggtggtggggggtggtggtggtggtggtggtggtatgtgcctattcctcagctgccccctgcccctcttcagaccctcccactccatgtcccagtagtggtgggaggtggggtgggcacagagggaatgacttctttctcctgcagtcctccctacctccctaacatgaaaccctccaggttggggtttggggctgctcatgttttgtggaccaggcctccattcatgtctgttaacactcgtcagatgccaaaactgtgctgctgtgggctcagaacatttggaaaccaattaaacgtgccttttgtgggtgaggacaagagcctctggatgtagatgtctctctggccatggtgtcccctccctcctgttgagcacgtgaaaacggctgtgagggtcctgaaagggggctgtggaccacgctgtttactaccccgagaagtacctcagctaaggctctggccaacctgctttggaggtgtcctaagccgccttcccacttcctggtcctcccttgacccttatttggagcatcctggtaaaaaaatctagtgcacagtaggtctggggctatcctgcaccttactgtgtctgaccttgggtcccagttatgctggaccagtgggtttgtctggaagcaggaggcttcattctgctttaggagacacctgagcttaggaaaatgcccgtggctctccagctgttctgtccttgttgtacagtccctcctgctcaccaatccctcctgtcttgcctggcttggctgaagtgcattcaagtgaagtcaggtatctgctctgtggtccagcttctagcttgcttgtgaatactgccagtctccctggcatcctcgggggtccttggtggctgtgcattacaaaaggtatgagtgaaggaggtgagatgctgacaaaagattctttgggcccagtggagaagcagtaacgtctttccagctgtctcttaaagacagggtcatgggttcactcagaacacctcaggagaatattctctgtggatgacgtcagtcttctgccagcatagagcagatgaaccacaatggggtccaccactgtgcagttaccaactataggtcaactcagagatgagaaaatagccaccagttcccagagtttgggggtagggtcagtccttgggtgttggaggtgtcttttgaggaactgagtccctcttctaggtcttcctctgggctttaattagtcccagcccttctctcatctttcatccatccttgctgtttggcttctctacatggccagggcaggggtgtcctgcagagaggtcctgaactgaggccagggttttgttcattgtctgatccttaccacatactgcagagtgcagccagacaggcagcaagcaggcacagctctgctctgccctttgtcctcctagttgaaactcctgtctataaagagcttgttcttcatgttttgagcactttatgaagaataaaaagatcacgtaccgcagccagcttgtgtgtttgttttgaaatgagcggacaaaggagaccgcctgtgggagagggcagtgtggttctcaggtgacagagctaccgctctgaaatcacaggcaacactgcctcatggcccgtgtgcctaggatgcctgtgctcacgggcactgatcacaggcatatttactgagtgttggg

SEQ ID NO: 31477 - DNA, 5725 bp, Mus musculus; identical to SEQ ID NO: 31476

SEQ ID NO: 31478 - DNA, 1178 bp, Mus musculus
tgttgctggcaggaccactgtggctctgggagggatggtgctggaatgtgtactgtgtgcctgcagtgaaaaggcgtctgttcacgtctttcctaagaacagtcagttagacagggccaatggttggagaacccactgctgagactgggcttccccgagttcatgcaggaagcctgcacccacacagagaggactcatgccaagaagtctagtgttgggatggaggagtataatggatggtaacccagggaaatctacttccagggccatagataggcgttccagctcttctactagatgatgtatggaacagagagaactggagaagttgggagaggagacggcagccaatagccatgaagagatttttggctgggggacgttgtcacagagctgtggaagtgtgaggatggcaccaggcctgttttcacatagcacctgaatctgaacatagctccagaatattctggaatatttagatgctcttgacccatccactctctcttttgtttcactagggacctatggtggggttaccttagacccttgaagaagttgggggttagcctcttgttttatgaatggccccaactcctgagccttgtgctcacctctgaacacctcagtcccacccactcatcaacccagcagatgtgcagcttggtgagccagtggggtgttaggcttactatgggagtatggtatgagcacagtaaggggttatatacaggagtgtgggtgaccccagaatagctgcatcccctcaaccagcatgagtaaaagctgtacagatggagtctcctattcaacttactgcttagatattctagtgccttctaaggccaaaagcagctggacagtattctttgcagctaggggtatgagagagatgatggaggtctgaaatctattcctttagtattatatatctctagctgtcttggaactatgtagaccaggctgatttcaagctcagagagatccacctgcctctgccagagtgctgaggaagtgcaccaccatgtccagtaaagctagtggactagctagcactatctttactgctgatcaggactaggacgcagaaatgtgtgctattggtcacatgatcaataacttctgttccctaggaacctttccctggttctcctgtctccagccccaccttcactggcatt

SEQ ID NO: 31479 - DNA, 1194 bp, Mus musculus
gcggggaggcggcggcccgcttggcccaggccagcccgcagctgcggcggtcggtgcgctgcaggcggcgcgggggagccggctcctgacagcatcccgcggctgccacgtctgtcactctgtcccagggtccgccatggctctggtgcgggaccctgagccggcggccggatcctcccgctggctgcccacgcatgtccaggtgaccgtgctgcgggccagcgggttgaggggcaagagctcgggcgccggcagcaccagcgacgcgtacacggtgatccaggtgggccgagagaagtacagcacctcggtagtggagaagacgcaaggctgcccggaatggtgcgaagagtgttcgttcgagctaccgcctggagccctggacggcctgctgcgggcacaggaggcagatgcgggccctgcgccctgggcctccggccccaacgccgcctgcgagctcgtgctcaccaccatgcatcgctcactcatcggcgtggacaagtttctgggccgggcaaccgtagctctggacgaggtcttccgcgcaggccgcgcccagcacacgcagtgagtctggggcgctgggagcagggacaaaaacggttgaaggcctaaccgggcggggctggttgggacgtctggacccggtcctcccactcaaggacacaaacccgtatactgtttgttacttctcattcagccttctgccctccccaattccccctgactgtctccccagcagcctggtgggcctggaaggcctgatggagttggtgtagtgaccaagcgttggcagtacatggccaaggaaagttcggaatgggattctgaggctgtgggaattcaagaagggaaatttaaagacttcagggtctgccttcttttcctcaaagaggtgactagcctgtaggtagtggagaggaagtctcaccttgtagaagcaggaaggtgaggtgttatcttccaaggcaagattgaagggagacaccccagccttcccaggggttacacaggacacttggcctttgaacgttcagggatacacctcaccgtatagacgtactctgtgactctgtcttagggtaccaggactgagagcattggcccacctcggagtaaagaagggtacatttgaatcagcttgggtcagtgggacagtggttataatgccctcagttctccggattattttct

SEQ ID NO: 31480 - DNA, 1099 bp, Mus musculus
cgaagaggccagatccttcacagttaaggaactctccggttgctgtaagaaagtattgtgcagatacagtggaaagggaaattaaactcatgagaagacatcagctctgctctcctgccacccctccaactgagacactcaggttctaccattttgtctaaatgtgcttctccaagaagtcttgctcttctgtctgtaccactacctatttatctggcactctccctccccccaccatggagtctctggatgggtctcaggacctcttctcaccttcaagtcctgtggatagttctgaggtttcccatgggcacagagaaattcccttcccctcataagcttagagctccctggcaagaacacacccactatctgaccagggaagctccgagggtagggaagccacagtcccatctcacccacctgcctcgatgtccttgtacagctggtcaatgaaggtgtctagttgttcccggtcctgaggcgtcagctccagggcatcacaggcgtgcacccattggctgagggaactaaacagcccatggatggaagcaacccaggtcacagggctctctatgtctaggcaggttaagcccaggcagaagggttccccatcccagatctaaaactgttcttttcttttagagtaaggaccccaccctcccaaaagagcaagattcccagcagcagattcccctgcctcattcctcgaacccaggtcatgacaacacccaatcctaccatcttcaaagaatctgtggctaccttcctccattaatcttctatcgaacctggaggattacttagtaggtctagaacattctctcctaacctggttccgattccttgaccattggtcccaacaagggcaaagagagaccggaatccttctggtgtgaaccactgtagggaaagaaaggtgagtctggtgcttgcttttcctaaccccactgcacttcaactccaggcctggagcaccaggaagaaaggcttcgtgctcctgccttcccacactcaccagactgagagcctcttcataaagggcctctttgaagagcccaagcagaagttccagctggtcctggtttaggggaaacag

SEQ ID NO: 31481 - DNA, 1348 bp, Mus musculus
tgttatctcacctggaaggccctgcccagaccctgctggaaaaagggggcctgtcctccacaaaagtggttggaaggaacaacccctcccctttgcacccattgcctgctttctcccttctagcatactgctggagggtaggatagaggctggacccgagcccaccccttcccagacctcatgccctgagcactgctgctgagctgcatcggccctgtgccatcacaagccttccagaactggccttcccctgccatgctccactgcagctgtgagacgggaatcaagtttcaggtctcatagtgttcttcctctgggccccttagcccatattcagctcatgcatccacgagaggcttggctcctattgactggctattaatttcagggtggcaacataatggccaatcagagagcagaccggctttcttgagagaaagaggtgatgtgaagccttacctcttccttattgttcacctgccacagctgcagctgaagtactggcctgccactttccagcaacaggcaggaacaagggactaggcctttagaacaacactgcaaaaagactctgccaggggtgctgggctgttcccactgtacactggggaggtagagattgacctgttcgccaaaccccagaattgctgtgcttacatcttgcctcttaggctcagacaagggggctagcttgataaggtgtggaagaggcctctatcaggatgaagactaccaccctctctcagaccaacagtagagcagatgacagattgtgctctataatttaggatgcccaatcttccccgagaccagctgcagtggcccagcaaagggtctctgggtcaccgacaccctcctttaggatctccagaggaacaccagtcttccagaagtctgaaggagctgggcagtacacacgaagatgagccaggacttgttccctcattgccacagatgaccatccctcacttgggatgggcactgcggaattacagctaccattccccatttgttccctgagaggcctgcacatggctctgctaggagctttcagggaggaccagtgcctatgctataggcccttttcaaggtggagccagatggaacatgcctgactggccccctgacctattgggcacactccttcacaacagccagcagcccctctccctctggtctgcccactggtctcaataaaatgtgagtggtgataggcctttgcaacaatgccttgtggggcgtgggctgggtgaaccactctgggtctacagtagtcaagatgggtgcaaagggcacaagttagaccagtgggtggcagcagaatgctccgggtcctgagcaggcccca

SEQ ID NO: 31482 - DNA, 1122 bp, Mus musculus
tggctggccatgctgcactgggtgttgtgacttggtgggggtcaaaaacaatcaccagtaccctctcacaagccctatcttgaatatcccagtcagagggcaaaaaagttctgagtttctggaactcccagcataactggggcagagggcagtgttgggtgctgagaaagtgaccaacgctatactgctcttcatgccctcccagctacatgatccgccgttctctggaacagcacgggctaccatgggccatcatctctatcccagtcaatgtcaccagtatccccacctttgagctactgcaacctccgtggactttctggtagaaaagctgactccaggttccagtgacaagtgactcatgggaagaggaaacccaagattctgctatttggagtttggagatagattctgaggacaagtggaaccagagaggacagggaacccctcctcctggctttcccttccccagggcctcaaggacatctcatgattcaggaagaggcttctgactagaatttgaaacaaaaggtgctgaaggcagatggccctgatacacaccacctgtttcagctcccagcagccaagccctcctcacagtgagccttgtagctgctgctcaagtggtttaaagaagtgatatttggggactaataagcccatactttcagcaataaagccaaacaaagctcaccaggtttgtgcctgtgtcctaaactaagaaagcatgctgtagggagctcatctgcttagtcccatgtcattcggctgattgtagggacggcttagagacgctcaaggccctctaggataagtacatcagactgccagttttagcccagccctctgggaagaaggctcttatggcccagagtcagcaactgaaaccaaacctctgagacccttggtctggctttagggacatttacacaccagtgtggggcctgctcaggacccggagcattctgctgccacccactggtctaacttgtgccctttgcacccatcttgactactgtagacccagagtggttcacccagcccacgccccacaaggcattgttgcaaaggcctatcaccactcacattttattgagaccagtgggcagaccagagggagag

SEQ ID NO: 31483 - DNA, 1085 bp, Mus musculus
gtgaagaagcaagataaagtgtaagtttccagggggctgtgtcagaaccttgatatcttgaggccaaatagggtattttggccaaataagcatgttgcagactttgtataagcgggtgggtggccttttggttcttgacagaccctttgatgtaaaacatgaaagaggctgtagactgtcattaagagccaccgtgggggtgggggtggggtgactgtatctgctgtcggtcactgatgatctatcgtaacagtggagaaggtgaaaggtggtaaattttggttcgaggaagagtaatgggttgatgtgtatagctgctaaggtagatttttatttaaataacgggttgatgctgcttgcctcaaatgtgaattgtctgccgcacagtgtaatggttactgtgtaaggtgttggatggaatgcaccactcccacactgcggtagattctggtaagaagctcaatgccagttttcctgtgctgcagagagcagaggaagatgctggagaagtgtgcgatgacagccctgagctccaagctgatctcccagcagaaggtcttcttcgccaagatggtggttgatgccgtgatgatgcttgacgagctgctgcagcttaaaatgattggcatcaagaaggtgcaggggggagccctggaggtgagtgagcctgtcgtggcctccctagacactaggcagcttcatgaggcagatgtgaaagcagatgtgaccgctctgccatgctgcccgtgttctttgcatctgtttgcttatcgtcaggatgggaaagtggacccaggccaattcggaatcttctttctttatgtcagtgtcagggtctatagaaggattatttgagataaattacttgtgaattcttcaaagatatatagtggaggtatttggcagttcactctccaaggtgtaatgtcaaactattagtttcctttggatagatgataaatagttcagactataaagagagcatagagtgaattgtcgcataaccacttctgtcccttacacagccactattaacagtttacgtagtgtaaccgagagtttgtatacacagtgcgtgtgtgtgc

SEQ ID NO: 31484 - DNA, 1173 bp, Mus musculus
cagtcctgagtatctgggataacaagcttacttagtcttctagtggactctgttcctatcattgtggttctcaaggcagcctctaggtagcagtatctcccagcacagaatggcttttgtaatagaagaggtcttactgggaaatccctaggcacagctttcagaagaggttaaactgttattctccatacctcagcagtgccaaaaattctggcaaagctccttccttgaggttactttgtatgtttgtgtttgaaagtgctaagtggttgctgttaaaggtccttgtgttttgggactgttggcccattcccagataaatcagcatgtttttgtttgagggaggggttggtttagcccatcatatatacccacctccattccaaccaccctcttctttttggggctctgtaggattaccaggcaattgttgatgccgagtggaatattctctatgacaagttagagaagatccatcagtctggagccaaagtcatcttgtctaaactccctattggggatgtggccacccagtactttgctgatagggacatgttctgtgctggccgagtgcctgaggaggatctgaagaggacgatgatggtaagaaacccttggactgctgcttatccttcatggccctgaactttttcctctgacccgatgtaatggaatagactatcaagttgtccctatgttaacactgtcaagaaatgttccaacccagtgtatatgcctagtaatagaaactcctttgaattcactgaccaagacaggtcaggaagtggatagtgcccagccaccaacactgtggtcagcagataagcctcgatgagtattgctaccagccagggctttccttctgggtttgagcctgtagtctaaagaactgctcctgagtagagttgctgcacccagagcactagacatcaggtccctatctcctttgaacgagaccctttgccttgtgtttgttctgttttgattttcatctttttgaggggcagtagggattatttagaggttagggtaaaggtgggctatcctatgcagagggctcaggctctgtggcaacacggcttagtgagtgcctggtgggaggctaattgtcctcattgatgttttccttgctcttcaggcttgtggaggctcaatccagaccagtgtgaatgc

SEQ ID NO: 31485 - DNA, 1332 bp, Mus musculus
ccaaatacctgcgggattactcgaggaccattcctgggaagcagcagctgttgattggggcatatgccaaggccctggagattattccacgacagctatgtgacaacgctggctttgatgccacaaacatcctcaacaagctgcgggctcgacacgcacaggtggttatgctctctggagtcagggatattgggtgggtgaggtaggctattaggtatgtgctgtgcccactggaaatacagtcactagatacaatggggagctgcctcctgtcgtagtgccagagttggaagtaggtgttggctggggtcaagtagggaaaggtctggtgccatttctcttcacaaagtgctttgtcaagtcaggttcctggagtcctttggaaggtgcaggaataaatgtgccatggtgactctcctctctttcagggaggtatgtggtatggggtggacatcaacaatgagaacatcgccgacaacttccaggcatttgtgtgggagccagccatggtgcgcatcaacgctctgacagcagcttctgaggctgcatgccttattgtgtccgtggatgagactatcaagaacccccgctccactgtggatcctccagctccatcagctggccgtggcagaggccaagcccgcttccactgagaggcgaggcggtctgcacctccttgtgaggtgagggggtggatgagaagatggttgctggtctgctgggttctcactgaggttatttaaataaagcttaaggttatttgcttggtgtgtttttcataaacattttcctgccttagaattggagtcatgtatacttggaaatagaagtaaagaattgtgttagcctgctgcttgctctgctgtgatggcccttgtctagacacctcagtggctaggtggtagcagtatcaccgtcacacaacactgctgtgatcgtagttggagtgcattccctgtctgctctgaccgcacttcatgttctctgagctcagtgtttcctcttgcaatattttaagagaaggcacagaaaagtgtcaggttgtcatataatctctggacttgagctttctaaggccttgtaagaaaacagcttgtttcttgttcagagtccctttttgtttacgctgataactgtggactgaacccaggcctgggaggtttgctcggcagccacttgaccgcagctccattccctgccctgtttttactttgggttgaccagtctttctgcacctagaggttcactaaattgcccatgctggccttgacctaactttgtctcctgagtaaactgggacaactggcttatgcctaccaccatcccagctcc

SEQ ID NO: 31486 - DNA, 1121 bp, Mus musculus
acatatgcagctagagacacgagctgcggggggtactggttagtccataatgttgttccacctatagggttgcagatccctttagctccttgggtactttctctagctcctccattgggggccctgtgatccatccaatagctgactgtgagcatccacttctgtgtttgctaggcccgtgcccactcttgaaaagtatctcttcgcctttgatatccaggccaggcagtgcttgcgttttggtaccagatctttcccattagcctactaaaagaaatgccccagttctccatgccctgtacttcgtcaaagcatgcagacacaactgcatcccttccataaagacggaagaggtaccataaacctgctttctctcgaccttctacctctgtgctcctgctttcttgaaggccttgcttgtctttctagatctttcttgaacctacccactagggtcaggttgccacttccaccatcagccactgtgtcatcagcaaacttcgtgttcctcatcctcctggatccatctacagccctccccccctccccccgacacagactccctccctctgtagcccaggctgccttcgaactcgtgatcctccggcctctgctggtattactgccaggcaccgccaccgttagctttcctttatctttgtccctttacagctatctttcctgccttcccctttgtttctctagtctcaatgggagccttaggagctgtataggatcagaccttgtgcttgttcccactgttacataagctcagcccagtcagggatttccttttttttttttaaagagaaaagggtttatttttgtttatacttcatactccatcataaagagaagtcggagcagcaactcaaggtaggaactggaacagagacaaagcacacctttctacctttcaagttgctttcaaaactcggaggaggagcatttacagtagctgctcaatttgcttttttctatgcaacccagcaccacaggccgagggacagctccatccacgggatttccttttttgttgtttagcaatgctttccctgtgtcccagactgtgcttggcagccggaataggtgttgaatggatgcgagaacagctgaatgca

SEQ ID NO: 31487 - DNA, 1130 bp, Mus musculus
aatctgattttttttccctttctttctaaaattagcctatgttgcatgtgtcagctctttaattttcattgttaaataatattctttaagggttttttgagtaaacatgactttctgttgagtaaatacctaggagtagatcagctaaattatttaatggtatatttaactttataagaatatgctaaattattttctgaagtacctgttcccattttgcccaaggaatattgttgataggtttggaaatactcagttttttgtcatgtaccaaatgtattgatttgacaatgagaacttaaatatagtgttaagtgtcagtgactgcctggtactaggagatgggagtgatcagaagagaacgaggaggttaatagggcaagaaggaacatagaaggaacaactttttttcaactctggtgagaatattgttaaatatgctatgagtagacagtagtattaatgtgttgactcagttaacgaccaacatcttttcctttaaaattttcctttcagagaacagagtcttggcattgtcttcctcaagaaagggattcttcccaaaccttggctatgtcccagactgagatcggcagagtagaaggaacagaagtaccagacctaccctctcaggagggaggtttaccagctcagtcacagtgtccaggaaagaagccaaagctgaatgtcttgtgttctccattgctaggtaatgcctttctctctctctattttaacattttattttactcgatatgggtgttttacctgcatgttatgtctgtgcattgttttcgtgcttggtgccaatggaggccagacgagaacacctaagtcctggaacaggaattatgggtgctgagaatcaaactcagattctcttgaagggcagctagtgttcttacctgtcaagctctctcctcagccttaaatggcctctgtgtctttacccagaagtaatagcttatatttcctttctttccttttcctctcttttttttctcctttttttctttctttctttccttctttccttcttttctttctttccttcttttcttcctttctttctttctttctttccttccttctttctttccttctttccttctttctttccttctttcttt

SEQ ID NO: 31488 - DNA, 1895 bp, Mus musculus
taggacatacagggctacacagattaaccctgtctcaaaaaaacaaacaaacaacccccccctccaaaaaaaaaacaacccaaaaaagcaaacctttttaagtttaaaaggcaagcttttaaactttttttataatgttgaaattgattctgttttaggagaatgcagcagtagtatcaggtggtagtttacttattggttgcaaaattttctttgtttaatctttagctaaagattgaagattagaacttttaaaaatgcactttcaagtaagcctgattttagtgacaccaggtttgtatttttattagtgtttaataataataataatcagattatgatgtcctatattcatatgtcatggccaccagaaaaggacactcagcagccagaaggcaacttggctgataaagaccacgttttcaccttagctttatctgatattagtgattattttaattattaattaatagttaatactcaggagctaattatttctttctgactttgtattttcagaggaattcctgataagtctgaagattctgaatggcttgctcgaccatcagaagttagtgaagctttaatccaagccacctcagaaacatcttcagacttagctaacagttgctttagtatatctcagcatccacttacaggtagcacaacttttgggtctcagcactctcttttcatgtttgaacaagagaataatggagaaactgtaccatctaatgcccctgatgaactgaaaagcccgaaggactcagatcatgatgtcctgtgttcatatatgtcatggccatcagaaaaggacactcagcagccagaaggcaacttggctgataaagaccaagtttccacctcaactttatctgatattagtgatgaaagtatagctgctaaaagaaacaacagttttggtgtttcttgttcatgtaatcagtattggaaccagaaagccttacaacaaactgaagcatgtctagccagtaaggaccatgcttctttcccatgtaaaattactcctcttcctaataaagtgccatactcttttctacaacgcatgttaaaaagaggaaaagaggctcctttgatcgctgataatcatcttgagaatgtttgtttaaggactccagcagaagatgagatgagtctaaagaatgagtctttggagggttttgaaggaaatgaagatctgcagaaagaattatctcaattctttaagcaaaaggagactagaaatacttgggcatcttctcaggtgcataccagatatccagagataaagtatattgggactgttgccgtccctgatagtaaaaaacaagttgcagaaccatatattctctacagaggacttgatatctctgattgtcctcttccgacagtcaaatccaacttggatgagacatcagaacaactctattttcaagaggaaagaaaccaaaaggcagcttctacttttgatgagaaaaatgttgatgctactgaaaatgtagcctttgaggcaattattgcctcaattgagtcttccaatcaagagagtcttataagtgagactcaaacggataacactgaactgttagcagatgacagcgaagagaaagaacccctaaaaccagatctttccccattaaattgtaagaatgaaatctctttcatcgataagcttaagtacctgaaataccagtctactcctggggtgtttgaaccagcagattcaaaatcattgttgtataaagaagatgatgctagttccctatatctgtatccagatttaaaatcctccattaatgctcctcagaacatgctcaataagccggtttctgtcactctagagcttaagtcatctttaagtgaaaaagcttgcaatcaggctgttggtcttgaaa

SEQ ID NO: 31489 - DNA, 1150 bp, Mus musculus
aaatggtggttaggaattaaactcaggaagagtaaccagtaatcttacctgctgcaaatctctccattcccaacttgttcttagagaagacctgggttctatttctagtgtttacatggtgggtcataatcatctgtaactctagttccaggggatccaacagctttctctaaactctgtaccaggtgtacataacatatatgcaggcaaaacactcatacatttaaaatgaaattaaataaaaaaaattattaaacctcttgtgttcatttttatgatgaggtttggtttttagccaaccaagtgtcaaattaatagaatttttttcccccttcatttctcatttcataggtaggttgttctaatctgggcattagccaggcttctccatcttcattgccttcatttgttcctcaagaaccaaccagtgagccggaataccattcctccaatctcagaatgttgagggtatctcccgacactctgctaacaacgcatacacattcagcaggtatgtagaaaacggaggcattaactaccctttgtatctagggtgtgattattgtcttaccatgccgttctagcagttggatggattaaaggatgcccagatgtcttattttgtgtttttattactgtgataataccatggccaaaatcaacctagggagaaaagggcttatttaatctaaataactttataactgagggaagtcagggcaggaactcagtgaaactggaggcaggaactgaagcgggaaccttggaggaatgctgcttattgtcttgctcctcctggcttgctggttttttcttacatcccaggaccacttggccaggcgatagcaccatccacagcgggtgggtcctttcttcccacatcaatccttagtcaagaaaatgccccacagcttgactttatggaggcattttcttaatggaggtttccttctttcatatgaatgtagcttgtgtttagttgacaaaaaaaattagccaacacaccagataattggtaaagcagcatctacacatacctgaaaggctatctgaggaagagatttgaataagtggactgaatatggaagatctgtctcaccattgtgagtttgtccagttggttgagacctggattgaacaaaaaggtccc

SEQ ID NO: 31490 - DNA, 1107 bp, Mus musculus
tcctcttcgcatgcagagaagcctgtttccccctaccagttaaccttgccaggtagtcatctacctgaagatgttttcaaagcttcttctgtttgtaagtcatctgatgagctatctggaataacagctctaacctctgcttcctactcatataaagggagacccaatagttcttatcagcagaagtttccagacagccacctaaatgaagaggcccagaaaatcttgggtacaactggaacagtagaccagaagacagtgacaccaacaatgtcttcttcctttttacaaaaagaaaagcctagtattttctaccaacaaaccctgccagatggtggtctgtctgaagaggatctgcaggtttcagctgttccttggccagctgaccagaacattgctataccaacagtaacttctgctgctttctcacaaagagaaaagcctcggattttctaccaacagactctgtcagttgatcgtttgcctggagagcctctgaatgttttagggacttctggaccacctgaccagaacactggggcaccaacagtaactcctagttcctacttccctggagaagagtccattattttttaccaagctggctttccaggtaacactctgtctgcaatgtcttttaaagttccaaggatttctggatcaactgaacagactaacgtaacaacaggatcatcaagttcctactcagttggagagaagtccattattttctaccatcaggccttgccagatggtcgtcttcctcaagaagcttctcctgcaccagctgacctaaacactggggagccaccaatgtatttggcttcctgttctgttggagtaaagcccattattttctaccagcagcctatgtcagatagtcagcgaactaaaggtcacaaagaatcagatgttcctggaccaactgaccagaagactggcatagcaacagtgcattctacttcccaatcatatatagggaggcgcactgtttcttaccagaaagagtttccagatcttagtgaaaaggctttgaaagttctaggtgatgttggatccactgaacagaaaactcaaataccagtagtgtcttctgctctcttacac

SEQ ID NO: 31491 - DNA, 1271 bp, Mus musculus
ctgcttacacaaagagaaacacgagatttcagcttcagctttgctgaattgccagacagccgagttgctaacagttactcagaggtcctgtttacatagagaggatcctgcaatttcaactgtgatcaaaccagatgaccaaaagattccattaccaacaacttttcatggctccagtgatcaaaaagtaaaacctgttatttttgttcaaaaacagttacgagatagagatcaaagtgaagatattccgaagatttcaactgtctctgagccaactgttgtaaatacagttctaccagtacttctgcctggttcttactcacacagagagaagtcagattcattttacccacaggaactgccagatggacatctaactgaagttgatctgaaggtttcaagcggtcttggtcaagctgaccagatttctgggttacctacaggtattcctggtacttattcacacagtgaaaagcaccagcttatctcagaacatgtccaagagctgatggataacttgaattcttccgagtcgtcttgtctcagtgtggatagtatgcctctaaattcacaaatcgatgatggagttatcatatgtaagccagaatctttaggttttgccaatgctggctgtgaggaaatgcagaatatagatcgtggttcgaaaactcttaaggaaattcagactctcttgatggaagcagaaaatatggcactgaaacgatgcaatttctctgttcccttagtccctttcagagatgttaacgatgtttcatttatacgatcaaagaaggtggtttgcttcaaagaatcctccacaactgatgtttgtacccagagggaatcatttgtagaagaagttccacacattgaatatgtacagaaggacattggcacacagacgaaccttaagtaccagaggggtgttggaaattgggaatttatcagttcagctacctttagaagtcctctacaggaagcagaaggcacagctagaatggcatatgatgaaacttttaggcaatataaagctgccaggtctgtaatgaggtctgaacctgaaggctgcagtacaggcattgggaataaaatgattatccctatgatgacaatcataaagagtgactcgagtagtgatgtaagtgatggttgctgctcatgggacaacaatttaccagagtctttggaatctgtttctgatgtttttctaaacttctttccatatacttcacccaagacaagtataacagatagccgagaagaggagtggt

SEQ ID NO: 31492 - DNA, 1182 bp, Mus musculus
acttcatctctgaatgaacacagacctggaagtcctctactgtatgtgtgttaggggcctcatatcagctggtgtatgctgtctgtttggtggtccagtgtttgggagatctggggggcgggaggtccagattaattgagactgctggtcctcctacagaattgcccttctcagcttctttcagcgttccctaattcaacagcaggggtcagctgcttctgtccattggttgagtgtgtacaaataactgcatctgactttcaactgcttgttgggtctttcggagggcagtcatgatagatccctttttgtgagcattccatagcctcagtaatagtgtcaagctttggaacctccccttgagctgaatcccactttgggcctgtcgctggaccttcctttcctcaggcctctctccattccatccctgtaattctttcagacagaagcaattatgggtcacaggtgtgactgtggaaggttcgacaagctttttttgaatcacagaagcattctgaccacagaagcaaatatactatgaagctgtaccattagaaataggagatgctcacaagggcacttcagcttgttgagccttttgaatcctgtggactgtatcttgtatatcaatcccacttgggagagagaagaaagcaatcacaagtgtgtgtgtgtgtatgggggtagtggggacttgggatgggatggcaaacagagcaggcctcttcctctacacaaaaataaaattcaaaattaagatctcggcataaggcttaagcctttaaaactcctgtaggaacgtatagaggaagtacttcaagacatgggcacacatagggtttgacttcctgtggcttaggaggttacagcaagagttgatagactacatttcaagttaaaaagcttctgcagagaaaggaaatattaatcagaatgaaaagatagcatatagaatgcaagaaaatctttccatctattcatctgactggaactactatctgggaaatagtaggaactcaaaaaagtatgcatcaaaactcttatctcccaatcaataaatggaaagaatgagcaattctctaaagagtaagtacaagtgctctataagtatatggaaaaatatttggtatctttacccatcaggaaatgcaaatcagaactaggctgagattccatttcact

SEQ ID NO: 31493 - DNA, 1165 bp, Mus musculus
cagcctggtctacagagtgagttccaggcagccagggctacacagagaaaccctgtcttgaaaattaaacaaaaagaacttctggttctaccattatgattcctttatgagaagactttgtttcatgtttatctttgtgtcctctgggcatttaatatagcttctattaattgtcaaattaaacaaataaatgagtctattaattttaactaagaagtactgtttcttcagttaaattacataaaggtattagaaattaaaatgattttagaataaataataaacatatgcttgatccctttttactatatattttacaaaatgaagaatactatggaaataggttgttaacatgcgagatcactatacttacaattgcatggttacttaaatattccttgccaaagatatgagttgttttgtctttttttgttgttgttagttcacaagaacagagtaaggtttcctttactacgtcctttggaaagttatcatctgatgccatcactcagataacaacagaaagtccagaaaagaccacattttcatctgaaatttttattcatgcggatgatcgtggacagggcattctagaccccatggcccaaaagccatccaggtttgcctcatcatcctcagtgcagcaaatcccagcttctcatggcaaagacggtaagaggatataactgaattttacatcattaaaccaacctatgtgtaattatctttaaaatgttaattgtctttctcatcattaaacctaattttaatatcagcattatgctataatattactgtatccagtttttgtttgcatacctgtgaaaagaataggattttcatctttattttaaatagagttaataagagtatatgaaattcatgctgctatggctggctgactttgtccagtgatttttgtaaaaatatacttagcatgtaagaactgttggcatttggttcatagtaatatggctttaactgtgtatagtaatagcgtatttcttgcttatgaaataaccatctgagccaggtggtggtggcgcaagcctttaatcccagcacttgggaggcagaggcaggcggatttctgagttcgaggacagcctggtctataagtgagttccaggacagcgagggctacacagagaaaccctgtcttgaa

SEQ ID NO: 31494 - DNA, 1176 bp, Mus musculus
gtcaaagcttattaattactttatgattaaaaaatactcttcactgatgttatattccatatacagtaaaatttatggtattagattaggatttcatatgttgctgttatgattaagtattcttattaatgtatcctgttgtctagcctgactacagtgtgtgttatttctatacatgccttgtgtgtgtttgtatagtgccatctgacatgcctttttgccttcatggtcatatcagaagacatcccccaatccttttcccttttagtagctttcctggatagcagttatccccttaactatcactgttccactttttgtgtcatgtcttacgtcatttgcttccttgcctggtaattttaccatttattctactgtctctgattttcagtttgatttataccttctaattggcctgcaacatttcttgtcatggtgttctttccatggaagtgatctaagggaagaaaaagtctttcttgactaaaatagttcaagcctattttagtgttaattgtaatgctttctcatttttacgtaggctcaaatgatgctattgccccagactttccacctcaaatgctaggcacaagagacgatgacctctccaacactgtaaacattaagcacaaagaagggatttatagcaagagggctgcaacaaaggggaaaaacccctctcagaaaggtgatgcaggtaatgagtgaccttgcgtgttttcaaatttgtttcttgaacctttgcatttgaagtgagaatagtgttgtatttatccatattctggtttgtcagaaaatgagaccctgagtttaatccctacaacggaaaaaaaaaaaaaaaaaagatgaaaagagaaataaaaaaaaaacaaaacgttaaaaactgaaaggaataatttacctgacaaagatcctaaagaattaaactttaagtgtatttcaacattcgtgtgtgtgtgtgtgtgtgtgtgtatacacacacacacacacacacacacacacacacaacaacacacacatactgacaagagaaactgatatgcgtgtcacatctgataggtaaacctccttactgctacattaagtaacacaggaaagtgaaattttagaatatttaaaatacttcagagaggttggaaaactgcaaacttcattctcaacataaataaaatgtat

SEQ ID NO: 31495 - DNA, 1206 bp, Mus musculus
aattaagagcctcagcatcaacttgaatttgggagagcatgagaaaatacatactatcaagaatcaggccagagacccaaaaggcaaaagacaagcaaatgagcaaaagaaggatcagaaggtcaccccagagctaacaactgagtgccccgtgagtttgaatgaactctggaacagataccaggagcgacagaagcagcagaatccatctggtgcttgtgatacgaaagagctctccttggtggaacgacttgatcgcttggctaaactgcttcagaatcccatcacacattcactccgggcctcagaaagtgcacaggatgatagcagagggggacatagagccagggagtggactgggaggaggcaacaaaaacagaaaggcaagcaacacaggaagtggagtaagagcctagagaggggccagagtacaggggactttaggaaaagcaaagtgttttctcctcatcaaggtgggaaatccagtcagttcaagattgagcagattaaactagataagtacatcctgaggaaagagccaggttttaataatgtcagcaatacctccttggattctagaccctcagaggaaagcgtgtctctcacagatagtcccaacattttttctagcacggattctcctgtggactcagatgtattgaccccaactgatagggacatgcctttaaatgagaggagcagctccatatccaccattgacacagtccggttgatccaggcttttggccaagatagactgtctttgtcgcccaggcgaattaaattatacagtactgtcactagtcaacggaggagatatctggagcagccatgcaagcacaacaggaaggcattgaacacagcctgtccccaaatgacttctgagcacagcagaaggaggcacatccaggtacacggctacaaattccaactggcaatgtgactgcctttttttgaggacgttttagttaatctcttcacaacaggtggaagaaaacagccatttgccctttcctcactacctctaacgtttctccgagctggaaaagagtgagaaagtgtagtccagtgctatcgtttgttgtcattctttccaccaacacacccctgccagccacgctttgcactatatgttttcagggtctgtgaagtaaaaggaagcccctgacatggggagctgggagctaagcatggcttctgtttggc

SEQ ID NO: 31496 - DNA, 1176 bp, Mus musculus
gggagatgctctgtccattgaagtagggaaaatggattttatatttattcaagttttcaaattttctatttttgtattacataaaaatggtaagtaaaataatttataaataaatatctattttggcaatttgttctcaaaaatattttgtcagtaggactgcatggagatcacaatactagagggaaggagataggagatgaagtttctcatgatcaatatttcccacaattgagattttggtagatatgaattgacagggattatgtgtgttaatagtggtttttaagtaataaaaaactggaaacaatgctggaaagaggggaaaggatcctgcttaaagatttatgtatggccaaataatgcaaagttcatacttcgagatgagcatcatggtacagatctgtactcaaagtactcagaagctgagacctagctccagaggtcagatggttttctccccccccccccaattaaacaattaagtaacatttggggcttatactaatcatccatactctgcccttcccctatcctctgggagtcaataatttgcttctgtctctggggacttgtctgttctggttatttcatataaacacaatcgtataatatatgattcttgtcaggctcccctgtccccagggattgaacataggacaactccttttgaggcagttctaccattaagctgcagttctaccctctttacattttttttcaaggctcacctatgccaaagcacaaacagtacttgagtttttcctgttgtatatatatgacacactttttaaaaatctattcacaaatccaatgatagacacttgggcacttgcaatgcttcagctattgtgaatggggctgatcctggaatccctgtatgcagttctttgaggtacacccaagaatggaaataacaaatcatgtggtaattgtgtcttactgagaaactgaccaactggtgagaccgcagtgcctgtccttttatgctttggccagcagtgattcctgagggcccctgcgggcctcactgctcttttgtggctgcttatttatcttgttgttgttggttgttttggtttttgttttgtttttgaatgttatctactagctatactattgagtataaggtggtttctcgctgtggtttatttacatgcctaccggacatcctgt

SEQ ID NO: 31497 - DNA, 1231 bp, Mus musculus
aataggggctcaccatctgtcttgattaagcctgccagccttgcttccggtctgctccatgatacatctgtctttctcctcaggtaacttggagattgtggctggtgtcaaaaaatacactcaggatgttggggtgactttcccaactcccagttctagtgaggccagattggaagaggacagtgatgtgacttcttcgtcagaagaaaaagccaaagagaaaaagtttctttccaattatctgcagaccaaaaacttaaggaagaacaagccaaatccctgtgcaggtcggtttctaactccaggtagccggaaactagtaaaagacgtgtctgagtctgtggaaagctctttgtactccaccagctgccagctaccacattcgaaaagtttgaaagtaactagaactttatgtagagtcttctgtagttgagaccagtttatgggcaccctaaagattgtcacccccaaccgatgagtcccatgcaagtcagtattacatacatttctttgatgtaattgggtgcagttattaaaatgtttgttcttgaaaatatttcctgtaggagtctcatggtttgttcctgtggaaagtggacaatcaggatctaagaaggaaaacctgcccaagatttacagacctgttatctcctggtttgaaccagtaaccaaaaccaaaccctggagggagccactgagggaacaaaactggcaggcccaatgcatgaacagtcgtgggtccctgggaggcccaggcagggatagtggccaggtttctcttcggccatttgtgagagcaactctgcaggtaggcacagtgacatgaggttgactttagccatatgtgtttgtggggtgtgtggctggcatgctggggtctagtcattccaccgtcctcagcatctgtggactgggaggagaggaagggctctgttgctgtgtgcaggctccccgtgtacagatcaggccgagtgtttgggtcactgtgcagagtaaaccaagcgctcatccctgagctctgcccccttggtggttaaaggaaatatttaatgaggaatttgtttgaagtgaatgaattgacctcttgtctcatcaacatttggaagagttgcaggtgaccccactttggttctcagcttttcctaaaggtgtttctgggcttcctttgatctccctgggtgtgccctcccctcaggctccctagacctgtggtataggtgctggttttttt

SEQ ID NO: 31498 - DNA, 1155 bp, Mus musculus
acctatgccaaagcacaaacagtacttgagtttttcctgttgtatatatatgacacactttttaaaaatctatttagaaatccaatgatagacacttgggcacttgcaatgcttcagctattgtgaatggggctgatcctggaatccccgtatgcagttctttgaggtgcacccaagaatggaaataacaaatcatgtggtaattgtgtcttactgagaaactgaccaactggcgagaccgcagtgcctgtccttttatgctttggccagcagtgattcctgagggctcctgcgggcctcactgctcttttctggctgttatttatcttgttgttgttggttgttttggtttttgttttgtttttgaatgttatctactagctatactattgagtataaggtggtttctcgctgtggtttatttacatgcctactggacattctgtgtgcattttaaccatttgtataacttgtttttaagtcctttgacctttagaaatttagctgcttgactttttgttttgtagttgttggacttttctatatggtagtcccttactaaatgtatatataatctgaaaatacatcttgccactctgtaggctgcctctcacacaatcactttgttgattgtgtcttttgacatatagcagatttaatagttcagcattgctttctgttacccatgtcttggggagatcataaccaggaaattgttgtcagatctaatgtcataagattcttgtctttttaatctagcttttatatttaggaattcagtctactaatggcatatagaaaaggtctactttcattcttcggcatgtttgtgtatagttctggcaagatcatttctttagacttttctccatttgttccttggcactgtcgttagaaatcttgatcgtgtgtgtgtatgtgtgtccacattggggcactcagttctgtcctattggtttcttttccttatcatgccagcaccatagtttggattcagttatcttcatcgtaagttttgacagcacgaaccgccgtgttttcaagattgttttgaccagagtccctttagaggacttgtaaatatctacttgtaaatatcttatttgttctaatgattttgtaactataaaatttaacttcatttttggattattt

SEQ ID NO: 31499 - DNA, 1412 bp, Mus musculus
gaatataaaagaaaaaaggggaggagaggccgcgaccgggcagagaccgccggagtcgccgccggagaggagtcgactcgccagccgccgccagcgaggcccgcccacccgtttgtctggccctctgccccgttcaccatgcagcctgcttctgcaaagtggtacgatcgaagggactatgtattcattgaattttgtgttgaagacagtaaagatgttaatgtaaactttgaaaaatccaaacttactttcagttgtcttggaggaagcgataattttaagcatttaaatgaaattgatctttttcattgtatcgatccaaatgattccaagcataaaagaacagacagatcgattttatgttgtttgcgaaaaggagaatccggccagtcatggcctaggttaacaaaggaaagggcaaagcttaattggctcagtgtggacttcaataattggaaagactgggaggatgactcagatgaagacatgtcgaattttgaccgtttctctgagatgatggatcacatgggtggtgatgaggatgtagatttaccagaagtagatggagcagatgatgattcacaagacagtgatgatgaaaagatgccagatctggagtaagggctgttgtcatcgcctggattttgagaaaggaaaataacttctgcaagatttcacaattgagaaaacccctgagtcgatagctctaaaggcagatatgctgtacttgcctcctctaacccagttgtcaacctttttttttctttttctttttttttcttttttttttttttttgaaaggcttcactaagggttgattatgtaccattgtgtggggcgatttaagtcagctaaggcagtatccttatgcatgaacatttcccaggattccatgaggcagctgatcctaggcaactgctccagcagctcggacaaataattgcatttcatctaagtctttcatcataacacaattacttacacattaggaaagctctcagcttagggaaagatgaaagttttagatcctagaccatggatttaaaggaggcggaaacaaattggctaataccttaaactgataccctgccattctttcaggatacctttcaaaattattccactaaagtttatttttcaaaaaaaaaaaatgtactttacatcattgtatgtgatcacttgtcagtgttcaggtgtattttagcaaaaactagtggatgccctaacttagatggtttttgaagcctatacatttggtattgtttggcccttaagcttttacatctcttagcatggaggacaaagaaagctgtacattgttgcttgagagtatgtacattttagaccagatttgtatttgcacagtcagtatggcaaatgagtggacaatgttaaatacactattggatttt

SEQ ID NO: 31500 - DNA, 1873 bp, Mus musculus
ctgagtttgaggccagcctggtctacagagtgagttccaggacagccagggctacacggagaaaccctgtctcgaaaaaccaaaaaaaaaaaaaaattaactctaagccaggtgtggtgactcattacagtccactgctcaggaggctgaggcaggagaaagctgcaagtttgaggtcagcttgggatatgccacaaattccagatcagcctaaagtactatgtcaaatcctatctcaataaatagcaattcatttaactctcttagctgctttttaggtagatatgtctttgtgcccactttatacaagaggcagctaaaagagtatagcagtattaactgactagcccagggtcatgtaactagtataaaaccatgtttgatggttccttttccccctcactttatcttgtattggattgtatccatcaagataggcttggtcaagggttagcaaagctctgtgaagagccagataagtactttgctcctcaaaggccgcctcatctggttcctgctacaattactcaatatgacctttgcagtctgaaagcagccacagaggacaggtacagagtgagtggcctctgtccagtgagccttgacttgaacaagcagtgggcagccctggagttgagactgtagactccagagttggctaggacatagtgacagtcaaaccctaaagctcactggcttagtacagcagaaggaaacattttgttatcttgaaggcagaagggatcagagggaaacccacagcagggctttagagccctctgcgggggcttctcagcctgggcttctaggttactgtgcagcttgtcagaagctctggggagggcagagaaacctaaaagcatccacatggaagtggcaggtattgctcacctcttttcattcacacaagttcaaaaatggtgaccccttgttcttcccacaagcacagtcagttctgcccctccagtcccctctaaagcgccaagtctgcaaagccaggtgctctcatagtgcagttctggggttgttctctgggtaccttatggtggtttgaatatgtttggcccagggagtggcactatttagagatgaggcctttttggagttggtaagaccttggcagaaatgtgtcattgtgggcatgggctttaagagaccctccctccttctagccgtgtgggagccagttttctcttagcggccttcagatgaagatgtagaactctcagatcctcctgcaccatgcctgcctggacactgccatgctcctgtcttgatgataacagactgaacctctgaacctgtaagccagcccgattaaatgttgttcttataagagttgccttggttattatgtctgtttgcagcagtcaaaccctaactaagacataccccacaccccaaattcctttctgagtcacacctcttgaatgttcagacaagcctgctccatggaggtgaggcagaggatgatacagaacaaagaataagtgactcttgcacacttgcccaagattgtccaaaatgaaagaaatcttgatgcctcttctcactattgtgtgtgtgtgtgtgtgtgtgtgtgtgtgtgtgtgtgtgtgtgtgtgtgtttgtgtgtgtgtgcaagttctcagtgtccctgcctcatatggactgttacagggaccccacattgagtgtgcagctgggatgttagctcaagggatgcagatttctaggatggatactgctgggcttagtgtggagaagatctcacagaagccagagaaggctgaccttggtgatgacagacagaaacatattacggtgaccatcaaagccagccagggtcaaggagagccacatggcaagaaagggtgagggatatagtcctagt

SEQ ID NO: 31501 - DNA, 1855 bp, Mus musculus
tgtactttgtgtacactgtgctaaaatactacttcaggttctgtgccaccatgtcaagtagcacagtatgacagtacctttttgcagggaaggatacaccctgtcttatctttgcaaatgtgtctttaaaatcccaaactaaatctttaatctcagcacttgggaggccgaggcagacagatctccagacctgcttggtctacagagggagatccaggacggccagagctacctagagaaaacttagcatgaaaatgcaaaaaaaacattcccagccaagtgggacgcattgactggtcacacgtggtacctctggcctttcttttatttatttatttatttatatatgaaaccccactttcaactaaagggggatgggacacactaggccatggcatcaggctccttgagctgcttgccagagagtgaggtggataatctactccccctgcagaggacaggaggcgcctagcaagcagacgacgttcttcctgttctgctgtagatcacttgtacagtttcattaatgagcttccagagaaagtccagactgagactgtcatgccagggagcctggcgtgttcttggcttactgaagcagggcagcatattgtatcacgtggctttgctgtttcctgcttaagacctttcctcaccattctgtatgtatgtgtacgtcaaagaaaacaccagtgacttagttcttaatcctcgcctcaagacctgcttcctggaggacctcaagtgtcttatggatctggcagccatgcactcttaatggtttgaccttacacatgaatgatatacctggtctcttcctgacttgacataccacaaaaacttggagcatttgaaaataccattatcagttatttcgacataacaatttatcaataattaaggtttcatttgaggttatatttgcatgacatgggggtaaattttagaatctggattaagattatattcactttaacagtgaggacagctatgactgtttatgcaagtcccatgtctcagcataacaccctgtcatgcattctgaactaacttccatatgctatatagtggtctcccttaattctggaggaaggagggtcattagctctgaaataacttttttttaaaagaaaagaaactacaacaaattcctctctaggataggcttttgtgcaccctgaccaaggaatttaccgcagccccagactccacccttccagctttctctgggtcacagcccctcccatcagcccagcccctggcagctactgatacagttttcctcttaccatctctaaaatgctgtgcaggtgaaattaggatgtgggcttctgagtggggtttcttgtttggctactggctttaaggtctgtgttacaaaatggatcgacaggtctcgcttccctctgttgctgagttgctcttgtatatggttgtctcacactttgcttaatcatcaaccagttaaaagatatttaggttttctgtaggggttttttaatttaaattttaaatataaattttttatatagcattttatgtaaacatctttccttccccctccccttggagtggaatgctgccgtgtatgtttaactttataataaattatcaaactttgccaaacaggtgtactatcttgtattctaccaacaagaaatagcaattaattgtgtgtgtgtgtgtgtgtctgtgtgtgtgtgtgtgtgtgtgtgtgtgtgtgtgtgtgtgtgtgtgtgtgtaaggtattctcagaagtcactgtctactttgggactttttttgttttaattggttgattgggttgggtttttgttgttggtattttgtttgtttgtttatggttggttggttt

SEQ ID NO: 31502 - DNA, 2587 bp, Mus musculus
tgtagattttaaaggttgaacagacatccttggatatctgggaaagctgagggttatactgactccgaggacctcaattcaggatctctgtccactggcctcccacactagaatggtgctctttctctaggacacacttcaggctacatggaggtgctaattacttgtccttagaactcactcaggaagttgctcctcataacacatcaagtccacagcaagtttttgctatgcacagtagttttctctctcatgtatgaacatgtggagggaacttttccctaatgaagtcccggcagatcatgtattccagcttgcagctaattttgcccaaactttagtcaagttgctctgcactccagtgatggctttttctctacccatcacattaacagattcaaagtgcttcttgttgtgagacccccccactccacccccgaggaattcttccccagaatatactgggtcagtgtattgtccagtgtaagaaactggaacagacagttaggaaccaaaagaggacaaagctgggacaggtacagaatgcacccagtctggacggtgcaaagaacacattgacaagcagcctctggaggacactgccaggtagggtcactgcgtgagttctgccacggttaggagttgttcctgccacctgccctgttcctctaccaggaattggattgccaacacctagtgaaaaccacctttatcattggataactcataactaactttcattcttacacactcgtctggcttctgtccatgtcacacaatacaaaggcctagtggaaggacacttcttttttaaagtttctagtggtctatttagtattcttaagttatattttactttagaaacatacatgaatattttctcaggtagctttcctgaaattcccatggaaaggcaccctgcatgtttcttgattgtcagtctcagaggtagcccgcctaaggatttcttatgctatgtattttcctcctttttttttttttaaatactcttacagatcaccattgcttcattttccaatttatgataacatgcgttgatgaattcttcctttggcaaatgaggatttagctctcagcctacccactcactccacagccctttgcagcctttgatgaagttactagataagtgtggtcatcacgcgcgtcgtgttcatggctgtgggttctttctggccttcctctttccttaacgtttttgcctcattcatttggccattttctgttgattatgtcacaaattcatcttctccatctgatagcattataaaccgtctcagtgaatgatgcgccctttgatttgactccttttctggagcttctttaaatgccccagtcaggtgccaggtctcgttggtagggctgccatgctagagtaccacagactgagggagaacatctataggaactttttgtgtctcatagttttagaagctgggaaggatagagtcagcaagaatttcttcttgtagatgactggtacttcactgtcttcttgcggtcttctgtgtcttaacatctcctccactcgtccctccccccctttccttttttcccttatgatacgctgagatgcatcgccagctctgtcttctcaaagatgccaggtcattagactcagactcactgtggagacctcatttgcctcttgaaagactccccaaatgcggtgatatttcagatactggggcttagaactttaccagcaatttgaggaaacacaactgtccataggaggcaaactggctgttccttacacgtggggcaaagctcccatctgagctctcttccctcttgtcatttatttcttagaacctgggtcccagggttctacttccatgactataatttcccatttgctcattatgtccttcagcagcctctcagggctgggagggtgtaacagccgagccacagaagtggatctgtttgcttctctgctcctgtcctttgatgagcagtaggtaggcacttttcagagtcctagttcatggtgttcagacggttgctgttggctgttgaaaccctgtctcctaatctcagatctttgggacctgtaattcttctcttgaagtcttagggtctttatctcacatgtcatagtgtattttctatccaccatgacatataccagctgagtcctttcaatatggcaaattgtaagaagtttttatttaatgctattatattagcattaatccctaaccctagtgcagcttctagtaggatgttggacttctttcctgaaattacatctgatttaattatctgtttttatttttatttaaccttttcgtgttactatctagcacttttcttctgatacattggggttgtagatgctgggattgaccagggccttgagcatgccaggcatgtactctgtaattgagctgtgcctccagccttcttcagacctatatatgtcatttgtataaacataataaaaatacaaaagataaagcattttctgatatttaagtatgttacatgattttttaaaaacagacacagggcttcagtatattccgcaggctagctttgaactccagggctccagcagtca

SEQ ID NO: 31503 - DNA, 1223 bp, Mus musculus
gctagatcctggaacactcagtggaaggaaaaagccaactcctgagagctgtcctctgatagaaggtggactctgctggccaggaagagagccttaccaacacagaggcctccagcacttgaactcaaacttgttgcctctagaagaaagagaaagtgaatttctcttgtgtaagccaggaaatcaacagttttctttgagcagcctaagctaagatactgcctcatgtagaacttgttagaaaaaagaaaagatgagaaaatactgttagctttatttcattcaaaacatttatgtggatctttcaaagaaaaggccctttgaattatttaattttataaaatcaagtaaacagatccccgccagatcgccgccatcatggacacgagtcgcgtgcagcccatcaagctggctagggtaaccaaagtgctgggcaggaccggttcgcagggacagtgcacgcaggtgcgagtggaattcatggatgacaccagccgctctatcatccgaaatgtcaaaggccccgttcgagagggtgacgtgctcaccctattggagtcagaaagagaagctcgaaggttgcgttaatcttgcagctgggttctggatatccactacttagcccacggaatgatctgcaactgttaaataaagcatttatattaaaaaaaaatcaagtaaatacacgttacttaacatctaacatcgtgtgtcagccatgctatgctgagctctgagggtgtggacataagcaagatggccttgggagctgataccacaacctagtgagagaatgaaaatatttttgcttcactatattttatatagtgaataaaatggcaaatagtgagagaacccatgtataaaaatgagaaccctgtagctaagacggactggaaggcctgggaagatagaagaagacattcaaggagctgagtaagcagaggtcttctgggtcgcagaccatagactcttgtgttgagtagagatgttcagtttttctccctagagctatctcctgggacaaagacatgtggagctgcagtcgcaaatggttcatattcaagagactgtgtgctagctccattctgttgctgtgataaaatattcagacaaaaagcaatttagggaagaaagggctgttcagattacaattccagcttgcagtccatcattgagaatttaagataaaactcaagtggccagtcatataacgacagtca

SEQ ID NO: 31504 - DNA, 1593 bp, Mus musculus
tcagtgcttagtctgagccttcccagtggcaccttctgtttgaaccaagagagtgttagacttagtactggcagagacgatctgtatcgagcctgtagcccaaggcctggcatgggaccaatactcagacaacagaagccagcctctcagccttctctctcttctcatcacaggaccgcctggcccgctgcaccatgcattgcaatgacaaagccaaagactcaatggatgcaggaactaaggagcttcaggtgaagcgacagctagacagctgtgtgaccaagtgtgtggatgaccacatgcacctcatcccaacaatgaccaagaagatgaaggagtctctgtcatccatagggaaataaaattgtttgccagtgaccatcgggactgcgggcaggctatttaaaaggaagaatggaagtttaatatgttaagcaacgtttacgaatgaggaaaacttagacacagcaagttccaggcaaatgctgctcactgctggacactagtccctttacattcggatcttagaaggtgaagtaggaagaagctggtgctaagatttggatcacagatagctcagaggagaagtctagatcctaaatattcatatgcaagtgtctgtactgtagtagagatcaaccttgtaccaagagctgagcttcttactacaaacatccaggctggcagctctcttcaacctgctggtaaaatctgaggatcggtgcatctcctcagagaagcttgacaaatcctgttgaccagaagtatcatcacaccaccttgcatatgctgggaaacaaaacccagtaggctaggaattcagaggaaaggatttccttttcaaatctatattttgcttagttttgtcttatatgcagggcacactggatttatgatacaggagggaaagtggtttgagtcacttctaaaggttcctagtattatgtaccgtcaagatgggaatgtccatttcttcaaattctgttactctagaagcccctgaagaatccggacagtgtcacacagtgaacatgggaaacagccttctttactgacttgtgcagcaaagtgacacatccttatgaaaagcaagggggtaggctgtcactcacatgccagtcgctaagaataagcagtaactaggaattattgagaagtgcaaacccagtattaatcagctctgaatctacagagccttatagcaacaagaaagccagaaactgagcaacttgggccacagatgggtaggaccactgtagaacaagagaggcacacactttcttgccaaatgccatttttgcctgggtggtttttattttttattttctttgcagtgcagtgttgctggcccaacatagcaccttatcttttggataagtactatgttgtatttataccaattaattacttgaaacagtgatacatctgtctttttgctgtgtcaagcctgcaatatattttccaagtggtttggtttttaaataaagtttcattgtctccacctttttcttatgggtagtgatatatcagtaaatgggaaacaccaagaggaaggcagagagcatcataacttgaaagctgttaatgttgaaa

SEQ ID NO: 31505 - DNA, 1588 bp, Mus musculus
tgaggccccgtgcatgctgggcaagtgttcccctcttgagctgagctatatccctagccctcctttgtggtttttcttttgagactgggtctcactaagttgtccaggtggaatcctcctgcctcagtctccggagagcctgggatttgattccaggccctccacatgaggcgtggctggataactggggaaacattggattttcccaggcttgtctggttttaagagtcacctggaacttcataaacatctgggttaggtcattgggctggtgtgggcctgggtttgtttagattgtaatcttttcttgtctctcttttcttctttgggggatgttacaactagggtcttagtctgcaccccaggctggaactcattatgcagcccaggctggtcttgaaatcacagcaatcctcctgtctcagcctcctatgtgctggaatacagatgtttcccagttcctggcagtttatactcttttgatgagaatgttctcaaagcctgaagtcctgactttaagaatgtgacttttgattgcttctgcctcggctttatcagggatagattcagagatagaagcagagatagcctgtgatttggaaccaaatatataaactattaacttgagaaactatttaatatataaactattaacttgaggaggtctgtttttctatactgtggggattgaacccaggaccccgagtatcccagacaaatgctctaccactgagctacattgccagcctcaagagcttcaggatcgacatccagagaatggaatttcctaggttgaagatggggtcttggctctaaagctttgtcaagatcaagttcctcgcatgcagccaagggtgagcaggtcctgggtgtcagatagagagctttgagtgccttaaaagtgctaagcaacacaaatcaaaaccacagcagaccggtgccagaggtgactggctgctcgatggttaatcagctgtggtctccaagggaacgaacactagagcagaggcggcctgagtgagcccagagcagttggccttagaaccaggtcttcatggctgcgtgagttcagagggacgcgtatcagatgctgggcatgcgcagtgaggggccgttgctgaaatcttaatacagtggcgctcagttgtagctgcacatgggagtcagatttctcttacgtagacaagctcaagaaatctggtgtttagtccactgctcataggtctccagtgactatcatagccactagtattaagagggaaaaaaagtaattttgcctgctttggtggtacttgcctgtcatccatacctttgtgacaaagcgagaggatcaaaagttcagagccagcctgggctgtggcaacaccctatctcaaggaataaaaatcaaaactcttcaccaggttatagcgttgcttcaataaagcggtcttaaaaagcctgattcttaaaaattatttttccctactctagctgtaggaattaataatgtgtggagaaagcagcggtgatatatttgatatggtgacagaaattaaattcatagtttaatcagaaggttggcttttttctaattcatttagagaca

SEQ ID NO: 31506 - DNA, 2161 bp, Mus musculus
tttgtcctgccttatgaaatatctgtaaaatattcttaaatgaaaaaaaatgatgttcacttagattgaaaacttttctcagatggaccgataattgcattcatcttgtttttataagagaaggtgcctcaaggattccctgttggatttgtttaaaaggactttttatcttctgtgataacctttgccatgtaccaggaactaggaaaacaagaaacttgttctaaagagatctgcaatgtgataagtcctcgccgcatcagtctcgtgcgtcagcatttatgtttacacgcattgttgtctaagatacttcagcaagtcatgttgtgcagttagcaaactttgtatgtcatttcctcctacaggtgtcatgaagagttgacgtaagacagattttacatttgcatgtgaatatcacatacatactttggtagtctttgatacaaactcatctgctcttctttttcaagcattttgagacacaaagttgtatgtaaaggaatatattaattagattttttttagttagatttactttaaaaagtaaatccactttaatgtgtacaaatgatagctgtgaaactgtagagtttttctctgtcaggcttgggattcactaagaactccaaaactagcctgaaggaccagccgggcaaaacattttttaaatattcagaggccaaaatatgagcaaacaaataaaaaaactcttaaaagtcctacctccttaaacagccttcaaggcaaagcccctgcgcacaggcatggctttggtcttggtccctggtctcttggagcccccatagtactattgaggtttactcttcactggcgttgttctagccttggggttcctaatatatttcagagtctcttggtttggtgtggttttagtgatgaccacaccttctcctcacagtagagaggaaggagccctgtgcactgtgggtttgaggcctgcagagagctcccagcattttacttgggcctatggaattggaagcatttcctggcctgtatctttcaggtaggagcacacaactctaacctgttttctaagccagtccccttgtacaacagagcccaggaagacagtctcaaatgtgtgcttctctggagctcaattctatgcagttgtgctaatgtttcattaagtcactgtgtatttttaagtactaaaacattgaaatttgctttatggaagatgaataaattttttaaatacttggaattttatttctttgtaaacttctacagatcaggacagacaataaaagcagcttaaataaaatactaaaaacaaaaagacaaaacccacacaccaggatgctatctttaagtttttctggatttgtctctattttagcatccttagtatatgtctttgtttaagaattttacttcctttgtaactttaggctgcaggatcttttgggcacaagtaatttattgtgtgcaaaagtgtagtttctctcttcttttgactctttcaagtactaaggacttttattagtagcatattcttattgcacagatcttaaaattcatgttgatttgctgttaagaaggtggtggtgctgtgttcctgatgaaagactgacatatcaggaacatagctgttgttagtttaaataaatcatttaagtcatttctcaacctaaaaaacttcatcctggtataagtatcaggtaaggaaatgaaggtttttaaagtgaacttccttgcaatatgcattcaggttttattctctggtactgtaaagaacctgagtgactctcagtgggtcatggagccagtattctttatcctgactgtttggatattaaaattcctttatgttttatatgacctgtggggtcttcttgcagtgattattgtgtgtgagatttttcccccggcgctggcgtattcatattatattgttaacactcaggttcaccttatcccagaagccatggtctgcatgggttccagaggatctgcactctgcagacttagccaactgtgaagtcagagtttggtcttcctggtgtaaaggagactccccgtctagattgtccttctcttgcttttccctgtgctcatcttccttttagatttgtgctagaggtccctttcattgtcaggggactagattacatctacagaaggagtagacaga

SEQ ID NO: 31507 - DNA, 1853 bp, Mus musculus
taacgagcccaactcccgaacgccgcccgccgctcgccatggacgccggtgtgactgaaagcggactcaacgtgactctcaccattcggctgctgatgcacggaaaggaagtaggcagcatcatcgggaagaaaggggagtcggtgaagaggatccgcgaggagagcggcgcgcggatcaacatctcggaggggaactgcccggagaggatcatcacgctgactgggcctaccaatgccatctttaaggccttcgccatgatcatcgacaagctggaggaagatatcaacagctccatgaccaacagtacggcggccagcaggcccccggtcacacttcggctggtcgtgcccgccacccagtgtggctccctgatcggcaagggcggctgcaagatcaaggagatccgcgagagcaccggggcccaggtccaggtggcgggggatatgctgcccaactcgaccgagcgggctatcactatcgccggcgtgccgcagtccgtcaccgagtgtgtgaagcagatctgcctggtcatgctggagacgctctcccagtctccacaggggagagtcatgaccatcccgtaccagcccatgccggccagctcgccagtcatctgcgcgggcggccaagatcgctgcagcgacgcggcgggctacccccacgccacccacgacctggagggaccacctctagacgcctactcgattcaaggacaacacaccatttctccgctggatctggccaagctgaaccaggtggcaagacaacagtctcactttgccatgatgcacggcgggacgggattcgccggaattgactccagctctccagaggtgaaaggctattgggcaagtttggatgcatctactcaaaccacccatgaactcaccattccaaataacttaatcggctgcataatcgggcgccaaggcgccaacatcaatgagatccgccagatgtccggggcccagatcaaaattgccaacccggtggaaggctcttctggaaggcaggtcactattactggctcggctgccagtattagcctggcccagtatctaatcaatgccaggctttcctctgagaaggggatggggtgcagctagaacagcgtaggttcgctcgtaacccccttcctgctgtttcccatgatccaactgtgtaatttctggtcggtaattccaggttttaaataatttgtaagtgttcagtttctacactttatcatccgctaagaatttaaagaaaaatcacattctctgttcagccgttaatgctgggatccatatttagttttataagcttttccctgtttttagtttcgtttgggtttttttggctcatggattttattttctgtttgtcgataagaaatgtaagagtggaatgttaataaatttcagtttagttctgtaatgtcaagaatttaagaattaaacaaatggattggttaaaaatgcttcgtatttgaaagctgggaattcctatcttaaattcttcggttgctgctttctttcccttccctgttttaagtatggggtgcttggcggccagggggagaagggtggcccgcccttgttccttgcaagcttttcttgccttatcgctgagattcccctccctctgccccaacaaaggaacggcaggttgggcctgctttgggatgtttacaaaagatgggtctcttcctgggagtgacatatccaacctagttccagagaggcctctgcctttttctctggtggaagatacaggtttttctcgggtggaaaaactgcccgttcagcaggacagggtggatggagagcgtctagcccgttgtccgctacccccatcccgcggggcaaact

SEQ ID NO: 31508 - DNA, 1134 bp, Mus musculus
tagaaaagtatcaaactcaggacctcccagctaatctattttttgtctcaggacatttatttgaattaccttagacccttgactttgttgggttaagagacttttgtccccacttattcttaaatgtttgcatctatgggtttgagaagggatgggatgattcttcactcaattccctgagatttgggtgggagctgagtgggtagggaccacaattttctctctctgatccagcaagtatagtacagctatttaaatttgctaacatgtagtgttctgttttgttctaaaaacagtttcaactttttcttttcacccttcagttttatccaccttttcttttgttattgttattttcttttattgttgttttgaaataaggtctcacgatatctggcttaaaattgtagtcttcatacctttgtctctctctgaagtgctgtaatctcactaaactgcttctttatttatttcttacttatttttgagatggacaaggtctcattatgtagttctggctggcctggaacttgctatgtagatctgactggccttgaactcacagatattcatctgcttttgcctccaggatgctgggattaaaatcctgtgctaatatgtcacattcacttttatttgtttgaagatttatttgtagctgggcagtgatcgtatctggcctctaatcctatcacttggaaggcagaggcaagtggatctcttagtttgaggccagcctggtctacagagtgagttccaggaccacaagagctacacagagaaaccctgtcttaactaccccccccccccccaaaaaaaaacccagcacatctttatttgtatatgtacatgtttgtgtgtgtgtgaatgtatgctcacatatgttccagtgtttgcagaggccaaaacaggctgttagatctcctgtagctggagttactgattttttttttttttgggttattccagacaaggtttctctgtgtagccctggtctgaactcactctgtagaccaggctggcctcgaactcagaaatccacctgcctttgcctcccaagtgctgggattaaatagttacagatttttatgagcctctcacagtggatactggatccaaactcttgtcctctga

SEQ ID NO: 31509 - DNA, 1932 bp, Mus musculus
gaggagctggctctgccagctttagtccttagtgccaccctgtgacccaggagctaaacattgaggaagatagaagtaacaagcgcatgcaggcagctaatgggctggctggatgggtgcagctgtggcgagtgcttcatcctgtgctgcttcctcatgcttattttatccaacagctcaacttactaatgttataagatggggctatctagttgtcatcaaactcactaatgtatttgtcttgtaggagcaagtggtgatgaacttggacagcagacttctgatcttccctctgtacatctgctgtaacttcttgtatatatcaccagaaaaaagaactgagagtaatcgtcacccagaaaacccaggacactgaggcactcatcagtggccagttttaacttaatgacctactgcgttcacgtccaaggtgactaacagtgaccggccttatgaactgtgggaccctggagatgtcctcaccctcattacatttctatgcacatatgaaaaagttttttaaaactgagaaagcatctgtcaaaccatgttaaaaggatatcaactcttgctttaatttagtagcagtaaaaattgctgtaggtaaatttctcatttctttgcaacaagatatagatttaattttgagcttgaatttcgatcctatctaatgttagtgagtttactcatctgtaaatgtgttcctgttttgttaagagaatgctaaggacggagtttaagtggccaatcataaatgctctttcaattggtgcctttaaagctgtcctttcatttgttcagccacctggtgaagtcttgtgttcagttgagatcctttccagaatcttcttcgttttagccatcagatcccttgtcatggtttgggagattaagcttaagagttggttttgtttcgtttttcttttttctttttttattctaaatataagcattttcatatttttttaaactttaactttcctacagttttaaatgacaacaagaatcagcttgaggacttgaaataaacttgaataagggaaatcagtttgattctgaggatattccttcgccttacgtgcatggtcttgtctggcattctgtgtactcttatgttatgaattatttatgtacagatacatcgtcacacattttcatattctctgatagttggaatttatgtcaaattttagttgggaatcttgtttcctattaagctcaggactttataccctctgaactgagtgcctttgagtcacatacataagtagatttcatggtgaatgtacagggggagctgggaacaaaacagtcgtgttagaacaacttaccttgtcaagaataagatgtatgctcatcccgatctgtatgtgttggtcccttgtgtttattgctattgaaaatagcctggatcattgtcctccagtcagagtaagtgtttttgtggttgatgtatgtttttagtatttttttaaattggaatcatttttatgtatctgttcaaataataaatgctcatttggaaaaggaatatgctcctgtttaaagtgaacttaaaaagcttattgaaactagtttttttagttttggggttttttcaagatagggtttcaagatagccttggctgtcctggaactcactctgtagaccaggctggctttgagatccacctgcctctgcctctcgagtgctggaattaaaggggtgtgccactatcacctggctgaaactaggattctttttttttccaagtaattgatcctttgtgtttgttttcttttaaagcagaattctgttacgactaggagaaaagacagccgggctggaaaactgagtcagcggcttctggggaggagctagaaaagggagagaaagcttgctctgagttaggtcccaaggcaggcagcctcagctgtggaaggctgcaggac

SEQ ID NO: 31510 - DNA, 1175 bp, Mus musculus
gatgatgtaaattcagttcccagtgcccatatcaggcagctcaaaactgcatgtagtctccatcactgatgtaagttagaaggctgaatagctgtccctgtcctggtcaacatgtgaagaccctgacatagcctctgggttccttgggaagggattctagagacagagtctcatacaagtcacttcctcaagtatacctctcttaccatgctgtcccgtaagagcaatcacaaaaataaaaggacagctgaagtcccaacctaaggacataattattactaaaattaatttgagagatctatcaaagttcctgtaagtttcctcaaatcttagattcattctaagagtgttgaaatccttggaaatggcttacttacattctagcaaactgtgtctatgactatccatagaagcatttagtaaaacagcacatttgacaagaatgctgtttaattaaaactttcttaatagactttgaagggacgactttccttgaaactgagcagggaaaaccatttgcgcccgtgttcagacatttaaggctacagtacattatcagtgatctggcttctgcaaggatcattgagcaggattctctggtaccttcaggtaagaaaacctgatgtgttttgtgatttaaagtcatgtttttctgattgtagcatttcatacttgcatagggaagaaaagtaaagaaaccaggaagtcctctttgatcccttaaggtaagtgtctttatgcccaagagatgggcatgtgaatactcttcctgtgctcacctctcatcctgatttatctcccttatcatatttcagtgttaaagtgcttgccaccatagttaagtggctaagaagcattttgcaataggatatttgtttttcttttctgtatgaatcaaactgcctcagctgcatgctaggccctgctggtaagctgtagtcagccccagcttgaagcagttcatctgctacttctccttcccaagtgccgccgtcagggtgtgcaaccacacacttggctctgggtattgtcaggttggttaaccagtgagctgctttggataacagcctgacaagtgagttttgatatttttttaaaattacagctatagctttttctgttagttttctttaaatttgcttagtttctggtttttcttattctgaattcttaaa

SEQ ID NO: 31511 - DNA, 1177 bp, Mus musculus
tcttgctctctctttttattagcttttgtgtttaatagtatttgttagtttcagctgtcagcctgacaacccaatgttattagtgagggaatctgaattgaaacacagactttataagattggaagaacgcatgcgggtcattttcttgattgctaattgatattgaaaggctgttattagttgtcagttcaactatgtctggaattaactaaaatccaagggtctgggtatgtgtgtgtacctatgagggagtaagccataaaatgggaagacctacttttaacctggatctttttgagacaagaagatacacccttaatctagatcttttgaggtgggaagatacacctttaatctgggccatgttctctggacagcccatggactgaacagctaactactgtattcttagaccttttgttggcagacagccattgttggactggctggacccacaaccagtaccctattctaataaattctgccccctctgagtgtgtgtgtgtgtgtgtgtgtgtgtgtgtatttcaccccatgtttggagtccgtggtttattgtcagggttttctagagcatctgtgggcatgtgtctgtgttctggagaacctgagtagtaaaacactggttccagacacaagatgaaacagtaactgataaggtctcatttagcccaggttggtctctcattttctgtttagccaaggctgaccttgaaatcttgatcttccttcctgtttaagagcactgaggttataggtatgcaccatcataaccattttctttctttcttttgctgcagtaaagcaccaggacaaagttcattttagctcacagctccagctgacagtccatcgttgcagagaagtcagggtggcaggaactcacagctagcacattgtatgaagtcaagagcagagagcagtgaattaacacatgcagactgcttgcttcctccatgctcacagtttagaaaccctttttagggaatggtactacccataatgggcaggtcttcccaccttaatttaacataatcaaggtaactcactgacaaacccacaggccagcccacttcagacaataaatgtctacttgaaattttactttcaggtgaatctagattatgtcaaacaaacaaacacaaacagaagagtagatgggcagtgataaagggt

SEQ ID NO: 31512 - DNA, 1102 bp, Mus musculus
cagtgagctggttaacctgcccacacacatacagaaaaataatgtaatttaaaaaattgttttaaaaaccctggggtttcatgtgaggtcagatatggttgaatcagcttgagctgtattttactccttaggttgaattaacgttggcagacagacaatggatggcagtgccaaccggagcgttacttatgacttgtgaaaagctgagaggttatcgctgatggcatccctgtgttgttgagagggcagagcactacattgatgccagattatcaactgggattacagagatccaaaatatcgacgaaagcagttcacagctgtgccagttgcttaatgtctgtgtacagggtcattcagaactgttgccctgggactgttgggtgaaggaagatgactatgtttttggtactggtgtgaataggaggtttagtacctatgggaacagggaagagatggactcgggtctgtgggctgtgtggggagggtggctgctctctggctcttgctgactcagccttttctgattggctcatctggccagggcccgaagtgttgcttctatcacacgttttaaaacttgcttagttttccccagatgtaacccagtcctattcctcaggcctttggcctttttttcctttaacattttggaaactttgattggggtgaagtggggacaggttggtgggggctgtgctggaagagatgattctgttagggcatttgactatggaaaactctaggcttggccagagagtgtatgtcgctcagcagtgattgggaaagttgattaatactctgtctgcccctgcctgccctgcagaagtagagggggtgcctctgtgttttcctttgcacctttggctagcatagtggggactgaggtcacaaacatagacgacagaggtaggcagctctttgcttgaatcctagcttgtccctgtgatgttgactgactcctaagatctactgttctcttaaaattcaaaacctgggtggtttttgtaagattagctgaaagaatttatctagagaacttagataaattggcatgttcttggttagcagtctctgagtaggtaatttttcgtatttgatt

SEQ ID NO: 31513 - DNA, 1100 bp, Mus musculus
gaggtggctggagagatggctcagtggttaaaagcactgactgctcttcctgaggtcgtgatttcaattcccagcaaccacatggtggctcacaaccatctgtaatgggatctgatgccctcttctggtgtgtctgaatagagcaatggtgtactcatgtacataatataaataagtctttaaaaaaaagaaagaaagaagaggatgtgtttctattcatttcctgttgagtattggcctgcagtaagttataactgtggtgctcagtctgcatttgtgatagtggtcataggggcaggaagtagctattagaagtgtatagatttgctgaaggtatagccaggaagggagggggagcctcagagagagtggggtttagttgtggagacagaagggactaacaccgaagagcagctgagtataaagttagagaggtagcatctgaactcagcgaatgcgccaccagagcatggcacacattgctctgttcctgcagggctaggagagggaaagagagatcagcagcggacctgggctagtggcttgcctggtgagcgtcatctctgtaggacctctgaccagttgtggtgattcacttgtaaaaaggtgttttgtttgtttgtttggttgtttttttttttttttttttttttttttggtaatggagatttttctcaaaaggtgatgtagtctttctgctttgaagttttgaacgcatagctcagagcaaatatcaatgcattatttaagtggctgtgttcttacttaggaattacagtgtgatttctaacatgatggaatgtttcaagtcttagggttggttcatagactacgaacagataactgtatgaggccaggaactgggtagttggctcattctagcagactagggcatattctcctcctctctgagtttgtggatggtcctaaaggcttcttctaactcagttgtttttaagttctaggatttctgttgaggcaacttgggagagagagagtgggatggggttgattgaattgaagggacagatctgtgtagctaggattaaaacaatattcctgatttgattattatgattatcattattattattattact

SEQ ID NO: 31514 - DNA, 1118 bp, Mus musculus
taattttcatgcaaaccgggaatttttttattatgtgtattgtctgcatgtctgttcactgtgtgtgtgcttggtgccttactgagagctcctaactacagaaccacctctcctgcctgtgcccattgttttggaggtctctgcactgtcctaagggtttctctaagtcttggtccttataatctctactaagttaaaactcttaacttacttagtgcctgaagattgcctttatttaaaagtttttaaaaaatcaaaccctcaaataagattctaatggagaaactgctcactcatcaccagacaattgtcacttcgaaaagtaactaatgtaaaaaacatcagttctgagagttgtaacctaatgtaataaagtcattactatacccacttaccagttcagtaatttatagcatggaaaatgaaacaccaaagggaaatggggaaatgatatttttctgagttgctcctagagaggcttccaaaaagaaggtgacatttatactgacgactaaaaggcacgtgattgtttgctctttggataagaggcggggatcttggagagctgctatcctgagagtagggcaagggtttgaaagtatggtcagtgccactacagaggtgagagatgcgctggctgtaactggctggccatgaaaatggggccctgcctttccagcagtgcagttccctgtctgactctctgaccgtgttttaccctgttccttcaagtgtctttttcttcaattggggtgagtcctgttaagatacatgctaaagaataacttctctgtgcacaccagtaagactgtaaaaatgaaaccttttattatgtgactgtgaaactagcttttcccattactaagtggcatcttggattgggtggtttgggaatgtttttcaggttgaaaatatcctcttgcatgaccgaggccactatgtcttgtgtgactttggaagtgccaccaacaaattccagaatccacaggccgagggagtcaatgcagtagaagatgagattaagaagtaagccttttctcctttcctggagttttctcctttgtcagataagcaccttttcttttagtttataggtgaaacagagtgggaagaaaagg

SEQ ID NO: 31515 - DNA, 6083 bp, Mus musculus
atttttcttttttttctgcccagaaacctttttaatccaggaatattttacccctagttaacaggggctatattataccatgactttgaattcctacagctcctgttggagtcacttgtattgaagaattaagattgatccctccaggactcatcaatactcttggaacagagaagtttctagaaagaagagcaatacaaacctactgcacatctgaagaagttaatcttttagctactcatcattcattcctatggagccagcacctcgcaaagcactctgggatctgtcaccaagtctgtaggagccaagctggccctgtgcacaagtgtctgggtgcatactgtgggtcagactctgtgtcgagtaaaggaacacacagatgggagcagcattctgcctcccacggtctacatttagactagtgtggacgcttgtatgctcatgcatatgagaaactcttgtcctttgagtgaaaccaccatgcctacctccattagcgaatcactcgtttttcttgcatttgcctgttgacctgacttgaaccttggctttattagattttttttttttcttctcatggtagaattgaagttgttggacaatttggggcaatcctgctggaactgactgaggtgtcagagtgaattttttaaattccatttacctggttttgaaaaaatcaatttcctaaaactggacatggtagatacctaatgaatgtaatcctagcacttgggaagctgaggcaggaggattgccacaagttaagagattagtctgggcttaatactgaattccaggtctctatatctcaacaccttctccttccagccaaaaaagtcatcagtctttgtgtttccctggcaacaggggaagagaatcttcagaggtccagccacggggactcctgcctgggtaccattgttgtgaaattcattaatcaggagcccaagccacaagctaagtttgcctgttatttctcccaaacccttcccatacacctctactgcctcttaagtgggtacagacctgagacccggaagtaaactgagaatggaaaagagttggtcagttgtccttgcaaatctttaaatgatctgtgcctttcagatgttccagtagagcagacaggtgactggctgcgtgttcaggagtgtgtttttatatctggacggctctgaccattcctagtggttttcatgtcctttatttttactgccttagaataaaccctgactccatgaggcatccactgaggaaagagttgcagcaaacccaggtgtgcactcatggcttctcacagacactgcttccacttgcctgcggaagtgtggagagctgtgtgttgcgctggattagtgatggaagaaaggctagaagctaggcacagtagcgtaccgctgcaaacagggcactcgggtggtacagaaagaaggaattccagggcagcctagactgcacgacacactgtcccaaaagagaaaatccatccagggctaaagcctgaatgccaggctgcacttgcaatcacttagttgtgatagccttaaaatttgaaagtcagggtttgggtgcacaaggcagcagcagaagatatgcttagcttgcacaatgccctggggtctgtcgtcagtacacaaaaacaatacagttaaatctagaagtcttgacggtaatataagaatgactatttttttatgatatcaggtacttttaaccccagaacttgcgaggcaaggacaggtggatctctgtgagtttgaagccagcctgtctacataacaagttccagtccagccagtgagtgaaaccctgtctttagaggggggtagggggctatttttccctcttttcttcatagcattctccacctgtttcaataacaggcactgcgtcggggcccatagcagcgccatttgaggactccaccccaccagaaacctgcctttcacttcagtaaaggttaaacattttctttaggaattttctttctcacaattattattttttaatttcctgtataatagtggatacaaaattgtctttctattaaataagtagtttgactaacgcacatggaactttgcaaccaaacttcccaagcttgccgtcagatgaaggcctccaaggcacttgcagaaaggatggtgatgttcagggagcccttgcttaatgtcatagctcctcccaggttgcagcacatacctgtagtcccagctgcttaggaggctggggcagaaagactgcttgagcctgggatctcatggccagccttggcaacacagaaggacccatctcttgatgagaaacttcaaaatgcaaggtcaacaccacctcggtaatagctctgcaaactattcttcctttgattactggattgctccatctaatcagtcatttttttctcacaaggtccaaattagaataaaatggattctttatcttatatagtttaatcatttgtgaagtgtgggcttagggcctctttttgtactgagtggaaagtctatctaccatcttagaatagacagtgaaaatgaccacatgcagactgtttttcttacatagtgattcgtgaaggaaagctgacacatgataacccgtgatgagttctgaaggaggcgctgggatgatcctggattacaggatcagtgtgtaatgtaaagattaggtatctttgtgggatgccatcctgaatggaaatccagagatgtttgtcttacagggaattatgagtgcttaacgtctgtggatcaggagcaggttccctgggaccatactgtcacaacttaataataaggaagaggagaacattgtcaacaatgtactgcactctctttgttttagtgtctgctgtgtgtttgtcactttgtatatttcataggaaacaccagagattctggacttttgactcagtagacagaaatgagccagagtttccttaggcaacgccttatgctgtatcatatactaatgaactcctaaatgatgtgctaggctgggagcatggctcagagatggagccggtggtgcacaagagaggccctaggttcagccctattaactgactaatgagcactgtttacagagttaacttaagtgtgaccaatttcttaggcttacagtacagttctttagcaccaaaaccttggttggagtcaaaacaaatgaaatgaaataatgaagtgagcctctgtggcatgccaaggcaaacggattgcgaattcaaatttattctagcacaggcagcttagcaagctcttactatcgaactttaaagcagcttggtttatagtcaggtgggagagcacttagttagcacgtgtgaccactgggttttataaaactgaagtcccgggaaacagtgcaagatgcttccatcatgtgatggtgatcagtctcaccagagaaagtgagcagaagttggtgctcaaaaggaaatttcagttaatacagcctgttttgtcctggcttatttgtggagttgaagacctatgtactggcacatgccctagtgtgtgtgcatatgtgtgcgtgtgtgtgcgtgtgcgtgtgtgtgtgtgtgtgtgtgtgtgtgtaacagtcttctactcactaacccatggtatgtctcagtttcatctggcaactgagttcttctaaatggttaagaaaatgctgccttagagcctgttgtatatttatgtgttggagtctgtgcttatcagtattttcagctagtcttcattgtgcgtgaaatattagagtggtctgatgataagaaattctgtatttttattctgtaaattagaataatcaaaaaatgtatcaaattgtatgatatatgcattacttcaaataggaaatgtaaagtggaaaaccagggaccaggagctgcagtgccctccccagcagtgagtggacaacttccagtggagtccatttgggtccctcagatgtagagatggtgccctctgtggtgtctttggcattcaaactttagaacacatcccagtcaactccaaaatggctgctagtcacagcatttctctcagcatcgaagtcgttatggtgaaaggtagtctgcaggagtgcagtggtagaggcaggagcacctggcacttctcatggctgccatttcccaggcctccaggaaacactagggttataagtagaatcatgtcattttgagtttttagtttttgaaccatagcctttgtcaatatttgttttgttttaaccaccagaacacttgaaaactcagtaaaaatttcattaaagaaaagctttcaaaatgtttaagaataaaaagtagtgtccagttatagatggttctgccctgtacctgagagatctccgtgctccctagccctgtttctgctctcccttaattattcccccagcattcccctgaccattctgaccagaccaatcagtgggtgctcaacagtcatactaactcatggctgtttcccttgctactgctgtaaaatgtctgtttaggactcaggccaaccttgacaatctaacagtgaaatggaatagaggacaggggagggttggtggaacccagccgtcctctggagatggggggcagctctttccctgatcctatgtggctctaaaacgagcacatatgtgaaagggccttagaatagcaaaaatagccaagttttggccatggggacacacatgcctgtatggggcgagaggttcactctcaattcaatgactgttgccgggcggtggtgtcttacacctttaatcccagcacttgggatgcagaggcaggcggatttctgagtttgaggccagcttggtctacagagtgagttccagaaaccctgtctcgaaaaaacgaaaaaaaaagaaattcaaggactgtgtctgggctgcataacaagaccttgtctcaacacacacacacacatacacacacacaggctaaatattaactacatgtgacgtaggccaaagtctctgtaagttgtaatttcataggtcttgtcaggtgtatttcagcagtctctggcttcagcaagtgcgccattaattctgacttgatagtgcccagtgagcatggcctgtgctgccttgtggtagaaccatgcgtatatacatcaaagggatcagattccttttgtcaattttggcatttcagaatggatttttaaacaccagtcaaggataggtcagtgttggctgataccacatgcttagactgtgtgagaacccttgtccagtctccagcaccttcactttgagagacagtaaaatcctttccttcagaagtggtgatcctgctgtgttctgcaagtctaccaaagattcttgtgaggagtttctcagcgcctgtgtgtgcagacatgtaccctcctgcttccttcacggtgttagctccagcccctccgcttagtcatctgcagagggctaagacaggaccgcaggcagctggcacaagcaactctgttccctttgccaaaacctccaaagttagaaatgaagttgtttgcgtctgtggtgagggaattgaccagccattgcttcagcctccttcccgagtaagcaccttcttggtgcctgggtagccctgggaggacagtggtgacctgcaccacaaaacctgcaagacattattttgaatggaacatttgatgtcatttttagggaacagaaaccaaataacagaggccaaggaccatgcgtatttcaaggagggaagatgagcgccctctgctggcagtatttgtagttgattgagtgaggagctctaagcagcctggaaggagtgctgaggtcagcaggcctcaggaatccttaacatgcaaacaatcttgaggggaaaccagaaggtcattcctagcagttactgtaatacctctcattgcaggctgttgggtttctgtcgttcactcggtgtgatttatcttatgtatctgatagtttttatggataattgtttgggttgtaaactcctatactctttattaaaatgaacctaattaagagacttagttgtgtgttttttcttaagtgggatcttctggggatgaaagggtccctaggtacctgtccccagcacagatcctgtgatggattcc

SEQ ID NO: 31516 - DNA, 1190 bp, Mus musculus
atagatcagaagacaacttacaagaggcagttagttctctctcctcccaccatgtgggcattgaacgtgggttgccagacttggtagcaagtgcttttacccacggagccatcttgcctgcccctgagttgtatttttactaattctttctgtgggctgatggatgaaaaaggaatcgagtaaacattatgaacaaattgcctgtgtgctctgtcagacgccacagtgcacatggtctctctgaaagggtatgtactagtcattcttttgacacatgtgcacatgtgatgagtttcagatacgtgtgtgtatttgcatagttcgcacacctctaatcccggcactcaggaggcaggagcacggatctctctctgccagttgaatggctagttgaatgtatgtagtgagttccaggcagtcagagctgcacgtgagaccctgtctcaaaatgaaaaaaaaaaaaaaaaggtgggaatctggatttgtcctgtacttggctggaaatgcaacatgcttcttcaatgtgattacaggagaatgaagagttagactggaatttactgaaaccagacatttatgccacaattatggacttctttgcatctggcttacccctagtgaccgaggagacgcctccgcctccgggagaagcaggtagcgctgtgttggtctgtccatgcttgtccagtctttattgacttcctacctcattcccattcacctggatgccaagtgacagaatacagacttttaaaatgtttttattagagctatgaacatattaattatacgacattatgggttcagttaaggccttttatacatgtatataatgtgtttcgatcgtaagcacgtctattgctcctccttgtctccctcacgcctgatgatcctctccctctttccaccaaccccacctccatctcctgctgcttcctctgtgagaggcttacatgaggcctgctagtgctgctgacagaagcactggcaccttaccagtggacacaccaccgtagctgatatccttcctccccagcactaactttgtgtaggtccctggtgagggtggggcctcatgagagcctccttccccattccagggtgtttcacttgcgtgtgcgtgtgcgtgcgtgtgtgtgtgtgtgtgtgtgtgtgtgtgtggtcccgctggaggccaggagagggcatca

SEQ ID NO: 31517 - DNA, 1210 bp, Mus musculus
agcagacagtgaccttgaactcttttttgtttgtttgtttttcgagacagggtttctctgtgtatccctggctgtcctggaactcactctgtagaccaggctggcctcaaactcagaaatctgcctgcctctgcctcccaagtgctgggattaaagacgtgcaccaccactgcctggcaccaccactgcctggcgaccttgaactcttgattctgtgattataggcatggcctatcctgataggattccattggcccagctgagatgctgctgccaagggcctcttttctgaaacaagaaaacacgtcccagttcttttatatgcatttaatttgctttattcccttaggtccccagttctgcctaaaccttgtgctttgggctattgaggtttattcgtgtgggcgtgctgtgcgttatcatagggtatttcaggcaggcaaggatgttcatgctaggaagataacattttctaacctttctcttaaatcttgagttctctttgttttctggctttaggtgatggatgatgacgaatcagatgaaaaagaagcaaattcatcttaaataatctgcattttctttggccacaaccattggacctatctttactgatcctgtaattatagtctctgctatggaagtttattaataaaaggtttccttcctccagaatgatataaatacatttgcttcctctcacgaattatttatgccaccctgagtcacccacatgcttgggttgttcacttgggttgttcgggtcttagtcttttactacatcctgtgtcacccctgtgtgtgggtcttattcaggggtatttttgtttttactcctaatctctgctggtcctttctttgcatgatgggaaaaacattttaaaatacatttcctgggagctggagatatggctcagtggttaagagcactgactgctcttccagaggtcctgagttcaattcccagaaaccacacaaggtggctcacaaccatctgtaatgggatctgatgacctcttctggtgtgtctaagacagctacagtgtacttatatgtaataaataaataaatcttttaaaaacaacaacagtaacaaagcactaaatagctgtggtttagaatggtagctgaggagtaggtgggtgagggagccaggaaggcagtgagaagcaggaaataccaccatggggaaggagagcaggcctgcctg

SEQ ID NO: 31518 - DNA, 1167 bp, Mus musculus
tcactagcctgggttggctttgaactcactctgtagctgggaataaccttgaactcctgatcctccttctgcccccaagggctgggatggcaggactctgccaccacacccagctagttaaactatgttggagtgatgagttatgtacctaggcaagtacctggcattctggttgcaggttatttcctcatcttgtaccaggaagaaaagtatttgtatactataaaacaaaaagaaaaaggaatcggatgtagttcatgaagctcagataagaaaggaggaactgttagtcagagtggctgctagtgcaaggcagctattacactgagtttcactgattatgaagaataagtaaatcaatatgctagcacacggtatttgaggcatttctgtttttatttgctgagacagggtttctctgtgttaggcttggttgtcctagaacccagtaacacttttttatattagttttatatatttcccagagaataggtatctattttcaattgtttttttttaaactagtgattcttgccttttttaaaattattttttattttttttgagatacttacctgaaggttattgagggatgctgggactggctgctagggtgacttgtaaatacatactgtttacgctctttagaagtcacactggaggcagccgggcgtggtggtgcaagcctttaatcccagcattggggaggcagaggcagatcggatttctgagttccaggccagcctggtctacaaagtgagttccaggccagccagggctacacagagaagccctgtcttgaaaaccaaaaaaaaaaaaaaaaaaaaaagaagtcacactggatatgaagaagctgtgagctgtgagggaacttgtttgatacacattttctggggaagggagagcttaataggtgtcagggttaatagaaatgagcaaaagaagatgggaagggttttgtaatacttgtttgtgatagtcttctcccagagatccagaattagcaagactaaaggttctagaaacctttaaacctagtaactttgttgggctcatatatatatatatatatatatatatatatatatatatatatatataaagcttttagttaggaggcctttacttatccttctttagcattgagcaatatttagtgttgtttcc

SEQ ID NO: 31519 - DNA, 1099 bp, Mus musculus
tcaactgtaactttccggtacctagaaagggtcagaaggtgatgaaggtgatgaagtgcttggtggcactttttgagagaagactcaagagagttgtctttgaggaaacaaaatgaatgcagatataatggctgcaggtgctgtcacagtactatctgaggcaatctgaaatccatcaggcacaggagagctttgtaactgctctctgttagacctggaatgctccaatgacgggaggattcttaccttgagatacagagactagtgacaagggaggcagtcacctttagtggtgttgttcatcttcagtcagtgtaagtagaagtaaatttgagaactgtgggtctttgtttttgtttttttgagataatgcttaaatggttacctggtaccacagaggtcgggagagggcattggagctcctgaaactgaacttagaatggttgtgaactacctaccatgtagatgttgggaacagaaccaaggtcccctgcaagagtaacatgctcttcacctctgagccatctctttagccctcaaaacattattcttttttaaaaagagatcttacatgtaaaatgtggctgcatagttataatatgaatatatttatgataaaggattagtgtgtataagtcttaaatgtagcattgcctttataaagaaacatcgcactagagatgtggtcatataagtatggtatgtctattacatattatgatgtggcaccataagaaggctcagacagttaatgagaaggaatgatttggggtaggaaatctgcttataactactcttcaatactgcagcaattacaaaagggcgactttaaacttttgtagttactttacgcaggactgcattttgggaagtttaaacaagacaaaagaccttaaattatgagctgaagtagtgacttctttctaggaggccaccatgtgagtatgagtgtctctgtggacttgccctgcctgcttgtcatctcttccccgctactcagatcgaagatgatatcataatcataactggtggattctcttcaccttccctcccttccttcctccctccctccctccctccctcccgcccaccctcccct

SEQ ID NO: 31520 - DNA, 1144 bp, Mus musculus
tgtatatgtgtaatgtaatagtatataggatatagcccacaagtttgctttttaaaaaataaattttacttgacaaaatggcagttaaggaaatagttagctttataagttttgttggaaacaactaaatacttattttgacatatttttgttaatcttttatgtttatataaacttcccttttgaaaaagttaaatggactctaaataatttatttctttttaaaaagtggagccaggcgtggtggcgcgcgcctttaatcccagcactcgggaggcagaggcaggcggatttctgagttcgaggccagcctggtctacaaagtgagttccaggacagccagggctacacagagaaaccctgtctcaaaaaaacaaaaaaacaaaacaaaacaaaataaaaagtggaatctagctttatatttttgcatagcctaaacataattgtgtaaggtttgattcatcaaagttgtccattaaatttttttgcaggtatatttgcttatttaaattaccatgttcctcgaacaagacgagaaatcttggagacactaatcaaaggccttcagagactggaatacagaggatatgattctgctggtatttcctttaaattatattatggggtttggattgattcttgaatctaaatagtatttttattaattttaggagacttaatttgtgtttgctttgttttgtaaatgcaagtcttaagaattttaaattttggtcatgtctaaagggtttgtgaatgtcatttcagcagtattatcatttatgtggatattgcttctcagtgatttcctttaggaataacgttactccagggcttggggaggcgattagtatacatgaagccttgggttcatccctagcaccatgcaagctgggtttggtggctcaggcctgtgatctcagcactgaggaggtaaagccaggaaggtgagttcaaggtcatccttagacaaagtcagccttagactaagtttgaggccagcctgggctgtaggagtctttatcttaaaaaccaaaacaaacattaactataaaaccataaattatgccaggcggtggtggcgcctttaattccagcatgtgggaggcagagacaggtggatctctgagtttgaggccagcctggt

SEQ ID NO: 31521 - DNA, 1145 bp, Mus musculus
agcacggtggctctttatgaatttggatatggaatatttttaaattttatacccaaagcattaaccttctccatattttttggaaatgcgtgtcagacagattccgaaggaattgtagaaccactggttttgctaggatgtttagaaatgatcatgaaattcttaggacagtaagaacatttaagatctggggggctggagagatagctcagaggttaatagcactggctgcccttccagaggtcctgagttcaaatcccagcaaccacacataggctcaaaaccatctataatgagatctggtgccctcttctggcctgcagtcatacatgcaagcagagcactatacataataaataaataaatcttaaaaaaaaaagaagaacctttatgatctgaaaacagaaggtcatctttaatcggaaacaggatgcctaaggatgtgttggtgtctgtgtacaatgaaaagttcttcacattaaaagaacagtttaaaatacagtgttagaagatatgagttagtggagtcggtcagacaggaaatatttgagtgtgttgggacacatggcctccctgccagcactcagagccactgtcaggcttgaatgaaagcagccgcagaggaagggcttcactgtctcagtgagattttaatgcaatagtaatttgccagttgaaaattgtttattagaagtaggcaggtgtggcctgggaactcagttttctaatatagttattttgtagttcaattcagaggggaaattaaatcatttgaagagcattaaatttcaaattaaaatgaattttgaattcatacttaaaatgtgtattgttagtgcattatttatggagaagggttgattctgactcgttgcatttcaggcgaggtagccctctcttgattggtgtgcggagtgaacataagctttctacagatcacattccgattctgtacagaacaggtaagttgctgcatcacgttgtaagtgtggtgcgggagctctgagacgctgctccatatgctgcagtgaatgttctccggtcggatctgtgtgtactgtgcagacaactacatagttctgtctggacagaaaaagcttgttgtgaacactgacgagagaatttttctctgttgtacatcctta

SEQ ID NO: 31522 - DNA, 4402 bp, Mus musculus
tagtaaatcttatttatatatcagttataattattccactcaactaatgatttttgtgcaattgtctcattttcaataatacatgggggaatttgattcatagaatttaagtctaaacctaaaatcagagagatctcagctgtattttgttcagagaactggataatggatttctgggccctccatttcatagaggaggcttggtgagtgtcaaggcgcttggtgtttgcttcagcataacgtgattcggtcagtcagactgagggaagaccagtgcattgaattggatactccaagtcagtgtgtgccagtgcctggacagccaccaaaggctttgctgcgctacttataaatagaagatgctgcagtttatgttgaagcttatttctgttttgtttttaaatcaaactgtacaccaaaaaacttggtgagatttttatcttagtttagttaaattagttcaaacatgtctgtcatctctgtagacagtgcgtttgggtcctccacacctgcagagaagaccttgtggagtttggaaaacttgtgctgttagacattgatatgtggctggacatttgaagataggacacagggatccactccttatttcttcatctcttaagagtagttggcattttctcgcaactgtagagcttaactgaaaagcaagtactgtttgttgagtgacgtactttgtagctgcctttggcatcatagcacagagttgctgtcaagcctcaaattggtgtcagggtgctcaattctctcttcagctttgtcccaagaagagtttcctgcagttacctttacttcctcccctgccttgttgcagaaagcatcccttggtgccagtgtagaagttctgcttggggggtggcaggccttgctgctcatttgaccctcagtgtatgtggcaggctcagctgagaacggcacatacttggcactgtggagtgacgtcagtttcagggttgttttctcgatgttttccttgggactgttttgactcctgttgaggagtgaatgcagtataaatacgtgagactgtcatgccttcagctgattgtgtcagaaatgcaggtcagcaagttggataaaatatttaaaatagaacattagtttgacaccccaaaaatgtgcagagtaatttcttcacagagctatttgggtcagattgtgtgggcagtgggcaggtgtgtgtgttcaagttaggtccattgttttcaaaagctttcacctgtacacggtgaaagcgcagtgcttcacggagtcatgctttgtgtttgaacttagtggtaagcagttaacacttgtgaaggtgagttgaagaaaaagttgatgtcactttaggcatttcagaaggcttcattcacactgatggaggctggaaacctgattttgataacccaagacagggccacagtttgtactccatgtcactgctttgggtacgtttctctgttgtatttgtccctaagacttcatgttagtggagcatgtgtgtaaggtcatttcttaggcctgatgtggtagcacagctgctcgtgtttgggtgtggcttttgtttggtgtgtggctctggagcacagggtgatgttggtgtgttgagacactgaaactgggagacgatcagctcagtgctgtctggtcactcactgtcagctcagtcactaccccggggtcctgttggagcagttttggattatacagctcagtcttgctaaccaccctccgtgcagcggaacgtcacaactctttttgtcttctgtctatgatattgaacccatttaccagtttctcatccatacacactccaagctagaataaatactaaaccagtcagaaacccagatgaggaccagggtagtactgtctaaacaaatattattgttttccatatcccattttgctttctacctaaattcttttattagttcttaatacccagatattttagcaaggcaaggcactaggtgagtaggtcccactaatttggtataatacaggacatagaaatctaatttttcaaaacaaaaataccctgtaaaagggaggctttctattaaaattctcccccccccctacccccagctccctgtttttcaagacagggtttctctgtgcagtcctggctgaactggaactcactctgtagattaggctggcctcgaactcacagagatctccctacctctgcctccagagtgctgtcattaaattctaatctatctatctatctttctttctttctaaaaagtaattattttatttgtttacatttcaaatgtcctccttcctggtttcccctccatgaacctcccaccccatccccctcctttttgcctctaagagggtgctccccaccccctccgcaccccctagcatctcccttctctggggcatcaggccgccacaggaccgagcacatttatagtgtgtttaagttcacacacacatctttacctgggagtccttgctaggcagggaggactgaggcacctgacacatggcccacttgatggttactactttctaaaaaagagaatctatgccgtaagatagaaaggttagaaggtgagccactcactcttagcctgtgactggctcggcggctgtgtatgagcggctgccatgctgggcagcagagctagaccctcagagcaattgtgactgtccctggtggacctggtccttgtgaggctcaggagggagggtggaaaggtggagctgtgctgaggtattaaatgctgggcctgggttcgtttgacatgttcataagcagctgccccggcctgtccgtggaacaggggactataaagaacagcagttagtaatatggcaagcagttgtgtgtccctgctcagcagagtgatgtcacagggtactgtgcagaaggctgttagttcagaacaccaacatcagctttttaatagcaggctgtttctgaagtgacaggtggtaaccctttcagtccaggcctcttgcctcagtggttctgaaggtgggaggaaaggaggctggacttggtcccatgtagagggaaactaacactttcacaacacaccttcagtctttggggttactcttttatctttttttataattaggatattctagagcaataaaagagactaaggttacctgtttattatatacattaactggtatgagttttctaaaaaaaaataataaagcacaatgtcattggaaaatgtttgtttaaaaaaagaattcataatttacaacttgggaaggccaaagacatggaagggaaaggtaaagacattttgatttatgacatccacattttgatttatgacaacccatagtgggttgtgtgtacagtaatactacgcagggttttaagcttggagacatttcacatggcttttatttagtttcacattcaaaagttttaacataaattggactttttcactgtacttaaagattgttaataagtatttcagtatcttcatagctagaatttatttaaacatatcctcagatctgggatgataacagataataaaactgacagcattggctttgaatagtaatgtccatagttttaagcaagactgctaagttgtgttgtgttgactgtaagtccgtacgctcagtagtgatgttctgaaggctgatgatggcatcagaggaaacgtcaccttatcttgtttctgcactagtttccagagagtgtagaaatggtcttgctaatttttgaatgttctttggttgaatgtgtttttccattaataacatttttatatttgtttaaattatacttctgtgggactgggggttagaataatcattgctctgttttgattttgtattcttttaaatgaatgtttagttttctgagccagatggttatttcatccttgtgtcctgttcaatccagtgactacaccggaactgtgaataaattacccaaaaccttgctgtgtgactttttctttttttggttgggcttgggacagcaccccgggccttacacattaggtcacaatcgtagcagttcattttgaaggatttactagcgtttgaaacacacatgtgcatgtagcattttaaagttggtgctggctaaagaatagagtcagtgttttgctttcattgttggtaaacattgccggcttctcagccctgttgctttaaagaatgaatggttgtgcgcatatccagagccagtaccccagcttcctagcagttttacgaagaatcattagataaaactctgatgttatgtatgctacactaagctccgatgtcacttgttctgcactttctcatagcactttacattaaaaatgatttgttatcaggtttctggaagggtgaccagaaagctgaaagtgcattgatagctaggagaaaggggagtgtgagtgggttg

SEQ ID NO: 31523 - DNA, 1199 bp, Mus musculus
aatgtgagctaaggaacactcggaactgctcaattactgagacacaccacatgccaaaacttagagtgcagccaaagtggccctcagagggaaattcctagtcttaagtgtttgcataagaaaaaaaagttataggtcacctcagcataaaacttgaaagatcaaacaacaaaatagtaaaaaacctaaaatactgttttttaaggggcagggctgggaggatactcagctgttgggagcacttgctctttagaggactagagttctattcccttcacccatatcagtcagttcataactactcataactccagcctcaggaaatctgccctcttctgtcctccatgggtaccccaaagcacacgaacacatgcagacacatgtacatacacataaacaaatagcaaagtaaatctttaaagcaagcaagacaaaaataataagacaagacttgcgtagcaacagggcaactattagttgagcatagcagatgtgaaagaagagaaacaggcaggtatcctcagagctgtgttctcgctggagaggttagatgggaagacgagccaaagctagtgtggccacaggctgggctgcacaggccgaggtcactcacacagcggactgagagagcaatgcacactggggtcactgcccacccaccctgcccagtctcctcccttctcataaggagtgttatgaattattatagtttatactttactctcccatttctccaactaaaatctgtcaaattgctgtgacctctccctcctccccccccccccccccgagtgctgaggctgtgtggccttaaggtaatttgtgactgccatatttcattaggatccttgtcttccagtcagagggtcagaagccagggcctcccgtgccaggcctcagcctttgccctagtttagctttgcttttcctagtcttctgtttctcggtctctccccctttctactttgacaacttaagctttgaggtgtcccaacatccgatataagcttgtgtaaactgtatatttaatgagcccagttgttgaataagagcctgaggcagtgtgtgtgtgtgtgtgtgtgtgtgtgtgtgtgcgtgcgtgcgtgcgtgcgtgcgtgcgtgcgtgcgtgtgtgtgtgtgtgtgtgccacaggtgcacaggccttagaggacggccagtgtgcccactcacacctgctc

SEQ ID NO: 31524 - DNA, 1148 bp, Mus musculus
cctgcctatctctctgctcgctgttatgtctggggccaacgtgaccccctctcccaggtctctcagccaacctgccttcttacagcacggactcccacaagtgacccaaagcacacatctttgaggggcgatgggccctccccagccacaggccctatccccagcatcctagcaaggatgaattcttcccttgaccccaattctgtggcctgagagggccctgagtcctggactgaagctggcttctatggagaagctgcatccgtcccttctaacagtagtgccaaggctcaggccctctgctgaggcccctgccccaccaaagtgctcagagcgacctttgggcctttgtcggaaggtgcccagggcttgaggaccagaacataagcaatgcccgtttagaaacaaaccagctgcttcccttcccctgggcaggcttggctgcctgccaacagctgcccagggcctctggggcaatagaagtttaatctcttcccttgtttgaagagttactgaacagcaggaacaggtggaggctgttgctgttggggaggaagtacccacagaagggctggtagggccagggtggtagcagcaggagagaggtcctgtccactaaaggtactagagaagggacctcatgtctctttgggtggaagtctgtccccaaggacacaggccccaactggaggggatctacccgaaacccctggttcacactgaacaggttgccctgtcccaggatactgccagcagtgggcctctagccaaactcccccctgcagggcttgggcaggggcagacttgccagcccaagggtgccaggcacattggggagattttcacattacctatttatgaagatgtaagtctttctatcaaatctatttttgaaacatgaaaagttgccttcctggatatgtcagagacagtgtacaattcaaccattaaacatttctgtattgactctgtgctcaagcatggtctatcacctctgggcatagaacctgtctagtgaccttaccttgtggagtctctagactgattttcaggatgggtgggtgggtgcaccttgctgtccagcctggtctggagaaaggagcctaagacctttcctctggttctgggccctctgaggtagaagcagt

SEQ ID NO: 31525 - DNA, 1197 bp, Mus musculus
agggagacagaactgtggtgaactagataaacagggctagactcactggggtccccttcaggtaggaggcagcctgtgtactagctgagcctggctctgatggcatggaatcagggtctgctctgagtgctctcaggtggggatcactgtggctgtactgggttagagctgcatggctctaagggctggggaccatgaagcccgtaaggctttcttaacccgtatgatccttttgggggcatggcagtgaccttttcacaggggtcacctatcagaaaacagctgactgtcttcctttcctgggcccgatgcacttgagagagtcctgcttgctggtttcagttggctcaaactcttatcagggagagctggttccttccctgaccccgcccctgcagagcctgactccacccacgggtgggtactacccaactctgagcctgccctttgtactgcacatggtcttcagagccatctggcatctgtggttccatgagtagaacctggggggttgacgtctccagagccattcaggaaggcagcctctcatggccctgctgggtggtggggagtttgccaggtctttggttcaggtgttcaaatggaagtcccatttttaggatgtgtctgtctctctgagtttagatactgaccctgccatagctacccactactacccagcaagccttgctctttagcgataccagtgctgagcccagcaggacgttagggttccaatgtacttagggcttagaagagggaggtcagagaccttttgccctaaacagagctctaccctttccttcacaagatggcaactgactggtgatggggctcacttgccaccctgggccatgagcccacttttctagcctccaaagactggaagccatgaagccagtgaggcagtgtttcttaagctgtgagtctcaacccctttagtgagctcaaaggactctatcacaggggttgcctatcagaaaacacagatacttacattacgattcataattagcaaaattacagttcagtaggtacgaaaataattttgtggttgggggttaccacaccatgagggctgtatttatgtggcggcattaggacagttgaggactgccagaagggcctaacctggagtggaacagaactcagtgggctctgcttggccaggtagcttcttcactggtggccccgtgg

SEQ ID NO: 31526 - DNA, 1456 bp, Mus musculus
gccggggaagatggtcagcagaagttcattgctcatgtgccggtgccatctcagcaggaggtaggctggatgctgtgagccccgaggcagagtgctgcccttagagccagtccgctggagaggctcaccttcccgggtgtcccttgtccctcccttccactgtgcactctttaatcctaaccctgtggcacacagagaggtgtcttcacaaaggggtgtgggatccatgaagggccaggccgtcttgacggaagtgataagcaggaacttagatggactgttgctaggaaagtggctgggttcttgcagacccccagacgtgctgaccttgtccctgcaggtagtccctgcttgggttatgtgagaggtgggggccttgctgagagtgacttctttactgtgggtgtccacagattgaggaggcgcttgtacggaggaagaaaatggaactgctccagaaatatgcaagtgagaccctgcaggcacagagtgaagaagccaagcgactcctggggtactaggctgagccagagcccttcttgaactctggaagacctggtgggtgtgcttggtacaccatggcacgccatcctcatagctgccctgggctgtggctaggctgcctggcgctggaaggcctgtgcctttctcacccttcagcttacctccatttctggaatgtgagctggcctgatagtagggccctgtcccttcccaggaagctgccaggtactgaatgctttagtagccatcgcctttgtacagatgcctttgctaccgtgtgcatccattcatttttgtcttggaatgtgtaaaatctgttctctgaaaatttactttgccctatactctgcttttgggaatcaagaaggatcaaactagtagccaattttcaaaaatacataatttttattcaaatcacatctaaatttagagacacatcttctctgggagactgagatggtgtatcgaccctgagatggaattccatggttagtgctggagccatccctgcgtctgggcactgcttaccttgccatgatccccctctgggagagccatttcaccttctcctgtcctgtggacaggagttttgagttagcgactttatttttataacttgtttcagagaaaggtacttttattaaaggtttttaataagaaaggaaacatctgtgcctagagcttgttctgtggtgcatctagactgtggtggcttgatagcagacatggaagacactggacactgtaggggtggggcggggatggggagggtacagagtggttggtaataaccaggaacggtacagatcccaaggctgcacccagcatgcacataccacaagcttacacttacagcagaggatggtggtattctgtctgtttgtgcacctggtagattctcagtgactgaatcccaagcacctctttgagctgagtctcctgcaagatctct

SEQ ID NO: 31527 - DNA, 1194 bp, Mus musculus
tacttgcatgctagacaaacactactgagccacatctctctagggtcacttttaagggttttgaaaacagtgcacaaatgttcttctatatagagtgtttttcatgtgtgaccttattatctcaaattgtattgtgaacaaaagagcaggcttgtgtgtcagatctattcttcctctttctttcccaacaagaaagttggccccaagatgctggatcatgaaggtaaagaagtcccaggaaatcgaggttacaagtactttggggcagcaaaagatttgcctggtgtcagagagctatttgagaaagaacgtaagtagttcatgtgtttgagagtgcgttggcctttaattgttgctactgagtgagagaagtatgctgtatgctatctggtaggaattattgctcccagattttaaaaaatagtttaaaatttgtattcctaagtttattctatatttttgtagcatggtctcatgtacccccaggctttgaatgcctcatcttcttatatccacctgttaggaatatagacatctatcctttttgttaaaaaacaaaaaacaaaaaacaaaaaaaccattgttcacgctggcctaagacttgccaactaacttctgtctcagccttcatagttctaggattacagacctgtatcatcgtgtctcatttttgtgattgttgttcttgttcttgttttttgttttgttttcatctatcgttcatttttttaattgtaattgacattattagtgtgtcatcagacctctgctgagtaccattacccactgagccatctcatcgttgaattttatacaaagttttctgccttgttaagatttgagtccatgagcttgcacttgctagacaagcactctgccaccgacttccatcctcagcccttagctgggtttttccttcagtggtaggctttgttgttgttgacgacacagagcctttccgttttaccccaggcatgtcttaaactcgtgagctcaaaggtctgagtgatatcctgcctcagtctcctatgcgaccaggcctggctcaagagtggtgcgcatgagtcacccgtctcagtagagttaaggagaggtttgggtccccttgctgccccactgctggactctgtagaggtgactgggacccattgttatcttcaggctcccttgtaggccccttccttgtaggcttag

SEQ ID NO: 31528 - DNA, 1191 bp, Mus musculus
cctggaactcactttgtagaccaggctggcctcaaactcagaaacccacctacctctgcctcccgagtgctgggattaaaggcgtgcgccaccatgcccggctgaggatgaagtttttaaaaagacttttaaccccacattattgggaatctttgtttatagtacttggtcttcctttatttgggtgttagtgactttccttaatcaatttattatttatttacttttgagatggagtctcactgtgtatccctggctaggctagtactcactcactgaggtttgcctgcttctgcctcctgggtgctggtgttaaaggcatgcaccaccacaccaggccttttcttctgaacttcaatgagtagttttatgcagtgtacctttggggttgaagcctttctttctaaagctgtaacactgagtacatgattggaagtactgacattcattattgggcatggcatcttgaagaaatgatattaacattttttgttttctagctggcttaggggaattccgaattcgggacctgaatgacgaaattaacaagctgctgagggagaaaggacactgggaggtccgcatcaaggagctgggcggtcctgattatggagtaagtagctagagctccaggggcacctgggacaagctgatgacttgtctaagcattgtctgtgtgcattgtctgtaagttcagtccatcctgtccagaggggccaagggtggcagggcagagaagcagtgaaaaggatggtggtaccatcctgaaatcccgcatggcacaggccttggcctggctccccagagacattcctgtctgctgtcttccctcctgtagtatcatgattatagtaagacacatgctcccacactttgtttgtttgttttgagacaaggtcttcctattatgtagagactcctgactctcctggaactcattatgtagaccaggctggccttgtgtgtgtgtgtgagtgagtgtgtatgtgtgtgtgtgtgtgtgtgtgtgtgtgtgtgtgtgtgtgtgagagagagagagagagagaacgagaacacaaacatgagtgttggtgccaatggaggtgggagggggagtctgatctcccaggagttggagttacaggcagttgttatatttgagcagaatacctgtgagcctcctgatgtggatgttggggattgaaggcagat

SEQ ID NO: 31529 - DNA, 1725 bp, Mus musculus
caaggtttttgagaacctagtttttactcttctctgttcttggttagaagataaagatgtagactcttagctgggtacgatgatttaactcctgtagtcacagcacagagctagaaggttgtgtttacggcttgcgttgacttttatatgagactgttttcaaaagtaaagcccttttaaagaaggaagaaaacaattgcgtgcactgtaagggatttaaaaacaacctgggcagtaatgtctcataaaagagaaatagtcttacaaagaaaaatatacttatttgtgttcataagtttttttttttctttttctgtattgaccattgatttgagaacggtgttatttgttctgagaagcaatgtcaaaactatgtaatttttttttttttcaggtgtggtgaaactggtcatgtagccatcaattgcagcaagacaagtgaagtcaactgttaccgctgtggcgagtcagggcatcttgcacgggaatgcacaattgaggctacagcctaattattttcctttgtcgcccctcctttttctgattgatggttgtattattttctctgaatcctcttcactggccaaaggttggcagatagaggctgttcccaggccagtgagctttacttgcagtgtaaaaggaggaaaggggtggaaaaaaccgaatttctgcatttaactacaaaaaaagtttatgtttagtttggtagaggtgttatgtataatgctttgttaaagaaccccctttccgtgccactggtgaatagggattaatgaatgggaagagttcagtcagaccagtaagcccttctgggtttgagtgtgttcccatgtaggaggtaaaaccaattctggaagcatctaagcttccataaataactttaattcttagcataatgacggccttggattgtctgacctcagtagctattaaataacatcgagtaacatctgcatcaggccctcagaatatacagttgagttgggagtaaactgaaaagacaaatgtgttgaaggctatgccagggaatctggctcaaagcctaacacagaagcagcttcatcccagtgacgatgctggacgtacagatggtgatggcaaaggtgtagaacacattttttcaaagactaaatctaaaacccagagtaaacatccgatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaaaagcaactgaagtcctagaaaatagaaaatgtaattttaaactattccaataaagctggaggaggaaggggagttttgactaaagttccttttgtttgttttaaattttcatcaatgtatatagaacaaaataccatattaaagaggggaatgtggaggactgaaagatgacagtttggacttttctttctatgctaagtaatgtcttcagtaaggaaaagctggtgatagaagaacgcactgttttattaatttgtagagctacgaagagttctatggatcttctgttggctgttgccacataagcttggtggcttgagtttttagttccagaatctatgtagagatggaaaaaaggaactgaatccacagttgtgcttagacacatgaacaaaagaacattcttagcataatgatgg

SEQ ID NO: 31530 - DNA, 1187 bp, Mus musculus
tgtacataagagagagtactttgggagaaggcagtttgcatagtgtctaagacagacttctgagctcaactctctgtgggtttacttttggtaacaagtttttgagaaagtgaatagatgtagcccaggctggcctagatagaactccggattctctgccactgttcttggcttgaaattttaaattagtatttctgggtaaaagtgagtgatacatattttaattttccttgagcagtaagcatatatggcgtgcgcgtgcatacatacacacacacacacacacacacacacacacacacacttaagctggaccaggaatattgagatatttctgagattattaacacgggcatgttaatacatatatgccccatttagaagtttgtaagatatagtttcagagtttttcattttgcatatggtaggtgtatgaagcacaagtaaatagattggtactggtctttctaaccagtaagaattctaagtgtttaatgatattttttgatattccaaagctctaactgcagctatgagcagcaacgaatgcttcaagtgtggacgatctggccactgggccagggagtgccctactggtggaggtcggggtcgtggaatgagaagccgcggcagaggtggttttacctcggatagaggtatttttgtcgaataaaaaattttgaagtactccagcattcattaataccaagactggcctgattatcccaattctttttgtttctactcaaaatagggttccagtttgtttcctcgtctctccctgacatctgctaccgctgtggtgagtctggtcatcttgccaaggattgtgatctgcaggaggatggtaagtatttaacacttgatactcttgggagaggtgagtgtgtacttacacacagctttggaagggtttgtagcatgtggtttaaatatactactttataaaggttttatagtcttggtctgcttcttttccttattgttgaagcctgctataactgcggtagaggtggccacattgccaaggactgcaaggagcccaagagagagcgagagcaatgctgctacaattgtggcaagccaggccatctggctcgtgactgtgaccacgcggatgagcagaagtgctattcttgtggtgaatttggacatattcaaaaagactgcaccaaggtgaagtgcta

SEQ ID NO: 31531 - DNA, 1149 bp, Mus musculus
gctgtagggggtcttttgctttgggactgctttgcttagctgtcttcagggacacttcgttttaacatcacatgatttactctgcggtccccaaaggtgctgtttgcactcctggactgtactgctgttctcctttccttttatcacaggacagacgacaatcatccctggacaaggggtcttggaagacaaaacatgattgggtgtgaggccagaacagagttagggagcagcccttcccttcctccagagccagcttaaacagcacacgacagttcactagtgtaatgtgtgttacactcagtagaggaaatggggtctaaaatgtttccattaatctttctcctgttagaattagaaggccaagccttttgttttatccaacagagactggaaccaaggcttctgcttccaggctgcctatggagcgttgttccctgggcctgcctgagctgtaggcctgcgttggtctcctgaggatgtgagatctttgctcagctagacccttctctctgcagggtggctttgagtacaagcgtgccattgtggactgcatcatcagcatcatcgaggagaactcagagagcaaggagacaggattgtcacacctgtgcgagttcattgaggactgcgagttcactgtgctggccacccgcatcctgcacctgttgggccaggaggggcccaagaccaacaacccttccaagtacattcgctttatctacaaccgtgtggtcttggagcatgaagaagttcgggcaggtatatctgagctggggtgaccctggcctcttagcttcttttgcagtgaatttgcccagtaatgggacctaagctctcagggggacaagcacactgggaacatggccttataagctgttttttacattgtcagaaggattttagatgccaaatggataaatgatttttttaaaatttaatttttttttaaatttcattgtatattcgtacttaagagttttttgtttttattttttgagatagggtcttattctatagccaagctggttcatacttgaaaccgtactgcttcagccttctgtgtgctggaatcctaagtatgtaccaccatacctggagagagaacacacaccacaagatttatctttttttataagtcagtgatct

SEQ ID NO: 31532 - DNA, 1890 bp, Mus musculus
atgcagtgattgatagttactgcagcactatgtccttaagggttccagagctcagggaagcagtgagagttgtccaggcctcccagttgtgcctcagtgtgtgcggtgggggtggggtggagtggggtggggtgggggtgttgatcatgtgtcactctcagcacagcctccttcagcctcacaaaactctgcttcctctcacttacaggagtattccggggtggtcatgacatccttgtgcgttctcggcttctgcttttggacacagtgacgatgcaggtgacagccagaagctcagaggagctgccagtagatatcatcttggcatccgtgggctagaggtggcctaagccccactcctatcttgtccaacactacgtcgaagccacttcttccctgtgaagccggtggaaacccttccccagaccactgtgttaagaaacaatcaagagtcaatacagatttttttttttaattccatcctatcattcaggaatgctagggtagattttgtcaccatgcctgcaaggagagacaaatgaataaaatgttcagactttctcttaatatttatactcaaagaaaccgtctcatccctatgataagtcagcatgtatttcttgaataactgctgcttctgcaggctcgtgctcagggcctccacttctccctgaggcctcccttcaccaaatggagcgtgtgcatagcccctcgggactgtcagtgccaagcttagggtggggttaaaggctagccgaatgacaacagctagcaggtctggtaagccactcatctacaggcatctgtagatggatgggtgtccaaaggtccttagagggtgtcatgatctgctctgggtctatgagtgggaaaaacagtatctgcattccttttgggctggagtaagaaatcctaggggatgcttcagggcttgggctttaaactcaaatcaggtggtttaaactgttggaaacacttgaagaactggacctcctgtgaggctactcagatggctcagcaggtaaaggtacctatcaggacggactacccacttggtagaaggagaggaccattttgcaatagttgccgcctaacctcatgcacacctgtatactgtatgcacatgcacatgtacacattagaacagaggcctgcacctttaagccgaatcccataacatgaagacatcaggctacacttgagcatcgttaagctgttttagctatggcctatttcatgactggtcctggctccaccatgtacttggtcaggcatgcagtggtgaactaagtaacgtggtgtgaaacttcctaacaggttataaagagatttctcatttggggggttttctcaagtaggtgacctgaaggctgctccctaaagacatccctctgtcccccaccttccatccctctcctggggactgagcagttgctcttgcctggcctctctgcctcattccatccctttatgaaggcctctccaggctttaaaggaaagcctgaccttcaaggccacatcctgcttagcccttcctgactgtattcttcctgcctaataccctccccttctactcccaggcctggtcatagcctggaagccattccattcaaataaacttcattaaagaaattggtgtcagcctccttttgtgaagattacagcttactctagttttatttaaaggcttgcacacaccccacacacaaatgttaaaaaggaaaccaggtggggcttcctgacccttaggggtttgtgggaatagctagagagtctcaattcggatggccttacacattgagggtgggcagcacaggttttctggcttcagattccggcctgggaagggggaccctgaggcctcctggggtgcctgtctcaggtcagtgc

SEQ ID NO: 31533 - DNA, 1240 bp, Mus musculus
ccttttactacaaacatgtactgtaacacaaagaaataattaaaaaaaaaaaaaaaggaatgtctaagctagacaaacacctttaatcccagcacttgggaggcagaaacaggtgcatctctgagttccaggcagccagatctacatagtgagtccaagacagccacagctacacagagaaaccctgccttgaaaatctcaagaaatgtctaaagctagatgtagtggtgcatgtctttagtcccagcattggggaggcaggggcaggcagtctgtgagttcaaggccgacctggcctacatagtgagtttcagccagagctacataatgagaccctgtctttttaaaagaaaaaaaaatcttaagagatttgaagtgcagaaaaattaactcctctgggtaggtagctcaatggtaaactacttccctaagatcagttctcatctggcacttcaaaaaagaagaggttatctcctccagggccacacatgattctgagtgtgtgtgtgtgtgtgtgtgtgtgtgtgtgtttgtatttgatgtggttctgaaggtggaacctaccaccttgtacttgctaggcaagccctctgctaccacagtacagtgctaaccctaaccctatgaccatatcctttttattctctctcaggttcctctggggaaaggacggcggtgtgttgttttagcagatggattctacgagtggcagcggtgtcagggaacaaaccagaggcaaccatacttcatctattttcctcaaatcaagacagagaaggtatgagcagttgtgtaaacagtatgtttggaaaagacagagaaacaaatcaaggtcatatagcaatgtttctgcaaacattataggacacatataatgttgattctactcattggtgtataatataaggtatgttaagcatactctctgctgttactacaacaagaatgcttaatgtcacatttctcaaaactatcttatcattaatacagaactacagtttatttttgagattataatatgattgcaacatttctccctttctttcctctaaactctcccatatacccctcatgtcccatggcctattttttattgttattgcatgtaaatatatatatttacattcctaagtataccctgctcaatctgtatacattggagtatatgtatgttttcagtgctgaccatctggctctggacacaagctggtgtgctcttccctgggaaagacatttctcc

SEQ ID NO: 31534 - DNA, 1140 bp, Mus musculus
tctcctaaaatcagctgtacaaccagtaaaatttgagtctgggctgtaaaactggaaaatagtttgctttctattgccatgaccaaatgaagctccaggtggagagggtgtatttaatacttatcttaatcttagtccatcatgaaggtaagtcagggcaggaactcaagcagaggccatggagacatgctgcatactggtgtgctcagttactttttccccatcaaccaataatcaagaaaatgcccacagctatgcctacagtccagtctgatacagttttctcagtttgcctttcatcttccccagtggctttagcttgtgtcaacttgacaaaaaactaaccagtacaggggaaataaggttgagaagacaacactgtctgccagttgtggaggcacaggcctataatataacctagcactgggaggcaaaggcaggaaacttcgcacaagtttaaaaccagctggtactgcataggaagatactgtctgtcagtgaaacattaaagaatagtagtatctggtgctggggggaaattgaacattttatcaaatgaatagtcaccttcatttatcttttgtgtgattgctagaatccttgagtgctatatttacctgcatttgtggctttttcaaagcaaaaagttttgggatatgtagctgtatttgaaaccaccaaaccaacgatactagcagcaaagggagcagattttgtggtattgaagcttgttacattaaataaataaattgtgctttctctgtgagaagacttaagtattttgtgatgttggtcagatatggatctttatttttgcagcatcgtcaccagtggtgtttacttcatatctgttgtcttggagataatcatgttctcatttttatttcaaaatgcttaacatttctagtttttcaatatttaaaagtttcatttgtacacacaatcaaacatgtttgagccaggaaacctagacatgtttgagatgttaaatgagttttttctttatttgtgtgtgtgggggggggtgtgtgtatttttaaagcatatttaatttttaaaaatttttatgtgcatcagtgttttgctttcatgtatgtctgtttgagggtgtcatatccccctggaactggagttacaaac

SEQ ID NO: 31535 - DNA, 1197 bp, Mus musculus
gcgctgtcttactgggctttcatgtgggtgctgggaatttgaattcaaacctcatgtttttcacatcaaaaagtattttatccactgggccgtctctttttgataggtgaggttgttgggtgactccagagttgtcttgggtagaatcatctgattagtcaaaaccaggcgagccaggcgtggttgcgcatgcctttaatcccagcactcgggaggcagaggcaggcggatttctgagttcgaggccagcctggtctacaaagtgagttccaggacagccagggctatacagagaaaccctgtcttgaaaaacaaaaaacaaacaaacaaaaaaaaaaccccaaaaaccaaaaaaccccaggcactgctaggtctgcagaagggggtgcagtgtgagtcctttttctggaaatggggttcctggtgagattcctagggaactgcacatttttggctagggaaagagactggccttaaccagtaacaggttggaattcttctctgctggtgagaggcttcaagcatattcctggggccggggcccccttccttatccctgtctgtctcttctgctttcctgccgaatgttgaaactcactaggccctgcttcacttctgtttgttgttgttgttgttgttgttgttgttattgtttttgtttttttgtgttttttttgtggtttttttgttttttgggtttttttttcgagacaggatttctcttatagccttggctgtcctggaactcactctgtagatcaggctggcctcgaactcagaaattcccctgtctctgcctcccaagtgctgggattaaaggcgtgtgccaccactgcccagcccctgcttcacttctgactcatcttgaaatgatttctgagaagcaggcaaggaccttacgtcacataagtggagacccctaaagacaaagggaccccttttaggttgctggtagctatgttggactgtgtattgctactgctgctgacaagtctacctccaaactaaacttccccacatctgtccaagcctccatcctcacttcaccccaggtctgctagagggatgtggtgccaggctctgctaatagactccagtggctgctcatcaggcagcgagctggctctgcagcagcccgggtaagctctgccctggctccagcttcggcacactcccctttctgccttatgcttcact

SEQ ID NO: 31536 - DNA, 2057 bp, Mus musculus
gctgctgctgacactcctcacaaattctgccaccctttcatatgggtacacagtcaggatctgtccctgtgactccagtcatcaacctccctccctctctctctcctatccaggaaacagaagtggaactgtacaatgaattccctgaacccatcaaactggacaagaatgaccgggccaaggcctccgcagaaagctgcagttgttgaaggggcagtgagcacagagtccttcacagaccaagaacacacacgtaggccttcaatatgcgtccctcctcctccaaacagaccagaacgtgagctctcacatccagctgccaaaagaaactccaccgaacagttacccaacacacacacatacacaaaacacactcgtgcacacaaaaacacatacacacaacacacacacagcaagcaaactccagcctgtgcctgtcagggctcctggggcagctgcccgcctcgtgggccctgtgtatggcaggcatatggcagagaccctgggtgctctggggtgcagtgggcatggaaagcttactctttttgtccactggagagtgagagaactgttcacagttcatctgtgtctaattatctgattttttttttaacggtcttgtggtcttttacccctccctccttgaaggtcctgtgggaaggctggtgcccaggctccgttctgagcaggctgttttgtatgtatctgttaatgcttgttacttttaactaatcagatctttttacagtatccatttattatgtaatgcttcttagaaaagaatcttatagtacatgttaatatatgcaaccaattaaaatgtataaattagtgtaaggaattcctggattgtgtgtttaagtcctctaacgcaggcgtgcaaggtggagggttgaaccctgtctggattacagagtgttagagactcaagtttggaagtccagctagcggcagtattctgtacagtagacacaagaattatgtacgccttttatcacagacttaagagccaaaaagcttttcatctctctgaagggaaaactgaactagacagttcccttctgtgtctaaattttccaaaaggttgatttgcttaatatagtagtgtatacaatggataaattgctgttacttcaagaattaaaattctcattttctccctttctgttttttttccttatattcaacactttatgatgcccttttgtcactatcctactcaaagaggaaaggagaacccaccagacctgtcccagtgactctacctttgttctagaaggcgctcctttcagggttgtggtacctgtaggttagcagaccctcctcctttcccacccacccaagtgtggcccagcactaacccaccgtctcttgggttgagccctggcagttctgtcccttcccgaggtcctgccctgcatcatggcttgcttcctggagcacttccccttcagaggtctacattctagggtgtaggctgagttcttctgtaaagagacgaacgtgatgccaataaaatttaacaagaacaaagaacagctgctgtctgtctttttctctcaaagatcaagctatgtggggacattctgtatgttcatgggactcttggtgctcagaggcaagggggtgatccctagactacctaccctagtgtggatctttttcttagccactggaaacaaaaccgtggcctttactctggttattttgctgttttcctttctccctatcacaagccagattgatttgggctgttgaagacattttgagacaaaatatggttgggtgtgaagtaggaaggccctctccagagccagctcattgtgctcaagcagcccatgacaacttaatgtacacacaaaaagcatttttctctaagactgaactggcagattgcaatgagcaggaaactcactgagttctggctgcaccctaagtacctggccccctcattttgcccagatgaatcgtacctactgagtcgtgcattgggaagtttctaaactccagttcatccatggtcacgaaggttcaaactgacatggtatctgtctcta

SEQ ID NO: 31537 - DNA, 1230 bp, Mus musculus
tttccacatttaccataaattaacaacccgggagactcaaaataaccaaatcctatgctcaaaacaccgtccgctgttgtgggaatcaatggctttggggcagcaaccctgtgtagtttccagagttggaagctgaagaaagtgactcttaaggtgtctcacttcactgcggcccagtcagcatgttaggtgcttcctttctgatactcaaaaaggctactaagaaatcaagctatggccaagccatatatatatggtgcacatatttaatcctagcagtcaggaggcagagacagaggcagtggtgggtctctgtgagttctagacctgcctagtctacatagtgagactttgtaaaaagaagtttttacaacaggtatccaccggtatagtgttattcatctcaaaaagtgataccagccaggcaatggtggtgcacacctttaatcttgggattaaagtacttaggaggcagaggctgacagatctcttaagtttgaggacagccagggctacatggagaaaccctgtctcgaaaaacaaaacaaaaaggtgatgctagatcttcagtgagactgaaaccttgctgagtcaacacagactctgggacggtggggttgggagtaagactccatatgtatgtatgtatgtatgtatgtatgtatgtatgtatgtaatgtatggtttagagtatgagaaaactctagataggacaggtggctgaaggaagctgtctccgagggttcagcttccttacacagcctgtgggtgtttttcttatcagtgtcactgagcttaataggctgtcatgcactatgggggtggggtgggggtggggcagcattgggcagtgagaataggcagactttgtctgatagttgatcttggttgctgacttcatttgactgagagatacttaggaaatgtataaggcttgtctctgagtgtgtctgtgatggcatttccagaagtgatttttttattgtattgattttattgtgtgtatatgtgtgtgcatgtcccagcatatatgtggaggtcagaggacaactttcacaaactggttctctccttccaggctttaggaccggggattgagctcaggtcatcaggtttggaggcaagagcccttatctgctgagccatctcactgaccccagagacagttaagtagggagacagtctttgaatgtgggtggcaccatctcataccttttggtgggaggtgga

SEQ ID NO: 31538 - DNA, 1152 bp, Mus musculus
tttcccttcaaatataaactttaacttatcttactttatttggttttatttttcaagatagggtttctctgtgaagccgtggctgtcctggatggaactcactctgaagtccaggctggcattagagatctgcctgcttttgtccctcaagtatgaggattaaaggcatgtaccaccccagtgccctacttttttttttttttttttttctagacagggtttctctgcgtatccctggctgtcctgcctctgcctcccaagtgctgggattaaaggcgtgtgccaccactcctggccccacatggaaataaatataaaaataagagaattttcacaaattttcactccttgtgcctttttcaatccattatctccttactgctgttaactcaagtgtactggttttttttcatctttgtaaagctatttattgagcatcttctccaaccccggtcccatcccactcccacgctcaggacatgaagccagctgcagctgatttctaacacggtgactaatcttgcttggtttggattcctttgtgtgaatggaatcatgcactgtgcagtcattctctgtatctctgaaacctgtgtcatgtgtggttttaattccattttcattacactgtaatatttcattggtgatgtggcgtgcatctgaagtcttgttactctggaagctggtgcaggaccatctcttgagcctaggagttcaaggtcagcctggggagctaacatatgaaggaaagcctgtgtttttcctttttcttttttttggtttttcgaggcagggtttctctgtgtagtcctggctgtcctggaactcactcagtagaccaggctggcctggaattcagaaatccacctgcctttgcctcctgggattcggtgtgcaaagccacgcccggctctgtttcaaaatataaatgaatgaataaaaagtggaaaggcagggctttagtctgtgtgtctgtctgtgttccatgaacccagtagtttaaacagcagcagtgtattccttacagttctggagactatgtacctgagctgcgggtggacagaaacctcttttctgtccttcatactagcacccttgtttgtgtgtgttctgaccacctccttttagctatgctaagggccagccctaatg

SEQ ID NO: 31539 - DNA, 1209 bp, Mus musculus
gccagtgacttcgccttggactcctacaactgtgataaatgtcaacaggtatctgaggttaatatcatcaaccttggttagttgcttaaggtttctgccatcactcacattaatggttgaactaaatattagaggagagacttgagtttctggaaatttcccattttcctttaaacttttgcccacttagcattcgtatcactatagagaaggcaaagttagttccttagactaagctatagtatactgtttttgagctgagaggccagagttattttgcataagcatgaaggaaacagacaggatataaggaaatcaggggtgaatacggctattaagcgccccaagaagtacgcctgcactttaagattttcaatcaggcgccccacgatcgcccggttgccctggagacggggtcctttctgaccgggcccagccatcttgtggtgctgttggccaatcagcggttgcgccgtggcgggggggcggggcgcgtgtcggtggcgctcagctcgcggtcatggagtcgccggtcgccttgctgttgctgctgctgctatgtctcggggccttggccccgacgcccggcagcgcctcctcggaggctccgccgctggtcaacgaggacgtgaagcgcacggtggacctgagcagccacctagccaaggtgacggctgaggtggtcctggtacacccgggcggcggctccacatcacgagccagctctttcgttctggccctggagccagaactggagtcgcggcttgcgcacctaggcgtgcaggtgagcggagggaggagccggcgaacctcacgcgggatgcctgaggcgatcggggatccctggggaggggcggggaggttgagggcgttagggatcctccaggtgtctggttgtctgaaaggcaggtgttggagggggacagcggagaggttggggtccgccgtctctcttgtccgcgtgtcctctcggacacgtcagcacaagcttccgagcgtggggcaccgcccacgtggctgctctggagcccaaggcgaccccttggtcccctggcgacctccttccgcaccccaagaggatcttggctgtggccgggtgcggtacttcgggtacccagcttcttttctgtcccctggacttgctcgtctagtggaggactatcagtgagttaagacaatttatttcctgaatgcaattgactggtgtag

SEQ ID NO: 31540 - DNA, 1227 bp, Mus musculus
ggaattgaactcaggacctctggaaaagcagtcaatgctcttaacaactgagccatctcttcagcccctcccagggtcttcagacagtcctaatgtagctctggctgacctcattctccctctgtcactaacggctcttgaagccctcgtttttcagtgctgggattagagatctgtcacttgattgtctttggtagtccttacactcttgctattaaaacctgaggtgagcatctggacatctgtctttaaagacttacgttaatattttaaaggtggtaacttttatcttgagcataaaatttactgtgactttgaatatctctgttttcagtatctttaatctttttttttttttttttttttttttttgagacaaggtctatgcagccttggctggcctagagtttgcattatagaccatgctggcttagaactcacagggatctgcttgcctctgtcttttgaatactaaggttaaaggtgtgtgccaccatgcctagccagtgttataaattttaattctctttcttcctccagtgggagatttttcacggtcaagctcccagttgctcttgatcctgggtccaagatctcggtcgttgtggaaactgtctacacccatgtgcttcatccgtatccgactcagataactcagtcagagaaacagttcgtcgtgtttgagggcaaccattatttctactctccctatccaacaaagacccagaccatgcgagtgaaactggcgtcccgaaatgtggaaagctataccaagctggggaacccctcgagatctgaggacgtccttgattatgggccttttaaagacatccctgcctacagtcaggtaggtttcagagaccatctcaccgccatgcttggatgggatatgctaagtcgcattctgacactcctctgaacctatcttgaagtgactcttactcccgttaacttcttgagaactgagtttagaggctggcaagtgagcatcatgggagaaggcagtgagctattctgggtaggttagtgatggacaagagagacactggggtggctgtgtaccagaggctgaggtaagaaccttgggtttgggactgaggaagagaaagcaattcatgattaaaattttgttgtggggtcaggtggtatagtggtatatgccctcattcccagtactctggaggcagagactgggggagtctcttgagtttgaggccagtctggtct

SEQ ID NO: 31541 - DNA, 1149 bp, Mus musculus
tggtaggagcagacagacacttacagggctcctgtccttagtgcgagctgctaatacttttgtgtcactttatctagtttctggtctctgttggttcatataactactctgattagcagggtgacgtgcactttgactgttcacgggaggagttgtttcttcaagctaaattaccgtgatgttactcttacggggactttaagcctggccagaaagtaatatctgtgccctagccctgaaagagactgtgatttgtataaggaaagagcattccgaataactcccaaggcattcttcaggttctgggagaatctggtggactgtactgggaagctgcacactgtccttgtgagcactggagggagatgagtccagtcttgggctgaatcagcagcaggaggaaagggctgccagatgctggcagtaggcagggtgaagtgtgtgaatttagcttcttgctgccccttcgtcttagaattgtgcagcccacaccgtcgtgtgttggtgtggtttgttgaggctgtgactgtgtttgtgtgtcccaggaacatccaggtggacagtccctacgatatcagccgggccccagacgagctgcattatacctacctagacacgttcggccgcccggtgattgtggcttacaagaagaatctcgtcgagcaacacattcaggacattgtggtgagtggctctgctgtttgtggttggggttgtgggcaggacgtgagctgctcttctctgaccttcgcctttctctgtcctggctcacacgcaggtgcactacacgttcaacaaggttctcatgctgcaggagccgctgctggtcgtggccgccttctacatcctgttcttcaccgtcatcatctacgtccgtctggacttttccatcaccaaggtactctgctctcttcctctgtgtcaggcgtcctagtgcccccgtgatgtgtcacacacatctccaccgtaagatacccaggaccttgtacctctgagaatgcaatcaccagcacgccatgttaagtctctgcttcctgccttgttttggttgtagaagcaacctggacactaggtgaggtcagaacgtggttgagtgactggtggtggtggctctgctgttttgctccttgttactcttctgaacatgga

SEQ ID NO: 31542 - DNA, 1137 bp, Mus musculus
cagcctggactgggggtggcctctaagggatgttaatggcaggaagagtccacgatgtttcctgaagtccttgaaaaccttagaaggagtgatacaagatggcctccctgaagtcttccatggctagagctgagctctcctgccagtttcatgcctcagtctaccattcttgtcctgtcatgtcctgtcatgtccatgtgcccagggaactggaaagtgaagcctcgtccagtctttgttgttgagcatggtcctcactatgtgtcagaaggggttgactcctggtgttctgaggtgacttctgttggctggtggcagtaggcatcctctggcaggtaggtcggagtgagcctgttgacagacatgtcatctctctaccttccaggatccagctgcagaagccaggatgaaagtggcctgtatcacagagcaggtcttaaccctggtcaacaagaggctgggcctctaccgtcactttgatgagactgtcaatagatacaagcagtcccgggatatctctaccctcaacagtggcaagaagagcctagagacagagcacaaggctgtgaccagcgagattgctgtactgcagtctcggctgaagacggagggctcagacctgtgtgacagggtgagtgttagtgctgtgagtcacttttctgtggaaaagtacacgctgtgctccaggaactatttctggctgaaagcagcatccacccgactccttgggctaggcaaggctccagtggctctcctgtcccatatgtgcagaaccacaggctcatcaagtgctgccagtgcatgtggtgggacagaaagcttttggtatctgtaggctggcttggagaagttctgcagctgtgtccttggggctggcagggcagtgcttctcctcccagataccagtcttcagctctgggtggccatgcctgtaacctcagcacgctggacgtgtgtatatgtgtgggagtgtgtattttcagatgacatccacccagggcacataatatcctggccaaagggtaagaccttgtttttaaaagtaaataaataaaccaaatgcatccagacataaatcccaggctctgatctagactctcaatgtgagcagattatctaatttctctgtttcccttt

SEQ ID NO: 31543 - DNA, 1649 bp, Mus musculus
ctccctgttagctcctccacccccaccttgcctctcatccgtgccctttagttcctttagagcacccaccatggaacaattattcatgtgcctagagggtttatgtgtcagctccttgagggcggaaagaacactttctcctttgctgctttctggagcctggcacttgggacagcagaagtggtctggtcctaacagatgtctggccccagtaaagagaagacacttagggagcccgctgtgcccaggcgcgatgctggggttccgtggctttatcttgcttgtcatttgaaaagaatgtgccatgtaaatgatgaggccactgttttgacctgggcagttttcctacttgccagctctcttccataggcgctacttttgctgagtttttgaatcttcttgtgtcactttggatatgtaggcctggggggaggggggcagtggggctgttgagtggggtgaggggacggctcccaaaccctgtcctgttcttgtctctgccaggtgagtgagatgcagaagctggacgcccaggtcaaggagctggtcctgaagtcggcggtagaagcagagaggctggtggctggcaagctcaagaaggatacgtacctggaaaacgagaagctcagctcaggaaaacgccaggagctggtcaccaagatcgaccacatcctggatgctctgtagctcctggctccagagcaggcccaggtgcctagacttccagtggcattggataggtagaaagaggaggttgtggttagcccaaggcctcaagacaccactgaggcctgtccgtggcagtggcctatccgtggcactgcgggaagcttgtcccttatttctgaatggttcccttttttttaaaaaagcaaaaacctagacaaaaaattctgtttaaaagacaaacttggctgtgttttgagcacaggcgtttcagcagttgatgggtggtttctgttttgacagctggggatttttctgtcttcaagtcctgttttatggtcttctgatttctaatgtttgggtcttttgtgagcgtatgcatggttttttaaaagtgtgtatgaccaaatgaaaataaaggagggactgtgaacatttgcttttgctgtactgaaaaatctctcatgtaattctgaagtttggggatattgcttttatcaagatgggttttcttgttgtgtgtgcaaggcaagtgtcagaacactgatacaagtctcgagaggcccagtaaggtccggaggccacacaacaggggtggagtgagcctttgtattccttaaatctgtgccacacgtgctgagcattagaaactgtgatgggcgagcagtcatggttcataatctccaattggccacactgtgaggaagtcatggactggagaacactgggctaagtctgggtgggtgtgtgtttgaggggaggggagtccagagctgagccttaagaaccgtgcaggccagtgttccaggcagtgggcagtgtgtgtgaagggccctggtgcttgaggacccacagagggcctgtactagagtggatattacaggttatgacagggctgcagaggtgcaagtccagaacaagatagcttcataggtctctaaggctctggcttactttatatcagggcagactgagcactgggc

SEQ ID NO: 31544 - DNA, 1246 bp, Mus musculus
ctgcccctggaagccagccttccaccctctcacctggagtttcccctcgtccatttgtcctttccatttgtccttcactcacatgctttccctcaagcacggtgccagctactggcgatctcttaagtgcatgaccttgtggagtaggtggggatagacaggcagatgttaacagcagagagtggactgtagtgataggtggggagactcagccatacagaagagagctctgtagaggtctgcctgctatgggtgcctggcactggagtgtggcatggcaggcagggcctggatgacatctggaaaccagatgaagactcttggagcttggagcttggggaagaactgtacatgaggaccgtagggcagatgtcctacagcagctgcctcagctgcagcatggaggcctcagcaggtccctcttctcactgagttaagttgcagcaatggtactctggcctgtgccagcttgcaaggtggccctggaggatgccagtggtgtagcccctgtacccataggtgtttatagcagcatttcttttccagctcctgaagtcccagatttccatcccaacgagagacccctctggaccattccttatgtctgtggaccactgcttctccatcaagggtcaaggcaccgtgatgactgggactatcctctcaggcactatcagccttggggacagtgtggagatccctgccctcaaggtcagtcctgccttgactttcatttgtctcatacaccccccaccccccaataacagtaggagagaggccaggcccttggtcttcagggcaacagagtctaatgaacctttctcaagttctcttctacctaagggatgaggtagcctgcccctctgtgacaccatctgttattcaaccctctggcttcctggattctagaactactgttttccctagtctcatagtagtgactgtatagtgtgagctagtggtggcccacaaaagagattcctaaaataaaccaagtcttcaggggtagggtgagcttgaaagcacatggtcaagaacctagggtgctgggtgaaagtccaagctttctgaatattggcaaaaatatgtgtagaactatctctatgcttcataccccagccttaaatctgtagccttaaatttatgattctcttgccttggcctctccagcactgagattcatatgaggggtgtatgtgtgtgtatgcacacaagccaccaaatctggctttagatctctgggcac

SEQ ID NO: 31545 - DNA, 1170 bp, Mus musculus
cattggtacaaagcatgagaaagctatgtttagaagaaaagacagcatggggctgggagggattatgaactgctttttccttcttccctgacagtgttattgttagttttgttttaatgaagatggcttaagtaagggattctcctcagcgagaagggatttctagatgcagctttaggaactttgggatcaccagtagtcctaaatttcagagaaccagattgtatggatcttttaaagagcttgtagtttacgacctgcctagatccctgctgcttcctgagggggctcaggaggagttgaatttctaggtgaacctcttaggttctgatctaagtctttctttgtaggacttctgtttcacctggcaatgcagagcagtggtgctaccttcccatgctcacctgcaggctgaagaggaggcacgtggcgtgctcggtgatgtgccagcagctctgctgtctgtgccgggctgtgctgacagcctctgtgactgtcctgatggttgttctatttcagattccggggtgcaccgattattcccgtggcagccaaacctgggggaccagaagcccctgaaactgaagctccacagggcatctcagaactcattgaggtactgtcagcttgaacctaggctgctctctgccccaaccctgctcaagtagttctccatgttccactctgcctaagagggagggagaggcaatcctaggaagaggtctccaagggcctctctctcactctgatatcagactcttcacctcccttggaaactgcaaaacaaaggtccatagaagccctggacattggactctgcaaagttcttcctacccactgtgtttcctattctgcccctcctctttcacacttctttcagacaaagcagtgcctttctctgttacctgtccctcaagcctcccattgcccccaccccttcctctcactctcagagaagactcagtcttgtacgcatatctgatcacaagctccattcctgtccttcagattgtgcagtctgcctccacctaaagctggagcagcacagcacagcctccatcctggcagcctccactggaggagtagacttttttttttttttttttgtagaactatgggctcaggctgtttttccaggctcagtggcaatgggcagaaacggaaccgaat

SEQ ID NO: 31546 - DNA, 1196 bp, Mus musculus
taagatcccggagtgctaagttcttaggaacctgggaagtcagcagtgattatggggttcaactgatcactatgaaagaccacatactgatgaatttcctggggtcagcaagactcctcaagtctgggggagagctctggtgctgctctgccctgtcgatgttcaagacttgctgatgcttgttccatcctgcctctctctcctcccccagttagccagttcaccctccactacttgtttgttttctcttgatgtgactgtgatggtactagcacaaagtccttgtgggctttgctgctggtttcatgaacatatggtgattgagaccagaccttacttgtcatgtgtcatttgaagcaggcttgcaggctgcaaaacctccttgcctgacttcttggctttatttctttccttgggcttcttaatatcctaaaggtagggctaggtgaccttattctgtaagtttgatgacacagaaagagtttcatcatcatgttatcaagttcatttagcagtccctaagagatctgcatgcaaggaaggcagaagttaccctagcctcccagacaggtgggaggcaggtattaggaagtaacaaaaccataaagattgtgagttatggtcagtaccaaggacagtacaggactgttggctttggggtatctcccttacaccttcctgaggcagtaggattgaaagtaaattctggaaaagtgtggggcctgtgactggtgagttggggatggatactacatgtcagaggagcagcgcctgcagtggctctgaggagggcaggttgggctggtctgtaatggggagagggggtggtaggcagtcatggctatctttggacagatatgcacacttggattctgttagccctggttttgctggaggacaagcaatggtatattgtgatccatggacacagagagacattcacactagccctctacaggtggttggccataccaggttttctttactggcttttatgtgtccttagtcctgccggtttctgttaccaggcctcagattcatgtgggtgtttcctgcccttttcttaaaattttaatgtttttattgtagtattggagaatcgaatctcaggcctcctgtgtactgggaacactctgtactactttcctgtagtagagcaatgggctgaggtggaaatagggttggcaggcaattct

SEQ ID NO: 31547 - DNA, 2220 bp, Mus musculus
aggtacatccccacagccgcagcctttggtgggctgtgcattggggccctctctgtcctggctgacttcctgggtgctatcgggtctggaactgggatcctgcttgcggtcaccatcatctaccagtactttgagatcttcgtcaaggaacagagcgaggtgggcagcatgggagcccttctcttctgagccttgcgtgcccgtggaccagggtgagggcacaggctccagaactgcccaggaagggtgctcttactgctggagcatgctactgtggcatagggactttaatttttttttttaattttttttaaaatttcatatcttttcattccactgtgtaaagtgctaggaaatttccaatttgaaattttgctttttctggcattggcaaaaaaccagtagaagtgaattgttagctgatggccagggggtgtgataacaaattgtcctcaagtatcccatgtaatttttatttaaacccttgcacttctcagtgcctggcagctgcaagggtcccagctgccccgaggcagtctgtggccctggttgaaggaagcacaaactagatgtctgcatctcatctgggcgtgcagacaggtgaggatcagcagggtccacgtgtctgctgttgccagcaaagggggtcactggctttacctggagcctggccagctaggtagctggacgtatataaagggtcctcgtgcttgttctttgccagttcccactagaaaaggcgctcctgtggtggccacctctgtcttcctactgagaacttcctgttccaggttttagaattttcttattgtcgttaggaccaaatgtagactggctcaggacctgtaaggaaatcacaggttcagagatctcttagggaagttgctcaaaatcctgtttgtagttaaggtgtctggggtaacagataacatgggcctgagggagccctcaggtctataggaaaggcccctcttaagacagaaacggtttaacagcaagggtacaaaggctgtagtttgaggccagagcaattagcgcttgtcagcttaccttacaacacagagggtccagctgttcacacaagggggcaggagctctggtgggtgtgcagccatgtggtcacagcctgccagcagcaagacacctgggtccaccacacctcagtggaagtagcagaatgcctccctgacccggggctcttagggactcttgctgctatgcttgccagcaaatggcaatcaagggacaattagccacttgccccgacacaggtcagcatcagggccagatcccttgcacacagcccagggcgcacaccatatcacacgtggccttgtctagacccagtcctgagcagaggagcctggtgccctcccagtccacagggtcttcccactgcccctcctctgccactgccacagagcagcttcccacctaccctagggactccacagcttctggcaagcaggtgcagagtccccagctctgggctgtgctggggagtgtcaggcctggagtccacagcctcacctgctgctgtagctgtcagctggacctggtggcttgtggttgatggtcactattagtgggtgagtggggatgacctggcttccaagaggactgtcactgtggacaccaaaatggcttaactgagatacagtgaaaacatgacaaataaaccaactttttacaagctgcctcgtcatctttgtaaacggagagcagaaagcttgttgtgagtgttggaggtgaaccagggcagtcagcacctgtgacaactcctgggacctactatgtcaatctctgcctgccggcctcttcctgggaccagagggtggagtccctgtacaccagcagggagcagtatgcacctgggtcctgaagggcactggaggttgctgcccaagccaggtaggtgacccagttgttaggagctgctaggtttaactgttcaggctcagagcacagctgttaaccagagagtctgaggctgctctggggccagagcctggtggggacaggtgacctgggtggtacacctaggatgcctgccagcaactttctgtttacacacctcagcaagggacaggcgacagaacagttcttgggcaagactaggacagtgaacccagcaagcccctacacatgctgttctgtactgctttggaacgttctctgctgtgttgagcctgactgtagaatcctggcctgagcagtggc

SEQ ID NO: 31548 - DNA, 1517 bp, Mus musculus
tcagaggaaatgggatcaatagccaggccactggcactgtgggttccctttcaagacacctgaaatataaacttagatccaaaaggattggttttatcccaaagtcttgtacgctctggactggacctgaatggtgagctttcaaggtagtccacctacggctcagtgtagaggtcttcatatcccagggtcttgtgcacctgggcttcagggacgccagcactgcattgcgtctctgaatttgcttggcattccatgcttttcctaagaccacatttgccacatgtcaactccttctacattaccaagagactggagagcagatgtgcttttgttgagggcgcctgtgttatctcaggctttgacagtgtgactgttgggattcctccagctcctcggcggcagtgtcagcactatgttttttcttctcaatgttgggcatttgggtgttcattagccacttcctcttctttgtactgtcctgctttgagaacacagctctcttgatctctagtgtttggaatgatcattactatcggtcagtccattgtgtatgtgatgacgggcatgtacggggacccttcggagatgggtgctggaatctgcctgctgatcaccattcaggtaactgttgtgctgtggcccccaacccccacccccaaataccaaatctcagctgtgccttaaaagaagctggaggttgtaggtttgcccttgttaagagcagatgaaggctgagggcacaccccactcggctttctgtttttatactcaagaactctattattgaagaagagagccacatccactgggagcagtaacatgatctatttgggtttctttacttttttcttttttccacagctctttgttgctggcttaattgtcctacttttggatgaacttctgcaaaaagggtacggcttgggctctggcatttctctcttcattgcgactaacatctgtgagaccattgtgtggaaggcattcagccccaccactgtcaacactggccgaggtaaggccccagagctcaggccgaggtagggccccagagctcaggccagagtttggcaaaggcacaagctcctggttttgctgtgcatccacggcttttaagtacaggtcagctcatgctcgtggcattttactgcccagattttcatatgcctcgtcatggttggtgtgccagatctgagtgggcctgggttctcagcacagtgagagctgcatcacaggaggaagtgccttttgttttagcctctgtcttgtgtggacttcaaggcacagccactttgttgacattgagcttgtccgcgtcctctcctttattttggcagtttactctggatcatttttaaaaaaaacaaaaggaagcaaactagaaaaaacctggaactactacaccaaagcatttgatcctgcttgccctagggctcagatctattatccgtatgtggtgtgagcacattcctctactgctgatctgggtcatcatgtagtgaggggtcatgaca

SEQ ID NO: 31549 - DNA, 1135 bp, Mus musculus
tgagtatatatgtccatactgcatttgattaactcaatttaaaaatacagtgcacattaagttggaaatcagaactatgactggatttagcataatggaaggtgggagtttgttcacagccagatatggttgtactggcccctttccagactctgggaatgcctccagtgttatcctttcttactaactgatggggagaccggcctctcttatctccatgaggctagagtaaatctgttgctgaattgaaatgcgccagtctgaataacatgtgactgcctggacagaatgagatgctgcctggcagggtgaatggattgcgttaagctgtgctctggtcattgatatttgggggttgttctgtaagttaactgctgctagcaaactgaatgctgttgcagttgtacattagtgccctagtgttgatcagggtttaacagtgtttgttcttccaagcttattgtggctgtgtcttgcctcccttcctcaaggtaccttaatggagctgggcatctctcctattgtcacctccggtcttatcatgcagctcttagctggtgccaagataattgaagttggggacaccccgaaagaccgagctctcttcaatggagcccagaagtgtaagaaatactgtagattctgctgtccgcagttgcccgtgtgaatttgctataaagcttctggggttgaagcagctgtgctctgctctgacctccttggctgcccctctgcgtccagggctggggctaggaagaggcaggatgggtgcaaggagcagggctgggagctcaccgtgtacagttggcactcacacatcagagcttcactgaaccaagctcctgtctgtgtgaagcggggtcagggaagagaggcactgctgtgtgtcctgtgtgacctgtgctccttatcagctttgaagtgaagaaagtgaggtggtcgttctgaaggttcagtttttcatctacagagatagtgatgtttgctatacagcaagtgataggtgtaactggtaaccatggctagctaccagcattggtgtccttcctctgaactggaatcggttattcaggaataagttttcaaaccttttctgcctgaagaattcatgagtattagactgggtgtgtaactc

SEQ ID NO: 31550 - DNA, 1352 bp, Mus musculus
tcctgggaagggccctctgccccctctggtgaccctgaccatgcatagcagtcagaggctggccacctactataggtcataaggtcactgtgcccctcaacagggcccaagcactgcatgcagggaaggaagggcccaggagctgtccagagccccctcttagctctccttctgtttagaaaatgaagacagaaagagtgtgggaagaggggcagccagcactccctcctgctcagggaaccctggacagcagtggacgggcatggggtattttggctctccattaagttaaaaccattccagactactgtgctcagatctgtgactctcaccaggagccacccaaggctgctcccaaaagcacactgacaatgccacttttccaaaccaaacgccagctggcggctttcatgcatgacatcatttagagatgcatttgtatctggttaaagaaccactaacactaaaacccaggggtgggatgatcagaagttaagactgtcttgtgaagcctgtaagagtcatgttaagagtcatgtccctgcatgacagcaccggggctccctctgtagagagctaggccagtctcgtcagactccgcccctgtcactggaggaagcctgaccagcagggcttcacagtcacccccatcaccacaggatgcagaggaattggggtacggaaaaaatgctaggacacacaaggctcggcctgaagaaggtggaagccagcaagaaaccgccgatggtcctcccccgggtgaaggaggggagccagaacccgcaagaacagagcatctgtgggcttttccaacaaccatggacttagggcctgaaaagctttttagaaggtgccacctgcaggcagtggaacatctcaaccactaagccccagttccttagagataggggaacagcctccctccaccatgtgagcatcgggggagtgctctgctcacatcctgcctctgggccacctcacacttccctttctctcctgattgctaatgtaactttctaaggatcacagtgggtcactggtttgtcactgtcactgcgcccagtcactccccacgtatactcctagtggggaacctgtatcggcttagaattactaaagaagccaatgtgcactacagctcaccgtaataaaaaccacgtgcttttggagaggcctgtgtctgcgtgtctgtctgtctgcctggcctctcgtcctatgtgtcaactcctcttgctaagagaacttcaggcctgtgctggaagcagtgaagttgtgtgcttgtcacctggtgagaaggactcggcagccctttccagggtcaaaggtcaattcaatacctggattttttattc

SEQ ID NO: 31551 - DNA, 1200 bp, Mus musculus
gcgccgagaccgtgatctccgtgggcaggcagggaagagaaggatcctgacccttttctttgatagactcctttctcccatggcccttccttccaagtcccctggtcctcaacagatgtgaccaagctgcagctctctccgacaccagatgccacctcagagttaatgatccgtccctcaatttgaatgcagctctgagagttcaggtcttgcctcagatagcctccttgggctgccatgtcccagtgatcgctttctggttcatgacctcttctcctcaacattttatcaattgttttttccacttcttccatagatctgttctgttcccctccttccccgcccccagtgcctgcatcagctttcttctgacttccctgccattggctccccaggctgaattaggggccccatcaccttctctctcccagatattaaaagaccaaattctcagccttctgaacctggggcttggcctctgtccatgaagccatcacccaactcacagttgcagacccttgcagacctgtgtagtcccaggccttacccttctcagaggcattccctagcccagagagatgtggcctccttccccttcctggttgtctctctcccagatgagaagcaattctgacccaggctttgaacttcctgcccaggtacctgctggagcagcgagacgtggaggtgaacgtgcgggataagtgggacagcacccctttgtgagtgtgagcggtggggtagctgggtgggcagggtgggcctaccctactgacagcttccccctttcctaggtactatgcctgcctctgtgggcatgaggagttggtgcgctacctgttggctaatggtgagagagggtcagggtctgcctgtaagctctgagaccttgctccatgtttgtatgcacccttgatttcttgttaactccctaaagtcaacacatagtactctctaaccctctatccactttctcacgttacccttgacacccaggccagttctggggctgtctcctgtactgtaccaccattggtctgctaaactgactctctgatctccatatttgcaggcaggaggatctttccacagcaaagctgatgggagtgtttgggataaaagcacgtgggcatggttgcccacacctgcaattaaattattgggagagagaaaagtcgagacagggattatcttaagttc

SEQ ID NO: 31552 - DNA, 1959 bp, Mus musculus
atacctgagaaggatctgatggacaaggtatgcaagagctgggtggggcggggcggggcgggccagggcagggcagggcttgttgctctggggagctcttggccatttggggtgtaccatcagtaacaggcttgagctagcgataggcaaagggaaacaggtaccagcagccttgtccgagtacctgtggctggtgaagctcaggtctggagctctgaaccaacacagcccttccagaggtgaaggccggcgtcttctcctgctaatggctctgatgctgttctttctccaggccaggcagatcaatattcacaacctctctgccttctacgacagcgacctcttcaaattcaacaagttcagccgtgacctgaaacgcaaactgatcctacagcagttctgagaccagcacaggggcctctatgtctgaatgaggctcggtcaccacgctgagcctacgtcacttcccacttccactggggcttggtgccctgtaggggtgggaggatggcttaatgcagacctttacctgtgagcccctaggccaaggctgtagcattaaatgactatttattcttctgcccccctctagagcactcttcttggccagaccctctgtccaaggctcattagaaggctggggttgtgttcaggtgacagactttatcaaaactattgctgttttggcatgagttgtgtttctggactgttttgttttcccctttagacaaagagcaacttagaagtatttgcaaacttttccagaacattctcaaagcctgtgatggaggagcacaagaccctgtctgctgagggcccatgctcctctcatgggtttcttcccacctagccagtgccttcatttgcttgttgtacagtttcttgtagtttattttttaatagatttgaataaaacctaaatagcgctatccctttggttctggtttaatgtaccaacaaggcttccctgagctttttgaaggccctttctgcctgccctcagtttcaaaatgaagtaggtctggttagatctgctttgtggatgtgtcctgtactttgggttttaaatgtcccccttaagggtcattgctaatgcgatagccgtctctccctccctcccttcctcccttctctctctctctctctctctctctctttctctctctctctctttctttcttcctctgcatttattttatgctgaatttattcctgggccatgagattttgtttcttctgggatatctttttcttctgtgcagcctcctcttctggctttggaacgatctgttccttctctgagatcatctcactgtggcagggggagctcatgtatgggttaatccggccatgagctctgtaggttcgtcagcgcatcttaggtgccttgttcacctggatgtgttcaatggctagaaaatccatgtccaaacccttaagttcagcatgactctgcatttttaagcatatgcagcaaaaatttagcactctttggtcaccgtccctgtgtccagcctcactgtttggcctgggctcacccactgactccaccattacaccgctggaatggcacacattgcttctttataaagagacgtccttcagatacttggtggctttgcggatatgcatacccttggtggcctgggcagtttcccgggtgttcttaaagtgaactcgaaggtttgaacctcttgatttgcatgattttgggggaggggggttctgggtcaagagaatagcgaaccatcttcacaggtcatctctggctgcttacaggaagagaaagcacaaaggctactgggagaattcatgagacctaagatattagccttttttcaattcaaggtctcaccatgtaaacctggctagcctggaattcagtatggagttctacctgtctctgcctcctggaattaaaggcgtgtaccccagtctagctcaatgctaattcaccag

SEQ ID NO: 31553 - DNA, 1179 bp, Mus musculus
tagactggggtacacgcctttaattccaggaggcagagacaggtagaactccatactgaattccaggctagccaggtttacatggtgagaccttgaattgaaaaaaggctaatatcttaggtctcatgaattctcccagtagcctttgtgctttctcttcctgtaagcagccagagatgacctgtgaagatggttcgctattctcttgacccagaacccccctcccccaaaatcatgcaaatcaagaggttcaaaccttcgagttcactttaagaacacccgggaaactgcccaggccaccaagggtatgcatatccgcaaagccaccaagtatctgaaggacgtctctttataaagaagcaatgtgtgccattccagcggtgtaatggtggagtcagtgggtgagcccaggccaaacagtgaggctggacacagggacggtgaccaaagagtgctaaatttttgctgcatatgcttaaaaatgcagagtcatgctgaacttaagggtttggacatggattttctagccattgaacacatccaggtgaacaaggcacctaagatgcgctgacgaacctacagagctcatggccggattaacccatacatgagctccccctgccacagtgagatgatctcagagaaggaacagatcgttccaaagccagaagaggaggctgcacagaagaaaaagatatcccagaagaaacaaaatctcatggcccaggaataaattcagcataaaataaatgcagaggaagaaagaaagagagagagagagaaagagagagagagagagagagagagagaagggaggaagggagggagggagagacggctatcgcattagcaatgacccttaagggggacatttaaaacccaaagtacaggacacatccacaaagcagatctaaccagacctacttcattttgaaactgagggcaggcagaaagggccttcaaaaagctcagggaagccttgttggtacattaaaccagaaccaaagggatagcgctatttaggttttattcaaatctattaaaaaataaactacaagaaactgtacaacaagcaaatgaaggcactggctaggtgggaagaaacccatgagaggagcatgggccctcagcagacagggtcttgtgctcctccatcacaggctttgagaatgttctgga

SEQ ID NO: 31554 - DNA, 1101 bp, Mus musculus
gtaggaacttaaatttcttacctgcctgttaggttcagtttcatgaatctccctctatccctcagatctttgccagcattgcaccctccatctatgggcatgaagacatcaagagaggcctggctctggccctgtttggaggggagcccaagaacccaggtgagccccaccccccttgccagccctcactgaggggattaagcataagagttaacaagaggctgcagggagcgtggacatgctcaccctggtccactctgatgggctgtctctgctgcttggctgtggtctctctctctttgctgaggaacaggtttgagttggagggatctagcctgtcctctggccctcctcctgcaggtggaaagcacaaggttcgaggtgacattaatgtgctcttgtgtggggaccctggcacagcaaagtcccaattcctcaaatacatcgagaaagtgtctagccgtgccatcttcaccactggccagggtgcgtcagcagtgggtctcaccgcgtacgttcagcggcatcccgtcagcagagagtggaccttagaggcgggagccctggttctggctgaccggggggtgtgtctcattgacgagtttgacaaggtgggtatctgggctctggggctgagctctctgtggtgggagggctttattagagagtattaaggcctcttgggatgccctgtgttgtgtagatgaatgaccaggacaggaccagcatccacgaggccatggaacagcaaagcatctccatctccaaggctggcatcgttacctcgctgcaagcccgctgcactgtcatagctgctgccaaccccataggtatgcctgctgtagtacaggcctgggaatgacagcacacacagccccatccaacatgacctaccagagggggacagaggaaggacgtgggaacccagggtgattgtccatctgttccttacaccacctttgggtgctttgattctttgtccagatggggctggagctgcacccatgcccagccaggaggtgactaacacctaggggcccgtttatcttattagagtagaactttgctttggagcagctctggttttaatggaatgaggca

SEQ ID NO: 31555 - DNA, 1106 bp, Mus musculus
agactcccttttccatcctgggggcttcggcctccttgacggagttcctaaatcatattcttcaaactttcaacttcctgtttgcagctgtccagcaaggactttgtaagcccgtggagcagacctaattcttaagtgggttgtttggggattcattgtccactgttggtctcttgcagagactaccgtcccattccggagctcgatgtctacgaggccgagggattggccctggatgatgaagatgtggaggagctgacagccagtcagagagaggcagctgagcggaccatgaggcagcgggaccgtgaggctggcagaggcctgggacgcatgcgccgggggctgctctatggtatgtgtggtgggcatcccagaggtgccacttggacgtccaaagcatcaggaatggggaagacgtgggcagcgagtgttgtgtagaggatgctgggagaggcttgctcacgggggtgctttgctacccaagacagcagcgaggaagatgaggagcggcctgcccgtaagcgccgccacgtagaacgcgccacagaggatggcgaggaggatgaagagatgatcgagagtattgagaatctggaggacctcaagggccactcggtgcgcgagtgggtgagcatggcagggcccaggctggagatccaccaccgcttcaagaacttcctgcgcacccacgtggacagccatggccacaacgtcttcaaggagcgcatcagtgatatgtgcaaaggtatggtcctgataggctggggcgagcaaggctcagaggtgcagcatctctcttgagtgaggtcctggatcagtctcagcactggggggtgaaggtggcctggcttctgtatcctgctggctctgtgtgccgcactgaactcagaatgcacaggagcattgggtgacaaggactgaacctgaggaccccaaggtctcctgtatctgcaccagagctaggctgtttggggacatgtttaaaaatgtattacgaccctgttttggtttttggagggtttggttggttggtttttgcagaatcaggttgagcctagggcctagcacattctaagccagtgttctcccactgggccactctc

SEQ ID NO: 31556 - DNA, 1198 bp, Mus musculus
taacaagtggtcatctggaaagaaactgctcagacagttgagccagtgggtgtgagcctttcagtcagccagtctggctgggttgtgttcagctgggggaaaggcatagacagatagggagggtatagtccctggacacctggaatctgctctctgaccttgctggtgtcaaggtcttggcttcctctatttctgttttattttcttcttaaaattgtaaaaacaaacaaaactatttgtttattttatgtgcattggtattttgcctacatgtgtatctctgtgagggtatcaggtcccctggaactggggttacagacagttatgagctaccatatgggtactggggattgaacccaggtcttcctgaagagtacctgtcgctcttcactgagccttgtctccagcccttaactccttttcttactgggagttaggagctctttggagatttccccatatttaaaaacaaaaacaacaaaaaacttgtgtatacttgagtgtctggtgtgtatgcgcatgagtgtatagatgcccgcagaagtcagaagaaagtgtcaaatcccctgcctgacgttggagttctacaggttggtttatgggctgcctgatcggagtgctgggaactcaggtcgcactgcgccttcgctccagcccagccccttcagttgtaaatacacagcaaagtgccttctccgtttttcgtgtatgtggctcagtggcgttcatctgcatcattccaccagaacttttttttatcgtctcaaaacttaaatcttccccccaaaacgctacctccccgtccccatttggctgtccttctgggtctgacccctctggcccccatgggagtggttatggccttatccattggtgtaatgtcaagattgatccgagcagcttcacctcttatagtccccttctgttttaaggttgagtgataatctacagtgtaggtttatccattgaccaccctgggataataccgctaaatttggttctcactatgtagccttgactggcctcaaactctcagatctgcctggcggtcttccggcactactatacctggttaaattgttttgttgttttcatttaaaacgttattttatatatgagggtgcatctgtgggtatgtacatttgagagtgcaggtgcccgctatgggtgctgggaattgaattctcattctctgcaa

SEQ ID NO: 31557 - DNA, 1191 bp, Mus musculus
ttctctctctcatgtatgtgagtgttctgtctgcatgttcacctgcatgtccgaagagagcatcagatcttataacagatggttgtgagacacttgtggtttctgggaattgaactcaggacctctggaaaggcagccagtgctcttaaccgctgagccatcatctctccagccctttggtagacattttcacagctcgccttttttgactgtcatagaatcttgctgtgattgtccctgtgactctcagaagggaagtgactcactcatcaaaggtcacagcaagcaggaggcagggccaggaatgccatcctagcctggcttgccaattccataacctacaggagatgggaaccaggcctggggacacaagcctgttgccaccctagctattaggaagctgggacaggagaatcacaggttcaaggctgggcaacatgggcagcctagggagaccctgtctcaaaagtgatgacgcaagtctcactgctcattgtccagtgcttgcctagcatagatccagtgtccagcaatgcaagacaagtaaacatctgatctatttggaaaattgagaagtcagactcaaacaccctggtagtgaaggggacctggccgtctcatgactgggaaggatgggtgtcgtatgtggcagagtccggggttactaggagtccagtgtttctctctgcatccaccttgtgactttgctctttgtgagctttctctccaaggccccagcccagagtcacacttggcctgctgacctcagcagggtgctgggactttctggttggctggatttgaaaatgctcgcatttcctgacatttgtgctgtatggagctaatcccatctaagtctgtggacagagccgaagttcggagtgcccccggggaaagtgtgcccattggctgcctggccctatcccaccttctccatcctgctgctgtctctccttcctgtctcacctagacctgtccattctctgcagtggcctaagggaccccacccacagtggcttggggtctttggaaagagccttttcagtaccgagaatgaaatcatgttataggtgtgccaccccatctgacccagtcttaccaactgttttctctttccagccgccctggcctagtcttttttgtctttggccaagtctgtttctacctcagaacttttgtatttgccattct

SEQ ID NO: 31558 - DNA, 2703 bp, Mus musculus
aggccacataagtcacagcctggggctgtcccaccagcctctactctagcaccctgtgcttgccaccaccctcagattcaccgcgtgctctgcgcggccaaggctggagtgccacatccttctgctggggagagaggccccactcccctcctatggagggcctgcagaccccacttccaagtgacatgtggacaatggctaggcgaacccttctctgtcctcagggctgtgcctctgggagctcctggtcctggggctccagtcagagtgcatgttcccgttatttattccccgcctcctgctcctatcgcagcccaccacggagctctggaggataacaggccaccgtcccaccatcctttatcctcccctcccctgatgttcccggtggcttccagtctggcctctcaacggtgtcctggcccctctgcagtgggacatctgggtactgcttttaagggaacaagaaatcctgtggtattttgccctggggatgtggggggcatttctgccaccctgctgaccatgggcagtgacccaagggactggaggtcaactgtgtccacctctgccctcaaggagcaacagtacgtttttaatggaccctgtacatatatatatgtatgtatgtgtatatatatatatgtgtgtgtggccctggccccaatggggtgctgtacaattatttgagggaagagacacggaaaggcaattcaggaggaacccaggtggaagagagcaaaaccaagggccctggagctgccatctgatgtggcctctacttcccccagatggaagaagccgctgcccacgattccgtgccccgagctttgggtgcagagctgtggacctgcatgactgtgctagcgtttagtctgagttgatcttttcaaactgcaagtgttgaatactagaggtggttagaccctttttttaaatgttttttttttaattagtcattggaaaagcaagcaagcggcctactcccttttcaagttcacctttttgatggtactaaagattataatggattttaagggacagctaactgtggccaggaccattatcagtgctggggacagcacaccccacatccatgggctgctagtcttgtggtccctcacactccaagctagggagccgatgggacagggtggaggtcagattagagctgcacctttattagctatggggcaggtacaaggactcagggagcaactcctctgtggtagtcatgagcctagacaccctgggccatgaattctggtcagactcccaccccaactctttggctcattccctgggctgatactagggtcagagcctggatatagccgtttctcagaagcccctgttgttgcctggggttttacccatggatatacccctctcttccttctgatgcctccaggctgtgcctgggtgggagcctcagtttcccctaaagtcttccctggttgtaggcttcagatggaagcccccagttcttccagctctgcctggaacacgcacagcttctaggctcaatgccttcactatccagccccacgtccccaggctccctcagaataggccagcctcactttgtcctacaggccaccttgcccatgtgggtgtcaggtaggaggtgaggtggcctggagcagcttcccagggtgtttgttcgcaagcactttagcatttctgtttacatgcgaactgccctagctgttcttaccacgcatcttctcggcacagccatcagggccaggcctcatttccctgctacttctggactgggctctgacatctgcttgtccttggtcttctagagccatccatctctgtggtatcctgcaaagggttccgtttcagcctcaatatggcttggggttggagccaactgcacactgggtggtggatgctcagagccaccctctacaggcctagggcccagggaggtgggcaagcactactccagccagcctggccctaacactcttggtactgccgtcctgccatgggccccatcccccttcctgcctggtctttccctttgcacctggactcaggagtgcctgggccattccaagctgggcctgggtgcctggcctccacatgccttgggctggctctgctctccagctgccccactctcttatggttggacagctagacagagcagcaggggtgagggccttgatgtgtccccaagagacactgcattgagtccaggcacaggccagcaacctctgttggttcagaggggtccgactgccaccctctactccagtttccccagttggatctggtggctcacatcggtgctacacaagctagagtagatatatttagagagagaaagatatttttaaggtgaagcccatgattagctgtcctttaatgccgcagaacactccctcttacccccttcctcccacccccacccaaaaaaaatccctggtcatttggatggtctgagtagaccaggcctcggccattgcttctctggaagcggcagagccaatacgctcagccatcagatgtgtaaatatacggctatttcctattttacggttcttcagatttagtacttgtaaataaacacacattaaggagagattaaacatttttgctaaagctcgtggctctgagtcttagtgggatgggaatccaagaggtgaccacagaaatagcttatatcctcaggggtgacagtgggca

SEQ ID NO: 31559 - DNA, 1126 bp, Mus musculus
cagagtagagtgatggaggagacccgtggagaagaagctgggtgtaagtttgatattctctgggaagccagggctgtctgagctgaaggaagagaactttgcactggggaaagtcaaaagtcaaaaaaatgtgggacacagttctgggatcctaaggagatatgtctggaatagttgaaactggaacctgggtagagcagggcctacctcttgggctcaaccaagcaccagatgaaaggccaaccccatgggcagactatgccacctctgagcctgtgagtgtagctatccagtggaggagcctcggcttctggctctatcccaggctcttcctcaagtgcagagcaagcccctccctgtcttcctctcttcccccactcccttgttctatgtgccagtagaatgaggagctggatagaaggtagagaggaagaaaaggagggagagaaggaagggggggtcccacctctaataccctacttcctgtagagtggcgccagggtcgcatggcacgcatcatccttcaggacgaggacgtcaccactaaaattgacaatgactggaagaggctgaacacactagctcactatcaggtaacgctaccatccagggaccactgtgggctttctttcccttaaactggaacatgcctagtcaggtgtggactgtgccatgcccaagtaattatctgccctggaaccatcccagtggagattcagagtggtggcatgacttctctcgaggggcagaaccacgggtgtctttaggtcctcccaggttgggctggacacttagtggcaccctgggacttgtatccttgatgtctgcccacaggtgacggatgggtcatcggtggcactagtacccaagcagacatcggcctacaacatctccaactcctctaccttcactaagtccctcagcagatacggtgagggaccggcagggttgcaagcaggaagtgggtgggcagtggacttggatgggatgcccttcctactgctctgccagtgtgttggatgccaggactaaggggacatgtggctcgtggccttcctgtcagttctgaaacaatgcctgtccccatagcctataaacaagggacctcgggtgaccacagtggcta

SEQ ID NO: 31560 - DNA, 1217 bp, Mus musculus
gtagcacggggtggtggaccaccaccctaagcatgaccactgtgcctgcttccaacagtactcctatgaggggaatgatgtcagcgatctgcctgtgaacctgtcggttgtgtggaatggcaactttgtcattgacaacccccagaacatccagggtgagtagcggggctggtggcctgggtgggtggatggtggatggtccatgctgactaaccttcccaccatcatagcccacctctacaagtgcccagccttgcgccagagttgtggcctctgcctcaaggcagacccacgctttgagtgcggctggtgcgtagctgagcgccgctgttcccttcgtcaccactgcccagctgactcaccagcctcctggatgcatgcccaccatggcagcagccgctgcacagaccccaagattctcaaggtaggagctagagacccagtccaacacctaggcagccccacccttgtaagcccacccagtatctcctcccaccctgcacggtagaccttgctatgtccgccccagcctctgccttcctgcagctgtccccagagacaggccctcggcagggagggactcgactaaccatcaccggtgagaatctgggcctccggtttgaggatgtgcggctaggcgtgcacgtgggcaaggtgctttgcagccctgtggagagcgagtacatcagcgcagaacagtaaggcagactaggctgggtggtgagggcctcagtggccgggggagcttttttgaagtgctgagccccaccgtacccacaggattgtctgcgagattggagatgccagcacgctgcgggcccatgatgccctggtggaggtgtgtgtgcgggactgctccctccactaccgagcgctgtcccctaaacgcttcacttttgtggtaagccccaccccactgccctctgcttcctgctgcccccagaaagtagttaaggatactgcagaagtaggcctggactcatctctagtatagggcactgcccccgttgcccatacctaggctgagcccagctacaagggaatggttacccgtgcccccagagctgcctgtgtgagaacacagatgctagaggatgcacctaagagggaattccctctaacaagtcatcttcctgcagacaccgaccttctaccgtgtgagcccctcccgtgggcctctgtctggaggtacctggattggcatcgaagggagccat

SEQ ID NO: 31561 - DNA, 1181 bp, Mus musculus
tttgattctagtatgttctatattagcaacctaactcaatgtgttctctcagtgcagctggagcacgtccttgttaaagcagcagtaacgttgccatctcttgttttctttgcaaacaggtattcacaacattggaaatcacaaagtcctcagggctggacattactcagaaaggctgctgaggctagccctgctgctgttgggtttccctgtcacactctcactctgtgcccatgacatctgcttgggcactggggaccagtgccggactttctcctggcatagagacgagaaggcggcagaggaccagcagcagcagcagcatctggagtctcagctgacggcatgcagcagccaggctgcttccttgacaccttggctcggaacctgcagaggtgagccaaggccgacttctgcacgtcagcctcgacttcaccccacgaggccttagatggcacagtgagcccacctccctttcccagttgctagtgctttgacccctcactttgtttccatgaagagattatctttcagttgtggacttgactgtaaagaggcttgttgcccagagtgtagcacttatggatctgtggtgtttggggagccaggttagagcaattggctgcactggcctcccactaatataacctgctgtcagaagcctgactcaagcctcactccttgcatagctcctgaggggagaaccgtggagccattctcctcccagcctctagtctaacggagcatcacaaagaagagaaaaaaaatgtccttgtattgctattggttttccatgtttatcttaagggtactattaaaaaagattttactacaatttgtgtgatctaattcgttaaacatgatttgttaagtcatgatccattgaaaactattacactaaaattaaaaaaaaatgcctgtatttttttttttttctgaagcagagtcttacttggtgttaaaataaggctctcctggaactcaaaatcctcctgcctcagcctcctaaaggctgggattgcaggcatgcaccaccatagcagtggcccttcttctttatacatccgttatcttgggtagtctgagctgactggcaccacatgtgatagggaaatcatacttcacaactgatgtctaaccagttctccaagcactgcctgaactatcaaccaaatgacagg

SEQ ID NO: 31562 - DNA, 1131 bp, Mus musculus
cagatgtggtccaggggcagaaagaaagccatgggccatcccaatctgtgctgtccagctctacagagaggccaggggctcagaaggactcagagctcagtgctggcacaggcagtctctacttggtatgaagcactctattccatcaccaccactagctcacttccctaatgcactttggatcgtgttggggatgaatcctgtctatgcagacggttctttctggtgtgcagaaggacagatggagcctgggcaatagtctggaagcctgactttgactttgagtctggaattgacattcttacagctttaagcaaatcgcttaacttatctgagccctagatcctcacttatttctaaaataaggggttttggctacatgcattctaagatttcttttgagttctgtgattttatacagttttcatgagaaaacttgaggcatttcttactattgaaatattcacctttgtgcttttcacgtagtgacaagtcctagaagagcaatgttgacttcaatcgtcttaacagttcagtgggaacttgaaagctacgtcaggatatttttattagaataacagtgattcctgagccttcattcttgaaggattataacaatactctaattttgaggctggacagttattgtattctatatttatatcaattatacctttaatataatctaatttaaagtaatttaaagattcctagagagagtctgactttcctcagtctacaatggaaatgatcatataggtttctttagaatgctggttgaattttgttttgacatttatcatgttaagaatcatgtatcttaccttactatagcctaaaatactgctgtgaactggaatcaagtgtaagagtacctagcaaccaacctactggagccgacttgcatttatctcagtgtgagagctgcacagtctgtctgtccattgctggagtctggctggtggtggcagagctacacttgcaggcatctgcttaggctgtcaccgcagttgctaagagcaacaggtgactagacagggactggaggtaaccacaggtcagagcatgtgggaagcctgtccctgccactccatgcctccctgtgtctcaggaaagatggaatggaagagc

SEQ ID NO: 31563 - DNA, 1110 bp, Mus musculus
agccagcagaagttaggcttgccccttttttgttctcttgctagctgtgtgtggcattgggctccctgcttctctgagtgggatggtgttgtgaatggatttcagtatgctgtgagccagagaggactggtttcctttgctccatgtagttttaagaatgaaattttccttactgagtgttcacacatttttaaatttcctatttgaatactgttttctctggcacctccataagtttgctgaattcagtaatactttttgtattggcagatgacagtgtggcacttgctgccaacactgcccagggctgctgagacataaccctggcatcaagaagatgtggtgttttagggagcagggcagtgtacagctcttagcagtctctctctacaatatcttagtgcatatagaccttggaggagtatacttcacttattcagatgatgaagctgtgtgcgttttcctttgctaacaattgagcacgtggtttcccgagagcctttgctggtgactgaatcctggagctctgatacattgccaggcaggcttagtccccttgctacccttcctctgctgtttagatcaagcaactgacacacttttctttggtcccaggaaagtgggggctcagcaagaactgattaccgagccattcaactagtcaagaaaaaaaagcagaaaggaactgggagcgatgaaggtgaggccgagtgtgctgcagtgctggtgggcaaggggctcaggtctcttgtgtcacagtcacaggcagagaaagcacacagaacagttgtttctgtgttctttgtcttctatgttcaaaatacccttttatcaattccttagcttaacatgaacttagaaaacaggtagcaaccaaatcaccagcatgtctgaacatgcccaacaggtctgagaggccctcgggaaatcaagggtccaaacagggtcagttctggaaggctactgagtgaatgagcccagaaggctcggtgtcaggaaagcagacgggtggctggatacctagttaggccttgccttgtggtggaagcccttgcctagtagggccattatctcgaggatagctgtgtgaaggcggcctgtgtgcagcag

SEQ ID NO: 31564 - DNA, 1157 bp, Mus musculus
accgccagggcagccagggaggccctcttggagatggtctggtatgtctacaggctcactgggtggtgattccaagaagaaaagaaaacaaagctgggtagtgaccacacttgcagctacatcttatcatctgccttgtggaaatggaactccatgtaaagggaccgtttgccacctactgttctatcagagctgttgacaagagaatgtttatagctcaaatgtctgtcgacaaagctgcatgctttgtacatggttttggtaagtcagtctataagaaacggtggatgtgtgggtagacatatttgtgtatatacttgcatagaaacagaagtggtaagttgcccatgctggatagtctctttttctgggtgtaaatattgtgaatattttattgtggtcatttctactttttgcatttgagcatttgagaatacatcagttttatacatcaattttataactttaaaatctaaaactgccacattaagtgagcagtagagtagccagccattcctcctgggtggtttgtgaggccttaggctctctggtctcactagtacatggagatgtatgattcccctctcaggggcaggagcgagaggccagggtgggcatgtgctttccattccatagctttagccctgagatgacctactggtcccagcaaagtctagcctgtagccagagagctatgtggctgtgccatgcacatgtagttgaaatgccctggcgagttaccagccaagttgagccttgagtcagtaatctcatcttcataagtttctcactttcaaacaaatatctccaagcatgtgtttcataggtttcctcccttcttcctttagctgccatcatgaatgaaaggggcctccttaaggagaggtagggcatcagcccgtgattgctacacttctctttctaggacagaatttagtatcattcatacagttatctgaaaatttaagtccaaagcactgggtgcatttggattgcgtgggatgtcgtttgaccacgggagtttagtctcatcttatgagccccatacacacctagaacgtacgggcttatgaaggaggtagcttttggggtccaaagcagagtgtagactctacactgtcaccacatgttcttcccattcgccaaggtgcctctgt

SEQ ID NO: 31565 - DNA, 1389 bp, Mus musculus
catgccgtgtgtgtgtgtgtgtgtgtgtgtgtgtgtgtgtgtacacgtgcgtgcacgcacgcacatgcattccagcccttcccaggtccccttgggtctgacgtgggtagcaccttttacattaaaagatccttgcaggaagtgggtagagcatggctccctcctcaggtacttctctatactgagttgtagtgtattaggatttgtctgacacattctgagagcttatataacagcttctcacctgtgggaatggttttggtgggtgtattgctttctctacactgtatgctgtagtgaagccaaagtcaggttgagctctggcaaaacatctagtctgaaaggtgattggctggcctgccgcctgccagtagcctgctaatagaacctcttcctaaattgacagtgtgctcatagtttgtgaatgaagagttcgggcttttaaagtcatctttctaaattctgtttctggaattcatggtaagtagtaacttgtcagcagtctctacagtggagttctgaatgctttatgttatgtgtagggctggaacaataggcttgttttatgattgaggttggagataagcatattatgtggccttgtgtgttttcacagaatgatttggtcttccccgtggagacggttggttgccttgcacatatttgttagtcaagactggatacagggtcactcagcaatgctttgggcttttgatgtgtgtgcttattcagatactgttttgattctgtcccatctgagttgctttgtttcttggatttggggagagctctgaaactgggcatgagttttctctggatgctacctgggtgctgctccctacaaaaggattataaatcctacttgagaagactcctttccacatgtctctcctgcatcacaggccaaagtttaggggttgaacttgcctagctgtaatcagcgcccccatagacactcagtaggcagcctggtaccactgtcgcctgcctccagagcccaccccacagagaagttgctccagcagctcccacagcctccagcgtgtgtctgcaagtgacaggatgggctgttgtgctctgagctctggagcttcctgctgccataggcccagtccttagtgcaaatgaataaaagtgttcgaatgttatgtgcaaaagcttttgcgctgctttcattcaaggtactatgcgtggtattgagactcttcccactgcttcccagctggctacttgctcgtttgtctccaagagccagcaccatcctgccgtcctcagggacaggtttgagacttctccacgagcagctgtttgtgatgacaaccggcacagtgctctatccctcaagcacatgctttggatgaaatgacaaaaggggctccaagagactcc

SEQ ID NO: 31566 - DNA, 2595 bp, Mus musculus
ctactaggcaccagcctcagaccagcccagggcaccgctattgccactccctctgccctcatagcctgggtgggcctgtgggcttgccttccatggagcagagctccctctctggcttagccctggcacccagtcctcccttggcccaaggctggacctcagccaccactggccttgacatggcgctgaccaaggagaagtggaactgcctctcaccctgtcagccctcagcccctcactctacacacatctgaaaactcatcctagcaaagaaaacataagatagaaaagtcagacaaagcagaaccaacccccagactggctgtgttattgttttgttattggcagtgggcaaaataataatataataataagtagacctgataagggtgatgaaatacgtaagtaaactttatataatataaatatataaatatataaatatatatatatacatactgtataggtagtgtttgtgtgtgaaagataagcatttcatccacaaagctagcactagggacctcctaaggactgccacttaggtggcaggaagtcaatctagatacatgtgtgagtagaccaaaaaaccctgctagaacaaacccagatccttccatattttcatacaaagagactctctagcctggctgaaaccttacacgctcatgactcactgtgccaagtaacacagcacctgactgtctaataccccactctgctctgtatagccccctattttattaacagagtactattctaagtaaccagtattataactgctgttatctccagtaagcaactaggcaaagtgcagtcaactctaccctagtacttggggcaaccagtctagagctggctgtctcaggacctcagccccacagatccctagacactttatactggctgccataactttgatctcccacgctctacattccttccctctgtacatggtgagccacgctccccctcccccacagtcctcccagggcccacgtggcagaggggttccaccccaacacaacgaccactcatcttccataacttcctcatccagttcccagccccagcaggcgggtggcgtgagcgctgggcggcccagggcggtgtgtgtgtcccgtgttgtgttctgagtggcaacagcaatcactgtaattccatgcagccatgtgctcgtgacccctgtgtcatcattgcacctggccaatgagtgcttggccctggccaggtgaagcccccactgcctctcatggtccagtgagctgccaggcctcacatgccccagctgtgttcttgtcgcttccatgtgtgacaccatgcactcccctggggccacgtgctgcccatgttcctgtgcctgagtcacccacgggctgtactttacagtttcagcccttccagccaccacagcctccagtgctgtgctcctaagcctaggacccgaggactgcctgtggcctctgcctgcgcggaggccctttcagattggaaggagttgccgcctgaccgtgggctgcgtctaggaccttgtgagccaccggggcctgcccaaccacaagagagatcaggagccttctggcccatcaccactctgctggcctgcttgggtcacccatttccctccccttcgtgtcaccatcgtcgaggtcacgtaccagcagatctgcaaactgagcactttgtatctgtgcagagagcaaatcctgcaacatggaggtcagccttctgtctcacggtggctggacccgcccgccccatcctctgtcagcatggctcatctttctcttgtcatctacgcagaaagagaactgatcaccatagtgtatctgactggggccagctggcgaggagctgcccgcttcacagtgccccgagttccttgcttatgctccacgtactgtctgtcctcagttaaagaacactgtctgacaaggaagggggactgtgctgcatgtgacctggcaccagtcgtgtggggctgtgctctctgtattgtacatttacaaaatacaccagtgttactgttggcaaatagttggagtggtaacattaaatatgccggcttttttttttttcactctctctgagctagtggtaagtcaaccatgaacttgagattgttctgaaaaagacatggctgttaggtacactctcactctttttaaagggacacttaggaacaaactcaaaggaaggcccagtttatctggtagggtggagtggggcctccctctctccacagtgtcctgtattctcctggctagccagggctctgggctcctcccatgttatctttcatgtgtcctagagacaagccgaggatagtgggtgagttctagggaccaggcttctaagcatactcagtctttctctgagttcctaattcaatatgttatcggatcaggataatgagagcttgtgatcctgtgttgttttacagacagggacctgtcttcataggatgtgcctgggcctgcaagtcacacagcagaactagcttggaaagcataggctttttttttttttttttttttttttttactgatgtcccttgttgcctgttattcagctatggcattgaggcactgagtgtct

SEQ ID NO: 31567 - DNA, 1100 bp, Mus musculus
cctttgggagagggaaggagacccagctctaggcctgttctcttcccttggccacaagagccagagtctgtcataacacactgtagtagctgtgcccagcttggcctacccagctattgacaagcaccaagttctcacagagcggtcattcctggaatcccagaggcttcgtatcctgtaccaaggcagtccatctatgagaactggtggcactgaacagctctctcacctcctactgcacaatgttcagccacagagactgtgggcagcatgggttcttgagtcagcatctgaagcctatgccattactctgctactatccatgaacaggcagtccttgttctcggtttcccaagctaccatgacaactcaatgcattgtcctcaatagtgagtgaggtttgagggccagaatgcaaggagagctcaacctatctctgaaatgcagccaagtctttgaggaccttatgagaccctttcagatgaaccatgcagaccagggggtgagcctatgcacccagcatgccttgctctcattgaatgtttgaacaggagtgtgaggtgcaacggtgaacacccaactctgtgattgatggtggaaagagctgagacgtggaaaagacgaaattgaagaaactacagctcccactgggcagtaccacttctctctgctccagtttgggctgcaggatataagccatccggacttttctggagagccccacgcatgaggggtttgagagcttgtttgaaaaaaatgacagcagagaggggacactcatcacgtcagtgtggcacaacactgtcctggcctcccaagagcagtttggaggcaggaaataccagtatcacagatggggaaactgaggctaagagcctaagcagtagtgagtgtatcctttgcaactcaaagtctacttttgcttgtccatggacctcactgggaactcttttgtatctgcaaatggggaagcaacctttcttctcaccaaaggaaggggccatctctctgggaagcccagcagctgacgtctacatggtgcagtgctttccctctgattcagattctcccatgaatctgggacttggggacagcaggca

SEQ ID NO: 31568 - DNA, 1177 bp, Mus musculus
ctcactgtcttggttttgcttcctatagagctccattcctgagaattccaggcctctgttagcccaaagccactgctgcagtaggtgtagagctccagggtgtggggataaccgtggtagaagctgttcaccatcagtgatgttgccttgtttctgtggtttaatttggtgccagccacttaaccccagaaagtgggagccctcacgcctcctaggtttcttataggtagagagtactatgaggctagggaagctgctttcagtgtctcctccagccttggagaggaaacactcgctgtcagagcagcagccccttaactaccaccagtgtccatccagtcagtgtgcacggaacagtgtgacctgggcttattgtggggccctccgagcctgtccagcactccctgcctgccctcccaccacagctctgcctcatactgctttctcatttctcaggaattgttttctccttttttgagttttctttgcttttgtcattttttttttttcatagtgagaatctgacactcaccaccagcatgagggtttaagcaagggcttctcaacctggacactggagatactctggggcagataactgcctgtcattgcactgtgcctgggttcactgaggccagcagcacttgcccagttgtgacaacctgttgcatctccagaaatgccaggtgtcatatgactcctggttgagaaccactagcttcccagcggcctgttcaacccagccatgtcactcgactgcttgggccctggggtggtttgagtctgtgcagtggtcctgctgtgactgaagcccagggcaacagcctcagggatgccctggttgcatccctgcaaggatggagctccttgatgccgctgctctctgaaatacagaggcaaagatcccaggggcaaaaaactcagaggggaatctcaggcatctgagtccagaccaagaccacctgtgatgcccagtgaagcagcagcttaccctggaagacattggcagggcacctggagaggcagggtgcttgacctgggcaatgaggccccaacaggcagccaaatcatcctctctctccatagctgccactgtgcaaagtctgaggtgatgacagtcaggtgcactatcatgaagatgcaggcctttggtcaggcagggtaccctgagagcagc

SEQ ID NO: 31569 - DNA, 1203 bp, Mus musculus
tctcttttgactggaagctgggtggtgtgggcactcagatacaggcagaacatgtggaccagagctcatggtcccactaagcctttacaaggcagtgcttataatggtcatttattctaatgggttttgttattgttgtttgtgtgtttattaataggctttgaagggccacctctccctcaagaggaggccacctagaaaggcctagccctccctggctgttgatttccccctttggctttctgtttccgtttctgtgaagatccttgtggtcacctgtagatgaggatgctcagcctattggttgggagcagacttgttatattattagaccacccacctgtgccctatagcctcagctatgctctctggtgtctctgtgacttaatcacatcttgtacctcagtttccccatttataaaatgtagacgatggcaggtggctgtggggtagccttgaggacagaagacaccagttcacatgccagtgtgtagaggtgcacagaaactagtgctgacaggtggtggcactgacatccaggctggtgtggctccccaatactaggacaggaccgtgttgcttattcagggacaatgtcttgctggacaggagtagttaatttcacttcctcgccacagagaaaactagttttaaaagagagagggatgcagacatcgcagtgacggggccaagaactgttgagcatttgacagggttgagcgagaataggtcagaccagaaggaagtgatgatggtccacaggctcttgtgcttatagtgctgttaatagctgctaaaaagcacacagagatgagaggaattgccttgcctatggattggaaggtgtacccagcaagatgacttgccattcatctagggtggagagggaggcatggcctgcatgctctatgaggcagaatccgaaagccagagatactgagcactgcagaccttgaggtctaaatcccagccctgaggcagatttagtagatagagctttggggccttgggttcagtgggtgacctgtgttggatggagctttgggccgcactggtgattctggtcctgtctgttctggcacttgaggcctagggctcagggcttagcttcaatcctagagggggagatgaaagagggactcccttagccacccctaaatcctagagggggagatgtgagagggtctcccttagccaccccta

SEQ ID NO: 31570 - DNA, 1288 bp, Mus musculus
atgaggctgccacctcatagtcagtggttggaggttactgtccagagttggttcctggttcttctgggcctgacgtcttgagcataaagaggacatggagaattccagatagcaccttagtagttcccctcaaatataaagagcagctctgcatgagaacgttttactcaagccttgtgtctctcacttatgtaatgtttatttacatggttaagtactcaaagtacaccagaggacactggggattgtcccctccccttctccctccacgctggggactatagcaacacttctagtttccagttgcctggctctttcttctaaactttgcttgtcatggctcaacttctcatgtcttattcaacatttatgtttatacaagcaagtatatataaacattattcccctcatctttattttgccttgctggagttgggcccagggcttcacccatgctaagcaagtactctgctgctgagccacatcccagttcctcagccccccacttctccacatggactgtgaggatgagatcagacagcgtctgacaccttgtacagcctgctgtttctcacttggccctaggacatagacatcattatcttctatgtggagagggcttgaagttcagagaggaccttaatttgcccaagttgcacagctagaaaatggcagagccaggaatcaaaggcggagccggcaggtgccagatgcctctctggctgtatcttctacagcctcactagggagcagccctcggactggctgtgtggctttgtttgttcccttactgttctgactcccactctgcttttctatggttgaaactcacctgaaatgaatctgttgtaggaaaaaaagaaagaacattggctttgagccccagcacacacacaaggcaggctcaggggctggaggtagagacactttgttttgcctttcttcatctcctgtcttggtcttcccaccattttccaaaagagctttgtcctgcagcagagctttggtcccagtgtcccacatacacaagccctgattgctcctctagaacctgtgtgctctgtctagcgctgcttggatcagctgtgtgaccctgggcaagggaattaacctgtctaccgccactgcctgctgaatgggatatggtcaagattaggtgcagtcacatttagataccttagctttgtctttttgtttgtttcctttgtttgtttgttgttgcttttgcagaacacagtcccccccagttaagtgtcttgcccttcagtttcctattggttttgtttac

SEQ ID NO: 31571 - DNA, 1133 bp, Mus musculus
cccttctggttgtgcatctggtcagggcatctctgtggagattctagccctctgtttgtccagcctaagcattaaaaagcccccttgcttctgtgtctgttccaagagtgagggtatggacaaggactcacattgagccagcataactcacttcacccacaaaaacttgtttacaaccagtagcactaaatctgtgctgagcctagggacagatacacagacagcctatctttatccagagaaagggccatgttccctcacaggtcacccaggaactgagtcactgaaggtaggtttgggttagccaggtcctgaggcagtagtacctctgggctcaaccagtctccaggctgggccagccaagatgcagttctccagcaaggcagcaggtggcaccagcctctagcggtggtgagtagtctggcctagcaggcctaggacaaatggggctggagactgctccctcctgaacttgctaggcttctctgcccctcacccacacaccatccctgagccccaaatgcagctatcaacaacccatctttcatcccctctgaagattgttccaccagctgtggtctggctatcttcttaagccaatataaatttgccccagggtctgtcctagagacagatggagacagctgttggaatccctgttacaggcagtggagctcaggagctagagtgcctgggttcagatcccagctttgcagacttcaagattaaatgctggttccaggagagtgagcatgagggtccctgtgagtgagccggtgtcaggcagggagtgctagatgccatgccattctatctgtgcacaggaaggactgctggaacttggtgactatggtcaggacttacctcctcagctgcagcattaaggtatctggtccagcaccccagcactgcctcttgcaagctgagcacatttgggctgaatcttaggttcctaaggcacctggcaggggctcatgcactgcatgtcagagcctcagattgtgctgtgggtggggtgggctagatgagtgggggattctccactgattctgcctttagacccagagtactctcacccctttaagacaaggttggacctaagtgtcagtgggggcctaggcatgggtaaggcc

SEQ ID NO: 31572 - DNA, 1137 bp, Mus musculus
gcacaagatttctacccactagaccctcttctcaaatgtgtgctctggactgggagggagtctggccctggagccccctttggattggtggtcagttcctgggctgataggacatagcctgctgagaaaacaaaacaagacaaaacaaaacagccttcatttcatctccataagaggggaggaaggtctgaagaccaggcacctcactaccacctcttctcctaccttacaaagtgtggaagagcaaccggtctcacagatatggaaactgtacccagccccatccagcatttcagaggcacacccacggggacctatgtgttacaggcttgactactggtcctcagtgggtttcttgggttgtatggcaaaaggcagttcctccagtgcagagagcccaaggttttgagaagaaagtcagggaaaagctagcatctgggatcccattcagccatgcacagccctccctacaatgtgcaattagcttgtagtgctgggattgacttggcattgtactgtagacatcacagtggtacctgttttactgttaaatacccagagactctaaaatgctatggtgaagaatgtaccttgagaccccagccctgccccctatacccctcaggcacttagtcaattcaggctgttttcacggatcaataactgaggttccttagtcttctggagttcttagctcctgtctccgtccttctggggctttctgtgttaatgtgcatgtctcttgccccagtgcttgctaggaagtacagattatggtcaggaactctaccctggaactgtgtacagaggagagtgtgtgcgcccctccccagaacaagtatgaaaagcattctggggtgtctgtcagctaaatattgatcagccaccaagggtgtattctaaaggaccctgggcagcttgctgtgattttatgtccaccctctcggaactgggtccctggtggccacctccctccagaaggcacacagattgtcaaattctggcaccagattgtcctcgtcagcagggctggagcctggcacggggcaaacagtaggaattgtgagcagaaagaacgactcctctgtgcccagtaaggccccagggcagagactagccccctaccccactaccaga

SEQ ID NO: 31573 - DNA, 1175 bp, Mus musculus
tccccaaaaaggagggtgtctggttgggcacagaatctggagccactccactgttggatagtgctcaccttgttccctcagcacagactggaagaggaccacactctagctacagtgatagggaggtaacctggctggccctggagtcccagactaaaggtgaaggggacagcaaagagctgtactggggagggtggggagaggttgggggggtagtggagatcagactcgttcagtcatcacgtaaagcagagtttttcaacatgtgtcaggaccccttgagggttgaatgatccttttataggggtcacctaagatcatcagaaaacacagatatttacatgatgattcataacagtatcaaaattataattatgaagtagcaatgaaaattgttttatagttggagttaccacaacatgaggaactgtatgaaacggtctcagcattaggttgagaaacatcatgttagatagaggtcctgtgagagtgtttgagggggagtggggcaagctgggtacttaaaacaagcagaacatgataagctccaggccaaagggatgaggtaaggggtgggacccagaacacagagaggcgggtcagctcagcctcagctttaatcctgttgcttcatctgctttcagagacatggcagagataagggtgaactccacccactgggtcactagggagaagtgaagggtaggggcagggcagggcagggttaaggggcctctagaaagaatgtggaaaacctggaattgggttttgttttcatattttatttttatttttatttttattttttacagtgctgaaagtagaacccagggccctaggcatggtaggtaagcactaccactggccacatgacctcacattcctgtcgttccttttgtcctccctgtactaccaggcctggctcttttctcttctcttcctgtctccattttcctctaccttcttttctgggctcaagccatgcttttctcttagccttgtccatagctaggacaggccagagctatcaaggactgttggatgtgcatctagctctcatctgtataaggactagtccagccacagcttcactggagtctcgggcgttgatgactcaccaaatgctttggaagttgagggaggaaaattactttgggtttgaggccaagctgcaa

SEQ ID NO: 31574 - DNA, 1159 bp, Mus musculus
ttaagagttaaaaagagtcatctgattaaagtgtacaatcacaaggacaagttgcgcgtggcaaaaacaaaccatatttttccatagaggcatataaacacatagcaatagccacttgtgaaaaataatctaaactaaactcattcttaccggcttcacctggaaggggcaggaaagcacattccaagaacaattctgtgttttttaagaaactgaggtcacaagacttgtcttgttttcttggagctctcttacaaccactcagaaaacgcctcacagaactccattcttggattgtgctctgacaggaaaccacaaggaaattccaaaagggaattcctttcctttccatactatgtggttgaagtctcaccctttgggaagtagacagcattagagactcaacaagcaatgttagcaatgagtgagaaacagaccctgctgcccaggctaagtctggaatagagctttacagaaggtgacatcaatcagggacacagattctggaaccacagtggcttgactaggaaagtgacccatcagcgaggaggcccttggaaagttccccctctgtgcagctgtgtgatcttagaaaaattagttaatctgcagtgcttcagtttctcatccttaacatgttacttcatagggtcctggtgaattaaataagtctgtaaataagattcatgtatatgcaaagtgtgtagtgttaagctgctgtcacccagtcaccagggttctgaggaggcagaacatgtgtactttgcagctctcaggaaatgcctcctggagaacagggtagagagaaccagaacatggagaggagaggcttggagcaggttcagagggtagatttgtaagtctgtctatagttctgggggctatgaagtccatggcattggcatctggcaggggcctcatactatatcacaaaatggcagagggtattacttgcaagacaaagaagtgtgctagctttggtcccttcctcttcatataaagtcacctcatctgacttcccaaaggccctacccagatggtgtcagtatatgattttgggagcaagcttttcatgtgaatattatttggtgacacattcaagctataggaagggttcattttcccaacctttatgactatgagaagaccctttaaaatc

SEQ ID NO: 31575 - DNA, 1173 bp, Mus musculus
caggtgtccactagcgaacgaagagtaaacaaaatacaccacaatggaacactgctcggcattaagaaggagcttttgacacaggctatagcatggatggcccttgaggacagtatgctgaatgaaacaagccacattaaaaagacatgtcttttctgattcctcttaggtgaggtcccttgaatggtgacattcaaaggtgtagaaagtaagtagcatggtggctgccaggccctggagaggggtggagatatatttaagggtgacctaattttaatctggaaaaaatttaaaaaaagaaagtcatgatgctcaattttatgttttgtgtattttattataattgaaaaccttggaaagaaaatagtatgtgtcgtccagcgagtgctgggtttgtgaattttcaagctactgctattaatacatggtggggtagatgtcccaggctcatttctttgggcataatggtctcaacagatgagccctcaggtcttttgaggggagtggaggtactgatcacccctgctgagctggggaggttgccatgtcttggccttgcttcaggaatgtctgctgtactttgactcattagagtgctgctggactgacaagggtctctgcctggcatcaaggcatagccttatcaggtgtgtaccttctcagtctcttcgcctcctctgccttgtgcacgtttagtctttcagacactgtgtaaacatgagggtttccatctctgtcctttgggttctgtctttggtggcctcctagggcttttctgtatgtctcgctggcagggaattcagctccctaatatatttgtgagaaggttttttgacatgcaccacccacccacttcctcactccctcacttaagaaatgcttattgcgtttctgcctctcccagatcctcttccagttactgagagcttattgctgtgcacaaagcaagacaacaatattcatggacttgcactgcagtgagaagaagtagacaataatggagatgaatatggctaatatttagtgcatttatttgattggaagaaggcttcagagataagcagaacagaggcagggagagctgagggtggatgagtcgttttagaatctttagagccaaagcaaaaacccatggcaagcagtgggtgaacagtatgtatatccagacagatg

SEQ ID NO: 31576 - DNA, 1134 bp, Mus musculus
ggaccgaggattaaggagacgccggggaggcacagccccatcgccctggcccctggcgtcccgggagctccagcctgcagcagcttcgcctcttctgggtgctggtgccgaagccctgctggcagtcttctgtgcccatctgggcggggctcggtctctaggctgggggcttaggtgatgctgggatggagttgtctggtttgcagcaagctttctgcctactcctttggttgcctttgggaccgtcaggggtcaactagagaaagtgttcgatgtggtcagtagctctagaataggcgacctgagagtctttgggcatgcgatgctggaggagggagttaaactcactccagatagggaatctgattccttggagtgggaagccaagcactagagacagcgtttctcctaccttacatccgctgcatcctgctatggccatgggacagagcatgcttggaacatttatgctagggctggtccattctttagaagagaagaattgtgtgtacgggtggagggtctggaacaccagaatgtggctgagttctgtggctctgtagagggcaggttgaggtgttatattcacccctacgttctgttcatttgggaggtaggggattgtggctagctccaaactgaggtccctaattcagagcttctgcttccacttgagagcacatagaggaagcttttagttctgaggctcttcactagtccccttcacagaagctgtgggtcagcccatgctagatgcaagaatggagaggaaagtctgggctgctgaaatgaagtctctcgaagcttagggagggggcaccaggacagggacacatattcctgttttgatagggaacagtgacacacgttggtcggctgatgcctcacaacattatcccaggagatatatatatatatattctttcaaagtcacccctactgaccaactggaggatgtggacaggagaactctgaggggcagaggcttctttccctgccttgggggagtctccattgtccatccagacagtggtcttggctgaggaggtcaggggtgcaaatgctgaaattttatttcataagattccaccttggagaccatctggctttgctttctcccctactagaggcaca

SEQ ID NO: 31577 - DNA, 1941 bp, Mus musculus
ttccttcatgctcacgtccctttcctccccagatcttgcctcatctccggctgctttcaacacactgccttctggtcgcaaagccagccctccctcggggctctggagcccagcctatgcctctcactaggcaatgtgcagggctggtattactacacagctgaactgacacctggacagaagggtcactgtcattttcacaccggggtgaaaccacgcctgggccctaggccatcctcactgccctggccgtgctgaatcactgcctgattcacacaagcaagggattttaatttgtttgcttttaaatctctttcccagtcttgagggtcagggcttcctggttccctccttctcatgtggtgtgcagggtttgggggtgctgcttaatcttgtatttgttctgctcgaggaagctcgcttccctgttcatggcttttgagtattggaagctgtttctacatcatctacagataatgtcactgtagtgatctcagggaaaggattttctcatgactcctggggtttttgtggtgcttggaatagaacccagggtttcatacctgcttggcaattgcttgtccattggcacatgtgcacaccagccctttattgtgggttttttttgttattgttgttgttgttttttgttttttgttttttttttcatgaaaactcactcttctccttatcctactgctgctaggaaatgtgggggacaagcagatgtggatgtcccctaggggacaccatgcccagagccctgtgctgactgagccttcttactgtgatagttactgagcctcagcagagtggccctcccttcagagccccgggaggacttcggtcttgtttcagcagaagggcttctgtcaccagggttggagtacctctcgctctccctgaggcagcttgggaatagccacagcatcatcggccctgccctgcagccactggcagggatcttctgatctctgggtttgttctgagatgctgctgtgacttgtggagcagagagacccagggtcatctgctcatctgccttggaggacacagaatgcagtacctcagtggatctgagccaccctattggccctcctctccccctcctctgccaccagcactcgcctcgctagcccaggagcgaagaggatgccttgggaatacgacgcatcttcacgtccaagctcagggtcatggcctctgtttcaggtccaggtgctgtggtgctgtcagaatgagccagagactcacctccaagtggacgtgtatgggcaccacgtcaccaagagttgtttgcctttgaaggtcatgtgtgatcctttgaggctgagccataggatggactttctggacgtgaggatagagtctttgtgcccagccagccactcaatctcccccgagagctgttaatggagtcttccctgcatttgtttaataaagttctgtgtagtttcttaaggatgcggtggttcttgggggtactgactctgcctgggtgtttactatgactgatggcctgtaagcaccaatggtgcccttacctcctccctggccatggggtctccctaccctgaaggcaggggcaggagcaggaccttgtctgcagtagtaccgcacagtctcccttccctcctcttcctgccagtcctctcaggcacctgtcattctgccttctccttccttcattgtcatctaaaatgtttgtatttccccttaaaatggcctttctctgtcctccccctactccccctccctcagctatactcccaagatcttgaacacctcaaaggaccagttctctgcccctctcccccaccacacgcccttggtctggcttgccttctcagagccctcatgggccccaccctagccagcactagtcctgtcacattcctcatgggacctgccctgtcacaccatccacaggaaacaggattc

SEQ ID NO: 31578 - DNA, 1189 bp, Mus musculus
tagggctctgacaggtaaccctgccacactccgaccaggatttaagctgtgagctcattagattgtgttgcctggggtgtaggtgatacaagctgcaagaaaggtcatgaaatcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatccctaataaaaaatggaaaaaaaaaaaaaaaaaaaaagaaagagaaaagggaagtcagatttaactagtcacattatattatatataatatattctatttcaataaataaaaaggctcaagctaaaaaaaaaaaaaaaaaaaaaaaaaaagaaaggtcatgaaaaatgcccaacacaagccagcatgcactcgtcgctcaacacaactgacttgtttccctagatagtggtcggcacccctcagaagattgtggcccgtcgcctccactctgcccagaccagtatccaggaagccacagcctccaaagtgactgtcagcgtgggagacaggagctctaacctacttggtacaggatgagcaggccatgggcatttgggcttaccttgccagacttggggagcggggagtagcctctgtgccctttaggtatggttttatctgtttgggttttgttgttgttttgtggtgttggggattgagctcagggccataacacaccacaagcacatgctataccactgagcaatacccccagacctctttttcttattcagactcacctctaactccagagagagccttcagcccccgctcatccactctttgcagctcttaagaaacacgaggcctccataagccaaagcgtgaaaggtgccttcataaaagcacagctctaagaaactgcctgggctgagtcagagctgtgattgcagccctagggcatgagcagagcaagccacagtccactgcagctgatggtagaaactaatgacatcgcaggctggtggctggttttgatttttataattacctctccctagtcatgcatagaacattccatctcactcttcgcctgtgacagccctggacagcaagtgccagaaataaatatgtcgatacagattttttttaa

SEQ ID NO: 31579 - DNA, 1099 bp, Mus musculus
tgttatggtttatttttattttatgtgtatgaatgtcttgcctgttgctgggaattgaacttgggtcctctgcaaagcagagcagaaagcattcttaaccactgaacaatctctccagcctatgatttcttatttttattatcaacacatcgccagtgaggtctcgtctctgtttttaaagaggaagtgacagtgctgggtagtgagatgggcccagagatatggccccagcccacccaggacaaagaattgggaaagggtcttgtgaaaacagattccagatgggaaggtacagggggagctggggcctcctgaacaggtgcagagggagagtggcaggcggccagagctgggaaggtgggaggaccactttataggtctatgtggattcctccctgaagctgaggaatccctcacagacagaggggagtggggagctaggtttgggctatgcgtccaaacaaaatggatgatatctgggtttattctcccaggtgtctcagggacatggagctcctcagccagccatgtcctctacgttgaccctaagacaggcgtggctatagcccgagatgcagggtctgtgactgtttactacgagatcgctgggcagctgaagaccttcaaggaggtaggtcttggactgagagcagccagaagcaattatggccaatgaaccctgttagaggcagtaagagcatcggtgtgtgtctgtaactagacttggagatccatgtttgcacttgggaggctgaggcagaagattattttgagtttgagaccatcctggcttacatagcaagactgactcaaaactcaagcaagcaaacacacacacacagcccaccattgcatccccagcacatcgtagtgtgtatgcccctagataccagaacctgagcatgaccagatctctttacacaaaggcgtgagacctcagcacctcctgcctatttttattttatttttattttgtttttattttatttttattttgtttggtttcatggtctgtttggacacagggtcttactgtgtagcccagggtgtccttgaactgaatctcccgtgcatccctggtgtttgtcaccccctgtat

SEQ ID NO: 31580 - DNA, 1481 bp, Mus musculus
cttgcaggcaaaagccctggctagattgcgagccactgggtccaaatgtccagtgattgattctgcctagattgtttcagagaaggggaaactgaggcactgtgacatccacaaaaggctcagagtcctagagaacaagcatgatgatggtctctcttcttcctgaccacaggcattcccaccacccactgctgctcaggtcagcacagaacctgggtatagtcagttctttctggcataacgtatactcagtaccagacatgcaaataattgtatcaactctgaggacatagtggctcattttgaatcagagaaactgactcaggtgtcactcaaggctacacagtagctctacactgtgttctgtgcctactggggacagagacctcctcgggcaccctgtcacattgttaccaccttctggatcctagaggacaaagctcactcagtcactggacgctttgattcagggctggactgtagcttgttttatttagtgggccaagcaaatgcagcccacttactttttgagtggcagaaagtacgaggtgttcatcatatcccagccctgcaacagttaacctggcttgtgggctttggattttgatggcctcgtggaggcttcttgtctagagtcaggatgattgtttacctgccgtttatggggcctggattcagaggtggctctaagtgtcccactgttgacttccatcagcacccctgatgtaggggtgtaggcgcgtggcacctcttctccatccagtgggcattgcttctacttcacgtgccctgaggaccttctcccacaactctgaacatggcagccatggcacagagggcattctggccctgtgaaccattacctaagttttcagtcctggatcctgcctcaactgagtctcttggaggctgactagctgtatggggtgatagaaaccgtgttgctaggtgggaactctaaaaagcaaagtctttcttcctcacactcagaagtcagcccgcctactaagtgtccctaaaatagggacccacttgggcaggtaccaccacacccaaatgctgtcctccaggtctctcctgtttcatacctgaggatctccatgagcccagtcctgcacactcagcacaaggaggcgctgacagctctgcctctggggatgaccgtgaccttcattgtccacttccacgacagctctggagacatcttccatgctcataattcagtcctcaattttgccactaacaggtaggacataggcatttcttgtttcccaagaagctgggcttgttgtatctgggtttcatatataggttcagatgggtgatgaaagaaaggcaaatgctatggaaggacaatggaagggatggcatgccacaccacacaggccaggcctggaagcagcaagtccagtcaagaggcagagggagtgaggggaagaaaggcccaggcctttgtctgtatgtggcaggaacgtgttact

SEQ ID NO: 31581 - DNA, 1189 bp, Mus musculus
ctctggctcccataggtcttagatagatcagaccagagaatccctgacaagtccccaaaagaagtactagtgctgctagctggggcccacatcgagtcctgcactgagagattcataggtttctcaagcactgtgtggtacctcggcccctactggttaccctcagctgagggatgttcataccccatgatcagtgcatgtcatgtacagccagtgccaacttgcagatgccagtcccttctgtctctgtctccacatccaggtcttccccccattcagattgatacccaggaaggtgacactgatcattggagccatgatgcaggtgggagccactgtgggtctacacaggccttccttcagtgtcagcatctcacccttgagggatggtgaggactctccagcatggcaggtgctgatgagagccactgtttctcacttctcagatcacctctgaggggggcccccagcctcagtccaacatcctcttctccatcaacaatgagagtgtggcagcagtgagcagctctgggctggtgcgtgggctcatggtcggcaatggctctgtgctgggagtcgtgcaggcggtggatgcagagactggcaaggtcatcatcgtctcccaggtatctcacgtgccactgatgagtagctcttggtgtggtcagatttctgctcggtttggtctctgccttcttgaggacacctaaacctaagatggctcttctacagactaagtctcctaggctctaatagcttctctctgggataagatctctactatccctagacctacaggttctctggtacatgaggaggtatatgctgcagaacactgatctcagaacttggcgttcctcggtttatgttttgctaccttctgcctttgcagatgaattgtgtgacaaacctgctagtggcccgtggctgttgtgattctgagccttggcccaggactcactgaggtcagagctctgagtccttttgtgcactgtctgcagtggctcctgagcatgtggtaacaggatggaagaggccagtcctgatgagatgctctgtgtgtgaccctatatgcctggattcacagcagtgtgctaaaagcatgctgtatggttgccaataattctagacctggatttatcgttcagtgttctgctcgtctcttccttaaccactggcccaatggctc

SEQ ID NO: 31582 - DNA, 1145 bp, Mus musculus
cctttcaacttatctcagcaactgttctggacctgttaatccttacaggactaaaagcctcagcaaactcagttacctgtttcaaaacttgaaactgaatcagcagcaggatgaggtagccccaaggtaaccaaggggcctgtgactgatatttgtttcctgtctgtgccctcaggtttgcagacagtctcggttcacgaggcatcaggaaccacagccatctctgccacagcgactggctaccagcagtcccacctgagcgaagccagagtgaagcaaccggtatcttccagaggacacagtgggtgggaccatgggcaaggccaggacggatcctggttttgtgtagattctgtctggagatcactacctgcttgatttttccttgcttcccagcatctcttgatggcttcaggctaaggtgctgcttggaaggggttgggggagagggatccagtgggtacatttgaggaattagaaggcttctccaaggatggacctgtgtggatgatacctaccctgtcagactaccccataagctgctactgaaatggtggagacagtagatacttgtggacagggaaagtggggggcttgtgtccttgagagccaggatgctaagacaatcaggatgctaattcctctgggagaaatcagttcccctttggatgttttgatgttcacttatccctgtcccaaatgtcttctccccatttcgttcttttgtagaacttgttagcttttgagaggcctcactggggctcctctctggagcctcacaccccacagatggccttttaagaacttcacttatgcttccaacctctctgggggccaggggttctctctgcctccctggtgtcccctggatactaacaccgcttgaagcttccattcctggaatgaggcctctacctggagcatctagctcgactcttttcagagggaactggtagtgtccatggtcttacggatctgacagtgttggcctttctctttcagcatgaccctctagtacctgtgtcagcctccattgaacttattctcgtagaggatgtgagggtcagtccagaagaaatgaccatttataaccatcctggtgtccaggtgtgaccctttgcccaccacccctcaagtgaggaact

SEQ ID NO: 31583 - DNA, 1177 bp, Mus musculus
atcgcttagcacttaagagcacttgctgttcttccataggacctagatttagttccccagcacatgcatggcagcttataaccatctgtaactccagttccagaggagctaacatcctcttctggcctcattggaaatgaggcatgtgtgtggtgcacagacatatgtgcaggctaaacacccatacacattaaaacacacagagacagacagacagacagacagacagacacacacacacacacactaccaaccactacaaccaccaccaccactgtaaaaacaaagaaccttttttttttttttccccaaaatagggtttctctgtgtagccctagctgtccaggaactcactttgtagaccagactggcctcgaactcagaaatccgcctgcctctgcctcccaagtgctgggattaaaggtgggcaccaccactgcctggcacaaagaaccttccttacctacaatttctctgcccccgttcctcacccaactcaacctccttcttcttttctctgtgctaagaatgttcgccctgcggaagtcaggctgctgatcttggagaacatccttctgaatccagcctatgatgtctacctgctggtgggaacctccattcactacaaggttcagaagatcaggcagggcaagattacaggtacagttgtgactcagaagtcatgttagatgctttcttctttctttaaaaaaaaaaatctattttttttatatgtatgggtgtcttgtctgaatgtgggggtggggtggggtggggtggggtgggccctatgcacatgcagtacccgaggaggccagaagagggcagtggatcctactggaactggagttagctactgggaactgaacctgggtcctctgtgaaaggagccagtgttttaacaactgagctatcttttcaactggctcccttcttgttactgtggtaaaatacatggcactataaagttttcatgtgtgcagaccagggagtggcattgcattcctttgtagcactttttaaccatcgttacattccatctccagagcgtatccatcctccccagcagagccaatgtcctcatcacacacaccccatctctctcccttgcacccacggctcacaaacattgtctcatgaagttaactgctttgctgagctcagttgcatgcaggcc

SEQ ID NO: 31584 - DNA, 1123 bp, Mus musculus
atggactctggtggaacagtggtgtgtgttctggtgacatggaaccttagcgattcagggtgctgagtccttgccactttcatgcatcctggaatgccttctctgccaccctcccctggctcctggtttcctgggtcctcctgtttccttttctcattcttaaccatttcctccctctgcctgtgggagtctaggtagggagagttggtgcatatgcagagtaggccttccatttaggaaggagagatgtgacttgagttctctagagctcagcccaggtgggatgcaggatggtacagtgaccagcagagaaggcagtaatttgccatgtctggcctgtttgccgctccccacccccccaggtgcagggcagggttttcattttcaggctcctctgagcctctgttgtcaccttggtttagctcacaccctgagggagcatgtcctcagctggttccatgcttgtctgcatacacagagagcctagaaaattccagttagttccccatgtacatccttctgaatacgtgagactttaagaagcctttagttcttctgactcttgagtcatcacatctgtcacctcttcctcttgtgagtgtcagcaaccatggggcaagaaaaggggctagcagctgagcccagaagccgtatgtgcagatacggacattctatgagacagaccccttgtatagcatctgtctccccgccctccttgtaaggcctttatgctcactgggtacagtgtctttcttaagatttattttgtattatgttcatgtgtttgtgtaggtttgtgcatgagagtgcaggtgcccttaaaggtcaggacctggagttgcaggtgattttgagctacctagtgtgggtgctgcgaaccaaactcagttcctcagttcctgtgtaaacacagtatgcatggctttaaccactgagctgtctctgcagcctgctagagacactttgtgaactgatcctgtagatgtatgaggtgaagtttttgttcctattatatggtagaaagaaggggtctgcactgagccaagaggaatcctcagagtgttctcggatatgtaaatagccaccgtcagacatggtgctggagaggggctgagaggtaggt

SEQ ID NO: 31585 - DNA, 1152 bp, Mus musculus
tgccctatttgggttacttggaccagaagaacccagctcagggcttcttgtgtctgcaatggttcatttagagacatgtcttggcagaaacagtctaggggttagggaaggggctagacaaatcacctgtcagctgttacctgtgtagtccagtcctgtgggctctggagagagcatcccctacacacacacacacacacacacacacacacacacacacacacacacacacacgcacgcacgcacgcacgcgcacatgcgcgcacacgcgcgttcttggagccagtcattggctgcccattgctctacccgccctgcaagaggatcaaggctcctcagtgcttccttacaagggaggggctggaagtgcaggtcaggggtgggtggggttgaggtgagaggttcccctgcacagagcctgcagtatgtattacacttggtggccctgaaacccaaccacagctcctcattgcaacccacaggctccaccaaggacctaatcgagacctgttgtgcagcgggccagcagtgggccatcgacaatgatgagtgccaggagatccccgagaatggtgcccagagtgacatctgtaggtaagtggctttgggtgggcagaactgctcttgccttccctggaccccagatgtgtgagggtgaccaaaagtgaatacaatgagccatctggccaggcggatgtggggagactgactggttctgagggtcagctgaccacatggatctgtggctggcttggtgagtaaatggtgtactatttagagcaaattcaaagtgccatcatcaccttggggatccggggctccccaccccgaatgccccggagccgatccctttctatcctcctctgtcacctctgctgtgactcagacacctgcgctctgcttcccttgccagaattggtcttctgttctctccctttctcaactttcatggcctactcataaagttcagagaggcagtgtgattcacctagtgctgcacagctcaccagtatggccagaattagaactcatattttctaatgtctactgtgttctgtccctgcccattctccttcttctcccttcccctacccccttcttcttcttcttccttcttttcttctttttcttcttccttcttttcttttctcc

SEQ ID NO: 31586 - DNA, 1203 bp, Mus musculus
ctcagaaagctaatgggatgtctcagggatgggccagagacaggaaggccagatgtggacagcagggccatgtagcagtgtggaagcagggaggcctgggtgggaggcaggaccccagtggctctggctcttgtcttttctcagttattggaagctactgacagcgacgaggattcgggtgcatgtgccgtgtgcacatagtctgggtcacacatcctgttacctcggccacttagcttgcttgtagatttatctgggatctcccgagaggcaagtagattgtcctggtccagctggcccagttcaacatccatttgctgtgtgaccctgaacaaatgttactttcccctctgagccttccttcaatggacaaggaagatgtgagccctgtgtaaacctgcacgtggctgggcctcttgtctatctatgcctgaataggccggggctgggattctggagttctgtggacaaggaaggactccatactgtcttgtgtctgagttacctggtattctcactgaggaaaaaatgtaagccctggcttcctgcatctcagagataacactgagtagaggagaagtcaggcagactggctgatgcaatgatggggaaacaggcaaagggagacttcactcttgccaactggcacccagaggaaagaggaatagctccacctattcccaaggatgggtgggaattggcgatgggaaaagccacaaaacaggacagttttgaagacagttgggacagaggtgtggaggtgggaccagggcacacagtgctcagggcttgcggccagagtcctgtctgtcttgcctgtgcttggggaccatgtccagcctggacatgtcctcttcctcccctgcaccgctgggcagcagtgctggctgacatgtttgcctcgctgcacccacggtacaacatggccctcctgatgtgcttgccagtgatggcagttcctcctgggtggactgggtttgtgtgtgtgtgtgtgtgcgctgggaggcatgtgggtcccctctcaggatgtccccccatttgccactccctggcttggcagctatgacctctgctgcagggttcttagcggctgaaagatgagcccacggatgagaaagccaagatacattccattcagcaagatttatgaaccagctctgcattgcttccctctttattctgcacaagctatcagtcactctc

SEQ ID NO: 31587 - DNA, 1410 bp, Mus musculus
gcttagagcggtcaaggggatgcctccacaaagtaaggaccaaacaggttttgcatgttcgagatcatagagaacacctctcatctttccctgtccatctttctgttccagggttgatactgcctaacggagatattaactggaattgtccatgtcttgggggaatggccagcggcccctgtggggagcagttcaagtctgccttctcctgcttccactacagcacagaggatatcaaggggtcagactgtatagaccagttccgggccatgcaagagtgcatgcagaagtacccggacctctatccccaagacgaggaggaggaagaggaggcaaagccagtggagccggtggaggagacagctgacactaaggtctctgcagccaaagagcaagggacaagctcttgaaggccacatggctgccactcaccatgggactttctgtacaatgccttttggtcacttttgtgaaagttctttccctctgtgcactgtaatatacaaaataacttattttaatgatcaggggtcttggccgtatacactgaagaaaagggcgtgtgtgcacctgtgtcctgcataaacctgtccttaaacattagtccactcctggatgtactactctgtgattgccctggattttgccactttgaaataatgtgttgagacttctcagcaaccaaaagttgttactcaggaaagtttatcgtgagaaagctgatctattctgatccattttggtatcccttttggtagattttacacctcttttggaaattaagtaaatagatgccaaaactcctttaagagtgggtccattcctactggaagaggctggtggtcaggtgcttgctggagtacatggggctgctgcctcgttcccgacagctaattgtctgtttgctgtccaggctccagtgcctacagctgcagggtggcattggatcctgtgactcccggtccttcctaagtgaaaggatgggctgggtttgcagtttattgttttgctgttctaagagccctggtttggggcccatgttcactcagttgtgatattgaggtggggacctagctgcttccagagcagaagccaacagaggaatgtctgaatgaagtactcaattaaaaagaaaccatttctatctgattttgaatggcttttttttccctccctttaactagttagaaagttgttagctttcttatgatggtggagactgaacatgtctgaggcttgtgtgccaggcagaaaggtcgccatgaagccacatcccagccttttgtaattttgagacaaggttgcccttgatcttcctgcattagcttcccaaataccatgccaagctgttagttttgtttgttttgttttttttaatttttaagatttatttatttttttatgtatgtg

SEQ ID NO: 31588 - DNA, 2076 bp, Mus musculus
gcagacgtcgttatagagggataatgtgagctgtggcaggacccaagtggccctccctgtccatcagtaaacatgacctgctgaaccctgggtccttcctatgcaaggcatggagcagtgaggatagacaagcccgtcctctgcaggcttgcacagaggcttagagctcaggctctgactgaacagtgtagattgtcagtcagtgctggctctgggagagagggttttatgggtgtcttttcagtggcctcagcatggactttgaaagtccaaagcactcacacttggatctgggctgcacagaatagtattgtggtagcttgctgagtcccccaccctcaccccgtggtatcttaggtatgtgtgtggctatgtatggctctacttagtgactgtttcctccctcaaatggtagagaggagcagtctagggcagggagcacagtctcctcggggactcatggtcttccctttccccacagtggactggtttcctgtcttccgagaccttgtcaacattggcctgaaagcctttgccttctgtgtggccacttccctgaccctgttgactgtggctgctggctggctcttctaccgaccgctgtgggctgctctaatcggctgcctggctctggtgcccattatcattgcacggacccgggtgccagccaaaaagctggagtgaagcctgagaggccagattccctgtcacctctgcccagctcagctggatcaggcatctacacaccccattcttccaggggccagtgtccacacctgcatgtagggattcggtgtcctgcttaatgccttcccctctcgggcttcattccacccagctgtcagctgacctgcgggtgaagggctcagccttctcacccatccctcattgctggaaccaagtgccaagactaccacaaccatcagctacaactgcaacctgagaaaacagacatcaccctctactgcggggccacaccacatcagtaggacaccccatacccaggcttggaggagtgcacgccacaccaagcctctgggtagaatctgatgtggcctgaagaaaccctgaaggtcactgtcactgtggcgggacagagtgcttcggtataagcccgcaggcttctggttcttggttctattatgccacttctccggttctttctatcccaaggagagtgtgactgggtcacactcacagttgctgttactgaaatgaactctgcaggaatggtgtttcagcgggtgcggcttgactggtttgagttcccgaggccaaggggaagctttagctttgctctgcttttgaaccagtgttgggggattccctgtcgtgctgggttgggactgtggaggcggcaccctctttatcccctgctatcacagatgatctgttcacttgaaggtgatttttatcttgtagtcagtgttacaagaaaaggctggaagcatttctactaagcgaggccctttacagtgacctccaggcaactgaagtcaagaatcaggactcgggcttgctgcaggaggcccacgtctggcctttttctgtgggacacttctgaccttgacactccggcctcaagcagttgctgcagagtggttctttttgcatttaatgcccatcactatcctcatcccaaataaaatccattcatactagtggacatcatttctaagtttccttgctactgttacaccctttgaacggatgctttagctctgatgtcgtcacagagccttggtttatcctgtacctgtcatttctgtttgcaactggttgctgtagcaacaagagtgtttggtagctgaccaaggtgtcaggatccctgaccctagcgatacttaacagttcttcccatgtcctatggtatctgtgcttttggctgggtaaaagtacagccagagacggcttactgggtttagaatggaaacaacattcactactgttcagtgcatgctggtacaatctcttagaaactcctaagatggtttgggaaaatacagtgcaattagtgatggctaaatacacagtgcttgggattcagtctgtgtaacattttcttctgtgtttttt

SEQ ID NO: 31589 - DNA, 1219 bp, Mus musculus
gaacttaggacagaacttaaaaagccttcatgggctgtggcttcgggcacagaatagcacgtgggctgcacctcttgggctcattgagatgagtggttatccaaatcatggagggcaggcatgatggcacagctgtgatctcagactcaggctagagaccagcctgggctacagagcaaaggtctgcttcacctctctcacagagagagagacaaccatggatttccctgcatgggctagctagtgcaggcccacctgtgtcagattgacagcactcagtgcctggcgtgggctgagtcgtcaagcaggaagcatttcttataaccaggccgtttcctctggagcagatggtgaaaggcttctctaaccgtgcccggaaagcccggctctcggagccccagctgcatgaccacaacgacttgggcctctatggtcactggcagacggaagagtatcagcctcctatagctgtcgatgggaaggtaagggcagctctggaggtgggagtgagggtgggggtcagagtgggctgccctgtctcccatccagctactctggcattccaatctccacaggtgcctcggaatgagtttgggaacgtgtacctcttcctgcccagcatgatgcccgtcggctgtgtccagatgaccctgcctaacctgaaccgggtggcacgcaagctgggcatcgactgcgtgcaggccatcactggcttcgatttccatggaggctattgccatccagtgtgcgtgaggggtcttgggtggcagttggggaggctgaggctggtggcacacactttttagatttgactgtgggtttaaagtcagtcttatcccctgatcagccctagcttcttgcaaggagcagtagactcagagcactgagtgtcctggtcccactaaactgaagcactgaccccttttgcaactcacaggccggggaccaaggcatgggcagtgcccttggctcctgagtgctcctgggtgaagtggggactagggttgggagttctctagcactcaggcaggtcctgtgaaggaagaggtacaggctcccataagcctgcctcctgcatggctagcatctatctttggctgaccaggaatgtccatcggggccccaaatactcacaaaggaccattggcttctgaataagggaggaggaggggctgggtgggtggccagctcagggagctcatctgtattaatgtcccca

SEQ ID NO: 31590 - DNA, 1356 bp, Mus musculus
acttgaattcatggagacctgcctgccttagccttctccgtgctagcattacagtcatgagccataatgtctgacttgtttttattttacatttatctaatttttatatgtatgtgtgcatctgagttcatgtgtatcatgtacatacaagaacccaagtgccagaaaagtcacacacacacacacacacacacacacacacacacacacacacacacacagtgaaaataaatcttaataataatccagcacttgtggttgaggtgtgagaggtataggaattaggaatttcagactaacatgggctacacagcaagacggaccccatctcaaaaaaataacacaaaaccatctaccttgtgtccgggtctggtcacaaagaagcctggaaagtgcactctagcagtgcacagcgagagaagagtgggtctcggtgcgcagtggtccctgctgcggtcacccaggaaacaggcactcagactgcttaccctgatcctgcctttcccttttgttctcctccagtccacaaaacgaaacatccctatgctcttcgtccggggagatggcgtcgttctagtcgcccctccattgagagttggctgagacaaaagatggatcctgtgtaggaaagtggagactttgcctcttgagatgtacaggacactcccagagagagacgctcacacgaatcctgatagtcagaaatgaccccaggatcactctaccctcgaagaagttcatttgcaagcaactcacaagctctccagctaaatgacctgtccctttctccagccctccagtcagtgtgaccgtcttgctcttttcaggagttggtttgcccattgttcttgcagttactttcaggttgtttttctttaaattaaatttgatgtttccttttttattacttttttttttaatgtgtcttgtggattctcaagtttttacctggtgtgttcagtgtgtctcccatgtctagggcatcgtgttgggtgtgaggaaggagagtggccagtctgccctgcccttatctgagggagtgctgttctagcaattctggggtgggaggccattgcaaatatccttacctgtcttaggggccccaaaagctcaggtagcacccagtaagaactagacaagggaggcacgtgaccccagctgtcaacctactgggtaaatgcaaaacatgacttgtgtgactctgaagaaactgtcttccagtcctggctcataggccgccagtgacaaggacatggggagtctgagcaggaagcagtgaaagcaaagctacttccattccggcttcagccagcctacgcttcacatagaatcacaagaacacagggccaacacttg

SEQ ID NO: 31591 - DNA, 1173 bp, Mus musculus
accagtgacaaaccaaaaccaaccaaacaaacaaacaaaaaacaagaaaaaaaaacccagaaaaataaatgcacaaaaatagatgagctccaggttcagtgagacttgtctcaagggaataaggtggagagtgttttggcaggacacttgatgtcttcctatgactctccccaggcacaaaggaccaatcgccccttccccacagaactctatttgaaggtctggagatgtgacccagctgctgagtgattggctcagaggcatggatcccatgtgttcagcctcttgaactgtgtatggtggcccacacgtgtaattcagcactcagaagatagaggcaggaggagcaagaatttcatgctcatcttctgacacatagctaggtcatggccagctgggttacatgagaccctgaatccaaacaaaacaactacacaaagccctctgctgggatcagctgtggttgactttttcatggtcaccgtgctggccccagccatcataattggccagcgcagctggacaagtagggatggactgaccgagactgaaggtcaaatcatggcagaccttgactgtagacagcttcccctccatgacctcaccgaagggagccactcctgtgtttggcgtgtctcaactctaaccctattcatttttaaatttatttttatatacatatctacctacaaagaatatagacaaatgtcagtatttttcatgtttatgtattttgagtatttttcctttgttttcttgtgctgagtgttttgtttgagataagaacttgctataagcccttggctagcctcgtacttgctatatagcccagacgagatttactaataacagtccccttgcctcagcttcccagttgctgggtgtgacttcatactggtcagggccacccgtgtgctaaccatggtggtaccactgagttacaaccttcatgtttactagaagaagggcatgatggatgatcgtttgcaacctgtctttttgcacatccccaagattcatctgtgttggtccggttcactcatttttgttactctatagagtttatacgcaggtggtgtgatttttgttttcctgttacagatgagaaaaatgggactcagagaggttaaaagcctgaggggagtcagccagcttctaaggaacagaaaatca

SEQ ID NO: 31592 - DNA, 1193 bp, Mus musculus
acacacacacacacacacacacacacacatcttgcctatgtgaacctgtacgtgtggctgtgtctccggaaccctggccgtgtgcacgtgtgtgtgcccgaatgtgcctggatccctggatctgtggttgggggcaagtctagtgtcttctagctgtacccgagaggccatcccttgtgcccagtgggcccaatggacatctttggttcttcgtagtatttaggagaggtaaaagggcggtatggctccaggtgctgcctgggtgtggcacgcaggtgtgacagtcgctcccaggcttgagtagcagggctgaggcccgaaacgacagccaggggcaatgggtagcaccagctgaacacatcttcctctagactgctccccttcactttatgggttcctcttttgggtgggaggttctggtctgctcccactggggaagccacacaaggaaccagtctcaggaacagatcctacagtcccaaagcctcaacctaggctgtagcctggcggcaagggaggcgtgtgctcagcagggccaccgacctggctattttggtcactgcctggcctctgccagatccctgccttccctaggaccagccccaaaggcttgggagacagcctgggcccccatttcctgcctggggaaataaatcatctcaaagactggccaggcgcttgacccggagggtcctcggactgcggattggtagcacgtggctccaattggatgtcagtaaattggcctccgatttggcacagctagctttcaaataaatgtcatagagatcttttttaaattaaaagaaaaaaaaaattttttttttgttgctggtagggaggggatctcactcagagtctctaagccagaaggagtttatttttatgagagagctggtgagtgcttagcaacggcctgcctgcctccctctctaccagggagtcatcggggagtggggggtgagagggaggtgttttagcaagatgatggtgggtggctggagggggacctaggcaccagctgagaacccacaataggatggtattggcagatggttggaggttgtcttaggccttggttcagccactcagttaaccttgggcagtatttcttgtcctcagtctcttcatctgtaaaatgggtggggcatactacccattggatatgtcaactggggatccaagagtcttct

SEQ ID NO: 31593 - DNA, 1157 bp, Mus musculus
tgttaggcaccatcttgtagccctggaagccgctaccaccgccacccgctgcaccaacgtccgtcagcctgacagagttagatatgactcccgtgcacccaggtttgccataggagtttactctctgcctctggtgcctactgtatccacagggtgggagtgttaggagtgtccccactcccctacctccctcaggctccctctctggagcacgtctcctgtggccatccatgtccgtgatagagtgtggtagggccttggtcttggtttcctcccccacagagtgggattgcatctgaatgcacttctgtggccctaccatgcagcttccaagggaagtccctggtccttgagaaacctttggggaaagaccacagcacgttcaccacagaatcatccagagagcgcaccgctcaggggatgcattgtgtgatagaaatggaagcgaagatttggggctctccaaaacaacaaaaaagactgttcatcttcttggggaagttgtgctctgtggccgggaacaggttcaggtcatccctcctctctttcaagcatattctaggtgtctgtctgtctgtctgtctgtgctttgccctgtggctctgcagcgcatgcctgccctgaacatctgcaggcccctcaacactctttgatgtgtttactgtgattgatgtctggaagcagctaggactctcagtggaaggggccagtgatagactgctgagctcaggctggtggtgtggtgagagaggccatgaggccatcaccccagaggctgcctgtcacagcctggtgagggttctgttcattactcttggatggactagtgttccccatcaagggcactctggagccaaggtgtggggtgtgagacagcagcctttggaggtcttctagggggaagggtgaggaagcaggcacagtgtctcctttgttcagaacagaggatggatctgggtagaggatgccatgcttttaggtccacagtctgattgattgattgattgattgggccttggtgtgagggaggaaggacgtccttcctgtgggggaaaaagaagcattaaaagaggaacactgcagggaagggtacatttaaaatatcacccagacattgtactcactgcatagagggtaaggctgaggcccaggggcag

SEQ ID NO: 31594 - DNA, 1099 bp, Mus musculus
cacccatctttccatatttctatccattcaagtttctattcatccatatttctatccatctaccatccatctgtccatctatatttccatccatctttccatctatccatccatccatctgtctatccatccattcttcctccatctttctcttcatctacccatctttccatattcctatccatccaaggtttcattcattcattcattcattcattcatatttctacccatctatttatatattggcccatctattttttcatctatctctccatgcatgtttccatccaaccatccaactgcacagtcagtgtcctgaccccacttcttccattcatcctgtgactcctccagctgccatttctctaaccattcagccacttgtccctttatccagttgctccttcatcctgcgactctctcctgcttactgttgagatggcccctttgtcccacagactgggcacatcagtgcctccccagttgaaagtgcctcctttgtgacatgtgtctatttgcttgtcccacccacaggcattggctacgcatccatcgtcattgtgtccctcctgaacgtgtactacatcgtcatcctggcctgggccacatactacctattccactctttccagaaggatcttccctgggcccactgcaaccatagctggaacacaccacagtgcatggaggacaccctgcgtaggaacgagagtcactgggtctcccttagcactgccaacttcacctcacccgtcatcgagttctgggagtaaggctacatcttgggagggaggagtggtgtgggcaggtcaagaggggacagtatcttcctctgtgattgtggcataccctgtttctggagggaaggaggacacacagctgtagaacaaacactctgtgcctttgtcttgtacgagctagagttgaatcctagtttaccgccaaacggctatttgatttttgtagggaagtccccctactttacctttgagcctcagtttctttaactgtcagatgaggaaaatgtatcattcttccatgggattcctgttgagagatgtacaggtatttgaaaattatagttttcttaatgtatt

SEQ ID NO: 31595 - DNA, 1161 bp, Mus musculus
catgcaggccagttcagcagccttggcagcaagtacctttttgctcagccaactaaatcagtctccactttacagatgaggaaacagaggctcggggacttgacttgctcatggccaggctggagtgagcctgagatcacctattaagaatcctgactttggtttttttgtttgtttgtttgtttggttggttggttggttggttgtttttttggttttttttgggttttttttttttggagacaaagtcacactctgtcgtctaggctggcctggaattcatgatgtagcccaggcttgcctcaaattcaaggcagtcctgtctgccttaacctccccagtgttggaatgaaaatgagcactttgtagttcattttgtcatggtgccggtaacagaacccagggtcttgcccatgctggcttagctgccaagtggcccccaacccctgacctcttgttctctttccctaaaggcgcaatgtgctcagcctgtcctccggaatcgacaacccaggcagtctgaaatgggacctcgcgctctgcctcctcttagtctggctcgtctgttttttctgcatctggaagggtgttcgatccacaggcaaggtgagtggactccatcccctgcctcagggacagccccactgtggccagctcctcttgaaggctgaagtacctttcagtgagtgctacctagaaggaggttccatgttggacataggagtgctctgacaagacacacacacacagccccgtgtggctttgtctcttactgggtaaagtccctgggtgtcccctactcactgatcaggagattagtgaccttgtgactggcaggcaaccaaggtgtccccactgagcttctgtcaccagccactgatgtgcactgttggtatggtgagctaagctagcggagccaaaggccagtggcggccctactgctggctttgattatccacccacaatgtggaccctaactttgcaaagtgatctggcagcacccagagtttaaaagagatgctgaagcaggaccacccagctgccctgtatgactgtccttgtacagggtgcagagccccctgctgtactgaacctcagtctgaagggaagccagccaggcctggaccactccctgctaacattctccgtaagacaaatagg

SEQ ID NO: 31596 - DNA, 1135 bp, Mus musculus
tgcttgtgaggcacgtgtggttcctagaacaatagcagccctgatgggtcagagaagccaagacaaacaactctgtggactttctccagctcagtgctgagaggccttcagaggccatccgcctgcccgcctaccccatttaggggcccacccactggctggcttcagcttccagccctggctgcacaccagatgtggccaagtttgtttctgtggctaacttagtccaggagacgggagggtgatggatggaggacccgagttcaggtgcttggcttttctttcctggcctttccaactctctgagggtctgaaacaggtcccaggatgaatgtcagtttcacttattcaactaaccaggttgctgaaatactcacgagtcacctctatgttggcgacagctcatttaatccccctgaagttctctgatcctgtacaattgaaactgaggttcagagagcttaactaacgttccccaacgctacacagcttgtcggtgaccagactgggatttgaactcaggcaactcccttctcccacctctccgtctcatcctcgtgctggctggcaggtgcagggaggcagaagcctggcatgttcctgcttgctctcacaaggagacaggttgttggtgctcaccctggaaaggtctggatctgtgtgtggctgggtctgtggtcacactccaggacagcctgttttgtcagaaacaaagcagaatggggcagacagggctagttctgggtttggacccagctctgtccattataaatggaatgactttacaaaacctcttaccttgctcagcctcagtttcccctggtgtaatgtaatcgaatgagcttgctggtcaggccatctgctcccaagtaaagctaagtagcaggagaccggaagccaggtccctcttgcaaacccactaacctccagaggaccagggatgaggtgccccctaagcctccattttccacaaggcctctggccctgttctgaaggatcagcaacaggagtggaaaaataccacgtcccacagcaaggcctactgggccacagtcaggggcccaaggtggcgcctggcaccagcctctccctagaggatcccgagggacagtcacggaaaagttgagagaatggt

SEQ ID NO: 31597 - DNA, 2085 bp, Mus musculus
cagttgaaaattggagcagagcagggttggtggccagcctgagctgtaagctgggaaggtaggcttgctgccttccagagctataagctacagtccctagagaagtaaagaatgccttgtgttctaacttaggtctcagactaagccatcacagccgtcaaagctgccttggtgtgcttgatgtggaccgtggcaacttagcaatagactcagagaagactgctctttactgagtgtggaaagttgtttgcaggggcagggtaggctaggggcccattctgtagatatgaaaagcaaggtttcaggagtggtactggtcactccagagttagaggccttaactgatgcaggaagaagagggtcttcctctggggttctagatctgccctctggggttctagatctgccctctggggttctagatctgcctctggggttccttgcagctcgcctgtgtagacattgtcatggttaatcaccccaggcaaccaccctaatgctcttcccctcttcaggtgtggatcgacgctggaactcagatattcttttcctacgcaatctgcctgggggccatgacctcactgggaagctataacaagtacaagtataactcgtacaggcaagtgtcgcgctggcgggcccggtggacgttagaaatgatgattaaagaaaaaaaaagagaagtagggagcgtggcttccttgtgttgtgattaacttaccccctgacgtgtgtgtaacttagggactgtatgctgctgggatgcctgaacagtggtaccagttttgtgtctggcttcgcaattttttccatcctgggcttcatggcacaagagcaaggggtggacattgctgatgtggctgagtcaggtacggtggtgtcggtggcagtggtggtgggcactgccacctagtgtgtaagatgagtactgcaggcatggagccagaccccagggggatggagggagcctggcttttacatagacatcccctctccccccaagatgtgctcccatacctgagtacaaaggctacagttaaaggtcctcagtgcattctggcccactgaaggtgggaggagcaagggcggttgagatgaaacttggtggctgttttagttgtggtcttccagcccccaacacttccccagcatccgctggctttagccatggaagttggttttctaataaggctcaggtcagccacagctagcacaccaatcaccagcgctgctgacatctcagccttggtttctgtggtttgcatttggcacctggcgggctccagtgccaagccgatccactcttgagtccttcctgtctatgttccaaacctcacccctcccagcctccaccacagtcaccaggagcgagagggcaggggagaaacatcactcagagcccacgacagagccgatttgggagtaggatatgaggacactgttgcctttggggagttggggccctgttggccccatgttgctactcaagatgctaacattcacagaatggatggtcgatcttagggtcaggggctcttccttagcaacatgggatccagaactccagcaaagaaggttctggaacatggtcttgactcctactacctcatcacggttttttaggggtctgggctctagtcgccctgtagtggatggggttctggggtggatatcaccaggggccacctcctcaccccattctcttgcagggtggtcaggtgttatccaacctaattactctggggcttctagaggctgccaagagccatgggttgggtcttccttcaggccacatggatgggtgagatagggaagactgtccttcattattctaggtgtttttttacagaccagggcaggtaccctaagtccctgccattctcttccctcgatctccttatatttgaaacttaaggtcatgtctcagttctctgatcctgagccttggtattggaaggtcagagggtaccttgatactttgtgtctagatcatctagatattcatgtctcagcggagatcaggttgccttggtattggaaggtcagagggtaccttgatactttgtgtctagatcatttagatat

SEQ ID NO: 31598 - DNA, 1185 bp, Mus musculus
ttgaacaagggtattgcacaaccaagggaagcccaggcagaacatggcgtgcttcactcggggcatcccagcagtctaagtattctcggcttctactcgctcaagtttactgtggttgtagaggagggtgcttggcccctctcctgaggctggtttgagaaaatctaaaatgaaggacagaaagaagtgaattgactctgttcacagtgcctggtgcggagggttgggggtacaccaccttttacatctgtcttgtagttggctagtcctgattgctcattcttgaggtggacaaggcaggtccagagctttgaacttcagggggagccgaatgcttttggttctaacttgagcccaagtatatgtttcatgatgtccccggtgggaggtgcatgttctgagccccctgctctcaatcttgctcatccaagcagctttcagcttggtaagcagccgcacctgttcccctcacagaatcttctagtatcaccttctagcaaaactcagcggctgccccaggtcgttgtttcagtagggtttctcatttctcaggctgagcagacctcattgtaagacttctcctcccccgccacagttggggttgttgatgctttactaagtgaatttttttttttcaaaattggtttgtttttgtggattctcccccccccccccccccccgcctccttcttaagccattcatccagttttgatgattgtttaatgtttgctttaaagtgtaaaacatctcccgcagtttggcccatatttcttcttgattggtttgttttgtttctagtagtggattttactttagtttgtcagccctcttgtgggcccagtcccagctagctaatctctcccaggagtctgtttggtggtggtggaggaggggggcgttgtaagcaggagatgtttgtgttcaaatgaccctgtgagaggcactcagagtgggcggagctcttgtcccctttgcctctgagtctggccagagcccttttctgggcagtggtatccacttccaagaatctgaacatgaggatcctgggactacgaccctcagatctcaggggaaactgatgtcccccaaaacatatagaggaagtggtggatgaggactgagatgtggctagtctcctgggcctcggcaccttccttcagtgccaggcctgactgtttttacct

SEQ ID NO: 31599 - DNA, 2681 bp, Mus musculus
cctgctgtttactaacgttagattctcataggaccaggtttacagagctttatatttgtactaggatttttttttttaattgtcacagaaaatgttactctatgtgtgtgtgtatgtgtatcgtgtatgtctgtatatgtgtgttttgttttgtttgggggatattttgtacaaaaagaaaacccataggcctacgtcctggggaagaggatggactttcatattgatttccatgtattttgtgggaacttggtaaatttttctttgtattttttttaacatataactatatatacttagagtctgtcatacactttgccacttgaattggtcttgccagcaatggatctcgtttttcaaaagcaattcttcggtgcttatatagctggcagaaagttctgcccaaaaacaaatgaaaaaagagaaaaaaaaaaaaaacctgaatgctgggtggaattttcctatgatagtggatacatcttcaagaacggtgtagtcccttctgagctggttcaggaggaagaacacagctgaggagagggagccccccccccccactagctgaacagacctgaggggcaggagagagcagggctatggaccctcagccaacaagaaagatgccaaaatactggcccaccctcagcatgaatgatagatctcagagcagctgaagcggttgtaccagggccaaacgcctgccctcttacttggaagaagacatgggtggtagtcagtgggactggctgaaccaccatgggtattacaggcagggatgggacgtctgaatgtctggtgaggatgtggctcaggtctgggagcctgcctctgcaggcgtaggccgaatccctgtcctttcttgaacactcagtatggctgcccgaagccaggccacaggagctgctggggcttcagagtgggggtcacactcaggaagtgtctgcggtatttgagtggagtcatggtgggtggtgaccagagtattccccaagcagaatgtattttggtgagggcccggggtgagggaggccagtggaccaaatgatattagcagctcaggagggtgagtgtaccccaggctggcaagtgtaccccaggagggcactattcttccttgcctcttgacaaactcttgtgaaagttaccaccccagaaccatccagcagctcccagcaaggagtgctccaagtggctgtagaccctggatcttaaaggatctgagttccagtacagagccagcttggtagtgacctcagatgatttccaagccactgcattggctgttggacaggcgtttgcccccaggggacggcagagggaaggcgaagggaagtttcggtcagttgaagctatctccacagaagtgaggtcagtactccagagctgcccaatgtcagcttctgaaccaggagagggcactacaccttcaccccagcctccactgggcccaactgtgccatcctgaacttctttgacaaatgtacacattttttcctgtctccaaagcaatgtactctgccaagtgaccctctaatcctcttccagtggctgttgactcagccacccatgattgtactgtgttcctgttgtcctgtgtatttctggttgctctcgtgttattttgagtgtttggagttctccttccccgattttaccgacttgtaatgtaccctggttttctttcgttcaacggaaccttaaaagtaaccactgtgggtgactgaaagacaggtgaagtgtaagggagaggggggctcgtccagctgtggcagtgtctgtggtcatgcccgtctaccctacccctaacccccaccgggcacgcccctctggcgagccttcagtattttgggttggcagacaaatggcaccattctggaaatggcctgagaaaggctttttttaatcattcccagatcgaattctagaccaaagacacagcgggccaagtccccaggccctgcctggatttggaaggccagccgcctcccgagcccactccccagcagtgtcccctcacctgtcttcagtggcccccactctcaccccgcccctgcccctgatgacccttattgtgatgcttgtcttttcacgtctgcatgtaagtaacattttgaagtagagctcgtgactctggtccgcctgcctcctggagagagggctaagctgttcaccaaccagcccttgcctggaacaggccagatcctgtcctgcctgtcagatggagacaggaagcaagggacattgcctggtttagatgaggacattaggtgggcccaggagaccctgggagatgttatttggtcctaagagtgatgtgacctcccaaatggagggtccctgctgggcactgtgggcagccccagagggccctgatccaaggcacttatgtaatcaggagaataggcctagtgtggggacttacactgtgagctaagtggaactggacatttgagtcatttgtagcttcaggttctccaagacttagtagagggaaggcaggtccagggcattgtctaagtaaactgtcaagccttccctgtcaaccaaaggccagagctgatgagggcccttgctccatattcatggaacacagagcaatacccacgtgtgccagtccttaccgccctgctcaccccggccccgtgccacccttccttccttcctttctcctccaaagcctt

SEQ ID NO: 31600 - DNA, 1236 bp, Mus musculus
agcctatgaggaggcaacatcctggtggaaggaccccgtgaagcaaaactgctcacctcatgacaactagagcagagagggggagggatggacggtgaccaggcatacccctcagaggcttgcctccagggacctcacaatccaccatcccaagccccatcactggcaaccaaggtgtcatgagcctcagggatgcctaagagtcagaccaaaagagctccaccaaagccactggcatcctgctctccgttggattggaccaggagacccacttgagagtaggtctcaagtagggacccacttgagagggccacccatgaggattgcaagcttgtgtctgcagttcttgtgtcaccccacccccaccccctacccgttcccagctcagacagctctcccctcctgctcctatccttcttatcctggagccgagagcagctctaagatgaggtgacaaatctaggagctgctgccctagtgcaggaagcggtctaggaagggaggagagcaggcaccgcctgtgagtcaaaggtccgactttccctctgcctcagagaagacaatagacttcttgagtattgatgtcttcgtgtgtgaaatggccagtgtaggtccagtggggttttgtgagacttgtgtatctttaactttttcaaactttatttttgattttgattcttaaacgctttaacctttttagcccaccacccctttaggtagtgggaaagaaaggatacgggcaaagtgaacctggttagaaaggttcttcagagcaactccagtctgtgttgtcaggaaaacggcagttcagttcacaggtcagcagtggcagcttggtccacttgcaaacactgcacggatataccagcagttcagcttggtagagacgggatagcaaacacaaatcagcagtggtggccctacctagcagagacaccaggcctcagctgacttgagtcagcaaaagggagcaggaggaaggccaggagaagttctctgctgtgcctctctcagggaaacaaagatcagcaaagatgtgagacccacgagcattgcacagctagctctataagcaagccaagctctgtctctgtcactggtcatggagtcctttttatactccctccaaacatcacgtgtcttgcctcagcacctgtctgtctcagctgacaccactctaccaatcggcctgagtccaaagaagtggtaagaagccgccagcacaccactagaagt

SEQ ID NO: 31601 - DNA, 1154 bp, Mus musculus
tatgctatggctatttggtcactgtctggtcttgcactctgaggttgacttcaagagataggactacttggcacaatttttagggcctggagtagtggccaggttcttggaagagggaaacacatggccattccattgtggggagagttgtatgataacttgcttccagatgctcactctatgtgtgttcgtgttcatgtgtgtgtgtgtgtgtgtgtgtgtgtgtgtttgagagagagagagagagggagagagagagagagagagaagttctagtgaaccttcaccttgaccttcatgctcctatagacagtgacacattctcttctattcattgcagcgagtgcttcatgaaagatttcccccatacacatacatgcacacagcagccaatgactgtgcattagaaacaccaaaaactggtctttagtggaaagttgcttcagtctgccaggcatccaaggtactcagtgtgtggaggatggtactgagggacgagaagaggccctgtgcaactccatggagatggtcggctgtctgccagcagcatcttctgtgggttggcctgatttgggttgctcctttattggtccttcctactctctgacaccctcttgggatgttagtcaggggatatcagaagatgcccatccttctccacagaggtgggaaacgaagcagcagcagccagtatgcccagggctctgttctgtgtggagggtcccactgtgaacaaaagacctgcagggacagtttacactcaagggaaagataaagaagtatgcaagtcaatgaggagggacagcttcagagtgggggaaatgtactgtaaagtcccagggaaagagatttcttcaggcaaggcgcaggtggtcaagaaaggtgacttcagttgctaggcccagagcagaggagcagtgatttgagccaggagcagcgggtacagagaaaaggataggtatgcaggggtcatacatgtgaaccctgtgatttggcggcaaggaaggagacaagccggagattaacaagctgtaagactgaatgagccagatcttgagatgcaatatgttcaggcccagtggcagggactttggtgagaaccttagaacccaagcttgtgctgtctttacagataagcaggatcccgagaagtg

SEQ ID NO: 31602 - DNA, 1137 bp, Mus musculus
tggtaggtggaaggatgctgtacttaaaacaacatgagccagttgtctgataaacaaaatctatttctcccaggctaggagttaggaaatgcaagaccaaggtgccggtcgatctggggtctggagagagccccatgtatgtagatggcacctgtttgctgtaatatagaagagacaaagggggtcccacaagggagagggaagacttcctgtaggtagtgattcctgggatagctccaccacctctcctctctgcctgatgccttgtggctcagtgtgtagcttctggtgacagactacaccgattgtctgctcctgcctgtcctatggcctggagtaccagctgccattgatatatctgcccactggagggggattatacattccctttaagcagtgtcaccctggctgcctaccttactgccggccaaagtggcaccttctccctgcccaggctgtgggatgctccagtgcagggcgagggcgacacctagtgggcactaagaatatctacccagctttctcctgggcttggacattggggctcaactagggcccagaggctgctgaactcgcagcaagagagagggtgccaagcagagccacagcaccttggctcaccgagtctgtgccgacagctcctgcgcggagcgggacgagtggcactactgtctgagcagagcccttccggaggattacaagactcaggccctggctgccttccaccacagtgtggaggtgagtgggggccactccagggttcctagggtgggtcctgccatatcctcctcacagagacaagttcctcctgtcctcggggccctggcaacaccctcatcggtcccgcctaccatgcttctgttagagcgtggcaccacagttcaacccaggagcatgccctgcagtctggcaagcagaccaggggacagagtagacttgactccgaattagggagaaaggggctgcacttccccaactgtcccttggcctctctcctgactgtggttgctggctgccgcagatccgggaaaggctggggatcagcctcggtgagaggctccccaccctggtgcctgtcactcatgccatgatgtgcatgaactgcggctgtgacttctccctcaccgtgaggcgcca

SEQ ID NO: 31603 - DNA, 1115 bp, Mus musculus
caggtccctaaaagcttatttctgtagtaataggttttagttttgttgtttctagatttcagttatgaagttagtgactgagttttccagctatcactgttctttggagcttgccattttgggaagggagatgccctctaattgaaaactgatgccccatactttgttccatatgacttatgtctgtgaggtgtcctgtggttgtatggtggtgagacttgcccacattatctttatttcaggagcacttagctacaggtacctcacagctctccttcctgacatttcctgagagtttgttttacttactttttacattgtgatgtcctgcaaggagaagcttcatacacacacacacacagagacacacacacacagacacacacacacacacgtgcatgcacacacacacaagaataggatttggtttacacaccacattttctaacatggctaaatgcagttttaaaactctaacttatctgctctagttggataaaagtctttcttttggaatcatggttgtctgaagtttctctgcatgtcctttgactgtctcctcttttcttttcagaaggcatacattacgcctctttcatttttatttagcagttgatggctgaagctgcttgggaggtaaaaaaaccaacattgacatcaagaattccaggaattcaagagatggtacaggaagtggacaaggcctataaagctgtgacagtgaaataatggtggtagtaaacagaaagataaataaccagtggtggactagagaacctgccattatatgtacacactcagaaggaaacctgagttatgatggcagagatgacattacagatcagtgatgaaaggataggtcgttcagtccacggtgctggaaaattgatgtctgtgcctgactcatcacactcaaaaaactaatgggcacatggattaagagcttacaaagtgaatgataacattatttagcacttatataataaaatatgtaccatggtatttttaaccctagggtaggacagaatgtccttaaaacattaaaatgcagactgccagggctggcaggatggcttggggtaggtgcttcaatctttagagcccttgtaaaggca

SEQ ID NO: 31604 - DNA, 1199 bp, Mus musculus
ttcgtgagacagttagataatgaaggcattgaccagacaaatgggttcatcgcttgatggaattttaaaataatgatgttggtgggaagtggtgaagtgtaggaggtggtggtttgttgcaggagttggtcttgggagtgtgtttttgaggactgtatttctgtggccccttcttttctgtttcttgcttgccaagtgagagcagctctgctctgcctcattgcctctgtgatgactaaaacagtgaaatagaaataatttctccatttatcttacttttctattatctgttaaagcagcacaaaaacatagcatagctactatattccatctctaaggccatgggagtctagactactaactagccttatcacttccagaattgagcatccctacctaccgactcccaagggtgcttgaagctatttacgtaacctaaatttaatactgaatccattgccagtatgcttccccagccaacccaggtagagtcctttggtcttcttttataaataagattgcatttagggtttttgtgtgtgctaggctggcactgtatcattgtgctatatctgtagccctatgcttctgaaataaggaatcatgaatgtgacaagtatatgcctacacaggtaaagaagccagactgcaaagcttaaaaacagcacactcatagcccagctcaggttcaagtataacataggcccaagtagttgctgtagttttgtggtttgaaaattttttcctgggtttctataaaatatttttgaatacacttggttatttaaaagacaaatttgttagtgtaatttatatataaaatttaattgttagtctaatatatatataaatctaaattatattgattgtaaaattcaatgaattatcacagagggaatgtttccatgtgactaccacccaggttgagaatgtaggggatgtggaatgtagctcctttggtagagtgcttgcctaatttatacaaagcacccatctgtaatcccaggacgtgggaggtagaagcaggaagatcagacattcaaaaattatccttggctacatactgtgcttgaagctagcctggcatacatgatatcctgtcacctaagacagaaagggagggatggctggtcgaagaatgagagaggaagaagagaatttcctaaattccagaaatttagacatttctatttttcatt

SEQ ID NO: 31605 - DNA, 1112 bp, Mus musculus
tgcttcccatagctctggcatgtctcattctgtcttttgatccacttaaggttgctgagagtcacttcaggacacaactgatcctaagggttagactttattcattagctgtctatagctcaaaataaaggcctttttttttttttttttttttttttttacaatatagaagaaaataccagatgccacaaactaacttgttcattctttttaacacactgtgttgaactggttttaaagagaactgaaataaggagccagaaatccaaaatgtattacacaaaagctggagttgagggtctctggacaattctttgagtatcagttaaactttgggaagaatggccacagttagtatagaaggcctagggttaggcatctgtgttctgtgctccctcagcctgatgcctagctttgtaacgagctcatgagcgagagcagacaagtggccactcaccctgggctgaatgttacagcttttctcttgtagactgcctggcatatatggaagccaactgaatgtagcatgaacataatgtgcagaaaatgttagatactactctgggtttctttgtgtcttaaatagacaaacaggtcttcttgatccagggatgcttgtgaacatccaacagcctttgatacgtgaggatggtacagttctcctggccgcggattccaaggtaacactctctcctgtgttgcagtgcaggctgcttttccaactatacctgctctcttggccatcagacatgatgctgaaagcatagcctcctgtagctacattaatttctcatgataatagtcatcctaggacttgttctaaagatgcttgtggttttcagatactccactcagggctgaatggcaatagtcactatcacatggcagctttgtggacattcaatggttcttcacatggcatctttgtagacattctatggttctgttccctattaatgtaatccccttattctacatattggcaggctcccattatgctgggaaggtagctattttttctaaagcagccttttgtaaaagctccagttctttcccattagataatttgtaataggctaacaaatgagccataaataacgaacttatagact

SEQ ID NO: 31606 - DNA, 1766 bp, Mus musculus
acacctcatttctctaatgcctgctctctcttccagattggccaggattcttgtccgcctaccagcactcaggctcatgagctccaacataacagaagaacttttttttactggtctcattggcaatgtttcaatagacagcataattccttacatcctcaagatggagacagcagaatataatggccagatcactggagccagtctatagtgcacaaccaacagctgccaacagtgggatgcctcctagaactgtgcaggtgcaagggaagggaagtgtagcagtgtcttggtgtgcacaggtgtctccagtgtgtcagccacttcttcctgttcatcccagacaatagcaactaaagatgaactcttccctgccctaagaaatgttttaacaccttttggtgatgcagattttggaacaatcttttaattcaatttgtattttaaaattctcaaagggcaaaaaacaatactgaagttttataatgtcagagactagtattaaaagaacctaagaacagtatgtgtaaatacattaaaaaaaaaaagtccttggaattaatagctactaattaccagggtaatgttagcactttctaagcacttcttatcaaatctgcaatgttaacatcttacctgtggacagggcaaatggaaaactgtgtctcttttgtcaaaatgctaatgatttctgtgaaaattcactagggtacaggagacaatcgttcacatttgtaagagggcagcacttctagctgtgtgcagtggtggtgctacgctaaattcctgtgagtaaaatgtggattcctggcattgtgtgcaggggatataacttgcagtgacccaataagagctgctatgccagcagagatagcctgtcagggtccttaccctcatggttggtcccaatccctgatgcctttctgcagactcttccagaacatgggctccactaattttcagaattagattgcagcttgtcagaatgcctgtgataagggtcctgtaattcttccagtgactgaaagtacacctggatccctctaccaacttgtaggaactggagcctttgaccagagtgcaaggtggttgactgcaccctttgacatgacctgttgtccaggttgagtgtggcttctgcagtgagagttcctattcctggtgcatgtggagaggggccagtatctgatcattcagaacctgcagctgggtgggggttgtgtatcctcgctgtctggtgagggactggccttagattgtgaaacaaaaggcatcaagagaaatactttctgatcttttaagtattagtgattttagtgtactgggacacgatgttcttcagttctcccaggtatgtgctagtccaacaaagctctctggggcatttgagataacaaaagtagatcatcttctctctgaaagagaatccaaaaataatcctcagtcagggcacatagtgcaggcctgtaaccccagcacttgggaggctgaggcacaagaattatactttgaaggccaatctgcgcaacttaatgaggaaactcctgagttttaaaggagtttaagggagtggggtagggtggtgacttaagtggtaatgtgcttgcctagcatgcacaaggtcttgggttccatccccagtaccaaaagaaaaaagaaaaaccttcattcacaaattcccttacgttataatgactatagtttccaacaagaaagaatacagaattcagttccaaggaagttagatctgacttaaagctctttgc

SEQ ID NO: 31607 - DNA, 2963 bp, Mus musculus
aattcccagctagatttggaagccagtgttggagaacagcagggattgccagtataaaatgatggaaaggacataattttgccagcttaaagctttttttttttttatgtatgtattcaaaattaagacaaaagctctggacaccagtatagttcgagtctattttaatctctgtagagattcctgtagtacattaatcagtacaccttacagtgctggctttgcttcccttagggttttagaatgtgagccactcagacagggcctggacagcctggctcccatttggtatttagaccacatagttggataagaagtaccagcctctaagatgacactgaagggggaaaaatttttttttttttaatatagaaaagagttggtgattctaactctggtcctttgtaagttccgtcattagtaatggccaattgacagggccactttgggccaaactccttcactggttgtccagatcgttgtggccttacctttaacaattgtatccatacaatgttctcattaactgaaatcatttcaaactttgaatgatgctccattccatggcttgtcgaatgacctatgaaggtcagccccagttgcttctgggcttcagctttcagggctttccacccttgatttatgagtctgtgatactccaagccttatgaagcagggctgacctgtctagacacccctctcagggaggtggacagacacactgacctggctacttttgcagataggctagggtggagagatacacaccaaccctggctaactaggctcttttccagaaaggtcttaaatgttgatagttccatgttaaaatttgggataaaatatgacaggagatgtagacagagaccaaattccttaagcaagtcatcctagttactcctcaaatgttacaatgtgtcgctgtccttccagtttgcagtgtgtgttgaagaggctcttcactgcctcttctctttctgaggctgcagttggggttgtggtgtcttgagtttctataatgaaattcaagtgagtcacttatgcccttggaatggttttctagtttgtcagtgtcagtattagatgtggatggtgttctgaggtagtcatggcatcaatcagggtggtcagtatggctttcaaatggagcagcagcatccacactatataaaattgttttgaagggtagtactgctcatgcagttctctggtcagtatccctaagagctggacctattgtctgggacctgatgtcatgggggtctggaagactgttgctgctttccagtggctgggtgcagcggggctgttggtgctgctgaaattctagatccaggccttgaaaagcatcacttgacagctgcttttttttcccagggggaaggtcctggtaagacagatgcccacctctttcctttgcctatctccaattacggagaaccaatctccagattacggttctttgcaaaaagtcttaactcttatgtcaatttctaaagacaactccaaaatgagatgaggttgacctaggtgttttgtacaaggttctggacctcctcattgagtgcctcccatcagtgtgtactttctgtgcacaacctgtcccttcagccacactgtgcatgtccagagttacaggcctagatgactgaatgaatgtacatgtgttcatattatcttctttgtacagtgtatataatgtgtgtacataggtgtacattatgtatacagacatgtagccacatattcaaacttctatgttgtcaagagttgatgctagcgttgctaatgtgaatagatattggggttgcaaggttcccttaacaggaacgttgtgcaggtgagtttcttaccaacttcattttccttagacagggagctgcctgggccaggtggcactaattcctgcacaaggaagcctcgagccagaaaagtccagataggagggcagttctctaaatttacaagggcccagaagctgcaagagatgttagcctaatatcctaaactaaggataaacttccttttcacaaaccagtttagcataactggaaggagcttggtgactgagacccttggtcttcttcaaaggctccaaagctggagcttcgtgtggctcagacatgggcatttgggatccaggggctgcagcagtctcccttgtttaccctgggctctgtcagcaagacatgggggctctctggtggtaaaaacaaaataccagtctaccaaacattctatgaaaacagtgcagatagctaaaaactgcaatcagtaaattatcctaacttagctacattctgtagaagttgtatttaatagtacgaaagctaaggctgacattttcctcatctagcgggtctttgctgatattcgtcccctatgattgggatttttgggctgagatgtggacttgggagacagggcccagcttggcagagactgctcgtggccacagtgagcaggcatctggcttggatgaagccaagtgcaaaaatttgcctgacccacaggttgctctttgtgtttttgaagtaaattactggagtgttttaagaaataattgttaagactatagtcctcagtgcctttggtgagacgtgggtcttttggcttcagcttcccactcgtgtccctggcctcaccctttgtggttgttcaatcttgcctgtgtcattgcctgttgtgacaatcacactattaaaagtggctttccaagtaaaacacagggaagcttggtagtccctaaatgaatccttccattttctctttgggggctattgtcttagcagcaacctaacagtaaacttaaaagtggcttaggaaggggaaaccatcagacatttctaatgctcagcaatatgcacttttagttaattttcaatattgatatttatacatggaatgtaggaaaatgctcaatattaccactcttaagttttagtgtttgggtaacatttggt

SEQ ID NO: 31608 - DNA, 1942 bp, Mus musculus
gatatgagctgaagtcaccaaatctcttttccacttccttgctgtgacagtgagcaagggttacccctgccttgacatgcatgtagctaaagggaagatcagactcagttcccaggttcttttctgctcctttaatgaggaaggataggaaggcgggaagccaagacacaggctccttcacccctcctatccatctagcccctagccccctagctcccatccccatgggatgctccagtggtctgcttcccagtacctttcccctcacatggaagagactgcccctgtctggagcccctggtcatgttttgctactctgtgtgttccttggcagggagaccctcagggaggaggagctggaaaagcagcagcgctttcatccaggcaactttggcccccggaagtactgcctgcgggagtgcatgtgcgaagtagaaggccaggtgccctgccctggcttggtgcccttacccaaggagatgacagggaagtacaaagctgctctgaaagccagtacttaggtctaagcaaggccatctgggatggactggtggcatttgactggtggagatggattacattggtaccataaatgatggaactctgcaatggaaaggccagcttgcacatctgtttaaaggacatgggatgaaggccagggttgccagctgctgaacagatgtcaataaaagatttagtcttcctatacatagtaagtgtggccttgctggtctaaagaccatcagcatcagagagtttgggatgaggaggtgcaaggcagtcagtgattgtctcagtcctggaactggccctgctgctttcacttaatctccctccagtttctactctggaagctgttgagggctgttgttattggtgagccaaatgtagctgggagagtccatgttcttacttagcagtccaaagcaaacatgtgggcagtgtactaaagcctgcaattcttgcttcctgagagaggggagattctccagccccagttagtaacgagaccttgggcagtaggatcatttcaggcctggcctttcagttcagcagatgtgagctgaagtcaccaaatctcttgtccacttccttgccatcaagtccatgtggtggaggagtgccagtggcattgtgttaaccgtaagcatggatttttctggctttgagaatgaagatgccacctgggtggtaatttgactctcaattcttgcttactaggtgagagacagacaagacacacacactcccggatgcctttctaggtatattttccagttatcagtgccattttagctatgtagactccattcttcagtggacaacagaatcttccagggtcacctaatgtttaccacagacttcttggcatttggccatataggtatgagtttatgaggcaaaataaagcagtggttgttaaaaatgcccaagactctttagatgcaacaaaacagggcaactgccctcctcccccccgcccccccacatacccagttcactcccattctcctggcccctggtgcaggggtctcagggaggcagtgcaactagaatccttctatctgcaatatagtgcctttccattgtctactctggttctggtttgtgattttgcagcagaccaggtaggggctgcaatggaatgcttgtagctctgatgtgtaagggataagagtgcttcaatagaatttggtacagccccccacaggtcattcttttgagtttttgttcccatggtgtcttaatggctggtatcagggaatagactgcttccctccatggcagatacggccagggcccaaatcctaagcatggaccttgaaaaaaagaataaagttcaggtcccaaggggacaaattcttgagcttcactttggtcctgacccttgtttctgccaaagctgtggcaaggctacagggcaacatgtgggcaactgata

SEQ ID NO: 31609 - DNA, 2895 bp, Mus musculus
tgtgcactttgagacatttccactacagttgagcaagaacgggaaaaacaatcggcattcatgtgctggtttttctgtattctttttttaatgaagtattccattttcaggggactttaccattttattttcaagatacagctctgttgggccaaggcagaaatggctcatgggcacctcttagttcattttctgcggactgttgttggtcattatgcagtattatagggcagcccttgacaggcccttcctgtagccaggataggcagggctctagcagaagtctgtcctgacttggttgttccctttcagcacgtcacttagggagatactgctgtgaagcccagtgggaccagggcctctttatggatggcaggaatgttgccagtgttgtcccctcccagttaaaggaagtaaaattcccaagtgtgagggtagtgggctggtggtgtcagtgtgagcttgactgtgagatagtagtgttcaactttttggcggatgttatggtttggagaagtttctacttatgcagctgtctgatcccctgggaacctccttccaggtctttggtagaatgaccgttctgcaggtcacattcaagggcctgttgatttggaattgtgactgggaagcttctgtggagtattagcaggtgatggaacacttctgagtcaggatgattctagtaacttcaaggccctccagtcagccctcttccttgtggtttatcctgacctgggaaactggtaagatgtactgagaaatggaaatatttgaggcacagcctgagaccattccacagccctgaagtacttgaactcttgatagaaaacagaaagggaagttatgtagcttagtactttggtttacaggaacagatcgattgacagatgaccttgtaaggttcttggtgtgctcagctctgggtaatttctttggtgatgatactctttagttaatggacaataactgtccactagtcactttcccctcagctttctctgggccatgccttttgttggttactggtgtataagctgaaagtcttctgtcacattctggtgaagatccatctaggtggtaagaatgttatctgggtgcaaagatctctatgttggcagctttaatcccagttcattagtacatgttggggctttggctggatagagagccctgtatggggctatgggaagggctggagaaggagggagcgtatgaaccctttgagttctgctgacaggtgtttactggcctgctagtagattaccagccatttgccagctctgttggtgtcaagatgttctggaaggtaggcagcctggcattttatgttacctggggcaggctacctctttctaaagcccaggctccaggcatgcccaccatatctgccctgcttggtctgctattgtgtcatggacaaagaggcagtgctaacacaagaatgaagctaaattctggtttccaccattacttttccagactcaaatcaggtgttcagggtggtacaactgtagacaatgcttttcttataagactgggcttcttaattagctgtgagtgactcgatgggcagtagtggcacatgacttttatcccagcacttgggaagtagaggcaggaatttctgagttccaatccagcctggtctacagagtgagttccaggacagccagggctacacagagaaaccctgtctcaaaaaacaaacaaataaataaataaacaaaaataaaaattgagaaaaaaattatctagtgacttattaaatgtacttctttctggaactcaccccaggtagcagtctgactgagagcatggagaaaacaaatgcttttagactgactgactattaaaccgggtgaacccagatcccagagggtttcctgagtttctcattgaattcctcgctgaccatattctgaaagtccaacagaacacgagagacttgtctgccccttgtctggatcagctcccagaatgcatgcaggtcagagttggtttgcagagggggtttggcctgtgagggaaccacagtgccagcttcttaccgtgggtgaatactcgatgattcccaaggatggagcacgtccttgatacggtgttggcagatcccttaggtgtaggtcctgttcatagtggacaggcttcttgcttattcccttctaacaacactaaggaactggagcctcatcactgcacttaccacatatcatgtctttgtcgtcagacagtaaaacatctttctaagtcatcatgagccatattgtgtagctatgccatgcggttcaaattgtggaattggcctcggtacgaggtcagactagaggagctcggtgtgctggtaatcatgatgactgtcagcaagatggtcattgatgcgcatgcactacactggggccttgtattagaggcttttattaaaaacattaaaatatcatttatgtaaggcttttattaaaaaaataacatgttcatggctggacttgtgtgtgcttaaaacgtcccttcacttcctttttgtaatgtgtgtgtgaatgtttgcatgtgcacatggaggggtgtgtgtgtgtgtgagtgagtgaatgtttgcatgtgcacgtggagaccagaggacaaccttgggtattagtcttaggaaacccatccgccttttaggcagggtttctcatcctgaagctttccagttaggctagactggctggtcatcgactctacagtcctatccccaccagaaactgaagctcggaggggtgagggagcctggggctggcatttgcaccaggcactggtacatttcacactttacctcagctctgccaacaggtctgtgttgtgttgtttgacaaagaacagattggatacttacaactcatttgccatcagtatttaggt

SEQ ID NO: 31610 - DNA, 1471 bp, Mus musculus
aagccgaagagaggggagatttgggagaagtgggagcctggagaccccacaaacgacagcaccctggccgacgtgccaaccaagacaaggattcatggtcagatgagggggacagtgactggctgcccccgtcctggctaccagatttctttctggattcctggttctcagatgccccccaagtcaagcggcagcaccctggcaggcgatccttcccctggatggagtctgatgtcaccaagaggcagcatccaggccggaggttcatagatcctgagctccaaagaagctgggaagaaacagagggagaggagggtggcttaatgcctgagaaacgtcagcatcctggcaaaagggcagtgggtcacccttgtgggccccaggggatttgtggccaaacaggcctgctccagcttctaggtgacctgagtaggggccaggagaccctggcaaagcaaaccccacaactggaagcctgggtcagggaacctctggaggagtaaggttagagtcaggctttaggtctaggctgatgtaagccctgtgtatcctatcccagtcccttcactggttttcttcttagatgctaaccctgggccctctgtacatagcatccacccaaacccctcccttacccacttcaggaacttcaaagagccaatcaggaagttaaaaccctacttatcccttcaagcaaggaggtgggggcccctcttctctgacagccccacagtctctcaccccttccacactggccaagacggttcttccacgcctcctaagggacctcctcagaaagggtaggattgaaaagtttgggtgttaaaatccaacttctgtcatctgccccatatggcaagactgacctggtataacttcagcgcatcctccaaggttgggggccctaagcagtttgggggatattcagatatgttggggggggtcacatcttgtatataaccctgctcttgttaatctcaatgacaataaaatatatccaggtcatttgttgctttgctcttctgtatagattaaggtttttctttggttttttgggtttttttttgggggggggtgtctccagccacaagctctgcccagagggcataaaggggctccctcttaactgagaaaatcaggaccctcttgcctgttaccattctcagaacacaatgttactgtgaccaagggtctggctctgcagtctttgattgtctgggtgtggtgggtagagattaagagctagagaagacggctgtagatccttgagtctgccagatttgggggtggggaggagtgtgcaggaggggtggtcctgtgatagtaccatgaaccaggcaaaggatcaggatacagtcaagatactaaaactaggaggcttctggagtgtgtcctgggaagcaagcttaagagaggacaaactgacaggagtcacctgatcactgtcctgaacacgttcacctgttatacc

SEQ ID NO: 31611 - DNA, 1633 bp, Mus musculus
gcatagcaggaaaagacagaagagcaaaaactgtatcatttcgtaatgtgatagtggtcggggaatcggggagatgggagctaagaatgtaaactcagaaacgtgcactgttgtgaattctcaagtgctcttggggatggttcgtggaggagagatggagaatgctctcaagtcgagggaggcaaggctgcaggttggcttggtagatacacttggtgtcaccgtttgggacatgttaaatatgatttgcacatttcactttggaaacacaggctgtggaggccagggtaggtcatgtccttccaaggtggagtggccattaaccagatgacacactgtaacctgctcacttatcttctttctggttctcttccttttaggaccccttttccagtaaatactttattagccaggaccccagactaagttatttacatgttcattgtaaatgcgatgtaaatgagagttctgataaaatatttttgtattttgtaataacaacagaatttctatatcgtaggattccgtggggacttgcatgcatggccaccaatccctttgagtggtagtaaacggtggcccaggaccacctggcttttgtttgtttcaacttggtttggttgtctttctatacaaatctgttacatgtcagtgagactattttcaaaggagtatattcaatttggctttttgtggctgaaaaagaaaattttaactattctacccaaggcgttctatgctctagggcatctaacggtccatctttaagtccactcccaccctccatagaatttattctctacaaagtaagtagatttttatttaaattgcaaatatcgcttttgctgattagagataacagccagtgtcagtccagttctgtgagaaatgccatccttgtttggaaccttgaagttgcttaatgtcgctctgtccctcggggggagtcacagtgactgtgagcggtgccagtgtgtgtgtcagcatggcgttgttttgagtgtggagttgtctggtgctcatgtttcctggattgtattttctgctttcttcttccaaggcagacgaagctgctgcctttagcctgacaactgtttgtcctcacagcaaatgagcttcagcatttagcactgagggacaagaagatagtgggggggagtggctctggatgcactggcatggtgcagactacacaaggagatttgaaaacagaaagcagatagatgttgaaaggtgtgagggaatatgaatggagtcagggagaaagaatttgtagaaagaaagaggtgacagccaccttgactagtccccagtgctttagagagaatccaatatgacaagcttagtcaccacaggggctggcttcttaccctggagggtcaagctgctgagatgataggaaacaacgtagaaaaacagaccttgtggcaagagagatttccattttgaactttgaggactgttggtcaaacgggaaggctcaagagtgagtttgcttcaagaagacatttcactgcaggcgagataaatacacagtgaaatagaacttcttgccttgcttcagctttttttttttttaaaaaaaaaaaaaaaaaagtgaagcgcctgctcttggtccattttctccctctcc

SEQ ID NO: 31612 - DNA, 1105 bp, Mus musculus
ttcaccacctgtgaaatcaaaagcccacgtcaccctctgtactgagggtaggagtgacagagtgtatgttccaacacagtttgtcggggtgctgtgctgccttgtggtcgtggtctcctccctgtgatctagaaggcatctgcttgaggaattgctcctacaacagaaaacagagaaggcttcgtggattcttgacaggtgtggcctccctgtgtctctcttggggcctcgctgtttatcccaacagcataaacctgagaagccttggaggatagaaatctctttagccttggctttgcatgttgtaggctaggatggcccttgccccatttgccagtctcctcttcccaactgcagagctcactgaagaggaagctgcctaccaagctaagtggcattgtgacaggccatatcgttgagcctcagtttccttgtctgtagtggaaaacaatagtgactttggagaggctaaaatgagttgaggaacagagagatgggcctctgcctgagagctgtgcctgagcagatgcatcactccttcctgcctctctgtagatgtcagagccccacagttgctttacctccttttaatccagtgtatctgctcctcctgcccctcttcaagtccttcagaagttggactgccctgcccttttccttctgaaaagatgtgactattctgtttctaatgccctgtcactgatgtcatttcctctgtggcttcatgttgtcatacagtaatatccagcaggtccatatatcttcagcctggatcttgctctcctgagctccagatttgtcccattgtctcaaaatattagcaggggactctctctggtactcctatggatgccaagatcagtgtttctcttagagtgctgtgtttgcataaagcctacatgcatccacctagaggagtggttctcaaccttcctcatgctgcaaccctttaatacagttcctcatgtcgagaagaccctcaaccataagattatgttcattaatacttcataactataattttgtgactgtttatgaattatggtatgactatccaataggcagggtatctgatatgtgacccccaaaggagtgaccaataggc

SEQ ID NO: 31613 - DNA, 1201 bp, Mus musculus
tagcttagtgttcttgtgagagtcctaacagtggaggagggagctgtttctgacttttgactgcttacggaacccttttcctcctaccaggttgccttatccagccttgatgtgatggtctctgtctggtctcactgtaccttgtcatactatgttcggttgatgtctctgagaggccttctctgttccgagaagaggtagaggggtaggggtggatctggggaagaaggaaggtgaaggggagagactggagagagaagaataaaaaggaaaaaagggagggaggcagggaggcagggaggcagggaggcagggagggagggagggagggaaggagggaaggagggagggagggagggagggagggagggagggagggagggagggagggagggagggagggagggagggagggagggagggagggagagagggaaaaaatgtgcttagcagtaccttggtagagagggacaatagaaacactggtggtgatactggtggccctgatcttgtagttagttgtctgtcactttaagatgcattgctgaaaaatccagtagcccactgttttaggaagctgggtttatggattaaaaggccaaacaaacagacaggcccttgttaactgtctctgaggttggtcacaataggtccttctagtcaaggtgactttgacatagttgtcccagaacttctgtaggccacatgggccgtcctgtgggaaatgtcatttacagcgagaccacttcttgcaaggagatgtaactagacagctcttacaaatgctactccaggtctctagttgaaactctgtgtttagccctggagtcttttttgctttgtctctggaacactcacctttctgcagcttggtagagcccaggcactgtgtgtgtgctgccctcaattccccaatacagaaggatttgaatacctaactctgctacagggggacctttactgagccattcacttagctaccaagttcttctgaactgggtttgccccctgtcctatgacagctccctgggcatcctgcatggtgggcctgtgagcatggcagagccatcctgtgacctcgtctccatgtatcttaggcagatgaaggctagtgtggaggttttgatggatctctactttttcttctaattgcaagctattgttggaggaggtagtcctcatgagggctctctagggacta

SEQ ID NO: 31614 - DNA, 1219 bp, Mus musculus
ccaccatctaggtaaagaggagccttttcatcctacaagagtcccctttgacaaccagtttagacccaaaagttctaagtggcctgacttttctctggaagacagcaccttctctctttagctgtgtaggtttcctgtgggatatgacttgggactcacataggcgacatggagaaataccaaaacgtcctctaaacatttctagatctgtccttcttagagaatcctgtgattagccaaggaactattgatcaatcccctgcccccctttctcatatctctctttctctctctccgtgtgtgtgtgtgtgtgtgtgtgtgtgtgtgtgtgtgtgtgtgtgtgtgtggtgtactacaaaggacaggactacttaagaaaaacaacaattgaacattggccactcagttcttaaaattcacaggtggcaaaaggccttagctgttttgtgagtttccccacggcaaccaggtactgggaacatgtttgggattaagatgtattcttcctctcagaggacagttatgctaggttcctgtctgcaaacataacagagtatcattagtcgtgtcagggactggttcttgtcagtggataagtctcaatttggatcagtcattggctggccatttcctcagtctctgttctatcattgtctctgcacatcttgtagacaggacacattttgggtcgaaggttttgaaggtgggttggtgtccttatccctccactggaagtcctgccctgctataggaagtggccacttcaggatccatatcccccactgctaggagtctcagctagagttgcccccatataccctatggggcctcccccacatcccaggtctctgtcgtgtcctagagatgccccaacccccacaggccaatcacccttctctttcccttgctctcctaacacatgatcttctgcctctgccctgttcccctcaccatcccctcttccacccagttctctccttcaatcaactgccagtatctattttgtttccccttgtaagaaagatccaaccatccttccttgagccctccttgttacttggcttctttgggtctgttaattatggcatggttatcctgcactttatggctaatatccacttataggtgaggacataccatgcatgtctttttgggtctgggttaccccactcagcatattttctagttccttctatttgcttgcaaaattcatgatgcc

SEQ ID NO: 31615 - DNA, 1357 bp, Mus musculus
tagatgagccccatcccaaaaagatctcatcttaaatatgaaaatatcgccaagtcttcaaaatgtctgaaatacacactgatggtctcaagcatttcaatgagggatactcaacctgcggaacaccctaatgatgtaaagtttaatatttatgtttgaaattatttattgtgatgtaatatttttgtacgtaaaatgattttattatgactgcctgtgcatgatcctcccccttgcagtcagacagctgcattttacgtactctacattatatgtagtatatgacaaagtgactcttcgttatcacggtacactgttgtttactttttacctggaaatgtgttttactgttacattttgaaaatttttgtaattatttttttaacaacctagctgacatcaaggtgctatgtgggttgaataagggtatttttggcaattgtggggacgtttcattagccaatgagtaagttagcaacatcacaggttgtaccaactgttcatcatagtctttattccgtttcatgtgatctctgggaagaattgtgctgccttggtgctaatattatatgtttttaaagtaattgtcagagtcaaaactgtaaacacttaacaaaagggagcaagaaatagattatccccaatggataaaatcacttgctagagtaagacctactatttactcttctttttagacctgtctttttttttttaatagtagctggactcttgtcttactgttgttgttggtaatatgatctactctgctccatggtgccttggactcctgtcaatcattgggagggtccaccaaaagcttcattacagagtgacactgggaaaggaggctctcctgctgttttgtcacgatatcctccaagtttatgagcagcaacacaaaggatctaccacaggtgtatggccttaacacccctcagcatactcagagaacgacaggagatcgaccaccttttacctgaaaactttggccaatgatatgacttcccttgaggctgggagcctaataccctgccgggtttcctgtggtcttcagcgtttgtgtgaaaaaacaaactggtgtctaagatgcccaggtctttctgatcttccacgaatccaccttttgttacttctttcaggaatgaacgtgctgaggcagtggtcacaagacattttacttgagaaagcctgaccaagctttccaagaccaaagagattaggaaaaccctgacagtattccccaactccacagaaatgccagagcacttggtgtttgaacaagtgtcatttttctattgttaatacatgtgaaacatattataaataaatattgtgaccacatccaaaccatagatgc

SEQ ID NO: 31616 - DNA, 1223 bp, Mus musculus
caatcaacaggaaatctatacccaccaatagactagtcattttggaaatacaggagattttttgttttattattattattcagtgtaataatcagtgacccaatatctttcaaggtacctggagtctcttccctgcccctagacagaaagtccatctgaaaccagtttttaactttgctcctagccagtagttgacatggtgaggcaggtttgccactgtaaatgctatacaaacttctggggcagttctaagcaaacaggaggattaaccatgtcaacacaataccttgggtaagcggtggcataaattatggatcaggtaggtctgatgtgtctaagtacagtaaatattctataagcacattaattgcagtgaagctgaaatcagccattctataaagctatttccagaagccctttttattcagtggggtcctgggaaactcctactcattcctagtgccagataaagagcagattaactgaagtagggtgagtggcactcattgatgcttctacaagtcaggggtttcagcatctgtggctgcatctgcagggattgcttataacctagttgcaaggctctgtgttcaactgagctagaagtggaagcaagagctagactgtgctccttagctgggctgtgggattttattccggagtttaagaaaagttacaatgtcccatgtatgattctctaaggatattttgtttacaacactggaaccttttccaggtgtatgcttgacagagcttgagataaacttaagacaggcagatgtcctttgaaagccccaacttctctgtcactgccacatactactgttcatgacatgttacttctcgagcccgtggcatgctcgcttagccagagctaactgttccaagtccattcacactctcaaaggtagtatgtcactagttctaacgtcactggttaggcccctgtgagaaccttacaagcctccttattacatagtcttgtggtttgatgaagaaaataaatctgtgttttccttctctaggttttaatccttagattatcccatatttttctaaaataaattgtttaggaaagtggaaaaatatattcatagtgagttataaaatataacgttggggatatattttcttgtatataagtatatatgtatatgtatacatatacatatatatgtatgaatatacacatatatgtgtgtgtgtgtctgtgtgtatgtaca

SEQ ID NO: 31617 - DNA, 1119 bp, Mus musculus
tgaattaggcataatatatcatatctgtcctttgagagcctctaattagctgtcaatattcctgtcctaccagatggcatgaaaagaaggaacaaaaatgaggtgggaatgactagtggtgacattcagaaacctgagtggtggctgtggccaaaggagagactttcattcccaacgtgtgttctacgagaatgttctatgatgacgtgtgtaaatccacactgtccaatacagaagccagggacctacagtagctattgaatgggactgaccagtgtaatgagtaatggattacatttcatctaatttaaatgttaaatattatctgccacatgtaacgcctgtattaaatatacagctcaggaaagacatattccaaaaccattcattctttctgtatgtgtgtgtatgtgttcctgcatgtgtgtttacatgtgtgtggagggcgcaggttcacatcaagtgcctgcatcattcagtctccatcttggttttttgagacagggcctctcactgagctttgagttcattaatttggctaatctggcttgtcagagggctccaagtgtttctgcctcccttccatctccccaggaagatgtgtgtgtgtggctttgtgcaaacataagtataagtgtctgtagagttcagaagaaggtgtgggatcccccggagatggaaagttgtgatctctctgacatgggcgttaggaactctgatcctctgcatgagaattataggatcctaagcaccaaatcacgtctccatctctgtaaacgattttaaaacaagctgagtgaggttagtgagaaacttaaggagcaggagataattagttggatgatgttgttttaatcccgtgtctgggtgatccaagcaaacacatttctgccgtttgaggaatgctgccaacactaaccttcctcccctttgaggaaacatggcaaatatactttagtatcatcctgtgtagatggttgctttaatgcccttttctgatcttatccccgaactcatgattaatggatttctgctatgatcccagttgcaaagaaaattattgtctgtcacctgagtgttctctcagccctaactcaataacatggcttcttaataata

SEQ ID NO: 31618 - DNA, 1164 bp, Mus musculus
atctgtgcccagtttcctctcagcctttcagacatggaggctgtgtctagtgtggaaacaccttccctcgcctacaacagagaaaaagagcctattcctgctctcaagaaatggatggctatataggataatcctaaagaagaaagctgtcctggggtaggagacaggaaactagcctgagagtagaaagagcaagccactgtcaggatgtaaaacctagttgtgaactttaaaagggagggtattttacacatgtataagagtctgagagtgggccagtggaattgttgaaattagttttacttgactgaagaagaggaaagggacatgggggctcagacaattaacgaggcccctcctgcagggcctgttagctgtacaatggacttggggctttatctgaagagctacaggaagccattgaagagattgagccagagagtgatatgattagactttgcacttaacaagcagtggggctaaagacagaaaggatcaggtaactcacgtagaggctgatgcaattgtttaggtgggccatggtcctgactggaagtgtgggcagttggggtgggacagcagacagattgcagagctagcaatcaagtagaattagtaacacttgaaggttaattgggtagaaggactgaaggaacacaaatgcagaggatttcctgtgtagggaggagctggtgatgtcagacaccaagacttgggctgatgggataaagcacagatgtatgttcttattttttctccctttaactattgggattataatgtaattgcatcaattcctcctttcctctatcaagatcctcccatataccccttcatgctctcttgcaaattcttagcctcatttttcattatttgttgttatatacatatatatgtatggaactatatatatatgtatatacataaacatataatcctcaatatgtttactcctcaatacaacctgctcagtttgtatgatgttccttgtatgtatattttcagagataactatttggtattggttaaccaattgtgttctcttcccaggagaaacctatgtctcccactctcagcattccttagttgactatagttctttttgtagggttgggacctcatgggctccccgggccccaatccacttgggtatgtctattgggg

SEQ ID NO: 31619 - DNA, 1149 bp, Mus musculus
gtttctgtttttctggtactctcccaaaacaggagatactcttgttgcatagatgcagtcagtggtttcttgcagtcagtggtttcttggatttggggagttaaaagtcatgtgacacaggcctattgacacatcgatgtgaggagtttaaggtaatgctgctgtgattgagaagaatcgccccagtaaagctttagcatgaagccaagcagcttataatgacacaggattctcaatgaatgaagttttaagggataaaatctttacaatgaaataaaaacaatcttaagaaaacgattaggctctagtaaaaataagctgtgttttaagagtggtttctatattcagcgttattatccttcacttatactcagataaatatgttatgctcaagctggctcatagtcttcagaaataagaatggacattatactttgatgtaatatcaacatgttgcatatacaaagtaaacacttttggtgataaaaaatattgactataaatgtcaacaaacttattttgtctttcagtttaaaaaaaattaattgtattttgtgtacatgggtatttgcctcaatgtgtgtgtgtgtgagagggtgtcagaagacctggcgttatagacagttgtgagttgccattggggactgtgagttgaaaccaggtcttctggaagagcaaccaagtgtccttagccactgagccatctatcgagctcaaattttctctttcttaatagcaccatctatgtttaattaaaaaactaaagatgtttttgaactatgtaaagatatgatgaattataacagtgagagtttagagtttccccttccctctagtctccctccacctttataattgcttctgagaagtcataatgctccttgctttccatatcataaacaccaaactcatagaggataacagggatggggaatgcttagttggcaaagtatttgtagcataagcatgaggccctgagttcgattcccagaacctacctaaaaaatgtcaagaatggtggtggcatgtatttgtaatcccagtgttgaattgggacagacagctggctcttagggctttgctggccatccagtctcatttattaggtgcatcaatggtccaagagtcatgtctcaaatcaaggtggtt

SEQ ID NO: 31620 - DNA, 1131 bp, Mus musculus
tttcccacaaacattagtggggcctaacatctgaagttactattaggtttagagtgggtcttctttagcatctaacacacaatgtactagaggctttgtactctccctaattgcttctctctacctatggagcaagttcttactgaaggggcattacttttaaaaagtctttaggatctccttggggctttaagtccctgatagactggatgtggtcttcaatacaatgtataaactcctgaaagtagggtgcttttctcattcattccttagaagttacatctcccctaagagtgtgacttctctttgaaagataaggaaattaaaatccaggaaagctagccagtcatccacaaaggaatagataaatgaagaacatctggaattcttccactgattcagaatcttaatgttccaccagggtctcaggcagcttgtgcctctacagtctcaaggtctcgaaaatagtggtatgtactgtgatagctattcttgtttgtcaacttgactacaactggaattaactcagacttccaagtggggaacacctgtttttgaagtgggaagatccacttctaatcttgatctttgaggtgggaagaattacctttaatccagatctttcgaggtgggaagatccacctctaaccacatggaagaaagaagcttttgcgctttgcctgcttgctcttgcctcagtagcaagttcattccttcataggcattagagtctgcttcttcaggattccagcatacacggaagagcagctgaagcattcagcctcgtgcactgagagcaactcctggattcttagaccattccttcaaggcagcccttgttggactcgctggagcacagcctggaagctggtctaagaaatcccatttctatacatagtgagattcattcagtaagttgttattcttagagaaccttgatcaatacaaagacctataagcatgatgggaaataggaggagaggtaggaacaggggacagaggggagtggagagttggtgggggggaggtggaggggaagactagacagaaagaggcagagaaagaaagaagaagggtttagattcacctctgctctattattcctctggcttgggaagtcactgttactgt

SEQ ID NO: 31621 - DNA, 1215 bp, Mus musculus
ctaagagactataacagcagactaacaaggcaatgctaatcactaaagataccccccgaattcttagtctaggtgtataactggactgctaatgttgatcttaggcatcaaatccccattgcttggtgggactgttttgttttgtaagggaaaaggacacagagctttcactggaaggcaaaccaggggtagtatataactaaattcagaattttccacattagtgtctttcttggatattacatgttaaaataggataggaaagtaacttagcagtcctcttgggaacagaaagttttgccattttaaaggtcgcatctgtaccccaagggaggtgtatagaaaatagaagcaggttccttccttaagctcatgatctgaatgctttgacggccacactaacaatgctgatggacaatgcagaacaacagaggttggctgagaagaaaaagcatagcagagaaatcttcgcttcgaagggaatctaactgtaatcccaatttctaaaactgatcaaagcataggagctctgtttgaagtgggtttgtagcccggagggtcagctctgtcaggtagccttacacaatccctatcccctggaggccctggaggactgaagcctagtgctttggaaagcattatcctggatactccattttcggggtggtgacagatctcgcctagctaagaaaacctgttagaggaaacttggagctaatgagtgacagacacggcaggagtctgcttttttttttttttttttttttttttttcggtctcatcgttgcctgtgacgctggactggatcccttctgaaggcatttcagtgtgcagaagcatcacctggagccttgatgccatgctgatcttccttgggaggatctgagatatgctcccagatctgcatttctccctgtctgtcaagggcagccaccatttaggctcgaatattgagacaataaaccaagaggaagaggaaaaagcaaactgggaatgactctgcattttaaaacctcaaagcccactcccagtgacatacctcctccaccaaggccacacctcctaatccttcccagaaagttctaccaattggagactaagcatttaaacacatgaacctatgaaagaccttctcattctgaccaccacattccatttcctgacctccactgggttgtggccatcatgggaattagggggtggctgctttgagat

SEQ ID NO: 31622 - DNA, 1209 bp, Mus musculus
cagaaacaagaaggttggctgccagtaaccaaacccagccttagctcagagggtcagattcatcaggccccgccacagaaccaatacatctcacctgcagcagtgcccattgcaaagcatcagcctctggatagaacagacaagctccttctgggttgtctggtccagtctgaagccgagtagatccgaatataggaccccatgcctctgggatgagggagatgtctgttaatgtctccaacgtgggaagagtcccctcccccagtgtttagcataagcccctgcttgccttctgcccagtgggagcagaggaatgaactgtggtggaggaaacctctgtcagcatattttaaaaggattgaggctccatattcccagaatagttgatcatgcactttttgaaaccataatccaggtcctaaggattgagtgaaacgtgatgacaccagtggatcttgatctgtctacagggaaatgaccttgttccttgggtttggggacagcaaaggaaagtgtaatggtttttcttgctaaagtagacccattttctgaaccctcagaaggtgtggttgtgtcggctgtagccctgagaagtggtttaagtggattactgcctagctgagccaaagtgtttgcttgtacctgtaggaccactacagcaaaccctgctgacagagcatttgtatttctgtagtaccgggttttttgtttttttgtttttttgcattttcccttcagacacaaaacttttccagtcaatcactgttgttcctgtggtactgtaataagggagagggcaaaaaaagagaaaacaaaaacaaaaaaatagaaaagaaaaccagccaatcattgtatgtagagtttaaaattgtaattaatagagcctgtttgaaaaaaaacaaaacaactgttgcctttttttttgtataaaagagaatttatgacagaagtctagctgtggagaatgtgacatgtgtctatatttctgaatatgaacagattgattcttggggatatactttattgtaaactaaatcaggtatgtaaagttgttttaaaattatataagtaatcgctacagctttagtttgttggggctattgtttccccacggagagactgctcatgaataatcaagcattcatttgcattctcgtttcttcatttatttcttgcttaacactctctctgggttgatgaaaagcaatg

SEQ ID NO: 31623 - DNA, 1195 bp, Mus musculus
ggagcataataattacctggagagaagcagcattttaatccctagttgatgtccaagcacagatggggcagtcgtgtctctgcagtgctgagcctgtacaatggtgtcattttcttcaaagccttgttgcactggaatttgccagatgtattgagaacaaggatttcaaggcctgtgataacaatacaaccccttaggctctgagctcaaggtagataattttgtggcatttactagagtcttaaaagcagataactgtgagcattgcctgtgtggcattgaatttaatttttttatttgcttctgcattaaaaacaaaacaagacaaatgctaaagctgtctgtggattacctgtgttccctttcccctgcaggagggaagggcaatggaattgggatgcttttctattaagaagctgcttttcctgggtttgagttctaggcaggccagcttacagagcaggtttgcttaattacttaggttggaactccctgttctaatggactaatggcatcttgggcctttgtcttttctgctgcaggcacaacccggtctcccagagaaggagaagtgcctggtgtggattacagctttctgactgtgaaggagttcttggacctcgagcagagcgggaccctgttggaagtcggcacctatgaaggtgagctctccagctgccctggggcattcctagtgcctgcagtggtccaggcagagcgtttagactctgggagagtttaaagagggaagaagagattaatttacctaaatatggttcgtgccaataagacataggaaagcgtgaagactctctttgcaaatactttttctcttttcccatttaagcttaaggacatacattctgtggtttgatgtggacacacgtactatttcactgaatcataggttgtcactgttggacttctaggaattgtttttatcttgaggaaatggaattccatttttaccaggagatggctttgcctggaagtgtgtttacacagatcataaagaaatatcacagagtttcctatggcagaatgctgcctggctggctggaattcagtgtgacgggcaatgtgacagctgactggaactcctggtttggtttggtgtgtttggttttggtgttgtgtatatttttaagttgactttcgcattagcatgcatgcatttacacacctgtgtgtgttc

SEQ ID NO: 31624 - DNA, 1113 bp, Mus musculus
ttgggggagcactggtacaggcatttgaaacctcagagcccacccccagtgacacacttccttcaacaaggccactcctaccctaacaaggccacacctcctgatccttctcagagtcccactccctggtgattaagcatttgaatacatgagcaagtgggggccattctgatttaaacaccacaggcagcaacagccacagcgggttctctaatctcataggagatttatttgttggagcatcatctcacactgtcttcatcccagaggaggaaaccatagttgatactttctgtgtatactgttcacatttgcacacacatttcatcctgggtttcctcctctaaccaacagtgtttcatgtagcccaggttggccccagactcctgttctcttccttgcattctccaagtactgaaagtaagtcatttgcaatcacacctggcttcgctcccttaatgtttaagaaacattcatttatgtggtgtacatgtgtgtgtaacatgtgctgcatatgtgccacagcctgtgtgtggaggtcagtggacaacctgtgggacttggttctcatcaccatgtgggttccagggatggcaacaagtgtctttacccactgagcccttatctcaccagccctttgaagctcgggtagtgggaacctactaccttctcttcagagagagcggatggtcctgtggtataggagacaggcgggcagagaagggcatcagctgcacttactagaaataagagaaacatctgagatcaagggaactgcagccttttggatgaggtcttttaagggcagtgggatggagctgataggtagaccatctacataaggttctgtttgttttggttttggatattgtttgtagggctgggagttgagcccaaggcatcatatgatatatgtaaagcactcttccattgaacttttctccttgccctgtacactttacccatgtccttatctataaacttaggatggtagcattgctttagagattatatacaagaaataaaggacttgttggctacatctgagtagagacatctatttctgttactgtcatcgcttctcggccttttggctacgatcaagtgtatttc

SEQ ID NO: 31625 - DNA, 1181 bp, Mus musculus
ggaactgctgcagaatgcatggtaactgtgctatccggggaaaatcagcagcttgctctaccatctcccatctcacttgtctttcctttcccctttcctttcctttcctttcctttcctttcctttcctttcctttcctttcctttcctttcctttcctttcctttcctttccttggtgttctttctgggagtatttgatgtaatgtgttgagtagaatagagaaaagcagatgtatgtctcttatttaaaattgcaggggaagctctctgtctcagtattaagtactgcattagttagtactaagtactggcataggtactggcctaggtctctccaagataccctccctctgaccagcaggtatgaatgctagtgaaggtctattgtaagccttctttccattctaatctagctatagtctgacaaaagttggtgtttgttgcaggatatttgatcacactgtgaaccccaagactgagttatttatgcttggccttgaactaactctagcaatcgttgtaatcttctggctcctcctcattttctgactctttctgtcttcacttgtgtctagcttgttctccctctgcaacctgtctctaaaactctcctggtaaaactgcttccctctttctttttttctgctctaagtagcctttctattctctcctttctcatgagagttgggcatatcctattctgtcagatctttctctgattcatcactttgtccaccactcagtcagacgtcgctttcaaacatgggtgcttccttctgcaagctaactttatctttattgtttgggattaaagacatgtattatgatcacatctgtgttccatctagtggatgtgctaagggatgagccacaccacaaggagaaagaaacaggttcttctcagtaaataccactaccctgggattcgcactgtgatcagatatcttgtaacagattatttattttctctttcttgctttttttaaatcagtattagaatttctcaaatgttttttccatgatcacaaagtatttgcataggttttctttattgagcttttgagaacaataatcagatttatcaatcagattattattgttattattattattattattattattattattattgttattattattattatcagctccctgcgcgagtgcaggcaagcaa

SEQ ID NO: 31626 - DNA, 1158 bp, Mus musculus
tctttaattgttattaatattgtctaagttagggttgggattgatatgattcaacaccacgcgcatacatatatatatacatatatatatagtgtatgtaaatatatgcataaatacaacctgctgagtcttttagtgttacttgtatgtatgtttctgggctgaccatgtggtgttggataaccaactagggagcttgtccctgaggaaaactattcttcctctctcagaagtcacgagttgcttgtgggcctatatataggagtagggctccaagagattttccccatttcatttgggttgtcatctgaagctggaattattcaggttttgtctactaaactcaagggtgtggtgtgttcagcaataggatcttaccatcaacttctggaagtcgctgataataacctgtaacatagctctgtcatcgactcaaaaagaattgacccattctcgttctggggtttttatttggtagccagtgattacagggtatgtgtacatacatgcatgcatacatacatacatatgtatattatcttctgtagtgtttccaaaaggaatttactgttagctcttgctccccacattccctcatctgcccttcctttctatcccccactccacttgatgccttctattccacgttttctctctttcctctctctctaccattatagtccatctccccttgcttcaaagaatccctgctcccatataagcctttactagtttcctaacctgagtgggcattccaaatgaaaacacacatatctaaagcttaaaagctaaaatatgtattttcaagaaagcaagcgtatggtttgtctttcttcatctgagttttctcactcaagatgatggtttccagttcagtccattggcctgcaaatttgacttttcctctgttgagtgtttttccattgtataagcataacacattttcattatccgttcatcagtctgtgatggttattcctggttgtcaacttgattacatctggaatgaactacaatccacaagtggagggcacacctgttgtgatccagatcttgaggctggaagacacaggcttctgacccaggtcttgacatggagatcttgaggcatagtggccatgaaaagctcaggcccaggcaaggtactacacaccttta

SEQ ID NO: 31627 - DNA, 1156 bp, Mus musculus
ttctttcttttttttttttttttttttttcttttagatgaatttacccgacagtagactcagacttagtcttgggacaaatcagtaaatgagacaggaaaaaaaaaagggtttgcattgagggagctggtagtccttttgaaacagggtctcactatgtagctgtggctggctcgcaactctctatgtagagcaggctggcttcaaactcacagagatcccgtctctgcctcctgagcacagggattccaggcttgcactaccacttctgattgatagtcatcagaacatatgtgatcattataattttataatagaaaatacactgatgaatgaagacagaatataagtgacttcattaagttttattagccatttttccccctttttacagtgctgggaatgatagtcatggccttccaaatactttgatcttaagctacaccccgtccttttttttttttttttttttcctttttaagtgaaaaactttaaaacctaatgctttattccttgagcatttcagacactgtatttcaatcatagtcatctcttctcccaacccctcccagatctgcctctgcctcaccgcccgcccaactttgtgttttctctctgtaccatgtctgttttaaatccattaagtcagttctgaggtagcctgggtgtggagtgtggcccttccatcagaggtcacacatcaaagaaaacggactctgcctttcccagtcactccgcagtaggggacttgcctgcctccccatttgttggagatttgtttggcttgggtttgcacaggttttgtgtcttctgtcacaattgctgtgagttcttacgtgcatatgttctcttgtatacaaacaaagataaaacaacaacaaaaacccaaaccgaaagtaaacaaggggaaaaaaaaacgccactatttccttgtaataatacatccttcttggcccttaaactattcctgtctccctgccattaagatctctgatccttgagggggaggggtgtgatctggatgtcccatttgaactgagcacactgaagttccttattctctgtgcattgggcagttgtattttcagtgttaattcctctcttgtgtaagaagcatccctggtgagggtggagaggcagacacactgatcttaggg

SEQ ID NO: 31628 - DNA, 1206 bp, Mus musculus
tccttggcttcggctgctgtaagttgctataggctgagtggcttgaataacagttattttctcttcctcctagagggtagaagttaaatattaaggagtcagtgtgtttgccttcttctgaggccggtctccttgacttgtctgtatggaagtacattctctctgggtcctcacatggtctttctttgagcacatacatgttcaaagccctaaggttgttgttattaggacatcagccatattggattagggtctacccatataatctcattaactttcattgtatttttaaagaccctatctgtaactagacccactcattcttggaattctcatttccacatatgaattacatgtgcatgtaacgaaatgaagcttgtagtggagatttgaccaaacatcaaatagatccaaattcaaagttccaagatgcagatcattttgataagtctctctttttagaaattgctgaaagcaacacttttacttttaaaaccaaatagtttatttgatgaaaagtccagtgatcatattacagagcttagtgattaatcctcacagttagagacactttcttgttcatagcatcaaacctgaagttctagccatacataggatgtagctgctgcatgatggatacttactgagtgatggtgttttattggaattgagggcacagatgagttttgggaattatcttcacaagaggctatgaaagtggatggctacatcaagtggagtgagttataaaatgaagggcagaagctaggtgtggtgaatcatgtctgtgatccagcactgtggaagacagagccacaaggaccaacccaggctccatactggccagcctggcctgtatgcagttgtctcaggaaaaaaaaaaaaaaaaaaaaacttaaaaagaggcaatgaaagttttatacttagggtgtagtacacacacaacagagaaatttggtcaaaatggggctcaaaagtccatgtctgcaggtgtcagggaagaccatattgaagatgtggctattgtttaggaaataagagagctggatattaaaagtcactggttccagctaggcagtggtggagcatatgtttagtgccagaacttgggaggctgaggcaggtggatctctgagtttgaggccagcttggtctacagaatgagtttcagtacagccagggctacacagaaatcctgtctcgaaa

SEQ ID NO: 31629 - DNA, 1199 bp, Mus musculus
gtgtaatttaattgttcccagactttcttatattattccttagaacttgagaactcatacaaagggaatatatagtaaatagtctctagatacagagaaaagaatcatcgtaacaaaagctttagtgaggtgaatagacgattctaaaaacctttaaaatcttagcagaggcatggactgcgtcagaagtttttactctctggctaattaggatgttggtgggatgtgatgagttggatagacatattctctctctctctctctcttttttggtttttcgagacagggtttctctgtatagccctggctgtcctggaactcactttgcagaccaggctggcctcgaactcagaaattcacctgcctctgcctcctgagtgctgggattaaaggcatgcaccaggatagacacttcttaagaagcttctaaattttcttattttacaggacctagcacacagtaaaaacttgacacacagttgactggatgaatgcactttgaaaggacagacctttctatagtgggaatgagcaggataatgactttatgttaactgatgatctcaggaggaataataatagatgctgtgtggtgtgtggctctgtgtgtgtggcgtctgaggaagtgcagatctcttttgagttgtaagtccatggggacagctgtctctatttttctcaggtgatttataaaaacaggcccattttactatgcctgccattttacaatttcttagaaatgctacttttcatatctgttttcaggctttctcatttgggcagatgtattttagagtttgcttacaaacatttcccagacatattgttgatcatcgggtctcttcagttaacagcagcttcttgggggctgttttcgtacatttctgattggcagtttgatgaatgctgtaggtcttcacagatgcagagatagagaagtgaatccagtggaaatcagatagagctgggacagttcacccaagatgaattcataagggctgggggtggggcttgaaactgtgcctgggacagttcatccaaattgaattcacagggtttagggtggggcatgaagcagcgtggctgtagcttgcatctcaagtaaggtcagtgttgatttttgtgccgcttccccagatgcgcacacattcacttgagcttgtatttcatttatttctctgaggcattctgcatagaac

SEQ ID NO: 31630 - DNA, 1241 bp, Mus musculus
ttagtgtcttgtaattgccggaggcaagtttatgtatcttgtcacagatcctccctcccatgtgttaggcacagagcacatgctcagttcctgttagtcttggttcaatttcttagctgtctcttactttaaaaaaacagcactgtgatctttttgttctatgtactagttcatacactgagtgtaccatttctcttggtaaagtggaatgaatgggtgtcagggtcagcagtgggttgctctgtgtacccataaaccgcgtgaacaaccgctctttacactttgactttgtagaccacatggcgcatggaggtcctgagcaccttcaagtccaaagactaaaacttacgcttagaacaagaatattcagtctaaagctggatgtggccgcgcacagctttaatctcagctcctgggaaatagattcagagcagggtgacttctgtgtttgaggctagcctggaatacatactgagatcctgtcttgaaacaaacaaataaacacatattcaaaataagaccttttctgtaatagtatattcaataaagcacaaaaatagtctttaaaaattacccgagttattgcataacaggattttcaggggttgtacttttagttgttggttttgttttgtattgttgttttggtttggtattggagacaggatttttcttcataaccctggctgtccggaaactcactttgtagatcaaggaagccttagactcacacaaatctgcctgcttctgcctcatgagaattagacgtgtgtaccaccatgccaagtagttgttctggtttctattgtacaacctggagtcacttggagaagaggaaccactctctattgaagaaatggtttgtggctctgctgaaaggaattttcttaattgatgattgatgtaggagggtccagcctactgtgggtggcaccatacctatgtagacaagcaggctgagtttgacccagacaccacaccagtaatcagtgtgcctctgtgggttctacttcagtttctgcttgagttcctgtcctgacttcccctcaatgatgggctgctatctggaaatgtaagctaaataaaccttttttttttttttctttcccctcttcaagcttcttttggccatatatagtgtttatcacagcaacagaaaaggaaatgagggcagggtgggatacaactacaggcatcttaaagcagcaacagtgcactgtggcaaacttctggctggcctg

SEQ ID NO: 31631 - DNA, 1195 bp, Mus musculus
cccaatactgcctgctattggcaccgtctcagatcctggttagtgtttatttttcaaagttcccgttcctaaaactctccagtaccacacccatcccaattccgtttgctttaatgctataaacctacgtattcctattacctggtgtgcatagcaagcctcctggggagcagcccaggcgggttttattcactcaaaacactaggctgttgcagtcttgataagatttgatcaagtctttgagtgtttaatcacatggacatgtgtgattatttttaatagtgtacaatatattactgtcagtcataaaacacattgaaaattaattgcaaacataagtcagccgtgtttagtcatttgggaaggctgccaggagcctctcttatgaggggtctggctgtgggaatcgatgggaagtgatttctgctgagagaaaatgtgttgtggtagcccattttgccaagaatctggtcatctgtggcttaaaattaaaaaaaaaaaatcgggccatttgtcttgtaaaagctgattttgtattttctgcgagcatttttactggaactgcagttgaactgggtgtttccatggatcagtgcttggtagtgaacctaaccaggctcgctatgtggctggtgtctatctgtaagtgaaccagccctcctcccttcatccctgcctgtctgttttagccttttaatgcctttgttaggtgtttctttatcatccaaacatgggcatcttagaaggctcgggatacagtgtcttctaatagttagaaagctttaaatgtaataatctaacatgataacctgtatggattgagaactacactgacatttatattaatggcatttttagttctcagaaactttttctttcgtcctttaatcaaggaaaaaaagattcttttttacacatttatacacacttattgaatttctttgctgctctcagtgttataggtcatgccttatgtgccctctgatcttcttagttttatttttgctcatgtttccagtttactatcatcatcatcatcatcagtgtgtaatgtgcatacagaaaagtgaatgagctgtaactgaacagtgtgatgggctttcaggaactgaaacactgccaccccctgccacctccccatccccaccctgtgctctcacgaccagcacccagtttctgcgggtctctggctcat

SEQ ID NO: 31632 - DNA, 1239 bp, Mus musculus
ttcagcagatagggttatgtattgacaaaggagagaattgactggagggtcatttgtagccatgtactctatttaagtaccttccctcagtgaggacgtagctcaggaataatttgtcttaaaattggtataaacagagtatcattaatagtgtcagggattggtgcttgcccatgggatgggtctcaagttaggacagttattggttggctattccctcagtctctgctccatcccctgtccctgcgtttcttgtggatgggataaatttggggtcaaaagttttgtgggtgagttggtgtctctgtcgctctactggggttcctgcctggcaacaggagatggcctcttcatgttccatatccccattgctgtgagtcacagctaaggtcaccccctttgattcttgggtgcctctcttatccaggtctctgtctctccctggagatgctccctacctccccacccctggcagttgctaagatttccatgcagtctcatggcaccgatccctgacactattaatgatactctgttatgcttccagacaggagtctagtatggctgtcctctgagaggctccacccagcatctgacttggacagatgcagacactcacagccaaacagtggattgagcttggggactcttatggaagaacaggaggaaggattgtgaacctcagacagggataggaattccacaggaagaccaacagagtcgtcacttggggctctcagagactgaaccatcaaccaaagaacaacaatgggctggccctaggccccctgcacatatgtagtagatgtgcagcttgcttcttcatgtggatcctcaacaactggagtgggggctatcccaaaagctcttgcctgtgtgggggatatgttcttctagctaggctgccttgtctggtctcagtgggagaggaagtgcctagtctcacagagatttgatgtgccagggtaggaggatgcccagggggtgccccccaaccccgctcagagggcaaggggagggagatgggggaaaagattgtatgtgggggaggtgggttgaccaggagagggacagtgagcaggatgtaaagtgagtaagttttaaaaaaaaaggtataaacaaaagtgtttcatttctcagaatgactctggtggcctttgtaatccataagaacaaattttcctcttgatttgaggatgagacccaagaagataaaaacaccaacttgttaacacttgt

SEQ ID NO: 31633 - DNA, 1119 bp, Mus musculus
acttagccttctttcctctgggcatgctttctctcagtgatactgacattccgagaggaagtgagggctggggaggcttgtcacagtctgccacatgctgtgtttctcttaccgttttagttaaccctgagtgatcacccttctcctttcagcctggcatgccctccagtgatagctgatgctgtgcgtacctgctgcttttctgggcccacatgcatgtcctggagttggtatgatctgaggatgacgattccacctctgaggtgccatacttctctctctggccctgaacttgaaatagctatttccagatttttcatctgtgtggcgatatatctgtcatggcaccctgggaggtgtatgggtcatgatttgaacagagggaccaggtgacaggacagtgaggcttgctttcatttggttgcaaaactccttagctaagcatcccctgggaagggcacaatgggaaacagtatccacatagagtcgtgtctgtaagaacagtgtctcgcttctctgtgagttatattggggagttatgtatttggaggtatgtatgtgtgtgtgtgtgtctgtctgtctgtctgtctgcctgactgcctgtctgtctgtgttgtgtgcatcttcaaagtctggttttaagaaccattcttgcttatcttgatgggcaatctatttcggtaatggggttataatagtgctgaagatactggtgtaaggttcttgcacttcttagaacagaggtgattggagatcattgtttaatctttctttcaagcatcctctggctcgtatgtgcagggagtaggtgacggccatagctaagtccctgtgtggaagaaaggagcttcctgggtttaggttttcctgtttgtttgtttcctctgcaatatgtttcaagtaacaggctagaactggctcagaaccaatgtgtttttgtcagggccactttggatgggtcttaacagtgacaacccatttgctctgaagggattttcatttttagtgtcagcagcgaaatgggtgtctagcagagggaagcactttaaacagttaactaaactgggggcctgtgtagctagagaccgcttccccttctcattcacccatccctttttg

SEQ ID NO: 31634 - DNA, 1166 bp, Mus musculus
gaataggtggcttcatgtgtctgctgagagttaccaagtgttaagagtataataggagagaggaggctagactgttctcgagtgtgaactcgagtctgccatataagatcctgccagtaaccagcgctggagctttaggcaagtgggtagatcaattccgagataaattttgttatctacaaatgggagtaatttaaaccacctcttttaataattactttttattcttgtgaaaaagcatcatggccaatgcaagggtttatttggctctttggttccagaggtctaggagtccatgaccatcatggtgggaagcaaggagcagcagcatagagcatatatcctgatccatagataccaaaactcaaagcccacttccagtgacacgcctcctccagcaaggccacacctcctaattcttccaaaacagttccaccaacttgggactgagtattcaaacaggagtatgtgggcgctgttcttgaaaatactgtaacaggacggcagtgcatttgattctgtactatgtacaggtgcacatttgagttgtaggactcactgttagcatcagtctacaaatgtttctgagcataaggaggtttacatttttgtttattggacacccagccagggtgtagggagctggtattgggacacagatagcttggctttctggcattgttatattagcaaacctttgagcaggatgtcgcttagtgcctgtaacttttgtgtaaaaagtaatgtcgttactttacacaaggctacaactctctttcagagaggaccatggctttttctgcaggttctctcctccatcccacttactgtagatgccagtgggcccgctttttctgttctcaaggaagtgccacagcaatgattgcttctcaaggtttcccctggtatcctgagaccggtgatctttgcttgcctctttatttatggttttacatcaacaagttgagaaatttttgaggagcatttcagcacaagtcctgggtgctctgtgagatgactcatcccaattaggctgcagcctgcctgatggggattctcttgtttatcagtatagttttttttaaggtagattgctggcatagcaatagcagccattgctcagcaaggctcatgatgactgatcccagcaccttggagacagaact

SEQ ID NO: 31635 - DNA, 1210 bp, Mus musculus
ttgatttgtgctctggagcttaagatccatggtacttccagaccggtgactttaactttttggtataatttgtgctgataaataagtgccatgttaaaaaaaaaaaaaactgggaagatacagaattttacgaatttctcatgtgggtagctaggtgcacctgacttcttccttgtgagatggacttgttaattttctgcatgcacactttctttccttcctgtttttttcttcttcactctgcccccttttgtccttttagagaatgtcccttttattctcaacaggatggtttgtcaaagtcctcaccatcttctagatggggaacttacaacttgaagttaagtcagatgaactcttccagatttgaaaagaatgggcctaagttattcagagtctgttgaccttgggtatttaccactatttccttcaaaagtgtgctgggcctgctgccaaaatctgtgcagcactctttttattaagaaagtatatatatatttttaaatttgctgttaattgtgtttggagtaggcttatgaatcgagggtcagaggatagcattgtagagtggattccctgtcaccaggcaacccaacactcagactgaaatgctcccttcctctcccctcccttctcctcccttccttcctcccttcccctgcccttcctggaggtctcatgtagccaatactgaccttgaacttcagatactcctgcttccacctccaaaatgctagatttacaggcatgcaccattacacccagttttatgcagtgctgggtcggtcttgaacccagggctttgtgcatgctaggcaagtactttactgacctagccatatctctggtccattggggctgtttcttctttttcttttatagcatgtccacataagaaaggacttttcttttggcttctgttgttagcatctgaagaaatgcctgcccagtgcgtctggcggtgggcccagggactctcccaggggagtctacacaaccagttcccattaaccttcctcgcacatgctcatatgtaggtcagagtgattctcagaattcatgaaaagaaagttacctgtcaggattgaatgttctggatgctattgttgtgcatgtgtttcctgttggcagccactcaggaagctgaggaacttcccacacggaagatggcttaggaacaggaagagtgagatgtgtggtccctgatgga

SEQ ID NO: 31636 - DNA, 1197 bp, Mus musculus
ccttggggttagggtgcgcattggcatataggtgtttcatgtgtgctgtgctatctgtcatgtatagacaatggtatgtttgagagaagtgtcattaaggcctagctagatagagaaagcacttgctatgcacatgtgcagacccaagtttggattctgagcatctacatgccaggtgggatggtgagccacctccagtccctgaactctgagcaggaagagcctgagcatctcggagatagggcggtgagctaggttaaccctttggatggactctgggtttaactaagagatcatacctcaggtacaaggtagggagcgatggaggaaaattttaggcatcagcctcaggccttgacatgtatccacacatacgtgctctcctgaacacacatatatgtctatgcacatgtgaaaattcaggcacaggagtaccaccacacatgcatacatggcaaaattgtcattaggtgatttcttgctgaataaacagggtacagagtcactatgtgataacattttaacagaacctgtgtcatatgcaattcattcttgaccagaatgtcaacaagaggcatgtggctatttaagaaaagtatgtgaatgtaattcttcaaggtttttttaaaaaaaaaaacttgtttatttgcgtgtgtatgtatgttatggcacatttatggtggtcaaagggtaacttgtgggagtctgagctctccttcttccatgttggacctgggtattgaacttagctcactaggttgggtaataagtgcctttccccactgagccacttctctgagcctgtgaatatatttcttatgcactatatgactatataatttgcctttataattacgcacacaaatgatagcaaatacatacatttgcatctttcttttcgcagatggtagagtttgattctgtataattgaaaccttgaatcactgagctctgagcctcatatttgagggggggtgttcattatttttagaatccaggaaatacaaaggaactggcatgtgcataggaataaaagccgtgaggcagaaaataccgtcagttacctgataaccatctttttaccaaggaaggagaaggccgcacttgcagtgtggctcctgatggagctgcgtgccacttgaaggacacacatggtgacccctggggatgagtcacccggtgcagctgcaaacttct

SEQ ID NO: 31637 - DNA, 1161 bp, Mus musculus
caaactcaagtcatcaggctttgtgaaaagtgcctttgcccttgagccatcttcccagtgctccttactgttacttagaaggtacggatgcagacattttcagactttagaaaggtgatgagtttattctgttttttcccccctattatcttgagcatgtgagattcttctctgtcatttaatgaagtacagggggtagaacactgacactgaattacgcactcatccgttttaagtgtttactttgaatcatgatcttgctaagttgcccagacttaggtagccaaggctggattccaatgtgggtcaaggctgcttctttgacctcctgagtagctcagattgtgatccttgctaccagaacctggggttcttaactgcatttagaacacatgtacctaccacacttttgagttttctgcagatttgaatcttatagttggtatagctcaaattgtcaacacagagggatacagacctgtctgaagagcatttagctgctttaggaaactgtttcctgtttgctgtgacgttcagatctccttctcatgcaatatcaggatctgtttccttcaggaactgcacaaagtaaaagctggggaattggtttacatggcagtaggtgcacactgatatttggaagttactcagcacagaaggccccagagtaccaaatacacacagtgcagaaaaggggccaacttctctttgactgctggctgtaaattgacattaatttatatagagtaagtaagatgaaaacaccttatttgaattatttagagattgcctggctattattcttgccccatttaaagtttacttgaaaagcatactgtgtaaaatcatcagctgctgtatcccttcagtatctacctttcacctgtaccttcttaatctgcaggtgaaaacggaaaaacaaacaaacaaacacacaacagaaaaagctttcagtgcctgcatgttttctcccatatcaattgaactctttctgtttatcatgttctgccgtacttggaagctgctgtttatgtggtgtgcagcacacacgtgtgcatgtgcatgcacgactgcctgcatcgttggaatgccattttcaggtaacaagttcctgaaaatgggctgtgggcacatgatagaaccaactcactggattccact

SEQ ID NO: 31638 - DNA, 1181 bp, Mus musculus
aaactccctagcaaggtagcaacgtacctgtgacccgtatagtaagaatgacttctattggctgataaacagagctctgggctggggcctttttccaagggatgattctattcattgagaaacaaagcccagtattaggtcctaaataattaggggattgagggggttaaggaggatgcttgctcctaatagaatagctaaggctcaccacgttgtcagacaccatttactgcagccttccaggtgagaggctgccattcatttccttccttgaagaaagcagaagtctggctcctctaatgctttctgattaaaatgtataaagtgttacaaaaatatgaatcggtaatgttgccagttctgatccactataaatacagcactaggtcctacacttaaaagttgggagagagaggagtactggtgagaagcagagagaggagacgtctacattgggaagaacaaggaatcaaaggacctggtgatctcccaagtccatgttcagcccgacattgacctatcattccttagtttcaggtctgtcctgctaggtggtctcatgaactgtccgaactctgtgctgccctagggtgttaaccttgctgtttgagagtaagaccattgtcacagtttaaaggcaaaattgaagcaagctttaattaagctggccaggttgatgggttctctctgggtttctagaaaatggccatgagtcattccttgcagaggcttgaaaaggcaatcccacaaggccactatatttcccatcaggtctagttcaggacaagcatatatcctgacatatttcctgcctacgtacctcctgcctacatccaatcaggggcaagcatacatcctgacttatttcttgtctacatatctcctgctcacatgtgatcaaacacatcctcttgttatctcccaaaaacaatagcctccagcctttcaggaagtatttgtccttgggcaaggggcttacaagttagaggactttttgtttcatagatctgccaggcacagtaatttaaacttaaatacgaaatgttgcctttcacaagggtccaaccttccatccctccagcatgggattcctgaagagattttagtctttgggggtcccttgtgttgatagtctaataactgaagggagggtgtaaatgtatctcttcacctgacaggac

SEQ ID NO: 31639 - DNA, 1177 bp, Mus musculus
ttgtgatggactgttaggatctgtagctctgccccgtggcccgagatcagtcaagatcactctaaaagaaagctaggccacactgagcttgggcctgtgtgtcgcaccccccacccacaaaacccccactcccaactagcttctgaggaaaactgtggcaaacaaaggccttcggaggttttctgaaacatgaatgcaaactcaaatttcattttgctcccaaaatgttattacctaaaatcttgaaaaatattttcttttagggttatttccacaaggttgttaatctgaaaatgatccaggcctaacaggcctgactttctgccccttgctttgggctggagagtggtggctgaggttgaatggtggtggaggaaatgaactcatttaatattacacctaccattgggatatgtcacctcagagagggatgctatgtcccacagccaaggcgaaacttttaaagtcgtccacttttaaaaagagcagcatgtctgcaaagtcacaaatgtgcattggccatcaccctaaccagggttgtctctcgagatggatgctattgtgacatttttctcctctctgtttccatagctggcacttgacagtcgtcttattttcctttccttgtcgtagacactgctagctcaagtgctcctgtgttgtgaggtccttgtctaaatgaggcttatcaggccccgtgagtcttgcacagcagagacaaaacttcgcctgttcctggttgggagaggaatgtggctggttcacctgcctccctggatacacctgtagggctggttcccctgcagacaccttactgctgaatctgtaactcagccagggtttgctctcccctggcaactcagtgtcaatagtgacaggaagcagagggactgaggtttctgtgttgtttttttttaacctcctgcttaagtcccagatatgtgtgcaatctctcttactctggtgtggtaaagtcgaaactcggcttatcactggcctgagagtctctgggaacataactctagataaggtgggaaaaaaatgccatagaaagttaatctttgctcacaaagaacactgctctctttaattggctaggctgtgactaggtgagggggtgggtgtgagggaagccttccatccctcccgtgggcagtttggaagcaggaaggagtcg

SEQ ID NO: 31640 - DNA, 4999 bp, Mus musculus
cccactgttctctagaaacatcttaaataaggaaagaaattcatgccaaataacgaggccaaaggttagtactgtgagggaagatctcaggctccagcagtccacttgctacttaagacataacttcagtccaagcctgagtgacacttggttacagacgaagatgcgatgctttttgtgatgtagcagctgtcttggattcagatgttttggggcatcctggcagggtgttttctcttacctcatttcttatataaagtatggtgctccaggaagggttagaagtgacaaggctgtcttttgggcctttccgctcttttatgtctagcctatgcttcataaagaagattttggaaattggtctctgggtactaatataattgctgagtcaagccctgatttttcagaatgaagattattcttgccaagagttgcaagttggacagcaagaacatttcagttgtttttgggtgaggcagaaaattcaagttgacatttctcatggataattgctgttttttaaatagatacttcctttccaaaccattatgaatgagttgtataagttgatgcaactatgcaaaataaccgtgcctctcatgcttgttggtttgtcactgtcagaacctgggatggagagtttatcacgatctgttactaaagccagccaagatttcccccaattgattagtgtctagtgtttgggatccaaagtgtgccagggttggtggatatgttcagtagcatatctgtggcctgacatttgcaagattaatccttttgtcctagacatttttttctctttccttctctcttggatcctcggccctgtagggaagccatgtgatgaatggcccacggggtgagaggctcaggtgccctgctgtgtacagctacttcaggagagctgtgggtagtcactgcaaagatgtgaaactgaagcacagtcagccagccaaagcctcactgttggattcctgactcacaaacgccattggataataaatattggttatttgaaaccagcaaaaccagactcatttggtacacagcaataaataaccattatagacataggttgcctaattgatctgccccccatctacctgtttccatcggtccatgatttcagttgttgtcagagtctgcagtctctgcaactggtcttgctcagcaggatgtaagaaggtgtgctctgggatctatgctctcaaggtaagagggagcatatcttctatctttctgctgatagagatatagtccaccctatcatttccctagtattaacattttaaaagtaacttaatgtttttacttttgtgatctttcccttgtagcattctttatactaatcctgaatatgggactgtcagcatttctttaagccatatttaatataaaccaaaatgtaaaccatttagataaaatgaagtaagctagcatgtattttatgacatccttatttatgttacatcattctctagttggattaattatcctcattgcttacattttattctgattatatgaattttctgaaaataagaatttagggaggaaaatgaggcaagctaaaccagtaagtcctaatgctgacagagtgatttcaggatgttgaatttggggctaaaccactcatttgcattcctagtcttcatcttctcaaagtgttatggctactacatctgggttttgcttaataaaagtaagatctagaacagttaattattgcagagtctaaaaatcagtaaacgttggagatcagttttaatctaggcctctgagctggatgtgtgttcatatccccttggaagtgactttttcacatataaagtactgctaacacgtgttaatgcaatcccaaggatccagtatgtgcgtatatctgattaataaatgtttatcactcagagttgcattctgggctgctcttagtaccatttctctcatttgtttttcttcctcatcctcctcaaaattagcatcttttctttaactcttgaccttagcaagaatacctgagatttcaagctgaatggagattgtgagggaaagttgttgaacagtgctgctccagcctggtaaagattatacagtgtactgttcaggacagggtcacgtgagaaagttaatagaactaccttgtaatacatttataaattaaataaagagtatgttttatctggggcgatttggtattcacatctgaaaatgggtaggactgtcaatggtataatagttaggcagcgaaggttactgtgcactggtgttagtgtctctcagcagcagcagttaatggtgtgaacggacaggcgtagctctgtccacatctcccatggctttctctgctgcagtgtgtgttttctttccttccattgggcttttgaagtggggcagaaagtgctttaatgtggaagctggcagtgtgagagattctttatgctgctctctctgttggaggggagagcctgtgagagtctccaagtccctgtccctctccccccacctcccccagtaccatgagcaaggtgcttttcttgttgtgacaaaacacttgacatagtgactagactcacactcagacgatatatagaatttcttatagtgtgggtggctctatagtggtggtatcatatagccaaagacttcctatggaccaggagtgcataaagaatgcctgactggaaggagggctaacagactccccaaagccatgccccccagagactccttccctttatccaggccccacctattaaagattccacaaatttttagagcagagcctctagctagagatccatgtgttgaaacccttgtgggaaaaacaatagactaaccccataacacacaatctcatctctttggtttccttcttctcctcttgctagatcttttcccctttgccttaaattctcctctgttggatgggatatgctggagtatgaaatgatagttgactgtgcccaagagaaagctatattgaacttgggtaggtcaggaagtttgttcctctgctggtgagatagctcagtggataaaggcacctctaccaagtacaaacccatcatgtaaacaccgaacaattaaatggaaagcctcaactattctcactcagtggtccttggtctgaaggacaagggaacacaccatgcaggactgcaggaagtcaggatgcagcagacttcctctctggcaggaggagatgtgcctgatttggctgacacagttggcagggctctcctgtgctctctggttgttcatctttgattcctttgcattgcataaagaccacggatttgagttgggtgctgattatacttcctctctgggcaaaggtcttgaacagtagactggtttgtttgcttccccccacccacccccaccccggaccgcccccacgccccaatttatgagaggagaacaccattcaaggagactgctgaggcctgcagtgcttctgaaacacagtactggtttctctttaaataagatggtctttagtaggctactgagttagagaggtgcagcgtgtgttttctgaaatgcaaaactccatccactcaaggccacaagccatagactggacccttaaggacggttctggagcagtggttcttaaccttgctaatcctgtgactctttaatacagttcctcatgctgtggtagcccccaaccgtaatattactttattgcttcttcataactatagttttgctctgtagcctattgagtctgataagtaattcatccgcatccacattctgtgtctttatctttagataacagctggcctttctgtgattgtagagtataggtgctcctaaagcatgctgtagtatttactctttgattactctgttgttggcggagccatgaaccactgtagagacttagtgcattgggcagctctttggaaggcatgctatgtaacaaactgcctctaaggcctatagcgtacaagaaccagatgatagcttgtagctgcagttttgtagggtagagataaggttttacttgttctgtgaatagaaaagtttgagcaccaagctaaatgtcagtcaaagtcctttcttggtactgcagtgtaagctgagaagtcagtttggccttcctaagtctgcgtctgttcctaagtacacctggcatctgtagtgtctagagatggttttggttgtccggactgggatgagcaaaagtggaggccagagatgttggtaggtaggcatgctgtggtacccaggacagtcttccacatcatagaccatgaagtcagtgattcctagctttagaaatcctttttgctcccgacaaatgtctgtaattgacgatcagggagagtgagtgccatgcttctcagcgtggggaagaagctactggacagggcgaggtgaggaagcttgcggccagatgtggccattggcttgggttctgggaaggtcctcagtacctgactctgtcacctaattactttgttagggttcagccttgtctatgtgaacctcagagaacagatcacttacccattcctctcagtcacgcctcctgtgaagttgtctctactgatgtgcttcctgcctgctgtacatgtgaggtgtcctcaagaatgtccagctcgggtgaagcagttcatcctggcacactcgccaaggcaccgtggctaaagtccacctaagccccacacgcctgtgagtgcatcatacaagtagtctggttcagagcatccacacagttatatttactgcgtgttcttaaaaggacttcacgtggaggattaaagaattccaagttcacagaggatacagtgagaagtctctaacttctcgacttaactagttctcctgcgggaccctgcagctgttccatgttctggtgattgttcagccacatccacgtatgtgtctgtctgtctctctctccagttaagtatagaatatatagaataatatgtatgcacataacatagaaatatgcttcctgtgtgtgtgttttaaagaa

SEQ ID NO: 31641 - DNA, 1122 bp, Mus musculus
cccctgctgtaggagcaggtcagaatatagtctgtcatgactagcttgcccagtggttcctcacttatctgtgagcactgtgtcacgagttcatgctagtcagttactctgtgcttggagcaggctggctgggacttagcaaggcaggaatggcattgaccagtgaagcttgagacatgttggagctggccgtgacagctttgctctgtggtgtagcccttggtgttgaagtaagagagcttgccttatcaacaaaatcacatgtgtggttggtgtgtatgtcagtctttcagcactcatgtgcttaatccttaacttttccagttttgctagtggtgggatgatcactgagaacgtaccagtagtttgtaactggaatcaagacctgggtctgacttgctcctgctctttactgtgagggttccagtgtactttcttttcttcctctttgcacttgggtggcccttctagtcttgccagccttcctgctccctctgtagtctctttcccattgaccttggtcctcgaaccactatcacacacacacacacacacacacacacacacacacacacacacacgtatatgtatacacacacacatatgtatatatatgtatatatatgtatgtatgtatatcctcctgaaatatattttacaatatgttttttgatcaaattactttgcaaattttagtctagaaaaatttgtttaagaaagggcagctaacattccctgacattctttaaaacaatcacaggactgttaatataaaaagcagttatacctggcaacccatgtggtgtacataaatattcggcacaatactcatacacaaagagaagaacaagtcattaagaaatgaccctggggctggagatgtggcccaagcgtagttttatgcctagaatgcacaggacttggatttgaccctcacaactttgagaatttttttttaaagcattgtaacgcagtcaattcacttaccatgcttgctcatgtactgttactgcatgctctctctgcggtctgtgcggcacatgtggccaaggcgggagatgagtgtggcccaatacaagctgtaaagttactgaatattatgacggcttttcgtgtctgaat

SEQ ID NO: 31642 - DNA, 1105 bp, Mus musculus
ctaacgttgttgctatcttagcacctttctggaaatgtgttggttgatgtctgtctacaccagggagaagccaaggcagcgtgagtcatcagaggctcacagttgcctctgtgtttgttcagggcctgtgtagtctgtgtgagagttgaggactggggtagacaatctccttggttcccggaagcttgtatgttggtggaggaacatgctgaggtccctgtacctcccatgcttagcacttgacctggcaactcttggtttccttcttcgtcaagagaaatggcagttttacatcttctctatgcaagggactggtctttgtagaaaacaaaggtaaactgaacagatccagtcactgaggtggatgtaatgattgaaattgtttgttggctcattcttttatgtgtgcaagttatgctaggctttttgcttagatttctcccacgagttcagcatccgctgtttgtgcacttatagatccctctattgaacattgcagggctgtgactgctttacagaggtctgtgacttcagctaaggagtttttgctatcctcttgctgtgtgccattctagtgggggaccccaggcatgagtgtgaaagagagcttgggagatggctcagtggataaaagtgctttgttgcgggaaggcctgagtttgactcccacacacctgtgtgaaaagcttggaaggcagtaaatctgtaattcctgccctggaggtcagaggcaagtggatcctctctggccggctggcggccagccagcctagctgtaaaggctttcaattcagtgaaagcccatctcaaggcagtagagagtgatagaggaacacacctgaagccctctggcctccgagtgtgtggagtgtgtgtgtgatgtgtgtgtctacatttaccacacagtcatgtgtgcactcctctgagctgggaacccagattaggttaagatcataatggatcaggatctgtttcattccaaggtgttggctcttattggctgcctggctggtttacctgatgtttccttgctgtgcgcatgtgcaagtgatacctggaccacagaggattcttacctcatggagtgagacctctcatctagcat

SEQ ID NO: 31643 - DNA, 1168 bp, Mus musculus
caaattttgattaaaactgaagaataaattccaccctgattttctgaacccattaggactccttaaagggattatatttgcaaaacatgatgaaattagttcttgatttcaaaaagattgtggactggtgatcagtcctatcttaaaaagaaatgtagtatccaaataataaagagtgaaatagtaataccatgtgccagagtgacctgagatttttttccacacagagaaagtggattttaggtcattaaaatatattaaaataggtttgattaggagcagagtatctatcacgtttactcaaaggcctgggtaaagtgcaaagtaaatcttcagggtctctctgtttctctctctctcttctctctctctctctgtttctgcctttgtatcgttgtctctgtctatctctttcatatacagacatgtgaatactgtacagtagtaggtgtagagtaggaggagaaagtcttgatgctctttaatcgtgtgttatctatgtgaacctgggacttggtgtgttaggcatgtaagtagaccattggcatagattgttttcacagttattgtttctgtcttctctcgccgactttcaccctgcctctggaattacaatgtctttgaagaggattcttttatagccatcgccctgagtgataaaagatcagaatgaaaaggcactagtaaaatgtatcatggttttatccccatttagagatgattctatcctctgttaagaattaagtaattgtgagtacaatatgtaagtgtactataaaaccacttccattaactgtttccaataatgggaacacatcaacactaaccccatgaagctatgtgccttaaaagtttacaacctcaattttatgggctttgaggctttttgcattagatgaaaggaatattacgctataaaaattggcaccttatgagcctgaagttttcgcatcagcagcgttctaggaaaggcaagggtaaaaaaaattgtttcagaacatgatctataatttttagaagttggcattatcttttggctgtggctaaataaggaaggcctaataggttagtcttagtctggtgtctcagtttctaaatatacatgctttattaaaagagtgagtggattttatcgtttgttgttacttccacaaatgtttatagcaag

SEQ ID NO: 31644 - DNA, 1202 bp, Mus musculus
tttaaaaatgatattggagaggaaaaaaataattcaacaagtttcccgtatcctgtgatgtaattgttttcttgtatcaagtcccttttaaccttgaaattatgagccaggtcttcattatcctgtagctagattgccattgtggtaattaatgtgccctatgtccaagttgtttggaaaggaggtgggaaatgactaatgagaaaggagaggcaaccgaaggtaggaatgggcagtgagggccacttgggtaactcccgtttccatggaaaaatggaattagcaacaaatgcccagtctgtgcagtagacatgcactttatcagttcgttttcttctccttttgtttctttgtttttgttctacaatatttttattcttcacgggttgtgtgcatagtgttttgatgacattcacccccccaccccagaaagatttgctttctgttcccatgataaaacacagaccaaaaccaacttgggaaaggaaggatttatttcagcttaaagttcacagtccctcgttgaagaagtcaagggaagaacttgaagtagacaccatgggagaaagctgcttactggcttgcttcccctgtttgcctgtacagcccagggggcactgctcacatgagtcatctcgaaaatgtcccacagacacactcgtagaccactcttacaaagacacttcctcagttgagggtccatgttcctagatgactttagtttgtgtcaggttcacggaaatcaagcagaccatccatgccccttacatttggtgtttatgcttgaaccctgagctccgtccactctgactgatgctataatgttcaaccagctggttatttgtctctcatgctcagggtgttcaaggtgcttctcttaaacatgtgaatgtggactgattgctggttgagtagtataagtttgcgtgtggagtgattccatgctgtcttaatttccctgcaagtgccagtcgttggatgcaatttacctggctgggtaaatggctcttcctgtgctccttgtttccgtgagtatcaaggatccagtatcaaaggtagtgaatcaaaagcactgagtttgaaaaaagagcccacccaggacatgtgaatcttaatcagcacaaagttatctcacagatcttcttttgctctctgaaacatcttaaaaataggctccagctcctgcctaccagccgtatcct

SEQ ID NO: 31645 - DNA, 1180 bp, Mus musculus
cagtcccaccttactgtaggctttttattttaaccaatcagaaggtgatggagaactatgtttttaaaatactaaggtaggagattcttagaaatacccaatctggcctataatcagatctctgccagttcagaaatcagctcttgaataatacaaggataatctttacacagtgcacacaaacatcctccaataccatgagactggggagatggttcagtgagtaaaagatcttggcctgcaagtacaaatacctgagttcaaatcctcagcactcagggaaaaatctgagcatggtgcatgcctgtaaacccagaattggaggccagagagctctctggtcagcctagcaaaaaacaaacaaaccagcaaacaaacaaactactactaccaccccccctcctcctcttcctcctcttcttcctcctcttcctcctccaatgagcttctggtttagtgagagatcctgtctcaagagagtaagttagagagcaataaaggaagacacacagcccttctctggttttacacttacttgcaggggcacatctactcttccactccctcatgtgcatatagcacagtcacacaattctcagtgtctgtctgagcctgtcctctctctctgcacctcacccctctataagatcgccaagccaaaaaaaaaaaaaaaaaaaaaaaaatcctaaacaaaatttaagaactcagtctcgttcttcatttgtgtgtctctattcaaatacgcaaatgtgttttcgccaaacagttttatgtggtagccttagatactcctcatgttctggtaccacaggatggccagagcataaacaaatgaaaaagcttcaatctgggattgtcaaggcttggcacttgctgaaagtaagtctctctagtttgttttagtcatatgtacacattcatttacaaatgcatatagctatatataaacacatgcatatacataatgtgtgtatgtatacgccacaaatgcaaaattccttacttggctttctggcaaaatttcagactttaaactccttggcaatattctgtgttcaaaggtgggattttgtttttcttcctgtctattgctggcagtaataggtttttcagactgtcgcaagttacttctgactgtccagcattatttgtgtaataacaatgacctgtttagatagct

SEQ ID NO: 31646 - DNA, 1209 bp, Mus musculus
agaaatgtctccataggattggactgtaggcaagcatttgggcattttcttaattagtgtttgatgggggagggctcattacccagcgttgtagatggcgacacctctgggctggctggtgatcctgggttccatgagaaggcaggctgagcaagccaaaaggagtaagccagtaagcactacttctccatcacctctgcatcagctcctgcctccaggttcttatcctgtttgagttcctgccttgacttccttccatgatgaaccgtgataaggaagtgtcagcaaaataaacccttcctccttatggtgcttctggtcgtggtgttgcaacacagcaatagaaacccttactaagacagacgctatctacattttcccttcctattgtgtagtatttgcctgtgtgatgtgagaatgtgtgtgtgcactattttgcgccagtgcactatttcccatgagacaggggtttactgactgtagctagactggtgtctggctggctacagtcattcagtccttctgtcttctgttccctgctcctccacagtgtgtgtgtgtgtgtgtgtgtgtgtgtgtgtgtgtgattacagtcacttgtgcatgttttgcttttcctgtaggtgcttgggatccgaatcctgattttggacattggagcctggaagggcttaaacagtaaagggaagtgcctgataccatcttgttgggctattctacagagaagccaggattccagcctttcctccaagagtagacatgctgttagaacttggtgaacctctggggcctgttctgcagtgccattgttacatggaagctgctattaccctcgatgctttcctgcctgcataatgggttgctctgtattacataattgatgctgaacaccagctttgctgtgctaggctgaggaacagactcagtgtttcagaccagaggcttcgtcaatatggtttttctatcaaggagccaagtaagggaagggatgctacaagatcaaaacggtgcagtaaacggtagtgaaagccaatgcagacttaagactcgcgtggatttggtttgtgtgtccttctcattgttgggcactttccatccctctgtacccctgtcagaatggaacattctggtagactgtctaggaattcagtttttagataggttagtttatatgtaatttagaacttcatgtgtgagacagaactaagg

SEQ ID NO: 31647 - DNA, 1143 bp, Mus musculus
gggcggctgccagccaagagacagtgttgacacaggctggcgatccctcaagcactctttgtgttcatgtgcctttttcgctgtacttcctcttcctgcctttccatttgcacctttctgctcatttggaagattcttcaactgaaagttctctaagtttcctctgggtctggaagtcacatccactaccccactaccctagactcaataccctcttcttcatggttccagaagtcctgtgtttgagacattgcttctgtcctccttcctcttcccccatttgttttctttcttcttctatttcttcttcgtcagcattcatgtagcccaggctgacctactccatacagagttgaggatgcctcttgatcccaagttctgagactacaggcatgcaccaccacaccaactaacggggcacacctcattcatctttacagtggaggccgtgtgcattgtctgcctcaaaatcatttttgaactgaactgagtttaaggaagattgggtaggaagatgttggattccattgcatatatatatatatatatacatatatatatacacacacacacacacacctgtgggattaaaatatttgatgagtgaagaaacagaaattagattttttaaaaattgtttaaaaatatcaattttggaagacatgtagcttgcagtaatgaatccttcattagagccatatctcttattgtgtgtcaagaaaaagcatcattatcttgagctttcagagatgatgttgcatgtcagtccactccacagcacatgtatcatgtcacctgtgtccttgcacctcagtactgaggcatacatcggtgctgtgtgctatacagaggagggtaccaaggaagagtttgtcagtgttcataccaagagcaagctagttgcttttgtaaataaagttttattggaacttgtacaagctgttcattcacatgtcattgtctatggcttctttatactaaaatagtgtggttgaaccattgtatcagaggctgtgaagctaaagagtccaaaatgtttgtgactagtgtttttgacaccaaaagttttgtaactcttagagctattagttttggaaaaagtaaaatccctttttgttatatccaagttatattaaaatccgt

SEQ ID NO: 31648 - DNA, 1441 bp, Mus musculus
ttagcaaagttacatgaagcagactgcatagacctaaagccttctcctacgttagcttcaggcagcccagagctcatggaagacgccatatctactgaagcccagcacttgcttgtttccaatggccacctccccaaggcctgtgactccagccctgaatctgtgccactgaaagggcagatcactgggaaacggaggggaccactgctattggcaccgagaagctaggcttcatctacctcagctcttttaaagcagtcgctacaggaaagaggtaggagaggccgtggaaagcttgtgtccagacgtcactccggacagtccgacttccgtgtggaatgtcagtcagtcggctagaggagtggcatctggagctcagaaacgtgagagactatttgtgtacaaaaggcaggaaaaagtatttgataccactgtacataagagttttcagagatttcatatatattatatatcttttacagagactattttaatccttagcgcatgggtcccgcttttggtgatattttcacattaggttgctgtctaattttggagagggtcaggaatcgttctggtgccttaatgcacagctggaattcaggtaaacacatcagctgttgctggcggttggaaaggagggcatcttggctgtgtggcacttagtggtcagattcgagtgcactggccagacctatgcaggcgtggtgttggcagcctcactgtagagcagggtgcacgggtctgtagttgaggacgagattgagagctgttaatccaccaaatgcaatggctcagaacaattaagcactgcctttcgtctttctttgtaactcacttggtaaaagcaaatgtcttgtctccttcagtggttctttgaagcttagtgaggcggaggctgccagtgttggtacctgtggattttccaatagtgagggttagctctgcctccagggcccgctaagttctgctgagcaggcctgtccacgctgttccttaccggtgagactgggcttggactgtacaagacttgagtcctagacctgggtgtatttgcactttggggccctgttgctagccatcttgtgagtgccaatgtataatgcagtaaagactacatggaaacacaaactcagtccttaaaaccccaggagttgaggggaagtgttggcacagtgatggcctgtgtcaccgtgtagtgtcataggccatcactgtgccagagcaagcacgctgagaaggctagtctccatagttgatggttaatgttacttccacaaaatatgtgaatttgctgcttctgagaggcaatgtgaaagaggaagtattactttttatgtacagagttatttatttatagaaattttggtacagtgtacattgaaaacatgtaaaatattgaagtgtctaacaaatggcataaagtgtctttaataaaggt

SEQ ID NO: 31649 - DNA, 1129 bp, Mus musculus
gccctaaggcacctctttgtttcttatggcagttaaaagggtgttggtgaggtctcagttctctccttgctctaatgggcccccctcttgtctttccccagccttgaattgtatataataaccctgccatttcttcttgctttcccagccttctgccctgagaagactttagtccttatcactggtaggcaaaagaaataatgaagaaccagcttgcctccactttaggcataaaagctctcttagaataaagataaaccaggtccattcctgtttatgattaaacctgtttctcaagcattgggctatgccccctgtaaccttaactacaaatggttctgtgctgcctgtttcaggtatggcaatcatgtctttgtttcaaaaagctaagaagcatcctgctaccctccctttgcatcaaagggttgctatagctaccttgttgcgaccacctgttgttatgcctgccttgcaaccctgtctttgtttcaggaatcatgatagctaatctgttattcttatgttctgctcctgtaaccctgctggtttttttgtttgtttgtttgtttgttttgcctgccaactccccatttggaaaccctgtacccgtgagctataaaacacttgtcttcctcacatccagggctgttctctaaaattccaatttagggtgagacagctggctggccaatcctgggtgcacctctaaaataaagcttgctttagtttgctctttcctcttacagtgctcaggtttaacaataaaagcaaagcagtagggcacaggctggctctcatggacttggcacttatagattaaggctgctgtatctgttgggaggctcctgggagggccctaggagctcagtaacaactggtcagtgtcttcttttcctaaggaacaacatctacctgcagagaaagacagagaaaacagataatcatcatacaagggccgggtactgtctgagtcccttcatgttgctgatgtgtgcatgacaggaaagactctcagataacgagtcatttgacccaaggttgcttaccctgtctgtggtagcagagtatggcatagagaaagaggcatcagaggttaacaaaagagccaaagccagttggcaaagccact

SEQ ID NO: 31650 - DNA, 1119 bp, Mus musculus
gtggaaactaggtaagaatatggaaggggaaaaaaccaaaccaaaccaaaacaaaacaacacaacacagcccacagttgacacaccagtgcttccaaattaactgggctcaagtcggttctcccggaccttgcggtcttcagagccaaaggcgggtgcaggagttgtggtggcttagcagtggtttaattttagaggctctagaaccacataacattgtgggttgggaagagagagagaaagcaagccctttggaggctcctggaggacatgtgcagctgcttccaagccacagctctccactgctcacaaccctgaggaaagcccatcagggagtgccctaacccggagtgctggacaccgagtcctctataatcagagggctatttatacagtcctctatgaaaaggcccttggatcacattactgtggtggcttgggggtgcttgctactaagctgctttgctggggccactgccctacacgcttcctggagagggtaagggagccctgccttcaggtatttatggctcagctctgctctgtccatgctgctgctctttctctcaccctgctgtgtgcatgcacaagaacaggtgcagagggttgggatggctgtgacgtgaaggaagactgaactactgaggagtgtttgatagactgcggctgttagttaatagctaatagctgttattgctattagtgctgactgataagtatttcccatgtaagtatccacagcctaaacttttagatttatttctcctggatcctgccaaagccccatgactctggtacatgtattatttacatttttttttaaaagaggaagactaaggttcagcaaggttaggtggcatgctgaggatcatttgattggtacggagtagaagaatcgctctctgttttttaacaatctgttgctgtatgaccacatgcctctgacattgtaattgagtgtactcctgaaggactggtgtgttactcagactttggacagagctggacacacactcatctttcacccttcttgtcatatgcgactattaacttggacctccatatccatggatttgtcatctgtggattcagccaaccactgattgataattgaaaaatg

SEQ ID NO: 31651 - DNA, 1172 bp, Mus musculus
cagtttatgtgtatgttttgtgtgagggtatgtgtttctatgtgccttggacatgttccccagcatatgtggaattgctggggcatatgaaaagtacatggtttggggtgggaggattcctaggctgtttataaagaatctgtaccatttttaaaaaagaaaagtagtatgatttcaggtaaggaaagtttgggctgtttctcaggtagggatgttcctctcaggcttgtcttcgggcttagatctcttggagtcttctggtagaaatacaagtagaaatcacaaatgcccattaactcataaaggtaatatcccacagcccatggtgagtgagaaacactaaatccaaaatgtatttgcttcttgtaacttgtagcttagcaacacagtgcttggttgtttgtgttggttgctgggagctgtggcttgcctgcagagagagtaaggatcagaccacacatcactactagcctgggaaaagatgacattcaaaattccaagtacagctcctactgtgtgtctctggctgttgaacctccacaaagtccaagaagagtgactgtctgtacttagtggcttgcccctgtggcagcacatggcagtggttactgtggggaccctcggtatctgagtccagaggggttcacagtgctggtctctgccaggacagactaggggagcttgcttttctgtagcctgctgaaatttgctatgcgtctgcacccgtctctgggtctgatcatttcttctgctttggggcaagcctgctttgccaaccgactggctataaatttaggtcgaaatgcagaaagcaggctgtccaaaggtaggctggataattgctctggacaggtttacaatagggaggtgtgaagtgcttggtggaggcaggaagctgggggagggggattgaacttgagcagttcagggagacggtctgacaccactaattgaaaactatggctctggtggcttctaattggaagggaaaccagggcatacagtggggttttgttgttttgttttgaagcaggaaagcagagaaaaaaaccactcactgagttactgaggaggtcggtttgggatcttttcaaatggtattgtgggctggaacctgtattttaaaagctttaggaaattgctttggatttttaagtgtgagctttcctcta

SEQ ID NO: 31652 - DNA, 1169 bp, Mus musculus
ccttcctgtctgttccctggggtccccttgggcttgatccactggggctgggtctgctcctaccctcgagtttctcctccataaatggcacaagttagttgtggagtagtgctactatgggagaaggtgacagggggcctggctagctctgtcagtttaggtgcacttctgtgctgctgggattggggttcgttgggaacattagatttctgtaaacaaagtggagtagaatagcattgttattcttaaaaaaaacaatacaaaacaaataaaaaaccaaaaaaacctagacctttgagtcgaatcttgctcagctatcagtaattagcatctctagaactattagtaccttccagagaaaggcctagcttgagtagtctgcgtctcatttgagcttttgaatgtctttcctaggacacagaagtagtacagcagtagcttcagtcatgacatttgctgttttaaaaagcgaaaattgatgacacaggctttaactcacacctgtggcttcattgcagaaaactaggggctgggtatctgaccgtcttgaaggagagaagttgattcttttctaacaagaagactgtattcttagagtgaggggcttgggtcttcacattggtcacttgggcaatctgctgtgggagttctgaagccagcaaagacccttctgctactgttgctgccttgaggatttttctcttcttcagtatctgcttcctctctggaattcactactgaaaatgcctggtcttagagtggggctgaacagtggctctgtcagttactgggaggtagacacactattgctctctgctaagatttttatctattaataactgaggcagtttggggacattttggggttttttttgcatacttaagatggaatattattattattattaaataatagaactatgtgggtagagtcagagaatgttctcaagtgttcacttgttggaagacttgcaaagccatgtgtcaggggtgttctgaggaaggctctccgttcccaagccacacttcctggagaggacagagtgctcttatttgtactttctttttgtcacaagacctaccttggcttgcccttccttggagcagaacttgctggtcatttttaggctttcagttgcctacaagtgacaattcacacagcataaata

SEQ ID NO: 31653 - DNA, 1179 bp, Mus musculus
accttccctgacacatacacacaccaccaggccttctctgctgtgacaacctgaaatcctgaaccacatcttaagttatttctgtcaggtgttctgccatggcagcaagaaagttaatatattaagaaagcagacaaggctaagcaccccggttcctacatgatggaagaagagaacccatttgtataaagtcatctgacctccacatgggggctgtggtgtgtacccacacacatgcacacacagtcattggcttagttggagggcttgcagcacaagcatgatgatgtgagttcaaatccctagccagggcgtgaaaacctgtaaccctagcatgggaaggagtggagaaaagcagatctctgaggcttgctggtcacaaacttcactccagattcagtgaaatatggtattccaaagaaataagacagatggggttagacagtggggcatccagtgtcctcctcgcttctgagcccaggtacacacaagcactaaaaacaaataaataaatttaagtgtagacagcatcctacaactcttagcaatggtcacttggctcatgcatccacagcaagctgcgagaattaatatgaattgcaggacacactgttcatcaacacttcaaatgtgcttttggccccaggttccttcccagactacacctgcctgagtttcacttaaaagacagaaagatagacagaaagacagaaagaagggagggagggagggaggaagagagggagggagggagggaggaaggaaggaaggaaggaaggaaggaaggaaggaaggaaggaaggaaggaaggaaggaaggaaggaaggaaggagaaaaatgcaggtggcacgaggctgagggaaagctctgttttagggtgtttacctggcatacccaagatcccaggttccagggcccacaagattcacagtagaatatacagcatctgtgaccccaaatgtgtagacagtattagaaattattattattttcgtatcacattacagtcatcatacatgtctcaaaatatacttttaatgtctacatttcagagtaatagtagctataacccaggacctccagcactaggagtggtacctcatacacagtgtccggacacctcccagatcaatcgttaatccaaaaaaaaatatcacagagacttgcccacagaccact

SEQ ID NO: 31654 - DNA, 1062 bp, Mus musculus
gagtgaaagagaagtacaccttccagagatttttgccaaatgtatacgttttcctctaatggaagatacatttatcgagaaaattcctcctcagtttgcacaggccatagtcaaaagttgtggagaaccctccaacaccagtggctgtacacagaggcttggaatgactgcttctgaaatgatcatatgttttgatgctgcccacaaacactcaggaaagaagcaaacagtgccttgtctagatatcgtcacaggaagagtgtttaaactatgcaaaccaccaaatgacctaagagaagttgggattcttgtgtcaccagataatgacatatacattgcaggaggctacaggccaagcagcagtgaggtgtccatcgaccataaagcagaaaatgatttttggatgtatgaccattccaccaacagatggctttccaagccgtccttgcttcgggccagaataggctgcaagctagtatactgctgtggtaaaatgtatgcaattggagggcgtgtttacgaaggtgatggaagaaactcactgaagtctgtggagtgctatgatagcagagagaattgctggatgactgtgtgtgccatgccagttgcaatggagtttcataatgctgtggagcacaaagagaaaatctacgttttacagggtaggtagcaaaaggagtcttcatcaaagggttgcatgccaaggttgggtttcttaataatagcaaagcaggtaacacttcctagtggttgcttcttcctaaccataaactatgctagaacattctcttagaaaatcaaggtcaaaaacatttaaaatgttaaaatattcctaagttcccgaaatagtcagttctctgtttttgagttatgtttggatctcaaagtatttttaaaaacataataaggaatactttatttcttattatttcagagcattttcaaataaacaataaaggttaatcacacctggctatttttgctcttcaataatagaatcaagagatgtggcaactactttcttatggaacttacgaatgagtttcctgaagctgcactctt

SEQ ID NO: 31655 - DNA, 1150 bp, Mus musculus
agtaactgactcaatatcaattccattcattgtcttgaaatttgtctttgcttcataacaacattcacataaatacatgagtgacctacaagcacaaatctaaacaattccatatgctattttctagtcaagtaccacacatgtatataatggtttggtttggttgttttggtttttggtttttcgagacagggtttctctgtatatccctggctgttctggaactcactttgtagaccaggctggcctcgaactcagaaatccgcctgcctctgcctcccgagtgctgggattaaaggcgtgcaccaccacacccggctttgtaatgtacttttaatggttaagttgtatttgatcatgttgccagccttactcctcccaggtcatatgtgccagtgcatgttggctgtaatattactgtgattttgtgtattctaggaggcaaatgtttggatacaaccaaacatgaaaacttacatatttgtttcccttttcttttttaggggaatttttcctcttctatgagcctcaaaaagactactggggatttttaacccccatgactgtgcctcgaatccagggcttagcagctgtgtacaaagactcaatctactacatagctggaacctgtggaaatcatcagcgtgtgtttactgttgaagcctatgatatagagctaaataagtggactcgtaaaaaggactttccgtgtgatcagtctataaatccatacctgaagctagtacttttccagaataaactccatttatttgtgcgagctactcaagtgactgttgaagaacatatcttcagaaccagcaggaaaaattctctttaccaatacgatgacattgctgaccagtggatgaaagtgtatgagaccccagatcggctgtgggaccttggccgccattttgagtgtgcggtggctaaactctatcctcagtgtcttcagaaagttctttaaataagcagcaggccaaagcacgcccctggcatctcatactgaggaagctggcttaggaaatgctgtcgccattgaagaaagctaacagagtcttgtattcagaaatgggtgctcataaagactgtggtgtggagagggatttgattttaccttcatgatattttcagttcagtcaggaaaggg

SEQ ID NO: 31656 - DNA, 2315 bp, Mus musculus
gggtagagacatccaaactggttaacgtgactttcttttaactacgggtaacaatatgaggcaatatcatttatttagctgtgatctctaacacagagaagcactaacctagatcctcagtcttactatttatatctatttacatatatatttttgtgtactgttttcaagtgtacgagatttaaatgtgctgtcagcagacggaagggaaactcggttttcagagcgaacttttagtccgattgttccatgtaacttttaagttaagctgcaaggttaaagtggcagttttctgtccataactttttcaagtgctaacactgtctcattttttaaaatcccagaaagggctcagatttgcaggtgactggtgctcgtataagttcattcatgtgtagttagatcaacttaaatggttaccgagtctctgtttatctttcaggttagcatgctagttccatggtcctggcactttaccttgtgattccatgaggtctgctatttgtgtgataggatatggccgttggccattggtctagctggattcagttttacaattccaagtttgcactaacatgggctgttttgttgcccaaactctctttccatcctctacctttccagtcattgttggcatcgtgaaagttaactaataatgtgaagttttaacacctacttataaaattctgttttctagaaacaagagtcttggagtggtctaataattaagtggcttataaggttcatattatggttacaacctctctatttttttgcactcaacagtgatgaatatttttatgttgaaacacttgtagctgaaggcgatctagaaggaaggatgagtgagtgaacaggtcaaaggtttctgtgctctaggtactaaggcgctgttcatagtgaactgataagtttctcacagttagttagggatattaacataaactccttttcacctaaggcaggtatttaggttgataacatactcattactatgcctactataactgataaagaatattacacataaggcagagcctgtcctcagtcaacacattttctttaagagactcaatttgattctcttgaagaaacctggcaagattttgtattggaatagaaaaaagtcttgcacaacgtgtaaggtgatagatactgtgaaacaaatggaaaatattgcctcttgcatcacatacctccttttccagaaactttatagactgcattacaaaggccctacaaggagagagttctcgaagcagttcaagtggacagcattcacagattgttcatgtgtcctccacagctggatgcgtggcttctcctaatctctttgtaaactttgtcagccaatatttttttaaacctctctagttgtcttatggttttgttttttttgggtttttttcatgctgttttagggttatttctgtgaattttttgaattatagttttgtattgctaatgagagggaagagaatttttacaagagatatccatgtaatttatttttgaaagctttgttgagtatctaagatttcctgccactttgacaatctctgtatttaggaaaattcattacttgaatacatgatgtagaacattgagttagcaatgtacatgtaccgtacgatatgtaagagaacaatacactgtggctaattctatactagatttattctgttggtctgtacaacagttggtccttttgtcataactgtgtctattgagggaatcatttcagaatagtgtatcaaagccaaggtttagaatttgctacaggagtagaatatatattgaattttgtatgaattatttgtttacattacatagctgggatattttgccacttttaaaatgactttagaaaaggtcctaggaaacttaagattagtgatgtgtgtgggtttatgtgtagaaattcaaggtacattctcatagtctgaatataagtaaaaggcacaaaggctacagcaggattcaaagatctaacaaatgccaatcccactttaactatgtttctgcatttgaatgtacacagcacttttcctatatagttctatacaaagaaaacagaactaggtataactgtgttgtaggattgaagaaatcattatttatgtctgtctttgtttcttgttatcctacaaagttgatgtgtaaacatcaagttgatttcattggtgcatgaggaaaagtggatgtgatctgtgaggaaccagagtcccatgggaagagtttaagatggcattcaatattcagtgctcaggtatgtagtaagtactgtagtcctatggggcaaatgtgtagatatt

SEQ ID NO: 31657 - DNA, 1536 bp, Mus musculus
cttactgagcaggtgcctgagaaacattgtgcgtatgcatgatctggaagaatgcttatttctcattttggagtgccagggacaatacaggaagtgtctttctaatgagagttcattaaagtgaaaagaagaggggctgaaaatgtcagccgggcatatctgaaaagccagagcttggcagtaaaaagccacatgtgttctacttaaattgttggcatcaaggagaccgggcatcctggaattgcagttgtccaacttgactgggtgtgcccctgtcaaactaatttatcaattcccattgttcccccttctaggaactaatgtgcaggaggctcagaatatcctcaagagcagcggactccccatcacgtcagctgtggacctggaggatgcagccaagaaagctgttgccagtgtggcaaagaagtgatgctctccctggctcccatgaagaagggcatgtccctgactactgtgaaagcaattgttttctcactgggaagggacacacacaaggatcatcatgtgaaaaatattaactctgaactttctcaaatacgttatccagagtgcctaaagctgaatttatactgtagtcattgtttaaaaaaaaaaatcactccttacaatttcacatcttctcttgcccattcagtagcagggtctaccagctctgggccacagtcagtttagccaaatagtgtgcatacatacagtatttaaagccagatctaggttcattcacaagggcatttattctacattagaaaattttacaggaccctcaagttcagacaggctgatatttaacatagtggcttccagaagggtacagctaagacacctgagcttctgtgaccagtggcctccactggcccctaattccagtacattaagaaagcccatgaacatttctaaagtgtggcttatattgggcatcccgtgttgatatatgtacattgcacacattttaccctgtgccttaatgttgaatctactgtttgcctcacactaagttactaccagaagccttagtcatgggtgtgaggtggaaggtttcattttgtgtcagagttgctgaatgttaatctatttcataaagagtcacactaatgatctagctgctggtagcggccaggcttttccctcttgtcccctccacctcacatctatcagtttgccacagaaagatgagagatgccattggacagaatgtgaccttcctaatgatgtccttttttgtgacaggaattttcttaacttgatttttttgatttaattttgataaatttatagtcctatacattttaaataaaattgtttttcagtgctacttagcctcacagttcttgtttctgtctgttatctgttcttgtgaagacactagcctctgtgccagaggcctagctctagttaagaaactgcagttgacccggattgttccagcgccacagtgccttgccatgtgaccatttctgtggtggtgattcagtgaagggctaacatgtacacattagacacaagcccaggaatctg

SEQ ID NO: 31658 - DNA, 1122 bp, Mus musculus
tctaaaggcagttagcctctttaagaatttcatgttttaagctattggtgtaatccctgccctcctggaggtagaggcagggagattcgaggttatttttctttacatagtaactttgaggccagtgtggctgctgtaagactctgtctcaaaatgtagattgcttgcctaatatccacaggcctgagttggattcccagtaccacctaaaatccctatatttgggaggtgaaggtaggaggtaggtggatcaggactggctacatatcaaatgagtttgagccagtcattgactatatgagaggtcttaaaagaaacacccccccccccaaacaacaaggaaacatacccctccaactccccccaccccccttttttcaaaaggacaaaagtgcatccaatgcacgatgttgcgatgtgggcattagtgacacctttcaaaaccgtttcttttgttttgggccagatttagtaatattaattctattagtaaaatgtagtttacttaaattttcatcacctcaggttgtttctgttgtcttcctctccttggttttgtgtgtgtgtgtgtgtgtgtgtgtgtgtacttgctgacctagggactcactaacttgcctaggctgctttcagatagactctggaaccaatagaagtcttgaacttgtgagctttctacttcagcctccctagtagttgggattgcaggcctgtaagctagttttcaattgtctttttaatataaaagttaagcacaccaaataagcatggaactcctttcaaactctgtcctcctccagtccagctgtcactgcactttccaagggtcctcctggcagcctctcacactcagaagagatgtgagctctttttcacattcatttgtcacttttaagactccactgaattacccagatggaatgcagaatgagaagaaatgccacgttattatgctgactgcagacacaatgtgggaattctttatgataggcccttactcatgtcttactgctttatttattccagtgtgctaagcacggcagcttggccttgtttctctccaggtagatgaggtggctggaaatagtactacctgttttcatttgggaagcttaaatgttttta

SEQ ID NO: 31659 - DNA, 1154 bp, Mus musculus
ggatgggaagggggtggtaagacaacaagtgcagaggccctgaggtctgacaagtagggaaggtccaaatcatgtgggtatcacgtggagttcttaagagcttagtggttgtgtgacttgcacaaaattgtccatctattataacaggaaatggctgggtttaagtcccaggactctgaattctgtgtcccacattactatgagaagtcagaactcaggatggcctcacagcttctgagggtatagttagcagttcagtagacatctaacagtctttatagccccctcttccctagtttgttgagatcgggtcttgttgtataggtccagttgcctttggccttgaggcaatcttgcttgaacctcctgagtgtcaggattatagacatatacaggcgtgcccagcaatacttcctggtagataactccagctagcccttcaggtatgtaggtgccatgaaaccttgtgtcatgatctcgcaatgagtggctgtgatgaatgcccaggaacccatttttctctgttgagtcttattgtaaatagagatctctctgtctgagacagggtctcatagcccagggtggcctcaaactcttgttcatccaccctctatctcttgagatgacaggcatgatccacctcatccggctttttgtgatgctaagggtcataccgggtccactgtgcagaggcaagcactaatctcagtccaggtactaaagactgtgtgtagagctgcctttggggcatttctctctcatgcctgggtgaagttcagggaagctcgtgtcttaagggatgatataggcctttcaggtctaactttggggtttccactgtgtggttctctttgaagcccagagggctgtgtattgtccaaggaaactgcttacccctgtgcctctgcagttggctccttcagaaaggaggagcagcgcagccatgtgcttcttctggcagtggagacagatggatgcatggttttatgtgatgttcacttatttgaaacggtctcactgtgtagccctggctgtcctggaactcaatatgtagacaaggctggctttgaactctgatcaggcccaacagagatctgcctgcctttgcccctagagtcctgagatcaaaggagtgtatcacctgcccagctatg

SEQ ID NO: 31660 - DNA, 1177 bp, Mus musculus
ggggagcaggaggagggggaggctatagtgggttttcagagaggaaactaggaaagggcatttgaaatgtaaataaagaaaatatctaataataatagtctagaaaaagactgggcagggtggcacatgcctttaatcccagcacttgagaggtagaagcaggcagatttcggagtttgaggccagcctggtccacagagtgagttccaggacagccagggctacacagagaaaccctgtctcaaaaaaacaaaaaaacaaaaacaaaacaaaaaaaaaaaacaaaaacaaaaacaaaaacaaaccacaaaagaaagaacaaaagaaaagaaaaaagaaacaagacaatgtaaatattctagtatctaaccaaatatgcttcaaaccaatattaaccagaagagataagaaggaaaacttcattaaaggtaaaagtcaccacagaatattacagttctaaatatatatccacatccaaccattaccaccaaggagttggggactgtgatgagattgctggggcagaaccccactgaggtggaactgcaggacatgattaatgaggtggatgctgatggcaatgggaccattgacttcccagagttcttgaccatgatggccagaaagatgaaggatacagacagcaaggaggagatacgagaggccttccgtgtctttgacaaggatgggaatagctatatcaatgctgccaagctgcgtcatgtcatgacgaacctgggggagaagctggcagatgaggaagtggatgagatgatccgagaggccaacattgatggagatggccaggtcaattatgaagagtttgtacagatgatgactgcgaagtgaaggcccgggcagctggccatgcccattctcctgatctcttctcgcgctctcctctcttcagcactcccctgcgtaaccggttctagcaaacagcaattgattgactgagaatctgataaagcaccaaaagatttatcccccccccccaaaaaaaaaagataacaattctgtaggtaaaaacctagattgtcctccaaatccgtgaaaatggatgatagcatccatcaataggcagtccatcaagaaaaaaaatgaagggagaaagtctagagtaaaataatataaaaagggcctaatagatgtttacagaatattccatcaaacacta

SEQ ID NO: 31661 - DNA, 1403 bp, Mus musculus
cagggtcaccatccaactctgggagaacacccgaagtttaccaactactcttttgatgtagaagaattcatgtaccttgtccttcaggctgcagagcatgtactgcagcacccacagtggccatttaagaagaaacatgatgagctatagaagtgttgaggttgtttccaagagtgttgacaccctctcacagccatagactcacaatcagaggagcagaacagcctgtcatatcctactgtaagaggaaacatgacgttttacttctgaatatagctcaggctgaccttgaactagtgatcctcttgcctgagccaactgagtgctcaccttacaggtgtgccccaccatgcctgtctacagagttactttttgtatatgaaagcacacctccaggagatgctaagtcttccatgtgtttattgtgtctttgctatttatcaaaggtatttttgcactgaaaaaggttacttttatagttcaaaggtgggcagatgcccattggtgtggcagagctctcctgtggggatgcaaagttgtcaacatcggtggcttcagacttgatatatgtgtttgttaactgtaatgtgatcttgattccagagtgtcatggcttcatctatttggataaactcatctatttggataaactcagaactgttgttatttgccattgtatgttcataaatatggttgtagggtctgggcacatggcttagtgtagaatgctggccttgcatgtatgggcctctgggtttaatccctagcaacaccacacacacacacacacacacacacacacacacacacacacgtctaagtctgtgattctcaggaccaaactataggactacgttatagaccagtaattagtcaactccagattccgtgcatcaagagcctgacaaagatcatgctgttgtatttattaattttgtttctatatctcatttcaatcatgttctccccaaatgtaatggcagtgttgataagagcctgtcagaacattctgtagtaccatctccactgacgcttcagccgtgaagacccttcatgctgacttggcatgaagtcttagtttccatcaggccagtgtttgtgagcacacacggctgtgtgtatctacctctggcagaatggaagtaaccctagtctctgtaaaacactgccaagtagccacatgaagagaagacactttccctgtttatttgttttttgatttttaaaataaggccattaaaaacacggtagacctgtgaattatccaatcaaaacaaaagccccaagaaagtggcactgagcaaacaggatgcccagcagcaggcttcccctggactgcctttgtttcttactgctaagcacatagctcaacagtcagaaaccatgggtttgttctattgtac

SEQ ID NO: 31662 - DNA, 1233 bp, Mus musculus
agtcaggttgtgttttagacctgtaaaatattttgatagattctattacttaaaattgtttaattgcttttatcacagtccttctttattcttttgcttcttttgttcttttgctttttgtggttctggctaaggtaaaaaataatccaaaaatatatggaaattacagaaagagtaataaatgttagagtgtatgctgctgaggggagcctgctggaatctcactgtttgactccatgtgtccaggacgtttgcacgccctgtgagcccctgagccgcctcacctcagctgttgtgtctactgtaatagtgtggatgagcttgtgatccggtaatccctttgttctttaatggccccaagtgacaaagccaaatgttagccaggagtgcttccttaatggcaagatgaacatccacattggctgtcttgctggaaattgatagcttctactgtttcaggcatccactctgggtctcaaaactgtcttccccacgagaaggtaggagttcaagtaaaaaccgtaaattttagttacattttaaactctacttcagatcacagctgtgagtagccatcttgcagaatggagaaattttaggggtaattcaagtgaccttgtttttatcttgtgttcttgtgtttctgttgtgggaactcagatttgtagcacgaataaatgttcttttggtgaaagtaacagtcataaaattaagtttttgtattttagtggtaaaaagcagcctcataactttttgctagctttaaaatgttttaatattcaggggcaagatgataagtctgacagcaataaatacatagtgttaaaagagacaggaaacctgaatttcaaaattgttggcaagcatttagaactggtagtttgggaaatgtaaaatactttttaaacaaataatttgggaatgtggcagagaaaagattttgaaattaaaatttcctgtattctagattttataatatcaacattaaatatttttcttggttcttaataacattaataaaagcagcccacttaaaaatcttaaaatgttttcaacttacttatgtataaaatgacatgcaaccatttatatctgcttcatctgtaagtgaatagctgatgttcacactgcttatgttggctagaatatacttagacctttcagtacatttcaagttgataaggggcactgaataaatttcttgtaaataatccagtaagtggcagaagactt

SEQ ID NO: 31663 - DNA, 1640 bp, Mus musculus
ccctgtgagtggaggatgggacacttcaacctggggattgaactcaacaagcagcgaacctcagagtcccccaacagcctctcaagcaattacaaagccagttcgaaggactgtagtagatgaatctgaaaatttcttcagtgcctttctctctccgtcggatgcccataccattcagaagagcccagtggtatcaaaacctccatctaaatcccagcggccagaggaagaagtgaaaagcagcttacaagaatcgtcatctcctggccagtccagagtttctgagacagctgaagtgagagactccgtgtgtgtttctggagagacttcagccgtgggcactccctcacctgtacctgaagacaagcatgaagaaacggcaggtgaagagtctgaggtgaaggtgcccactgtgagattgaaggcgtctgaaaacgtagttaatgtaaacacaacagaagatgtatctaccacatccactcagtctctcacggcagaaacgaaggatatggctttggaacctaaagaacaaaaacacgaagacagacagagcaacacaccttctcctcctgttagctccttctcgtcgggcacctccaccactagtgacattgaagttttagatcacgagagtgtaatcagtgagagctcggccagttcgaggcaagagacttcggatgcaaagtcgagtcttcacctcatgcagacgtcatttcagctcctctctgcgtctgcttgtcccgagtatagccgcttagatgacttccagaagctcaatgagagttgctgctcatcggatgcttttgaaagaatagactcatttagcgtgcagtctctagatagccggagcgtaagtgaaatcaactcagacgacgaactgccaggcaaaggctatgctttagtacccataatagtgagtccttcaaccccaaagactaaagtagtagaatctactgaagagaatgctgaagaagaggaaggaaacgagacattagttgcgccgtctgaggaagcagaattagaggaaagtggccgaagtgctactccagtgaactgtgaccagccagatatattggcttctcccacagcaggaagtggcgggcactctgcctctggaccggccactgagcagtgtgaagctgttgaaaaccagccaaaagcaccgccagagaaagaagatgtttgcaaggtaactacagagtagaagagggcattggggtatgtttcagagttacagatgttttcgtggatgtgtggtgatttgaaaaagtagatgtttgatcatttaattgtagcagttacggactttaaaatgagtaattatgttaaattacttgaagttcttgcaaagcaactatggtagacttaagtagatattatataaaagcttagtgtttccattttccatctgtattgctgcgtccttatcactttaacattctttgatgctctgttcatctttctgacagtttgcaaaggactgtttaagtcacaatgtgttctcctgaagatagacatggaatatcaatctgaatgttaccacttttatatcaaagtgttttgcatatgtatcctatttatgggaaattttagattttatcgttttggttttatatgaatactgtagatgctttcctgtg

SEQ ID NO: 31664 - DNA, 1407 bp, Mus musculus
ggagataggatggatgcctttgtgtggctttagctagccttgaacttgcttatagcccaggctggctttgaactcagatttattcataattaaatatgaccaaattgtaattatttatatctctatagtagaattgatggcttcttttaataaaaataatttaaaatccaagaaatcaagttttaagacatgtctgaactataaagctataacttgtgcgttatgtatgtgttattctttttgttgaggtatttattttgcttggtctaatgacacttttctattttagaactgggactagttgatggacaagaactggctgttgctgatgtcactacaccacagactgtactattcaaacttcattttacttaaggaaaataaatctgcacataatagaaaattcatagaaataatatactttataaatgatatgaaattgaagagcctggaagatgaggcagaggggaacatccaagaaaggaaatttaattggtgtcatttttagcattagtgtggctagaatttgacttttatatatatacatatatataaaaaaggactgactcttttttaactttataagtttctcttgaagactgaactttggggttgggctagcaagcattttcattttattactatggaaagctatgccttcaggagagattatgaacaagtgtgttgcttctttaaagcaggacaaacactgtcttgtgtgtgagtttgttgtggtcaaagagcatattcctcagcgtgtatctgaaatccacatgtgtagaaatgtctcctgggatggaaatgaggagctatgtctgaagaatagtaaatattcacagcctgacatctagagtatatcaaacataggcagtgtcttcattgctactcatataattgtgactatccatgtgtgtattaattattgcagaatttaacttgtccatgataatttgtaaacagtattatagattcatacctgtgcatgaaaatacaaaatattttcatgtatttgtttgcaatgccacagagaccagtatgcacaaatttaaaccaagacatggctgttcaaagaaaattaatgtttaaacagttatcattgatgcttttgcactatttattaataaaattgtacattgtctttttattggaaaacttaaagtatatcaataatagtaaataactttatagtgatgtagaaataatttttaaatgtttaccagttattatttccagacttttattgcgcctgagttaaatttttaaaattttattatagtgatttccatagtacagactaggttcactcattctaactagtaaatgaaatggaatgacttaatttttatagtcaagtctctctcttagcatgcctttttttttcttcaaaaatgctaaaatcaaagtgga

SEQ ID NO: 31665 - DNA, 1099 bp, Mus musculus
aaaaagatataactagggatcgtttttaagaagtttttaatttatttttattttacgagtgttttgccttcatgtctgcatgtataccgcacgtgccaaatgcccacaaaggtcagaagagggtgtccttttctctggagcttggggtgtggatggttgtgagccaccatgtgtatgctgggaatcaaacctgggtcctctacaggagcaacaagtgccttatctgctgactcatcctaatggtggttttcctgttaaaaacaggctcttaatttcatatagtaaaagtaaatttaaagtgtcaaagttgaaactctgaaattataaggatttcaatatttgtaattacatctctttcataacatgccaggtgtgtttcttatcgttaattgacctcttttgtgcctacaccaacaactattgtgtggtttgttgccttattcatggttcttgtggtgatcacctggattttaatatgtctttctatttgttacagtcactccagttcttgttagatacatgtaaagttctagtcattggagctggtggcttaggatgtgagcttctgaaaaatctggtaatatatatgtataatactattctcttagagataagtaagttcttttgctttctgtcgtataaagaatgtcttcatttcatgatttttttctcttgaacatttattaggtaaatttagctggtaaaattctagacaataaagtatgtaatattatttgggaactctaaaagttttaagtcatatttttctttgctttttttttgcttccttttgcctagtgctaatattctattgaactaaatagcagaatagagagtttatcttttaatgtgtaattttaaataattatttttttcttttgcttctctaaataacccagctaggtgggttttagatcattttatccaaaatgacacattgaggtgcagcaaaaatcaaagcctccctcgtttttcctgacgtatagtgaggttcctgactctgatccaagtcctcacttattatatacagtgctcttttttacagaagctctgcatgaactaagatggtggtttttgatgaccaaatgataataaatgc

SEQ ID NO: 31666 - DNA, 1422 bp, Mus musculus
gggggacctgatgccattggccgctgcaggcatcagcgctcacgtgcataaacccacagacatagacatacccacccacgattcaaaaacagtagaaattgtatttatttgacattatttgatgctgtcacttctttcagtgatgttcatccacgcatccctgagacttcgcaacctcaagaacaagctggaaaataaaatggagggaatcggcctgaagaaaactccgatgggcattatcctggatgccttggaacagcaggaagataacatcaacaaatttgctgactacatcagcaaagcgagggagtaagcacagcccgcccagtgacggggccccgcagcaggaatccggttgcactttcccccttgttcagacccattttcagtctgtggtttttaaacagaaggtgcacgtcttaccacccacctctccaaggcatcatgcatgcacaggcccactgctaagatctccgatatgacccatagaaggcctcagaaactgcaaaaatacagacccactctcccgttgtgtctgaagtgtccggtgtgcttttgaaaaagagtgtggattagacggccacagtgccatcttatcgtagggaagaagtccctgtagagcctggaggcaatgtggaggacatgaagatcagttaaagtcgaggatgttgtgtgtcagcctgtttctaatgctgtctgacatcccctccaaaatcccctaagactctgatgtgtcgggtatgttagtttagcggtattatttttgttgttttaaaaccagaggctatcacttgggcacctgtttgatgtgcagtggaaactgggtcagccagttgtttatattttgtttacgaatatgaaggtagctgtttaggacaatgttttgttaaattttgtaaaatttttaaaagggttagtaatatgctttcaccagcaggtgtttcttgcaaactaaatgtcaacctcctggggtaggggtggggggtggggggatggttacaactctgtaacttctgttattcttgttaagaataaatacaatagaaccaaacttgagttctgtctatatggcacatttttcgttactacaacaataaaagggtgtccaagataatgatatttgaatggtttagattttttaaaagattttttattgcttttatttgtgtgtgtgtgagagagagagagagagagagagagagcgcgcatttagaaagaaagaaatgagcatgtattttattaattccttaggagatcagggagagcaaccacagttgagcttttgagcctgcaaagcttccctagagaaccaagccaaaggagtttaaacagctcctgtacctcaaagctgttgacagtacgcatggtggccatacacttacataaatagcactggagttaggatggcgtgagcctttgcat

SEQ ID NO: 31667 - DNA, 1182 bp, Mus musculus
atagaatggtgcaaagatttttttttattgtcctggttgagaagaatgaatgaaggtagggagaggccccttgtggactgatggtcttattctagatcaggatacaggtgtggttacctagatgtcaacacttaccaaaatgtcattactatatgtgaattatgtcgttacacatgaaaatgtcaatgctatcggtttactgtgacgttgaatcccagggaagcaggagtgacaggggatgacagaatgatcaggagggtaagaagatagacaggcatgcatgtgatgtgtaaggaagtcagcttgcttagggacaggctgatggcatggtctcccacagacagcttaggaagtggctttgcgaaatcacggtgctctggagagtgctggggtcaggggttggatcagtccttacctgtcatgtcttcagaggcccggaggactctgatggaggctaaggctgaggccacggtgacctggctctgcagctgtcggaattttgcaagacatcaccagagttcctctggccatgacagaaagcctgtgctcggatccagggtggagcacacctgaggcaggcatggggtctggcggggctgagctgtggctaaggtgaaacccgacaaagccaggatgacgaggtaacagtctggtctccaccactcactaggtaagcagctctgagacggtgacctaacctctctaaacctcagtctgcctagagttgattgaaagagcccccggggccttccctagaggaggctgtctctagacagttctcacacacactgctcaacttcctgcaccttctgtctggccataggaacaagtctcctttgaagatcgaacagtccagacactcttgagtgagggcaaacaggcccaggagcttaagtgctgaaagactgaagcagtgatatgattgcagccacagagtcctgtgggaaataccaagggcagtcacactgtgtcaggagggcttccggtgaggttgagacctgctcactcccagtgataaccgagacaggaatgcgccatgttgaagcttccttcccttcttgtctcagctcttcaaccccctacctaggctttgtaggaacatgtccccaaacatgcttatccttaactcttcgtctcagggaaaacccaacctaagggcattacgtgactgccgccccatta

SEQ ID NO: 31668 - DNA, 1156 bp, Mus musculus
catagtacaaattggttgcttgcgcaattagggtttaaaggaactctagatagccactacccccaagataggttgataaaattcttaaatgtgcatgatatgatatttcctaagatgacttccttacagcctttaaataatgctctattgatttttactgatggctcctctaaagggcgagctggatatcttattagtaatcaacaggttatcgtagagactcctggtctctcggctcagctcgccgaattaacagcagtactgaaggtttttcagtctgtgcatgaggcttttaatatttttactgacagtttatatgttgctcagtcagtgcccttattgaaaacctgtggtacgtttaacttcaatacgccgtcaggatctttattttcagaattacaaaacatcattctcgcccgaaaaaatccgttttatattggccacatacggtctcactctggtcttcctggacctctggcagagggtaatgatcgcattgacagagctctaataggagaagccttagtttcagatcgggttgctttggcccaacgtgatcacgaaaggtttcatctttctagccataccctaagactctgacataagatcacaaaagagcaagcgagaatgatcgtaaaacaatgtcctaaatgtattactttatctccagtgccgcatctaggagttaatcctagaggccttatgcctaatcatatttgacaaatggatataacccattatgcagaatttggaaaactaaaatatatacatgtctgcattgatacttgttcaagatttctttttgcttctctgcatacaggagaagcttcaaaaaacgtaattgatcattgcctacaagcatttaatgccatgagattgcctaaacttattaagacagacaatgggccatcttattccagtaaaaactttatttcattctgtaaaaaattcggtattaaacataaaactggaattccttacaaccccatgggacaaggaatagttgaacgtgctcatcgcaccttaaaaaattggctttttaagacaaaagagggtcagctatatcccccaaggtcaccaaaggcccaccttgccttcactttatttgtcctaaatttcttgcacaccgatatcaagggccagtctgcagcggatc

SEQ ID NO: 31669 - DNA, 1182 bp, Mus musculus
ctttctttttttaaaaagtcattcaatggaataagaaaaaaatagaattttcaatgatttctaaaatggttttgccattttatactacctgtgttcccagcatggatggtcataaaaatcaaaatataggccacctctacaaaatggctgaagatgttcggtgatctctagtgccaaagaatcagccaaaggtttaattttttatataaaaacttgcaacaaaatccactaactagtatgtgaattctttaagtctttaagaagaatagaattatatgtatagcaaaatcattttaaataaacttctttatgatttattatcaataaatttttggttttcatatgtattttatatgcctgtataacagagtcaagtaaaaaacttttccctttccggcggtgacaacctccctacgagaacatgcctctcgcaaaggatctcctccatccctctccagaagaggagaggaggaaacacaagaaaaagtgcctggtgcagagccccagttcctactttatggacatgaaatgcccaggatgctataaaatcaccacggttttcagccatgcacaaacggtagtcttgtgtgttggctgctccactgtcctctgtcagcctacaggtgggaaagcaaggctgacagaaggacactccttcaggaggaagcagcacttcagcccctggttgaagatgagtgggaaccttcccaataaacacgttttggatatataacaaaaaaaaaaaaaaaaacagtttcatgcaaaaaggaactgtaaataggaaaaacttgaggagctcttgtctaggacctaagtggatataaataccactatagcagattaactgtgctaaaaagaaagggacaggtactttgaaacactactgacatgcgagccacggtattctgtatttataacccatctccatgtgactttacaacttacaccccattcctgttacagtaatactgactacccatacctccatacacacccccacacaagcttcccgttatctctagcaattgtttactgagtcacaaccacagattgatactatatactattataactcaatattacatactgaattataataaaagtgaattctcagaagcatgagatggaaaacagagtagatcagtaaggatacaatcctgaatgagatggaaaacacagtag

SEQ ID NO: 31670 - DNA, 2519 bp, Mus musculus
caagaaagactacttttatgcaaggtcttgtgttcaaagagagctttgcaaatattttgtatattccactatcacttgaaactgtttttcaacacatttaaggtgtagtattaataggttaacaaccaggctttctagaaaaaaatacttacatatgtatttctagggtattaaaataactatattcttgaagattgatagccatagcatttaccatgcccatgatggtcaattcaattaggatttatttcaacacaccggctagattctttttaaaaagagaaacactgtattggcagattacttgataacaacattttgaccaagtggcaacattgtaaagttagtgtctgtgcattgcttacttgcataaccctatgcaatatctgtagagttacatgtatcaagtctagatgttttgtgcaggtgatacatactggtacaagccaggctgcctaatggaatttctcagtagcagcctacgattgaatcctgtgtggcataaagcataccctttcagaatgaagtgccttaaaaatctcagcagtctcttttggaccagcactgactgaactgtaactaggagaaagtttcaagatggaatctggagtgaagaaggaagacgtagcgtggtgcctctgtagacattctaagagcttccaatttcccttcagatatttttaatatgaaatatattttactgacagtgccaaattctttcatcaggaaacctttctcaggagggttttttttttttaaagtgtttaaatgtcaaatgtgaattggtgatgggtgatggagagatccaagagcagtgattgtcagatgtatgaatggatggccttggtgagattcgtcaagtgcgcggttcccatgcatgttgggtaatgcaaatctttggaaacactgatgatgctatccagtcttgtagctttattacttaagggggtagggaaaataagttcccattctttcaactcccttaagtgtgtgactcttttcctagaatagaaatgcaaatgtgcatgaaaagataattgtaccatagtgttcaccgatacaatcatagcattgtctgtttttctcttcatatttatgtggggggggggtgcggggagggctggatgcagaagttgaagattgcaatgctatgatgctaggttttcttagctgattctgacattttctttttttccttttttaataattgaacaaggtttcacaaagttgactatggccaaggcagagcaactttctaggaagctttgttgaaagaaagtatggcatattgcaccattaccttggcttgtagcctctgagcttgccaccatgggctttccaggcaccttcctcctaagacacagctgctgggagaggcaggcaagcaatttagaggtgacaacatagggaatggttttatttatttcttttgtgccagccagaatgtggattctttcagggactggttaagccaagacgcagtgtttttgctcactgtttttaaggagagaatgaatgatccttgcctctcactccccaacccctgggtgcagaattgtatctcagggttggacctccgtttagagtgctcaaaataccaaaattatccacctgcctctgggtaaggtaacggaaataccaaaccttctgactttgccaaaaactgtgcaagcaatctggtcatacccagagcatgatgcagttcagtttggttgtttgtaaacaataaagcaataagaataaacaaaatgcacaggacattaaaagatataaacaaagcacaaaggaatgtaacttgttaatatttctgaaaaaaaatgcactggggagaagttgatgttgataatagtataaaaattacccaacttcttgacaaagacaacaaatgactgtctcttgcagacacttgctactgtaatgtcaataacagccccccgctgttgggtacagcaatactttctgtatggtccgcagcactgtatattatgattgatattaatgtatccaatgaaataattgaactgttgttcttcatagcctcattaaagcatttggtttttcacattgtgttgaccagttgtgtccagttcatgcctgttttcactgatgtagatgttctcaaagcaatgacaacatatcccttcctctcagctcatgaataagaaattgctagaaaagtataattgccaacagctctctgtttagcttgtgtcattcgaagatggcacttttttagttcgaaacatttttgattactttatgacttactctcaaatgagctataattatgtagtatttcccctgttctgaatttggggagactttgaactcccagacgccaggaatctactttagatataaggggtttatgtaaaatatttcagggcgaggcagctttattaaaaaggagagaaattgtcagagaaacctttgcatatttactgaaaagatcctgggtttttaaaatacaaatttataataatgaatgcttaatatcccagcccgccagctccttttta

SEQ ID NO: 31671 - DNA, 1883 bp, Mus musculus
gaaaagaaaagaaaaaaaaagatcccaaaggctgcaccttacacctgaaggtccccacacggggacatgacatcctgccagtaagagaatgaatgacagaaaaggaaagagagaaacgcacgcgcgcacactctagggacatggcagattcatttcacaaaaacagtattgggggtgggatgggggactgttggaggtttttcttttttttctttttcatagcacccaccattgtgagtaactgccaccacattctctcagcatcaggaaacacagccacgaaagaaacagaagagaataaacaatcctcaatagttagactgtcacagtggccatggaagatcttccctcctataatcaggtgaccaggaccacaggccctgtgccatcctcacccgcacaggttgctctgtttgcaaaatgaccaaaaagccagcatggtgacagggctaagtttgtacagtagttcagacctgctcggtggcattcatctgttttaatgcaaatgagacttcacattgaacttgttatgggagttaatgaggactgagctcagcagacgctaatgtgtcaggttccagtgtgctaagtcggtactgcagcttggtctgcaatgtgagcaccacacccaccaccccagtagcacagacttcacggaagaggacaccaggtagacagaccagggcccacagaatgagatggctctaggtcaatatgccctcggcccttcaaacccctccacatttccgtctgcacccgcttccctggcatgtatttatctggggctgtagcttttgtttgggtttagtttgagagcctttcggagcttaatttatatactttgtacctttttttatttctaaaattaccaaagatattacgcaaaggtaaattattttcttttatactttatctgatgaagccaaatatcctcttattgttgatcaaaggaggcgaaaggattcagaggcaaatgatgaggtccaggctatttgccaacctgagggaaattactgcccgtcagcagagttcatttagcagactatgtaggcaatggaaccaaagttttttactttttttttcctgttttttttttttttctctttccttcttttctctacctgtagagagaccaaaactaactcctataaggagaaaatccggggctactgcagagaaaagaaatcaagacaacagtattatagctcctgtggaaagaatgggctagcatctcaaagaaaaagaaatgaatgtatgatgctgaaaattagtatataatcgaggagacacttaggatgaattcagagagaacggagaagtgtctggccgctcgaggccacttctagaataaagagatttttagaacattcgtacgccacttttgtttaagggctgtgctctgatcactgcgttaatcttggtttatcctggcatttatcctctggtttccttctgctttttgttgatgttttgttttatttttttcctatttcagattatgatttggtcagtgtttttcatttacacacaaaaaaagctaacattcccacccactcataagcttagagtagaacacctttggcaatgacttctgaaggtttgctctgctttctatagaggggcggtctgtggttattcatgccccctccaccaccaccccacccatcttttccaggcagcttcacagtgtgcaggcagtagccaggccgggtcatgggaagggggccctgtgcttctaaactgagtggttgctggttagatatacaaaagaggataaaactctggtaggttagttcattctcagcatgtgtagctagacaagagtaaagataacagcatggggactgttagtacgcacacctcagttcaaacctttagggaat

SEQ ID NO: 31672 - DNA, 1316 bp, Mus musculus
tggcctcatatggcccctaaccccttgggctgcaggcagtgaaaatgtccagcagtcataggaagtttcccaccgtctttgaaaaacttggttttggctgtggttgtggccaaggttaccctgcctccactgggcggcatctctgtagcacctcttgtaggttgctccaacaccagcgtcagggcaatccgggtgttcccctaagcctgtttctctctctttctctgtaggcaccccatacacgtcaaagaagaacccctcgaccccgaggaagctgaaggccctctgtccttagtgacaacagccaaccacagtccagattttgaccatgacagagattacgaagacgaaccagtaaatgaggacatggagtgaacctctgggcgggccgacccccgagaccgaagattggggaaaaaaaagcaaaacaaatttaaaaaaaaaataaaaaaagaaagaaaggaaaagaaaagaaaccacgtcaaaagttagcagtgaaacccgccctccgtttcttgtacagtctggaggattttcgctacattttgacaactctgaaacgtgttaactcttagtgccatcaagaatcccatttgggagtatttttgatttttctactttttgttgacaaaagggatttgtactctgtgcattggatggacctgtttggtacttgggattttcctctttgagtcaacatcagtgttgtaaattcgataaacggattcacttttagcagcagactttgaactgcagcttcgcccggctgatgctgggcgggcgccgaggacacccgactgagctcacgtacctgcgctgcagaccaagccttcgcccgagttcaagactccagtggacgacctttttgcacagcgctgcatgttgataccactgcctttactcactttggtttgttttgtttttgtttttcgcttccagttgggatgggggaaggcctttgtgtgtgtattggggggaggggttaaaaataattatcccaaattttttaatgtattgcttttttttttttcttttactgtttttttttctttctttctttttttttttggcttctttaccattttaagttctgacctcaggcctccatttgggcccagggcctcttggaggcttcgcgttttctgtaccttgtgatgaatgttaataggcgtttttattatacagagctgaatgtcatttctcgtctgtagttttctggcactcattccattttcctatagacatcaccatgtttctctcaagtttaaaacaaaacaaaacaaaacattccgttttggtctttttccaaaaaaaaa

SEQ ID NO: 31673 - DNA, 1172 bp, Mus musculus
aaaaggaatttctctctctctctctctctctctctctctctctctctctctctctctctctctctctctctctctccctctccctctccctccctccctccccccctctctcctctttttatctttttgtcacttcccagtctctccctgttctcctttctctttcttctctctttcttctctctccttttctgtttctcctcagtggtctttctctctgttttctcacctctctcttttttctcctttctttccccttctcttttctccccaccctctctctatatagtaaccgtgtttctggtcaagttatggaaaatccactatgcgttcaagcactctttagccagactcttcatcaggcttcggcattaacaaatctgagtctgaggccccagaagatgtgaatctttattagtcataatgagtggctgggacacaacctcataaaaagcactggtagaaaacagggggttaatatcatgagttatagatcccgtggttgatttatgctcacatctgacccctgtattttctgtcttgagcaccaaggaaggactgtaccatttcttcagtctggactttaacaacgggagaggtaggcctgatgcaacatccaagctcacgtctatttacttactttatatatttttttactgtgtgtgaatgagtgctatatacataggggcacgagctgttctgtgtgtaaggtcagaggttgatgctaggtgtcgtctttcttctgtggctctccacgttctttctattatcaatttacatttggcattttgtctgcctatgaatgtgcaccacatgcatgagttacagttgtaagtcaacatgtgggtgctgggaattgaacctgggtcctctgtaagtgcggtcagtactctaagccaactaagccatctctccaggccccgtgttatttcctgagacgggctctctaactaaacctgcagcttgctggtttggttgggctagcttggctggtgagtttcatggatcctcctgtctccagtgtctggattgcaaacttgagcccctgtatctacctggcttttgtgtaatacttgagctctggcctcaggtcctcatgcttgcctattgaactgtccatccatctctctaatccccatgctcacactttagacagttcctaataaacttga

SEQ ID NO: 31674 - DNA, 1102 bp, Mus musculus
tatactttcttcctgacagtaggccctgcagtctttttgtactggtaccgacttcttttcttccacgtgtgatttttttttttttttaaataaaggctacactggttttattcatgcaaagtttcctagagaccatggccagttttctacagaggctatttttgacaacctcaagtggcattacctttgcgttgcagtgaaggagagcgagctaggagatgttggagatggaagagagggacagagttgtctaaagtcccctcagaactgcaggccacagggccaggtgagctgtgtgccttgtttggggggtgtgggggacttctcccagtggtgacactgaactttaggagaaaatgcgaatgggtaggaggacggtcttatttgagtcacttaaggagcaaggtctggggccctgtgtaagttattataaaacaatgcatcagcaaacagctgctctgtagaccagtcttggatggaaactttctgtgagactgtgacttttaaacagtaaaaagtgttttggatagtaatgtggagaaaaaaaaaacagtattgcatgtgtttgtaccgattgtgatttgcggatggggtgggctctggagggcagaaaaatacaggtttgtttgggttaggggtttgggggattttcccccccaataaaaagttaaaatacttttgtggaaatggcttgtgctttgataagcccagttttactctgtattatgagctaattttccctctgaagacttgtctgtggttaagaagatatgggatataacggtgcctctcccaggagacaagcattttcctgcggtgtttgctaagttaggtggtgctgttctactcatggctgttttcaatgattaataagaaaccataatttaaaatacgatctctttgttagacattgtcacttgacaccgaaggacttcattgcaagtactgtataatactttttgcttaaactgctctgtttttattaatgtaacttgcgttttgaagatttctatctgtacttctctttgcattacacaaatataccagtattttcactctggagtggctgttttgtttttgaggccaaatctcttaggtctgt

SEQ ID NO: 31675 - DNA, 1555 bp, Mus musculus
tttttacatgagtgttggagagcaaacctaagtctttaggcatatgtgcaaagcaccaagcaccctagctactgaaccatctccccagacccatctgtagacccatctcttcttatagggacactagtctcaccagactaaaacctgttaaaatgtcctcagtatgatgccacctgtgctatggtgtgtgtgtgtgtcccgtgtaggctactgtgtggtattcaatctcagtgcagtggtatgagaggtaaggcctccttggggtttggttcaagggagtgaggtcttcccaaatgtgtatcaatgactttgtcatagcagtagggtcggctagctgggaatttgcccttttctcttgcgtgaggttgtcctctcctactgtctatttccaccacgataggcctacaccagatgcagctgcatggactagaatttcagaatcacgcttttccgcccactcccccctccccccgcgtgccgctccggctgcaccgagctcgcttccgcgctgtcaggctagcgccgccgtccccagccatcaccatgatcatctaccgggacctcatcagccatgacgagctgttctccgacatctacaagatccgggagatcgcggacgggctgtgcctggaggtggagggcaagatggtcagtagaacagagggtgccatcgatgactcgctcatcggtggaaatgcttccgctgaaggtccggagggcgaaggtaccgaaagcacagtagtcaccggtgttgacattgtcatgaaccatcacttacaagaaaccagcttcacaaaagaggcttacaaaaagtacatcaaagactacatgaaatcactcaaaggcaaacttgaagagcagaaaccagaaagagtaaagccttttatgactggagctgcagagcagattaagcacatccttgctaatttcaataactaccagttttttattggtgaaaacatgaatccagatggtatggttgctctcctggactaccgtgaagatggtgtgactccattcatgattttctttaaggatggcttagagatggagaaatgttaacaaattggatctatcacctgtcaccataattggctgctgcttaccatccatacaacaccaggacttaggacaaatgggactgatgtcatcttgagcttttattttgaccgtgatttatttggagtggtggcattgtttttttaaggaaaaaaaacatgtcatgtgggttgtctaaaaataaagtgcatttaaatccaaaaaaaaagaatttcagaatcacacccatatcaactcccctttataaactgcccagtgttgggtttgaaaatggaccaagactgtctgctaagaccctcatctccaaataaagccatattcccaggtaccagagaatgagggcatgagtgtgtctccactcctgtgcacccccaaggcacagggcctatcttagccactgttgtattgctgtgaaaagacaccatgaccaagtcatcttataaaagacagcatttaatagagggcttgttgacagtttcagagagttagtccattg

SEQ ID NO: 31676 - DNA, 1205 bp, Mus musculus
ttagaaaagtcatttttcatgccctctcccacacacacttgtgggatgtttgggggtgggtgtgggggtagaaagtatatttccttcagtattcgagttaccacagctgaagttattttgagtgtcttagtgtgcagatcatcgcatagtaaaagaaagatcagagctacagaatcattgagacttggaagaaagcaattgtgtctgtgctcccttaagataggctgtagatgatctgaaggaggaactggagaggtcttcaagcatttgaaagccctcagtcagcccttgctctccacagagctcactaagcctgtggtacccagatggagtgaaacagggtgtctagtccccaaaccccaacctaagactggctcttcaacctgctgctgcttgtggcctgccttgaggattcagcctgagggactccttgtccggttctgtgcttgagctcacactgaagggaagagtgcatatggagtcttgccttgttgaagaaacgcttacccaatggttcctgtctgcatttccatcatcgttcaggtcttctgaaataattagcatggggtaaatggtgatggtgctgatgtttgccccaagacgacctaggtgtagaaaagtttcctgttgtcttcctccgatgctttttgtggtacttgcaggcggtggggctccccactgatagtggtactggggacacttgggtgaatggaatctctcatgtaacttgtctgagcactaggcatcaggaagagtgtattgacctcatgacctgagaggctgaagctgctgctcagctaagttgtcatggacaccaactatcctgaccttagaattgcttgccagttgagcacagtgtggtaagtcacttgctgagggaattgtacaaggccagaatggtgttaaaagtcacaagcagtgcccggaacaggacagaaagaagtgtcttgttccttgcaaataaaagcaggacaaaagtagagcctttctggaggtaggctggtaacttcagccaagtactgtttgctagtcactgagggaaattactgcctaatctaattgcccagtggaaggagaaaggctctcattttcccaaaaagactgtactccgtacctgggaatacaagccattgtggggcccaggcaaatggtggagtgaaaggtatgcaggctgtgtggggttggggagttgggcatctttccac

SEQ ID NO: 31677 - DNA, 2626 bp, Mus musculus
gcttgccgtgggcatctggctaccaaggaatttcgtaccctgacagttactcttgacacttttatgtattccattgttttatatgattttcctaacaatcatttataattggatgtgctcctgaatctactttttatatatatatataaaaaaaatctgctgtgcacaattttccatgtacattacaactggttttgtttctgttttgttgaagagggttgggaggggggagggaacttttatttattgtgttcacagactccatcctgtcagcatatcctcttaaatttagttctttcttccagctatactctgtactatcagttttgatataactatatatataaatataaaattatatataaagggttatttgaaaccaatccatggcaacgctggtgcttgatacactgtgaagtgaatacaacattgaacagttgacacagatctgggacagtcccttctatgaaagtgctgaaatatcattaaaatcagtcttacatgaagtatgttccaacctgcgtgggaacttgactctctcatctgtctttagagtactggataatataaaaaatatattttttaaacaatgtgatctcaaatttaaagactgctccagatagcctgcatttgcaatgggctaattgacaaatgacaagtggttcagttggagggctttgaccattcggaagtaacaagactagctccagaatgccaagtattcgtgtaaattatggttacatgttaacattgctgtttttattaagcactcatgagaatatggtgttctgtatctcgaattccggcctttttccagacctctgctcacgcctgaggtatatctagcagctgtcttagttctagggttgcggtagtgcatctttgaatccacaccacccagggaagcagtctacatcctctgtggtgttgcagtggtggattttgtgatcatggcctgttttactcctcctcccgtaccccgtcctccaaatcctcaccctaccaatgcagttgttagtctttcttcttaaaacctactatggctcattttattaaacaagggttgtcaacctcacatccagacctgacacagagatcttccagtctctggagtcagttcttagttccttgtgtgggaaaggatcgcaggggtgcatgggcgagttgcggggaaagctcacttcccaggagagtgaatgaatagtaggtgttctttgttgactgaactcttgaaagcttttcattttcaccattttaggggtaggagataatgaaagaccactgataatagtttatcatcccatcccaagtctcagtgactctgctttgctcttagattcagggtatctctcctatctgacttagcttcatgtccaccgagtttgtagtgcttaagtcacattaagcatgtggtgttaaccttcctttagtttatcacactcaaggactcataggagagcgtgtaagggaacaccgactcttggtggtaaaagaaccgggtttgcttaataaaagaatttctatgtgtggaggcaacaagttaagaacatattaacagcttgaattgagtagccaacaggaatggttccattcacatttacattaaaaccagtcattcgatgcgccggagtctgtccacaaaggcagtgctatttgtcaatgggctcctgttctcgacgcatggacaatgctcccctctttttaaaacagtgcttgtgtctgggatgcaagctgtacttacctttttaaatacctttttaaagtatttattaatgaaccaaaggaaaccaggtgctttctgtaagcatcagaatatataatacatagtgatttgactatgaattttaaatccacattttaatattagtggggtattgcaaagacattccttctaaagttttaatattccttttattaagggtctcagggagggttaattagtcagccatatttattttccagaggtgtaaggaattgctaagttttttaattaactttttaaaaaaaaaattaaatgccaccaaattcatgtggattgcactgctctttgaaccaataagtgttggtatgcactttgttcagaaacactgtgtactttttcaaaacgagtttcatgtaaagtgattggaccccctagattagtggaaaaggctgatttaccagctcctcataggctactaattcattcatcgctggtgtcttgggttttcagttttgcctccatgataaattaaagaatgaggagaggtgaagggagggaaggaccacttcagaactagtgaacttgccttgaggtagaaactgcagtggtggagtctaagcagtcagatgttcctggccgccctgtctcggctgtcgtgggctgcgttgggatagagaggtgataggtgccacacaatgccatcctcaggcatgcattctggaaatggaattcctattagcttcctgcatttacagtttgccctgctatagtactccgtaggtaaaaacactagtgtagcttacaaagagacattaagaggaccagaaatacttggtattcagtggcacagaaagaaagcagattaaaacaaaaagcacagtgttaaggcttgcaagtttcccgtgcgtttagtacatgatcttt

SEQ ID NO: 31678 - DNA, 1204 bp, Mus musculus
agctctagctctgtatgtagaccaggctggcccttgagatcttcatctgcctttgcctcctgagtgctgggaataaaggtgtattccaccactatcggcttcttacctttttattttattttgggtcacaactaaattttaaacattttaaattagaaagaaaaaaaattattttgtatgttcgtgtgagtgcaggtactcacagaagccagaagagagggcattggatcctctggtaccttgtcaggtgctgctcgttttgtgggtgctatgagtcaaactctggtcccctctacaaaagcagtatgagctcctaacaattgagaaacccaacttttaaatcaagcattagacacattacagatttctgcctcaagagctggaattcaagaaagacaggaaccactgcctgactgaaaacactgattttttttttttttttttccccttcgagacagggattctgtgtagccctggctgtcctggaactcactctgtagatcagactgaccttgaactcagaaatctgagttcacagcactgcatctgcttcccaagtgctgtgattaaaggtgtgcaccaccactgcctgctaaaaacactgatcttaaaagacttcctactgtggaagatcttttgatgtcttgggttgtattgtgtgagtgtgaacctgtattaagtgacatggtaactgggattcagaggtgtgataacatccccaaataaagcttggggtgtgtatgcacagttattagttattcaaaacataaaaagggaaggatttatttctcagcacaaagaattgttattttaaaagtttaagttggggctggtgagatggctcagtgggtaagagcacccgactgctcttccgaaggtccggagttcaaatcccagcaaccacatggtggctcacaaccatccgtaacgagatctgacgccctcttctggagtgtctgaagacagctacagtgtacttacatataataaataaaaatctttaaaaaaaaaaaaagtttaagttgttagagtgatttggtcatttacacattatatacctgtataacatcattatgtttcatgattattccaagagtcaaaagtattttttaaaaaatcaaaatcattttgaaaatcataaagcataaaaattggcattgaactccttaagtatgcctatgctaatgatgttttattggttctg

SEQ ID NO: 31679 - DNA, 1209 bp, Mus musculus
agttggttcttcccattacttttgctgtgtttccctccccctcccccccagccccctggctttgcctaaagctgtatgtgtgcttgaccactagaaacccaatccctcgtggtcactgaggtgaggccagctagtggtgcttcatgttccctctgtaaggctgaaggccatgcctcgagcctctagctacaactctttgtaatcccatggccggggccttttgctgtcataaggagacaagcagctctctggtgctggcagttctgggctcgtttgggacggaagggctggactggcagaccccgaagctcacatctccgagccctgagagctagaggtctatcgttctgagcctcagctgccaaaggcttatatctctaggtactaagattggaggcttattggtcttggcttaaaccaccagtatctctagaactggtagtgattataatccttgcctttcagaagtggcagcaagggcctgaggtgtcatggctttcaaatgggccttgggtgttgggaccttcatctcctacagtgtctagaccattggtccttggtaacaataggatccctggtatcaggtttatggtctatgagatgttggcctgtacggcttagcatgaccctgggactcatagagtaccatgggttctcatctctgacttcacagaagcctgcctttccccagccttagctctctgctctcttttgcctctacctccattacccctcactccctctgtctcctctgcttcttgtttgtaccctagatgttctctagacccctccccttgtcccctgctgtagccagggcccctgtggccactccaccagcttttaccatcttatgttagcacttcagtccagtatcaaaactgggcccaaaaggccaatcaggagaagccttttgttaaactaatactgccacatgggaggagtctctcccaccaaaatgtggaagcggagaaggagggtggggatggcaagagtgtttgctttggttagggcagtacttcatacagatgtactgtattggtgttcataccaatcatggaccttcctctgggctactaggggaaaaatctcctctctagcctggatgaaaacagttcccagacttcaccaacacttaagatgataaaaagaggggctggagagatggcttagtggttaagagcactgctcttcctgaggacctgggttcaa

SEQ ID NO: 31680 - DNA, 1187 bp, Mus musculus
agttcggaacagattgttcactatcaaagttgtaccgtcagttcagatgatgcatattttaagttgtaaagtagtgagtgcgaaattcattacttccttctgtgaggaggtaaggttcggtccagcactgagacaggtaccataggagagtcttattctcccaagattaagagtggaccagcagccttgtcagcacctcagctcagagctgcttataaagccaggaagcctgtcctcaccctccctcatcagatccaagtctgagtccataggcacgcctgtccccttacgactctaagtgatccttctacacttgtgggttttcagtcacctttgtgatttgttgatgcagtgtgaagaattctgaagtgtgatgaagtgaggcgtacgagaacctggcttgtgtcggtgatctaggtttacacggtttaaccaaaccgccactgttctttctcattgtgtgcttttgttgtgtaatgtactttatggagatgacttactgaggtgacttttcacagacctggacagacgttcatgaaatcctggtgtcctttggaaggagagttttgtgctatccactttatcgtcatttcaagctggtgctgaaagcctaccgagacactataaagatactgcaactaggtaaggtaggcttgcagatctgggcattagaagttgtaaatttttagtaagtgaagatgcaatcacgagttttgctcttttctatatgtaaataatgaaagtgatcaggtcccccacccctcaggatataaagggcacgctgaccttttctaagaaagggaggataaagggagaagtgtgcagcatccagagcccttcacactgaacattccattgctcattatgtttttttggaaccctataactttctaggcactgaggtcatgtggatccaataatgaggatagaaaattctcttctccagtgagggttacagctttgtcagagataactaaactgacagttccagtacagagccccagatattccgcctgagaagtacagtgattgttaggaggggacttgtttccaagacttgggaaagcaaggacgttccaaggaacggcatcactactctcaagactcttgactgccgctaagtttagcatgaaaagtcaatactttctgactataagagtatggaaaattccaggcttcaaaacaaa

SEQ ID NO: 31681 - DNA, 2263 bp, Mus musculus
tgggagttgtgctcaagcattagcttgctgtctgtagaatgagtgcttcggagcctgacatgaaaccatctcaagagcccacaggtcccataacattcggttgcttttctgaacactgtcaacatcacatctgtctttctgaataatcctatatgccgcatggcactggtgtgaaacatcactgtactggaagaattagtagaggacttcagtaatgtacctgagctaaaatgaccgaggcgttaggggtgcacagaaaccaccatgatttgtataacattttgaagtgaattaatatttttgaacatgcttcttcaacagccagtgttatatttttcagatcaacacaaagcacaatggttactactctataaactcaatattttcaaattcacatatttaaagtcatgcaagctgcaacttccctgtcagaattactggctgccaaatttatacctgtttcttcagctgtactttttgatatttagaatttttaaatttctgtaaagtaggttttgtagactgtaatgtgttcactgcctttgtgaagcggtatattgtataatttcgtgtgtaactgaatgcttgggctttcaatacagtattcatataaagcaataaatattaatgttatgaaatattggagtacatttttatcaaaatacaaaatctcttttttagtttcagacatctgaggtacagggatggacctaatagctgatacaaacagtttctcacactttatctatcctaagcttcgggtgatcagagggaaaccacaaggtttgcattttgactgcttagacgttactatggctaaaaagatatttggctccgtttgttcataaagtaatatgctactgactgatgaccttcaggttcacagcagctggacagtagatttatgaatctgtctagtaaaactgtcgatttactgtacccaaaggggtgaaagtcaaatgtaacttcaagttttttggcaaaaagattaaaatgaagcaaaatttaagtgtgacattcatttgtaatggcctgttagagttgagggattgacagtaagagcagattttaaacattttaggtttagagtttttgagattttccttaggatatttatgaggttgttgtcaataaacctgttctctaagctcctgtgacctttgatagtctttatttatggtgccatggaccatttacaaacaagtcagtttgctgttggttaaaagttgaagatttcgcatcatgaatagaggtctgtggctttatttgtaaacttgcaattgctatctttgcaaggggaagtgtatttctttattaaataaagtacaattaataatggtgaatgtaccaaaatgacatcactcaattctatgagaggtctgcattttaacctatagtttaatagctttaatatttattagctattcctatgttgatcatagatgaaagttgttgctgtttatacagatacacgtaggatactggtgaagggtctctagggcagttgtaatattcatcaccgtgtgaggccatgttcagactgtggatgcattggtcccttggaagtccatttccacacgtggtgttagatgcacttacaggagactgcaggaaagtgtcagttctaatgagcactgagtcctttgtgagtgacagaatgagacccaagagggagggtcaagccgtcccgtggctgaagtagctggctctttgatgttgaacagattcctaaccgggttctcctttcccaagcctaactcagatctgggcagtgctgatggtgctgacagaatacacatgacatggttttgccacccctcccttttaaaaagtgaaaacattttgaaaactctataaagttctgtacatgtagaacagaagtgagtagtgaaaatatattttgaggattagtaaacttaatccacttaattgtcacaactccggtctttcccatatgtagccagagcaatggagttacaactctggctttcgaaagctattccagaaaccctgccccagaaagtcttaaagcattgagatccttgtgttttattttggcagtgtagataggcatgtatttatgcatttgtaaaatcaatttttttcaaataatgtatgtaatgtactagcttaaacggtactgggcagagcctagagctactgcgaggattgaatgtgaagccggtatcgcgggtggaaatgtacctgcagagctacagcaaactattccgggtagtgtttcaggctgcctttgagcaggagt

SEQ ID NO: 31682 - DNA, 1190 bp, Mus musculus
agtggagggaaaatacacccttactctcttagaaggcaatattaacaagcagctttttttcaaatagcaatggtaattttttacttgttaacctttttcataaagtgtttaaatttccaaaagatcttttattaagcatactttcacagaataatttgtttaaactatattcatataaaagaaggttaaacacgctttttttctgcctaaaacacaaaatgcaactgccagtatgtatttttaatgggtccctattttgtaatgtcacttcgctgaatgtgtttcatacaagtcaccattcattcatacagcttatatcagttggggtttcaacacaaaccagccaaagtctggttggtgatttgacacacacacacatacatacacacacacacacacacactaaccaaactagcagcatttctagtcgggatatccatttttaacatttttatggttaaggttcccaagaagagtgtcaaggttttaacagaaagcaaaatttcctgcagctttgtggacgcttaaagcatgtttgcaaatattgccgcctgttggaagaatttgcatgtacagggaagtcgcggatggagacctgtttgtggagttttaagtgctcattgttgtagacctttgctttgtagattggaagggacagacttaaccaagcaagttcacaggatcatgattagttacaaacatcaagtaaaatgaagttaaaataaattattattttctatttgacctgctctgacatgggtgtttattttgcactgtcggtcctctgccctttcttggtttatatcaccggctgcctcttttaagtctttcagaccatcagattcctccattcaacctagagacagatgacaaaacaaggactgactagtggcaaagaataggggatcaaagataccgtatccccctgggctttggtggcccacctcccaggaagctccaagctagcccggtatcctatggtgaggaaagcttgtgagcaagtgcatctctgccagggttgtgtttaaaaggcaagtgctttggtttactccaactctactctgcccatcttaacaaacatcttgtccagctttccacctctgagatgtgtccatccaccaggcaatggctttctcagcatcgcagatgtcactaaagtagctgagcttggagacaggttcccttccagg

SEQ ID NO: 31683 - DNA, 1147 bp, Mus musculus
caactgttatttattttcctttcttgctccccctccaacccccaccagtccctcccacccacccggttcaccccacccctaggtttggaagacacagggggggggggcttggttataactaggaaaatagacagaataggaaaaaaaaatgatttttcaacttctcagttctagctgtcatgcctttccattgcacacgggtgtaacagaaacccctttctgattgcatttcccggaaacttaaaaagagactatttgtaatcataattcagattaaaggagagcctgtgtagggactagtacctttagatgacaggtttggaagttaagagactgcttgcctggtctttctaaggatggaaaaaccacccattcctagatcaccccctagtggcccctcatgtctgtgcaaaggaaatggcaaggcttgtcctagctctggaagcacagcagcctattgcctccctccagggtggaactagctgtcatgtgacacctggttggaagcaagtatggaaaaacttgggctggctttactgtgcaactccacctggtctgtctgtctgtctgtctctctctctctgtctctctctgtgtctctctctgactctctgtctctgtctctctctgtttctctgtttctctgtctctctctctctgtctctctctctctgtctctgtctctgtctctctctctctcttgtccgttcctgccaccagattttgctttgttttgagacagggtctcctgtaagccaggtgggtcatgaattcactttccagccatagataccccacctccacattctgagtgccagaattatgggtgtgtactaccataccccgtctatgcagtgccgggaatagaagttagagctttgtgtgttctaggcaagcagactacaactaagccatatcgtgagatttttggagactgatgtaagtttggcttaatgtgtccagccctggatccgagtaaaggatgccgtcccaggaaataacttgagccaatgccttgattgttctaattagatctagtatgatagaactctataacttcccccaagttactgacataggaaagttcattaaaaaaaaaaaaaaaaagattaaaatctctcagtgagaaacttctcacaaggcagaa

SEQ ID NO: 31684 - DNA, 1189 bp, Mus musculus
gatcttaccaggaaagtcgtcctgtttatagccaattcctgtccatatccattagcttccatatcatacctactgctacatgtctttaactttgtcacattataattaacaaaatgaatcattgtgtcgacttttcccaaggttcaacttctcaggattttaagactttaatgttctgagtattaagacccagagctcagtcagtttgagaaatgccaggcctagtaacaagataatgaacaagaaaacagaaaatatattaaacttagtgttggacatttttactgcataatcacattaatacaactacattagcatagagaagttggatttaaatttgggattgtagaaaaaaaaattttgttctgaaagagtagtaaactcagtgctccaaggtatgctaatcataaaacagatagtgacattcctccacccacccacttcctgagttcaaggagtattcattcaaagaaagtcaccctgaccataaccggaagctgcaatgcaaatgtgctattgttaggggctcttagaaactgtcttgagagttaacaattaccaggtattccttgtgacacccgtgactttgtacttccttgtgactcttatctggtatttttggtattttccaacaacgcccttcccacctccttgagttgtgttttttttttttttttcctttaaatacccccttactcagctacttggggcgccacagtcctctacccctgcatggtgtataaccgtgggcccgagagcgctcttgaataaaaatcctcttgcaatttgcagcaagaccgtttctcgtgggtgattttggggtgtcacccctcctgagtcagaacatgggggaggcctcacgttgtgggtctttcagttccagtattattttgcttctaaaactgtctaaggggaactaattatttactttgtgatgttggttctcttaagaacttctttctagttcccaaacactttctacaaatagtctgttcttggcatcaggcacttagaaacagtaggacaaaaacttcccaaaagaataaactttacccatcatttgttcttacacctgctagtaagccccctactgtcttcctttggctacttctgggtttttttggatctagaaaatcaatacaataataaacgctatgattatgactaagaatttagaaagtgaatataa

SEQ ID NO: 31685 - DNA, 2070 bp, Mus musculus
tgatatatgtgtatagtgggttacagcatttgcctaccaagttcaagagcatatttagggaatgagaaagcagtataaaacataaggctgggttccaaaatacttgctttttagtagcttggtgccatggattatcctgttgagtctatgtcatgacaggataggaaaacacagttgaaataatgggaatggccatggaacaggataggggcaccactgctctaaatgatgaagctctaaatgatgaatgctccagaaactgggttggtaagcacaagatagaggcaaggcagtgtaattttaaaaggactttgctcctttcaattttccttagcttgtctgagatactgacctgtacattttgaacatattaaagagtaactaagtattctgagcagaaatagcagcatttggtgtagttgcacttttgatttgatgagcctgtgatgtgctagatccctttaactaatgtatatgtccattttgcattttatttgcaaatataagtgaacagtatatatttctaggattataccatttaggaaacaggtttacataaacataaatatccaaatctattctatttggctgaattatgtcaaagtaatcaagtagaatactgaaaagtgtaagtacgtaataaaatgcaactcaagaataggctgctccttaatgtcattttttcaaaagttctacttgtgtttcattcaagctgctgtgatggagtggggaattatgcctttactgctgcagtataatctgatgatccatggactgtttaccattactttcagataggactgtttaaaggaatcttacacaatatagcagctttgatgtcactccatctgtgcagatgacaacagcagaaactccatagtttaaaatccaggtatttactgacctgggtgaagtagattttgacacgcccttttatagcacatcaccttatttgacttcaagaaaattcaaaatccaaaagctgctgtttacttgtacagtacacagatatctatgagcagctatgcagtaagtaactatgtaagctatcagaaagctaagccatatccatctaacttgtaaaataaacaatgtgttcactatctgtggcacctgatataaaggcaagagtctcagcacaagccctcctgttattcctgcaactttctgaaatcagaacaatcctgttataaatagatgctactatggactcattcaggaaaccactaagaaaacatagtttctcttcaacagttactacattttaagatcaacagcactgctccacaagcattgggaaattcaggaggtagacttgagcttagtttttctacctacactcatgctggttttggggtctcagtaacacaggaggggagaacaccagccttaccaagacttcccctgtttcatacagggctcatctttaggtcttctttatgtaacttagtagttcatctttttccatccggtaaccacttttcttccactgttcacgcaactgctgtagcagggccccaatttccttccctgaagaaatacccactttcctgatgtcatgtccactcacagggaacggcgggacagaccactgctgcatctctttgagaagaccatgctctccttggtacttcagcagctcacaaacacgggcagttgcatctggttccctagactaaatgacacagttttatcacatactaaacactcacaatttcattctactatttaaatacttacatcaaatctacagtgtgaaaaagttacttttctctagttagtgagaactattttctgctcagacctaatacatacttacgtctatcacaaagtcttggtatggtttcaatggttctgaactatctgttgctttaatcaagtctttcctgtttttaactataaataaacccaggtttttctcctcttttgaaattttcaatctcaagtccaattttgtgacatcatcttgtactttgaataaagaagccaaaagagtcattggttttggtgaaaagccttcaacatttttactgactttgttaaattcttctaaatttgcattagcaggta

SEQ ID NO: 31686 - DNA, 1204 bp, Mus musculus
acacacacacacatacatacacaaacatgattcttactttatggtagcctgctgactagacaatcacatggataaccatggaaggttactgatattttggggggtgttataagtggtggtggcctttctgtcatatgtaggtgctacttctaaggtaaaagatactggctggctgactctttgaatatgctctgctgtcttttgccaagcgtacagcacacagaatatcttaagaaggcatttcaggagcagctcttccttcaggtagctctgagttctctgtaccaggtatttttgtgaagctgtaactaacgtaagccctaagccaagggttccaggatctcttacggcatgttatctgttatagtcctattgctataggtaccgctgtgcagctcgaagccagaacacaccagatagctctgcatccaacctgggattccgatgtgcagccgaccacctgcccaccgcagactgacagccaagaggagcttttccagattcaagaaggcgtttcttactcgcagctggcctcccctggaaatctgaactgatctcatgtaaagtattcccatctacggaggattccatgtccacccagtggccaaaggaactgtctcgcgtgaccaaatggctggcgagtgtcagcacgtgtgctttattgtgtggtgtatctttggggatcatcgccatgttttactttgaaagccttttgaagaggagagagccgagaaccaggaagtcctggccagactctgccacagggtcagaccctggagtccagcaccttgtctgccttgacctctgtctcctcatgaaatgagggatggtcaacgtgatctttgaggctctctccaactctatttgaactagcagattctattcgaactagcagagtgtattgtgattgcatagtgagaatttatgacagattattttttagctatttttttgccatgtgtgaatcttgagtaatactaatcatataaggcgagagttatcttacatattattttcagaaaagggtggggtttgagtcttttatattcatactgcactttgttctttcaaggaaatcagtgtcttttacattgttgtgacaaatcccattgggacagcgaggggacacttaagtttggagttctgaacacacaggaatgcctgtggagtgactctactgtcctttttcttttgacattaagtg

SEQ ID NO: 31687 - DNA, 1122 bp, Mus musculus
acttaagtcctggctttaaaacttctcaaaaaaatgtgtaaataaattctcagtcaagattggcatggcttttattagggccttagtttgtctacagaataagtattgccaagttctaattcatctgaaagcttttcatcagcatagctacgtctccaaaaaaaaaaaaaaaaaaaaaaaaaagggatttaagggtccagtcacaaggaacatgttttttttttcagcagatctcatgatccctcttagggccttgctaattcttagctgccttacctggaatgagacattcttgcttagtgtacttccacttgagctataaggtacagcagggcagtgttcctattaatgttgccttctatgaccctgaacttgtagtttttctcagaaggtatctcagcttattgcagggagtatttaaatggcattggcatcttagctgccacggctttgtttctgtctcctgttgtgacagtggtaggacgtggtcctctgttcgagccacatcttagaattatctgaggaaggttttcagttctatagatgctctggactgatggtcgggaactgtttttgtttgtttgtttgcttgcttgttttcagagtagaatctcactgggtagttctggctgccctgaaattcgctgtgtaggctagactggccttcaactccaccgccctcagtctcctgagtgctgggattgaaggtgtataccattgcacctcgctcagcactgacgtttttaaggcttccaaaatggtttaaaaattacattgttttgtttattaattttgcgtgtgtgcacttgtggccatctttgggtgaggccagaggacatcttgatggagttggttttctcctttcaccatgtgagtttcaaggattagactcaagtggttaggcagaaccagaaggcatttttttttttaaaatcccttacaaaaaggagaaatgcatgcttattggagtcccactgggagtgtatggttcagacccctgcagactaatgtctgttctattttgagtgcaatgccttaaccattgggccaccctgctgacaaaactgattcttcttgctagtgggcctacgcaccgacttgactggtggcctggtcacagag

SEQ ID NO: 31688 - DNA, 1160 bp, Mus musculus
ccacacggtcacccgtgcagcctgccctccgcggagtcccggagccaagaaggctcccgccggcgcctgtgccacaaacctctcaggccaggcagaccccgtgctctcaccaggaaggtggccggctgtctggagctaaagatggcgccgcccagaagctctgcgactctctcgcccgtcccagaaacagctggcactccgtattccacacggtcacccgtgcagcctgccctccgcggagtcccggagccaagaaggctcccgccggcgcctgtgccacaaacctctcaggccaggcagacccccgtgctctcaccaggaaggtggccggctgtctggagctgaagatggcgccgcccagaagctctgcgactctctcgcccgtcccagaaacagctggcactctgtattccacacggtcacccgtgcagcctgccctccgcggagtcccggagccaagaaggctcccgccggcgcctgtgccacaaacctctcaggccaggcagacccccgtgctctcaccaggaaggtggccggctgtctggagctgaagatggccgcctccttccctcttgccccatccctactttggagcctctgaacaggtgattttcttaagggtcttcttaaagtgttgtctttcattactccacaaaatagggttcttgcactcccctctgttgagatttgaaagtctaatcgaatcaaaacataatctcgctcatcctgggttttcatcaatagcttctggctctttcttcgccacggggtagtgtcagttgccggagaagcaacatagttttaactctcactctgtttctctccacccgttgttgtcgtctctcctcctgtgaagtgggtgatttttatgtagaaaaggtccagtgccacgatagcctgggtctttctattaatggaaggtccagactgagtctttcttcccttcccccaagaaaacgatgtgcttccctggagacaaccattccgtgctctgcttttccctggagggctgctcctactcctctaatcaaggctgaagcatttccggtgctctctcaatctactgttaacagccatcacctgccggaggatctgctgacagcttggcaccagcaggcctttgtgggcttcattgcctgtgcttaagttttttttttcta

SEQ ID NO: 31689 - DNA, 1144 bp, Mus musculus
ggtcatttccgttttagcactgagtaatactttggagagacccaaatctctatccttatctctatcactctctgaagacatacaggatgcattcaagttttgccagttgtaaataaagctgctatagacacccataagcaggttttgtgtggagatgttttcagcacctttgggtaaacacttagaaacatcaagatggcttctgttgaaaatcgtcttcaacggtgtactccttacttagtgcatccagcctcttgtcagatagaaaccatcaataatttagtaaagtgtttggttccagtttactcatttagtgagtggcagttagtgacttgaacccagagcctcaactttgaaatcacccttcagtttctttttgactgtgttcagttccttctcattgggatgaactatgttagcaggtggtttgatgagacctgcaaatagtgaagtgtttatttccagctgaaagaagagtgtgtgtgtgttttgtttatgtatgtgtgtggaggctgaaaactgaagttatcgtcttcgaatttgctttttttcttcacattaatttgacttatggtgtccttttctcctctaccagaggagccgtacaggactgtgactcagcccaggaacggtgggacagtcccggttctaaatgtgactctgaatttggggtttcaagtggtgattttggcctgagtgtaatttcagcaacagtcacacgttcacagcataaactcatctaaatttatcagtcactgcatcgtaacaaatccatgtctcattccgttctctgttttctttcctacaagaatattctgcactcctgagtaagttctgagtagcattggactatcctcaaattggccaatttattaattcatcttgaaaacttggaaaaagatgcttcggagtggatgttctgaatgagatttttcttttatttggcaggcagagttatgtaaatacaaagatagtgtaactgaagtaaagtaattctaatagggtaggcgatcggatgatgagtttcaacaatgctgaggacgcactacggcagatgggacaagaagaactaaaagcaacagcaaactcagggcaggggtcaagatggagctaaaggaaattcctgaatttattttatattaaa

SEQ ID NO: 31690 - DNA, 1099 bp, Mus musculus
acagagaaaccctgtctcgaaaaacaaacaaacaaataaacaaacaaaaaagaattataaaccaaattggaaattgatcttcaatcttttaaagtttgttcatccagttcgagagagttaacaattgcttttcaaatttcccattaaggaacaccgactgtgtgtgtgatcagggtgttgtgacatcatacttgctttctccagaatgcaggaaccatcattcctgtctcccctgggagtgggcttgtgtccaattgcattcacgtctagaacctcagctccaaataaatacagctgaaaggtaggatacagatgggccatttgaggcaagaatgagcctagacactgttatagttcaaggcaggaagggaaagaaataccattgtctggtccaggacacacatatgtagaacttttaaatacactaaagaagcagagctgcttcctaagttacttgtgcccaaattatcttccctctccactccgcgtcctgaggtgatccatctctcgggcctgcatgactatggaccggacagtaaccagcctgaccagggccatgagtagtgctaggtgcttttctgcaccaggagctgcggaggtggttttcttttctccatgtcctctgttgtcaggagacttgagagtttagcaggtgacatcttcccctccattttcccctcctttccaatctcttcttccaggatgtgcatttcgagcagcaagacaaggtagattacatctgagtgtctacatttgaatcctgcctctgccactcatgacccaggaaggtatttcatttcctactcatctgtgttggtatgaagtattgataccagtaatacctatttcgttagtctgctgtgtaaagtgagttagcacatggcgaactcttaaaccacacttgctaatgtcttcagttagcattacgtgaagatgagaagtactcttgtcagttcttccctgagtgacagacgagtgagtatctcaccctcattatttttgctcatcattattctatagtagagtggtaagacataacagagctggttgccaacagaatcgttcctggttgaacttcctgagatgctacaggttggag

SEQ ID NO: 31691 - DNA, 1195 bp, Mus musculus
acttgggttactatgattgctttatgtattgaaccatttcactagccccaaaagtcacttatttgtttgtttgcttgtttattatttattttgaggtagggtcccagtttgtagccctagctggcctggaactcacataggtcttcctgcctctgcctttcaagtcctgggatcaaaagtgtgtactagcacaccttgtcaaaaatctgttcttgacaaagtcaagaacaatcttattcattgagtttcagtgacatgggaagcatagtgctaagtagatagtagactcatcttacataatttataattttgtcatgtttgaagcgctgtgagctaggaattatacattctcttatagaaagacattgagactcagagagtttaagcagtgtcataagttagagtcctgtagcagagctcgtattggtaaatggctaggatatcattgtctcacggtgacagtccttctcactcttccgctctacattgggtgtctgatgtctcactggtgttgactgggttttcatgggacccttcactgaggacacctctgtgcttcattgtgcctgccttgtcattttcctgctcagcccgaggatgactgggaaacttaacctcaccctgtgtaattgcggtcagaattcaggatccttgacttgtgctcatttgctattcctgtcccttcccaaagggagaagtgtaaggtagtgtccacagagaacagaacctctcaaggcagccggcctttgtttgctctacagccagattccttgttgttaagctctgctggcttggtaaccccttgagaatctgaggcaggctacaggtatccgtctgtaaaagcctgcaggtatacacagctttcttctagatctgtaacctgttattttagtttccttcagaattgctctaatgcaggtaaccatagatactgtaacaagcatgtcacggccagaaggctgcatttcccaacacctcttcctgttctccagcttttttttttttttttttttttttgcttcctcttctgtatgttccctgagccccactggtagcagtagaattaactagcaatattccatttaggttgaacactcagtctcttattctcagcacactgatcaggtctgcctccctccgttgacttctgtccgccacaaaaacgaaccttctctgattcaaaagtcgagtgcag

SEQ ID NO: 31692 - DNA, 1139 bp, Mus musculus
attgctgttcatcacttaaagaagtcaggactggaactccagcaggtcaggaagcaggagctgatgtagaggccatggagggatgtttcttactggcttacttcccctggcttgctcagcttgctttcttataaaacccaggaccaccaacccagagatggtaccacccataaggggccctcctcccttgatcactcattgagaaaatgccccaaggctggatctcatggagtcacttccccaactgaagctcctttctctgtgattactccagcctgtgtcaagttgacacacaaaaccagccagtacactggccattgaaacatagatgtgttcagcaagacacttttcttacatagattagattttgtacaatctgcacagatactatgtactggaggaatgcccctgtcctaagttgtgaatgtattatgacctgacccttcaggtctctcctcacactgcagttcctggttttatgtggttgatttcttctttcttagattttgattcgacttagcaagctctgcgtgcaggagagcgcgtcggtgaggaagagccggaagcagcagcaacgactgctgaggaacatgggcgcacacgctgtggtgctggagctgctgcagatcccctacgagaaggtgagggcgcgtgcatccagggtggaccggagtcccactcccaaagccttcacaattgggtgaagtaggggagggccaaagatgcgcttgtgacctaaagcaagtccacgtcatttatatgagagagagcacctcttcctaacacctctagtgtttgcgttctataaagaaataaagatctcgttcttctgtcacatccaagccttcttagatggggacttctagatctacaccagaggtttcatttgtgtgttttagctggtgttattcacctttgtccaaaacacaactaaaagtcattggaggcatgtgggactatgtggaacttgctctattttttgacagtgtcctatcatctgagtatatatttagaccaagaccaagccccgacccccccacccccaacaccatctttttttttcttttctttctttttttctttttctttttctctttctttctttctttcttttttttttttttttggttgttgttgtt

SEQ ID NO: 31693 - DNA, 1149 bp, Mus musculus
cctttgcaaacaagtactggccaagtgtcctcaggtggccctgtgctggttttcagcgctgtttcctcatgggggagcgtggcgttgtcctttgttagggagggaaagaggaggagcctccagtgcagatgctgttttgtgtcttggtcagtggaagtttgctttctgtaggctgttctgtagaacaacaaaattggttattttgaggaaaacagtttcttggccaaccaacttatttgtccagatatttcttaaaatgtacaagcacccgggcattcgtaagaagccagccattcatttaaactggtgttgagctgttaacatgtcttccccaagtgttaatgcttggaaccatttcagtgtctgtaggtacaagtccccagagtttacatttgtggttaaaagttgagtttcctctctctcttcaccagaccatacatacttgcccattataggcgtagaaaaatctgtctagtgggccatgaggattctagcctgcttcccagactgttgtagactcatgagtcatccgtctcttttgcagccaagagccgggccatagccattcctgttgacctggacagccaagtcaacaacctcttcctgaagtcccacaacattgtgcagaaaacagccctgaactggcggttatcagcccgaaacgccgctcgcagagactctgtactggcagcatccagagactaccgaaatatcattgagaggttacaggtaaagtctgaggctggaagaagtggacttaaacttgagaagtgtattttctgaagccacaaaacatacaagctccgctacacagaagaggtttgtggggccaggagtaccaggtcttttggtaaacaaaaactcccagaaggggttccacggcagacagttgatgctgagcattagccataattattgtctgaagtctatatagagtgtccctgggtggcataggcctcctcacactgtgacagctgagtctataaacatttctagggaccacttggaaacacctttgtctttatcaccctagctctaaagatgtcactagacatccattctgctgccctctgttggtctatgcagtctcagagggacactccatttcttaggagggaaattcaaaccaccattcagtgggaaggatgt

SEQ ID NO: 31694 - DNA, 1103 bp, Mus musculus
gacagcacacttgatggctataggcagtactcatctattataacaggaattacagatttctgtttctggaaattagtcagaaagccctaagtagacagatgtgtatacgagcatatccagaggtgttcatcacagaagcactgataagacaattgaaaacatgttgactagtcacaaacatgatactggctatgttaagtgtatgtgtttctaaataacactaggagatcattttgacatgacatgaaatgtgcctgaatattgtccaggagtggctataagtcagtattatggtatttattaataatatctatacattccatttttaaaaggaataatacgtggatgtctatagatgatggaatggaattattaggttttttccttggtattctatcttttccaaggtcaatttttacttagaaaatatataatatatttatatatattataagtaaaaatacagaatatatgctatattttattgtttcaattttaaaattattttctaaaaaccataagagggtctttcctggtttgatctgttaattccgtgcctcctgcccacagaagacaagtaccctttgttcgctgtgtgatttgctcttagtacttcagactgagttgctaggaaatatttaaccaatgttaaagcaacacagccttttactttcttttgtggattaaatgccacatccttgcttcctttgaaagatcctactttgcccagtaccctctaggaaactagtttcaggatacagattggaattaagcagggagaaaagctaattggccagaaaatggccccaaatatacagtactaaactggaagacattgaagagaccagctctgtgcactcattttacagatgaggagatggaggtccacagaggctcattcggcatctcgctgtaattcaaaagtgaagtggagagcccacctgctttccccataaccatcttcactgtgcagttagctaaagccacaatgaagaccaagcctttcagagctgcctagacatgggaacagaggcaacgttaattaaaacacaaacaaacaaacaacactagccttcagccatgtctggcagcatgtgcctata

SEQ ID NO: 31695 - DNA, 1658 bp, Mus musculus
gggtgggtacggctcattggttctgatttgcccactaagggtacatgtgcgcttagtacatttgtaaatactcagttttgtattgtatgtatatgattgctattctcagaggtttggactttcgtattgtaattagctctgttggcatggtgacttgtcactcctgccaaaaatattaaaaatgccttttttggaaggactacagaaagtacctgatttgcacttgaaccagattatagatttaaaagtatatgacatgtattttgtatttaaaactagaatagccagtatttatgttttttataaaactgtgcaatacaaattatgcaatcaccataactttgtaactcctgagtgtcctaagggagtacacatctttgaagctgatttgttgatactcgtgtaataaatggttaaatatcaaatgctgctgctgctgccaaaattatattaatagcgagtttctggcccctgggcaattttgtaccttgtaattatcctatggtgatgctgtttctcgttgctaatggcattagtgcccctgtatcctagtgataactccaggtctgtgaaccattcaaacagcattcattttgagaaaagcaactttagtttcaaggataattttaagcttcaaaattaatcatttaaagtgtttctttaagagagccatgttagaggctcacactttagcttgaaaggagttgatgaattaattttttaaagggaactttttacatgacgtttggaataacagcatattgctgaccagtcagtgtcatctcccgggtgaattttgatgtcacgttatagtcaaatgagttagctgatggtttctagattttcttcctctgaaccatgatgcagtaggtaagaagttattatgcgtatatacatatatacattcatatacgacaaagtaggagctgtccccttaggatgcatagctgcccctagggtacgtagctgaacactgacaatggcgttcttctgaaagagccacgtttgggttttatttctttgtcacatgatttcttttctggatgggtgcaaagtatcacaggaagtgttttctctctgtcgccttgttttgtacctgggtctcgctttactagaccgtctctgcacaaaagtttaaaaactgaaccgtatgcagagttccgaagcaagtcaagtttgtaaatgcatacctaaaaatatttaataaacgatgcagaatcctatgcagtgactggctggtggctttcatttgtcatttccttgtggcttgagaacgattccagtgttagacttttctccccattgggactgagtaaaactatagctaaaaactcatttggttgccagattaaatcaggaaatgctaacctgattttagaaaataaacaattgtttatatctcaagagaaatcagtcaaacaaataacagagggaacttcatacagaattctcctcagtgactgagtggcaccaggatgtcaaaggcacttggcatgacacggtccagaatgctctgtttagtgtgggcacctttaacttggcattttccccatgaaaggaaggatcactaatcattggatttgttggtcccactccccggtgatcaggctcctatcacagagcatttatgatgtttgtcttgtactaggctcattctt

SEQ ID NO: 31696 - DNA, 1174 bp, Mus musculus
gaataccccagcattcagcaagttacaggagaaagggtttattatggcttacagtccattgcctcaggggaggcatggcaccaggcatgtgaggctgatcctccgcacacggtaagctgagagagaagaggaagtggggccagatggagagacaggaagtagtcaaagaatggccagtgccagcaaagaaacttgactgagcagtgtctacaatcattgcctgtgattttttttttaaagttaccatctgcttgctaataatgttttaaaaatcaggacccgaattcaacccctccagattgtttgtttaaaattatttggtctatctaacaagtggtgagaaattaccaggagctccgagagaaaactccataattcattcacacagactcgacggtttaaattaggcaaacgtatcatcacatttattttagtccgttttcttctcttgttttgatctgctgtttgacttttttgccttgccaacccagattcaactgtctgtaaagacatctcgctatcacttaaaaatcagctctttttccttagctaatcttgtactcggaagaattaagacaatattgcctagctgtactgttgactcacgtgcaacccatagaaagctaaattgctttcatgtggctgattaggttttatagcaatgtccctgatgaacatatgctctttcgaaattgacaataattctatcagtttaaacattttagtctctgtaatataggatatgtacaatgcacagaagataaatttttatttatttatttttggtgggggtggggtggggtgggggtggggcagggtgttgtttttgttctttgagacaagatctttctacttagtcctagctaccctggaattcaccatgtagaccaggttggcctgaaactcaccaaaaaatctgcttgcttctgcctccaaaatgctgggattgaagatgtatactaccgcgcctgaaaattgttatataactttaaaatgcatatttgtgtcaaaggggttttattgaatagtatactttaggaaaagaaagtataaatctgcaaaagctgatttctaaaggacatagtcttttttgttatgactgtaacaaaatactcaaggctgggatgatgcataaagataagaggtttactttggcttgtgatttcaaaagtct

SEQ ID NO: 31697 - DNA, 1432 bp, Mus musculus
gccttgctttctttcctccctaattccaaaaaccacaaaggtttccctgagtgcagagagatcagcccaccctgcagacccacagagaagattcagagtgtgtgtgagagtgagtgagtgtgcgtgcgtgcgtgcttgtatgtatgtttgtatatgtaggacaataagttccttctgacacaagggagacacgagaaggatagcctgacatcagatgacagactggaggactgtagcacatctctgggcgtttccctacccagagaagagcccccccctttgatacaaatcggttggattttcatatgcttcaaaggcttgatctgtgagtcactctccagtttgggacatgggtctgtctgtggctttgagaaaaggtactttcaaaagagggctttccagagcacagctcacagccagctgttaggaccccacccttctccctttattgtggaggtgactcacagcagactgacagtggtcaggctgagctttctgctaaggtggtgaggtcgccaacactggcatgtctcggtagtggtttgggcaaatttctgcaggtcccttccccccaaccccgtctctgatgaataaagaccatgagtggagttccttaactcaggcttttgtgagtagtttactaaggaactgaaaatggtcccctttgtccaagctgagctgctagggaatcaaggtgaactagacccgtcctcaggcctctggcacctgtttctagctctcacttctacggcatgctgtccaaggaaccaaaggaggctctcggagatgcccccaaacgtcccaaagtacacagagctaagtaatcaattgctacacttattgcacagctagacacggatttcaagtgtatcctaaagctttgaaccaagcttagcttctcaaaggcctagcagagctttggcaccccaagatcctttctgtaggctatttcctcttgcccagcagtggatggagcgtccttgctaaaaagggttccatctcctttaaggacgttttatttttgatccagagtccttgtttccttgacttgctccaccagccctgcaccagctttccaaatgcactctgcttgtgttgaaattctcccatttttatttgggcataaaagttgttgcctttatttgtaaagctgttataaatatatattatataaatatatgacaaaggaaaatgtttcagatgtctatttgtataattacttgatctacacagtgaggaaaaaaatgaatgtatttctgtttttgaagagaataatttttttctctagggagaggcgaggttacagtgtttatattttggaaccttcctgaaggtgtgaaattgtaaatatttttatctaagtaaatgttaagcagttgttttaaaaatacttaataaaataagcttttttcctgtggaagagaaatggtct

SEQ ID NO: 31698 - DNA, 3024 bp, Mus musculus
gcaacaacaacaaggttttgaagccctggtctaggtgtcaccgtgagtagcaaccccattttccttgtgccttagctgcatctcatcagtccctcctctacagtaaggcatgccttctaagacttcatgtttttgtcctttcatttgaaagccagtctctgagtggcatcaaagcccaagtgattattttatcttttattacaagtctcttggtcagagagtttctttcctatgtgccttcctggcagtttgtgattagttcctgacttgacaggtgatatgtacaaagaaaggaacccagttcaccgtcgataactgccctcttgaagctcaggcaatgcagtacacatgcagaagagacctagcaccttaagtatttaatgtatcatgtgtttatttcttaatgctgatttcctaactctcactttccccatctatagatatcacacttcagtggcttattcaacactcaaaatcccggagaagctgagacctcttcttcgtcttccagtccccttggctctaaccttagaactcctgtcgttcctctgaagtacttcccaggacatggtccttcctaaacccaagaaattgcctttttcagagtttatttctcatgtgcactgctgaagatgtgtattcctatccttcatagcaaatcagctggagttgtcatgataaaagtcagcacacactaaaaggcttcatatacgtgtctagtgtgttgaggcctctttcctttctattttaaacacccacatttttgaccatcttaattaagaaaattgcatattaccattctggtctttctgggccagatttttgtattggttttcagtaaatgtctacctatttcattacagagtccagtagcttctactactggtatggacttgatgcagcatggaatttctagtgccacccacagtatttagaaaacctttaagcctgactgatgtgggatacggacatactgtttatcccatctcacacatgcatgtgaaatgtagacttacactgtaggaataattggtctgtcagagttaacagaggcaccaggtcagaatagtagcttccttacactggagatttcctacctggtgaatttttaaaaaccttctgctttctgaaactcctttgtcagcagatagcgtctggggaggtgggaggagtcacagcatgctcttttctatctgtccagatcattaggtttttttttcccccttttaacacacttttttaaagggatgggaattgaagttttttttttttttctcaaaagctttcatgaatttagagcattctagctaatgtaataaaaccctttaagaatgtccgacttcatctgaatccacgtctgttctttgtctccaggcacccaccctgtgctgctgcatgccacccttaattcctgactttttatatctagtcatgaaggtgactttcagcacaaaggacacttataaacaaattcttatttttttcttaccaatgtaaggtttggcactcttttcactggtgccactagacttattgattgtgacaactctagacctgcctgctttatctaatgtaatcatgcgcaatgtctacaggttgtttgatgatcggccacacagagaacggaggaaccaatgctgtttattgtttgctatgatacagagctgtacaaaaacttacaatgaacatattttgtagcttagtgatctccacgtacataaagggacatattaatactggttgacttgtaaattgatactcatgccgatgtagtagatagaccccatgctcccacctgcttatgtgttgctcacactgtgtgtgatttgtctcttatgttaagcagcacctatgtcaacagtacatattcagatgtgttgagcactccaggtgtagtcagtaggaagttcttttactgagtaccgttttaatttatagactgccacggccttaagaacattctggacagataactgcaccatgttgcacaggcactacttgttctctccattctcattcttactgagtaggacctgggctggaaagttctcttcttattcacggaggcaggttgcactcttcctgaattggatgggtggtttgaataaagggatatttaaactttgctcctgtagcccgacatgactaatggtcactgtgaaccatttcaaagaatgtggcaacttgcttatgcctaaaaggagggattggaaccagaatgtttaactaagcggggactgcataagttcttgttaattgacctatggaaaccttaatttgtttatgtgtctttccattgctttccagcatttcaggacatctaaaagctactaccaacattttcctgtgcataacctctgcatgtgaaaacctaacagttactgaactttgtaaatacgtaaattttttatttaggtgtggatgcattttttgtctgtttactgctcctctcagctttattcaataaacttgcattttgagggttgcattgacaattttaccttaaaatgtatcatgatgaaaagacgcagacctttggactcgagtgggaagataatcactctggaaagggctccacagactgtgctggaaggtggctgcctcagctggccgaggtgttgatgggatgaactagaaataaacttttacagtgtctacagagttggtatcatggtcccctcccttctctcttgctcggagaggattctgttacatatacattgagtggcacttggtgggccggtcctgaggagtgagtctagtcttcaccaatgctggccaggcactctaatgtcaccgaacacacactctcttcttagccccaagtctaggactttttaaaatggtggaggcaagtaaagagttttatcatccagtttctttaaaaaaagttacactgccagaaactgaacctaggctcttgcgtagtctagagaagccctctaccactgagctacatcccagccttaaaaaaaaaaaaaaaaaaaaatcaaagccataattaagaaatttcaaacatgtcta

SEQ ID NO: 31699 - DNA, 1180 bp, Mus musculus
gccattagctgagtgtcatactcatggtgtaacttctcagcacggtgaatttttaagttttcctataattttctctctctttctttttttttttttttttttttttttaattgagatcttgctatgagctgaggctgtccttgaacttgctctgtagtcaggctggcctccaacttatgacccttctgccttggcctctcaagtgctggggtagctgtttaacacccttagggtttccacaccacctttgattcttcccactgcaggtgaatctgaagacaggtgttcctcctgacagcaataatgagacctgcacagcgggggccggttctctcctggtggaatttgggattctgagccgactgctgggggattccacttttgagtgggttgccagacgagctgtgaaagccctctggaacttgcggagcaacgatacaggattattaggtgggagtccccctctgctgtcagttggttcctacagcctttggtcccctttcctcctccttccttgaagctctgcacaatacttcgtcttccctgaaccactggatctgaaaatccaacagccattggtgcatagtgagttcagcttcttcacatagccttttgcttagtgtgaagttttaggggttgatggaagataataatagttcagctgttaagagcccctcagtttggatcccttggtatattccactggaaattattgttaatagaaatgccataaaaagaactgtctcagaggcaaactttattgctttcaatataaggttctaaaaatacaggaatttaccatttccttaaaaaaaaagaaaagaaaaaacaatccagtagtgcaagcctagatgaaacatatattagattttttcccccttgagaatatttagccaagatatttaaaactcattatagaaggttttaagcattagtagtagacataataacaaataatatcctctatgtattcatcatggtgttcatctttggtagctactcatattttggtaactcagtgttgttttaagatgggtttttaacatcataaaattgtcttattgggacatattttctttttggcatctggaagtaacttggttgtttggggaccatattgggttatttataataggtttttaaaagtaatttctgtcttctgaaattcatctgcaaactt

SEQ ID NO: 31700 - DNA, 1163 bp, Mus musculus
ccctacgtgagtcaaggccagcacagaccagttctgctccatgtcactgttctgaaatccaaatgtgaaagtgctttctgtaaatgtagtgaagttttgatagtccacagaggatatgtttagaagtaggttcttgccaggcggtggtggcacacgcctttaatcccagcactcgggaggcagaggcaggcagatttctgagtttgaggccagcctggtctacaaagtgagtcccaggacagccagggctacacagagaaaccttgtcttgaaaaaccaaaaaaaaaaaaaaaaaaaaaaaaaaaaaaagaagtcggttcttgtatagacacctacaggcagtctgactgccaaagacttaagggaggagttgggaaaaagttagcgttgattttgcttcagtgacacacagggaggtagaccaccagagggacagagtgaccttccctttcacctttgcctgcgctctctggatccacagccgggaagcctgcaatgaaggagaaggagacccaccgctctacgtcaacgtgaacatgttcagtgggcagctcatgaacacctggattgactcgctgcaggctttcttccctggactgcaggtatctggcaggcttgtgttgagaagggctggggagacagctcagtgggtaagagtgttgctgtgtgaacctgcaggcctgagtttgaatcttcagcactcacctaaaaggacagtggtggcagcatggccctgtcattccagggctgggggagaggggtaggcagggcacagagatgagaagtttagtgggggttgactgttgctagcctagctccagggagtaagggggagagtgacagagcagcctacctcagccatagggataagcatgagtaaatgcacacgtgtacatatggagcgcgcgcgcgcacacacatacagaaacacacacacacacacacacacacacacacacacacacacacacacggaggggggagggagagggagggagggagagagagattattgggaaagctcctctcttctgttattcttagcattctctggctcctttggatttgggaggttactagcacatcttgatcgctctgtgaaattagtccctagccgtgcaaatctgcttgagagtttagattatttgcctgtattgtctttc

SEQ ID NO: 31701 - DNA, 2414 bp, Mus musculus
ataaatataattcagttccttggcatgtttagaaagggggtttcagtagtaactatcatcttttaaatacttactatgcaattggtcttatttatttgttaagaatattgaatgtttctggttttctttcttttgatttcacaagcattgttctatgtatccacagtgtctcgtctactgtatagaaaactttctttaagcagattatctgttttacatattttcgttaactccgtaaaagtattaaccacatgcatgcacaggcctgtgtgtgtacccccttttacctttgttccaggcacgttcacgtgcaactgtgaatgacccactagggacagtaaagacctatcaggaaagaaagcatgcccctcaggcttctctttaccatcttccccatctctccctctctctctctctctctctggttttggttttggttttgttttgttttgtttttttttggcaacagcggtgtatgttggcacccagcagttctctctcatctgggttctcatctgttgctcttgattaagcttgggttgcttcttgctcctgtgctcttggaatggtgatctgtgtctggaagtaccatggtgccttgagtgctaccagtgggtctcaggggtacaggcagacatgcaatgtattttattaagtcttaaaccctcttgacttttgggtaccagatttttcagctgttgacaaggctgagggtaaataagataatgcctgtaaatcttaccattgagtttctagactgctgagaccaaagccagtgatttgtggggctagatgaagaacactgtctactgccagacatataaagaacattattagagacaagttcgaagctgtcttgctttctgaatgtcagcaactgcaatgtatatcttacaatatatttgctgttccttccaacctgtgtgctgaaatatgggtagaaaatttctaactcactgctttggtccaggaatgtgaacagaagaatttcatggatgtttgtaaccatgcttgtgttcccaggagtagccagtagtgtccagtttggccaacatgtgaaaagttgcaaactacgtagcaggctgtcttatggttaggtatggtggagtcccattctacaaccaacaggcttgccttagctgctctaaatactgtgacagggtaactccattctcctggaagaggaggtgaccaaggaatgtttggtggctttcggattgctttggtagctgtggaaaccaggcttgtttcccagagcctcccttgagtttcttcctgctcttctactggagcgtactttttgtaattggatttctagttctgatgtctggactttccttgtcttggattgtagactctgcacatgacattcaaatacttttctgtgtgttgaagtgaaagcatgtgagggtagtgcctgcccagaggagtatctgagagcccatgttttactggtttcaataaatgcagtcgtctctatcctgtcttcccttctctctcaaggaaaatatccctcttagcatctccccaccagctcagtgaatgagtgtccactgcagttcttcactttggatcctgtagactctgcactggacatcccttttcttctgagctctgagatcttgttctcttgatgtggacaaacatagtgctggtcagagggtagggctgggccacctcaggcgcacgcgcagagtggccgagcagggacttgggaagaaggtgctgatctttgcctttctgttcctggctgtccagcacctgctctagtgcctcttccctgcaaggcagggaccccgtgtgaatcagagccggtgatgcgtgtgggccttgtggccgctactcagcggggctcagggttaaggtccctcttgagtttggatgtgaatatcctaaagctatcaagtacctgtgaaactctgcttcactgctcttctccttctgagaggtaaacaaatcatatttttaagggtattttgttttagtgttaaatagcatcccacgagctgcatttttatttattacatacacaaaaagtaaatgtgtttctataaaatacaaagtctagagttggaaactctgggaaaacttgctgagatgcacaaatgtttctctctgtgatgtgcaatatgcttggccgccatagatggtacttcatgtttaatctgtaaataagaactgtatttaaattaaatgggaaatttttgtaaaaggaccaaatgttcttttataagcatactaaggaatatcttgttctttgaaatttattaggatttttatgaataatttttattaaaagattctctttttgagttgtcactgtgtttctcctttgcatgctctgcaagaccagggaaaatcatttggagaaattctaagcttcgatgactaaaatcttcagctttttggttttg

SEQ ID NO: 31702 - DNA, 1760 bp, Mus musculus
cttaggagagaaccctaagataggaagcgttgacttctgtgaaggagtgctgacttccatggagatgccactcagcagtgaaaagctcttttgctttcgggttggctcacaatgtctgtaacttcagctctgggggatctgacgcccttttctgacttcccttagcatccacactagtgtgcatgtaagcacatacatgcacaaactcgctcatatgcacacaaaagttaattagattttaaagatgctctactgttttaaggtgttggtgaagtgccatggctttataaccaccttcaaaacctcactcttccaagttcaaagacaacaaaagaagccaggaatcctgactatggtgtctatccatttttcccaggcttctttgcctcaataattatgagcatacatgtctttggccagacagtgttgagtgctatggagcagacctttgtgaagacccagagaacgtcagggttgagagccagggactgtgcgtccacattgtgtgaggtaaactaggattattttaaattataggcacacatgtgcatctgtacatgtgagcacaggtacctgtggggtccagaggctgtggatttctcttggagctggagttgcaggcagttgtgagcagcccaatgtgggtgcttcattgtgttgaccaagctggtcttgaactacagagatccgttgatcctacctcccctttgctgggactaaagacagtcaagcactaccatgcattcctgtttgtgccacgttgttgttgttattattacaatttctaacagtttttaaaaccagacttcccattgtctgataaccccatcaccttcccactaaacccttcctcccaagcccctgtcttacttcagtgtatatgtgtcactgaacttatgtatggttgctttcatgaggatggtgtgtgtgtgtgtgtgtgtgtgtgtgtgtgtgtgtgtgagagagagagagagagagagagagagagagagagtacatgcacacgtgcatatgttagtccttctgggagtaagcccagggctttaagaagtattctgccactgagctatcacaagtaactttttgtatttttgagatccttaagactgcaggagtacaccatcatacctgactttaaacaggaagtgtaggaggggttgaagaaatatgtgggttagcctcagaaaggcctgactggaaattttgttttgtcccttctgagtgtgtggcttggatccagctgttcccttcatgtagtttcttgttcatagcacctttcctcccagggctgtcaggagggcagggtgaacttcagtgccatcttgtcagaatgtgctaatagcagcatctaaaatctttacctgtgtccttctgccatgtggtcagggaagtgcactataccttctgtcttagaatatgaggcctgagtggcgacaggtggttactgtgccctcatgccaccagcctttgtgggacccacttttcatatggaacttgtacacagatttgcagccttaccacactcacacctcagtgatgggcataagttctagttctctcctgaatgcgctgggaaaatgatcttccttgtaatcaacacttgaaccagtttgtaccaaatgacctcaagttcttttgggaaccattgttaattgtctgtctctatagtctcaggatggagagaagcgagatgaatgttcctagaggacacagttaacaggtctcatcagggatgccttcccagagggttgggagaagga

SEQ ID NO: 31703 - DNA, 1149 bp, Mus musculus
gaagagggaccagaaagcgctcctgaaagctatgttcaacaacaccagccctatcacaggcgaaggttcccaccttactacctgctgagaccacagtattccaacctccctgttcaaggagaaatgatggagggtgctgacaaccagggtgcaggagagcaagttagaccagtgagacagaatatgtattggggttacagaccacgattccgaaggggccctcctcgccaaaggcagcctaaagaggatgacaatgaagaggacaaagaaaatcaaggagatgataacccaaagtcagcagccacttcaacttcggagagagaaccctaaaccacaaggtggcaaagagacaaaagcagccgatccaccctctgagaattcctctgctcctggggctgagcagggcgtggctgagtaaatgcgtgcttaccatctctactatcatccggtttggtcatccaacaagaagaaatgaatatgaaattccagcaataagaaatgaacaaggattggagctgaagaccttaagtgcttgctttttgcctactgaccagataacattagaactatctgcattatctatgcagttttaattatttttacctaaagatgtctctttttgctaatgacaaatgtgtcttttaagaaaaaaaaaggcctggtttttctcaatagacctttaatggttttaaaattgtttcatatctggtcaagttgagatttttaagaacttcatttttaatttgtaataaagtttacaacttgacttttttcaaaaatgtcaacaaaaacgtctcatgataagtagcctctagaactatctatcttctgtactatccagagcggaatccaagacccctggtgtcctgacatctcagtcttcagggatgtcgctggggcctccagaatgttgtgaggtaagcctaccagagactaccacacagacactcttaaaaccaaaatgaaagtctttattgctgactggcaggtgcagaggaacttgctcaaatcatgcatcattgagccttacagccctttgtgttttctgaaaagacaaacaaataatacaccatggttgtcacatatcagttaacaagaagcataactaaagaagcaaaaaaagaacaaaaaagccaacaaacaaagtta

SEQ ID NO: 31704 - DNA, 1149 bp, Mus musculus
caatatccaggacagtagggttcctttagagcccagcaactgtaccacagcaggtaccaagtattgcagcataggtgaaacacaagacaaaaaccttaaaatagcctcagaaatcatgccatggatgattaaagaggaaaaagatatacccttaaagaaatctatgggcttcctctttccagacagcgctgagcgctgagcatcttttgggaaaactggcacaagcgccgcaagaccggcggtaggagaaaaccctaccacaagaagcagaagtgtgagctgggacagcctgctgccaacattaacattggacctcagtgcttacacatagtccaactttgaggaggcgataaaagtactgtgccctgaggttgaatgtggggaactttttctggggctctgattgttgtactcgaaaaacaagaatcgttgatgttgtctacagtgcattcaataatgagcttgcctgcagtaagatgctggtgaagaacggcgttgtgcttattgacagcacactgtacagacagtggttcgagtcccattgtgcactgtccctgggccgcaagaagggggccaagctgactcctgaggaagaagagattttgaacgaaaaaacaatcaaaaaaattcaaaagaaatctgacgaaaggaagaagaatgccaaaaatcagcagtcttctggaggagcagttccagcagggcgagcttcttgtctacattgctgcaagaccaggccggtgtgacagagcagacggctatgtgctcgaaggcaaggaggtctactgcagaagatcaaagctctgaaaggcaaataaatctcattcatagtgtaataaaggtgtttgctgttctatatgtaaacaaacaaacaaacaaacaaacacaaaacaatacaacaaaaatctatgaaaatagaaacaggggaaggaaatggataaaagagttcaagacttgaaaatggaaatagaataaataaaaagctcaacctgagggaaacctggaaacgaaaaattttaaagttgagcaggaacctcagaagccagccccaccaacagaatataaggtatggaagaaagaatatcaggatttaagacatgttagaagaaatggataccttgttcaaagaaaagtgaaatatgaaaaacagtc

SEQ ID NO: 31705 - DNA, 1167 bp, Mus musculus
cttggttgctctcctggggtgttaacttccttttctaggtgacagattgcttcgcataataggaataataatgtatctgagaacttactgtgtgccagacgtgtataggcacatatgtagaccactgcatccctttagccaccctgtgagaaacacatcaatctgcataaagtattgaaacaggaatatacatctcatgatgaagaatgaagagattatacctgtcaatcaagacagtagtcaataaatcatatatcatagtttatactcctttgaaaagctacatataatcactaagggtttttttaaaaataatttaaaatgtgagttacagcttgcagtatctaatatctaagctgtagctttcagaatacttggagtaactactgaatgggcattaagttttattttgctgcctataggaaaacaatactttattacgttgtcacccttcctacagagtcacttgttaaatgccagtgactgacaaaactaactagttactgacaaaactaactagtacttgctgctgcctgtttatactctgcctgtaggacttgctctgtgtactaaccctcattaacctaggtaggcacgctgcggtttctgtggactcaactgccgttcatgaaatggaaacacatactatgtccggcgcttctgtaaaggcagtaaatgcaggtgttgaaatccataattggccatgttcacgtgatcgcatgagcagtctcgttgattgtaaagctaacaccagaagcctcgtatacgccgcaccatgaggttccgaagcagtagcagggattgtggggatgctgactataaagcattggcatgcaggctgtggagagatgacactggacattggtgttgcatgtgtttcataccaggcgaggacagctcctgtacagctacttctgtacagtgtttatatgatttatctttttatttatgaaaataaaagccattttacttacaaaaaaaaaaaaaggatcccctcaagctgttttgctgttgtggtttttcatttggttgcttgttggttggttggttggttggttttggtctgttttttaagacagggctgtgttcttcttgctatcctggaattcactatgtagatcaggctagcctcatactcatagatgtctgcctgcctctcaagtgctg

SEQ ID NO: 31706 - DNA, 1176 bp, Mus musculus
ctttgagtaactaacatatggccagggtttcagaacaggaagcaccaaagtataagactccgtacaagtctgctctatgggtgttaaaataatgaatattaagggacaggttgtcatgcccaggtggggattcgagcaagtacataaggtttgctgtgtgcctctgttaactgtcaaagtggaggaccagaaactgaagtggagcgttctgtgtagttacaagaaaaatcccaaagacttggtgtttactctgaccgtttttatattgaggtccctgacaggcacaactagagaactcttgttgtgcacccaggctttgggtagcagctgggtgcacaacccctgaatacattgacattctgtcgctgttgtcattctgcactaaccaaagaaacccagctggtgtgaatgccaggtgaagaggcggcaagcaaggtgccattctgctgctgtcaatgtctctgcctgaatgaaaaccctgacagagatcgggattttattgtgtgtatgtgtgtgcctggcttctaactttggaactcgcaatcatccatttgaactcgtaggggtccacatagcattgttctcttctgtttggatcacgcaagtaccacatcgtgaatcttttatgtagcacctggatttgagcagccttaatttatatggctgttaatgtcttctctgctaaatgtagttttaggccatctgaaatttattgctaagtagagagccttttaaacgagtaattaattacatttcagtgcatgctgggaagcactgcttcactatgctgcagcctcagcccctggggcatttcagtgttaactatttgaatcctaagactatctgcaaatgttttaattttgagcataataaacagaatgtttctgaaagtgtgaatgtgaagagccatttgatttctgatttctgcttctactacttgacagtgatttttacctgtgttataaacttgagaggatttaatcccagcacttgagaggcaggcagacatctatgagtatgaggctagcctgatctacatagtgaattccaggatagcaagaagaacacagccctgtcttaaaaaacagaccaaaaccaaccaaccaaccaaccaacaagcaaccaaatgaaaaaccacaacagcaaaacagcttgaggggatcctttttttttttt

SEQ ID NO: 31707 - DNA, 1140 bp, Mus musculus
tcttgtgttctaggagataacagattaagggagtgggaccttggggcaagattctacccagcttaattagatccaggcatggtgctacacacctttaatcccatgagacaggcatgctgatctctctgcattcaaggtcaatctacagagctagaaccaggatagccaagcttaggcagtgaaggatttagaaaacataaagctagtgataatgtaatagtacaaggggatcatgttctagttcctgtaagcagcagaactccacagcttcagccatgtggctctggctctagagttaagaatggaaggaactactgggaaaattgatgctggttagctggagctaaggaattagcagtgattaagaagagaccaacatcactgaggtgaaatcttctggaaattgttttctgggagcacaaagaagctgtgttccagagatacccaaggttgtacctcatgctgcggctggacttggtaatgtgtaagagtcactcaggtggtactgcatgtgaaggcatgaaggtgtcatgaagaacagatgaggcttggcactgtgagaggtcatagaaggccattggagaaggtgtagcctcagctgtagttgatgggccaggactgaaggggtcaggcaaaggatttgatgcttggcaccatgaagagagcccatgagaggatattggtgaagcctagttggagtggaacaccccagtgtattggagatgtcagtaccatgggatgatcaccaagatcagcagccatagtggagtggatcaacctgagcttagagtgctacagagggcagagctggagaagtaatgccagcccttaggaggagcccaaaatatcaagtggaatcccagacactgaaacaagaagctgtaacattgaaattgccttggagactcaaagacgttaaagatgtcagagccatgggatacatgctgaggaaagctgctaacatggagtggaaccagcccaggagaaagcagtttgttgcagtcaacaaagatgaaaaaggagtggagatctgaagattgctttaacatcagcaatggagatgcagagtttagtgcttgcccagctagtttcctgtctttctttgaggattacagttaagtgattggatgaatctcagaa

SEQ ID NO: 31708 - DNA, 1156 bp, Mus musculus
aaatgctgcaatggaagatatctggataacaccaaagaagacagagatgatggaatagagaaatgacaacaaagaaagcgccacacacactctgctttgtgggtgactgcaggcatgggttatacaaccacaccagagtcagacactgtagaacagattggaagagatagatactgtgcacctttgctttccttacaaggaacgattttataattctaagacaccgatacattgaaaacaaaagaacagaaaaagatatgccatagccatttcaaacagggctaacatgttactgtcagacaaggagacttaaaggtaaaaactgtaatagagccaaagacatttataatgcttgaaaaggtcaatctatcaagaagacaaaatgattgagaacatgtatacatgtaacaagagccgcagactacacgaggcaaaagatgatggcaaggaaaaccaccacagacaacagggagaaaaatttcaccatcaccaccactactcctcaaacaatcaaaaagcaagaacctattgccgtggactctgtcgtgtcctcatcaactctttgtggagagagggccatgggctgcagtgagctgcagatctgcgtgctgatgctgctccactctctagtgtcctcctgccttccccagaacagtgtggtaaagcaggaaaacttggcagttctctggctctgtgagtctttcatggcctccaggtgccagctagcgcctctccgctcttctaaagtgcacttctgtcaggagtggacttcagacacagacctccctggatctcagtctcttccttttgtcttgtttagttttgcctttcattttctaggtactgttctcaaagtacagtttttagttttgatgaaatgtataatgtctgttttattatttttgtccaacctaggaaaccttttcccaaccccaaatcaccaagattttttttctttttgttttttatggcttagaagtattaggttttgcgttaaggtttgtaagctatttcaggtacatttttaagagtgtcataaggtgtggagatgaccgtggttcaatacttctttttggcatgaggctttcccattgctacagcactaggtattgaagagatgacccatgtctgtttcatatgtgtgtgtatttgtttc

SEQ ID NO: 31709 - DNA, 1234 bp, Mus musculus
ttttgaaatgattgcaattgtgaagaccactttgaaaactgcttattatgcatctaattacccttagagctgaacctctagtcagaatacaccacacctttgtgtgggtgtgagtatgcatgctcatggtttggggtacatgtgtatgttagcatgtgtgtgaatgccagaggtcaaccctgggtatcacactcaggagtctgttctacctcgttctttgaggcagagtctctcacttgggcctgcctggccttggtcattagttaggcaagctagctagcaagctctaaggatgcctctgtttctatctccccaactttttatatggatgttagagaccaaactcatgcatatgaaacaagtgttagagaccaaactcatgcatatgaaactcatgcatatgaaacaagtactccattgacttagctgttttcccatccttttatcttaatgtctcaactattcttctagtcagtcaggtattgggaaggaaacttactgttttatctgagaatgcttgataattcacagtaatcctaagatcttttttgtttgtttgtcatagttctgctcacaaaaggaagccgttgcccaaaactgtatataacttgctctctgatcgtgatttaaagaaaaagctgaaacagtatggcttatctgttcaaggaaacaaacagcagcttattaaaaggcatcaggagtttgtgcacatgtataatgcccagtgcgatgctttgcatcctaaatcaggtaaagtaatacccctgtgctcatctctgcataaagtaagtatgtagctcagagattataaaccacagaaagaattttagtaagtacttttttggtagtaggtaagataagcaaatgaattttaagagctacctgtagaacactgtgctaaggcagtcttcctctcaggctgtctcactgccccaggtcccttctctgagaatcactgctggcaattttgagtctctttccagagactgcaaggtggtaaagagtgatgtagcgtcttacactcctcctcctttaatctgagtgactgtgagcgaatcacatctctgtccttcagttttctcacctgtagcttgaggattataatcctccatgctgtattctttcgaggtgacagaacacaccgagcacagtaccttacaagtcgttagagctcagtggatgcttctactgtgattattatacataaacagacatccttagtcggtactgatgc

SEQ ID NO: 31710 - DNA, 3424 bp, Mus musculus
ctcacacacacacacacacacacacacacacacacacacacacacacactggctggttctctgcctacctccaagttttacaatccacaatctggaatctgtgtcacagcccccacaggagccctgtgacccatagctacaccactcctgtcacctacagatgctttgaagtgccatccttggcatttcttccctttgggtttacttccaccatttcttgggtcctccattgaaaggaatcttgaccgcttccccagggagggacctagtgagtcattggtccttgagtgtggggagaatcacccattctgccttgcctgtacgatcagcactgagtacactgtggaatcaagaatgggctccaaatgagaatgccaggaagatgcccgaaccatcaagcctccccttccctctcaactcctgctgtgatgggccctctgttttttgagcacataaagatatctccattttatagttgaagacagtaaggcctgggggtgggaggactgggacctgcacaagatatgccagatggcctagtgggctgcattgggctcaggaagccctcatttccaggaatctgctatctctgctatgcatccgggagataagacttcttttttgtatcccagggctatttccagatttttaagtccactcacctcccaggcaaaaatgcaatattctctgcctggataccagatagaagcaaaattgagtttacaaatctattaccggacacacctattgccagttacgctgtgcagatttgtctctgggttgacttatttcattttccttactgcctctcccccaaatgtcccaagagcagagcctcagctgttttccttaagcatctatctttcccccattggcaagtggctgatgaattcacatttagggaagcacacacacagatggcagatgagtccccagctcttccaacccccaatctgagctttgatgcagaacaaatggaaaagcactgtccacccccatccccaacacacttcttcatctggtccccttgcatgtctcagccacccccaggtcccaactcagccccaactcagtcccatcggtgtctatctagtgtgagcatctcccttctgactcctgcctgtttttagtccactatatattgctgtatttgttaaatgctggaaagtaactgttaaaatgtgaaactgtaattttttaaaatgaaggctacaattacattatagccattgccactcaccaaatctttgcacctagtagatagatcgatgtaaaaacaaataccagaaacctaattgtacagtgattggggtggggggtgtagtaacatagttagtagtcctcaatatagccaagcgtacaaggggaagtggtgtctaccaatgttcatcaccattattgagagctgtactgatcagttagtttataacgggcatttaaaaaattttattttggcttcatggaatgatttcttaacctccaacttaccccgaggtcaagccttttgtctttatgtataactagtgttcagtctgttttaggaatgaaccagcaagatgttcatttaattaaaactgaccaaagacaattaattcctggtctagtttcctgggcaccgtgtggcccagttgccactaaagacctttctccgatcaatttgagaacaagccgagcttccaacccgactcaccctccctgccctccttctctttgtcctcgtcgagctgctctgagctgtgggatcctgtgaacaactgtcgtctttccttctcttcagtgctaacttctcaccttgaagcgccttttgagcccccccggacagagcacacaactggagggaattgtgggcgtgggaattaagacgagggagtcttttctctgaagtcactaaaccagggatcaggagggaaacggattcctaaggaacggaaaggtttatatccaatgaagaaatcaaatcggagcggaaagagacacagggaaatggagccatccgttggctactggctggaaccagcagttcagagatctgccttataaacactttagactggtgtgtggtacgcaaggggagctggtgggagagaagcctgtccagatgttcccttccttggcatctcctagagtgccttgttgggtgcatccctttcttattcaggaggcatggatgcagaggacatatcgtgacttggtacttggtcatcattgagtggccagcgcacatacatttggaacgagtgctggaaaactctccaaggactaacacaacagccctccctctcagcctttctgtttctaacttctcctcttccagatggttccacactagagcaaatgcctcattcttccgaaaaacccagaaaggggtggagtggggtgtcatttctagctgcggtagtgggtcctgtcgtactgggaggaaaaggtgtgacaggggaggaaaaggcagaaaggggtgaaccaaggcattgcttagctgattttctgctgtgcagagctaaggctgacagttcgtgttcacttccctgtggttctctggggtctcttctccactgagatgaattccaagtggagaattccacatactccaagctacccatgggaactgccagaagggacttcactgtcagtccgagacctcctgacctcttaaagttgatctgccagcatactgttgtcccatcctttgggactggccaaatggctattgcagtcctttgctgacaactcctttctgtgcaaactgtcccaggcaaatcacaaagctgttccttgaagtggaaccaccagattgcactttccttccctgatggatgtgggtcgaggctagctctgctgcccaggccctcgttccaggcagtgtgactgtttacatggtttggcaataggtttgcttctgattgcttcagagtggctggtctgttttgtttgctttgctttctttcttcccccaaattatgacaggaaaaacaaactgaaaccaccctaggaaattgctggttgcctgtccccatgtgatgctaactgttgccctcttctgggtatcatttctctaccttatgaccaaaatgcccgtcctatagagtgtctgattggatcctctgttgcgtattctgatggtgcctgctggtttgatgtggagctatcctgtgaaataaaacagcttaactttttctcaaacatagtctgtggttgtttacaagcataaggacacacccaggggagtggccttctcctccttcagtccactctgtctgtacacctcttccatcagactccctgaaaacactctagtgttgcaggatatccgatccctttgtgaacactgaggttgtgttctttactgaagagtgaagaactctgtttccagttgtggtgcagctcagcacttaccacccacctttaatccctctggctggaatac

SEQ ID NO: 31711 - DNA, 1354 bp, Mus musculus
gcagtgacacccacggagaagatgttccctaatagctcctcggacaagtctggcaccatgtgacctgcaggactggtgacactgccatggcccactgcagcacaccaaggcctagggtggccttagtggcttccactagcttcccagggatctcctggccttggagggcagatcctggaaggtcagcctgggagggtgtatgtctgtggagagcagaggcccaggcgttagctgcaactcccgctcagccatgtgaatgccacagacctcttgtaggcaaacagacatgccaaggaatgctggagcaagatcagtcccaaggacagtgtttcctaagattgaggcagatgcttaccagcttctcatattgtcactggaaaattattctctcgatattctctacatacgtatatatgtgtatgtatataaatacatgcatatatacgcatatgtgtacgtatgtgtctgtaggtgtgtgtatatatatatatttatgcatctatatacatatactagagagctggacatacacacatgctaactgtatatagacgctccttttttttttctttttatgaaacttagatttacctcagacccatgccaccaaacatctcccactcttacttggtgggatttgcagggacttctctgggagaacttagaggccccacagtaactgcgaacgaagcaatataccactaacctgcagagacacaaaaccagaaacagtctccagctgtctccagaagtcgtggccttccagaacagtctgtctgcccctcaaggaagggtggggcaggcagtacccccaagcaggctgcccctaaaggtggggaacccttcatagaaaacccttcacccacccccctagagaccctgccctgtcacccggaggccaaaggtcaactgtacccccagaaggcacaggggaagttggtgtgaagacccttgagtttgtatactgactcaggatggtgagatgctgtggttgggggtgtgggggagaacaggaggaaacaaacaaaacccaaaacagtagtatggagtagttcaaaccttacacgtgctgtagggacaaatctgtgctgactgtacaagttttacttctctcatcttcaaaatatttaatggttttttttttcctcctcgttctactgattatgctttgtcagatttggaactaaatgggcaaggaggcattcagtcacatcatgtctgtttgagagcagtccacactctgttccccgctggagcctccagtgcccagccatcccttggcctccatcctaggaggactgtgctaggaagcaccgtaggctgggatgctatgaaaacggcagtgctcctcacc

SEQ ID NO: 31712 - DNA, 1217 bp, Mus musculus
ccatgagcttgaatgtactctgccctaattttcattcaccatgtggaagtctaagagccattgaaaggctgattgtgaggctcagtgacagagttccttcctagtgtgtgggaggctctgggttccatccccagcatgacaaaggaaaaaaagaaagagagaaggagaagagagtcacagaaagtattgtgggtgaacagagatgggactctagtgctgcgtgcaggcagggtgggggtcttatgtgtaaagtggaccagagagaaaagagagcccatgggaaagtgaagatagagtatatgctggcatgcagaaggaacagagatctcctctctctctctctctctctctctctctctctctcacacacacacacacacacacacacacatacacagagagagagagagagagagagagaggatacagggtctcagactagccttaaattcctgttatcctacctccacctcccaaatgcttggattataggtgtgcattaccacacctggccaaactggcttcagtaattatgcaacagaaaacaaggatctggcctgccagctccctatggacattttagatttgtttgtttatttactttgtgtgtgtgtgtgtgtgtgaaataagttatcattatgtaacccagactggtcacaaactcacagtcttcctaccctgggctctagaatgctgaggttgcaggtctgtgccaccgagcctagtactcagtggacattctgagaaattgcatggcttgcctaagatcaaggagtctgagcctggcgcgcaggggccctgagccccagcccatgtgttcatcaagcctgccgcccgtgattcctcactgaagctaaggctgcatgagtcaccggccacccctaagacctcacagatgctctttctcttgattttcttctagaagtggagcagattgaggccatcgccaagtttgactatgtggggcggtcccctcgtgaactatccttcaaaaaaggggcctcactactcctgtatcaccgtgcctcagaggactggtgggagggccgccacaacggtgtagatggactcatccctcatcagtacatagttgtacaggacatgtgagtgggaactggggccttctgtgaagaatgagggaatagattagtgatgtctggaatgggcagtggaaggggaatatatgtacaggacatgagtgtgataactggggcctt

SEQ ID NO: 31713 - DNA, 1221 bp, Mus musculus
ttaaagccgaatggaacaaacaaaaacatggggaaatgtgtgctaacgcagatgtcaaatgaccccaggtggctctggtttgtgccagcccgaggcctataaatacacggatgggctcccatctctctcctgaagcagcaagccctggggccaggagccagcctgtgatattccataatgccccagttgtccttcttagggcatcagttgggcgaatgtgacctgtggagaccaacttgtctcagctgacatcatagtgaagcctgcacccacttcctgcccaatgatctgtttggtttcccagtctgtcctcccctcagtgctacttcctgttacaggtgaccaggacattttattccttattctgcagccttcagtggtgttgaggaaatcaccaagccccatggggcattttgatcaatatgactttgtattggcaacatttccagattcttttattagtttaggatgcttccaaatctagttctgttatctgtctgtctgtctgtctatctatggagtgagggtggtgtggtgttgtgtttcaagacagggtttctctgtgtagccctgactgccctggaacttgctctgtagacctggcctcggtctcccagagatccaccttcctctgtctcctgaatgctgggactaaaggtgtgcactttggtgacatgtaaacatttaaaaatggctatggggattatgactgttctgttggacctagctcctgtcttgaactctagactgcagaagtgtgtgtgggtgctgggggaactggatatgaaccctaggttttccagaaatgtatctgggataagtcagcttctctcctttcaccttgcttggtcagagtaaactgatagtgtggataggtcagagatggataggtctgagagagatgggcagctgatggagtgggtagatctgagatgaggagcagtgaaggaggttacctgtctagagcttgtcactcatgccctactgacccagatacacttctctccaggaagacactgaaagttgaaacaaactcggtatggtgatatatgcctgtaatcccagcactcaggaggtagaggcaggaggagcagaagttcaaggccagcctctagtacacagagagcttgagacatggtctcctgtaatctgggccagcctcaacataccaacatacctggctctcctccacttctccctcctccttctcttcttcctctt

SEQ ID NO: 31714 - DNA, 1098 bp, Mus musculus
aaggaccagagttgtctacaaggaaagtaggcacttatttgttcagttacaatggtgagaaacaaaaggctttcattctccatcatttgcaggaagaagttctaagagactttgaagaactggctggaaaactcccatggtcagaccctttaaaagtctggcaaattaacaccactttcaagaagaagaaagcaaagcgcagaaaggcaaatcagagtgcaggtaaagagaaggctgactgtggacaaggagacaaagcagatgagaaagatggtaagaaaaagcatgccagcagcacttcagattcacatatcttggactattatgaaaatccagccatcaaagaagagatatcaaccttagtaggtgatgtcttgtcgtcttgcaaagatgaaactggtcaaagcttaagagaagaaactgaaccacaggtacagaagtttagagtcacctgcaacagagcaggagagaaacattgctttacctccaatgaggctgcgagagattttgggggtgctattcaagagtactttaagtggaaggctgatatgaccaactttgatgtagaggtgggtattagcttttattgatgatgaaaaagatctgtaatgtggctggggagatgggtcagtgggtaaagtatttgctgagcaagcttgagtacttgagttcagattcctagaatccacataaaagccagagtaaatgtatgaatgttaatcctagcactgatagttagagacaagtagtgtcctggagcagacaagctgaaacggcaagacccaggttcagtgagagactgtttcaaaaataaagtagaatggtagaaagacaatgtaaacttctgtcttttgtacagtcacccacaaaagaaaaaaaaggttctcatacatttgtaaaatttccagacagctagcacaagggccattgaacagtggccgtaaagctagaaggatgttaggaatagcatgacttgtggagatagatggataggtattgattgaaatttttactcagtaactctctagacttggacaagattgtctctttgagcctctgtttcaaatggagccaataatagtgtgtacctttaaggtc

SEQ ID NO: 31715 - DNA, 1140 bp, Mus musculus
ttttttttttaaaaaatgggttatataataaacctcataaaatagttatgaggagtgaggtggactaatattaaatgagtccctcccctataaaagagctattaaggctttttgtcttatacttaactttttttttaaatgtggtatctttagaaccaagggtcttagagttttagtatacagaaactgttgcatcgcttaatcagattttctagtttcaaatccagagaatccaaattcttcacagccaaagtcaaattaagaatttctgacttttaatgttaatttgcttactgtgaatataaaaatgatagcttttcctgaggcagggtctcactatgtatctctgcctgatctgcaacaagatatgtagactaaagttctgcctgcttttgtctcctgaatactaaggttaaaatgtagtaatacttttggaacttgcaggtcagattcttttataggggacacactaagggagcttgggtgatagttggtaaaatgtgtttcaagtgatgaaaacttgaattattatcaccgcaacctactttttaaaaaaaaaagccaggcctgttagagcatgcttaagggatccctaggacttgctgagcacacaagagtagttacttggcaggctcctggtgagagcatatttcaaaaaacaaggcagacaaccaagaaactacagttaaggttacctgtctttaaaccatctgcatatacacagggatattaaaatattccaaataatatttcattcaagttttcccccatcaaattgggacatggatttctccggtgaataggcagagttggaaactaaacaaatgttggttttgtgatttgtgaaattgttttcaagtgatagttaaagcccatgagatacagaacaaagctgctatttcgaggtctcttggtttatactcagaagcacttctttgggtttccctgcactatcctgatcatgtgctaggcctaccttaggctgattgttgttcaaataaacttaagtttcctgtcaggtgatgtcatatgatttcatatatcaaggcaaaacatgttatatatgttaaacatttgtacttaatgtgaaagttaggtctttgtgggtttgatttttaattttcaaaacctgagctaaat

SEQ ID NO: 31716 - DNA, 1155 bp, Mus musculus
tttctgtccctgagccccccacctcccctgttcttgcggccttgtgacaactctggtcgctcgtgggggcccagtcctcccctccataatcttcctgaacgcctctcctctggttttccagttcctatctcagatggctgctgcttttcccacaccaaagacattaccttcgccacccccacctcacattcttggactccctgtggcgtatgccccagtatccttgcgatatccctgttgaatttgtagggttctagcctggaattgagccagattttgtcgttttccctgcctagggcgtggagagcgatcttttaagaacgactctaaagaagagggggagggatatgcccctatgaatccgtgcaagccaagatcctaggtaaatggtagtgggcaaaagccctggttttagtaggtaatcgctcagaaggaaagttttaactcctgggaaagccccttctatgctaatttattctatcgggcgcctttgcctttctcattcttaggaataaggatctttctcctgtgtactgatgctgcagcccgccctgctggcctgggtcaggggtgcgtggatgacctgcattttctgctttctcatgttacttgtgtaacgtcttcaccagcaactcatttttcgcccagagctctgggctctgggttttgtctatacctggattccttttgccaattgttcctgtgctcaaaatacttaaaaagattcaggttctcgaatttcctccataccttgactaaattgtttttagatgacatatttgtgaccaaggtcatgtttacattacttccttgcttatatgttaaatacctatacttttgattggggaggatccagatggaggaggttccaggaggaggtttgtgtgcagcatattgagaggaaagtgttttgatggttaatttgatattaataatggtttaggtcgctaggaggaaaactttaagaggttattttagatgtgtgcaatctgacctaggactaaagcagagaatactgacataattagagatttctgagtttggaggacacaggaatttcttttccctggatttcttccagttttctcaggaggatcattagttctctgtccaaaatttgtggcctgttatgggattagaggctttaaggttatt

SEQ ID NO: 31717 - DNA, 1173 bp, Mus musculus
acatctgttgcttgagtgagatagagaatcggaatgatgattactttgtgtagcaaagaagacattgttgtagacgaacataaccagaatgctgcatgtaatgtacattgatcgagtttttgttgttttgttttgcatcatttctctcttttgtaaaaagaagtacagcatgttacccatgtaacattttattttaagtatggcagtcttggcagttacagtacacaaaatattttgatctgaaaaaaaattaaaagactggtcgaaggctcagttggtcaggtatttgtaaaaagagtacttgagttcagtttctcaaactcacgtaaaattgtgtgtgctgcttgtaatcccagccctgggcagacagagatgccaggtctctagggcttactcactggtcagcctggcctacttgtccagtttaggctagtaagagaccctgtctgagttgtggggaaagaattcctgaaaaatgaaatgaggttgtcctctggcctgaacatgcatacccttgttcacacatgcccaaacaagaaagtacatttgtgttattatcactgctgggaaacatttctcatcagcaaaatagcaacaattttaatgtgaactctagtgatacctcattatacattacaatagaaatttagatggtcttttcttctttttatagtctgttaacatggattattcccataaatttgtgggaactaaaaggaagctggtttttctagctccagtgtctctatcaaatatctattgctagcattagggttcccttgcaaaaaatactagaaatgtagcttttattgcttcaaccgaatcaaactagagacctaaaacagattctgacaaacgtgagaaagtaggagattacatcttgattccagtaatatttataacttgtagcttcccaaatagctaatttcatttttgtaagatcgaggcagcagtaggccagcatggaggtgaagcacacacagcacctcatcttggtgtgcagctgctccaccttacttcctgctattattatcccactacgcctcttcccagcaaaaaaagaaactaggacaaagggggaaattgaatgggctgctgtagtttatagcttatgttaggttgtggatttgtttatatgttctaaagctagtactttaaaggctagtgacaaat

SEQ ID NO: 31718 - DNA, 1164 bp, Mus musculus
tgttgtagaattcctgccatttgcccagcacacccagttatgattgtatactttataagcatctttgtaatagagccggaccactgcagtgaggaggcctcttgtacacatcagagtattatgcttaaggtttctttggtgttactgtccttagctgtcatttgagaaatcttctatcatattttcctttattacggtaagaaaaagtttgtgttttctaaacaacaagctacttacacaagaaactcccctggtaaacaatgcagtggattggcttttaagcagacaggagggttactttcccttcagaatttgactcagttataggaagaaacatagttaagaggtatttttggtttggtatgatttttgtttttcttgtaagtggttgtcaacatgtaattcttgtcacatgagtaaacctaaagagttaaacatattcaaggacagggtgaggtgatgattccacatcctaaatccagcatttgggtggaggaggcaggatcttttaagtttgaggagttctaggccagccagaacaatatagtgagaccaagtgtctcaaaaaaaaaaaaaagaagaagaaggcggcttcagggctgataatgtggcttagttggtaaaagtgcttgcctaccatgcaaacagctctagacttgattcctatcaccatataaaactctaggtgttttggtacatccctattattagcatgcaggaggtagaggcaggtgaattggagtttgaaatcagcctacagagtacctaagatggaagacacaccttcagatagcttttatgttcatagtaattgtttgttgtcattgataaagggagaagtgggaaatctgcatatataaaactcaaggtaaagctacataatataaattcccccagagagctggaagattctggacttgttaataaacacacttttaatttagatattgctacccaacgtaattagtttaataaataaaagctacgtgttaaaatcttaattttcttttgaaatctgctgtatttgtgactttcttgtgagtaaattccccctttcattgttactcatacaacccagagcttattgaatgctaggcaagcactctaccactcagctataccttcagttccctgagttaatctttttctaattatgtttttgtc

SEQ ID NO: 31719 - DNA, 1149 bp, Mus musculus
aaggtccacagcctcagtacaaagactgtctgaagcatacgaggcctgttctctttctaaagctgcactcttcttcctgccagtcctcttcacaggattgctaaagctgacttgtgcgtttctttcattgggttgactgtttactggtctcttgtctcccagctgcttccgcctcacctgtctgatacatttcttctgaaatcttaaaagtctagaaactacatataaatggtaactctcaaaagagtgctcagtattggaagacaggctgggtttgttagtggatccggtattttgtagatctggtgggttgataattgatggcagagtgaaactatatttttactttgcctctgtccttcctcttacttgctgctgctgaatacttgactattttatttcttctttttactgtcaccttcaaacctttttttttttcacttcaaaattgtgaatatacttttgaaaatatttttctaaagattactttgttttccagatttttaaaaattggaaacatgcgcacgcccacacccacacacataaatgtaaagggcatgccttctaatggatggtgacttgtgaacagctttcttccatgtttatgacctgttattattttggatattgagagctcattttggtcagtactatatttgactttgtgaaataaaaacatgaatttaagaaattctgatcacctactcttccctttcttcattctctttccccaaatttaataggttctctattttcctttccttttggggatatagtaagttgatggaattgaccccaggtagaaccgattccccctgcccccagtttttataaggaatggaatggggaaaagaaaggagtcatcatttaatatgttttgctaggcctgtatccaaagtaaatctggtatttgatgaaaagaggtctgtgccccatgtggtggtgtgtgccaataatagcacttgggagggtcagccaaggaggatacaagtttaagtctgatgtgggctatagcaattgcttaaaaacaaacaaaacaaaacagaaatgtaaaagttactgagtttggaacccccatggaaagacaagaaaaacttgagaatcctgaggggaacagttttgatagaagggaagagaagggcagtatct

SEQ ID NO: 31720 - DNA, 1174 bp, Mus musculus
atccaaactgtagtaattttttttttgtcagattgattaaaaacatttgctaattgtgttcatttgtgcttagaaaaaatttaatgacaatttactttggttttgagctctgaatgtaggacagaaattgcttgtcgttgctttatgcactaaaatgtgttgaggtagctcacctattttaaaacatttagttttaaatttctgctataactgtttactatatttaaaataattttaattttttttatcttaaagtttagtgatgcatatgctatcttaataatactttgaataaattcttataaaccctactaattttacttttgaaatagcttctggttgatgctttttttattgttgtttttaatacttttctacccccagactcgagaagaccgaaaggttgaagccatcatgcatgcttttgaatctttagagaagagaaagaaacggcgggatcagcctgtagaacagagcagctcggacatagagattactactagcagttcagagatagtagttggagaagagacaaaaactgcagcccctgagtctgaagttagcagccctgtttcaaatgttgctatcccaagcaccccacagagcactggtgtgaatactcggaggtcctcccatgctggggtaagagggaaagctctgaaaagtcctgcgtatgctaatgtcagttgtctttttctatagtggtagaagttagtattttcaacgttgctctgtatcagaataagcaaagctattttgatctcaacagctggtttgtgggatgcagagagacaggtgaggtcaacatttgaatgacaaagtcccttagcacttaagtgtctcccagataagttcatagaatcctttggtttgggagaatgcatactgagcacgaaggcttcacctagctcagtctccatctctaagggaagaaaccaaatctttgggtttctctcactgattctctgaatagctcaggtacatgactgaccttccagggccttctcaggactagtgtttaacataggacttctgggtgtagaaaagaaacaagaattatcttgcctaagaaccttaatattaggtacctagctttaattggcttttgacctattttattttatacatgtttgttagaaatagaattaactaaggcagatgtttgtctatggtc

SEQ ID NO: 31721 - DNA, 1143 bp, Mus musculus
ttactggatcccatgtcaaccgtgctgcatctaaataccccaaaaccaaaaaggtaagcgacgatataaatttcatatggtaaggagtatcacgctaaagcaagagggcctataatccccaaggaagaagtaaccttagaattattagattgaacattttacgtaaaaagttgtttgtgctggaagctgaaaccatcctacttatttttgttcacttgattttagacagaatttaaatcactggtaaaacactatttttatctgtctttgtgagcatggaaaatgtaaaggaaagataccttatactctgaatgctcagctcatcttcactgtggttgctgatctgttctagttttagttgaagtttgatttgtgaactacactactgcttctggcagctgttacaaatgcagtgataactaatggtttttgttttgttttgtttttttaaacctttagtatctagttacagaatggttaaatgacaaggcagagaagcaagaatgccctgttgagtgtcctttgcgtatcaccactgacccaactgtgttggcaacaaccctgaacatgctaccaggtcttattcattccccattaatttgtaccacccccaaacactacattcgctttggctcaccctttatgcctgagaggcgtcgaaggccccttctgcctgatggcacattcagctcctgtaagaaggtatgtgcctttctgtctgtctctatctatctatctgtctatctgtctatctccccctctaccccccaccccctccccgtgtgtgtctgtgtgtgtatacctgcccatgaatgaaaatatgtttaatactgtagggtgcatatagttgtagtatattttacataattgtctagataattcgagaatctctagataactttgtgagtttatattgtgttgttaaacatggaagtagactctttagaagtcactgtggtcaagttggaatgtatacagcatttttggtgctcaaacttgtgactgtttacctgtccatacctagaagcttttcacattactgagagcacaaggcaattgatgggatggatgtgttttgtatatgcttttgtgatactggttagcatggtaatttgtgactattgtatgatgttggaccccaaa

SEQ ID NO: 31722 - DNA, 1131 bp, Mus musculus
tggcccagtccctatcaccacatacataaacttgatattgtggtagacacctacccagaggatgaagcagaagcatcattatcaccacatacataaacttgatactgtggtagacacctacccagaggatgaagcagaagcatcattatcaccacatacataaacttgatactgtggtagacacctacccagaggatgaagcagaagcatcattatcagggtgatctttagatacttaggatgtttgaggccaatctaggttacatgagactatttcaaaactaatcttcattaaagagaagggaaagaacagccaaagccagccttggctgcacaggcccgaccctgtctagaacctatgtgaatgtatttgtattgtattactcaccaattaatttgtaatgatctggttagtgcactgaaaatagatatcttttaaatggttattgaaaattctctgggttttccctcccattgtagcgctggataaagcaagccttggaagaagggatgactcagacttcatctgtgccccaagagactagaacacagcacctataccaaagtaatgagactagtaattcttctagtatctgtaaagacaatgcaggtatgtatctgatccttttctaaatttgataagaacagtcaccatttgaggttcacagtgaaattttcagtgttggttctctgatataaaaagaaatagtgttttctctaaatagttaatttacatctgtctttacagaggaagagaaagatctcgagtcagggatcagttttcccaggacgacaaagaaggaactagacagtgtacagataacagcagaaatggttataaaaaaggttagatacgtttaacgtagtaagtttaggaaatatttatttgtacttataaggggagacagtagaaagtggtggaacactttcaaggggaacagttggaactgttaagtggcttgttgggtgggatctgactaaaggggcaggaaataatggcatccttgaggaatcattgttgttttgttttttttcaaaagaacttgcctcccagaactataaaatttctgactaagacataaagatatgggccaaatggctatgaaaaaaggacctgatcattgtctttta

SEQ ID NO: 31723 - DNA, 1120 bp, Mus musculus
ccagcaacttaagacctttctgtggtgtgtgtgcttggggctcagatacatccctggctacactgccagccccacatatgctgtcaaacgatgtgatgaaggctgagcagagtagtcatgtttgcagaattgcctgatgccttcattccctttttgccctttgactttttctgttataccatgtcccatatctctgttgatttttatttcagctttgtcaccgaaaagacctagatttgacaaaagtgggattcccagactccagcactcacagctgcgctgataggccctccctgcttaactgcaatcatcctgacctggcttctcatccctctgttgttcccacctccgaggctggcttcccaagcaggagtggagatggtcctcagaccttgctgagaaactcagaccaggcgtttaggacagagttcaatttgatgtacgcctactcccctttgaatgctatgcctcgagcagatggactgtatagagggtctcccttggtgggagacaggaagcctttacatttagatggaggatattgttcccctgctgaaggcttttccagcagatatgaacatggctttatgaaagacctctctcggggatccatgtcacctggtggtgaaaggacctgtgaaggagtcccatctgctcctcagaacccaccgcaaaggaaaaaggtaagtattcatgttactcttttaaagaatattagtcagataattcagaactttctaagctccagtgcataacacttgtcctactctttgctatgacctgtaaaaattagttcttttatttgattacattacttctttggcttatgtgggggggggggggcatgaacatgccaaaagcacatacatagaaatcagattacttgtgggaatcagttctttgcttccaccatgtgggtcctgggattgaactcaagttatcggtcttggcagccacagccttcatcaattgagtagactctattagtataactggaaagtgttgtgaatagccggcaggactgaagtgcagtcagtaaaagagtgtagccatgagtaaggctttccatctttagcatcccaaatacaaataaagcaaatatctagcttgccttagaggc

SEQ ID NO: 31724 - DNA, 2175 bp, Mus musculus
gcctaccaggcctccagggtatctgcggtttccaattcacagcactacccacatcgtggtagtgggggtgtacaccagtaccgactccagccactgcaagggtcaggagtcaagactcagacaggactttcctagggcttctggatatgggcaaactgaacttaatgagcccatagctgcttccttccagctgcctctggaatcaaggccgagcatatcgctggggaagaggggtacaaggtgccagaggaatgggtctggtcagcaagaaatgagacttgtggtcatgactggcctccggccttggagaaagatgtaaatcttgtctgaagcagagactataaagaagtttctccctgctgttaagggtacattgttaacaagcaaatggtgtttcggttagtaacggttctaagtgcaatgacttgtgttgaagcctatgtctcccatccttgcctgtagcctgtagtcacttgtgcagtgaggacatctttttcaataatttttttttttttcttttcaaaagaaaaaagtgggaaagagccaatcttaaagccccaagccatctgagtagtgttagggttttatgcacttaagggaaaaaaaggtaggtatgtaaatgtctgctgtgagacaaccattcctaatgcagatgcatggtcaaggtgtgtccacctggagtgctccctgcctttgtcttaaagccaccaggaaatgggcagggagaggaatgtgggtgcctactctgactgaggcttgcccggctctctgagaggaggagctcctgggtatttgggagcagatttgggatggactgggctccagctgttaccatccactcctccttccaagttgtttcacagtttaatgatagccctgtgaagtagagaagtgaggcaggccagtttaggaaacatccagtggtctgggtaatctttgaattttaattttcctattcccagttaatcaggagttgctgtcctaagagcaggacggcctccgtgactgaaaagcatgcactcatgactgcagggtaagaatgggacagatagggttgcggagtggcaccgacagggctgtgattgtgtgtggggcatacctgccccacgtttctatggggaatgcttatatgacagtgagcaggtgagagttagcaagtcacccatacccctaacactgttctgtaggagagacaaagagcagactggcttctccccatcagtgcattgtgcctgttgtacacccctggaggagccctgaagccagcccaggtggggtacacaatctttttaaattccatatggttgccagcttatttctttcacttgtttactgtaatacctggcgtgtttttatttatctaattttgtattcagctataaccatggtagggtagtgagtgtatgacagtgtgatccctggtgctgcagtggaccgtacttcttttggacaagatatactgtgagtctccctccttacctctaattgttttctttcccattccctagactctttcatctccttttctaccctgacctacaactatcatatgcacagtcttctctctttgtgtgtgactgttacaaattttcacttttcaaaattgaaatcaggtgtttgctcaaatgaggggagaattttttttttgttttggttttatttgtttttaatgctgaaccctcggcatagtactttctgttgttttccccacaaacccatcagtctgggagagcattgggagtggaaatcatgttgcctgggatgctggtttctttgtatattatataaaacgtatgtaaatgtctctccatttgggctggggtttgcattctcccattggctaaaagccaaggggagaggccagcgggcaggcggccctcaccctgcctggcacgtgcagagaccccagccactctgtgtgggcagggtgctgtcaagaccagacctctgggggggagggtggggggaggggggactcttggaagggaaggagcaccacttcttcctcaagtggagtgtttacaccttgctgtaacatttgaactttcacaagagatgtaataattttgataataaaattcttaaccataatcatcataatgttaacaatgtgtttgttcgcttctggaacatcacgttccctgatttaacctttcctcacgaaaggcaaggtgg

SEQ ID NO: 31725 - DNA, 1132 bp, Mus musculus
aaagagaacttcagctaagatgctagaagtcaagacagatgttcccacccactcatttctaagatgagattggggaataaaataactttggacaggaacctggggaagagggacactaagctggcctgcaccaggctggaggcctggggttttcagcagaaccctatctggttctctcacttggtgctcctgttccacaatagatgacagcgggctgctggtacactgtatctcaggctgggaccggacccccctcttcatctctcttctgcgcctttccttgtgggctgtgagtatgaatgagctggagcggggaatatgcagagaccctattaggtctccaattgtcacgtttaacactgttcttggttgggggctggggtaggataagggtggtcctgtcacccagtctatgttttggtttgctcctggagcaaggaggcccgcactaggaaggcagctttctgagcttgccaccctttgtctcccccaggatgggctaattcacacatccctgaagcctgctgagatcctctacctgactgtggcctatgactggttcctctttgggtaagtcttcaaggaggtgtgtgtgcatggtgtattagcttttcttatgaggaacagagataagaaaacagctggaggaaaaaagttggctctctttggaaaggatcaaagatgttggcaggcttcatgtgatgcattggtgccaaagacttggtctgtctgtgggtcacacggctcctcagcgctgggttgtgctttgaccttctcactcttctttttcagacacatgttggtagatcggctcagcaaaggggaggaggtaaggacctccgcacagacatggactacaccttaacacacaaggcattcattctggttgccatgctgggaaggcagtttctccacccaggatgcttggatgagcttaccatcctcttccctcaggcagtgtggtgggaaaggcaagagcacagaccgtgtgtgggcctcgggctccctttgtaccacagagggagttctggccacagtggctgtgaccatttcaggctcctcatcttccctctgcacttggctctggagccagtgttcaagttgctttccatggctccatgctcaaagctga

SEQ ID NO: 31726 - DNA, 1148 bp, Mus musculus
tggcagattgcccatcgtgactacggctggcatcctaagacatcccaggctaagggcccgagccctttggccaacaaagaactgggtgaggagtgtgatgctggggcgttgggctgaggttggagagcctgtcattcttaaccatctccccacagttcccatctctgtgcatggagggcacgtgtgtggctcaattaatgtagtttcctcacttctaatttaggaaactttttccggaatctgtggggaccttatgctggctgggcccaagcagtaagtatacctagtccagaccctaaaggactttccctcaccctgcctgacccctggactcttcagctacctgttctcataactcccaccacccccattgaccccagtcctgacctcagcatgccctgtttcccatagactccttatgccccctcccataggtgctgttcagtgctgaccttcgccaaccaagcctgtctcgggagccaccagcaaagcgcaaaaagggatctaagaggccagagggctaggtagggctcaggggcaaaaggtcttttttcctttgttctccatttctttcccttgtctctcccccccccccaacccccgacccctaagtctcaagtcagaaagacttaacactcccacctcagaggccagaaccccaaatcaaagtcagtttttacaatagggaaaaaggaagctatttgagcaaacggaactgtcttgttttatcttccctttattacaagaaggaacaataaaatagaaacatttgtatggaaaacgcagtgaagagtgagaggggaggggtgaagaggtgtggggtcagaaactccccagatctggagtgaggaggaagcaggctgcctccaacccctctcatgaaagaaaccctgacttccttgatgttcaatccatggccctagagcttgggggtggtgcagggggcagttccgagcctggttccacacagcagtctcggcagcagcagccagctgctggccctgtgtagagggaaagggtaagggtggctgtagagccggctccagctccagccttgttcttcctcatggaccacctatgcccttccacgagaccctggttcttaccaccagctgttggtgtcagcagctccccgtggctgccagtct

SEQ ID NO: 31727 - DNA, 1168 bp, Mus musculus
atatctgtatacataaaaacaaacaaacaaacaaagtctaacaggcttcaatcaggagataccatgtgtccagcactgtgggagcactgaggagttagcagaaaatgaaacactccaagtgcctgcccttaagagctgacatgtagaaagaatcagtgagtaaataaatctatattagtgtcacctggtcaaagtcactgtgaagataaaatcaaacaggagtagggagatgtggatagatgtcacttcagatagtcaaaggccctttgtgatggtaaaatctgagtggcttttgagccagtttaggtgtgatccggtttaggtgtggggaggatgtcaaacatgaagaccctatgacagcatgttcaaggacagaaggaaggccagtactgccagacagaagtgagcaagacagaggacttcctgtgagtcccgtctgactcttggcactgccccaaaatgctctccaagccaacgagtatttttaaagctgacatgaattctctttctctctgcctaggctctgtggctacccacccttttatgatgaaaatgatgccaaactctttgaacagattttgaaggcagagtatgagtttgactctccttattgggacgacatctctgactctggtaattgggtctttgccttcttcatctagcccctgcctcacgtcttcatctgatccaggagtctccccactgtcttgcctccgtcgtattttattcccagactagaagcagatgtcgtatgtcttatcttgggttccctctgcttggcccctatctcagagctctgtaggcattcagtcttccaatatagtatttacaaaattacctcccctggagcttactgactctctgaggcttaaacagcattaatatttctttttttttttttttttttttttttagattttttttttttttaagatttatttatttattatatgtaagtacactgtagctgtcttcagacgcaccagaagagggcatcagatctctgttacaggtggttgtgagccaccatgtggttgctgggatttgaacttcggacctttggaagagcagtcgggtgctcttaccccctgagccatctcaccagccccaagcattaatatttctatcttccattttgtgtcccagtcagggaccagcttgtgatggc

SEQ ID NO: 31728 - DNA, 1176 bp, Mus musculus
tttataccttgtatctttttgttgtcggtagtggtggttgtgggtttttggttggttggtttgtctgcctcccgagtactgggactaaaggtgtgctatcctgcctggcttctattttatatcttgctaatgcatatcagcttctaggtgtattttgatttttggttcttgtttgtttgtttgtttatttgagaaaagatagggtctcagcccaggctcagactcctgatcagcctatgtcagcctccagaatgatcataggctaggtgtgtacgccacgcctagctgtgttgagtctttctatacgtgtttcccttactggagtgtgagtggagagattggatcttgttggcctttcgtggcaccagccttggccttgggcaacaaatccgtgaggaaagaaagaataaacggatgcttcctgaccgagtcccatgccaggagatcctctcacattccagtctcagatgggcagtgtttacctctcagagctgagtgagctctttgctgcagattccccccctagggaaacactactcccagcgctgggcccaggaggatctgctggaggagcagaaggacggcgctcgggcagcagctgtggctgacaagaagaaaggcctcataggaccactgacagaactggacacaaaaggtaagcctcagcctcctcacagcccaggcctggatctgaggccccggagcttcaggcctccagctgttgttctccctgtccagatgtggatgccctgctgaagaagtctgaggcccagcatgaacagccagaagacgggtgtccctttggagccctgacacagcgcctgctgcaggccctagtggaggtgagcaggccatctgactgggaaccacaagctaggcatggtggcatctgcttgtaaccccagtggcacttgggagacagaggctcttagctcaagttcaatctggttacatgtgactgtctcagaaaacaaaaaaacatttacacacaggctcgagcgagcatgcgcacacgtgcatacacacacacacacacacacatacacacacacacacacacacacacacacacacacacacacacacacacgagcgctcgtgtgctggcactttattgttattttgctttttgagatagagtcacactatggactagaacttttagtcctcgtgcct

SEQ ID NO: 31729 - DNA, 1718 bp, Mus musculus
cttatctaaagcagcttcagttgctaggcaagctacagggaagcccttagcacttaattttttctgctctaattttgtgtttcaggctagtgtcttcagatcactgctaaagtccggccaggttaagagctcatagggtgctagaaatgatttggtggctcagggcacttgttgctcttttggaggacctgggtttggttcataaagtgccaaaggctgatccagctctcagagacccgaacagcagcagctcaccaggatgtaataaccccacactcattgcctgtcattctctttgacagttttaaaacatctagctggatctcgcagccttcccctcggcctccctgtgtctctgcgtctgcaaaggtgtcctggagtcactccccggagcagcggtgcagcagcagcagccggaagctgggttgggtgggcattggatgtgggaggtgggtgtggtgtgcttgctagctgtgcagaaaggcagcagtgggcctgccccatagccacatgtgtctgctctggctagtttctgatgctcagtcccctggaccgggacagactttttttttaaacgtcttgaaacctaaactctgtgcttgtagaagactgtaacctttttgtctttttttttttttttttaaacaaacaaaaaaaccaacctccagctccagtggctgtgactggccccagtgattgtaccttattggtcgctgtggtctgggcgggcctggagccagaaggcgactatttttcccgagccacccccggtggggaaagagggaaatttcagactacagtttttttcccttgctgtcttacaagcctccttaggcctagtagagaggcggtatggaccctctactagcctcctgagtcctgcctgaagatgcccactgcactggttgggaacaagggctgaatctatgattgccgggcaggcctaggagcgggggcccagaagccaggcaaacttctggccgtaggggccacccggtgtccatccgaccccttccagctgagaggcccaaggtttgcccgtctgggtgcagggcctgtgctgcaggtccagaggtgagtcctgcctgctcgggctcctctgctcccatgctcgctgtctcggattctgatgaactcccctcccccctaattaaagtctcttcctgccccttcggggctgcatgaggtctgtgctctgtgtgggtgtgtgaaaggatgcgtgttttgatgccttggagccttgtggctggcatttgggtctggagcagcccaccagacaattttgtcatcgatcccggccaagggccccaactcggagcacttcactacagccaagcaccgtcattctgaaggcggtttctgcccagacagagatgcggtgcttccacagcctgcttccattctagctttcggggaccccaggaaccatgatcctactttgtggataagaagagtcatttcccacgctacctaaccttgttagtctgactggtgcctcagcaggtgttgggggtaactcggtattgaacatgctgggaacttccgttggatagtgctcactcctcaagtaagcagtcctttctctcgctgtgtcctgatacttggagacctgtgaactctatgccattatccctgtcacacaggggctaggtgaagtagttgatctctctaccttctgtttaacttgtgtatgctggccatctgtactgacatccagt

SEQ ID NO: 31730 - DNA, 1718 bp, Mus musculus; identical to SEQ ID NO: 31729

SEQ ID NO: 31731 - DNA, 1323 bp, Mus musculus
agcacttggaatgaaagttgcttctccctttgctctgtcttacagtgtgaccctcaagtacgaaatcaagaagctgatctacgtgcatctcgtcatatggctgctgttggtggccaagatgagcgtgggacacctgaggctcttgtcacatgatcaggtggccatgccctatcagtgggaatatccgtatttgttgagcattgtgccctctgtcttgggcctgctctccttccctcggaacaacattagctacctggtgctctccatgatcagcatggggctcttctccatcgctcccctcatttatggcagcatggagatgttccctgcggcacagcaactctaccgccatggcaaggcctatcgcttcctgtttggtttttctgctgtctctgtcatgtacctggtgttggtactggcagtccaagttcatgcctggcaactgtactacagcaaaaaactcttagactcttggttcaccagcacacaggagaagaaacggaaatgaagcctgcttgataaactgctctgaggggtaaaacctaggtctcccattgagcagcgtgaagggagctgtccagactctccatcgattgtggcatctgtgatgttggcacctagtgcacactaggctcagattttggcctagagttctgttaccatctgctgaggtggcaaagctgttgtatttaatttatgcttgactagctgcagctgggtgaccaatggctgtgacacactttacctggttgaacttgaggccctttagagtttgggttttccagactgagccttatccttgccttctcttggccgtactccctccttccattcgtcacctcttcaccaccagtactagaagaaatatggaataaatcagtacatgaaagcagacttcagtctgtgggtcatgggcaagcaacatttgggaagttgctcccctatgggctgttctgtttactgcaaaccattttaaataaaaagaacctcaataaataaagttaagactgtcctgtgcctcgtgttggagatttgattgtttttcagagttgtatggagctgcctgtggagaagagagctggggtgaggatctaagtcagctgcagccctctagcttttaggtaagaactacccggggtgaggggcaccggaggtgtgcttcaggagttaagagcactggctgctcttacagaggacccaggttgggttctcagcacccacgtggtggctcaaaaccatttctaactactgtcccagggtattttatgccctcttcctgcctctggagatacttaatgggcatgaagtatgaagacaaacttg

SEQ ID NO: 31732 - DNA, 1185 bp, Mus musculus
gtgtaggcagcaactcagatagcctggttaatcccaggcctgccaatacagctgtaggagatacgtgctttagaactgggaagctgttcaaaagaaagaaactatagtgatagatttcaagctagatagtatagatgcagtcattggctggaaatggggccagtaggtaggcagagtggtctactcacatgagcccaagaccttggcctgcattctgagcccttcacctccagccatccaccaccctctcctcatagggttctgcggtatttgactgtttcgaggctagtcttggggctgaggtacagatctggtcctacacgaagcccaggtaccagaaagagctcaacctcacacagcagctgcctggtgagtcaccccaaagtcctggttccccagtctgcagtccctttggtcactccccatctttctggtcccatcattttcaggcaaggttctgagctgacaccctcctcagtcaatttcgtgtgcttctagcccctgggataggtgctctgtgccctgtgtaagcgtgggtggtcttcaggggacaggcagcccctctcaggatctccccatggtttgcactgcttccctttttgccttggtccccatccccactggacgtttttctgtgatctctccccagactgcaggggtcttgaagtccgggacagcatccagagctgctggggtaggggccagggacagtgggctgggtgggggagggcaggatctggagtttacacaattggatgcttggggttgacatcagcctcagagatgccaggttccaaaagtcacaggacatgttctatcattcattcattcattcattcattcatttgctcattccacatgaactgcagaattgcttcatctatgtatgtcaggcactagaaatattacaaatgctcattgatcccaggaacatctagtggcccaaagcactgttaagattctggtgcctctcctgactgaccagagtgggtaaactattaaacctgaaacagcgaccaaaaaatgaggagattttgatgttacttttgttttgtattttcttttaaagagaatttctcatgcatatgtagcatatattttaaaaagatataagtacaatgatttttttttttgagacagggtttcactgtgcagctctggcactataaagaccaggttggtctc

SEQ ID NO: 31733 - DNA, 1277 bp, Mus musculus
atattagatggtgacaagttatggagaatattcaagagagggggatgggaaggatgggagttccagtagtgagacagcctcactgtaatgaaggatatgaagaaaaaaccctgtatttgagagacagagtcacataggaagagaacagcctgtgcaaaggctgtagggcaggagcaaggcaaagtgtgcttaaggaatgtgaaggcatctcatgtgtttgcagcaaagtattcaagatagaggtactaacatattaggtttgagaggtctcagaagctagcctggttaaggttcgtggaagctgttgtaaagactagcttatattgggattactatgtgggggcataagcagagtctagggacagtgattgcattaaggaggtagcaggattctactggctgcagaagaggagctgtccccaagaagcaagctggagcctctatgggcttggctctgggcttgtgtctggggacaaagcccagtctgagatggagatacagtctgtcctccaagggcctcctagtccaaacccttccaggggtttgatggaatctctaacggggcagttggtgagtatggcccaggcttagctgtgcagagggggtgaagagagtctgaacttccccatctctctctgcttttcccactagtcctgccctggctcaatgtgtctacagatggtgacaatgtccttctgacactggatgtctctgaggagcaggactttagcttcttactgtacctgcgtccagtcccggatgctctcaaatccttgtggtacaaaaacctggtgaggcttctcctctagacccatgctctccctgtgctgatgcccatgctaaggatgtcggcaaactgtcaaaggggacacacccagagcagaggaccttagcagtggggagggtctgtctgtccttggactttgggcctccccacttcctctttcttagcttctcttaacccacttctgtctactcatcccacagactggacctcagaacattactttaaaccacacagacctggttccctgcctctgcattcaggtaagagcagaattcatctgtacatgggagacaggctagggaggcacggagggatggcctccaatcctctgggaccactgtcctccatactctgagatagagagcacggccccttcgggtggctgtctcattgctcttgctgtcctatgccttctgcttgttatgtgtccggaaccctgttcctggtgctccatccacaagactgttccctgtggctcgtggcccaccca

SEQ ID NO: 31734 - DNA, 1190 bp, Mus musculus
gactccacagacatgatgtggtatgccacaggccacacaaatacaaacacacacacacacacacacacaccaaaataacaacaacaacaataatagaaaagaaggagggtgaggagaaagaagaagaaaagaagaaaaaagaaagaagtagatcttcgaaaatgtgtcagaatatattgtaaaatgatgaggagaaaggcaagttacaagagcaattaagaaagcgtgggctcatttttatttaatatgctctgggaaaagcctggaagatatgccaggctgtatgtatgatctacctatgcctgtatgaatccagagaaagtgagctcccagtccccgcaggtatgcaaataaagcgggctgtagctagaaggaacactgcagaaccccacagggctctgacaccatctgggctgtgctgcttgtgagaaaggggcggtgaggagcagcgaacagagaccgttcccaaaggaaagggttaagtatcccgcgctcctgtgggcgggcttgacgaggagatcggcagagccgggctctgctggccaagcctgagcatctcggaggatgcgcctccgggagcggctgcagggacgcgcgcaaggtgaacgcatggctgcggatgcagcgcgcaggtgaggagctggccgagggaaggggagatggcgggacccaagaaggcaaggagcaaggcttacagccccttcgcgggcatgggcctgcacggtgccaaaccccacccgggacactgcgggaaggcatggagccagggagagagaagctggagaaggaggaagagaggtaacccgagatggaccagcttctgcaggctgtcctgcagaggccctcaccctgctccccccaccccctagtctctgcggctgattgatctcatctcccctcagaactgtccagccatggggaccctaatgctaggcaagctcctgcctggactgcgggtgcccacatctcttgcatcgggggtggtaggcagatggcatgttattcactgaaggcccagctcagccatctcctcctctgcaaagtctacagagctgtacgggcttcagtatctctagtatgtgttttcagctggctgtgcgaccttggacaagttgctcaacctctctgactcttggttgcccactctcctttcctgtgtgatgggtacttgcacctgctgtatgggaagg

SEQ ID NO: 31735 - DNA, 1857 bp, Mus musculus
aagattgctttatgagtatttgtatatctgggaggcatatggacatctctgcttcacacgatccaatgagctcatacacagaacagccttgcttagctgctggtcagagaggtggtcactccatgctgtccccagctgtcagctcagtggcaagcatccctcttagcatccctgtgttctcttcctgtgcagacagagtgggaagctttggaactgacagatcaccagtgggcgctcgatgatgtggaagaagaactcatggccagagacctccactttgaaggcatgttcaaaaaggaactacagacgtccatattctaaccacatgcggggtcagctgtgtccggaacttgcagtagcacttaaccttgtaacttccgtggagctggagcctctgagaataaaaaggagggtgcaggggctggcgggtgcagcaaggctcattcttgtctgagctgggttcccctttatgttggaaactagaggaaaaggagttgtgggtgactgctgtcttaaagtttgtgattgttccttcaggtgactctagtaaggacgtcagagaaaggggagaccccatgctactgagaatagctcaacccttagcaaaaactccgtgcttggaaagagcattgtcagttatagcagttactatgttcggtcagcctgacttccagccacagtaaactcctgttttcttaggatccaaacaccctgcattttaccttgaatttcttgtttgtatttttaactttctttacacacgtaatatacttttctctaccacaatttagaaactatggctgagcagcacagcgctccccgcactgttcacttgagcctacaaaggacgcagagaactggtgtggcccaacattgctgaaataaactctttgcagagtggatccccagggccggggcagactcagcaaacttttcatatctcttcatacttagtccagtgaaaacaggtgaccctgaggcacagccagactctcaagtgcctttgggctcatcagagacaggttacatatacaagttcttgattggaacttgaggaaatatcaactctatcggccagtcaatggtgctgtgctgtaaatggctactcatttgaacgaatgacctcatcccagttcctctgggcaggagagaacttaccactgttggggcaagaggacagtttctggtggatatgtagattaaggtgcccaggagtcctctgaccagggaagtgttagggtgccatttctgtaccaaaagctgggtgtgttgcatgttaagcactgtagccaagaacaagcgactcttgactcttaattaaacagccctgttttctctttgcctgtgaaagtgttgcttctgtgggttctgaaggggaaagagataagagcctttgccctcaacaaactcatagaggggggcgggggatctgtggatgtagcctagtgatgtcagttaagagtacattatccccagaacacacacaaaagacctcatctgagagaactgcttattttcttttatctgtatgagtgtttggcttgtatcaggtctgtgccccacatgtgtcagcgcctgcagaggctagagagggtggtgagttccctggaactggagttatcatgggttgtaagctaccgtgagggtgctgggaaccaaaccctggtcctccacaagagcaaccagtgctcttaagcacgtctctgcatccccaagagagatctattttgaggtcatagaacctctgaatctgatggtccaaagccagggtgacttgtgagccatctcagaagcaaacttgatcctgaaagtggggggagggactaagggtcagggcttgcagctggggtaggcgtt

SEQ ID NO: 31736 - DNA, 1154 bp, Mus musculus
gaaaagaagcaagtgtcttaactgctcagccatttttctagcccctcattttgaattttttgaaacaggccatggtacatatccttgtctggccccaaatgcagctttctcctgcctcagccttcaacttacttacttcaacttactgttatgagtccagacacgagccaccactcccactccctaaaactcagctgacactagattatctgaggacctctcagtcttctctcagggagactctgtagggagcaactagttgacactaattgccagtcctatcccatcctgtcacatcccattccatattatcctgtcgagttccaggccagcttattctttatgaggtcttcctcaccccaccccataacagcccaaaatagcaaataattttgtccatgtagcttttgtctacccagctttctttataaagagacaacttaggcagcttgtgtgcatgtgaaaacatctttaatgcatgtgatgctatgcgggttcttttgtttcttgcttctttacagccagagcttcagttacttgcagaacttccaccatagtgttcccagtttccagtgtggtctctaccttctcagacttctgatggcccttctggagaagtctgcagtacctaaccagaagaaagaaaaacttggtgatgagccttgatccctttttcgggggaaggggaatatgtgaataggattgatgtcttacatttgcaaaatttgtgttttcttagaattttgagcatttttacatgtaaatcccacaaaatcacaagcgtgccttcttgctccaccaaggagaccatgtttacagagcaggctatgacacagcttagtgtacctgtggttagattaattgactggacagttttctttttttgtttgtttgttttttgtttttgtttgttcagttttttttaattaataagatgtatatattttgtttttattttatgtgtataagtgttttgtgtatatgtatgccatacatgttggagaccaaaagtaggcatttgatccactataactggagttacatttatgagtcgcccaatgaatgctgggaaaaaccaagttctctggaaaaccagcaagtgctcttaatcattgagccatctgtccagccccaagttgttgtcgtcttcttct

SEQ ID NO: 31737 - DNA, 2436 bp, Mus musculus
atcccagcaaccacatgatggctcacaaccatccgtaatgaaatctgatgccctcttttggagtatctgagaacagctacagtgtacttacatataataaataaatcttaaaaaaaaaaaaaaagaaaacaggaagcgggcatctgctttagcttagaacattttaaatttcactgcttgtaagaacaaaagtggtatagtgtacatctgtgagagcagtgtctcgagcactggcctaaagtacctttttcttcctttcccttaggatggggaagatgaagcaagtgatgaacagaaggaccaggacagtgatgaaagtgacgacagctccagttagagccgagtggcatggctgccctgctcacctctgacagactctcatctctttggggtttgaagtcagatgtctgtttttctagtcagaagcatcctgtttgtccatcaagaaggggtgtttatttaattccccagtgggtttcacaggttgtctaacctccaggtccctggttcaggagtccagtgtagcatccatcgttgactaggatgaacatggctgggctgcagtgcagtgcagtgcaggtgccctagctgggccttggggttttgaaactaaaatttaggcttataatagctttgtaaataaatctgtttcagagttttgcctcagctacctttttcctcactttagatgtgattattcaaggatctcattattcaaggattaggtaatattgagttgaggtttgtgcaatcgtactggtggcctaaaagtatgttccgtactgttatcttcctggaggaatgacccaactttcttatcaatgatcagtgtttggtttggtctgtgtcagggtctctttacatagtcctggctgttgtggtattagatatgttgaccaggagggtcttgaacattacttttgaattttaaacatttttgtacatatgtgtatgggcatatatgtgccactgtgcatatgtgtaggtcagaggatagcttatgggagtgagctctctccttccaccatgtgggttccagggttcaaactctagaccttcacctgctcagccaccttacccttttaaaatgtttggttattaatatataaaaggaaggaagacaacatcaaacatgtgctggctttgtatgtatatatagtttttatttccacattaatttgaattatgcctataatatatttgtaataatcatacaaaataattgtaatttattagaaatagaacatcaggagttaaaataggggattcttctgtcttctgccaggaagcccagtctcagagatgctgccaggctcttcctcgctgtgccattaagattatttaatttttgttaatatttttactcataccggtattaaagttatgttttgttgggttgttgttgttggttttttgtttttgttttacttgttcacattgatttgaggagggaatgctgtttttaaattagtccttaacccatttatagatttttttgaccccttcatcctctggtatccagagatccatacctgtcttttcttggcatctctttcttcaccagttcatcattgtctttggcatttaaggtgtgctcaactaggctggcttatttctatgataaggtaatcattttcgcacatgcacatcaaagttaggttaactttgaaacggccatccagctttagagtagaactgctcctcctcgctcagtatcgttggtcctgtttctgaagagaaagggagagggggagctcctgagttgccagagcttgacctaaaggcaaaagatctggtgtgctgtcagcttggtttatgtggataggtctgtgcgagctttgggtacataccagagagctggtgtggaggtccagtggggaccctttacttggagtgctgcaaggcgaaggtgcacttcttgtaagtcgcatacagcaagaggattgagcgtagcatctgtttgcacatagtcactgtcatttggacctgaggctccttgagccctgtaggccactggtgctccctgctgattattttgcagaaggctgacttgtctgaaactctgaaggttccagtccacttgggtggctgggctgtgatgaccctaccgaaaacagaatccactccactgaggcggactggctgcggcttcctcaccacccctttcttgttactcacggctcggagctctgatgtgtggcagggtaacttggggctctctccaggttccacaagtggtctgtctaggacaagcgtgacttcttgaaggcacaactgcacttcaaggtcagagggggtgtgggggaagcaaggagaggccctaaaagggtgtttggaggaaggggtaggtgtagtgtgccgcagccattggaagctctcatccagtggggtccatggtgaccagagctggtagcctgccattgacagtcctaaagg

SEQ ID NO: 31738 - DNA, 1622 bp, Mus musculus
agcccagagggtttgtgtgggtgtgggtgtttggagtggcattaatcctgaatattagtctccttttaccagatatgtcttgtcgttcaagactcgcaacactaaatgagaaattgacagcccttgaacggagaatagagtacattgaagcgagggtgagtatagtcccaggctaccccagagggaatatctgtgtagaatgaacgcggtgcagaggttaagtgctctgcctggatgtagctgtctgggactctgaagctgcctttgctactgtttctcactgtgcaggatccaagataggattttttttaatggctttagtcctttgcgttttatctaaatgtcagtttttccttcacaggtgacaaagggtgagactctgacctagaagtgcgccgccgcgttgctgctgggaagttgctgtacagaacactgccgtgtgggaaaggcccagcagcctcctgctcctcctctctccttacagagcaacagggctttttcttgtttttcttttttcaaaagtggcctttgggctctgctgtgtgccctggggtatgacgtggcatgggggagcaagcagtccaggggacctcttggaaacagcattaggctttttcccttttcagtaacattgttcggaactacttgtcaatgtgtttgaggtgttgagaggcaaaggctgggactctaaggtcctccccacctctcaaactctttctctcagactttccctacagctcccatggcctctacactgatttctgtcaacagtcggccttctctccacctgtgagaggtggaggcagtcctggctgagacttgtgccctgcagtgtggttgccagaaaatgttgttgctaacccaccagtttcttgttctgggagctcaaagccaggcccccagttggcttgaagggacattttcagttttctttgtgtcacttggggtatcagtagctctcatgcttccctaataaactcaactttgtctgactgctgtgactgtggtggcaagagtggctggagagggtctccttgttgagagtctggtgggcaagagtgctctccagcagaagaaacctgcagccctagctggttcaaagcctaggcggctctccagtcagtgttcctgtctggacacttgaactagttcagtctggaattacttggtctttcagcagataactaccaaggacttttactatataggtgtgttagactccaataaaagatacagtattgaatcagacctgatgtttatgatctgttgcaatcctagcatctttccagtttaactgtatccagggtaggttactagttttataaggtaaacagcctgtgactgtaaatacggaggcttgtgagatggtctgacaagtggggtgcttgcctcaaaacttggagccctgagttctgtctctaggaccaacatggtggaaggaaagaacctgttcttggaggctgtcctctgatctctgtgggcatgcggtggcattcctgtgcgtggtgtacacgtgcgcacaatgtaaacaccaatcttctcaagcagatactgcagtttatacagaagaatcaaagacttactgtgcttcctttacacttcagccaacttactgctaaagg

SEQ ID NO: 31739 - DNA, 1180 bp, Mus musculus
actgtggaatggatttggggtgaggagtagttttgcctgctggtcacaaggccctagggtaatcagtgagcaacagaaaaaaaacattatgacacagtgtacaatgagatggccagtctggatccctgccctttggcctgggtttcccagcagtctgaataaagtcacctctttatctgagcacatgtggatatatataatctggtcccttcttccctgtcatgaaaggaacttcctgagggaggtctcctgtgcattttctggaaccttggctgaggtgccaccttgcatgacttgtagcgttgccactggttctatgtctctgaggtgcctgtctttatgatctcatggcggtgtgatggtgtgtcctgtgagaactaaaggaggcaggctgtctactctcagtaaagcccctgtggcgggttgctgagcatctggggccctgctttgtatcttttttataaaacactgggccaggaatatttccctcctttcatacttgtcagtctccctgtgtcctccacccatgctgcccttaccccagctcactgggggggctttggtcatttggattgttactgctgagcaagcagcctagcgtctaggtgagatgacctctctctcccttggctgctttctgtgttctgtttgtattttaggggccttcatttgtttgagcagtatgtgatctaaataggtagctttgttctggtctctgtagtaccttgtaaaggtggactcatttcaggccttggaggtgatgttggcctgggcagttctgtgaggagaatcatgttcttagtccagaaggattagtttgtgtagtccagcacttaacagtgggttcttctacgtgactttgtctttggatggtgcacttgagccttgtgaagtaaaatagataagctgatggcctgtttggactttgcagtgggactcagtgtcaggtctgggaaatagctttcatcttttcttcacttcccttggtcagctgctttttctctgcctcacattttttcactataggaagaacttggcttcctttttgaaagacttggcgtttgctcagtctgccacactattgtcactcaaacaagctgtattgtaaccatctttacagcagaccattgatatctttgaggcaccagtagcttcactgtagggcattactattgaccac

SEQ ID NO: 31740 - DNA, 1158 bp, Mus musculus
tgggcttaagaaaactgaccgggacttggtcgctaagtacaagcctgcagtcccagcatttgggaggcagaaaggttggtaattcaaagctactagccataggtggcttagcaaggaaaccaaacaaccatgagcaaagaaagaagagaattggcatggggacatgtttataatgatgtattttctttgtaccgtgtctcctaaccatgtgctcggatgcattttatttcatgtgaccagctgttcttctcaaggtctttccctccatgtgctaagtctcgtccttcatttctgctttcctgtgtttatttctgccagttgttaacttgaaattgtcttctcgccatcaggttctcttgatgaagtctaaggaaaatgaaaaataaagggcatacctccctggtagagtgcttgtgtaatgcacgaaggccctgggttctgaacatgcccagcactgaaaccccctatgaaaccctagatctttggcagttgggctagggaagctgtgctaggatggaaaagccacgacttgccttgagtcagagtttctttggttgtgaatcttcaggtttttgttgtgtgactttgggggagatatttgatttctctgaattctcttagaagtagaattgctgtaaaaatggacggaaatgaaattcatctgtttgattgttcatggtaggatcactgaatggtggctgttaggaccgttgtgtacctgtttacccttgtgctagagatcctgggttctgctttgggaatgagtacggcagagaggagctggagaagtgcaaggtgtgggctgtacagctggtgctcagattcatctctgcccacagtgaactacttggggtatagagtctggccagagtgtgttcagcatctgctttgaatgactacagggcacaggaagggaaaggagaagtacttatttttggtaagggaagcatcatgtgaccaactgtcctttcaaggtctttccctccatttgctaagtcccttcctttacttctgctctgcaatgtgttatagtggtcatttgtgacaaaagtcttgctgcctgtgctattccgacaggtgctgttggtagaaagggcagcagggcattggtgctgttgtgtatcctagggataagcctagttgataccagtgagtatt

SEQ ID NO: 31741 - DNA, 1165 bp, Mus musculus
tcctgacaaaagggccaagaatccattagttgctcagtcatgatgtgggatgtcagatggtcttttgtcaacatttgaatccagaagcaggtttaacaccagtgagccatgctttagccaagggatagatgaactggacagtgagagagagggcaagcaggcaaaaaacgaaagcttccttctgtgtcctttttatatgggctgctatcagaaggtgtggcccagatttagggtgagtgttctcaccttaaatgattcgatccagaaaaatcccgcacaggtgtgccttgctgcttgggttttagttgactgcagatgtagtagtcatgttgacaaccaagattatttacataacacatatatgaccatatttaactgttaggtccaaagtattttgttttaatgtgtggttaacaacaagtcgatactgaactcttacagtgtttaagtccagtgggcaggctctaagtcgtgtccaggcttctaggcttctgtgcctgcagtgctgtcgaaggatcctgctggcattctgccctctcctttcaaagcctagcatatcccactggctttcctgcccttctcccatcttagaactgtagccccagcccttgtctttattgtctattcatcagtgtttgccctcagcctaacggtgacccagagcctgacacattgtgctcagatcccaccttgccgtcctcacaaatctggtcctttccctttccaggtctctagtgctcgctgggcactggtaagtattctgagtggctggttatctagcaccagggtctcagtgctagttaggcctgcagggccctggcctcaaattgctactagtgccggcacaggctaaagcatgctggcatttggctcataagcataggattctcaagtctcatccttagacctgataccaaaggtcttcagcgtagccctggaaactagttcaacaggtgtcctcagtaattgttttgttgttataaaaagatttttttcccttttagatttttattatttttaattatgtaggtgtgggtgtgtgtacttgtgggtgcagatgcctgtggaagctagagatgatagaacaagatttacctatgggctgtagaggtgtcaacattattcaagttctccaagaccttgcactgaatccttgtaatcgcca

SEQ ID NO: 31742 - DNA, 1209 bp, Mus musculus
cccatgtccccttatcctgcctcccatgctggttttaattgctcatcacattatctgtgtgctgtaacccaagtcctgacaactagagggaaatcaccatgagtgcatggaaacatttattttattgctatgcaagaacatagcatcaccacaggttcccttctgcagattggctgtaatgctgtcagttgggccccagcagttgtgcctggaagccttatagaccaaccatcagggcagaaacccaattacatcaagaagtttgcatcaggtggctgtgacaacctcatcaagctatggaggtcagtgagttgtgtggacatctcttctgctgcctgtcattgctcagctaccgtgtacaaaaagcaagatcacctttctccctgccagtaaagtctgtcaagacttcctttttaaaacaaacaccttgctccttttctaagcactttagtattccccaaactttggagctatggatgaaagggcatttcctggagaccttaggggcaggaattctactcattggtctcattgaagaaaacatgaaaggttacccctttacccaaggtggaaatgaccagccagccactgtgttcctgctctgatttcctctgcagggaagaggaggatggccagtggaaggaggagcagaagctagaggcacacagcgactgggtccgagatgttgcctgggccccctccattggcttgcccaccagcaccattgccagctgctctcaggtcaggcccatcccctattttcacactagagttcgttccttccttccagtctgcccagagggaaaggtgggtagtaggcacctttagacttggacagagaacagaaggatcctatagggccagcgtacagtgagatgagtccaatgtggcttgagaatagtgtcaagcttagtccctcctgaccctcatgtaggaggaatggaggcaccttgggtccatgtactagtcatccttcccttatttcctgtcatcactgggatgagaaataagaggcagggatttcaggtccattagtgtttttattggacattcttgtttgctcatttgtaagatgattgtccctgttcacatgagacacactagtcagccaggaagaaaaacagtctgtttatagcagttctctgaattcatccctgaaaccacagaatccaggccccagcctatttgtgagatgtgttcagggcgaaa

SEQ ID NO: 31743 - DNA, 1177 bp, Mus musculus
ccagttgggattgtggggaattcttggtcacatcacccaccttatattggtgtgtgttgggggagggggttagaggattagtagataagattgttgccagcagtgtggttttggtaagggtgttttcttcactgccaccttaaattgattagtttttctgttgactataattgattgctcctggtgcctctccaatgctcacgggaaaatgtcattgtctccaggcaggtgctgctcctctttctctaatctttgccgacacttttcagagcatttaagattctcaaggaaacacacttacttattcagtgtgtgccttctgaatgccttgccgccgtactctcccagggtctacctttctgaaaaaatagcccaggctgttggagaattcttgatccaccctcttgatcctccagagtgttaaggatctgcaacaccacacctgccttgaggagtcaggctttgtaattgcaaagtttgcactgggaaaggtgacttgttggaaatggtgagaaatgtcagtctcaaatggaagctaccttttcaatccacttttctctcccaagaatttaatagtggatgagagaagaaaaaaaaaaagatgtgtgtctttgctcttttattaactcagtaggtagttactaagttctttctatctgtaaaaaacattgtgctaaataacttaaagagattcaaagctgaggtgtgtgatggtgcctacctttagtccgagcactcaaggcagaagcagataaatcccagggctggaggcagcctggtctatgcagtgagttctaggcagctagacctatttactaagacagacagcgaatgcatcaaagctacagatagtttcaaggagcttaccttctctagcagagaagtagcatcaagctctatagctgtcatggctgttgtgtatgtaagagtttagctagttggggatcaagggaggctgatttaaatcaaatggagaaatcgctggtgtccatcacaactgtttttggcctctacagactatcagacctgggtcccacaaggtgaaaaactagatgggcctttcacggttcatagtaggccagagagtaacctcagaggtaactaaagccaaatccttgtcttgacttatataacttgtttcacataaactgtctgggccatcagaatcgcttgcgat

SEQ ID NO: 31744 - DNA, 1163 bp, Mus musculus
tgtggccaagtggtctccaccgtatgggacatttggcttactagtgaggaaacaagagctgggtttggtggaggaagagagaggggaggggctggtcctcgctgcaaagggccttacttacccccaaccccctgcccacagcgtctccaggtcatgattcagcccagtgaagatattgtgcgccctgagaatggccctgagcagccgcaggctggcagctcagccagcaaggaggcctacatctaggggtgcagccccccatcacccctacactggcactctggactggctgtacccacaccccttgaagactgaagatactctctgtctccacctacctcaaggggcaggtccagacaccatgaccatgcagagaggggcggtgggggacagtctgaccctgggtgggccctgagtgggcagccgcctctggaggcttccgtagaggccccttagcaggagcaggtggctagcctttgtcactgccactgtagctcctttttatgctgccagagagggtgatagctgcggccacacgctcctggcttttagtctttttttttttttttcagactgttgtcctgtgccccaactatagactgttatccagacttttctgcccgccttggctctgaactggtcatggaccggggcttcggcattttgttcatggccgctgggagccagcaggctctgcctcttccttctcaatttctccttcctgaggcagcttccaggacccacccccagactgttcacagatcagtgcggagagggtcctctgtccctgtgaccctgtgacccgggcagctcagtgtcccctgccctacctccccaggtggcattaacaacaacagcccatccagaagggtcctgtgtactgggaaggaacaaaagaaatcacaagcacaattgccttttttggtcaccatcccaggactttccccaagtgggagctgtggtccttctgagctgcccagtttggcacaaacaatgaccaaggaaatcaaggtgaaggttctaagtcaggaccaatccagctcactctggtttccctcttagactgtcactgccactctgttctggtgtcccccctcacctttctggaaaactttcagatgtacacgcccactcatggagcagggttactccagaggctccgc

SEQ ID NO: 31745 - DNA, 1204 bp, Mus musculus
actgctgtggagatccaggcaagggggtgcagccacggagaggaggtgggacagctgttaggagtcagtgagggaacactgggcaggtggcatgctggggcaagggcaagggcaatcggtcattgttaggggtggcgctgaagccatgttcttggctaagttcactgtgtttggcttttttcttcattggggggactcagtttggttttgtacttagggtagactagacacgacctcataggcggagcctctgcaggggattcacagttctgcaggcatggtgccacttgcccacttcggggagttaggaatggggctctctctgctggagcatgctcagtgagtggagtctacagggcagcagtagggcctggacacacaggggctggggcccttaggagatatggtagacatcctgacatccttcctgcactttagttgccataggtgacaggtggctgcatcccactgatcgataagcccatcccctgcatcctccctgcctcagctttagcatagctctccacttcccttcactggaccctgacaccttccctggtgctcccaaagcccattgttactaccggagattgttccagggtagagtctgacggtgtcacctcctgttccaaacccagtgatgacatctagtgcccttacaaggaatgagccctaggctgaagcaagaaagatgacgctgatgaatgtgctggcaggtgatgagagtaaatggcagaatcacacggacagcatgcacagtgtccccgttacttttttttttttctttgtcaacttgacacaagccagggtcacccaggaagagggaatgccaattgagaaaatgcctccatcagtttgtctgtaagcaagtccgtagggcattttcttaattgctggttgatgtgggagggccctggccggatggtcctgggtgtttaagaaagcagtgagctatggggagcaagccagtaaacaaggtttctttatggcttctgcttacgttcctaactctagcttcccaccttgagttcttgccctggtttccctcagtgctggactacaagctgcaagctgaaataaacccttttctcctcaccaagtagcttatggtggtagtgctttatcacagcgatagaaacctacctgggacagaaatcacagatagcagagcgtcctggccacactgtggcttccaggcccactc

SEQ ID NO: 31746 - DNA, 1151 bp, Mus musculus
ctatatgtaatgttgggaacaactggtattctaagacaacagtgacttctctccatgtacatggagctgcattgggtaagatcagagcttcctttcaagctggctacactcccattccctactctccttatgcaaaaggaaaggggaggttgtctatcaagagtctgttgtgtgccccatattgtgcagttcttctgtatgtagtacctgggggcagagtaataattcctgtcaggtgtttacagggtcctgaggggaatttcttcttctacaaatccctgatccaggagcttcattgatgccacagcagtgctgttccacatgctcacagagcttactgggtaggaggcagagagccactaatggcattgttcacaggcaatgggatatggggggatatggggatgttggtctggggcctgagagtctgcctgtaggtggcactattgtgcagagatataggtccactgagatatggaccaggtcgagatgggccaggggttcctgggacagcccttagggctgggaggagctcagagctttccaaggacttgggggttatgtggccagagcatgggagggaagatggacaagatgaggtcattgcacctccgagggaggacttggctctgcatggccttgtgggattgaggatgtagagagagggtgtggagaaggaggacaaagcacatgctagagactccatgggatgctggtgcacgggattttcagcagtcttcattgatgacctccatatcataggcaccatcttaacacaagacaacagaggctcagaagagctggttggcagcagaaccaagcttcctgcctgcacctgttccgagccctagctcatcagcccacagcaccagctgcagtcctcagtactgcccaccacccctcccttcccaggtgtgaagtggcctacagggctagcccagcccagcccagctccctccagcccattcttttggcctctggcctgtctctgtggcatccttgcttaggatcccagagggaaatgtggggtctggtaattggattccattaagcctaattaagatgcagatttgtacagtgaatgaaggaagcaatttggaggcaatttggccaggccaggtctctcatcggcttctctcctcggtgaggag

SEQ ID NO: 31747 - DNA, 1198 bp, Mus musculus
ctttagttactaagctttaaagacactgcagttggatgtggtggcccacggttgtagtctttttttttttctttccattttttattaggtatttagctcatttacatttccaatgctataccaaaagtcccccatacccacccacccccactcccctacccacccactccccctttttggccctggcgttcccctgttctggggcatataaagtttgtgtgtccaatgggcctctctttccagtgatggccgactaggccatcttttgatacatatgcagctagagtcaagagctccggggtactggttagttcataatgttgatccacctatagggttgcagatccctttagctccttgggtactttctctagctcctccattgggagccctgtgatccatccattagctgactgtgggggttgtagtcttgatatcagcaatgcagaggcaggtgaatcatgagtttaagccaaccttgactataaagcgagacccagtcttaaaaacaaaatcaccatcaccaacaagatgcataggagctgaagggacaacagagtggtttgtaacacgttctgctcttacggaggatcctagttccgttcccagctgccacattgggcagctcatcgctgtctgtaactctagctccaggggttccaagaactcttctggactctgtaggtacctgcgtcacatgcacagcctccactctatacacataattaaaaataaaaatagctctttaaaaaaaggacatatatcttcccagggattattatcttgccttttcactttaaagtggagagcttcctccttcaccttcattgcatcaggaaaacacccctcgtgggttgatgagcattgtggagaaatatgaaaacagccagccatttaaagctgagcgtgtctgagcaggcatggtggcacacagctttaatccctgcactggatgggcagaggcaggcggatctctgtgagtctgaggtcagtcacatctacatagtgagttccaggacagccagggctttaaagtgagaccccatctttgggggggggggggacacggaagctgagcatgtctgcgtctgactttggggggagtttgttctttccgtttaccacataggtccctgggattgagcttggtgtccccttgcctacaaaccatcatatttgatgttgagtcatggaggag

SEQ ID NO: 31748 - DNA, 1196 bp, Mus musculus
gtgcatggggcacaggagaagaaggaggcaggaggcagatgcaaaccccagagactggggtgccaccctctgaggtgcgggaagccgattagtctaattctccctcctgtctttatggtcaatcagagttaaatctcccaacttcaaaagactccgctgaattaacaggacacgtttagtcttatccctaagagatatcccagcatgcctcgctgctcctcatcccattcctgaaacacagtggagccaatcgttattttcatcttacatcatctttctgatgatgtgtttatcacttaaggttgaacaccctccctcctcctcctccttctctttctctctctctctctctctctctctctctctctttctccttccctccctccctccctccctccctccctccctccctcccccctttcctgcttccctcctctattctgattgggtatctgtagctgaggctgctgtgacctcagttgtctggctttgctctctgggttctagggttgtaggtgtccactgccacacccagccatgtctaacctgtcaaattaagctgtagctctgcctcggatgagcctttccctgtacacaggtcagttggaggctcactgcaagtgttcagaggctcactgactttgtcttcataggtgtggatatagaattgtgtcaggccccaccttagagtgtgtgctggagaagttggcccactgatggccccttcttcttgatgctttttcttcctgaattgctttagacggtttctcttcctcctttctcttgccttcccccttccatcctcagagctcaggctgttcctggaccccactcctgtttgatgtggtaatgtgaacagctcctgccctggcgtgccactctggctcctccacagagcctccacagggggctttcccacctgcccccggtgcttcacagactttgctgtcctttgaagaacactgtttcaattttatgaaattgttggctgaaatattttaagcctttggtgaaattaattgttcttaccttgagcaaacctcagctcttgagaaaacctggtgggatcgagcacgttcagagtggtgtggctatggacggagcccatggaaatctaacctcagggcccctctgcatggaagtgcacataagcagtcatttcctagtgttctttgtggcacagtcccctactgcag

SEQ ID NO: 31749 - DNA, 1181 bp, Mus musculus
ggttgtccaggaaactgctctgtagaccaggctggtctcatactctgagatctgcctgcctctgcttcccgaatgctgggatttaaggcattggccagcatgcctggctgactgttgttgatgccgagctgattctgaccctccttcccagcaggagtgaggaagagtccattgctccccaggtccatggccccagacacagccatggctccactgagttgctctcggatgatcggctgtagctagtgctgcggatgcctcggcatcttcagcttgctagggtttgcagacctgtgctgtaacccactaggattcatttagctcttggccagacttcctggggacatgactagggccatcagtgcttttccttgctggggctctcctgagagttggcatgattagcgtgatggaggtgggtaggagagagagcagcttattatagtgttcatggatctgtggagtggtttccaggatgtgcggcaggctaaagactggagacccaggaaagaggtggtgccgcagccttgagccaagagcagattaccttcctcaagggaccttgtgcctttctcttgtatttcagctggtacaggagccttccttgctatgatgagggtaatcagctctgtttatattcacctgatcaaaatgttaatcacacctttaaagtgaccgagtgtctgagcactgcagtttaatcaaagtacatagaatggccaccacacccctgtgtcttctcagtacagaaagagcactaatttctccctcctaggatgtggttttactttttcctactgctttggccagtgggagggagctcagagccgctgcttacccttctatagtggcagctctcacgtgcctctggagtttgctcactggaacactcctagtgccagtcatcaggtcaggcatatctgcccgggccccacctggctctgtgaagctgccctgaagctagagttcagagttctcccggctcagggccagagttgggcctgcatctcctgattagtagattcaggtggctagctgtccatgcctgagagcatctctcagagggcactggacagcaagtaagaggatatgtagccctggctggcccggaacttactgtgtagaccaggatggccctgagcttcgatgacgtgtgtgtggtcacacgtgactttgtggag

SEQ ID NO: 31750 - DNA, 1202 bp, Mus musculus
taaatcatcacttctgaaactggaaggatctagcattgcggactgatactagatggtgtctaagagctgtactacctttaacaatcatgtatgtaaaaatactggccatctcacttgcagtaccttgggagacaggtcagtcttgacacaaaatctctgggcagttttaatagagatgtgggtttgtttgtttatttgtttgttctgttttctttggttttttttttttttttggaggggattgttttgtttttaattttttccaagtttctatatatagccttggctgttttggaattcactctgtagaccaggctagccttgaactcagagatcctcctgcctctgcctgctgagtgctgggattaaaggcatgcaccaccaacatccagaaagacatgggtatttgaagggtaggtaggtctcttaagttgctaaggagaccagcatcttgttcctggacaaggccttggccactccctccctcgcttgtgcttgtggacgcagcagcctggtagtttgctttttgtcatgttcttgtcttttcttgcagcttatcaagtacggggttattagcactggcacactgattgaggacctcctgaactggaataacctatatatcgccggacgcctccaaaagccggtgagtctgtgcccttcagggtgccacagttagcaccatctccagtctctgaacttgaccttacttgatttttatgagctcataaatatggaatttcaggaaatggaaatataggtagagtcctcttccctcccatgaagttcatcatcccacagtataaagagattaccctgtgatgttgcaccctaagatgagatggtatacgtaatatgtatacatacatctttatgcatgtaatatgcatgtaaaacacatggtgggctttgtcctggctcctggcagagagctcctaaacccttggaattcctggatggaacagaggtgccacggctgttagttacactgaaccacactgccaacctagtgactctggacgagcctctgcttagcttcaggatagggctgattaccagaggaaatcggcctgtgatgagagggctcttctgcctaactctaggaaggagaaggggtgctggagactgagtgactcagaaaaggctgggaacttaccggtcacagataacagaacagccgcctggagagatgactccgtggc

SEQ ID NO: 31751 - DNA, 1101 bp, Mus musculus
ttgaaattcactttccagtgctaaagaaagggtcttatatcatgactggagtatctgtcagaaacagtgtgataaccaagattaaaaataagacaaaatggaccccagtaaaaggcagcatttttctctgccttatttaccagcatctcttggttttaaatagcatagattgtcacactttgttaaagggaggttaactttgtcaaaataagcaaataatgttaaagggtcgatgatgcttgcttgtcgctggacagttagatgcaggggaatgagggcggcaagctcggcctgcagtccacccttgagaagaactcggcatattggtgggccaccttgaaggctttctgggttactttgttgtcacggggttgagacttgagtgtgttattgacgttgtttctgttggcaggtatcagcatcgggtggaatgggccagggacttcctgcgtaggcagggccacgatgagagcactgtgcagaagatccttacagactacacagagccactggagcttccttgcagagaggagaaagaagagaccccacagcacgagccactgagctccaaggccgactcctccctggaaggcagagtggaaaaggatgaactccccgtgacccctggaggtgctggacagtcagatgacctacccggtctcggcacacactcagactgcctgcaggaggggcctggccatgccacactcgctgcggctagtccatctagccataatgggcatgtggcagaggaccccgaggttctcccccaggaaaccctcgttccacagggtggcctttggcctgaagccagcagccaggccgcaggagagaaaagggctgctcacgagtatgtgctcatagaggaagagctgtgtggtgcccaggaggaggaggcggcggcggcatcagacgagaaggtacatagatcaaagtgccctgctccccacatctgggcttcagttacagtcagcgacagtctgagagcattgctgttggttgtggcttttaaaagagagcccacattccttattgctctcattgcagtgttaggacccctctcctgtactcgtcactgctgctaatctctcactagtgcag

SEQ ID NO: 31752 - DNA, 1412 bp, Mus musculus
atcgagaaccgagaaacccggcaagtccccagcactgacgatgtggatgtgacagagctaggagacctcttcatgcacctttctggagtagaatcatcagaaccctagtcagtgctgacgccttcatttggctctgcagtcaactttccaaggcacggtgtggacgcatctgtcaccgacccgaggtgacgtggtactgggatgtgagtgcagtagtgagtccccctgggaagggaagggagatcaccacgtccacagaatcactacatttagagttgagctctcagttgtacctccaacccctttctccgggaccagctatgtggtccagctgttttaattgagtgcttttaaatgaaacctgactgccatctttcttttgtgactttcttccttaagcaacagtaaacttgcagcagatctggttttttttttttttccttgccaagacatcgccagccctgtagaaggctcctctgcagtgatcatctctaatagagttgtcgagccttggaattgatgcagctgtgtagtgagaacacatttggccatattggtgctgctgtaccatagtgtagacttttacagctgtgagggtggctattgagttccttccagtgtctcaagtcacaggtgtgtgcagttgtgaagatctccagggagactccatcttaccctccccttgtactaagagcacaagacacaggactcacagattgcttgttctcccctataaagtagtaggctccacacttgtttttgtggtaaacaggagcagtcactcctctgtctaagaactgggggcaagaaagagcaaatttgtcctgaacctgaatttatttttataagaaaacctgttattacctgtgtgcttttcacttggttgttcatgaactgcagagggggctccttgagttctgtctgcacaagaaactgcactgcaagttttgaaggagtcagtagccattaaacctaaatttaatttattttattaaaataacataaggaaccaactgtattggctcaataaaaacaaaattaaaacccaaaatcattaagaaaacctgtattcctggctttcttacagacaaggatgtggctacagatagggttgggccgcggcccaccccataggggcagctcctggaagacagattcagcacgtgggaggctgccaaaggtggagcaccgcgcttggaaagccatccacacaggacaccttagacacagtttgtccacaaagttctgtagtaccaaagcaggctcccccaggtggccaggactccatgtgcaaaactggcactgcaccactgtccatataggctcaaggagccaagttcccaattgcatgtccctgcagcagccggagtgccctaccttctccaaggccacttgccctacaaatactcagc

SEQ ID NO: 31753 - DNA, 1373 bp, Mus musculus
tacaagaactgccccaaggcaatgaagaggttggtggctgactgtgtgaagaaagtcaaagaagagagacctttgtttccccaggttagagagctcagttgaaatataacattctaaggatgtaaatgtgggccaggattgggtcggtggagagaggacctccacaagctcttggtatggttggggagataccaagtttccaactaatgagaccacgtggggccttgtttcagatcctgtcttccatcgagctgcttcagcactctctgccgaaaatcaacaggagcgcctctgagccttccctgcatcgggcagctcacactgaggacatcaatgcttgcacgctgactacatccccaaggctaccagtcttctagctgatgatgtagctgttcttaggccaccaggggacgaagaagagtcagcaggcaccactttctgtttccttgggggcagaatgcatgtttttggaaaagctgctgctgctaaggacctagactactcacagggccttaacttcatattgccttcttttctacccctcctgccctggaaatggaagctgtccaccaagaaagcctgctcagctccagaggtatacaagtcagctgagtatttgtagggcaagtggccttggagaaggtagggcactccggctgctgcagggacatgcaattgggaacttggctccttgagcctatatggacagtggtgcagtgccagttttgcacatggagtcctggccacctgggggagcctgctttggtactacagaactttgtggacaaactgtgtctaaggtgtcctgtgtggatggctttccaagcgcggtgctccacctttggcagcctcccacgtgctgaatctgtcttccaggagctgcccctatggggtgggccgcggcccaaccctatctgtagccacatccttgtctgtaagaaagccaggaatacaggttttcttaatgattttgggttttaattttgtttttattgagccaatacagttggttccttatgttattttaataaaataaattaaatttaggtttaatggctactgactccttcaaaacttgcagtgcagtttcttgtgcagacagaactcaaggagccccctctgcagttcatgaacaaccaagtgaaaagcacacaggtaataacaggttttcttataaaaataaattcaggttcaggacaaatttgctctttcttgcccccagttcttagacagaggagtgactgctcctgtttaccacaaaaacaagtgtggagcctactactttataggggagaacaagcaatctgtgagtcctgtgtcttgtgctcttagtacaaggggagggtaagatggagtctccctggagatcttca

SEQ ID NO: 31754 - DNA, 1594 bp, Mus musculus
gggcagatctgaatcagcttttgcttaaatcacttggttacctgtcttcctttttctgggcacagaaagaatggtgtcagtcaggtttaaagactgttgtgttcctatagacttgtatttatttttataacttctacaaacaactttaagtctgtaactagtgtacagcacatttgtgtttgtattatatgtattattttagattgaagtagctattgaacactaacctgtagtgacttggtaggattttaatattatgcagtccccttatagacagttactcttgtcatgagattgttgtattacatttttaaagaacactttgttctaggagcatacattttggagtccaacaggcttgggtttcaacaggccacacagtgagcagtgttggcttatctttatggtgggaccagaacacctgtgaggtgtgcttagacagcatgcagtaggtagtagaactgctctatgtcttgagccttgtccaatgttcccttatgttatgctttggataatttttagtaagaaagcacgcttagattggaacaccgatgccgcctctctgattggagaagaactgcaagtggattttttggatcatgttccactcacaactcacaactttgtaagtttcagcttctccctttctttgccattttgggctctctacagtggatggctgacctttcagagaagctctgggtgcacattgttagttgctttcagctctccctatgctgtcatgtattaccagaggcccctctaccctgtctctgaatctgacagtcttgcaactatgattcttccctgtgggtactctggtaaggacggggagggcagtgctgtgtttgcttgtcactcgagttctcacaatcccgctttcttgtcacaggctcggaaaacgttcctgaagcttgcattctgtgacatctgtcagaagttcctgctaaatggatttcgatgtcagacttgtggctacaagtttcatgagcactgtagcaccaaagtacctactatgtgtgtggactggagtaatatcagacagctcttgtaaggcactgtggtttttttttccttgtaaaaaatgccagggtcaggtccagaagcatttttgaggatgctcattatacattttcaatgtaaagtctgagctttaggtttgctaaataaatgattgctgcgagtcagaaactattgactttagaagcataatagttctgagattagttagttttagtgtggtggtcatctagctgtaaaataaacaggtagggagctggggatgactcagttggtaaagtgctaactgtgcaaacatgagagctgagtttgattaccggcgctgacataaaagctgggcctacagtgtgtaatctcagagttggggatgtggagacagggctgtccttgggtttgctggccagctactctagctgagtcattgagctcaagtttcagtgagagatcttgtctcaaaaaataaggtggagagtgattgaggaagactcctagcattgacctttggtattcactccagtcatatgaactcagacacacatgcacaaacaataccaaaagcaggcaggacccattg

SEQ ID NO: 31755 - DNA, 1195 bp, Mus musculus
tgatgactatgataatatgtagtctaaccacgatgcatgtaacctgtgttcttggacttggatccattgtactacaaattaaaaagcatgttagatgttttaaagctgtactttagaaagtggtatttcataattatactttgctttttgattaaaatgttcagttttactagaactagtgatggtttttcatcaacctttatgtacaaaaaataaaatgtcatttatcagtttgaaaaaaaatagtcttactctttatattgttctaatgaaagtattttccctagtaaacgtgccgtagactactgtccccttagtaactaattaagggtagttagttagtacaggagatgcataatgttccaatgctgattcaggcctatgtgcatctgcttatacttaactctggatattgaggtgtttttctctgtgtgttcactattgcaaacagtatgtcataagtctataccattttatatgtcgtgcgtgtatttcagtgtttatctttgcgagtggtgctgtagcctacactggtactaaaggggatcatttgtttgcaggtcaatgtgcggaatggaatgagcttacatgactgccttatgaaagctctgaaggtgagaggcctgcagccagagtgctgtgcagtgttcagacttctccaggaacacaaagggtaagagcaaagccagccagcaccttttaggattctaagcgtttcctagccacaaataacttggtatattacaatgctttgtattagcctcctagggattagtgcatgtggatatactctgttttcaaagtatcaattcagaaaaattgcctctgagaacttgaaattattgcctggacattgtcttaaaagctataataaatgggaggtgctaatagcattgtccagggatggaggcagcattgttagaaggcctgtttttgagtgcaaagacttttcctggtgtttgccatgcagagtgggtactctgaacatgactgcactcttttttatggttaagaatgctaggggctaaagagatggctcattaatggcatttgctgctcctcagagaactcaagttcagttcccagcactcacatcaggtggttcacagctaatggtagctcccgctccaggagattgtatgccgccttctggcctccaaggggacctttacacacatgacatacataccactta

SEQ ID NO: 31756 - DNA, 1286 bp, Mus musculus
gctggataagacaaaagaagtgtctgacataaggctcaaagggagattctcacagttttctaaaggaggagagccattactttgtctccttgctgacttgcaagtgtctgggcgttagtcttatacctgaggcgcgttccatagttaacacatatgtgttccatagttaacacatcagattaagctggttagatggccagtctgctgctttggttctgcactcaaactaaaccctgaatattacaatggaaaactcagactttgtaagtagatatggaatctgggagtttgggggcagcagctaggatgatttcttacaaagagtagaaggaagaaataaatcactatatttctttcctgactaacttgctcacagattacaaaaaaagccataaaccactgttttcacaactttctatattgtgttcttgggttaagtacttttcttctagaattataattatttgtctttcaggtataagtattgtttaaactgcatcaatggagcacatacagggagcttggaagacgatcagcaatggctttggactcaaagatgcggtgtttgatggctccagctgcatctcccctaccattgttcagcagtttggctatcagcgccgggcctcagatgatggcaagctcacggattcttctaagacaagcaatactatccgggttttcttgccgaataagcaaaggactgtggtatgtgaccctagaaaatgtagttctcttacctttggagactgtgctatgctgtccagtttatagatgggagaatctccttgtcacttgggatctctgttaatcgtttttttttttttaactcccccaagtgaagatttatttttatttttaaaaagacttatttggggtttgagatggctcagtggttaagagaactgactgcttttccagaggtcacgaggtcaaatcccagcaaccaaccacaatggtggcttacaaccatctgtaatgagaagcaaataataaaaacctatgggctggatgtgggggagggggaggtggaaagagctgggccggagcaagagggagaaggaaatggggggaaaaaagaaaaaaaaaagacctatttgttttatgtctctctctctatatataagtgttctgtcttcatgcataccaaaagagggaatcaaatcctattacaggtggttgggagccagcatgggtgctggagatcaaactcaggacctgtagaagaacagtcagccgctcagatttactttatgaaatcactgttctgctcactctctactgcc

SEQ ID NO: 31757 - DNA, 1757 bp, Mus musculus
ttgggaataccagctgtgtagtacagcagattggtggatgctggatcaggtcccctcttccctactcagatgtggatatctaactcaggactttgtgcgtgccaggtgaaatactctaccaactgagccacatacccagccccaaagttgtgatcttcaaatagcagcacagtagtagaaaaaaaatgaaatctgattatgcatcagattgaaattaggcctttatttgaaacctatgtttaaggcgggcgtggtggcgcacgcctttaatcccagcactcgggaggcagaggcaggcggatttctgagttcgaggccagcttggtctacagagtgagttccaggacagccagagctaaaagagaaaccctgtctcgaaaaacaaaaaaaacaacaaaaaaaaagaaacctgtttagaatgggtaacagagactcagtaaggacactgtctccctctgcaggtcaaggctggttctgtgaagcaggagctggagaagcaggaggagctgaagcgctcagcaatgcgggcagtggccgccctgctgaccaaccctgaggtgcgcaagagccccactgtagctgacttttccgcccagatccgatccaacccagaactcaccaccctcttcgagagcatccaaaaggacacagcctccggccccagcacggactctatggaactcagctagctgcccccaacacaagtctcccttcttatcccaataggccttggcctcttctgtccttccctgtcagcctcagtgcctttgctagggccccctgctcacagccccagtgccaaagccgggcccaccaactcaggacgttcattcacgagcgtcatgtcccaccacctttacactgcacccctccactcacttaggagccagaattggcctatgcccaagaccagaaggcaagcagggggttgacttcctacttcacttactctgaagtccaaatgtcagttagcaccctgaacctagccatgggtagggtatgtagagcccatacaagagaaccaatttatacttagtgcctcattagttagcagagtgagaactgtttacagggaagatagtgtggctcattggccaggtgtaggtccactgtctcaaacatccctaatcccatcacccaggagtgtaacagtcggcttgtgctcttcccgactttgtagttagtactgaaaatttaagtataaatgacaggttttgatttttaagacattgtttctctttgtagccacatatggcccagactcaaatccacctgcctggaattaaagccagctgaggccagttatctgagttaataacatatacaaagctctcctcacaggattcttatccatattgattcagtcctggaaataacaaggccgatggcatagacctgttatcctaattccttaggaggctgaggctggaccacacactcaggtcgtagtgaacaaatttaagatctacctaaaagcaacagggcaggatagctcagtaccacgccctcctggtagcaacaactttctaacctgtcctaaaggaccctatgccttcgggcagacatatatacaggcaaaacaccaaagtttaaaatagctcagttgtagagcactctccaacactacagcaagatgataaaacctcatttctacaatgagaacaaaagcttagtaataaaaaggctgggatgtctttctctccagtcatttaagtgtcacccgtgacagtcaacccttctgaactccattactgttt

SEQ ID NO: 31758 - DNA, 1167 bp, Mus musculus
gccagttggccttctcactttgatagtttaactcaggtacccagtcttcactccatccccaggtgcttgttcacctcattaatgagcacctagagcaaggaccaaaagaaggaaaactaattaaaaccaatgcatattcatgccaaaacaagtggtccccaagcctgtttaaaaggttaacttggcccgaaaatattgcagcagcttcatgcaagaattgccacaggacactatggccttgctgggctagcatttgctgctgtaatctagttgctctggtatagaagagaaccccatggggctgtgggagagacaattcagtggcagcccactggcttctctacccattccacaggaaccctattcctacccccacccctgcccacaaatgccactgtgatccacagctgaagttgtttctaattgcctaaaggcagtctctgtgtctggagcttcaaagagacaggcagacctgcactaattcccttcttcctctagcagactgccttgggaaggaccttcagtccaggacagaccctgtcatggcttcttgctgtcttacccttctcactcaccaggcccacagtcgcctgcactcagtgctgtttgtaacacatctgttattctgcctacctgtactttttgctgcccatccctgttgcctttgagtttcttggaattgtggctgtcctcggaatctcttttctattcacagcccttctatagccttgctctgatggttttagcacttgatctgagagaagcttgcccataatttaatgcttcttttccttaaaaaataaaaaaaaaaatcaaaaaaacccactaaagtgaagcatttcttgattcccttttccatgctggtgcctagcccgggtgagtgaggctggctgtgttggcctgggtgacttgtggttgtagagttggccatcattctgcactgttgatagctgtctgctccagtttctggtctttggtatactcagtgtggcccggtgatgaaggctttctactccttaacaggtacagttggatccatcgctgatggtgtttctttagccccatcccaattggcctaaaacatttgtcaccagaacagtggggaaaagccttcctttccagccatgtctgacagtgagcatgctttggtgtggtcttcactgcttt

SEQ ID NO: 31759 - DNA, 1416 bp, Mus musculus
agagagatcaggagtcatagatgcaagcatcaccaacagaatacaacagattgaagagagaatctcaggtgcagaagataccatagaaaacattgacacaacagtcaaagaaaatgcaaaatgcaaaaagctcctaacccaaaacatccaggaaatccagaacacaatgagaagaccaaacctaaggataacaggtatagaagagagtgaagattcccaatttaaagggccaggaaatatcttcaacaaaattatagaagaaaacttttctaatctaaagaaagagatacccataaacatacaagaagcctacagaactccaaatagattgaaccagaaaagaaattcttcccattacataataaccaaaacaccggcagtttgaatcacggtccgacggaggagtgggcgctgggatctcgctgagcgtccgcctggcctcgtctcttcctcgctcgtcggagcttcagcacggtccgagatggctggcggtaaggctggaaaggactccggaaaggccaagacaaaggcggtttcccgctcgcagcgagccggcttgcagttccctgtgggccgtattcatcgacacctgaaatctaggacaaccagccacggacgtgtgggcgcgaccgccgctgtgtacagcgcagccatcctggagtacctcaccgcagaggtacttgagttggcaggaaatgcgtcaaaagacttaaaggtaaagcgtatcacccctcgtcacttgcagcttgctatacgtggagatgaagaattggattctctgatcaaagctaccattgctggtggtggtgtcatcccacacatccacaaatcgctgatcgggaagaaaggacaacagaagactgtttaaggatgcctggattccttattatctcaggactctaaatattcctaacagctgtccagtgttggtgattccagtggactgtatctctgtgaaaaacacaattttgcctttttgtaattctatttgagcaagttggaggcttaattagccttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaagcatttggttttgtacagacattgtttccactctggtggataagctcaataaaggtcatatcccaaaaaaaaaaaaaaaaaaaataaccaaaacaccaaatgcactaaacaaagcaaaaaatattaaaagcagtaagggaaaaagttctagtaacatataaaggcagacctatcagaattacaccagacttctcaccagagactatgaaagctagaagatctcatacagaccctaagagac

SEQ ID NO: 31760 - DNA, 1175 bp, Mus musculus
ctccctctgaccttcccagttccctttgctccatccagcttagcccaagatcaaacacaaccatcccccaacccaggaaaagcaggaggtgctgtccactccactggctccctcagcttctctttcattccttccagcaagccaccagctaccgctaggcttttctctcccccccccccccacctttgctcctcagaagagaaacattcagacagctttattatcttagaatttgccagatagcacaattgttgggtgcagatctcctaaacttattagctaacctatatcagccagcttcagctgacctacttggttaaccatggtagtggaggctgctggttcttgttccccaaagatcttacatgactgctacatttccaaagcttggctgtaaaggccacttccctttcctccaatctctttttcctcttgggacctggaagtcgaacctttaacctttgcccagcaattggctcctaccttctttattgacacaatcaagaaccagttagggaatcagcacctcccccttcaactccgctgttagagactttgctgcttttgcaaaggacttgagtttagtccccagcactcacattggcaacacatagctgcctgtaaatccatcttgacgggttctgagacctctttctgatcatcttgggcactgggatggtttgaatatgcttggcccagggagtggcactattaggaggtgtggacttagagaaagtatgtcattgtgtgcttgggctttaagatcctcatcctagctccttggaagccaggcttttcctgtttgccttcagaacaagttgtagaattcttagctcttcctacaccatctctgcctggatactgccatgctcctgccttgatgaaaaaggactgaacctctgaggttgtaagccaaccctaattagagagttgccttggtcatggtgtctgttcacagcagtaaaaccctaacttagaagttggtaccagggactgggatattgctgtgataggcctaaccatatctttgtttagaagaatgtagattttgggactttggatttggaaatcctattaggaatatggaagatggtagtgctgagggtaatttgaactgtgtaggcctgctgtcccaagaagtttcaatggaaaagaatgttattatgtcatctaca

SEQ ID NO: 31761 - DNA, 1117 bp, Mus musculus
ggcttggggtgggtgggtacccaggagccctagaaagcattggagtgttcataagtccagtgtattcactggtgctctgagctcacattctgtatgaattcagaggctttgcatgggaatgtgacagagtagttcagtgcttgtttcatatgtgcatggctctggtttcctgtccaacactacagaggactgcatgtgttggggaaaggagagaagaggaaagaaggggagagcctgacagaccagcaaggggggaggagcgagggcatcagtccaggttcctgagggctaggcagccctgggctgcattttgctgtccaacacctgcacaaaggttatttcatttcctaagtgttttgtggctgaacctgactcatgagtgctgtcaggaggctcctgctggagcatagctctgactgtccttccatcctcagggcatcctgatgtgtctgggtccacctctgccccatcactgaaggagctccagaaacatgggcagcctactccggggaagagctcacatttgccaactcctgctggcctctttgatgatgatgataacgacaatgatgaagatgataataacttttttatgccatcttctagcaagccttctaagaccggtaccacttttaggctaattctgggaacttagagaagaaaattaaacttaaggggacacagttcttcacattcggtgtctcttacagttccagaatgccttacttactgaacattactgtcattgtcttatctatgcttaaattgtgctatagccttgggggggtccctcataggtcaatcttttctgctttgggaatcaattactgaggttatcttctttaatagggagctgaacttcttctgtattcttttcttaaagtttttgcttctgcctttcacattacaggcagaaatttagtcacacttcctcctagcaactccgggtagttacatgagcggaacattgcgtgcttgttgcttaattcccagcttctcttttttctgccagagggctcgtattgtttttgctttggtgcatcctctcccctcctccgaggtccacactgatgtccttcctgtgcttttactctctgacggagctatgcctggggag

SEQ ID NO: 31762 - DNA, 1162 bp, Mus musculus
gagtatgcttgatttttaatttgtttgtaacttaacagttagtaaactcattttacttgccgtattccatatttaaattagccactagataatgtatgtctctgccactaacagagctggctggtggctggcagacctctggacttggggaccacccaagaccaagaagcaaagctgtgaaagaccaacctatttgaggaggagggagaagagaaagatgtgtgtacgtgtgtgtgtgtgtgtgtgtgtgtgtgtgtgtgtgtgtatgtgttgagtggaggggcccttgcacatgtttgtgtgtggtctggctcagctgatgggtgctcctggggtccacctagatctgcccccaatgctgggatactgatgtgtgtggctatatctggatcttttaaacatgagatctggggatttgaactcaagtcctcatgtttatgtagcaagtcttttttcctcacctagccattttgtcgtcactgtcctgtggatttttaatgcatgatttgtgtcttaaggaccaatggaatattgctgattcgcataccaagttagcatctgacaataagtccaaaggagagctgtgggactcgggggccacccaaggccaagaagcaaaggctgtgaaaaagaccaatctatttgaagatgatgacgatgatgaagttgatctgtttgctattgcaaaggacaggtgagatgtttacaatcgcaggaaaagtttcatgtgtgagacggaatgtctgttgacgtggtcgatggcttagtgttacatacacacacacacacacacacacacacacagacagacagacagacagacagacagacagacagacagacagacagggctgctcttgcttatctgtgcgaaggctttgggaaagtttgccttgatttttatttctgacatttttgtaaccttgaaacagttttttctctaagaggtttaagaatgatattgttatcttttatgtcttcccctccctgttaggtataccctaaaaaaggttacttaaaagtttgttactttgatagaaatcctgaaaatgttgaaaaacatgatattaggaggagtaaactcccagcaggcactaactatgccttctggtctatgtgactgagctgaagctagtggcttgtggagtgtgacatcgggcat

SEQ ID NO: 31763 - DNA, 1831 bp, Mus musculus
tgcctagggtccatctccctgagctttggctgcttcacctgtcttctccagagactgaggcaaaccgaagatgaatcttttgtagttcctagtagaagccccgtgcttagttttcagaagcatgtggaggctagctagaaggcttgtggaagcaagttctgtcctgttatccccttgtctactccctggagtcatggagttcagttgtggagctgttctgccagggctttcagccattatctaatgggcccaccccttaggtcagcctgccctctctctcccagaccacataagcctccctgtgctcactgtgccccaaagtgcaattactcacactcagtgaggacaccaggcagctacagactgcccactaagctctgactattccttttagcagctgctgcggcgagtctctgaccctgtccatctgtctgtgacaagatgttccaacattgggtgggcagtcaaatgaagatggaggcatttgtagagaagaaagtgtccctcaatgggggttgtctctgcacagctgccctaggggacttgtactcccacatagataggtggctttggaagcatggcttcatgttgttccctttatttcaggaaggcctgatgctatctcttctctggcttctctgatgaactctgtccttcatccttcccccgctcgttttccctgaaggttctctgatctagtaaacaactacacatgtgactcagtgcaggagactggcaaggcacggctgcgaagcatctggcagagctctgggtctgcccagactctcctagtccttgcctctttggcctctgagtaattttgcagggctatctgtctaccccattgttcctcactttgagcttagatatagtgggaagatggcatgtagctagaccaagcagatctaggatgagggagacctcaggccaggagggcttgtgcttgtgggtcaaatgaagaaggaagtcgtctcagggtgtcactggcagccctctaacttggcctttaccccgtatgtcatagacccattcgcacagctttgactctagctgccacaagtgagtagttgagggttatgctcaagtgtatcacaagattttcctggaaatgtaaacattctcttagtctaggtctctctgtctctcctttctggcttcaggacactcttcgttaagtaggcttagttttcaaacctgtgggtatgtccaagtggacacagatgtgcaggctcaggcggtgggggataggacagttcaaggcctggggtagtatctaagtgacagaggggaaaggctgtgtgggcagggtgaagagctgtaatcttgtgggtgtggttagatgcacatgtatatatttcattctacctgttcaaatctggtttggaataatgcagcttatagctgcagctcaaggaaagcccaaagcatagggagagaaaaggcacttgtctctgtgtcgggagtgagtgacgaaggcatgtaactggtgcacatttagatgcaacgtttcaagttgattgttaataaaaaccaaatttacactggtgtgtgtagtgtagtttctaaaaagcacttcacattttaaatttttcttggaaaatttctagtaatctaaatgtctaattttttaatctttttgtgtatgttcattgtttctcagtattactgcttgaataattctctgtacaggggatttgtttgtgctatatacggggtgtctaaagttagcaataaagcctttctttacaaaggaattttgtgatgagagtgttttcaaatggggaagctaggataccctttcccgcccacatatcagtaaagaataatgagg

SEQ ID NO: 31764 - DNA, 1173 bp, Mus musculus
tccacaccggcgagaagccctactgctgtgatgagtgtggccggtgctttagccagagttcccacctcattcagcaccagagaacccacaccggagagaagccctaccagtgtgaggagtgtgacaagtgcttcagccagagctcccatctgaggcagcacatgaaggtgcacaaagaaaagaagccacataagaggggcaaaaatgccagggtgaaaactcacccggtgtcctggaaaaggggcaaagggaggaaggcggtggctgggatccgccaggtaaagggagccacttccggcctttttaaaaagaagaagtgaaaggtagaggagaaagccgctccgaagagtggatgctttacagtagagcacttagataccgctcctccctagcatggagacttcaggagtttcatgacagtgcgctgaaactctgagtctagctgccctcatttcctttaaaaataaataaatttatgtgacatggagcagaaagaactgaaacaatagtttggtaagaatttaatattcttagcctcagttgaaatcgcttccctccattttgataaaaagaatcatgttttcatgatccactggcgtgccaatgattactcttatttttcggaatttctgtatacgaaatcattaaagaaagaaggaatgggttttcagattctaggatcgactacattttatgtttttaatgttttgtagtttattaaccattagtatcagcattgactcagtatttgacatagtaaaatgcattcagattcatagattttggtttttattagtgtatattgtacgaagtaatgagcttccttttctccaatgtgtatgaggtatctgtatgatgtgctttgctcacacccaccgttaccctcgcccacctcctcctggttctccttttatcccagagagttcccctccacttaaaatgttgcccctagcgtctgtgaatgacagacagtgtgtttggttatttttctgcatccactttcctgtgcctactgtaatgttctctagttcaatccattctccaagcaacaggactgtggcttttctttttcgtctcacagtctattgtagtgtttgaaggctttagcgacaacccgcttttgtttgtttctttccttctgctatgttagtaaagggtgagaaggtctccatg

SEQ ID NO: 31765 - DNA, 1194 bp, Mus musculus
gctgccctgctttagaacacaagaaaggactcactggtggtggcctgtggatggcctgagcaataaagtcatcctaaattgcagaattttagcatcagaagtgcaaaggaatcttctagccaaagactctgaaattgaaaacctgaactggatttttagcctcaagacatctgcctgtccggtgctcagaggtaattaactgacttgactgttttatgccaggcctgtgctagaccctggaggaacaaagacagagccttggtaattcctcttctggaggagcagacttggagacagttatgcgcctgatattgagtagacagctaagagtgaatggtactgaatggtactgtaagccacgagacagcttccgtccctgacccaggaactcactcagtgctgggggaaccactgacacaggaaaccctggaagtggccaccaacttggtggtgtttcacagctgtccaaatattacttaaggctttttaaaataagttttactttcaaactattatcaaaactaatttctgaatgactagagtttggaaaaactctagcaagttgcacagagcagtgctctctgctgtgttcctctgaagtgttcacaaatgttagactgacctgccacatctgctcttagaggacaactggagaaccaacctttgcagggcataacaaccccagaacttgagactatggaggctgtggcttcacagtgcgcttgggctatcacctgcgatggaggtcacagccttctggtgtgttctccacttctcagatgataaaggtatctatagataaagtgaagatcccggttagaaaggactgtcttccaaaatagatctgtcctcagagcttcacatagtaaacagcacaggtcgaaatcagtgtgattacaagattgcaaaagtcccgagctcaggataaacagggttgtttgtccagatcaaatgaccagaacggatcggaaacaggagtaggggaaagacttgtttttctaaagcaataataacctttagactttctcagtgacaaaacaaagtctttcacccagaatacatctggcttcttggtcacagggcaaggagagagggcttatttactctactcaggtgatctggtaggaactggaattatgccagctgcactgtgtgaacacagctgcagagtgacaggccatggaatgtccttat

SEQ ID NO: 31766 - DNA, 1104 bp, Mus musculus
gctggcttcctggcttccatcctgtctcctctgagtagctgatgctgtgtcctcaggaacctgctgagggaaaacggggagaacaagcactaagccatcgctctgtgctctagtgctccctgctctagtgctccctgctctagtgctccctgctctagtggacgagcgctgtcaactgccttactgtcaaccacagcagtctctgcttattttctatttgaataagagcactgcacctgaggaaatgccaaagccaatagagagcaatattcttattgtagagatggaaaagtcgaggctcggagaggaggcatctgcagtcacccaggtcttagtagctcccagccctgaggaagaaggcctttctgctacactgcttaacttaaaggaaattctacgtgcaaatgcttctactgtgaagtaaaagagaggacggattctccttctgagggagagtagagatactgtaaactaaggcaggccatgagtcagatgccacaaactagtcccatacctgtcttgcaagtgtgtgctccatttggtctcctccctttctctctgattattgtttctccctaccccctcccctcccctcccctcccctcccctcccctcccctcccctcccctcccctcccctcccctcccctcctcttctcttctcttctcttctcttttctcttcttcctctctctctttccctccccctctcgtctccccctctctttcccctctctcccctctcttccctctctcttctctcccctctttcccctctctcctctctctctctcctctccccctttcttctccccccctcctctttcccctgtgccctcttcccccccttccccccctcacatatttactaagcagcctttactgcctggacttaaatgtgactgggctggctgttgtcaactctgcctcctgagtacttagtactatcttctaaatgtatttaaatgtatacaaatttaatggaacacttctccttgttagtcagtctggaataggttatgctgcagtaagaaatgcccgaaacaccagtgtcttagctaatccagcagagatggcttctctttccaaatgcaaatccactgtg

SEQ ID NO: 31767 - DNA, 1244 bp, Mus musculus
acgggagagaagccgtaccagtgttacgaatgtgggaaaggcttcagccagagttcagaccttcggatccacctccgagtacacaccggggaaaagccctaccactgcggcaagtgtgggcagggcttcagccagagctccaaactcctcatccatcagagagtccacacgggtgagaagccgtatgagtgcagcaagtgtggcaagggcttcagccagagctcgaacctccacatccaccagcgggttcaccgcaaggagcttcactaagtaacatgagcccactcagaagacttttattgtaaagataaatatttttcacgaccgagtgtgcatatcagaggtagcatgcttgcctagcatgtatcagtccctgagtttgagccctgatacgcccccacccacacacacacacacacggtttccagcttattaatactttgtgcatgttaggaatgtgtgttcatgcagagaggggtatgtgtgttgtgctggtgtgtgcatgtatgtgtgcacgcacgtgtgtggacgtctgaggatatctcagatactacattctgtatgtgagactaggcatctgtctgtcacacatggtgtgtaatgtcaccaagtaagccaggccagagtcccatggatctaactgtctccacttcccagctcaccgtggctagggttgcggatgtgtgccaccacatccaacctttttatgtggattctgtctcaagctttctagacaagagctttgctgcctaagctatgtcccagggctccagtttaatactttaaactcttacgtttgaattcctcaaaggaaagaaatagttaagggttattccgatatagcccctcacagaagaaatcaatccgagtactcagcacattttatgttatacagtgaatgggttactctggtttctcatatgggtagagtgtataatgcaattctgccagtgttgttagaattatattctacattttttaactgcaagaactctgtatttttccaagcacagcatggttcccttcattcatattctctgagaaattggaattcatgtttcctctgaaattatgtgccttgtttttcatattccatttaagtcctaaatagctctctttaaactgtgaccgtccaatgtgttcatttgagggtggggtgggggagctggaggtataacgggcatggtgacctgttgtgtttagtacaaaaatgtgcatcagtttgcactcacactacaggaagt

SEQ ID NO: 31768 - DNA, 1505 bp, Mus musculus
tatttaattcttctagttgaacaagacagacgatatctggaaatagttaatacttaagtctttcttcccttcgtgctgcggagtggaggtcaaaacgtggttcagttcttccatctgtgtattcagactgagcgcaggtagctaaggtctggcaaaaagtgcgttagcccattgaacaatgtcgaagtacttttgagtacgccgggtggctatgcatgcttttgcgctcagcgctcggaggtagatctcagttgagaacagtcttacagaccaaatcctgacttaaattttgaactttctgcttttcttatctccctcgtgttgccattagtcttaccagcctttttttttttttttaagttacaaatcattatgtagccacagaggatgaccttgaattccagatcactcagctccacctctagattggagtactaactcgaccacaccccattagtagttactgggcatggcaggctttaggcacgctttgtcagccccattctgtctgtattatgcccgtttttgtagtaatttttaaaaaagattcatggtttgatttgaaggaaggcctgggcacactggatctaaaagtaaatgcaaaagtgattacttgtttcttgaggtagggtctaactattatattacgccttggcgcaaaattactgtatatttagataaggctggcttcaaactcaagcaacacacctacttttgcttccatagtgctgtgaattgctggcattaaaggcatgtatcacgaagcacagctaatacaagggggtgtgtgtgtgtgtaacagctttcttttgtttttcgagacacggtttctctgtatagccctggctgtggctgtcctggaactcactttctagatcaggctggcctggaagtcagaaatccgcccacctctgcctcccaattgctgggattaaaggtgtacactaccacgcctggctgtattttgtacttttgagatgtttggttttgtttggggggggggttattttgttctttttggattttcaagacagggttctctttgtagccctggctgtcctggaactctgaaatgtttgttttatatgtgattatatttaagactttagtaaatgccgaaataaaactactgaccatttgcttaccaaaaaaatttcagttctctgtgtaacccacaagtgaatggttgtgggcagatgataccagtaacatggagaggtcagagaacagcttttggcccactttgctactgtgtcttctgggataaaactggggtcaccaggatttcagcaggtgcctatcatccctttctcttaaaaattttatttattttgcttttgagacagggtctctatgttgtagctctggctgacctgtggctagttctttagatccggctggctttaaactcagaaccttctgctatttcttgagtgctgggactaaagggtgtataccactactcctagggtctaaattttttcccctctgatgttctgaaacgg

SEQ ID NO: 31769 - DNA, 1240 bp, Mus musculus
catttgcagctatcaccagctttagtttcaggtttctctcctccagtttttgcagaaaataaactttagtaacattttaaagtagttatgtataagagtgcttgcagtgttttcactacaagtgtgcttaggtcagaggacaactttagccccttctcctgtgggtcttttgggggttggtaccctcaggtgtcaagctgggtgcctacccagctaatgcctttctttctgcatctttctgggtccttaaaacataggcctttgaaataatctaatcagttctcaatctaattgctttgaattaaaatacattttgtgattgcctcttgggtacagactttataaggttcatttttatacatgtgggccaattacattcaaaagtcaagccccccttccactatgtggtcactggggaaccaaacttaggttgtcagcttctagaagtcaagggctttgggggaactcaagaggaagcctaggcaggcctctgcccccggaatgctggaattaaaggtgtgcaccaccacacccgatattaatatatgtaaaaaaatgagacaaggccggaattaactcgtacacactatatacactggtatcggctttagatcctcctgcgttaagccccctgagcgattaagtgcggccaccacgtctggcggaagtttttagttttttaaagtttatgtttcaacatggaaaatatcctcgagcccatggtcaaaagaaaaaaagcaagtattgggtgtcggcaggtctttatcctgtagcatcccagtgctaggtgattcggttttactttgctgcgtcttcaacgcctcattgcgctcccctttccaactgtagctgtagtctggactttgctcaggtggctggctcctttacccagaactcggcgagaagtcttcccctttccttcccccacttccggcgccggccaaacccactgttcgcgggccacacctgcaggcacgcttttctcattggtgacatattggcgggcccggcagggcacttccttctctgcaccccgtgaccccagtccgactgccgctgtagatcacgcggctgcagcttcccggactccggacccgaacgcccttttcggcgtggtgagccccgcttcccgcccgagcctcaggctccaggcagcgtactttacctggtcacctagaagtttccctcttggagcctttccacccttcggcctgcgcgagttcttgctcagccctcttcc

SEQ ID NO: 31770 - DNA, 1957 bp, Mus musculus
tctgtcccctctgctaagaatgaggaaatagtggacaacaaaactgtcctaagttggatcccagtatagttttggagacaccttttaaaactacagaaaagggtgttatgaaagtggaatctcagacatgttgagcataagatgttttggaaaggtgatggagcttagacctggaggattatcatcaagatttagctggacaaggttgggcagaggatatttggatggagaattactgtgcatgtcaaatccttcagggaacagagagtggggaaattacaggaatgaaggggaaaaggaaatgatgggatataggtaagaatgtctgtaggatccaaggatttcattaatttagtctctgttataaccagcaggaaatagggcttagaagtggggcattgaaataattgggttacagttgtagttagagaaatcttaagattgtgatagagtagcagggagtaagttcttttttattagagttaagagatattaggaatatgagaatacagaaagaattttgaacaaggccatctaatacagggctgaaattccagctaccaggaggtggtgaggcaaaaggtctaagttatggtcagcctgggcaacttaaacacagttgagtggtttcaaagtggctgtgtgtgtgtgtgtgtgtgtgtgtgtgtgtgtgtgtgtgtatgtatgtatgtatgtagctcaggagtggagtattttatttgcctatcatgtgcaaggcactatagctaagggaacttttttgatcacatttcaggtgggctagtctagatttaattttgatgaggtcctgcacatcaagtgcatattttgatttaaaaagattagtttttttgtagagcttgtagactcaggtaaaataaaaggtataggagtatagaatgccatgttcatttgtgataccaagggttgtgtgttaaggccttcaaagattgagtccagctacatgtgtgggagctgattagaatacctaagaggattctaggaaggaatggttaaattctgtggagacagcagatgaagatattattagtaagaacttattttattgatagtaagtagaagatgcaatagaggggcccattgagattctacatttaagggggggggggaagatcagtaagttgaggcaaagctggccaaagaagaccttattaaacaatgactggttagtagtactattgacattcagtgcaaggaagacagtggtcagtaactataaagggttttctctaagttgggtctctttgtacactgtagctgtcttcagacactccagaagagggcatcagacttttgttacggatggttgttagccaccatgtggttgctgggctttggaagagcagttagtgctcttaaccgctgagccatctcaccagtccctaagttgggtctcttaagtagagctgtaaatatcttacaagagacaggttcttgtttataagttgataaaacttaaagaatttgtggctttccttcagggagttctgggtccttttggaagtaaagaacagcttttaaagctgcccaggaatctgaagggggagcccaagagtggatttgtagatgggattgtccatatgtacttttcctttgtttttattttgagatagctagggtcgtgtagcttgacagaagttagccttggagctactcatgctgattcttcccagatgctgggactgcaggccttgaactcctagacacagacacagacacacacacacacacacacacaccctttatttatttttaaagaagcagagtttcactaagttgtgtcatctcaaattgaacttaactgaatttgaatttgggtctttctgtcctggtctccagagtatctggttaaataggcactgccaccagttcaaattatgtaggtagtatttgaggcctacctgagggcagttcaacttcattagagactggttgg

SEQ ID NO: 31771 - DNA, 1213 bp, Mus musculus
ttcttttccatgttctttctgaaatgtttttgtagctcaacttgatgtaagaagaaaacgcaggtgtcttgatgtatagcctgccttgtgagagtactatagtatgaaacagttgacaaaatgaaattttatatttgtccccaaaatcgtttgaattagattctgcctggtacctgtgttctgattggtcctggagtatacgaggctaatgttgagttggtcagcacactcctacagggaacagaacactggttggtcgaaatgttcaggcagatatgcctgctgaccactaagtcaatcatttgacttcagtctttagatgaaagctttcattgatcacatgtagaatattttttttcacagaaaataattaacatatctaaaatctacagtccatcacaaaggcataagtcaaaaccccttagtttcatgttgctttccctttgaatatgtttttaagcaaatggatatagtagatatagtttagaatttatggtttgattataaataaaatatattgttatgttaccaatgttcaaaattcatagtcaaattgtagtagattgttttgaacattttattatattggaatgcaggacagtagctgtgtttgggaacgtctttttatataagccagaggcatagaagatatgaacgttatagcatggttttgtatggcttttgttttgcactgtcttgtttagcatgggcacatatatatttattttctatatgctaattttgccataattgtgtttgcatttgtattatactttcagttgaaagagttttattgaaaaaaaattaaatgcattatataataagaccacccttgatttgagaaaagggaaggaaggaaaagtgacctgataaaaatataaattatggagtactttaaaaaaatgtacagattgaatgctactttaattgaaatgtaaattatattaatgagacaagatgaataagaaattatattccagtagaactgtactataatatttatcacacatggatattttatcattgggtcatttactagatccagaaattggagataaaataaaggcatgcatagtttttttaacccctgacttttaaagggacctgctatttctatataacccatgagaactcagaaaaagtcattatttttgttcagtaaatcataccatctcaaaagttacaaatgccaaatttctaggtgctaatgtga

SEQ ID NO: 31772 - DNA, 1195 bp, Mus musculus
tgctttgcaagtgtgtcattagggagctgtgagtttgcttattaattatttacgtgcttgtcatcaattttccgtgctgtctgtgggactatgattgtactgttttcttttaaaaatgctaaggaatgaacacagggattctgcgcaggctggccagagttctaccaggaaactctgattccagtccttttcagtccttttttttctttaaatttctgttcggggacagggtctcactaagttactgagtgtcataggaagtcttaacttactctgagcccaggcaggactagaaccttgaaacctcctgccttagccttccatttctttgcatagtggactggcattagcttcttactgcacagtttgaattggtttttatttacttgaaatacaggctgtggatgccgaaagaggaaaagcaggtggatgtggaaacgggccgagtgcgtcggaaagccatttttggagatacagaagatgagtctggagatgaagagagtgaagatgaagaagacatgtctgaagctgacgggatggaacctggctctagtgatgatgaggcggaagaggcagaggaagaaggtgctgagagcagcagcggtaactacatgatgggtaggggacgcaaacgaccaaagcttgaggagcaggaggaagacagtgaggcagactcgccagcgtttgctgatagcgatgatgaccttgagaggagctctgggggcgaggaggaggccgaggaggcggatgaaagcagtgctgacggtgcctccacaggggagagggacgctggggaatgcggctctgttggagaagctagtgaggagagcccgtcagcagcccaccagtggaggccccatgcggatgcacagaagccctccccggtgagaaaagcagccctcaccacttctgactctggccactgtacagccgaggaggcgtttccatctgaggatgagtctgaggactctgagctcagtgcagaggaagaagactccgaccacagagaggttagggggaagcttgcacaccctctgcgcgacagcggacagaaacctgcctcggagagcctggttgatgagaccagcgacattgaaagtttactcaaagaggaggaagagtacaaggaggacaatagcagctctgtagaaacgtcaggtaatgactccacagaaacgccaggcatccttacact

SEQ ID NO: 31773 - DNA, 1152 bp, Mus musculus
ttcataaagagaatctccttttaaaagaacttacttaatttatcttccttttctttgttatagaattgattttagttctctaaagctgtgacagggttctgcggaggattcatctggacctaggtcttattcttgttttggtctcattgcttgtgggggatctgttacatttttaaatctctttatgacttaatgttggtatgtcacatattcatcagtttctctcagattttccagcttatggaataaagattttgaaagtatatccttattaccctacggatagaaaaaaaaatatccatttttgtttttaattttattaatttggatagtcttgtttaactcggctaaagctttggtgtgtgtgttttatggaattagagggtgctgtcttaagatgtaatgctttagggaggcctgaaatatttcataaagataaaaattttacttctgatacacagtgtaatctttattttctattttttaaagagttatttatttattataagtacactataactgtcttcagacacattagaagagggcatcagatctcattacagatggttatgagctaccacatggttgctgggatttgaactcaggacctctgggagaacagtcaacaagaactcttgaccactgagccatctctccagttccccagtctaatccttataactaataccttttaaacaattaagtttaaattgcctgttttgattgagaagtaaatacaattgtgtaaagatatcatttccttttttaaaaaatttactccatgagtttggaagttttgtccacatgtatatctgtgtagtgcagtgcctgcggaggccagagagggtcatcgggtcctttagaactgttgctatagatggttgtgaactgccatgtggatgctctgaactgggctggagtcctagaagaagagcagccagtgctctaaccactgagaaatctctcccttcaaaagataattctcaacttgtaactttactgaatgagttcagaattcctttttaataacacttaccagacttctagaaacttgctaattaaagcttttattcatccttattatcatcaagagcatatgggctttagaagagattaacagcagagaagttttattagggtagtccttataaa

SEQ ID NO: 31774 - DNA, 1223 bp, Mus musculus
cagacttgtccctgaaacccaacctcagtctccagtgctcttttgggaacaaccttccagggaagcttctagatcagcaaccacttgcctgtccaggcccaggaggaattcctgccctggtgctgtagggtacctgtagggccacgagcatctaagtccctccctttaccatgtgtccagagtgtggtagaggtcaaactgaaggtcaagctcgctcccctgtggcctgtgcctctcaaccactgccgtacaagggaagcaggggtgagggggagaggagagagagatgatggagacgccttctacacctgcacctctgtcttgtccccagagggctggaggcctgttcggcaaccatgtcacctactatcagagtgacagcaggggcaactttcctcagacgttcgccacccagcgcccactgcacatcaacaagacagggaacaaccaagctgacactgagtcaccgtcccatgagaagctggtggactccacgttcacccccagcagctactcatccacgggctccaatgccaacatcaacaatgccaacaacactgccctgggccgcttcccccatcccgctggctactccagcacggtcagcactgtggagggccatgggcctcccttgtcccctgctgtccgagtacaggaggcagcatggaagctcagctctaagaggtaagcaggagggtaggcctggccatgagggctcacataccctacccagacaacaccaggaaagatgggcttattctgtctgctcagacaagccttctgtgtggggtccctgctctgtgccttcccttcagggtcagaacagagaggtattgaataggattccagggacttgtcagttgggtcaagccatctcctaaaggctctgctgcccacagctagcctgtggttccttgtattgactgcccagaccaggatgctgcttcaaaaccaagtctccacatctgtctttacatgtttaagtttgtgtatggggtacatgtacttgtgtgtgcacgtgtgcggaggccagggattgacatccagtaccttcgattactttgcactgagctgggattcctcactgaacctggggctcaccaattcagctggtggctcccagcttctcatgaatactagggattgagcctggggcctcacgcttgtataacagtcaccttacaactaagcccctgcgtcatgcatgttattctacctactat

SEQ ID NO: 31775 - DNA, 2628 bp, Mus musculus
gttggtggtctttcttctcccttccttgctccttgcagcagtaacatgtatgagtaccatgcaccaactgatcgtgccattggagctccttaaacagtaatcacaaccaagttaggggaacatttgtatccaataaaggggtgggagtgcggttttaggcactcctttgggagaacaaagaaattaatgtaaataagatttctaatttactgtttaaataagaatttatataaacatttaagacataggggcagggagggagggagactttttttaaaaagaatgaaacatgcaagtaccacacactgtttcaattttgcacaagtgatgggaggaggatggagtggtagccccagaatgcacgatgtcttggtgcaccaaggtgccttccctaggccgataacacttggaccctgctggggcagagtggacagccccagcccaggaacttcctggccactctcaagactgagagcctttgggcattcagagggggagggatgtggaagtcgtgtgtgcttttcaatggaagcagcacaggttgtcatagtggctctagagaaagtgtcatttgggagactgttatgtaggctagtgatgacccttttgaagagtgaagccacctggttctactgtagatgtagtagagacttgatgaaggggaggaggacctgggggcatcagcataggaatggtctgcttctccctggtgtctcgtttgaccaggtggtagttcttatctgaatagaggtatggccattttccagaccctctctgtggagctctgagccattctgcaaattttgctctattgagaatcactgccctaactgtccttcctcctggaaatcaaaaactgcccccccccccccccccccagcatcaaagctccttcgtggagccggccactagtgagattctgatgagcatgggtcccacctgaagtcatgcaggcaggtgtggaggaccatcccttggactaggaatggtggcgcttttctctggtgcaggcttggcaggcttggcatgacaacagattcttctcccgttgaacaagaaagtcagtaatacctactgtggagttgttagcacgcactgaatgccatttgcaagacctgtgctacagagttgaaaaggaagtggactgttattaccaggtagtcggatagaattaaacccacaattttgaattgctgctagaagttacaaataatttctttgtcctagggccttcttgttatgggttttagagagtggcagtgagttgggtcttggctcctaagtgagaaaccaagcacttgagtctcttagactctaggcctcactccttggggctggtgggtattgcagtgtaacatgggcctcgggcatcccaaaaggggtgctgggcagtatgaggaggtcctgtttttacagtagtgttttcttggtcgtcgttgtccttcctctaccttcagatcgccacccagctgcagctgggacccaggaaggagtccattgaaaacctgggaagaacttcagagtattgggttgtggataaggtcactgccctaggtaggcccaacaggaagctctgggtgaacagcattgtgccagacaactaagaacagtgttaattcctcaagaagcagttcatcaagacagtgtccatccggaaggaagctcacctaggcttgtggtagcaacagcacatatcagcagccagacgcactctctggtcgtgcactttgggacatgagtttgagacgcttcctcatgacacctacaggagtagaggtctttgggactggtcatccctcttcccaaagcagggagactctggttcaacatagcacaaactcttagggaaccgaatcaccaccaccactgtagtccagtaacttcccttcggtgtgtgtgtgtgggcatgtgtgtgccctgtatgtctgcgcagctcactaccaacagcctccatgtgcacttgaccttgtggtgcctccgggaactttccaggttggcacctgaatgccttactctcagcagtctgaggctcgcttgctctgcgcacacgtttcagtctccttttttggccctaggctggttaggaacctgtacaccttcactctctcatcattaaatagtggcctttttcagtatttcctctctcccctctataagttgctgaaatcacaaagcacacttttggggatcatagaaggttggggttccagaaaggcatctctgtgatggttccattcactatggggatttccctacttgctgtcttcttgatttctctaataaaaagagccaaatggaaaatgagttttgttgtgttttttttttattgttgtcccccccccccctttaaaaacttacctcacttttgggatatccttaatatcctaatttagtcaggaagtttagggaatttttagaaacttcctgccttcaggaggttgatgcaggaggatcatgagtttaaggctagactgggcttacacagaccttgtctaaaaaaggtgagctttctctatacctggttaaagtgaccatcaaggcctcagggctgtgtggaacctgaccacatgcactgggcccctgtattttgtccgctccatttgcaagccacttgaaaccctcagggtg

SEQ ID NO: 31776 - DNA, 3331 bp, Mus musculus
ggatgtgaggcccgagcggccgcgcgggggcgggaagggcggcaggaaggaagcgccgctcggacgcgccgggaggaggagcggcggcccggccggaaggcggggaggggcggccgttggcccgcggcgggccgctctcggcgcctcccggggcggcggcggcgcccgcgcctcctgcacccggcgcggcgtagcggcgggaggaagatggagacccacatctcgtgcctgttccccgagctgctggccatgatcttcggctacttggacgtccgagacaagggtcgcgcggcgcaggtgtgcacggcctggcgggacgccgcctaccacaagtcggtgtggcggggcgtggaggccaagctgcacctgcgccgggcgaacccgtcgctgttccccagcctgcaggcccggggcatccgccgcgtgcagatcctcagcctccgccgcagcctcagctacgtgatccagggcatggcgaacatcgagagcctcaacctcagcggctgctacaacctcaccgacaacggcctgggccacgcgttcgtgcaggagatcggctcgctgcgcgctctcaacttgagcctttgcaagcagatcaccgacagcagcctgggccgcatagcccagtacctcaagggcctggaggtgctggagctggggggctgcagcaacatcaccaacaccggccttctgctcattgcctgggggctgcagcgcctcaagagccttaatctccgcagctgtcgccacctctcggatgtgggcatcgggcacctggccggcatgacgcgcagcgctgccgagggctgcctgggcctggagcagctcactcttcaggactgccagaaactcacggatctttccctgaagcacatctcgcgagggctgacgggcctccggctcctcaacctcagcttctgcggcggcatctcggacgcgggccttctgcacctgtcgcacatgggcagcctgcgcagcctgaacctgcgctcctgcgacaacatcagcgacaccggcatcatgcatctggccatgggcagcctgcgcctttccggtctggatgtgtcgttctgtgacaaggtgggagatcagagtctggcgtacatagcccagggactggacggcctcaagtccctctccctttgctcttgccatatcagtgacgatggcatcaaccgcatggtgcggcagatgcacgggctgcgcacgctcaacattggacagtgtgtgcgcatcacggacaagggcctggagctgatcgctgagcacctgagccagctcacgggcatagatctgtacggctgcaccaggatcaccaagcgcggcctggagcgcatcacgcagctgccctgcctcaaggtacttaacctgggactttggcagatgacggacagtgagaaggtcaggtgagggcggcagttccagttcccccgccccgccctgttcatcccaggaccaccactgttccgcacactcacgcgcgcacttacacgttcagggcagtggccgcggtggggcgatgacggaagcctgggctctcttctcctagtctggcgcccctctccactgcgtctggagttgttctgctccctctacccactctcctttcccagtgaggggagagatggaccctgctgtttctctgcccactcttctgcagggtatggagactttcagccaccgacaactgtatcctggggcactgcatttggaaatggggtgggggcggggagggactagtcgtttcaaccccgaggagttgaggaaagatgcctgccttcacttacactttcatttggatactgtgatctggcttttaattccaaacgtgtagaaagcaagcccgacttgaacagccttctcatccactttgtagccagtctcctctcatcgctgcccctttggtatctgcaactcacttcggttctggttttgttcttgttctgtttttttgttttgttttttatctgcttcctttttagttttcaaagaaatttgaaatcattgttcttttttctttctgctgagtatattctcatatatatatatatatatatatgtgtgtgtgtgtgtgtgtatgtatatatatatatgtctggctacctcgttttagtttacttttttctcttaagccctggaattctacaagagagatattttgagattgaaacatttttgtgcctagactggaaagatgcccactgggtttgtatctgtttttggttttggcttcttcccaacctccctgtacccaatgtgccccacttccgcatcctggctacgaccccaccccccaccccacccccagtctattgggctttgatgacccaaccatgtttctatattgatttaatttatagcacaaatgtatgggagaaatgagagcagaatttcctttttgtttgtttgtttgagatgcagatttgagtcttgaagaggagtattatatatgcaaattatgccccaccccaaccctcttgcaagtcttcccaccgagaggttagctagtgaggctgttagctagtgaggcttcccgtcctgtcggggagtgagccgtgtcagcagagagcctgaggctatgtgaatgaagggaggaggctgaacttcatgtcctgtctgagttctgttctcgaaacgggagcttgtgggtttgaaaacttttgtttctaaatggaggaatagatgactttattttggtggggggttgggactgtggctttaaaacaaatcgcttttgagtaggatgtatatttttgttggatattttgtttgtttatttttttagagtcctccacagcaacatgagagaccatggagaaacccagagacctttatcaattaattgtactgtttgtgaatttgtataaataacaaagatcctcttaaaacgtttatattcttacagcaaaaggttaaactgatatttatataataaaagaggaaatatgaagtatgtttttgaaaaaaaaagcacaaaatcccccccttgtatctgtgaattatttttaaggcattgtgtgtcgggtacatgctcaggtgggaggtgttaggagtgcacagaaactggaactaaggtggagttcagctggctcatgtgctgtaagtttatggttgagaatttcttttgtgtaagatttaccactgacatccaaatgttctgtctctagaaatgtgatcagactggagagttctataaattttggttttaaactgtcaacatggaaactgaaagaaaatgaaacttttttttttttttaagagaccagacttggaagagtcagagtggccagtttctttttgggaatggtggtggtagaggtgagatccaggg

SEQ ID NO: 31777 - DNA, 1099 bp, Mus musculus
gcttgttgatattgtttgtgtgattcagagaacggggcagttacattgtgtccattgttgagaatattaaaatattaaaacagtagttatagaactaaaaaattaaagagctgtgttttaaaagatgcaaacccatcaatatcatgttaacaaaggaattcaagctatgggcagcctagctcctccccccaggtcggtgtggtggtagccaggccagcccttgggagacacactctccacacctgagttaggtagctgcctgggaacaagaatctggggctcagagactctcagttgtgtcagggttttctctacatcctcaggacctctgggtaggggtttcaaagttggtgaccccagaaccaccctcaccctcacattggatcaagccttgtgtgcctagtgctatattgtaacctgggcttgggcctggagcccctgcttgcaaggccacaggacctcttcctgcccacttggtgctatctcatcatgtccatctatcagggcagcctgggctcctggagcctgtgggccaggtgccgtgggtggccctcaagagcttagctctctctggctcctgatcctagatttttttttcctttgaagctttctcttggctccagagatgtcagagttagggaaggaaatgagccaggctgaggcgaggagatccacccctatgccacagtgagcacaccagcccagcccctttcccgccacaccagtattacacccattctttaaagcatctagtcccacctgaggcacatgccattcagtggcccagctgcccagtgcagactagaaacctaggccggggatggggacgtttctctgcacccctacttcagaagaggcatgttgcactttagtggggaacccagaacgttgggcactggcttcctgtagcttgagtccctgtagatagccatggtggcagcctgatggcttgtgtgaagcagctgcagctgctgccagctgtgcacatgtgtgcagctcctagagtcaaattgccggcctgatgatgacatcacaaagatgtgttctgttcaactttgccttggtaattattgtaaacactttgttcaatttttttttc

SEQ ID NO: 31778 - DNA, 2440 bp, Mus musculus
agggatggtgtggaagccctgtgagatgtgctcagttgaatcatggcagtgaacgcataccttctcccttccttcttcgcagaccagcattctttgttctccaccctcatggcatctatgggcttgggtgagccacctctctgcctggaaggtcccatgtggtaggtcaggatctttgctgtcagtgttactaccctgaaacatgttcgtttgtgtcagctgcctgcttaacacagccatgcacacctcatgggcttggccatgctgcaatcagatgcagatccccccaaccccatccccagctgtagaggacagctatcagatggagtcgggccctaagagagtgcagctcatgtctcattcttcatccctgaagcagactcctgacactgctgtcttctggtgagaggctaaggcctctcagcctgcatctccccttctgcccagttaacactctcaaaggaatttaatgttgcccacaaatctctctcaccctcaacctaggacatcatgcggccactactgtcacagtcacagccctagctccccttcttccctgacatgaagtgttcccttgtatgggatgctggagagaattcctcgtgagggttgggtggcctctgccatgaacctctcatggaggtgcttttggaggtcccagcctggccaccaggaatatggaaattaggctaaaagatgataatcattgctgctcagttctctcaattttttttaattgtcctatccataaatcctttagaaaatcccggtatttcaggataggaaggttaggatcttatttattctcataaggaaccactacctagtaacagcttcacaggctacagtggaaatcagaaaacttagaagagtccaggcccacaggagtagcctagcactgccactggccagctgctgctccagctgttctgtgagggatcaccacagacaggcctccttacatgtacccattttggtgtttattagcagaagtaccatctgccacccttactaactgcacatatgaacccctccaccccttccttctccatcaggtccctccagagaggttgcaggagccctgcaggacatgtgcttaattgagaaggcaagtttgtaaggcagactgtgtctgatctctgcactatagcaaaggcttctcctcctcagggagtgatccagcagctcaagtggctctggagactgtggagctaaagttgaaccataaatgtagtgtttgtggtctttgtgttaggcaaagttaatagggtatctggcattgggatcctactgactgccattcagtaagccaatagttactaaatgcgtaactgccattgcactgtacatgtcattccatgactgtctgcatgcacatgatccttaaggtagctggccctgagagctcactgcaggttggctgagatcatccctgcctcttcattccatcgtcaagcctcatagccttcgcacctaaggtaaaggtggcctccccccaggccttcctcattggcctcctccaggccttcctcattggcctccctccaggtctttgaagaagggtcaaagcaagaatatgtcgctatgtagggtatgatacccacaggcctaagtgccagcagacccctgtgtcagcagtgtctaccccaagtgacatcataaagatgatagtaggaaaagagggctagaagccaacctggggctcccagctctgcatgccttagtagactctgtcccaggccctcattgagtgactgggattagcaagtacttacggacatttaagatgaagaagtcagagtggggtttagcaactcagcaatgcggaggggctcctgcaattcctgccagcctttattctcccacttgagaaggcctgagtgtacctcttcctcgccagtgggctttagaagagcactggaacaaggagagcagactggaacaagaccaccagtggtgttggaggtcacgctgtggctggccgtgtcctgtcccatccgtttggcctcctgggaagaatgtgttggctcaatttctttctcaggagagatgaagtcagtccagatggttctcacgtgctactgtcctgccctctgctattaacactgggactggcttggcaccacaccctcctatgtgactgaagcacagactcattggcctccctccaggtctttgaagaagggtcaaagcaaggatatgtcactccgtaggatgtgatacccacaggcctaagtcccaccagaccctatgtcagcagtattgataacaactctcgagtctgcctcacctcctgcctgcagagtccagagtcatgggaaaggagccagagggatgaggccgcaccacaggcctgttgggcacccgccgtcactgccagtctcagagattctgactgttcaaagacatgttcttcctgtgaaccaagaggacgttcagg

SEQ ID NO: 31779 - DNA, 1159 bp, Mus musculus
gtatttttaaaaaactctttcataaatgagctgctttaagtgagaacataatatatagctccacgactttgcaaagaatttaacactccatctttgactaccctggccaactagaatattgaccaggagaatcgctcagtgagaagaaatgtaaaagtggtgaacattattctctgcccttcttctctctctgctgggcctctattaaagaattccagtaagacaggtgtgcctgggacattagtcagtcaattaatagtgggactttcctggtacattctatattgaaaggcagtggacagtaacccaaacaaaaaaatcaaaattacccactagtatttattcagttaatatatgaacagcaaatctgcctctgacaatgtcagcaagtaaaaaagaacacagtgcttttatagccgattcagaattgtaagcagccacagaagactcttggtagatggaaaactaattttctaggaagactgagagtagctgacacatatatagaaacttttaaagggtgtgggtatgtgtgtgtgagaaagagaaagagagagagacagagacagagattacaggttcctcttctggtgatggccagagaggatatcaggtccccttgagttggaattataggcagttgtaaactacctaaaatgggtactgggaaccaaatgtcaattttcggaaagaagagcaaaaaatggctcgcaagtaaaggcacttcccaccgagcctgctgccggaagttcaatccccaggacccacaggtgaagcagagaaagaacctctcaagctgccctctgacctgcgcgtgctcactgtgtcacaaacacacaaggaagtgaacataacttttaaaaacctcttccaaacaatggaatttgaattccccaggggcagatgctctagtttctaatcattttcagccccttttcatccagtcttttatgataaggacttgggtaacttctcagagtgttataaccagctaagctatactcagatcagaggagaaccaggttcgggctactgacctataatcccagcttcaagaagctgaagcagggggatcacaacttcagcttcaaggatcataatgtactgacgctgtgtgtggacagacagcaatatttatgggtcctgtgtggcatctcct

SEQ ID NO: 31780 - DNA, 1189 bp, Mus musculus
cccccaaactaatctgacctggtgtaaagcaactttgagatatgtattaggaaaatagcagttttgacagacagagagagcacctggcataaaaccaatttacagctcttttgggggggtgagatggggtggggatgggggctcctgtgagcaacaggaagtcaatagagccatctgcaaacaagcttcataagcaatggacaatttccattacaactccatttctcagagtgccatttgtcacaagttttatttctctgttctttatttaaaagtaactgtctcatatttaaatgaaattttaacattaaaatatagcagctttcgagttcttttttctttcacaggttcagagttgtactgttgattttttttttttttggcataatgatattctattcattcagttgtgttgtcttcctttgagctccactggggaacgctgtgtccaaaaaacaaaaactcgtgtttcctcctcctggaaggagattctcatggaacttgagagtttgttacattggtggtgccctcggccctttttagcgaggctggcagtattcatcactcactgactgcccctgcaaacatctgtgtcatgcatcatcaccttctgctgtgtcaattgcttatatttcattctttgcattactagaaagcttcacacatgattcctgtaattcctttaatgttctcagcagtgtgcagatatgctgaaataagtgtgtgtgtgtgtgtgtgtgtgtgtgtgtgtgtgtgtgtgtgtgtgtgtgtgtgtgttcctatgcaagccagggatcaggaaagtcaatacattccagtgacccacgaaggtagaaagacactaatacactagaccccgtagtttctcatctcactgtaaaggagtgaccagtgcagcagcattccctggtctgcagctggctgcatgtgcccagaacacagtcatcaaatcctctttatcatgtcaatttgcctcagttgtgtccaggaagaccaaggtattggatttactcccttgttcatagtagtaaatcctgcacttcttttcctccaagctacatgagaagaagcataaaaccgtgctagcatgcagctgctctttgacttagcatcttcagtaaaactgtagagcaaaaacagcatgaatacttggttctagctggaaactgggatttttgtctttaaagga

SEQ ID NO: 31781 - DNA, 1148 bp, Mus musculus
gcatacaaaataatagatttcatagtgacatttccatatgtatgaatcattgtgctctgcacatgcacacattacacacatacacacacatagaaatacacaccattaacaacctctcttgtcccccttctaacttgtctcttcctctcttcatgtagctcccttctgctttcatgtcatatataagaatatagataaatatgtatatttcacatggattcctggtgcctcaagagccaggtggatccctgagtctcaggtcagcctgttctataaaggctcttccaggccagccagggccacataatgaaacccagatccaaacagtgacaagaaaaaaaaattagactccagatgtaatatggtatgtttgtcctatgtcgtcctaccgtccccacaacaccttttcttaatccccctcctccccttcccctgtatattagtcattcactatagatgtgataaaacaccgtgaccaagacaactcaaagaagaaaggttatttacacttccagttctggaggtttgagccattgatggcagagcaaggccctggctgcaagagtactcacatctggaattggaaacatggaccagaggtctaacttgaaatggctggagtctttagactctcaatgcccaactcccagtgacatacttcctccactaggactatacctcttaaacctcacaaacagctctaccaactggagaccaagtactcgaatgtcccagactatgggcaacaactctttcaaagcaccataccctacacaatccccttacagttttatttttttggtgcatatttttaatccgaattttgtagtttgtcaacttgaacatttacactctgcttattgacaaccttttgttttggtgtattacagttcagagaatgtcattattcttgctttttttttttaacatatgtaagtatatttctctagcatatattctttaatagaatttgctaataagaacatatacattgtttgtttgtttgtttgtttgtttgttttgagacaggtttctctgaataaccatggctgtcttagaactcactctgtagacgagactggcctcgaactcagaaatccgcctgcctctgcctcccaagtgctggggttaaaggcatgcgccaccac

SEQ ID NO: 31782 - DNA, 1203 bp, Mus musculus
ttgtcttttctgtgtgaaatctactatactagagagcatttggggaatacagcattggacgtataatctgtttatagtgagttcttgagcactttgggttttattctgctatctcccacagagaagtctaataaaccctgttactgatcatggcagtagttatcaaggtacaatgatcgggcctgagaatcaggggcagcttcttactggtttctgtgtgcaattgatattgttgttaggtacatcgtactgaatgtttgcaatgcaatgtattttcctagagaaatgtgactccaccgtataatttgtcttacccagtagatagttcttgtatgggttacatcctaaattttagtttgataattatttctttttccttataagctattaaaaatacactgggggttagtgtaaattgtattggatcacaaatcaaatggaatgaattttattccttattctgttttctagttgtgacttagtaagttccctaacttctctcagaggaaagaaagccactcatgtctcacactgaaataacctataaagactcccttcgaacactgagccttattatggcttctgtgtgtgtgtttttgggaggacagtagtgtctgcatgtaagcctctgtgtgtgtaggcttgtacatatgcacttgatacttagaaattccctttctgcattcttgggttgtcagacattaagttccatgttttgtctttcaggcaaagtaaacttctagtaaagtgaaatgactaatttatttttccacattcgtttatctgagttcaattcccagattccatgtgttattaggaaagaaccaactccaaagatcctacgagtagtcccctgactcctatatatgccatactgtgcccctcaccaaaagaagaggggtatattaattaaaaaataatagttgctgcttctttgttagtgctatttgagaaagaaattgtggcctagtatttacattatttctaacattttttttcttccaaaagtacagaaaattaaatctttttaatttttcttgagcgttgtgaacctgtttgttgctgaagcaaccagactatagaaggtacttagtcatacaaacataagcaaagaaaaagccagtccgctgaaacattaatttgcagggtattacttcagattactttcattttcgtttggaagctatattgccaaattttact

SEQ ID NO: 31783 - DNA, 1151 bp, Mus musculus
agctgtaagctgactttatagccatagagaaacctcacagaatcacattgttgtttttttcttcataccatttctggcacctaagttcaccctgcaaccatgtatggaagtgctcgatcagtagggaaggtggaaccaagcagccagagtcctgggcgatcacctcggcttcctcggtcccctcgcttaggtcatcggcgaacaaatagtacaggagggagttctggaaacagtgttggaggtggcagtgggaaaaccctttcaatggagaatatacagtccttaaatgctgcctatgctacatctggccctatgtacctaagtgaccatgaaaacgtgggtgcagaaacacctaaaagcaccatgacacttggccgttctgggggacgcttgccttacggtgttaggatgactgctatgggcagtagccccaacatagcaagcagtggggttgctagtgataccatagcatttggagaacatcacctccctcctgttagtatggcatctactgtacctcactctcttcgtcaggcaagagataacaccatcatggatctgcagacacagctgaaggaagtattaagagaaaacgatcttttgaggaaagatgtggaagtaaaggagagcaaattaagttcatcaatgaatagtatcaagaccttctggagcccagagttaaagaaagagcgggccttgagaaaagatgaagcttccaaaatcaccatttggaaggagcagtaccgagttgtacaggaggaaaaccaggttagtttcatttatacatttatctttatgggctgagtccatgtatataaacaaaaagaggcattccttttccatcccgtcttagatttcccccatctttgttcttttattttttttatttatcctttttactttagaactctgtttctactttcttagcctttttaagacttgttcctgtacatggtgcaaaacactcacacatataaattaaaaaaaaaaaaatcacaaagcagtgacgacaacaacaaaaacccaacttgagctggacagtggtggtgcccacctttgattccagcactcaggaggcaggggcaggtggatctttatgacttggaggacagcctggtctacagaacaagtttcaggacagccaaggctac

SEQ ID NO: 31784 - DNA, 1177 bp, Mus musculus
gcgggcgccggtcgtgctgtggcggtggcggcggcggcggcggctgtggtagtgtcggcggcaggctgtccgggaagcagtagcagcaaccgcagcagcagcggcggccctgaggagagtaaggcggccgcgtcggcagcggctcgctcgtcaggcggaacctcgatctgcccagaggtcgcaggcgccgaggcatttgtcgtttcctacccggctcggcgctcccggccctggctgggcagggcagagcgcccctggggaggggcggagctgtaggtgaggcttggggacccctccccctcctttttgggccgggggtggggaggaggatggggaggtcgggagggcggaccccgccccagcgcacccgagcccaccggcggccgcgccctgcggagctcccggattgggcgggagcgaaggcgctggcggtaaggatcgctgctggaggtgggaggtggggggcttctggcccaccgagagccgagggtgggaggcatgatgtggggctattggggagccctggagttggggtgcggccaaggtggatcggatgtaaaatgtttaagatgatcttattattttgaacctggttagatagaagaggaaaggttgtatttcagatggaaaatgaggcatggatgtcgccttggaggtagctggaggggctactgcagcagatctcacattgccactctagggttttggttcttttcttggtcagatgagtagaattcgctgagggaagagaatccctttgcgttgacttggggttggtaaattgggagcgcgagtgagtgaggtttttacacacaagaaggaagatgttggtgtttagacaacttcattctatagcaaccaaccatgaaggagtgagtctcattactcttagcccctcaaaagtgctatcagccttttcttttccttgcccccctcaaccccctctcctgtgcttgatctctttgtaccatttttcatttttgagttgacccgttaagaaaaggccctggactcagagtaatagttgcaggtggttgtggctgattgctttgagcgaactgtgaacagttctgttggagatgactgtatgaaattgcttaagcgtttaaagtgcaactgtctcttacatcttgtttttcaatagaccttgatacattttgcgtttatttaatcatta

SEQ ID NO: 31785 - DNA, 1132 bp, Mus musculus
acccagctacccatgctaaagtcctgtgtgtggctttggtcctccataaaaacatgtcatatgtcagctagacgttttttcctgagtctgatctgttcccagagatagactggtagttctggtttgatttttccagaactctctgaaatacttgctgcaaagtttcctgtggattggaaattttgccaaaaaacaaaacaaaacaacaaacaaacaaacaaaaccaaacaaacccaaaatatccacatgaggaataaatgactttcattcacatttaaaaatgccaaagacattttaatagctttttcttaaaaaatttattttctaggtgtgttatattgaaggtcatcgggtaattaatctggccaatgagatgtttggttacaatggctgggcacactccatcacccagcaaaatgtgggtatgtttctgtgtgtgctgcctgcctcacactccttactgcataactcctccacttgtgctcaagagggtccagtgagttaggacacagggcaggtgggtttgtttgacagctgaggaacatggatggggtgcaggggtcagtatctctccaactactttcctttcccattcctagattttgttgacctcaacaatggcaagttctacgtgggagtctgtgcatttgtaaaggtgcagttaaaggtgaggggctggggtgccacaacttcctgggaggaccaagtaggcagtgggagggagtctagagtggagaccagggatctgactcagccagggtgcctagaaaggcagtattcaaacatccttgctcatctgcccctcatctgtagaaaggatggatcttagtttagattgatgtgtgtgtgtctataacttgacaattgaaaatctataatgtaacagatatttacgttatagttcataacattagtaaaattatggtgatgaagtagcaagaaaaactactttatgtttggcgtgcgtgtgtgtgtcatacaacatgaggaactgtgttaaagtgtcgtagcatagaagggtaagaagcccgcagttagctgtctaggcctctgagtgtctgcagcacagtcttcctccttctgcctcttacatccgagacgacaggctcgagtgtgctactcaaggcccgct

SEQ ID NO: 31786 - DNA, 1100 bp, Mus musculus
gtagtcttcttgcctccaaccttgagtcccaggattatagggcttgctctgccatgtctggctaagctgtacttttatcacggaagggtcacactgtttctgtggcttgtcttaggtcatatttcctgttgctgttgtcctactgtatttatgcttgaaaattccatttatagccccatagcacttccacacctctgtgtgtgcacatgtatgagtgtgtgtaaaaacaatttttttttttagtttaatttctattgaccttaaagctttagataataaagatttggcactgagcacaggcgtctttccaggcagctccaagacagcacttctcaaatttgatatcttaaactgtgtgctgtgtgctcttcagcagtgtcctgcttccaccgtgcagggtggcttgtttattttctttctttcttttgagtgctgttggtcagagaagaggctgggcagccaagggcagagctacagctttctactccttttctacttcaggatggttcctatcatgaggacgtgggctatggagttagtgagggcctccgttcaaaggccttgtcactggagaaggccaggaaggaggctgtgactgatgggctgaagcgagcactcaggtgaggagggagcaccatctcatttcagctctcatttctaaggaagtggcacattcacgtgggtcagaaatctaaatagcatggaaaagatgtctcaggtcatcctgatctcatgtttccctgctctctgagggacgtggttttggtttctcccttccctcccaggaagggctcagagcttttcaggagccaagtcaccaatcagttcttagaacagttggctgaatatagcaactcagaggtttaggttggctcagctttgagagggcttagtccagtattgactagcatgcatcgtggtggagaggcaaaaataagaacaaacagaagagaccagtggtccatagtcgcagaggacagatgcccagtaacctaacccttccactaacctggagctcctaaagacgccatcagttccatactgctcactagagatgatgccctgtgagattgtgtgccatgtcactgctctgtcctcag

SEQ ID NO: 31787 - DNA, 2803 bp, Mus musculus
ggaagtagcctatatactaactactagtgctgcatttaactggttatttcttgccagaagggaatgtttttaataccattttgagccctcagaatggagaaccaccctccttctccgtttgttggagttaaaaaagaaggaatgaacagctttctggtggaggggctgcttgagactgcttttctgtttttgtacccctcagtaaggcctagaactagaagagaaccttgttaccagaaagccccaagagctcaatgtaagccaaacccgatctgtatctgtaagtgggcagagctctttaattttgacatgtgtcccaaattccttattccctcaacaatgcacaccttaagacaaaggttctctcccactctgatccctacccccactttttcccccccttttacaacctagtgaaaaataccaggggactggggttgcaaccctttcttacataggtcattaatgctttaagcaaaagatattagcagctttgactgcagcattagcaattagggaaaacaataacgttccctgcggacatgtaactttgccatcagttttgatgtggaaacactgtgatatataaatgttgttggacaacattagttttaagagaaaaatttgaaaggtttaaaaggttcacacacacacaaaagctagctctgtcctttacttattaagacactttaactttttcctttgtatttccattgtattagataaataaatgtgaatgtaaaattgtataaattactgtacttgaatacttctgttctcccagtattgcttgctggatattttagtgccttggacttctattgcttctgctgttagcatcaacttaccagaccccaggtcaccaaagggtatgtggaaagaaatcttaggtccacatgaccccagcagtggatatgccaaagggaaaatgaaagtgtttttggttttggtttggtttattattttgttttgttttgttttgttttctcagtcgtttcaattttgcctagagcaggtgtaaggtgagcacagtgaagttggcatcagtggttgaaaacaaagttctgtttcagaaagaatgaggagggttgtgagctgtgtgtgaaagataaggactgaagatgtggggacaagcttgtttgaagtgatgcttggccagtgaacaaacgagatctagaagagattaaacaaaaagaggggagtgggctagattttaagttgggaaggatgacagtgccaagtcacagatggaaaatgttgctctaaggaaacctgctcggttgcccccacctcttgttgcacaagtaccaccacactttctctgctttaagtactgtattgtgggaattcaacccacttctaactttctaagcattgtaggaaaaagtgcttatttcctttcctagctgtccaaatggttgcacagtcagaatctattgtgctgcctgtacttctatattagagctaatactctcacattttcatacccatatccccaaataacagcaaccaaccagtattatctgattttctggcaatagggacctaattggctgtttgggatctgaatattctggaaaagtggaaaaagtagaactcatttcttgggtgcttcctccttcaccttgagttgggaactgacacatttccaactttatgacacatcccaggagttgccacactagcaaggcttcttcctgtaagagtcttgttctttttaagttggtcgaggcccaaagatacaagtgagagctgaaagtttcaggagagggaagtgtaatgagcagggcttttgtttcaggtcgtgctaccaaagtgttgactcatttattccttttgggagcggtaagaggtactgtgggagtgaagcaggttacaggatgactgagtgcttcataccagcagtagagggagccaaatgcagcatgtggtgtttggtttagtcattctgagtgaggtctgttcccccttcacagaggtttacttactgttggtttccccctcctgtggatgaaataactgaagcctagagaaacgagctagtgctactgaactgtttaaattatttttgtgttaatagtacactttgagtatctttccacatttaaaaagaactttccgaattataaatgttttccttacgttatttaacaatgtacactgtttaaaactgaattcaaaccttggggtttctcagcagccgttacctgtacatttgcactaactccgggggctgcgcttctgtaagattgcgctttgtgcttcagtttgttacctttgtagacttatttaatgaaaccattcaaataaaccaaacttgcttttgttgaactgtgggttgttctttctgacaaacaaaaaacccttttgtcctcactggccctaccatttataactaaaatcgtgctgttaagggtgaaagtggcacttctccaaggagtctgttgctagtcctcaggaaaaggcaaagcaacagctgttagatggcagggaaattattgcaaactgctgtcagtcaacagcgtctgacataggtctcagtttctcaccaacagatcttgtccctgcttcaagactaggcacaggggctagaggcacttctttctcaccaagcctgtgcctggtcccagggactcaccaattccctcatagcataaccctaaattcagcttaagtagaattggaagttcattgttcctttgaaaagaatcatgaaactttgggtgtggtatagttaaagaacagttacttccttaaaacacctattcctagggagacagctaagtagtttctcatccaaata

SEQ ID NO: 31788 - DNA, 1663 bp, Mus musculus
aaatggaagatctgcttctctacccaccccactcacttttgtttgtttgactttgggttttttgtttttattgtttgttcatttcgtttttgaaaaaaggtttcactgtgtagccttagctggcttggaacttgctatatagcccaggttggacttgaacttaaggagatcttcctgcctctacctctggagtgctaggattaaagcctagccagggacatcattttttaattatacttcattctctttttcccatcaggtttcagttacaatggatgatgcccagaaagaacgtaaaaataggtcagaagatacaaagtcggttcattttgaatctagcacatcagagtcatcagttctttcaagtagtagtccagagagtaccctggtaaagccagagcctaatggaattagtatttctggcatctccttagatgtcccagacagcacccacaaagcacctaccccagaagcaaagtcagatgcaggacagcctaccaaggtgggacgttttcaggtgacaactacagccaacaaagtgggtcgtttctctgtttcaagaactgaggacaaggtcacagagctcaaaaaagagggaccagtgacctctcctcctttcagagattcagaacaaactgttattcctgctgtgataccaaagaaggagaagcctgagctggcagaaccttcccatttgaatgggccatcttcagacctggaggctgcctttctaagtaggggtacagaggatggctcaggtagtccacactctccccctcacctgtgttcaaagagccttcccgtccagaatctaagtcaaagccttagtaattcattcaactcctcatacatgagtagtgacaatgagtccgacattgaagatgaagacttaaggttagaactacgacgactacgagaaaagtaagtcattttttcatgtaaaatagtgttagtatcttacctggtattaatagcttttcaatgcagatgctaattttacaccccatttgagcagaaagtgatatacaaaagctaaaattacctgatacattattcatgggtagtcctgtactcaccagcacccatggcatttctacttttgggatctctttaacacctctatattattattttttattatggcacctttaaagaaagttgtttatgtgtatgtttatgtttatgtgttttgcctgcatatatgtatatgcatgatatgcatgcctagggtaggacaaaagtcagtatagttctctggacctagagtcacagatggttgttgactgtgatgtgggtactgcaaactgaacccaggtcctctgcaagagagaaactgctcttaactgctgaaccatctctccagctatgttaataactaacaactcttggttgtttgttagtctataacatgaatctaataatagcactacaatatataattgtggtcagttttccaactatcacttggatcacattagcatttttgcctacccttcctatgacttcaagtcatttttttctgtagtatgctatcatcaaggctaggagcttgctagaatgtgtcttgtgtaatagagaccagcaaaaatgaattgtaaaagtagaatctcacatttagcacttgactgcagatttaagaatatgctttaactcttacttcaac

SEQ ID NO: 31789 - DNA, 2502 bp, Mus musculus
cttgatcaagcaataattaatgatcaaatcaaaagtagaaaattaaaagtaataaagtcacacagaagaaggaaatgaattataatagagaatgtagttggacatgacacatgcacgtgatttcattgctcaggagacagagagaagggggatgatcaggaggtcagcctgggtggctgagtgacactttgtctccaaaaaagaaaaaatagaaaagagaaataagagaaagactgcagaccatgaaggaccaggtgtgctaaacaacctatacagtagtgtgtttctgtatttagaggtaaatttttttttcaggttagtcttatgtttgatggttttcaagattatgtactcataagctgccttactagggtaaactgctcctttactgttttactgcatgctgtttccttgggagtcttactgatgtgtagcattgttgataatccaataatggttcttcaaaaactctcttttttaatccatgtgtatatataggctaatttctttatttttgttttcctttctagttgtggcctctacatctcaggcccctggaatgaacttatctcactctgcttcatccctcagtctccagcaggctttttctgaactgaaacatggtcagatgactgaaggacccaatacagcacctccaaattttaatcacatggcgggaccaacattttctccctttttggctagcattgctggtgtccaaactgtagcagcatccacaccgtcagtatcagtccctataacaagcagtcctcttaatgacatttccacatcagtgatgcagtctgagactgcactgcccactgaaaaaggcatcgtgggagttaccactaccagcacaggtgtggtagcttcaggtggtctcaccacaatgtctgtgtctgagtcaccaacatcttccagtgcggtttcaagttctacagtacctgcagttgtcactgtgtccacaccatcccagccagttcaggcttccacatctgggagcattgcttcaagtacaggcagttttcctcctggaacattttctacaactacagctactacaatgggtagtgtggtggccccagatgctaagcctccaactgtattattgcaacaggtagcaagcaatactgctggggttgccatagtgacatcagtctctaccaccactccattcccaggcatggcttcacagccatcccttccacttagtagcagcacctctgctcctactctagctgaaacaatggtggttagtgcacactcactagacaaggcatctcacagtagtacagcaggattgggtttgtccttttgtgcgccatcctcttcctcctcctctggaacagctgtgtctacttctgtttctcagcctggtatggttcatcctttggtcatctcatcagctgtagtttctacacctggcctcccccaaccagtagtacctacttctacacctttattaccccaagtacctaatatcccacccttggtacaacctgttgttaatgtgcctgctgtacagcaaacactcattcacagtcagcctcaaccagctctgcttcccaaccagcctcacacacactgtcctgaaatggatgctgatacccaatccaaagctcctgggattgatgatataaagactctggaggaaaagctgagatctctctttagtgaacacagctcatctggaactcagcatgcttctgtctccctagagacacctttagtagtagagacgactgtcacaccgggcatcactaccactgctgtagcaccaagtaaactcatgacttccactacaagtacttgcttaccaccaaccagtttaccattaggagcagctggcatgccagttatgccagtaggcacacctgggcaggtttctaccccaggcacacacgcttcagccccagtcggcactgcaacaggagtaaaacctggaacaactcccccaaagccaactaagactgtggtaagagtcatcatacaatgactaaataaatatgattacttttctttcctctcaataattacatgttttcagctgagtcttgcaagttatgaaggtgcctggcatataaactcgtctctcagtcttaaagtgacaacagttttaggatctaagtataggtaacacaagaatgttctcttagtttggaatgtggctagatttttaggttatattgaacagttttcttagaatgtagaattatcaggtaaaataaataatggtcaagtaaaatacaggtttttccctgggtcttatgcctcatgtctattaccccaacacttgaagacagaaggtagttacaagttacaggaaagcctgggcactacaatgagttacaggccagtcttggctatagaatagggctttgtctctaaataaagaaataggaaagaaaagaaaaaaaaccaagggctcagcatttaagaacactgctctttcaaataacccaaatttggttcccagaagccatgtgcagaagacttaataac

SEQ ID NO: 31790 - DNA, 1181 bp, Mus musculus
tgactgtacactcaagtgtatactggcaatgctaagtggactcaaaggggtttgtgtgtgcatggatttgtgggagaatggataggctaggtgaaggcacatatgcatacatgaaattctcaaacagttatgtggacaaagatatttagggaggaaaacacaaaaaagtgatgttagtagtctttctcagatttaaactttcaaattaccttcatatgacttgaggatttactctatttcgcagtcagttgctgtaaaaagttactcttaggagcacaattctgtaagtcactgcttgaaagaatgcaacaggtaattaatgagaattaatcaaatttgtgtctcacttccatgtttaacgactttgacactaaatcatttgatgtataaccagtgggtgtctgaaactgtactgaatcttataatacatttcctctaggacttaatgtaccttattgtaaaaagtttccaaggaggtttcttgaacaggatcaagacaaatattaatattttcagtctacacttgaagaattcaaactactgtgttttatttagtcttgtgaaagattatgtatctctctgtgattcagttatcactagttttatttctgttacagagactgtagagatggttagaatttatgtatcaaactccctcccatctatgtgtttacagatttatatcaccacttatacatgttgctatatctccctggattccttttgggagtggattaggtttgggggtttgctttgagacaggttgtactatgtagcccttaggtggcccagaactcactatgttaattaatcaggctgtcctcaaacttaaaggagtgtgctaccatgcccggcacttggttcttaatccatatcattactgaaatggcaataaatgcgaaggccttcttctaacctatctctccaatagtgctgttttgacactttgctgaaagttttatttttgaagtatttgtttgtttttggagacagggtttctgtacacatccctgaatatactggaactcactatgtagaccaggctggccttgaactcatagagatcagcctgcctctgcctccatagtgttagaattaaaggcatgtgatatcatatccagccaaagaattttttatcaaattaaaattttaaactgttactgtactggatggttttatgt

SEQ ID NO: 31791 - DNA, 1099 bp, Mus musculus
cacttgtttttatactatgattcttatatttggtaaatgtacattttatacaaatacagaattttccccaaatacagatttttctttcctattgactaattgcatgtaccttaaaaataatatgaaaatagatgatttcccttccttaaccctggacatgtacagataaaatgcacatcagggtgcaattcctattcccagtatcttctctacagtggtaggtattgtcagagaaatttgtgcagttcttttctttctttaaaaaagatttatttattttatgtatgtgagtatactactactctcttcagacaccccagaagcaggcatgggaatcccattacagatggttgtgagccaccatgtggctgctgggaactgagctcaggacctctggaagaacagtcagtgctcttaaccactgagccatctctccagcccctgagctgttcttttcatgttaatcgccttgtggattctgttgtatatgtacctatttcaccagttacctggagacttggggcaaaaaatatatagaactgtggactctttttctgtgactactttctggaatttctcccttcccttcttaaatattttattttttgaggttataatatgattatatcatctctcttccctctttctttcctcttagccttcccatggtacctgctctcctaggctctctttcagattcattccccttctccagcttatcaattgttatgaatgtgtgtatatatacaaattcataagtatataaatacctattcagtctatataatgttacttgtagtatatgttttcagggctaactattttgtagttgataacctattggtatgctttttccagggaaagactaattttccactctaaacagtccttagttgcttataggtctttttcaagggttaagattttgtcccttcgattatagcatgtctattgatgttgtctttgtttaggtgatgtctaagcagagttgtagatgtatcagttatatctgggctctacaactctgcattttgagcagttgtgctgtaatggtctccatctgctactaagagaactttcctcattttagggtaagaac

SEQ ID NO: 31792 - DNA, 2078 bp, Mus musculus
agttctctagactggaagcccaacactggtggcatcttcctactgcagtggggtgtcgggtgggaatgggtgggcagagggcccattctcccaagtgtctgacatacgggctggtgtaaaaccagcaagatcaagcaagaagaagaaatgccccttctcctttgactctcctgccaggtaagacccggagagaataggaaggcatcaccaaaggtgacatgaatagcctttcagttacttaagagagacttggggacggactcaagcaacatagaaaggcaggaagggaaggaaatgtgtatactgcaagcctagtgcccttgtggccttgccctcctgcagagagagcccagcctcccagccctaaagaaataaggaggtgaaaccgggccctcagataaagggcagggcaaggtatgggacagacaagaacaggggcaggaaaagctggaaaatggctaagttctgagaagaagcagcctgcaaccccttctgtccacctgatggcgcgtacttagctgtactaataatcccggtcctctctggctggagacgctctgctgcagctgcttcaccagtggtgcattgaatgctgggcattaattaagctcagtctgtgaagggggatggtgagggtcagggcaccatctttctgctgtgagaaatggctggtgggtatgcagcagggccactttgcagagcgtgaccactatgctgtgaatcaagagggccgcatctggagttgcaggacccacgtggtgggctctgagtgccaggagcagagcttggcacatccaaggtggggccctctgggaacccaccgggcctttctttgaagctatccgaagggcagggccgtctgtttctgggctgcagctttttctcctgcctgctcaggccctctgccctttagaaaaggtgcacaggaagcaggctaaggctgcagcagaacagctggagcgccgggcttctctctgaaaccagaaactttgggccctgtgctcgaaggccagagccggtggctgcagccctcctgttctgtcctaaggactagaatccccctgggcctccccaccctgcttgcctcctccctcccaggtctagtgccttgtgtctgacatctgttacctccttaccatctgccttaagagagaggaaagtgccgtgggtggggagagggaggagggcattaaagtcagcatcttagaaaacaagcggctgtttccttcttgcccaatcaaggtaggaaagggttgggtggaagagccaggggtgttcctaagccattcatgtccctcagctgtctgctcaaggacacgctaaggaccatccatcccctcccttctgacttgactcctggttcagtgcttgccagcagaagggacattttctgtgctgtgcttgggaagggcacagcagtgtcccgagtctattagtctcagcagcccaggttgtggtctcaactagaaagtcccccacccccgtcctagtgaggaagacaagctagaaccgtgcagctgtaatcccagcacttgggatgctaacacagaaacgtcaggagagcatgtcagcctaggctaatagataaacataagaaaatcttttctgtgtgagttgaagatgccctactaaggcttcgcaagtgtgagttggcctccctagttatgtttgacctaggcaaaaatttttcaagaatttatgtatatgggtgttttgcctgcgtgtctgtgtgccacctgtgtgcctagtgcccagagaggccagaagagggcattagattccctggaactggcgttacaggtgtttgtaggtcaccaggtgggtgctgggatttgaacccagaacttctggcagagcagccggtgctcttaactactcggctgtctctctacttctccccccacctccccttttttcttaaatgcttttagccatgtttagtggtgcatgcctttcatctcagcactccagaggcagaggcaggtgaaactgtgggtttggggtttgaatctagcttggtctacatagtgagttccaggccaaccagaattacatggtgtgaccctgtctcaaaaaaa

SEQ ID NO: 31793 - DNA, 1118 bp, Mus musculus
gtcatactgatgccagtccctttgggtagtgggatagctgcatcacatggtcactccagttctagtttttaaaggaaccaccctgattttttctttagcgactgaactaacttacactcccaccaacgtgtcttatttgtctgtatcctctctagtggctgccactctgtcatttgacagctgtgacagtctttccagggtgaaatggtttcattttgattttatcctgatgattagtaacactgaatttttttatgtacttgttagccatttttttaaaagatttatttatttattatatgtaagtacactgtagctgccctcagacactccagaagaggacatcagatctccttatggaaggttgtgagccaccatgtggttgctgggaattgaactcagtacctatggaagagcagtccatgctcttaaccgctgagtcatctctccagctcccttgttagccacttttaaaagacttatttattttatatatgtgagtggtttgtctttatgtatgtaagtacatcgtgtatgtgcctggtgccttcagaggccagaagaggatgctagatcctctggaactggagttaaagatggttgtaagccaccatgtgggagctgggaaccaaacctaggttctggaagaacaagtgttattaaccacagagctgccatctctctagcttattttctttggtgtgtgtgtgtgtgtgtgtgtgtgtgtgtgtgtgtgtgtccctcctgtgtcctcttcctaagtgctaggattagacatatgctaccatgcctggccttttgttcttatatgtggacttgacttgtctggaactcctcactgtgagggtgaggctggcctcagactcttaacgcaaaactcctgattctgtctcccaaattctgggattacaggcatatacctgggggcgggggtggggaggggagtagagagaggtttttttgagaccaagtcttgtagatcctgcctggctgtacactttgttttctttaaaaggtatctgttctggggtagagaggtgctcagcgggtaagagcattaactgtgaaaactttaggggcctgaattcgattcccacatgaaggcctggcacgccgct

SEQ ID NO: 31794 - DNA, 1163 bp, Mus musculus
aatccagctcacaaccttctgagaggggggatttgttttgttttgttttgttttgttttgatcttttccttgttagcatatgtgcttttggcttttaagacaaggtctcatgcttgcattcaggatagcctaaaacttactatgtagaccaggttagacccaaaaaaatttgtgatgttcctcctgtctctaccttccaagtgctgtgattacaggcatataccccccatgctgtctgtcagtcttgatgtaaataacaaaaaaactaggggtaactgaggtaggatagcttatccaggtcacccaacaaatgactcccactccccctccatatgtcacatgtgtaactgtctgctgtttgttttccgggaagagttgaacattcctgaagtgaagaatggttgttattgttattagcaggtttggaggatggccttctagaagaatcccagtatgaagacgtaccagaggaaatccccacctctcaagaccagaatactgggatacaagggagaaaacagaagactatttccaccccggggctgggtgtcactgactaccacctgcggaagctcttggctcgctcacagagtggccctgtagcgcctctttccaaacagaactctacaactgcctttccaaccaggacaagcaacatcccagtccagcggccagagaaaagccctgtgcccagccgagatttgtctcattctgaccagggggcccggaggaacctgcctctcatccagagagccaggcccactggtgacagacctgggaagactcttgagcagtcccagtggctgaatcaagtggaatccttcattgctgagcagagaaggggagacaggatagagcctccaacccccagcaggggctggcgtcctgaggaggacgtggtgatagcggcggaccaggaaggagaagtggaggaggaggaagagggggaagatgaggaagaagatatgagtgaggtgttcgaatatgtgcctatgtttgacccagtggtgaactggggccagaccttcagcgctcagaacctcgacttccaagccctgagaaccgactggatcgacctgaactgtaacacatcgggcaacctgctgcttccggagcaggaggccctggaggtcacacgggtcttcctgagaaagctcagccag

SEQ ID NO: 31795 - DNA, 1196 bp, Mus musculus
tggcttctggctctgtgtagcttaaatgtgtgtcatagtggagaataactagcctttgtacggtgccatttatgcctttatctggtaggttttatttttccttttataggttaagtaaactgaggctgagaaagggtaggtctcaggattcacagtcatggtcagtacattctacctgacttgagatcctaattgctctggaggactgccttcctgaggtggcttgtgttgggactcaactggagaggtcttttccattgttcttttgagggtttgtcttttctttctggaactctagtaacttccctgagtcacttgactttcttgcttttttgttttgttttgctttgttttgttcttttgagacagggtttcatgtagcccagactggcttccagtttgcaatgtagccaacaagggtgacctgatcctctcgcctttatgtccagagtaccaggattagagagaggcattgtgttgattcattgtgctgaagattcaacttggggccactaagccagaatcctaccaacctcagcctgccttttttgttgttgttgttattgctgtatattgttatgtgttttaagacaggatctcactctgtagcctagactggcctggaacgcttgctgtatcctgcctgttctcccatttgtagtaatcctcttgccacagcaagtgagatcccaggtctgagcccccacccctggctcatcctgactttttgaagtagatttcagtgtagttgaccaatgccctgctctgctccccaaatgcacctgcagaattaagaaagttaaagattttttttttttatagatttatttatttattatatgtaagtacactgtagctgtcttcagacactccagaagagggcgtcagatctcgttacggatggttgtgagccaccatgtggttgctgggatttgaacttcggaccttcggaagagcagtcgggtgctcttacccactgagccatctcaccagcccaaagttaaagatcttactgtaggcttccagcaagcagtaggtaaagtgcaatacctgtgaacttgcttctatttttggcacaggaagcactccctgggattccaggcccttgcgcagggccacggggcacagctgtacctgctgtatacgacggggatggccctcttcccagggttccccctgccgagcagagcagtgtg

SEQ ID NO: 31796 - DNA, 1185 bp, Mus musculus
cccatcatcaggcatgggtgtcctgcacatagctgtgcacagaggcaaaatacccgtacacattaaaaacaaacaaacaaaaaaagtccaaaggcttgccgttccgagccaagcctggttgtgcttgcctgtgatcccagcacccaggaggctaaggtaagaagattatgagttaggggtcagcatgggctacacatatagtagaaatgtttcagaaaaaaagagggaaaagctacatttggttctggttctgctctaacagctatccataccctcattcactcaactttattagtttatttagaggtgtgtgtgggtctcagaatttttcttggtggcttcaaagttctgggctcaagccaaactcgtgttttagtgacccaagtacttaggactacaggtctgccacacatagtgtgtgcacataaaagtttattactctggatacaaatagatgctgggatcgtagctcagtggtcagccccgagttgatctctagcactgcagacaacaaaaaatcctccagacagcggagtcttggggtgggggtcagaatctgggaagagagctgggaatttgaagagatgcaaaaaaaaaaaagttatgaaggaacttcgtctgattcataagcacgggggtggatacccagatataaccttgccagccatctctctgttccttctaatatctttactttcaaatgtaattgaaagtctgaggaagtttacaggttggagaaagtggtctggttaggtcaggaggagaaacctaagaagaaaacgtagggggctggagagatggctcatcgggtaagaacactggctgtttttccagagtatccaggttcagtaactaacacgcacctggcaactcaaaactgtctgtaactccagtttaggggctctgacactctcatacagacatacattcaagcaaaacaccaatgcacacaaaataaaaaaaaaaaagaaaatattttaaaaaaataagtaaattagcaggcagggtgctaaggactaggtagagctgtaataagagtccaccccgggcttgatatatgacctcatggccctgtgggggcagaaacctttctagtcccagtttccagagggtgaaagactgaagctcacagaggtccctcaccttattcaaggtgtcatagtgaatcacgtgcgcagtcaggtg

SEQ ID NO: 31797 - DNA, 1149 bp, Mus musculus
gagttggttatctccaccatgtgggtcctgaggattgagtttaggtcattggtcttggtggcagatgtccttgcctgctgagccaggccattggctcctaaactggggcctttaatagcggcttttacctcatgtcattgcagtggattctggagtcttgtttcaagcagcaactaagacaggactgatatttagaactgattaaaaaaataaaaaataaaaataaaggaaaagacaaagacctggcctggtaatgcatacctgttattctagcttctagggaaactgaggcagaaaaagtataagttttaaggcttgcctgggtacaaaatgagttcaaggccaaccctgataacttaaggagaccctgtaccaaaataaaggctgaaaagaaaagaaaagaaggggagaaaagaaaggaggctctagatgtagctcagtggttaatcactcgcttggcatcctgtgtgaggccctaggctcactctctagtactgtcccctccctccccacagagaaggatgaaaggggtgggcagaaaaaacacaacccttttctcttttgagaacatagtagatctgggcagcagcagtgtgactttcagtcttgttctgatgtgaactggctgtccgtctttcggtggagtcagccctgctcttccatgtctgaggctcagtctttctttgtcagcacagagccccaactgtgagtcctggtcttatctaaccctgacattgtcctcagaggagtggtatttgcctcagctttcagtatcctgagctgaatgtggccagagaaaagtgagcaaaaaagaaactagggaagatgactgggttcaaatccaggctccttagaatcactcgctgtgtaaactcacctcacccaggtgagatgggaggctgggcggagacacgctctatccctgagatggccgctgtcttcacctcccccttcccactggagaaggaaaggttgacccggcaggtggggtttatggggaaggctaaggttggatgttgatgtggggctggctcttcagctgaagaggctcggtgacttttagggggcatctccctaagccttagtcaccgttgtcttcaatctccaagtcctcccctacacttctgggctatagactggactggaccc

SEQ ID NO: 31798 - DNA, 1146 bp, Mus musculus
tctctctctctttttttcaactctctaggcaaccatgaacaacacccatggagatcaggacctggccatgctgtgtgaagtccgtgacagcaacaggagagctcataagatacagggggaactgaagaacctcaagtctaaagtgtttgggctggagaatgcgcttaggctgtgctgatgactcctttcagggttggcttctggagacctgagacaaggtcacctgtgcccacaaagtggacctggagttgtccagagtagtggcatcaattttaataaagatggtgttaagggcatgatagctcacacctataatcccagggcttgggaatctgaggcaggaggattgccacaaacccatggtacaggcaggtggatctctctgattcatggccagcctgatctacaatagtgacttctaggccatccaaggctatttaatgaaaccctgtctacaaacaaacaaacaaacaaaaacaaaaataaaacatcaaaaccagagaggaaagaaggaaaacagtggcaaacctggctctggcacagctgccctggctgactgcagtctcaccatcctgctagccttgtcttttatatactgataggcttttctgactttaaaaagtcagtgatggggatgtagcttatctggtgaagtgctgtcgagcatacagaaagccctggtcctgctagctcccctaaagccaggtttggtggctcacctgtagtcagcactggagagagcccatgtgggagaatctaagttcacattcacccttggctatatggtgagttccaggccagcctgggctacacaagaccacgtctaaaaatgaaaacaagaaacaaacaaacatacaaaaaagaaaataataacttaggaagagccgttttgctgagcttgctaagtgtcagtgggagaatgtgtttcctggagaccaaagtcattcactgaagtcattcactcaggaattacatacacatggaaagtcacagacttagctgcgttccgagttactgaccaccagggggcagcatagcccttgctctcaagtaaaattggtcatcaagaaaagggtgctactttatgtacagtgggccaaactgtacaaaatgatattttatgtgaaaaagtttgacattttatcc

SEQ ID NO: 31799 - DNA, 1220 bp, Mus musculus
gatagaacactcatgtatgtaaataataaatccttttaaaggggactatagaaagaaattagttagcaggtaacatgctaagattttcagatgtctgaatatcttgtgctattctggtgagactgtaggagaatagaattgacactatacctgagctatttctagcacttcctcttttagttttttagtagtaacactggggatcaaacccaaggccttgtacatactaggcaaatactacattgtcaaacaaaatctgctgcttatttatgtttcattttttttttttacattttcagaatctgctggatgatgtagaagaatttcatgaacgtgcccaggaggccatgatggatgaaaccccagattcttccaaactccaaatgttaatagacatgggctctagtctctatgtggagctacctgaattgccccgactaaagcaagagctccagcaggctcgatggctggatgaagtaaggctaactctatcagatccacaacaagtcactttggatgtcatgaagaaattgattgactctggcgtaggcttggcacctcaccatgctgtagaaaaagcaatggccgaactacaggaactccttacagtctctgaacgatgggaagagaaggctaaggtctgcctgcaagcaaggtaaacatatttttccctttaataacttaagtgaaggggtaggtagagagatggctcaatgtttagagcactgctagttcttccaggtactaaggttcaagtttcagcacaagtggcacataactatttgtaacttcaatcctagaggatctgataccctcttttagcctctatcactccgggcacacacatggtacatagacaaatatacaagagaaagcacccatcctgagtaaaagagtagatgaggtggaggaacataaagcccatttcattaactttcattatttgtcttgtgccttttgaccaatgactagtaatcaaatgtggctacatgtagagagtttcagatatgtccagactgttgtgtagaggatgttgttaagtaattccctgaaatgatgggaaatagtattgtttcaagtccatgctatcaatacaattgcaaaatcagagttacaaaatgctcattaaaggggaagactgccagttcagcagctaagaacaatggctccatatcagaggatccctggtttgattcttagcacccatgtggtggctgaca

SEQ ID NO: 31800 - DNA, 3093 bp, Mus musculus
tgttgtttccaaagatgaatggacttcagaaaaagtcctcttagtgctggcttcctctctgcatggattgtgtgggctccattctcttatcatctgtgcagaggatgtcttctttggtgcagcagccaagtatttcaactcttgattcgttgagtgtggtttgctgaattaaggtcaggttctaatggaactctcaggaggctgtttggcattaatacattgatgtgcttagtggggcatataagaagtggctttcgaccaactgatacttgttgtagacggttacaacctacaggtggtgccattggaaggccctgaccgtttaaatatccttagttaggataattggacaggagtcagagcacaactttgtaattactgacatttatgccctactgatccagttaagagaagcaggccaaagttatcccttctagaagtcttggagtggcagtgcagtctatgacctcagctgcttgtgtttatttagaccaataagaaaatcctccaaaagatcccctcactttcctcaggaggatgtcaagcaggttagaatatctgattagactggattctgggaagaaggggttttttttttgtttgtttgtttggtttggtttggttttttcttacttcaaggcaagtaggccattggtttgagaagtccatctgggtctgtgttttagaaaagaaaggtaggtacacagatccaggtttctggagggagtagggatgactaatgagaatgttttactgagcctcggtgatgcatgcttatctgggaaaccctcattcacaagtattccagactccaccatgcttcacgcatggccatgagcaagactggcagataacagcttttgccttgcagccctaaccccaatgcctgtagtttccaacatggcctcagcagatatttgtgaataacaccatggcttcatcagaggatgtggggctgtaggtcctctgggtgtgaagctgttctagtaaacccatttttaaaaagaaagacttgtttttacttttttctaaatgtctctgactactgactgttctatagattatttttccttttttgatatacatatatgaatatagatatatatatatatatttactgttaccagcagcgtatgatagagtttgagcatcagaaatccatttggaagcttgcattttctttctgctttttgataaagaaatcccattccttccttgtagtacaaggagttagcacttccttcttcattctcacctaaacatatcttccacttttcttctattcaaatagataatatatttcctccatgttgggacttgtccctgtctgttgggcagcttggtcttattctagtcagtgctgaatgttttgtatgtctgaaactatggtgctgtgccccccccccctgcccctattgggttctgtgttcttacaaaggtcttaggtggactctgtaaactcctgctagaaggagaataatatattttaaaggacaaaaaggttttctaaaaatggtgtttatcttcactatcctttgttctttattttggtttaagaatctgcaatttaacttaaactcatcacttgtcctgttaaaggggcattgagcaaacctaggaagtttgtagcctctgttcccctttactccagtctcttaaataaatgtcttctagtaactagaagtgagatgtactgtccagttacagactgtgtgggtatgagggctacctcaaaaggcatcttaggaaaagaaaaggttttcttacaaaaccctttatcccaagtgctaaccaggcttggccctgcttagcttccaaggtcagaggagacatacacgtgcaggtggtacggctataggtacaacatccaatttctgaaaatactttctctggtttatactacctactttttggtctcttcacttaatgttaagtaacatatcttgaccagttatgttgtttgaatgtgttgctgtgcttgtatcttgaatttccatctcaatgtgagtgtgagctaagatttcagtaatggttacaaggttaattaagtaaatagttaatttcacacattttcattttgccaaacatgaagattatcacgtaagaattttatttggttattgttataatgaaaaaaagcacaatatttcttaacttttagtctttgtaaaagacttgagatacttgtggtttaaaattgagtgtacaccaacccttcagaaatttacaatgtaagtgatagaatcccagaatacattttacaattttgattttccttccagttaactacttttcattaactgtgttatcaatagtaaggagtcatgaggatactgaaaggtgactgttttgagtaatttgtgttctttgtacagtgtttgtctgttggagacctcagacataggcagtctgtacctgtgaatagctgcctgtcatcttctgatgttttgaaacttttaaatatataatttaattgattcattcggctcttctgtacttatttgaagactttgatatcttaaccatagatttagacaaaaactcaaaagaccataagggagggggtggaaagatgactcaacggttaagaatcctggctgctcttccagaggacccaggttcagttctcagcactacatggtggctcacagccatctgtaatgtcctcttctggacgttactgcactgtacacatgtggcatacagacatctattctggaaaatactcaaaacacaaatacaagtaattaaaatctttttttaaaaaattaaggatataagagaaactagcactctacccacaaattaaaaaccctatagtttgtgagttaatgaaataaagagtcatctatttaaggaaaagtagatgttctaatgtaaagctttgtttcacaagaattgcaagtaactccattcttctgtactgtttgtttacattttgtattaaaacttgatttatgtttctttctgactcctcaaagttgcacttcttcgttattaagtgtttaatattttttaagctatttctcactgccttcattatactttaacaaaggtaacggaatgaaaaaagttggaagtctgcctggtgtt

SEQ ID NO: 31801 - DNA, 1985 bp, Mus musculus
atgctctcggtgctgcagcagagcctgagtggacagcccctggagagctggccgaggccagaggtggtcctcgagggctgcacaccctctgaggaggagcagcggcagtcggtgcagtcggaccagggctacatctccaggagctccccgcagccccccgagtggctcacggaggaggaagagctagaactgggtgagcccgttgagtctctctctcctgaggaactacggagcctgaggaagctccagaggcagcttttcttctgggagctcgagaagaaccctggctggaacagcttggagccacggagacccaccccagaagagcagaatccctcctaggcctcctgagcctgctacttaagagggtgtatattgtactctgtgtgtgcgtgcgtgtgtgtgtgtgtgtgtgtgtgtgtgtgcgtgtgtgtgtgtgtgtgtgtgtgtgtgtgtgtgtagtgcccggcttagaaatgtgaacatctgaatctgacatagtgttgtatacctgaagtcccagcacttgggaactgagacttgatgatctcctgaagccaggtgttcagggccagtgtgaaaacatagcaagacctcagagaaatcaatgcagacatcttggtactgatccctaaacacacccctttccctgataacccgacatgagcatctggtcatcattgcacaagaatccacagcccgttcccagagctcatagccaagtgtgttgctcattccttgaatatttattctgtacctactattcatcagacatttggaattcaaaaacaagttacatgacacagccttagccactaagaagcttaaaattcggtaaggatgtaaaattagccaggatgaatagagggctgctgccctggctgcagaagaacccgagagagcctgcgggtggcgtctgggcaagaggggagtggcctgtggattgagtattaggaaggagccagagctcagggtggagagagctctgtggggctagggtgggagcagctggggactcctctcatgagtggatctgttgccctacgggggaggaaacttcatgccaaatatacccagaagtcttctcagatcagttctttagaaagagctggtatagaaatgggtgatgtaaaacttgagaagcaggaagaggcgtgtgaaatcctgtgctctctcaagtgctggctgccagtccgtgggagggctgcggcatgtgattcttcatgggctgcagccaccagatccctggagagctctacctcggggtacagtgagggagttgagaaagatgtgagggtagtgggcatgggggcgtggcataacaggagaactcgggaggccctcaaggtcagaggaaagtatgtcactgtataactacagtaagagaggttgtttaaagtagctccagggcgccctcatggggcagacagcagccttgtggcgtaggttctagagaatgcacaggtcttcctagacttaggtgagaaaaggaccatgaaatgctgtgggaagcacgaattcagtgattgtgtgtgtgcatatgtgtgtgcagtaatgaagacttaataaagttgctgtattggtaagaactcatagttgttattgaatcacctcttaccataggtcagacacgtcttgcctagcattagcaagccctgaggttccaagtctcactgtgtggcctgtattcaaccctgcagcagccaagtgagaaagagaaagcccctcccacccatcagcctttcccagctctatttcttcagaaattcaggcagcaagggcccttggatctagacaccagtcaagcctatggcatctgccaccctagtttcagatacgaacttaaacgtaagttctcccagcagcaaatcagccccacatcagcccagaactgctctctaccatgtctgactccacgtagggctcccagccctcagcttctagctgctgtcattagatcatatcagtacattagttcttctgct

SEQ ID NO: 31802 - DNA, 1301 bp, Mus musculus
ttcttctttgccctctggtattgctgccctgccagtgataaccctatgtctgatgtctacggtgccaacctattccatcagtacctgcaaatggccaatcgtggagaggaggaacagcagactggtgggcaacagaagcagcggccttcagcaacccagagttgtgcttccatcctggtatgcactggcatatacagttctcaggacccaggctcccaagtgcctcctcctggaaggagagagcttccattccacggacaccgagacttcagcttcagtccagggctcctagaagcctcccacattgttcatgatgtaaacgaagctgtgcagctggttttccaccaggagggttgggcttgaggggacggagatgtagcagaggcagagggggctgttggagcatgcgctcagggaatcctgtgtgcccggctgtggtctgggtcacaggcatcaagtccaagcctggcttcttgccattacttcctgggacagagaagactgtagcttcagtagctacagaaagcccttggggcagcatctcaggagaagggatggatttctgggcccttcctgtgcgtctcttgcagtctgacctcatgctggtccctttacctctgtgcctcagtgtcaggtcctctcagtgaggaccttctttttccagacagcgtctcactattgtagttcccgctgtcctggaactcactatgtagcccaggttgtcctgaaactcagatctgcctgcctctgcctccccagtgctggcatcaaaggtgggtgccatcacacctgcctcagtcaggactttaaaaaccgcacagtgcaacgttatgtggaaacttgtggagggagagcctttggtcacactgaaggaagcgctgtgccatgccagggaggggtgtggctggcactctccatagtgtttactgtattttagagtgctgcccagagacttgggggcttttttttttttttttaattaaaaactatcctaatatttgttacattgtgtcttgtgaggatttgtgtggaatgtgctagaagccctgtgaggggaggtttgggagagtggtacatagggtactcttcgtgagttgaagggtttgtggcatttcattccctaaatatggcgggcatcacctcctcctgctgtccgtcctcccattcccaggtggggctctgtcagcactatttacattgcgtccctaaagaggagtcctactccagcttccccttggctcttccccagccttggcatttgtcaaatttcctgctgctatagtttagatgttgactgcctt

SEQ ID NO: 31803 - DNA, 1170 bp, Mus musculus
ggacagcgggaactacaatagtgagacgctgtctggaaaaagaaggtcctcactgagaggacctgacactgaggcacagaggtaaagggaccagcatgaggtcagactgcaagagacgcacaggaagggcccagaaatccatcccttctcctgagatgctgccccaagggctttctgtagctactgaagctacagtcttctctgtcccaggaagtaatggcaagaagccaggcttggacttgatgcctgtgacccagaccacagccgggcacacaggattccctgagcgcatgctccaacagccccctctgcctctgctacatctccgtcccctcaagcccaaccctcctggtggaaaaccagctgcacagcttcgtttacatcatgaacaatgtgggaggcttctaggagccctggactgaagctgaagtctcggtgtccgtggaatggaagctctctccttccaggaggaggcacttgggagcctgggtcctgagaactgtatatgccagtgcataccaggatggaagcacaactctgggttgctgaaggccgctgcttctgttgcccaccagtctgctgttcctcctctccacgattggccatttgcaggtactgatggaataggttggcaccgtagacatcagacatagggttatcactggcagggcagcaataccagagggcaaagaagaaaaaaaccttagtttagtgtttcgaagctatcagaacagcctggaggtggtgtgactcagcttcggggaagcctgggtggtgtgggcagagggaaagaaaagcagctatgataatggagaggcaatggacttaccctatagcatacagcttcctgatgggggcggcccagccccgcctctcagcctgctgcctgatcacgtcctctgcatactggtaagtaaggatgctgggtttgcccatcagaccctcgtatttcagctcattgcctgttattttccggtagatggtttccaggcaaagcagaaaggtgccatgaccaaacctgcccaagaagagatctcagcaacttagccttgaggccatctgccactctctaagctgtctccaagcaaccgacctgtatccctcccctagagtcattcacatgaagaaactgaggcaagagcaggcagtttccccagggtagcaaaacta

SEQ ID NO: 31804 - DNA, 1153 bp, Mus musculus
agattaaagttgtgtgccaccactgcccagctaatttgtggtaaatttttaagaaatgttagtagtttcttggttgattgtatgatcacttaagattgttaaaactgtacaaaatactttggatggctggagagatggcttcgcagttaagaacagctgatactcttacagacctaggtttgagtcccagcatccacatggtagctcacacccatctgtaaattcaattcctgataaatcaagtgccttctttaggcatccacaagcttgtatcaggtatgcacatgcatacatgctggcaaaacactcatacacataaaataaataaataagcaattagagtacttggtggttagctataagatggagtgctccgacagttctgtgtaagtattggggtgggacctcaggtaccactagggtaggacagtttttgcctttgtagagttctctgctgagtgttcagtcatgacaatcaaaataggtcctccctcttttaattttaactttattttttaaatatttgtttttgatacagggcctctatatagccctggctgtcctagactcactgtgtagaccaggctggcctatgactcacagagagccaactccttctgtctcccgagtgctgggagtaaagggctgggcccggctcacactttattttttactttttacttttatttaggtatgtatatatgtctgtgtacatgccacatgtattcagggacctgctgaggccaaaagagggcattggatcctttggagctggagttgcaggtgtttgtgactggcgtgggtgctgggcgttgaactcgagtcctttgcaggaacagcaaatgttttcaaccactgagttctctctgtacccccttactttgctttattttgaggcagaggcctcactctgtagcctggactagccttgatcttttttgggaaaaagatctcatgtagtaatcactgacttctgatttgtggctagatcagtagccgaggtgactctgagctatctagcatcccgtctcacctctcaagtggtcatgctatcacgtaggtgcatgctatcgtgccaggccttagtttttatttgtttattttgtattgctagggttgggatttaaggccttattcatgctaggctagcact

SEQ ID NO: 31805 - DNA, 1194 bp, Mus musculus
gtgaggcattctctctgctttaacattttatagttgggaagaaatttccgcagggtttggttagtggaggagatagatggttgtcctcttgtgtctttttttttttttttttttttaagtgtgtgtttgggaatgtgtgctttttgaaaccaagaggaacccttaggaacactgtccacctctccttagcctggagttatgttttagtctaggacagtggttctcagccttcctaatgctgtaactctttaataaagttccccatattgtggtgactcccaaccactaaaattattttgttgctacttcataactaattttgttactgttgtgaatcgtgatataaatatctgatatacagactatctaatatggcacccctgtggaagggttgtttgaccctcaaaggatcataacctacaggctggtttatcctcctgtttctgcctcccacactacatggcttgcagacaggtagatccaaattgaagtcctaaagtttgcttagaaaatcagttaaccaactgagtcatcagctcagcccccacctttttgttttgtttgatttgtctctggatgtcctagaactaactctgtagaccaggctggctctgaaatcagagattcacctacctttgcatcccaagtgctggaattacaggcatgtaccaccaccctgggccccttattctattttaaaaattttttgttgtcttgttgtagtgaatttgtaatatattctggaaagtccacatgtatccattcatacaaaggatgtagagataatttaagtctagctcagttgtacagatgaggtacattgctcagagtgttgtgctgaattgtgattgaaacatgagaatcaagcctcaaagtcagtagatagcctgagttagcatttgcttttcatacacacggttttctgtgtttctggttaaccgtttttattttaaagccagtttgtaaatcaggtgtgtgtgtgtgtgtgtgtgtgtgtgtgtgtgtgtgtgtgtgtatctgcattgataaagcatgacatggcactttagtggaagtcaggagacagtgggggaagggtctgttcttaggttatcaggtttgccctgtaagcatttttttctcactgaaccatctagctggcctctccctttattggagacccaagtctctgtagtcagtgaccatacacttaac

SEQ ID NO: 31806 - DNA, 1155 bp, Mus musculus
gtaggcactgcgcacatgcagtacatagtcacatatgcagaacacgcaagcatatagtttatggtttttttaatgtcattaagccgaagatgacctttaacttttggtctttctgtctctacttccaaaatgttaggatttgttgaatggaccactgggcctaatctatgcatgctaggcaagcactccaccaattctgctacatccccagtcccgatcttgtgttattgaaattcttcgttacaaaatgttttctttttgataaaattccaacagaatgtattctttttttttttttttttgcattaggtttcatagagtggaaatgtaggatctttcagtctttaaagactagaattgtggatattttcttttgaaaaggaacttaatctctactcatgagcatggttggaacactatgttggtgtcctggagctctacctagtaccctctacactgtgctagtctggctccattccttcttgggctctataaactttaacatttagagattcttgacttcatgtgctgatggaaaggagttgaacatagcattgtgggctcagacagtgcaggcctgtgtagcatactgacacttagagcagggtgtgagaggtcagaagcatcaggttgtagcccaggcctttttttgtttgtttgtttgtttgttttgtttttttaaaacaaaatgttaatcttcatccacatgcattctgccttataaatcttcttttttctttttgttcttttgagacagaggcaagtcttaagctcacagagatcaggttgtccctgcctcgtagtatgttggaatttcaagactatcactctactgggctggctacatagtccttaaagttagctgaatagctatcacacattgaccaataaacaaaaatgaatgtatgccagacacagtatatacacaacacacacacacacacacacacacacacacacacacacacacacacacacagctaaaaataaaataaatcctggaaataataaaacaccaccagatgtggtggtgcacgcctttaatcctagcacttagaaggcagaggcaggcgggtttctgggtttgaggccagcctggtctacagattgagttccaagacagccagggctacacagagaaaccctgtattgaaa

SEQ ID NO: 31807 - DNA, 1129 bp, Mus musculus
cccacacaggagcagagctgacccagatcctacaccatccttgatcctatgtacatcagaaggattttagctctaaaaaaagttaatgcaacaaacagaatctattattctttttaggtgtttttgtttactacttttctgtctctaatgaactcaaagcattattgtgattgattggtaattatgcaaatctatgatctttgtccttatttggaattagaagaaagatttcctattgagtaagattaaagaaaatttgtacaatgaacaggagcatcccagcaggcaagagaaaatatcagtgttgtttaagagaagggatttaggaatatcctatctttagagtgtctatatagtcaaatggttttgttaagcaggcaggactttagaaataagcagttaagaatacttttctgcaagtgtgctaaaagcacctctttgtgttactttccattgcccagtggtgtgggctgtcccttgctcagcctgagttcttccccagtagccactgcatggtggaaagatttgttctctggggcagggaaagtggggggacattgattcgggcttttcactaatgagctgtgacgacagctgcaagaggggcaaatcctgttactctcttcacctactctctgaggctgcagagtggatgggaacaaggttcccctctctctgccgatctgctgccttttctgctgttgcctttcccttcctcttctgcccctgagcatcttggcaaaggtcacatttcggtgctcacagttcattgcacacagtgaaagggagatacaaaagagtaggagagaaagtgagaaaagcaaccaaaaaaaaaaaaggttggggtggagatttttaggaggctctctcccttgctgccttagtcttacgacttaagctccaggttgaaaccttaaagctttgaataacctggatttccaagtagttttttgtaagcaacttattagagcatgaacatgatgggctgtgagttaaagagaatttcaatttctgttctgaaacttgtaaattttgaagatcgttttatccctagtgtttgctcagactgtcattgtaaggatgacctgtaatatttatagtatgtgtcagagaccatacttagcaatat

SEQ ID NO: 31808 - DNA, 1235 bp, Mus musculus
ggattttataaaatgataatataatacataattcttcaatgaaagggtttcaagttcttttataaactgtcaacctattagtttcctttccctatcttctgttttatattaatgcatttatatatttggggccatttgatttaggcctcagacattccacagctacttggaagatatcattaactaccgttgggagcttgaagaaggaaagcccaatcctctgagagaagctagtttccaagaccttcctctgcgtactcgagtagagatcctgcatcgcctctgtgattaccggcttgatgcagatgatgtctttgatcttctcaaggtacctgtctagcaagctcttttttctagagagtaaaaagccagcattttgagtgtgaaaaccggaaattattgagaagcaagaggttagcttgttctcagcagtcttcatgcccgtaatcaataatgacctacatacatagccagtggccaaaggactgccagccatgctgggatatggctttaaaatttgttccttttaatttcctgagccatggttcaaataggagaacctttttgtaggtccttgtaggtcttcacgtaaaacaactgttgcaggattttccctgtccaatcacattagggcagtgggaggcttgtggttgaagggaggcagagtgaggagttgagagagacagagtggggggtgggggtgggggtgggggtctcaggaagaaagagagaaccagaatggtgttatcaaaaggttagaataattgggttaaagctctatcattagtatttggctctgaaattattgtattggcatcttgtaaattttgttattattgatacataaatttgattggctaattaaacattaagagtcttgattctaccaaataattaggtgtcgagatggctaaccagggatgcatgaggtgttgtgtgaaagggagaagaactcgggggtggggggtgggggggttgggggtggggagcatctgagagatggcctggtgggagccatgtggcctcgaagggctggaacgttggcgggccaagagactgcgtgagtgagatcaccttgcacaggggctagctctagagagttgttggtggcagcaggagtgcaggagcatggcctggccccgctgagagttggcacgttcattttttaatatttcccacaacaaacaatagtgaattttttttctgtaattaacaaactccagagacttgaaact

SEQ ID NO: 31809 - DNA, 1044 bp, Mus musculus
cttcctggcagtctggaacatgggctatctcttggcctctttctaatgtgactataacaacacaggagagacccagattttttatcttttgatagcttagatgtgcacagtgttctgcctacaaaagagtgtacagacccccaaatgattacacctttcagagactcactgtgtctagcagaggtttgtctcagccttgacccagttcatctaactgcatgctctatccattgatgttgtcatttcagctatcaagttattgttttgttctcccttgccagcagagcctttgcctggacatgaagagaaagcagcaagcatttgttcttcagagggggtatacctcaaacagctacctcacccagcacctcccttgcaagccagctgtaccaggcaaagctcaccacaagaaagggaaacagaggactcccaactcaaaagtgatgcttcagactctgcagacacttataagacatcaaagaacaagaacacctggcctttggacaatagctacagcagcccagctgtgcaaggctgtttgagggacctctccatagtggcagagacggggaatctacctgaaaatggggtcgttggtgaagcatctccctgtaggtcagaggggaagggccttgatggtagtggttcagaaaagccactctgccccaggggtaaaacattgcaagaagccgtgccatgtacaggaccgaatgcaactacacctccttgcacagatcccagtttgatggcagccactgtgaaccagttttctcccttatacatgcctggcatagaatactctaactcagctacacagtaccctatgagtccaagtttgcaaggtttggcctctatgatgggaggaaagtcctcaggatcacaacctcagtcctttcctcccaggggtttccaggctaatggtccccaccctggactctttcctcggtaccgtcctcagcagggaatgagatattcctaccagccgccttctcagccttcctaccacccctatcagcggactccttattatacatgtccacaggg

SEQ ID NO: 31810 - DNA, 5101 bp, Mus musculus
aaacttagccagagcaatggacctggagttcttgctggcttctccaaatcccaagactcttgttcagggaaaaatcactttaaacttgggtggagggtacatgtaaggctggagtggtgcttttaaactttcatgagcagctaatctcaggtatatatttggggaagggactacttgtagtattaatgtttttggagctgggtccagtttacagaagtttcatgttgcctttttttaattttttttttttttttgtggtgaatgtattgtatatatagtgggacagtcaggtgggcacatggaggagttgggattccttccccgatatggccagcatactatactggacgagtctctgtctttgtgcagtcaggtcacactgaatgcctgaggaacttggagaagagacccagaagactgcagcttatatatgtcactaacttgtttcctctccagccgacctccgagacaagatgtcctcctcagcattcatttcacagttggttggacggtgctgtcaatgtggctttactgggtgtcgcagccataggacaggctgctcttactctggtggcctaagttctggacttgggaaagcatgtcccttcctgcttttccaccagctctaccagatagttgtaagccaggaatttggactctagagtgttttattagaagataaagtggcttctccatgggcctgtcaggcctgtgatctagaaggcatcatacagtgctttctagcacaaatcacattttgtgaaagtgactactcaggtttgttatgtatgttagtctcaataaagaaattgcacaggtttgaataaggaaagtatatcctatagatttaaatttgaaattaggactatttcagtatgtgtagtttttatccagcttacgtgaatcatagtagactcagtcatgttgatttaaagtagctgccaagggctagttcttggggattatttgttgtgtctgtgataggaaacaattttacagtattaaatcccgttactatggatttagaagtgaattacactggattctccctgtttagccttctgtattttattttagctgagatgtcaccaaagttaggatctatgtttaaatttttgaatatcccatacagaataaaccaagggaaataccctggagtttcaagtctttgtaaaggaatatgatttttaagtatgctttggggtaatagagatttccattaaaatactaatctgccctagtatcttatagtataggtgtgaggaggggtcaatggagttttccctccagttccagtgtcctcaggaaatgcagactagtctaggaggattgcagggaaaacaattggacacacccaggctgtagagatagctggaccctaggacacttgctctcttgataaaagtggctgcttactaacctgctggtgttgctgaggacccagagagtgtttcccaggttatggcgcacacacacgagagttttctttcctgtttaatttgtgtttgcaagtctcttgaatcagaagccagacatctgcaatccagtttagaagagcagcgaagtcagaattgtgctgttgagctgtataacttaacctaatcaactgctgcaagatttgtgtccaccactaacagtgggggcctgtaaatctcactaggactgcagcaacaatctggccccacagtgtcaaggtgctaaaactagaggttgctaagctgcttccacctcccatctcaccccctttacctgttcctaaagaagtgctatgaacaaaactgtggagagaggaaagttcctttatcccttcctggtttatggaggaaattaaataggaaattgaattactacattaagttctaacactgtaagaagagcctgttgtgtcctgtgtgtgaatttggtggtgtctaggcttacagaacctagtacttcctctcctggtctggccccaacttttattggtctttcaggtgctaggtttcctggagcagccagaacacagtgctgagcctctgtgatcacacccctcactctctcaaatgcagacaagatcattggttttttacctttctgcttccagcacttctcttccaggtatcttacacagatggcaatattttaaaagcagatgcaaataattctgtttgcagtcttcagtagggaaagagtggttttggaagatggaatacttaggaagcagtatataaggatatcttaaaagattcacttttaggctaggagctgcatcttttggtcactgtgaccttgctagtatgctgactctcagtgatccccaggaggacatagttgtgcgtaattggaagcactctttgatttagtgttagacttcgctttatcagatttcgtcataacttagaacccttagggcttaaaagaaataaaagattcagaaagcacaagtggagccttttagagggcttatgagcgtgtgtgtctttgtcccccaaccccatccctactgtgaaatagttttctttaaagggaaaaaaatagcaagagctgttagctaaaattcctccccttagaagaatgtgaataggatagactatgcagggctcttgttcatgtaactttccgtccaatctcttaaaaataaatgtacagctactcttgctttctgagccagattggttttgggtcacctgatgaggcacctatctgagcctgtgaacttctcttcagttcacactgagcctagctgggccacgtgctctcaaaggctaaatctcatactagtccatatattaaactatatggaaaactttaagacccgtggtctcctccaatcaaatttcatgttgccttttttttaatcaatcaaaattcaactttaaatgtcaattactctagtctgtctcttgactggccatggtgttattgtccaatgacatttgtttgctgtatggttgttctctacgttaacttctactgaaattaaaaggtgtgcatgttcaatgtagtcttaaacacacaaatgtcccaatgtagttctcaactatgtttgccatcaacatgactcaagtcataccacttggtcagactttttttttttaatgaatgttcaaatctataactaactgttcttaagacctaatcagaggtgggggaggggctaaagatgtagttctatgcactggcctagcatgtgcaggtcgaaataataaagaaggtctggtggaatggagctgtaatcccagctccaaggctggggctggaggaccataagttcagccttgcctgagcaacttagttagatggcgactccacagtgaagaggggtggggtggtgctcagtggtagaacacttgtgcagcatacatacttgaggtcctagcttcaatccttagttaccccaacactccataatttgaaattccccaggaaggcttaatccagagtcaagatcaggtgtcaaaatcctcaggtgtttcagatgacctcatttgatcttctagcattctttactgttccctccttggcctccttccttacatacttaaaaccctgatgtgacgttcccttcacaagagtgtatcagtgagtgttcagtctggaggatttctggaatgtgggcagctcttgtcaacagctatagcaaagacacttggcatttgggtgaaacatgcagaaacattgccccttcccccatgaatttacagcactgctttagttccagtgtgagcccagcatggtggcacaggcctttaattccagcaggcagaggcagaaagacctctgagttcaaagtctgcttggtcaggccaaagcttaagtagtgagacccccattaaaatagcaaacaaaccccaagaatgaatgtgacaaatgtgattgatacttgctggtaaaaggctctcgattacctttttctgtttgagcacactgaactccttagagccttaggacctggcttagaccttccttttgagtagatgagttgcgtgcccaatcacagtaggccaacacaagcttagccttggtgctaagatctgtgtcagtcttgggttaaaacacattctctaggtgaggtgggacaacaagctttctactagcttggcttaacttagctgctctcactccatcctcccccttggagttcagtggggacagctgtatggatattgaataatttattgaaatgctgcctccctccctccaccccattctctgtggtcccttcatttctttaggcaggggatatatctctcatttgactcgtgggccctagccccacattgccagtctgcacacagtatattggacattgctacagaagtgaatgccctatgaactgtcctggccaggggggaatggtatttatttttatattgtatatattttgtcatggtctgctggttccctgctgtttcactgagagcgacaattacctcaatagttagtttgatgctgtgtgttggataattttttgaaagaactttttaaaaagcttttttgatctttggagatctgtagatttatttccatatgaactcgttattttgtataaagtacattgttaaattagtaaggctttcgtgtatgtgcctggtgtgtgttcatgtgtcacttttatcatcaggtcagactcctatttcaacagtgcccaccaccttaaaggattcatcttcatctcacttagatgccaagaatcttcacagtggtacagtcttaactatggccagggcaaaacccatcacagctagtctgtggtacccacctgggacctttatcctcatcccagctacaatgcatggctggttgcaggtatcttcccaaaagtgatggccatgtttggcattgactgctctccttgcagagcctttggtgagcagtcagttgacagagaccatagataacctgtagcttgtagtcatccaagttacagatatccagaagagggagctgcaagcccaatgaagcttaggctaacccaattgtttttagttctagttcctgggaaatgttttgattaggtaggttatgtaatcaaccgtggtcttagaccaaactacctagctgcttttattattacacttttaagtagtcctcattccataataattcagccatacatgtg

SEQ ID NO: 31811 - DNA, 1169 bp, Mus musculus
cagcctagcgaagattcattttcaccacgttctcttcaggtttcaatggaaagtaaagttagaacttgtttgaaaacttcctcacaggcctccaggcatgagaagctggagagccaaccttaatggcagttctcgagggcatctttgaaggccaagctaaggcctgccaactccctggtgggctcccttcccagcagatctgccaatatcttagcttggtgaacccttcactatgagttagtgtgagctgatcaggcagttaagcatggcttcctggagagaggttcctagcctgtgtggaaggagggggcaggacctgacagctgctcagggagggtgctgaggagggaacactatggacagctggaggctcagcacctgcctggcccttctctcatgtcccttacccaagctagctgagaccgagaatcttctctcacactttctctttttctcctccccatggcctagcatctccgcaaaactcatcaatggaggtatagcaggtcttgtgggggtgacctgcgtgtttcccattgaccttgccaagacccgactacagaaccagcaggggaaagatgtgtacagaggaatgtaggtatcggcgggagaggtgaaggcagggaggggtctggagaacaaggccaactgaggtgtgcccatgaaagggaagaggcccacttggacactactaacttcctttctggcctctgcttccaggacagattgcctgatgaagactgcacgtgctgagggcttcctgggcatgtaccgaggtgagcttctgaatatcccagaggagttcaggctcctctatgaggacgatggggcagggcatacagcccacactttgtgagcctgtagcacagaggggttcattccacgcagggaattaactttccagaaccttcgatgtagaggcagattcttctggctaaggccaccttcgaggtgcctagtttgtgctatgttaaaagcaagtgtccccagcctttctctgcctccctcccctcttcctctccttgacataaagaatgacccacagagctgtgagctcagccccacatgatgaccccatgctgctgctgtctgcagcttctccatacgtaatgaggaaaaaacaggccataggtccgtgctggaaagaactgataagatatgcagggacc

SEQ ID NO: 31812 - DNA, 1212 bp, Mus musculus
gctaactgacctgtgtacccagctctcattcctgttttcttagggcctaacatcatttgtgtggcttcggagaaatgaattgagggccatgagattgggtttcttggtgttgacatggccatgaaaggtagaaagaggtgagagtcaagggtaggaactggagccagcacctgctgctcttccggaggacctgaattcagttcttagtgccgtgtctggcagctcactaccacctgtaacacagctttaggaggtccaatgctctcttgggggttacagatacacagacatgtaaattagtaaataattattttttaaaagctgaactctttcagtgtacaatttccccccaaccactctccactctagaacagcagttggaagacagtaatgaactgtctgtggggcccaagaaggcacagcttgactctgcagaatgacagtcatctgctatgctgattacaggacaaggatttaaccagctttatttcagatcatgtcccacaagcatctattggaagggatctgggcccatacttcagggtgagtatctggggcaggaccgctgctgaggtggccagaatgttcattcaggctctcagactattgctgatgcccgcgagggcacaggtgcacttctgatctgttagggcggcaaggttaggattgacgctaaaccctcacaggacgattctgtgccacacttgcctgcagtggggatgttagtgtggaagagcccttctgtcttactgcacacggtcctgccatagtacataagaggttggggcttccgaacatctctggttcagaaagtttagttttcataaaggagatgaaggctctactcgcttagtaaaatgggtcatttcttctgaggtagcactacaggttagagaccacgtacgtcagagccagcatcttatacttccagcagtgccacctagttccctagggccagaggtgacagcaagaagtgacacatagattactcaaagcacttcaagatgcgctctccgatgccaatgaagtagacgccctgggcgatcccaaagaggggggctatgaccagggcacggcagcctgctcctttcatgaaggctgctggcccctcctgtgtccagagcttcctgtgaaggaagaaaggagagcttggtaggtgaaggctacgcacacatttactcaggactttctgttgttggatttggggagaag

SEQ ID NO: 31813 - DNA, 1374 bp, Mus musculus
acttgggatactgagggagcctggaggcctgcaggggctttgacacacaacctatatcccttctgccagagtgggaactactttcacaagatcctgagcaatgctggcttttatcaaacttccagaccattggagtgcctgagaccccacaaaagccaatgtggttactcttaggggtcacactcatccttgtaactctctgtcaagacatcaacagactccatctaagtgccctttgcagccagtcctggaaggggttcacacactcagtgtcacagactgagtacagtaatgacttcaggtctttccccttttgtgagcatagtctgactgcttaactgtctggcacagtgcagcagataggacaggtctgatgtgcttagcaatgtcctttccccacatggtgttaatattgtctgcaacttccctgactgaggtcctgatttactgacttctttacagatgatgccagaagtccgtggagccttgtttggtgcaaatgccaataggaagtttctggactgagcttcaggaggagcagttcccccacggctgttctcctggagaagcagattatctgtgtggcttcctctttctgttctaatactggtaatcagtggacaccctctacagctaatgccctcggctcagtgtcaacagcagggccacttggtgtgggcaagaacccagccccagctcatctgaggccacagctgttcactgggtttgcagcaggacgggagggtcagatgtgctgcacggcctcacccaggacccattctttccctgtcctgctctagtctagagtgagttgtgcatgctgtccctgctctttgggcataaagtgcatgtgggactcacattcctccaggaacactaccttcgctgttactgtttaggtctagtcttccttctctgtaaatgtgatttaaaatctaagccacaaatattctttatttattaaaacagagggcttatgtggatttagttgttgttccttatgtaaggcaccgagtttgtgatttgagagtaagttccactgggcacggtagcccacacctgtagccctagctgtggtgggaggattgtttgggggcagcctgggcaacaggaagatccagagaggagctatcccaaatccctgccgtacattaacctgcctgtcctggaggctggacagctttgtgtgtgtgtgtgtgtgtgtgtgtgtgtgtgtgtgtgtgtgtgtgtgtgtgttagcagtgggtgccagagcctcatagggaagcagatgctgcaccgctgagccatgccccgcaacctgtggcctgtgcatctttggggttttacctatcttgtcttagagagaataaggccgttttcagatggattatc

SEQ ID NO: 31814 - DNA, 1906 bp, Mus musculus
gctgctgcggtggccatcctggcagtggctgttggagttgcactggctttaagaagaaagtaacagtcttttcagatgagacaagacagaaagacctacggctttagctgtattcactggaacttagactgccagcagctactggacatttgcaggacactggaggaattgggctttcagctcagcgtggcagtgtcttgagacagtgttcacattggcctggttgtcattttagggccttggctcatgctagattcagaagggcaagagtgaaactcccacctccaacaggttagtcaacttgggcagtaattctctgtaggaggctgctctgtgcattatgtaatgatcggcaacatccctgccttctacccactagatgccactggcacccacttacagtgatggtagccaaaaatgtctcctacattgccaaatgtcccccgtggacaaagtcatctcccttttgagggccactactttaagggatagggttcaattaggagactctgggggaggaacctgcagctgggacggcctgctgttcatcctgttgcagtttctcggggcaggtgagctgaccgtgctctgcagctgttttctttctggtccccattctgtatcgtgaggtgctctctcccgcatcacaccacctctcaggtactgcagcagggcagtctcaccctgtacttctttcccacccaacaagctcccgaagctccccacggctccatctttcaaagatgatgcctttagggacctttaaaatgataaatacccagtccaggcgtggtggcacctgcctgtatttaggaagcggaagcaaagagattatcccaagttcaaagctagcctggtatatataccaagacaatctggggctgtttggtgaaaccttgtcccaagaaaagggataaatacactgaagctgtataggagacttagggttccccagtctgaatgccagtgcagggtagaagctgcagtcattggtcttagaggcaggaacgtggtcgacatgacccgtcaaggtctatttgacctcttaaaagtatagccagccagccaccccacgtgcctatgatttagcaatgacacctctgatggcatccgcgccatccagagcctggattagtgtggtgtgtctcccactgcctgttcttgagcattggactatcatcagcttctctgtgggtctctgcgtgtagaaagcagtgtcatcctttggcttacagaatcagttgggccataacccttattcagtataaatcatgaaataaatgataaagctttatcatttattattaggtatcacttaaatgaaaagtgggacagaaacttgaatttaagaccaagactgctgctgaggttctggcttggtcttcggcattcaagagacttcttggcctgaactcagcccagtgccaggcaacagacccagaggaccctatgcactcactgtagctagtgggactcagcagaatcccgtatcacctggctgaccccatccctcaagaaggtggggggaggacctgtctctctcatgcctgaggacacagtgccaccctgcaaggcacacatgcttgataagaagtcatctcagatttatcttagtcatgtaatattacttcttagatcctgaaatttataataaaaatacttttaactactctaatcaccaagacctgatgttttgaatgtccttgatttttttaaaaaagtatttttaaaagaagctctccccaaagagttgatcaggagattttattttagtgtgattgtgtgtcctgtcgatgtgtcccaccgtgatgtcctcttgtgagtttcagtcccatgcagggactgctagttgtgggcagtagtgtagctggaggtgatgggagttccctccaagttctcacaggtg

SEQ ID NO: 31815 - DNA, 3192 bp, Mus musculus
ctggcctttgttttaggatatttgtgtctgtgttctccaaggcaggagcagggaagaagctagcatctgagccgattgcttggtgctttattttactgctccatgaacactcagcctaacatgctcaagtatagttttctgggggatggcagacaggtaattttccatggcttctccccacatggacccttataactcaattcttcctttacctcattgacctctgcttggcagtgggctagagtagccacagggtggttctgtcaccacagctcctaggtttgccatcactttaaacaaagtaaaaaatatatccctatgtagcctaggctggtcttgaacttgtagtccagctcaggactgagcttacaagcacgtgtcaccatgcctggtcttgctgttacattaaaattagttctcaaatccttgctcatctaagggacttggtagaaggaagctgtttgtgccctaaagattcagaatgcattcaacttgcaccagaattgagtcactgtgccatcttctgttctttgtaaactagtgggaagttctgtagagacaggctgtcgtctgcgtatgtgcaccttgtgctcggaaccgagctgcataccaggccagtgctccatcactcctgctcttcaacccttggtagaattaattgttcattcaatgaatgattgacgctcacttagccaaaagcctgtgaggttttcctgacaaaacacctaaagaatgccgacttccttgctgtactgaagtggccagcctgagtccagagtgccttagcaggggggacttgaatgagcatcactgccttctagaagatggtctatttcaggggctttcaacctgtgggccacaacccctttgaggactgaatgaccttttcacagggatcaattatcagataccctgcatatcagatatttatattgcagttcataatagtagcaaagttacagttatgaagtagcaacaaaagtaattttatggtctgttgttaccctaacatgaggaactgtattcaaagggcgcatcattaggaaggttgggaaccactggtctagttagcacactcatttgggtggtttatgtatacctcacccaaagcatccctggttcctcctgcctgcatttcagtcccttcgggtgtcttgactgagtagagtgaaggtcctcggagcctggtcctttgaaggctgccaccgtttgtgagcctatgtgctaagcccccagttagagaacagtgcctgctctcgccttctgctctaaaggtgagatgtgggcattcaacctcttaagagctactttatggacactacactgtctagtgaagaaagaagttctcttccacatgaactctgtgctcactggcatgagccttgacctcttgcctcacacacacctgtgatctcaacagtctagcattgagaacctccatttgtgagatggctgtgacaagctacccttttaagtgagctctgtgtgggttactactccttatgctgatactgattgagcacgcaatgcatgctggaggctggagggttttcacaccttacgcctccttcaggtcctgtctaaacatcccaggctactgggtataaaccaccgagaactggtttaccgagttgcctagcttatcagaggcaaggcagtgagtgaaaaattcccaactccatccaggtctagtgtttttcttagtgaccctctgtgtgtggcagagcccctgtttacagttgtgtgaaattactgcacacagcagcctaggtgtagcctgtgtttgtttctgtgaaagttccatgtaggctaagtacccagtctgctgaatacagaaacctaaggaacaagctttgtattgcaccactgcccctttaggcactgggtgaccctgtggtctgtagtgttgttggtgaatgtgttgtcttcttgctgtaaacaaggtcaggccatctgacacagctctcatcaccaagcagcgatatgaaggcggccagccacttgacatttttgtcgggtttttgttgttgcagttttgatccctccggtccttcctccctgcaatggccatcggtctagggtaggcacacggaaggatgagtggacacctagagatactgtttggattcctggccctcaggctcaggattaacgaggtagccttccatcccactcatctgacgagagtgcttcctagtgaaaactctgccacagaacagtgctgtgcccatcagacccgagtctgtggtcttagttatctaccctgtaaaaagctattcgagagctggaagctctcctagtcatcttcacacagccctcctcgaaaacccaacttggcttgccatgtccctgtgtgcagcgagggtccttcccatgctcatgtttacacacacccccatcccctccgatgttgtcagtgtctcaggtcagaaccgtctcagggacacctttgaggccgaggcccaaattagcagtcagctcaggggcctccgtcagcacgtcactctggtgctgccctttgcggcacggaataataagctggttactggatagctttcggcaaacattttgatacgaaaagctgttcatttatttatgtgtgtgtggctgcatgccacagtgtgcatgtgggagtcagaggacaacttgtgaagttgatttgttctctacttccgatatgtgggtcccaatgcttgatggaaggcaccttgatccatggagttttcttgccagtgccacgttttgtcattgtgagatgacaggtttgtggatgccttcccccaggaaggtgagctacacacctcccttagtgaggcctaaaacagtctgtgtggtcctacatccatgggccatctgttggccagcctttttctcctggacctatatttcccctgctctgacaacccatgattttcttccttgagactaaaagtgcctctttctcctaactccttgattaaactcagtttgttagtggttctggtatcttgtcccccaggtactggaatggttatccttaacatagcagagtcaggtagatgtagctatcaatgtctgcccggggtgcatgaaatcctgggttccatcctgggcatggaatacgtacctgtaatcccagtactcgggtgaaggcaggaagacaatgttcaaggccatactaggctcagagctaaaggctagccctggacactt

SEQ ID NO: 31816 - DNA, 1158 bp, Mus musculus
tagaacctgtcagaaacattatccgagattcttttggggggagggggtttttgtttattctgggtgaaggcagagtccacattcccagatggcaatggaatgcaaggcaatcctcctgcctcagcatctgcaggcatgcacccccacacctgggtgggtggagcagaggacaggtctctgtgtgccaggcaggcactgttgactgagcagcagcccagtgcttgttttctaacgcaccgtatcctccaatgagacttactctgctgcctctttcttaggagatggactgaggagcccgcacaagcccgatggtgacactgcctccagaggaaccgcgaccatggaaagaccttggcctgaagacaggtcccagagaacagctgtctccctatttccaggtggtgggaaccccaagctggtgattcactggacatctctgcgttcagcttgagtgtatctgaagagtttacgccggctcctgcatccacaccatgtacctttgtcctatcagctgtatgggttcccacttgggaatgaaacttaacagcaggctgtaaggcagaaaagcatctttgtaatgccaagtgactgttcctgagagccagctctgggctgtcttcaccatgtaggtgggcttctgtctaaggagaacagcattaggagaggtgcatcggcccatgagcgtgaagtccacccagcctagtggacactgaagtgctcacaaggcctccacctgcctttgtaaaagccgaatggctgatctcaaaccatgggaagcccgaccgccccacccctcctcaccccagcgtttagctgtttcaggggtcagctattatctcaagatttctatccaagtggaaacaaactgaatcatgcacacgacttatctgtgtggtgtcagttacactcaggctcttgctacggaatgcaaagaacaactcacataccagtgtcaaacagaatgcacagaagagacctaaaacagcagcaggtcactcggttcacaaaaggtgactcccagtcaagtctgacacactgtcttggttgtagagcacagctgccatcctctttccctgggtaacatcacagaagattccatatcaaaagcaaatgttccctccgcttctgtatttcagagacaaggcctcactgtatcct

SEQ ID NO: 31817 - DNA, 1507 bp, Mus musculus
ttagccttcttaatagtgttaccgacctgcttggcaccagggagcagcccagggccctgtgggtccttgttcacagctttgccgtcccctcctctacccggcaccctgttcctgttgccactggacttttccaggagaatagcctctctgtatggatgcatttcggagccaggaggccaggcctcgagacaggttgttctggtcttttgggaatcttggctctgtggaccccactttgtccaattttgctgccaaggttttacctcctgtacatatgttaaaggttgaggctagcccctcttcatgcttgctgggaccaagtagagtgtgatgctcagccccagctagacaggaacatgtgtgctggtctcacctcaacataccggccactccaatcttctctgcctatatcaggattttcttggcctggcaggagccagtcagcaccatgtaactagatccataagccaagctgttcatttctcatggttcagccagagaccagcagttggagccagggtgcttctccttcaaaacagcagccacctatggaccagtccattggtaccataccaatctggaaagggcacgccagctgggcctgtgggaggggccagtgcagacaacagccaagggcccacactgaccctggactccccgtgggaaccacactgtgcctcaacttgaacatccatccacccaactccagaggagcaaacagctatcttacttctcaccttgcgcaaaagctgccatctctcctgtggaaacccagatgtgctgctagcaaccgccacagcgctgacgtcatcacttcctggactctgatatggcggcatcgctatttttattccatcagaggaggatgttctggattctattttcaaccacaatctgccaatcaaactggactttggacaggaccttcatcgcctgtgtggccttctccttgaccctgtcctcctctgcagtgccaccggcggcaatcccacgcagctcagccctgtcattcctgctaacccagaacaaggaaaccatttcccgagcgactcaagaaggatgcaggggcacgctgcatctctagctgcctctcagagctctgcaccagatgttcccttccacctctgtcctggtcagccatgacgtgttgatctctccaaagcacacgctgcttccagtgaaagtgggcagaacacttcgcaggagggcctcagaaatccaccagccttgggagacgtcccgcagttctccagtcgtgacgacacgaggacttcagaatcccacagagcacttttttttttaggctaccagtttgtaaccactagtttgcagttgatttcagtggcccgggaacgagacgcgaagtgttctccacctctggaaatgcatacagctctggtcatgcgttcttcccaggaattatgtcttcacttgaaggcagggaagagagggatgtatacacttcatccacacatacagtgctagagtgcttttgagtaaacccaaa

SEQ ID NO: 31818 - DNA, 1157 bp, Mus musculus
tatgtatgtatgtatgtatgtatgtatgtatgtatgtatgtatgataaagagttcaccatgtaggctagactggctgtctggacagcaaatcttgggggtcaggatccacctgtttccacctcctccctagctgtaagattacaggcacaccccaccaagcctggctttttatacggggtttatagctcactctcaagtcttcatgcttgcaaaacatgtattttacgaacaggcttatctctccagcccaatctaggttttcctagccatctaaagccctgacaacaagaagtaacttccttttgcttccatctggttcttatgagcagcctgcccaactactccttcaccactgaggcccactagggtctgtcctgccctctacgagcccccttatcctgcttggtagccctgacacagttccattgccagcgagccatgctcttgaccctactttcccaggtgacccagagtgtgtcatgcttgtcttccctgtcactgccactgccaggttggcaccagtcgcagcagggagtgcattaataaggggctgctgtggatcccttgcagacaggtgtcggcatggctcttgaagtgtgtcagtgtaggaccctggggaccacatctgtactttacctttttaaactggcccgttctgcatgacgacttaactcacagtcggctatgcaggggagaggaactgagcaggcatgatgcccgtgctcagagctaaaagcagcaagtgtgtgcccagccagcatgcatgtggtatcctgtgcaggtcccccaatgtgccacccttagcgtcctcctgtcctgggtgccaccagattccgattgcctgcatccacagggacctttaggcactttatgtgacccatgagaagaccacaaaagcaaaggaaaccggccaaggctttgagcaactctggtcagtgtgtgaactggagaggtttcaatggttgcccaaacactggtacttcctctaaaaaaccgtgatttgtgctggtttggttcccttcactgggtctagttctgaaaaagcaggtttgcccagtgtcaggacatgtcttccattccatgctaagtgttcagtggcaggaacagagaggaaggaaggggctgccgtggctgaggagggccaagtcaccacaca

SEQ ID NO: 31819 - DNA, 1195 bp, Mus musculus
gagtctctgttggcccctcccactcctcccacacctccccccacccaactccccatctgttcccaacctcagccctcctcggatgcctccatcccatcgcccaccaagtcccccatacgcttccagccagttccagccaaaacatccacacccctcaccccactccccgtgaagagccaaggagaccccaaagacagactgagtggccccctggctgtggaggaggtcttaaagcggagtgatctggtggaagaattctggatgaagagtgctgagatccgccgcagcctgggccttactcccgtggaccggagcaaggggtcagagcccagcctcccctcccctgcctcgaagccaatatccctaaagtcctactcagttgacaagtcacctcaggatgagggtctctgccttctgaaacctccatcggttcctaaaaggttgggcctaccaaagtcagccggtgaccagcccccactgctgaccccaaagtcgccctccgacaaggagctgaggagcagccaggaggagcgaagggacctgtccagcagctcaggcctgggcctccatgatagctcctccaacatgaagaccttgggcagccagagcttcaacacctcggactccaccatgctcaccccaccttccagcccacccccacccccaccccccaacgaggagcctgcaacccttcgaaggaaaccccatcagacttttgagcgcagggaggcctcaattatcccccctcccacccctgcctcattcatgcggcccccacgggagccggcccagccccccagggaggaggttcggaagtccttcgtggagagtgtggatgagatcccctttgccgacgatgtggaggacacttacgatgataagacggaggactccagtctgcaggagaagttcttcacacccccttcctgctggtcccgctcggagaagctccaggccaaggagaacgggcgactcccacccctggagcaggacgtgccaccacagaaaagggggctgcccctggtctccgcggaagccaaggagctggccgaggagcgcatgcgcgcccgggagaagtctgtgaagagccaggcactgcgagatgccatggccaaacagctgagccggatgcaggccatggagatggtgtcctccaggtcccacacggcacaatcgcagggcaaggaactaggat

SEQ ID NO: 31820 - DNA, 1145 bp, Mus musculus
tacagaaaaaccctgtgtccgggcagggggtggtggggagccacacactaaaaaggaaaacaataataccccatatcccatatcagatgcttcataaagtgaggggcatcggagcaggagtggtgggttttgcctgaaacagacgtgttacatcactttccctatagcatcaagtttggtcaggtgcccttgcagccttcagcctgcttagtgaggggttagccctgaagataagaacgggcatccttttaagaatcgtcttgtccaagctgggcatggcggtacacgcttgtgagcctgtgtatgtaacggcagaggccaattgagttatatgagaccttggctttaaaaaggaagtaaggaagaatgaaggaaggaatgaatgaatgcatgcatgagtgaatttcctggtccagcccgggagcttgttctcccacagttcaaagaacttggttcagtcatctctggtgagcagtgtggtatatttcacaacatggctgtggaatcagacctggactggaagctcagccctaccaccgactaactgcagacaaatcccttatcctgtgtgcctcagtttccccacttggaaaggccatgagcttataatgaacattacacagatgaatgcctggtacccagtggtcaccaaattagtgtcagcattaagtgtcactgcttacacacccatcgcagtgcagtgcccatccctagctgagtaggccagggatgcaggtgttggtctccatcaccaggtggcctactcgactagggatgcaggtgccggtctccatcaccaggaggagtaagagccagagcctgcctgggtcaaacttactgcctcggctgatcatcagcctctctgtatcatagctacctgtgtcgcagatggctgattgagagccaattctgctgttctggggacaacccgagagccttccttaaacggtaatgccagtctcggcggcaagctgtggacactggtttccagggtgtctggggtcttcagggtcagcagatggcctaggagatgtttataatcacctccacgggttggatcacatagtgcctgctggtcttaagccgtgtcaccgaaccttgacaaccaagactcatcagccatctaactactccttgttgactcc

SEQ ID NO: 31821 - DNA, 2354 bp, Mus musculus
atctgtgcctgtctaaggaaaatgttaggggtttcagattttttttttagacactcaaaaattgagggacctatggataggagaagcatgctctataaaacacagaaaatacacttgccagtgtggttaaagagtcaaaacaaacaggaaagggcccaagctagaacttgcttgcagaatagcaagagagggtcaagatctggcgccccaaaatatcccaggtctgaatgtccaaagtgaggctggcactgtacccctagcccaagggactccctacagagggagagcagactctgcaagtcattgccctgagtcctggacatgctcagaaccctggcactcgatcttgctagccactgaaggccggggtgggggtgggggtggggaggcagaattatgagtgacattttataggtgccatgagattggtttctgtttcttcttgggtagaaatgcctttttccaatcccacattagctttgagtgcttggccaaacttgctccagaaagcttcaggcaaagcccagtgcctcgggcttccagaatgtgtcagagaagggttcttaagcccatgtcccatgtgatcgcccatgttccctagagctcacggggttggggcggggagggcaggaagagctgggccaggctggattgtggccctgcctcctggtcctgtaccttcttgatttcctagctcttcgctcttctcccttctgttctttccccttaggcaagaattagtgctgttgtataaacaaaataccagccacaaaactacccccaaatgacaatatgaccctccttaaccccttgtagagagccctgagtaggccttaacacgctgtcttcctctggtaacctcgtctgcagctgctgtctgacccctgtttgagacaatgtttctggtatttctgtctgtaatgtgcgtttaatatagaaatcctcgttttgttctcaaacctgtaaatgctttgtttccaaaccacctcctctcactgctacagatcagtgggcctggcacagatttccttaccctggcctcacagtacctgcctggagtttagaagtctggaaaccggacaaagggaaaaaaaatcaaaaacgctgggcgggatggctgttctcttgggtgcacgcccttggttgcagatggtttcttttctaggtagaggaatcccattatgcagaatgaaaagtgaggcacaaggcacatgggtgggaagggaaaaggagagcttttctccctgcgtgcagacaagagcaggagaagcacgctctgcagacatctgctgaggaagtgtctttcctggagaagctgtagttaccagtggcactgggctgtcccctaaccccaggtactcttcagtggtacccactggctcccacagttagggaacacaggcacgggcccacgcgagccggaatagccacacgctacaaagaatgcgtacaaagaccctgggcctctgcctgacgaggaggttgggatcctctcgtggcttcctagggccccttcccttcaaggctatgggagaaaaaacccaggaaaggaaatgctgtggaacagctgccatgccgtctgcttcccaacctgaccgccagagccaaagctgagcagtggtactgtgtgaaccttgaacacacctctcaatgtaaatgtgtatatttatgtgtgtagatgggttttagttcagtgtgtaggcagatactatttatctatactgtgccctaactggtaacagtgagactgtttataaagctactagtctgaaagccataggaattttctctggaagcttgccctggcttgactcccccagcatagccaggattcagagggagcccagccactaggcatggcctcctgtggggcatagatgcgggggccaggtctctggggtggtacacacccctacactcaggtaatcagttttcctcatcaacaaagcaatagtcttactggtgcggggaccagagagtctcagatacctcctttccctcaagtcagtctgtggtctaagtgttagctccactgtggccgtctcagatagccattgtcttagtattcactgggcctggctgcttcctgcaggacagtggaacccattaggccctctgtgccactgaatactggccagtgaagtaaaggggttcgcttttaatcgcccaactgttctcttggggtgaggcaggagactggcagcaaagactgcccagagctgtggtacatagaagccagagtgcggaggaccagctgtgccaaggaacactttgcctgtccactctgaccttccctaaagcttttaatttgcccttgtttttaatctgtgctgttgtgagttgttttttttttt

SEQ ID NO: 31822 - DNA, 1197 bp, Mus musculus
ctgattagatagcagggaggagagggaggagcccaggcaaggcaggagctgctgagtaggtgcttccggacccaattggtaaagctggctctatttccatgtgccaagagcatgtgccactgctggggaaagcccagggggagcagagtcctgtctgtgctgccaggtgcctctctgacgtcaccctgcgcatgcctccttgcctgtcagcttcttttgctaccctggttttaggtgcactgcaaaataggacctgctgtaacttggttggggctgcccttggagttatttggggggcgggtcttttgtcaacgcttcccagtcaggagaagccacaagagcagcaagcagtagagagtcccactgcctgctatctagatgtatgtattagatctcattgttcccgtttgctccggttactttaccattcattgtgcctctctattcaaaatgcctcagtgcagatttatcaaaagataagacagtgctccttggccacggtacagagcgctagggcacttagcatggatgtggaactgtagtctgattgtttctgacgctactgtgcctcccgtagctgttcttgctagatggctgccatcctcggagagacgctcatcacaggagtggatgctaacaatcctaatggcaggattgattctcctgtatcccacctactactcactggtcccgccatgacaagcagcagcctagagggagggtcacctgctattactgtcttgaacttgagcggtggttccccatcttcctaatgctgcaaccctttaatacacggccttttatagtggtgacccccagctataaaattatctttgctgctacttcataactaattttactactgtcgtgaataatgatgtagatttctgataatcgactccatggaggttgcgacacacagacacacaggttgagaaccgctgagttctcacatggctcctgctgtcgcttcccgcttcgccgggatgccactccatagggaactatgtgcacctgagagctggcgtagttttctctgttctctttcattgcatctcagtatggaacatgatcttctctaagatgtgccctctccaggctttgtctgagaagcagaaactatcagtaagtgtcagtaatttgctttggaaataaagtatgtggggggcgggatcctaacattttggacttgggcca

SEQ ID NO: 31823 - DNA, 1181 bp, Mus musculus
ctggggaagacaccactgtgtataattaattggcaatcgagtttttatagcagagccttttacccagttaggcctggaccagctgaactcatttatttccctgtgaaaatggaaaaaggaagtatttaaccagaggcttgaattctgtcacatcatttccaacacagataggctattctccaaaccagtcttgcagaggttgggtggatgggggtgaggagtagcagacaagtttatgtctttggtatttgcctgtgagcaagtggacctgatgggtcagagatgaacactgtgtgcccagccttcctagagaaggtggactaaggagagagctctgggcctcgtcacactccgggagcccaagaggagcagggacagtccctaagggcttcaggtgttgacacactcacccttgacatgtttattgaagaacttctccggagcctgcaggaagttaccgtatttgtaggtgacaacgtgagagcagtaagcctcgctgtatggtgatctgtgatttaattggtcaggagtgccgaacttggagtggtgcgcaggtgcgattggtcaggagcgtggaacttgggagtggtgcgcaagtgcgcactgctgaggcgcagtacccatccaagactgcttgcttgtctcttgcacattacagggagcctttctaggctttacctaaccccctgtgctgtggctgggatgtttgtattttgccaacagggttgggttgttttgtagctcttcctcctcaggaccatggctgcaggaagggctgggttacctccacttcctgcaggcggccattgggcccatcaccactggagaatctgctggctggtatccttgtccttgcccagccactgcttgccaagaagagagacaggtactctagtggccgagcacgcctagaggacatgctgccggccacaccctctcccaggtgttctgactgtcctggtcacgagggcctccactggtcacttgtgggtttagaactgttgttagaactgccagggcttctttgcagcaccgttccagctatgactcggagcctgggtggagccttgcggtgccgtttcaggctctcccaagcccccaccttctgctcatctttcgaggtcacttgctatatttggaggctgatgaaggcctccttggacttcttactgccgagtgta

SEQ ID NO: 31824 - DNA, 1367 bp, Mus musculus
tctttctctctctctcttgggggtgccccacctttcatgaggcgtatcttcattcttctgttaaccattcttaaatctgttagagactgaaccaacactagcaattcataataagctcaactccgcttcatactggttcctcttgaaagtcttttcttaggcagagtcaagaatcctgcttcgcctgagactctggaaagaactcctcgggctaccaaagggtggcattgggtaactgtctctccatccagtgcctggcagaacagggagattgaggagggaagagccggctctcgatctgtcaaggcttctgtttggaatgggagccagcgggacaggtgcattctggagaacgagagtgggcaagccaagccgtgctccaaagttgctcaggaagggtgagcaggccagcttgcttcccacacagaatctgtgatagaaattggattgggcaagagttgtgtgcttttcgatggacttaagcaagaaaactggctctaattcaaatgtccttaaatcaaaggtccaattggagctgtggctcatggtccctgcagccttcacctttgccccgcttcctctgagcagagctctgagctggggaacctcagacggctgatggggactgacacaaagcttagcttgcagtctgcccctcctgcatgtgcccagatctgtaccatctcacaccggctggaggatactcccgtgcacatgtgtgtgcaccagtgctgttatacatgatggtgcatcatgttatacatgcatgtggataaaacacatgcaattaggttgcacatgtatttatgtagaaaagtcagaatgtgtccctgtagacaaactaatatatgtgcccctatggacttgactttcgagatgctgaaagtcggaagcatgttgtcacagaacaaacagaacaagcccccgccccccttcccacaccctgtatttttttggcctttgcataagcacacaggtcccttgtttcccctctagtgttccagggcagccatcttcacgcctctccttccccctcagtctttagtcctcatctgattggccagctgttcccactccccgttctaatggcctctgtgagaggaagagctgagtcagctggtggccaggagccaggacccaggacagagtctgactatctcacaggcctgtgtccttgctgattcctgctgttgctggctctgccctgctccttagaagcacagagcatctccttactcaggtcatcctagagcctcccaaagcccgagaaaggcctggctcccaaaccacaggccagaaggcccccattccacagaaaggaccacagtttccccagctgtactgcagaatgatagatcgccatcctt

SEQ ID NO: 31825 - DNA, 1112 bp, Mus musculus
acactgtgtgctttgagtcacactgtgtgctttgacaggagtgatactttacaccaccccacagtggtgccatccaccttgtagattatagcatacacaggggctgccttttctatgcaaaatacctggaatccgtgcaatgcataccttatttctctccgagactcagtaacaaagcagcaaatctcttgggaataacatctaccatctggtagagaccaggttctgagactagacatttaaattgatgaaaaaaaatgcccctaagctttcaagtcttcttattgttggcctgaggtcaagggtcttttgatataagggtttcaaatgtttgtatcttctctctttcaagctccaatatccactatgccccaccctaaacacacatctggacagatgaatggccattttgtctccaccccttgcttcagaagttcctcccattggaatgcctctctctacagcatcgggctaattggatctgcagttaggccttccttgccagcccatctcagacactccactatcatcctctgagcttatttgaaagtctcctgtattcaaccagctctggtgacatcaaatcactacttaagaacaaccactttgggctggagagatggctcagtggttaagagcattggttgctcttccagaggtcctgagttcaattcccagcaaccacatggtggcaacgaccatctgtaatgagatctgatgcccccttctagtgtgtctgaagatagcaacaatgtattcatagacacaaataaaaaattcttttaaaaaaaagataaaaaaaaaaaagaacaaccacttcattgggagattcagatcacaggtatgcaagcatagggttggggaggcagaggcaggaggattgcaaatgtgagactaacttatgtagataatgagaggctgtgtcaaacactcaaacaaattaaagactggtggcaaagctcaatggtaaagtgtttgcctagcacacgcaggccctgggtttggtcagacgccacaaaaccaaacgtaactgaaacaactatagcttccttacagctcttagaggaaagattctatcattctgaagccatgtgcagtttgactccaaactc

SEQ ID NO: 31826 - DNA, 1206 bp, Mus musculus
gcccacaggatacaaatccagattctttttaatagaaacttaggccagtgttcgcacgtctggctgacagctcctttactgtgttgccctgttcgctgagcaggctgtactctagctgccaggtcctcctcaggcctccctgtgatggcttagctgtatctgctggagggtcttggagcagctctgctctagacccttggctttccaggctctcaagggttacccagcattctttgctgcccagcccatctcctgcccctcctgtagtgggggcctggtggtgggtggtgggactgtttgcctcttccagtgccgtaagctccatgaggctgcagagtgtttgagtcgggctggcattcctgtgtgggtgactgttggccagggttctgctttctcatctgtaagtcggttctcttctcacagggcctcttctacgagtaatgggcacttaggactcttggcacttttgacagccactaggaagagttctcgtgagcagtggtattcccaggctcagctgagcatgggtgggtcctcagggctgagtggactggtggaagagggcatgcgcttctggtgctgtgaaaccctgaacagatcggcttgtctttctgctctctcctgatgctcctcacagttgttctgctggtggcccatggggctctgtttatttttacctgactgctgcagggctgtctgtaccttaaccacctgcctatccagccaggaactcgaatcccaaactgttgctgttactttgtcctttccaaggatgtaggctggtcctcggctctgggcttaaagaggtcagagtgaagggagggccttcttggtgggtccagcacagcagccatcagccaaaggtagcttttgagcatttgaattgtgtgcggctcatccacgtggacacatgctgtaattgttaaacatgcacactggatttcaaagaccaagtactaaaaaataaaataaaagaatggaaacacaaagatttttatattgactgtatgttgaaataatattttagatatattgggttaaataaaatcaattaaaataatttcatctgtttctactttctgtagtgaggcttctagaatgtttaaaatgtcctatgctgcttgcatttagatagtgccattcaagacaccacacacactggctagtctcagagcggggatcagtgtccacgaagagcagtgcatg

SEQ ID NO: 31827 - DNA, 1449 bp, Mus musculus
tctgcacaagtagagtggaaggcagacagacatagggcctgtggggcagactcctgcaccccaggaagagcaaggacagctaaataggcagaaagccatgagccctggctgtaaacatttttataagttgaaacactggatactctaattaaaaagcaaagattacttgtacctttggttgcctcaagttgttctgcagtgcttacctggctgtaacccaaatactcccatttgctttgagcctggaatcagtcacctgattgtcccttgtgtgggattaggacagggaaaaaaaatgtgaaattccccaactacagaattctaaggtaccatcacgttgtgtataggtctttaagtggcttgatagtttgaattggaccctgggccatggtttataaatccataggtaacccaaatgcctaatcaagtagtccttttctaaagtaaacagaccctgtgtgttgccttgtggtagttagtctcagtggccagccttttcttcctcatctccctctactggtacttgtaaatctgagttgcacttttctcacagatctgtagtttggctttttatactttccccaatcataaaggaagggaatggaagcggaagtggacatggaggctctgcaggtctctgctttgggtggggacactgctgcacctgtctctcctgctggctcagggaagtgtctgacccacttatctatgggaaaaggattttagttctctctttctgtttaggccatctgcccagatgcaagctgatctcgctataatagtgaacgcctaggccactaagtaacaacacagttaatctgaacacaggagatgtgggaaaggcagggccattcgttactttagagaaaaatgaatgaagtcattcctacttctcaatacccttgcaatggcagtggaaattttgtttctttctatacaagaaaaataatgttatttttaaaaaaggcttctttgttgtttgcatcctaacccgtgttttcaatgaaaaataatataccacttttgtacaaaaacacaataattaaaaaacaaaaaacacgctggctttgtcgtttgtgctaaggagacacagcagaatgcagtaagacaatggaggccaactttcatccttttactgaggaaaaaaaatatttaatattttgtataaggaatagtgcccaaggtacagtcctgacctcagccccacacgctcctgttttgtgaagctataggacagagcagcgttggaatgggaaagagggttgaaggtgggaacagttgggagctggggtgcagaaagaatggcaacagccacatgtgtcactcaaacacttcgtccctgcagcaaaaccgataccaaccaagtgtctatgatggctggtgaccctgccatgaatgcagaagaaatattcagtattaagggagaaaatgaaacagaaaactgagcta

SEQ ID NO: 31828 - DNA, 2692 bp, Mus musculus
cacgtgttcggaggcgtggaccccgccgcagctcctctgatattgctcgtgctaagatccagggcaagcgccatcgggtgagctgctactgcagagccagctagcgtgtaaaatacccctcccttggagttcctttccttaggtaaaagccctagatacagaactctcagaattctagtttgacaccgactttattgccccgtctcctttcatctgacttcaagtttgtacatccatgagtcctttactacacttgaaatgatcagggaacactcagcgagttcacacttgaacggttctttagagtagttgtgcatctgcaagtgaagtacctgttgagacaaagctttcctgtggcctgctgtagttgggacgagaaggaactgggctgttctcactggcctcactgttctgctatctcctctcaagggtcaagaggactctagccggggatcagataattccagctatgatgaagcactctctccaacatctcctgggccactgtcagtaagagccgggcacggagaacgtgatctaggaaacaccattacaaccccatccacgccagagttacagggcatcaatcccgtgttcttgtccagtaatcctagccaatggagcgtcgaggaggtctacgagtttattgcttctctgcaaggtacgggaggtgggaggggagtgggggtgagggtgtgggggttggcccttcagcagaaccaggtccacattttccctaggtcgtcccaccaggctgacgtgtaagctgcggggctgtgtctggcagtttgtgtcctatagtgtggtttactaaattcctcctgggccaacaccattgatcagtgtccacagttctttggtttttactttgaattaaccatatttctcagttggagtttttggataatgtctctgtttggtgagtaactgagcacacaccagaggtttccattaggaaagacctttcttgactttcttcaaggcaggactgcccccattaaacaccattgctctttggaatttgtccctctgagaaaatgttggaaaagctgttaatctttttgccagtgttaaactgtgcgtgtagtttttcttcatctctagagttttgaggttacttatttgatgaacttgttacttgcttgatgttctatggagtagccagcagctctaatttcacttgctttcagagcttgcctcagacctgtctactactgaactgaggacagtgagttggactagctagccatcactaggcctgttttagttttttttttccatctcctgatgctaccatccagtttcccatgttcccaccttttccttttaggctgccaagagattgcagaagagtttcgttcccaggagattgatggacaggcccttttattacttaaagaagaacatctgatgagtgccatgaacatcaaattaggtcctgctctcaagatctgtgccaagatcaatgtcctcaaggagacctaagtgaccctctgcacaattcagactaaggcagaaggcctggctgttcaggttataacctggaagagctgttccttttgtgtgacctgtggggtttggaggcagaactctaaggattggttgctggtgctacatggtgacagctttgataccttctctgggtttcactttaacaataaaaaccttctcactattcacacctaccctaatccagtttttaaacaggcagactagagactaggactgcttagccttccttatcctggagtggagggactagccagggttcacttctccaaggaggaatggatggtaaggcaaggaaatggatgccatgtaggtttgcctccctatgggagaggtcagctttcctagcttatgacaggagcagcaaacctggtactctgctggagtctcactgtggctgtagctcagttttctgtttcattttctcccttaatactgaatatttcttctgcattcatggcagggtcaccagccatcatagacacttggttggtatcggttttgctgcagggacgaagtgtttgagtgacacatgtggctgttgccattctttctgcaccccagctcccaactgttcccaccttcaaccctctttcccattccaacgctgctctgtcctatagcttcacaaaacaggagcgtgtggggctgaggtcaggactgtaccttgggcactattccttatacaaaatattaaatattttttttcctcagtaaaaggatgaaagttggcctccattgtcttactgcattctgctgtgtctccttagcacaaacgacaaagccagcgtgttttttgttttttaattattgtgtttttgtacaaaagtggtatattatttttcattgaaaacacgggttaggatgcaaacaacaaagaagccttttttaaaaataacattatttttcttgtatagaaagaaacaaaatttccactgccattgcaagggtattgagaagtaggaatgacttcattcatttttctctaaagtaacgaatggccctgcctttcccacatctcctgtgttcagattaactgtgttgttacttagtggcctaggcgttcactattatagcgagatcagcttgcatctgggcagatggcctaaacagaaagagagaactaaaatccttttcccatagataagtgggtcagacacttccctgagccagcaggagagac

SEQ ID NO: 31829 - DNA, 1187 bp, Mus musculus
ttgcagctttgtggaggaaaggtcatcctttcagatgcagtttgccatcttgaaaggtcgtggggttggagagatgccttagcagttaaatgaatatattgttctttcagaggacctgagttgtggtcccagcacccatgtcaccaattataccaactccagcacttgagtatctgactctggttatattcctgcacacctggctaggcatggcacacacttttaatttgagcccttaggtggtagaagagcagacagaattttgaattcaaggccagcctggtctacttagcaacttccaggatagctagggccatataattggactttacctcaaccccctacctacacctccctctcaaagaaaaaaagtcttaagaaaataaagaaggagattccctcagaggcagatttggccatcaactcagagctcatccaagcagagacaaggggactttaaaaggctatagagggcagaaagggattagactgctttaactgccctttctctggagcaggtgggatgttctcagttcctgaaagaaaccaagaagccactgcaggctggccttccgaccgggctgaatgagagtcagccaagtggccctttggggggagacagcccctctgtaggtaagtgatgggtgtttatggagatgcttgatgaaggtggggcttgagcccagggtgtagcacatatgcaaaagttccacaaatgagcaacatccctagatttcattctttagagacaaggtctcaccacgtagacctgactgagctttaacttcagaccctcccaagtctggggattagacacaagggccaccacacctactgcccatacatccacacccacccagtcagtccttgtttacttaaatgaagaatttaggtaaggtctgtctatgcacaggtgtgttctgctcagcatgtggaccatacgaaagaactataagggaattttgctaagttaaggaacaggttggcttattttatatcatttaaggacatattccccttcctgtatccatttcctgtttgctaggattataggcctgtacttgtataccagttcatatacttcttgagagtcaagcctttagggtgttgggtgttagggatttttcagttagactgtgtaggtctttgtagaaaaccctgaggaaaattagtaccgagctctgggc

SEQ ID NO: 31830 - DNA, 1104 bp, Mus musculus
atgttttcacttcaaattcctaaatttgttactatcttagggtgtttatatatgtgctaattccatcaagagctctttacccagatctgtctttgtaaagtcaacagttcttagttcgtctacactgagtctttcagtccctagccaggacttagtgatgtctttcttgtcctgatgcagaagttacacatattgggatgaccaagaagtttagtgtatcaaaggaagtaaacagatttgggcacctggagctgagaatgttctcaggaagtatgtagttaaagtttcctttcacacctaaatcatagctgctttcttgtttattcctctctagggtaaagcccagaccttggctgtgaaacgcaaagctgagtctgaggaggagagagatgacctctccgcattggcctctgtgcttcctacaaaggcctccccagcagcagagagcccaaaggtaatagaggagaagaatagtcttggaggtgagtagccaacttctaaaatcttactggtgccagagaacaaagaagtgttttcagtgagtcaaaagataaatgtaatttagtagaaaatgggccagaacttggtgagcaataagtagatacagacacatgggctccatgggcagtgatgagagatgggtgtgttgtgtaggatcaggcttggtaatgggcgggtcagttgtgtcatctacatgcgccttaatgtgtgcttgtttttcagagaaagctgaaccagtggccagtttgaatgctaatcctccaaacagtgatctagtagccttggcccctaccccatcagcaccacctcctactctggccttggtgtccagacagatgggtgactcaaaacccccacaggccattgtgaagccccagattctcacgcacatcattgaaggctttgttatccaggaaggagcagagccttttccggtgagggcaggccttgcctgaaagtgggactgggaagggggaggtgatctcattttttttcccctaacattcctctaaaagaaggaagggtacaactgttttatcatcagagaatggttcattatggtgcctatttaattacagggtgagggacataggggagtttgtg

SEQ ID NO: 31831 - DNA, 1169 bp, Mus musculus
aagaacccctgggagtctttccgaggcgcccctcaacccttgcttctcactccattcttactgcaacagagttttatactcaagggtattgacttcttccaacacctgacccaataggcccagtagtatgtctacctcaatattaatttctagttccttcccatcggtgtgcgtcttccccagttgagtccttaaacacacccacacccaaaaggtgggaacgtttagggtggcctttgactcttagttttaatttttgattgagtttgccacctaaacggtgtgctctcttcactttctatactgaatctggaactcacaacattcattgaaaaatgaggattttaagatagatttgtgtgcctgcgaggtttttgatggcagtttccctggtgaaaagactttaaaattggccctctctgtttcattatctgggggaaatgagggggtcatcgaattgatgaacgtgttttatataaggctctattgcaagtaacagggtcttacgtctctgagtgcagtgagataactccagtaatctgtacaactgtgccatgctgcctctaatccttacccactttttttccttcacatgctgatattgaggattcatgggtctgtatctgtttagtgctttgatattttggcaaaagatgtggggagaaaggtagactgaagttgatagaataccctctctgtacctctttcattttatccgtgtgtggagtggcatttgttcggtcccagagttaagtgatgtagagatgctgggaagagaatccagagaaaactccacttcaggggccaaggttgagacttttgacttttgtttacttgtttgggattaattcctgagataaatccattcatctaatgaaactagagatagcccctagcagaaattatggtcggacttttatattcccaagccaaatagtacttgggagacctgatagttctagtacctcagtgtatcaaaaataaagaatacacagtgtaagtttaacgaaagaatgaaaactaaggagtaaaatgatgtcattttcagccgctttagaagagtgtttctgcttgcttctcttgtttcttttcctttttttgatatgtatttttcttttaatttattttttgctggttttaatgtagctgccagagggtaaattcttaca

SEQ ID NO: 31832 - DNA, 1264 bp, Mus musculus
gtaaaagagcaagagaaaattaaatataaaactacaaacttaatgggttatctaatgatggggaaggtaggatattgccgacgatttgtatttgtataagcaatttgtataaaatcatactaggaagggaagggaattttttttcctaagacagggtttctctctgtagctctggcagtcctgaactggcctccagtctgcctgttgctctgagtgaaatcaactaggatctctctgctagacaccatgagagtgagacctaagcagggttcctccagtgcactgggcacagcgttctgttgatgcttaaccaaattctgagagatgtttttgctaatggccttagattctctacgcagccaagtatgacattgagttcctcatcctcctgtgcctaagtcatcaggtcagctggagattccctctcctctgcgttcagttaacatagaactttatctgtgaagtcaaatctcatcaagctcatgtgtatttcctttcccatccagataaaagtttacatcaactaatccagaaaaggaagaacaagcagaccgagatgtgtagctcagtgactggtaagctgtggttcttgacagatcgtcgcatcagggaagactacccacagaaagagatcttacgagcgttgaaggccaaatgttgtgaagaggaattggactttcgggctgtggtgatggatgagatggtgctgacggtcgagcaaggaaatctgggtaagactctacaactgaggaccagtcttaccataaggactgcctcacagagcagctctgttatagaagattagagctctcagagttctaatcgtatcatgtgtgaaagagctggagagctgagtgcaaggccagtctggtgtatagagtgattctaggacagcaaagactgcacggtgaaaagttatttaaatatacacaatttaaataacttaaggaatttctttttttcttcttcttttctaagcctcttaaggaatttcttaactaatgggaattagttaactaatttcttaactaatgtgattttttttatccctttagataatatctgcagcattaattaaaataacctatcagatgtggctcatgatcatctgcctcaggtggtacatacatttctaatgtctcacatgtgttcagaagataatggatatggtggttcatgccagtagaggcatggctggagatcatagccagacagctatgagagaaagaacttgtcgacacaaacaaaataaatatgaataaac

SEQ ID NO: 31833 - DNA, 1152 bp, Mus musculus
caagacattgttgtgggttatccaccagagaagactgctccagtggatttgggtttgagccaatagaaagatatgaatttaagccaatagaaagtctttactagccagctggcaaaaatactgggtgttcaggatctcagcgtagagccgagcctttctcaggttgaggttttaagcacaaaaccatgtcctgggttgacatacttcagttatcaaaaacagttagacggaagcacaattaccgaatccaaaaagcaaggttagtacactcagggactttcccagaactgtggactttgttctcattttggcatgtggcactgcctgtgtgttgagttttaaggcctgaatggcgcttccacaatagaattagttgtgctaaagtctggggcctgtcatgacatcacctggaatctaggagagaatggggagtttcagggacatttgaatagccagaaaaggagggtagggcaatctggctagaccggtagaatgtttgccagatcagacacgggatatcaattctaccagagaccgtagtcaaattcctgcccagtactctggatgtcaaagtagaaatatccaatgttgctctggtccaatgggagtcaccaggactcaagagaccagctgtgtggagtggtgtcagggactcaaagaagcctggccaaaggagtggaggagagaatactgtcacaagtaacatttctaatcatttttttctcctccccgaagcaacaaaaataacggtaaaatcaacggagcaaggacattgacgatgacaggtggttaaaagccacatcaaggagggcagatctttacagtctcatggtccagattctctgctcataaacaaagtactactgtgtgcttgaccatagaggaagtgctcaacactgctttaaatagagaagaaaatgaccaagaagtaaaggtttaggcaggtgtggtggtacgtgcttgcagttccagcaatgggacctagaggcaggagtaccaaggtcttgtttgggctttatggtgtgagttcagcctgggctacatgagaccctgtctcaaaaactaatttaaaaaaagagagagagaagaaaactcttgagcaatcactagtgtcccagtagttatgccccaccccttgcttaaaaatagggg

SEQ ID NO: 31834 - DNA, 1287 bp, Mus musculus
gagattctggtcaaagaggacagatactccagggtaactgtccagcccgagaacccctgtgaccggctgctccgctctctccatgcctcgctgctggtggtaaccctcaatcctaaacactgtcatccttcttccagaaaaaggagggcggccatctctgtccccaagggtttctgtaggaacttctgccaccgtcatcagctgttcatcaacttccaggacctgggttggcacaagtgggtcatcgcccctaaggggttcatggcaaattactgtcatggagagtgccccttctcaatgaccacgtatttaaatagttccaattatgctttcatgcaggctctgatgcatatggctgaccccaaggtccccaaggctgtctgtgtccccaccaagctctcgcccatctccatgctctatcaggatagtgataagaacgtcattctccgacattatgaagacatggtagtcgatgagtgtgggtgtgggtagtctcgggactaggctaggagtgtgcttagggtaaatcctttaataaaactaccaccccacctttggcttatgctctcttgaatcggacatgtctgtcatcatggttcatgagccccacaattacacacatttgtgtatgactatggaccccttggtgagcttacttaatttgtgctcattatgcatagtagctgggcttcttgttcttgtttgaaacaaggtcttattatacatctttgctggccttgaactcatggcaattctctttcctctacctcctgtgtgctgggattacagctgtgtgccaccaggaccaaaaaaaaaatttttttttttgaaacaggaaacatggtctctataccaggctgtcctataactatgtagaccaggctaacctcaaacgcacaagagatcaaactgcctctgcttcctgaatcctagaattaaaggcctgccctgtaccatattatatccaattgtatatcttaagattttaaaattattttgagaaaatataacatagaaaaatttacgtgagctttaaaaatgttcacttgtttgttttatgtgtgggtgcttgtgtaagtgcacggtgtacatgcaggaacccgtggcggccagaagagggagtcagatcccctgaagttacaggtgatcatgcgtctcctccatgtggatgctcaagtgggtcctgcacaagagcaggcagcgctcttactgctgagccagttcttttttctgtgtaatcctggcagtcctggaactcactccgtagaccaggctggcctcgaactc

SEQ ID NO: 31835 - DNA, 1240 bp, Mus musculus
tccaacattttatgtatctgtaatggtttgtatatgactggcccagggagtggcactatcaagaggtgtagccttgttggaataggtgtgtcacggtagggatgggcttaaatgccctcaacctagctgcatggaagtgagggtcctcatagcagccttcagataaagatgcagaactctcagctctgcctgccccacgcctgcctggatgctgtcatgtcttgatgatactggactgaatctctggacctgtaagccagccccaactaaatgttttttgtaagagttgccttggtcatggtgtctgctcacagcagtaaaaccctgacgaagatagtagccagcatgaccttgaacttgtgctgcttgtgcctccaaccccttaatgcttcagttacagcgctgtaccaccagccctccttaaatagcactgggatccaccctagggtttcatgcatgttagacagtttgccagtgacaactccggcatgcaagtgtattcattcaaaaagagaaggacagtacttccttttccgagtaaccgccaagatggccgaagtggagcagaagaagaagcggaccttctgcaagttcacctaccgtggcgtagacctcgaccaactgctcgacatgtcttatgagcagctgatgcagctgtacagcgcccgccagaggcggcgcctgaaccatggtcttcggaggaagcagcactcactgctcaagcgcttgagaaaggccaagaaggaggcgccacccatggagaagcccgaggtggtgaagacgcacctgagggacatgatcatcctgcccgagatggtgggtagcatggtgggcgtgtacaacggcaagaccttcaaccaggtggagctcaaaccagagatgatcggccactacctgggcgagttctctatcacctacaaacccgtgaagcacggccggccagcccgggatcggtgccacccactcctcccgattcatccccctcaagtagccgaggccagtaaagactggttttggtccctggggaaaaaaaaagagagaggagaaggacaaaaacagaaaagccaacacaggctggtgctcagactgacttccagcttagttttagcaagtcaagtgtggaaattattaaaatttgagaagcaaatcttccacaggacaattgaagtttttacgttagccaaagattttgtctttgtttgtttgtggtttgattttctgagacagggtttctctgtgt

SEQ ID NO: 31836 - DNA, 1368 bp, Mus musculus
tcagaatgtggatttgaaagcccagtgtagctcttcttcttcttcgggaaaacaccaaatggcggatgacgccggtgcagcgggagggcccggaggacccgggggcccaggattaggaggccgtggtggcttccgcggaggattcggcagcggtattaggggccgtggttgtggccaaggccgtggccgtggtcgaggccgcggggctcgtggaggtaaagctgaagacaaggagtggatccccgtcaccaagctgggccgcctggttaaggacatgaagatcaagtccttggaggagatctacctgttctccctgcccattaaggagtctgagatcattgatttcttcctgggtgcgtccctaaaggatgaggttctgaaaatcatgccagtgcagaagcagactcgggctggccagcagaccaggttcaaggctttcgtcgctattgaggactacaatggtcacgttggtcttggtgttaggtgctccaaggaggttgccactgccatccgaggagccatcatcttggccaagcttttcatcatccctgtgcggagaggctactgggggaacaagattggtaagccccacactgttccatgcaaggtgacaggccgctgtggctctgtgctggtgcgtctcatccctgcccccagaggcactggcattgtctctgctcctgtgcccaagaagctcctgatgatggccggtatagatgactgctacacttcagccagaggctgcactgccaccctgggcaactttgctaaggccacctttgatgccatctccaagacttacagctacctgacccccaacctctggaaagagactgtcttcaccaagactccttatcaggaattcacggatcatcttgtgaaaacccacaccagagtctctgttcagaggacccaggctccagctgtggctaccacataagggtttttatatgagaaaaataaaagaattaagtctgctgataaaaaaaaaaaaaaagaaagcccagtgtagtgtagttacacgtctctgcccgtaactctggcattgaggaggtagaggcaggaggatcacagaaatttcaaggcctgaatttaaaacatggggttaataggtcaccaccacctttaaaaagcaaaatcggtgtcttgggggatggagatgactaagcagatgaagcacttgctcttccagtgctgggtctgagttcaaatcctcagcacggagtcgggtgctggtggcacacacctttaatcccagcactcgggaggcagaggcaggtggatttctgagttcgaggccagcctggtctacagagtgagttccaggacaaccagggctacacagagaaaccctgtctcaaaaaacaa

SEQ ID NO: 31837 - DNA, 1174 bp, Mus musculus
atggaagaagaaatttatcgtatttcaaatttggttttggtcatttctttgagatagagtttcacgtacccgagactggcctcacagtctattgctctagctggtcccaaactcctgatcttcctatttccacatcccaagttcaaagtttgccgatcagtccttgtgctcacagataagtgagtgaaagcactctaacccagcttaagtcggcttctgtgtataagcagagagggaagggccgtcctctcgtaacatctcccatgtgaagactctaccacagtgagtattggtaggagtggttcttcctgggttttattctacaaaagactaagcttgaatggctctttttggtttggggttttttttggggggggcggggcggagcgcgggggttggtggtgtttgtttgagttttgttattattctaggcagggtttctctgtgtagccctggctgtcctgggacttgctctgtagaacaagctggcttccaactcacagagagccaactgcctctgcctcccatgtgctggcattaaaggcctgtatgtgccaccactgccgccatggccaccacagccaccatactactactgtctccactgccaccactgtctccactgctaccactgcaccacaccatcattgccaccactgtgccatgccaccaatgccaccactgtgccacagcaccactgccaccatcgtcaccactgtctgcctctgctgccacccctgccaccattaccaccacttcccttcttccactgccaccaatgctaccaatactaccactgtcagcactgccaccaagccaccattgttaccactgcctctgcggccaccacggctgccactaccaccgttgctaccactgtgccaccatggctaccactgctgccccactaccattgccactaaagcctgcaatgcctccactgccaccactgccacctctgagccacaccaaccctgccaccaatgccatcactgccactacgaccaccactgcctcaactgctgccacactatcactgtctgtcaccactgccaccaaggcctccactgctgccaagaccaccacggccactactgcctccattgcccagcctgactgaacctctttttttttttttttttttttgagatttttctctttattctgatgaaca

SEQ ID NO: 31838 - DNA, 1619 bp, Mus musculus
aagcaagaaacgctgagtgctgaaaggaaagccgtgtataaacagagactttggcagcaaggtctgactctttcatgtctgtagaaagaatggaagaggaaactcagatcccccacttgacctgaaacttcccactagagatcgccagggtctggaggtgcagccgtggttaaaagatgaataaagtgaaatgaggtaaagcctctttttgggggggggggatgtctttagatcagaggatgccccctaagctttccctccctcccagtctgggtcaccttacagcttcttttgcattacaatgtccatggtggaccctgcaggtgggattaactgtgaattcacagggctggtggggcgtgggtgccgcctgggtgcctgggagaatagggggtgggtagggtaggaggcttgaggggggaggagcaggacctaccctttaaatctatcgccttgagccgttggccttcagataggctgatttggttggtgtcttgctctttctgtgggaaggctgcggctcacttccttctgacttcttgataattttgcattagacatttaactcttctttctatgatctttccttctagacactgagttttttggttgttgcctaaaaccttttcagaaatcccttccctcgccatcacactgacatgagtgtgggtcttcctggtccccacagtttgcctagttctgaggaagcatcgaattctgggaacgcctcatcaatgcctgcagtttttcatcccgagaactattcttgcttacaagggtctgctactgagatgctctgcacagaggctggtaaggaattcagtccccgaagaacccagtaaattagggtaagagtagaaaaaacgggctgaagggttattgcttctttatgaaccgtagtagtcattaacataagcgggtgtccttatcactcttctggaaacccctctgagtttgaccggtgatacgttggccttctagtctgaaatagagatccgggacacaggacggagcaatataaggctcttgtgtgtatttgagaacctaaatatttgggctctttggaatatgttcgggggcagtgagtggtgtcttcagtagcagggagacctaacatcctagcttggaatgagcaccccatttttttggtgaggttatacagttagtttgcaatttgcccaaatggccgttttctccagcagaagcagttagcatttctctcaacctttgggaatatggatgtcacttagcagttctgggtttgtgagctcagtgctccttccaaaccccaaacaagtgtacacagtttaagtcattcattcttatagctagcatctggagccaaggtctgaagctcattgtctgtacagagtcagcccagtactcaggcttgtaaatggtagaaccaagaggctgctaggctgtgtgtgccacggtgctcaggtgcgtgttgtgatgctcgggtgtgtgcagcgatgctcgggtgtgtgcagtgatgctcgggtgtgtgcagcggtgcttgggtgtgtggagcgctaggaagtgtgtgtccccttttttctgagcttttaagttaatgtctgtcatcttgatttttctgatttatgggttcaattttt

SEQ ID NO: 31839 - DNA, 1969 bp, Mus musculus
tggaagcctttccatgtggggcagccagacttggaccaacccaacttggagcagccagacctggaccaacccaacttggaacaaccagacctggaccaacccaacttggagcagccaggcctggaccgctcagtcctggaacggccagccttggaatgctgctccgctccataacttcggggaggactttctgcagccttacgtacagttgcagcaaaacttctctgccagtgatttggaggtgaatttggaagccactagggaaagccatgcgcattttagcaccccacaagccttggaattattcctgaactactctgtgactccaccaggtgaaatatgagacttacgcaacatctgggcttaaagtcagggcaaagccaggttccttccttcttccaaatattttcatattttttttaaagatttatttattcattatatgtaagtacactgtagctgtcttcagacactccagaagagggcgtcagatcttgttacgtatggttgtgagccaccatgtggttgctgggatttgaactcctgaccttcggaagagcagtcgggtgctcttatccactgagccatctcaccagcccctggtttatttttttaattattatttgctttttgtttatcaagacagggtttctctgcatagctctaattgtctttgaactagctctgcagaccagcctggccttgaactcagagatctgcccacttatctttgcctcctgaatgctgggaccaaaggtggcataccaccacacctggcatatatattgtttatttctatttctatttttattggtgccagagcaaacctaggacttagaacatgctgggcaccaactcaacttctgagctctatttacaacttggtgtgttagtgtatttgtcttagttctgaatttgtcctttttttagtgttaactctaggctttggagacagtgaggtgcatatactctctccttcccaagaataagtgcttgaacacccttacccacgcccacccacccatgctagtcttttttcttagaagcgtgggtcttggtatacactgtgtcattttgaggggtgaggtttaaaagtatatacaaagtataacgatatggtggctactctcgaggatgagacagaaggaccaggagtttgagggtagctcagatatgcaataagttcaaggccaacctgtactatgtttaaatagtaagacagcatctcgataaaataataaaactaaagtctcaacaaaataaaagctttcacctattaaggtgcttgcttgtccttggagtcccccaagagtaactgctatgttaatatctgtagaaagatgtttatatttgactgtaccatgatgaaccgatgccagctggactagtttaaacaaaataaaacactaattttacctttagtggtcttatcttttgtccagtggggtcaatatactttttattttggtatgtgaaggggagggtcttaaccgagggtccaggaaaatgggtttcttttggcttaaccggttgggagggttataccacaacagttggaatggcctggtaaccagagcaggaggccagccactcacaatgcatccagtcaagaactggagagcaatgaataagaaatgaatgttttagtgtgggtatgggccctgaggaggccagaagcattcgatgatcccctggagatgaagttacgtgaagccacctgatcacctgatgtggcaggctgcagggaaataagctctagttctctggaagaacaaatatttaactgggagagtggtttttattcctgtgaaataatagaacttgtggagagagcccctgaggtcacacacctagtgcttctgggaaagaggagggaccacagtctcttgtttttgtgtcacactggagattaatctgggacttcctggctccagatggaggctatcttccctgagcataaccccctaac

SEQ ID NO: 31840 - DNA, 2480 bp, Mus musculus
gactgcttctgagtgctgctattctcaccccacacactccatgaaaactcagctgcacccaatgctggggttgaccagatcgccaatggcttttaagtgtttgatttgggggatacttcccttgtaatcaggaaagaccaaggaagcctacctttatattgggagggaaggggccgcagctccccttaggttctaaaacccgctaactaggacaactagggagtaggagtagggtgcagcaccgcccccaccaccaccttagtttgccaggaaacagatcttcatacccagtgtggagggccctgggggattgaacaaaagaccccctcctcacttgatacagctctgcacagcaaagtaacttgagttttatttattttatcttcaggttgaattgcataaatatttatttttttaattgtaattttaccaaataatgagacagtaacgaaattgaggttggagggaggtgtttaaagagaggttcaggaggaaagaaagtttggtgctggagagaggttacaacagggaggatggatgttactggtggcctgtgagtcacttcctttgtagatgaagggacactatcccttgttatttctcagaagagcgagtgcctgtactaaaaggctcatggctttctgtgggccttttcttttaagattatagtttttatgtagtgttactaaaatctaggcttgttactaaagtggtctttgtagttagtgatattgatggatttttatgttgcatggagtccagacaagggaggggtcaccgcaagcctctcctttccctggaccaacaccctctctgtcctgtgagctcgctttttcttttctgatggtcaagcccattaccaaacgggcgggcgagcgagcgagccgtgtggatgagacacaaagacagtagttgttgagaggcattagtttcttcaacttagtttttttttaagagattttaggtgttggtttgtttcattttggtttaaagggattcatagctaacttggattttgttacctcagctctgggagaggattttcgctggatgactattaatgacttgttttgagggagtacatttgttgctctagagttgtggcatgctagcctatgtctgttacagtctcaggctgcccttgtttccaggttcctgtgctattgtgctacatgcccaaggggccttggctctgctacacacattagagacagtgactgaatgtgcagtgtggtccacgcatgagggcacaaatgtctgtgcattgtcactttgctctgggcatgaagtccctggtcccttggctcctgtagctttttattgatcgactattagaactcaaccctgtgtacagaagcagcactgcctctgctaggtggagcttgcacccaggattagatgccacccattgggttccctgtccctgttggagagaggtgcttccttgaggtctgaggttggaaggctctacctcactacagctaggaggcgcaatggaaaggtgtgaggtcagggctgtggctcctgaagacccagttgtgggccaagggtggctttatttaaagggagttaagaaacatggcatattggtatgttgatatcaccaagattcccttctgccataggtcacagacaccttcccaactgtcccctcctccacttccataaatggagacaaccctgatggacctcaccccttttccacaggtcactggatcccactgtcaccctcggtgcttacacatttcagaccctttaggcaaacccttgcatagagtggtagagccatatctcagtgctcggtttcagtattcaactctccactccctgtggccagttgggatttaaaaactcagattgctatggaaaggggctttgctgggaaaggcgactcctctaacttcacctcttcagttcctccagtggagtttttacatttgccaatggccatcttgtgaatatcttcatacatactttctattaatgttactgtagtttctgttttgaaataaaacttctgaatgtatgtgtcatgtcacaagcttatttttccccctcttgttctttctcattgggctttaaaaaacaaacaaacaaacaaacctttaaatcctggctgtggatctgggaacatagctcagttggtagagcatcctttgggctcagagtcatgggttcaatccccaaacctccagcactgcacaaaccaggttgtagagcatacatgtaacccaaagcactcctggggcagagacaggctctgttaaacagcacatttgagaccaactacaacctgcacgagaaggcttttttccatgttgctcttgtatctttcccaggcttttacacagatccgtgtgaccaccactctcctagagatgcacaggctgctctactcctagtgcagtgcgatcccttccagcgcacttgctgcctttgggttggtttgccttttgtttccagcccttgttcctataaaa

SEQ ID NO: 31841 - DNA, 1184 bp, Mus musculus
agtgtcctcaggcttggtgacaatcacctttatcggctgagccatcttgcaagccatatctaatttaattcctagcagtcatctaggaaattaaggccagacattggctgtgacagaaatcactctgccagccgggcgtggtggcgcacgcctttaatcccagcactcgggaggcagaggcaggtggatttctgagttcgaggccagcctggtctacaaagtaagctccaggacagccaggactatacagagaaaccctgtctcgaaaaaccaaaaaaaaaaaaaaaagaaatcactctgcggtagttccactttacagatgttgccatggtcttggtacagagtgagaagggtgaggcctgtagcttggattcagaaacgctaggctttttactcacaagcggagtgactgcagctttagacagcagctctgaaaatggatcctatgtcataccatgcatttaaacggactttgcttgcttgctttctcttgcaggatgactatgaagccatgagctttgtctgtattgtggctatcttgatctacgtagccttctttgagattggacctggccccattccctggtttattgtggctgagctcttcagccagggcccccgcccagctgccattgcggtggctggctgttgtaactggacctccaactttctggtcggaatgctcttcccctcagctgcagtaagtaaattcaaaattaaacatggcctctcacaaaccagccgactgactccaacacattattaagattcaccttaggggaaatgattgtgctaagcgcttaaatcacacttactgcttccttgtcaagaaaacaggatgggccagcatggggctcacggctgcaatcctagcacttgggaagctgtggaaagagggttggccagcctgggctacaattgagaccctgtatcaaaacaaaacattaagagggaaaactggacatttttgaggacctgagatggggtaggaacagaaggacagtaccaagcacccaaacttatccgaccaatattgaaatcatcatttcagtcagtactgagagccgagtgctcctaaagggtaggtggtcttcaggatttcctgttagaaaaagacgtggagctgatttgttatataaaccattccctattcccatgagtctttctacacatctgtatttgaa

SEQ ID NO: 31842 - DNA, 1038 bp, Mus musculus
gttcaatgcccagcaaccacatggtggctcacaaccatctgtaatggaatctgatgccctcttctgctgtgtctgaagacagctacagtgtactcatatacatgaaatgaatagaaaaaaaaatttttttaaagaaagtgatggagctgggtacccttggtgacagataccttcttataatccttgcactggagaggcagagactacaaagtaacacttgttatacccctactcccaccaacctcaccccaccaccaaaagaagaaagttaactaaatagtggggctgagccttagaaggaaacaggggaaccatgggaggtagagggtgcagaggccgagtgctggccaaggatgccagggctcattcctgggagcaaccagtgatgctcttctgtccctttccaggtgttctattactcaacaggaatcttcaaggacgcgggtgtccaggaaccgatctatgccacgattggagcaggcgtggtcaatactatcttcactgtagtttctgtaagttgagtagttcggattgaggcatggggatgagagaaacaagaattctttcttgaagtgttcaaacataacctgtctttcaacttctcacatctagttaaaaccattttattgctttcccctgggagaaataatagtggatgatgagcatactaagccatcttcagtcactcagaagctgtggaacgggtgggaaaggggcagtgtggacagactaggtgtgcctggagacaagacagggtaaggcagcagcgccctgtacacagaatcagcagtgtcttccttgccttccagctgttcctggtggagagggcagggaggagaaccctgcatatgataggcctgggaggcatggctgtttgctccgttttcatgacgatttcgctgttactaaaggtgagcactctttgagtggaggaatgtactgggtgggtgaggctgtagtttactctctgctgtgggggctggggtattgaccttcaaggtcatcaataaagtcaaatttgagatttccaaaagtaca

SEQ ID NO: 31843 - DNA, 1102 bp, Mus musculus
aagagttttaaatttttttcccctcttaatggtatttgtgcatcttggctgcacactcaggagtcccagggatacctcgtactctgagacaattaagtgggtccctagggcatgggaactatgtgtcgacattttcccagctccctttatagtttattagtctatttgagcaaagaatctcacaggtccgctgggcatggtggtgctcaggaggccaagcaggtttggggctaacctgggctgcacagcgggaccttttaccgccagaatcccaaggcccctcagccactgaaggttctcagggctagtctcttctgtctcagctgtgtcagtggctctgctgccagcttagcttataaagcattagtcacaccagtttcagtactgattagtactaactagcccttaactacttgacacagaccttttgaggattcaggaaaggattaaaaaaaattgtcctaaatatccgaccgtctttgcagtatgagttctgtaatgaaatgtgataaaatggggctggcacggtagctcagtacggagaagcctgtgtcatgaagccgatgacctgaggtgtgtaagtcctcgggatccacataaaagtggaaagagaaccaactccagccagccacaaaggttgtcctctgaactccacatgtgccctgtggcacactggcacctggacactcaaacacaaacacagtacagaataaaaagaaaccctaaggtatagcgaagtggtgaggagggtccctcaagtccacaagcccacagcagcaaaaaggaaagagattgacatctacggaggcttcagaagagcaaaaggatgaggagagacagacaggggatctctctcgcgcgcgcgttactaaccactttgtctttaaccttgcagacgcaactctatgcttctagtcaacttgctggccatcattgcgggctgccttatgggattcgccaagatagcggagtctgttgaaatgctgatcctgggccgcttactcattggcattttctgtggcctgtgcacgggctttgtgcctatgtacattggagaggtgtctcccactgcccttcggggtgcatttggcacactaaacca

SEQ ID NO: 31844 - DNA, 1659 bp, Mus musculus
atggagtctggttctgccctctatgctttgaggggtttgggtctgttatgttttatgttttgagacaagatctcactgtaagcctggactagccatgaactcaccgatagtattccacaaccctgcattcaccgttccctagggcagtcagatacctgtgtctatctggtgacgtttttggttgccttttctttttgagaaatttagttcaggcggactttgaactcaggatcctagggttctaggattacagttgttcaccaccctagtccggctggtgaaatggtcttgtttttgcttttcggtttttttttttttttgtttttgttttttgagacagggtctcactgtgtagcctggctggcctggtactagctatgtagatgaggccaagagaattgacttaaattcctttttaggtctttctctccaaatgcgcctgaaatcctggcattctaagcaaaggcaggagaaatgccttaagatggactccaagcaggcatccttgggaagggaaagaatgtcactggtcaaagtgtgtaagcatttccccttgtctgcttgctctccaggtgaccccatctctggtgttcgccgtgactgttgccacgatcggctctttccagtttggctacaacactggagtcatcaatgcacctgagacagtgagtgtgccgaaatgaaaagggattgcaaactgagttttaagtaggactgggactttaagatgcctggctaaggtgggggagggctagcacactgtggaagaagctaaggcaagctctttgctcctcaggctctgccccctcaccgagttgtgatccttttcctatattattctttagggattcctaagaacgtgggaagtcgtgactgggtggggtgcccctttgaacatctgtgctgccacctactggacgtttagggtgatgcccttttcaaagcacgtgcctttcctccctcctgatcctggcctctaaggaagccaccctaggatttgcctactactctcatcgagatttaatggtctgtcctcacactgtgcattttttcgtgcagatcctaaaggactttcttaactacactttggaagagcggttagaagacctaccaagtgagggactgctgactgccctctggtccttatgtgtggccatcttctctgttggtggcatgattggctctttttctgttggactctttgtcaaccgctttggcaggtactgagcagacactgggccaggagtctgcctgcactggttacccgaaagacagcagagcacatcgggtcagggggataatgctgtgtgggaacgtgttgggttatccttggggaaagctagtccacctgcctagagagctgcgatgtgagaccttgctctcggaagttcccattttagctcccaggctggtttaattttgctagagtgaggtcagcaacggagttccttaaacttcttttaaggacaaaggttgcttctccctcccaccccacccccaaggcagtcactggctaactgtgtagaccaggctggcctctatcaaactcggaggtccagccgcctgcctctgcttcctgggtgccatgacatccagccagaagttatttttgtttctgaaatttttggagacttcttggaagtcttttcattattttat

SEQ ID NO: 31845 - DNA, 1185 bp, Mus musculus
gtgtacttcacttgatccttcttggagcctcaagtcaagaaggctgccttcacacctggatgcgttttcttggactgcctcgcctttccctccttcaaggcgagtacacccagcctataatgaaaacgcattatcaattctctgcttcctgctccttggatgactttcaactaaaagcagcactgactctactctgcgtttagactgattccatcccgactgccttcaaatttgcccgccctccaaactttgttttagtatttttttctgtgaaacaaaaaggctgtcggctcttgaaaaggggaaggaatttggaagcgctttgaggggaaaaaaaaaagaaccacgaggaggatgtggtaaaaagcaggagggggtgggtgatggtggttgattgcaaaggacaggggctgggggtggagcggtgaagatcagataagaggtcactgaattcctggggtcacaggttaaggattggggggtgggaggttgaaggctccaccccttgcagagattataaataggtaggctgggcttcgggctgtgatgctttcggtgatagtccttaagccttctgagagcggcttctgtaggacccgaggaacacttgctgccgagaacattggctggatacctctagatctaccttaagacttgagaactaggttgggaccatggggacaacgaaggtaagagctggttgtttttatttgcttgtttggggtcctcacggaggtaggtcgtggtgcggatcgccgtgctccggtttctcctaagtcaccgagccatccggacggaggccttttcttatcagctccagcaagcaattcgatactagtgttagcgttctaggcatctcctacctgacgaggatcctctcggacaccttcttagcacgtgaaagtcacctcagaagctgtttgcctctcgggtgtgtttgaggtagctgtgatgagagcgaagagggtaggacttggccgcgggggtctcggagccagctggaaggcttgggaaaggcttagaccttgagaggacgtggggttggcttgggtttgctgttcagcatcccgctatcggtccttgggttcccggtactgtggggagggaagtccagttgtccttactatggttgtgagtgcaggatgtatcggagttagtgtgggcggagggaggaaggcagtattt

SEQ ID NO: 31846 - DNA, 1145 bp, Mus musculus
gccagcagtttatgagtgtttggtgtgtgtgtgtgtgtgtgtgtgtgtgtgtgtgtgtgtgtgtgtgtgtgctcggtgtgcaagcctggtgcttctggaagccagaagaaagtgtcagatcctctggaactacagttacagactgttgtgagctgtcaaagttctgtaagagcttaagtgcctcagcgtgctccagcaccatcccccaacttcctggttttgttttggttttttttttggggggttttttttttggggttttttttttttttttttttgacagtcaaactggccttgaacttggaatgtctctcaggctgtctttgaactcctgcttccatctcccaagggattctagttttggctaacatgtctaacttgatcacacttttgtgtgtgtgtgtgtgtgtgtgtgtgtgtgtgtgtgtgtgtgaatggaaaacatttaaagttaccagggttcttttcctttttctttctttttttttgggggggggggtgagggtaggatgagcctcccttggaaatcaggctattggatttttagttttttggcttttgaggtagggtttctctgggtagcccttgctgtcctggaacttgttctgtagatcaggctggccttgaactcacagagagcattcaccacaactttgcagcttctattctggatttttaaccatttattagatatatgacttacaactattttcttccattttgaaaactctggtttatgctgctgattttgcctgttgatacggaagtgttgctgaggttgatggcgtttcattgtttatatattttattcagttgcctgtgcttttgatgatagaggcaaaaaagtaatgtactgttagacttaagggtcagatgacctctgaggctgggatgtagcttggtggtagatgatttgacgtatggatgagtcctgggctcaatcccaggcactttcaaacaacaacgacaaacaaaacagaagaagaactctcggctctctgtgatggccgcatccctgctgttgtcctggacagcagctggcccactgcacgtgaggagacagcattgccccgtggacctgcgtgcccagctgggcctgtggtgggcatgctaagactggtcgtacatcactttggcgatcatct

SEQ ID NO: 31847 - DNA, 1242 bp, Mus musculus
gtcccttaaccctcctcaccaggggatctgcaccccacctccaccctcaaacgcttgggagtcctggggaaattttaattctttggtccattgtttgaataggttgatagctaaggggaggagctggtgtctctcccagattatctcctcctgctgggtccgttacaaaagcctacagtcgctcgaatgccaccgaacaatgaccgggtaacctcagtgagagcatgctgcaggagaatgttctaagagtaaatttgcactctgatgattgcagtggggtggcacggagacaggagactgcaggcatcaaaaattagtcatctacccgaacagctggaatgggtgaacgcttttgcacgcgtagtatatgtaaagctgactgaaataaaaagaagcaggcagcgtgggaaacgtgagcgacctggtgtgctgcacgacgaagccgaatggcctgcggcaaaatagatggacaggtggggagactgccgggcgcaggtggggcattcgccctcgccctcgaggcagactctggcgtaacctgctgctccacagagatgcctcggattcctgacaactgcactttctcagccccatccggtgggcgctggccgaccccgcccggcagaagggacgtgcgtattggcacggcgcccggcagcccccgcggtccctgagtcgcttggatctgcctccccagctcgctgactcattcgcgcatcctgcagtgttccgctccttcccttggtcctcacgttcccttgacgtttttggttgacttgtcgggaggaggcgggggtgggggtattaaaaagaaagaaacggactgggaaaggcggagggtgaatttagaagtaaaaggtagggtgggctgcagaccaccaggaagaaggaaagggtgggcctgggaaggatcagatgtgtgtgagcatgcgcagagcgttgggtcaccctgcaccatccgcagcgaactgcgccactgtggcacgatcgacgaccgacggaaaagaacagccctgcacattagggctatacattttgtgctacttgctatttaggcgtgcgtcggggtcgaaataagcagaagaaagtagaaataagggctttctggtgcctgcctcgccgtcctaacatccgccgtactctacctttctctgtgccccaaaccaaggaagcacgtgaacgctgcttgcatgcatttaacccttaatgacattttaggactttggatagacatgttcttca

SEQ ID NO: 31848 - DNA, 1246 bp, Mus musculus
ttctcccattttctgggaatctcaaaagacaaaaggaagccattctcactcctagtttcttcatgtcatagacatgctgtggaaacctctttccctcctgtcacagcagactcatacctgtgatactgctgacgggaggttggggagaagagagggaactggcggagatgtgggtgggaacctgtcatttgtttaactgcacagggagacgcttctcttgaagtccctgtcggtggggtggaagcttttgattttgacaggcaatgaataattacattcccctgtaagagggagatgaattatacagagacagggcgcagcaagggcaaggcgcactcctaggcacagagtggggagtctccattatcaatgaacggccatgatttattgctgcagaggtcttagtgagggtgtggttgaattcgattcgagagagggaaatctcacttccaccttattttcactaaattttctgaaacagacaaaatgtgtagtgttgacagggccaatctccgtgacttttgttcatatgcttttatttatccatgatttccaagacactgggcttcccattctcacttcccctcatcaatccctttcctttctttagaagggggcttatgtatgagactggtgaagtccagtgaagctaagtaaaggggcaagatggggcagttcactaaagagcactttatttctttgtaaggaaaaaaaaagggagtataagaaaaagtttcctccagcagtgtgcgatgtactggagagcatctggtgggccagtgtatgaagcagtagttcccgctagggaacggggtgtttccctagaggaggcacacacctttgccaggtgccctactagacatctcttgctatgcctcccatccaggtgtagtctccacagcttccctttggtttcctcgaggtctctcccttgcagattaccacctcttcttctaagcacctttcctggtcagatctgtccgcggttggggagctaggctgagtcatactcccaggtgccccggcttctccatgtcttgagaaccagtctccctggtgggcagccagagcagctacagtgggctggagactggagggtggctttaggccccctgaggttctagctctccagggtcaggcttgcagaacggggcagtttaaacctgatcccctctgggcctccgattcccatgccctccatgacgtggaaagggaactacttttattttgttggtccggtattgct

SEQ ID NO: 31849 - DNA, 1585 bp, Mus musculus
cccagaacccaaatcagtggtcagtctttcccgtagcttctctgtgcattcaggctggattcttttttgttacctctgtgtacttgctgtatagccaggggacaatctgctgtttcctgctcataaccaagcaggggagtagtgggaattatcacactgaccaactttgcagagttcagaaggccaactttatgagtgggagtgacctctaacatacgtaagttcttgaacttatttcagaatcatctcatgattccctagttagcaatttcaggagagacaaatgccttgaaactgtcttataagactaaaaatgggcaggctggccccaggactcacaaagtttgggttttcatagggttagatttggagaaagctgtgtcccagttcttttctgtaaggcctccttcaggcttatcccattcagtgagcatcccgtgctgggtggagccccatcaccttcttgtgtgtttacatatttttttcctttgacaagagggttgtgttggtggtaccttactgttttcttgttcaatagtgcagcatctttgaccagtgaatatttctgagatgaagggagtcaaggggctgtgctttccacattgtactccacagaagtgtttaatttcttgcagctccatgtaattgctgcatttgaagcatagcattaatttatactcaccctgtgtttgacctgaagagttttaacttgatgtgtagagcagaaagctggaagcacttagctcccattcagtacccacaatgccttgctgcctggctttgactccttttcataaacatttcatttcagtccatttagcgattcaatggaaagctgctgttaattatgtcagtgtgaaggaggttaagccacagctttctttacctgtgacaggtaggctttgcgctaggctttgatacccagctaggatatcttaaagcaagttcccacccatcactctccagtgtctgtccaccattccttttacagtgctgtgaagagctcccgttgaggttggtgggtactgtcctttgtttgttgggcagtttgagggcagaatgggaggactctcactcctgcaagcacctgcttggatagcacactctggctgaagagggtcctttcaaatatatagttctactcaatgctctccttagctttttctaacttcgggtccattctttcccattgcctcctccccttcccaggcagctctcttcttgcagagccatggcaggacatttaagttccgatacaaacactaagaagaaagtataagatcactagtgactgttgggaaacctattttctcaatcttcctccattttgtgttctttgtattcttaagatgataatatattatgtatttgaattgctgaaaattgaaaatgaagttgaagatatatgtatataagcgtatgctgtattggtgcaataatggtaattaaagatatttaaaaaggtattggtttttcatcttttagtttatgtcctatcccccctcccagggctttgtgcacgttgagggcgggggtaggggtgcgggtgggggaaaaatctttattgctagatatattcctagct

SEQ ID NO: 31850 - DNA, 1151 bp, Mus musculus
ttaaatttaaattataaggttagatgtcattgtttttatatccatcgaatatggtctattacaaaaatttatttgacaactacattcaagcatacaaatacacaatacattctgttcacacatattttcctccctccctcatctctgtccatcctcatagactctccagtctcccaccatgtccctatcatacatttgtctttcacttggctttttctttcatggacttataacccaccatgccttccacgtgggcataagtatgcagctatccaatggggtagcaagaacgcaaaagtgcttcttttgtttttattattacatattttcttcaattacatttccaatgctatcacaagtccccacaccctccccccctcctcactcccctacccacccattcccatttttttggccctggcgttcccctgtactggggcatataaagtttgcgtgtccaatgggcctctctttccagtgatggccgactaggtcatcttttgatacatatgcagctagagtcaagagcttatatggaaccaagggcaatgatcatagtctttgggttttgggggggcttcctaactgccacagtaatttttatatataataatctgtaatacctttgtttaagttctttttaaattgtgttttctctctcactagttcaaacttgtgctttatgtgtgaccccttcatatatcttcaagtttggataacttaccccactatattctctctgatcccatccttttttcatctctctattatgtgattctctacaattctataccacatgtggtctgctattctttccttcattagttacaactttcatattttaaaatctgaattttttatttgaattttctcaagtaattaatagttgtgaaaaattgtgtttattctgaaaaactattttttgcaaaaatttaaaaacacctcattttaatttttcctacttttcaccaaaatcagaatctggtgtccagaatcctccttacatcactgagtgattgagaaaagttcagttttcaaatttgaatagtgttgatagtgttggtaaataccacatgactatgctaacctctacatattgacctactgctagcatgtattagccttatgataaataaatggaacaataatga

SEQ ID NO: 31851 - DNA, 1774 bp, Mus musculus
ctgtgcccttctgcccttctgcccttcctagtgttgctctgctcaccggctctcattcctcttccctacagtgaggctgtggagcactttctggaggctctgaacatgcagaggaagagccggggccctcggggtgaggggggcgccatgtctgagaacatctggagtaccctgcgcttggcgttatccatgttaggccagagcgatgcctatggggcagccgatgctcgggatctgtctgccctcctagctatgtttggcctgccccagtgacagtgggatgggctgccctgtgagtgtctgcttggaggggtccgcgctctgggtgtgactccctctcctcaaacgggcctaccaagggggtgggctgatgaccacaagcggtacgacctctcaggagctgcctcagagtaggggtgcatagctgtgtcttaggtcctacttaattgtagggatgagctgtctctgtcccttggtaattcaagggctgtctacccagctacagatctctttctgttcatcaggccctttcttggtgctgcttcttgggtcggacccaatgacataggggagttgtcatctgccgtttctgatagggtctgccacatttgtaagtctctccttgccccatcttcctgggaattggtaacagtccagcttccttgggcagttgtgtgtaagaggctcccctgagcatctgtgcgacgccagctgggatggatgttaggagctgccctgctcgctgaaatggtgatgcggctccctagagccgaacttggaacaagtgctcgcagctcggtcactccgggagcgagcatggatcttctgtgggtggacactgaagcagcagatgctcatgtggttactgtactgtcctcagggccagggcttgtcactgcaggtggcctggcctatgggggagggaggttcatttgtggaatgagcccagagatgcgacagtagtgatacggtcagcactgcagtcctctcttcttgggagacttggaagtaggaactaaacaaactcttgtagcaacctggttcagaagttgcattcttgccaaattcccaaccaagggagggttcagtgttaccataagccttcttgaaacctttataggggatatcattgaaaacccccttcccctcgattacctccacaaggtgaagatgaagggattctgagggagcagctggagacgtctccactgtttctgtgtggggagatgcacagacccccataaatgactgctaagcctcttaccttgtcttcagtagctaatgatcagattttttttttttttaaactgccatggtcccaaaatcccatcctgaaatttatttttctttgtatgcatatgtgtaaatgatttaaaaataaaactgtaaaatatttgtatgaagaataaactggactgacgtgggtaggttccgctgctgacgttggggtggagggaggcagactgatgttcagatttccccttctctgtcttctagtttctcactggcgtacggttacttagccctctctccaggatgactgggtgccagcgacctgctgcagttatgtactgacactcacttttttctccctcctccctctctccctttctcttcttaaatcattcctgttactgttacaaagggaattgtgtgtgctgtataatcttgactcttttcttctgtgccatggatttacttctgctcttgacctaggctgtaccttgcctggttgtacaggtccacatggttctggagaaggggtgtggggggt

SEQ ID NO: 31852 - DNA, 1203 bp, Mus musculus
aggatgagactggggagggactctgcaatggcgcatgcttgtgtgtgtcctcaaggagaggttctgcctgtggctaggctgttgagctctcgctctctgcttttgtcttctccagtcctaccagaaccagcagacctgtgtggcaggggtggctggtggccagcaagaggaagaggacagcagtgactcggaagcagccgactcccccagcagtgatgagagacgcatcattgagagccccccacaccgctattgaggcgccaaccctgccaagagagagaggcctgccctggggagacaggcactcaggaaaaaaaagggagaacggcattttgagagaagagagaccgaggggggagaaagagctcttcatttggagcagtccttcaatctcagaaccccaggaggccccacaggagttgccctcctccttcagcctgcccctgccttgggctgcccttcccctggtgtactcctgaggtgtctgccccagctggctgccctgggagagtggctggatggctttggctgccctgtagcctacctgtggcagcatactgtgccagccatgcactgtattagggagggggatgtcaacagccttggttgaggtgggaatgcaattgatgggagcctgctgctgtgtccttctctactctgttctgtccgtgagggctttccttctgttgcccctccccctcccgcttcccctaggatcccctcgcctctatttccatttcactctggggatccctgctcctccctcttctcagcctcctccctcttttgtcctcttttcctctcctgcctgagcagtaccaaggtcttactgtctctattcctttctccatggcctgctttgcctgggttgtggggaaggaggaggagggggaccctgggggtgtattatatatagtgtatattttttcaatgttgtcgtgagcgcagctcctgtgtttctgtgtgcagctcacagccttgtatgtgtgcgtgtgcgtggcattgtcatgtcctgggatgagggtagggggtgggtgtggtaaaggagggccgcaccctagggttttcaaataaaacaactagaaaaaagttcttgcttgctgtttacctggctgattctgtgtgactgtgggctttctgatcttaggggccatttaggcctctgagcaggttgaggtgacagggtagggttggctctggctg

SEQ ID NO: 31853 - DNA, 1180 bp, Mus musculus
ctgtatcctagactggcatgttcctcagcatatacgtgctgcttttgagactagtcttgttcatgaactcttgtctgattctagaacttaggtgaccttgagtgatagccataggccttaaaagcttaatgtggcatgacttgtctcctttattgtgtgagatagttatcctgtgtgtgaatgtggacatatggcaatcctctgaaaagctttctagccctacttagtctttctggcttaggtctagagtgggctaggtgataggattcccattgctctcatcatgttctgttctgcaggtagggaaaacttacgagctactcaactgtgacaggcacaagtccatgttgttgaagaatggacgggacccaggggaagtcagaccagacatcacccaccaggtatctgtgtgggcagagctaatgaccctctgagcgaatgctgtttctcaggcttcaccacgcctttccctcttcctttctcagagcctgctgatgcttatggacagccccctgaaccgagctggcttgctacaggtttacatccacacacagaagaacgtgctgattgaagtgaacccccagactcgaattcctagaacctttgaccgattttgtggcctcatgggtgagaagccttaggactaaagttctgactgaactggcaaagtaaagagaggagacaggagaatcacacacccattccttcagtggggagtgactggcaggacggagtccagggaagttcagccccctgctctctgaagtctctctgagggtaaagctgtctgagcttgtcatcggtattagtgaaatccataactgttgtgtgacgtaaaggacacatagcccagtttccccaggctgtgtagcttaggcggaagagtgtcggctcttcccacgtctgaactctctttcccccccagttcagcttttacacaaactgagcgtccgagcagccgacggccctcagaagctattgaaggtaagccggagaaaccttttggtaaggttctgggccagttctggcgctgactcttctttttgtctttaggtaattaagaatccagtgtccgaccacttcccagttggctgtatgaaaattggcacttccttttctgttgaagacatcagtgacattcgagagttggtgcccagtagtgacccagttgtgtttgtgg

SEQ ID NO: 31854 - DNA, 1237 bp, Mus musculus
ccgtgggtctggggaccgcaacgtccggccagcggaaggaggctgctcaccggtgaacacggattcgcggacgccgtaggccaccgccccggcccccagcagcagcttcagcgccgtgcccatgccccgaggcccggcgggcaggcgtccagctaagtccttcaagttctgggccatgtctgatcctcccgaaggcggcggcggcggcaccagcggtcaggagggggtgcccgccagcctctgccccgctccagcttacagacctcgccttgcacacgaggatcggcggccttagagctcgcgggagaaagggcaccggaagtgcgcctccctccggacccgcccccctccgcccgggcggccctgaactccgcgcacaggaatggcgcatccggaagtcccgcctcttggtgggggggaatggtgtgccctcccggagaggcttccgtacgggcatcgccattttcgagcgccctctttcaaaatggcagctcgaaggaagttggccgtgaggacggacgtgaagttctaacttaaggacttcggtgcaacttccggtctgcctacaagatgtctgcggccagtggtggcttccaacctcgtgagcggcgattttcagtgcaggagcaggactgggagactacgccgcctaagaagctccggcttggggcaggaagcaagtgcggaggccggaggctcattgtggtgctggaaggggccagtctggagacagtcaaggtagttttgaacagtgagtgcggaggtagggaattgatggatcagattgtgtgggaaccagggccgcagagtgcatggaaaagcggagccttgaaatttgctctggaagaatgacctagttttccaggctgttgatatcctgggggtagtccttttgctctggactttcatttcagccctcgccttgcttttagttgacttatcacggagtctgtgatgtataatgcaaaatgagggaagcattgtctattgagggttcccacgtttccaaaggccagtgacttccccagccttttactaccaaggacttgatgctttattttgttaaatggggcttgactggcagcttgttctgtatttacctattctgaagtatgtctggatcagattatttaaaaagcctttgtctttgcttttttaccctcccccttaaatatttactttacctttatttatgcatgcaagtctgcatgtggccatgagccacctcatgaaggtg

SEQ ID NO: 31855 - DNA, 1341 bp, Mus musculus
atgcccccaggtgtccctgttgatccgaagagagctgacagagcgcgccaaggacttcagcctcatcctggatgatgtagctatcacagagctgagcttcagccgagagtacacagctgctgtagaagccaagcaagtgggtaagtccatggaggcaggcactggtcggggggcttctggaggtgggaggaggggggctacatgttcttgggcttcttacacctcacacttaatccacagcccagcaggaagcccagcgggcccagtttttggtggagaaagcgaagcaggaacagcgacagaagattgtgcaggctgagggggaggcggaggctgccaagatgatatccttgtgttgcacagagcgtggcctcatcccggggtcagcctgtttcccatcttccaccatgggccggttgatgagaccaaggcgaatgcgacttggcctactgactctttcttggcttgggaatgggggttggggggggggggacaactggtgagatctgaaatcttggtgggggtacctaaggcctgactccctgctgtaaggccagatcaatagcactactggccttgccctcatgtcagctgccacacagtactggcagcatcctgtagggaggcccacagggggtagccaacatgtgagtagccatgtgagcgcaaccttgaatctgacagcccaggggattcgagggcagagggagcttgccaccaatgtaacctggcccagaagaacccttaaccctgtctgctcaccttggagaagcactgagcaagaatcctggctatatcaagctccgaaagatccgggccgcccagaacatctctaaaacggtgagtggaaggcttcaccatccaagggctgctacacagtcacacagtggcattagaactggcttgagtttctacttaaacaatgtctttgggcacccttcctcctgcagagtgaccgaccccacagtgctccccgggttttgtttatggctgttacagagctatgacactaagccttcttgcatcgggtctttgtactagagcaggagcctgttctgttactgtgtcttccactgggtggccattgaatcaaagacttgaagcctgttaacacgtctgttccatgtcctgtagatcgccacatcacagaaccgaatctatctcacagctgacaaccttgtgctgaatctacaggatgaaagttttactcggtaagagatcccactgtccagagagcaaagcacccgtccactaccctggatcctggactatctagttaccagggccgtggacagtttctctgaacaccagtcagaaaagtgggtgtcagtctggttggca

SEQ ID NO: 31856 - DNA, 1180 bp, Mus musculus
ggatgtcttatgggaaaggcactttataaatatctaaatgagaagtgacgactggtagcaatttcacgtgagacccacgttgctgggaccgcacagatagtggcaaagagccgtcctcactggggagtgcgggtctggagcagctgagcctgtagctgactaacgatttatttctcttttcacatatttcctgctcacttcatggcatgctggttgcaggggaaggtaagtggctgcctccttgctatggggtcctgggggccatctgcttcctggacctgcccctacaccccctttctccccattgtcaggcctttatttaggaagaagctgtggtttggggtgttgtgcacctcacacttacatccccgataataggaatgttccctttgttctccagtgacagcctcattaagggtaagaaatgagtgtggacatcaagaaccccaccaccagagaagttggcacacttgtccagcttggaggagccagctcgggggtcaagcacagcccaccctgccccaggcatcatgtgatggacttttctgtatctgccctcttggattaaggaagactgagaccagccctttcagaggctttcctccttcctgtgttggctgggaagcggggtgggacaatgtgatttctccgtgatttcctacagccttgagcctctcccagagtgggggagataaccaccatgccaggaattctcaataaaatttttattacttaaagccaaaaattttgtgtctgagtgtgtacgtagattgcgcgaagacattgatcacactgggactcggccagcagagggcacaagcagtctggcctgtagcattcggactgccgccgggtcctcaacaggacctaagctgggagcagccgatctcaggcccaactacaccttcaccccacccgcaggtctaccaaatgaacccacagacttaatgacatctttttaaaagctgaagcagctgaggctttgctgagccaaactaaaaacgtgatgaccccagggggagctgcttccttggtaaccagctcctggttagctccgggagatggcgtgttcctcccaagggtttccgtgttcctaagtcccggtgtgctgttacttagtcaccaggtacgatgagctatttgcactgaagtttctccctgtggaggaggccttcccacc

SEQ ID NO: 31857 - DNA, 1202 bp, Mus musculus
tgaccacagtcacttaaattacaagaagatgggggtggtcctagggtctggtgagggccacaggtctcagtctatcgggtggaagcctctgcagggatcaaggctgatgctgcaaataaaagagaggaagtggatcaaaggttgtctgggaaggggatacaagagctagggacaccctagcagggtagcgtgagactgtgaccgtgccatgcacgcacgtctgaactgaagttggggaaatgggggcagggagagaaagaacacacagaaggggccgcaccatggccacctgcagacgaatgcccagatcacttcctcttgagagaacctttgttcttctccttgtctgccgaccgctgcttctttactttctcttccttcttgctcttgctatgcacgttttcgtacacctcctccttgtgcctggggttgggaggggacaggaggcatctggagactgtgcagggtgacccagcaccagcagcccctctgagactctcggtatgtgaagccaggagaacaagagagcctgctcactctgtacagtggacccacatggcccggggacagagacggcttctcacacaagtccatagcacgggcccacgtggggtcctaacgggcacttcagggaaaatttaagaacagagggaataggaagaaacttgaccttgaaccagggtttctctagcctccacactaatccactccagaaaaggacagttagggctgggcagtgggggatagagcctaggaaggcaaacagaaccactcacttggaggaagtacgcgaggctttggcgtgggcactcctcacagcgggagggtacgtgatattcccatactccgactcctggcccttctgggactgtgggcaaaggtgcggtgggaggatggtggtaccagcaggactaggtgatgcccacactcccctaccacccaccagccccactccggacacacttgtatgatctccagtttcttcttggtcgtttcgatgaactgggcaatggccacgtaaataaacttgtactgggcctcggtctgcaccatgccggagcgctgtgctcgtaccatctggatggtcttctggatatcaatgtcacagtctagccctggacaagggtggcaggggaacttcagggtagacaaaggccaagggatggcttgcccccctctcacacccacacacactccccagg

SEQ ID NO: 31858 - DNA, 1234 bp, Mus musculus
cagaagctgttgggtccctgtagcttggagttagggcagttaggaattgccaagcagggtgagccatctttgcaacccctctatttttaatgaagcagggccatggagcccaagctggccttgaacttctcagcttttgtgctggtatcacagaaatgtggcgctatgcccggtcgggcctgatgttccagagtctttgcagtgtggggaacttgtaaggatgagactacaagacatcgggccacatcgcctgccactacttaagtccgattcacttcggctttagctccaagcctttaatctcgcgaagctctttttttttttttaacaacataggagctgtgattggctgttttcagccaatcagcactgactcatttgcatagcctttacaagcggtcacaaactcaagaaacgagcggttttaatagtcttttagaatattgtttatcgaaccgaataaggaactgtgctttgtgattcacatatcagtggaggggtgtggaaatggcaccttgatctcaccctcatcgaaagtggagttgatgtccttccctggctcgctacagacgcacttccgcaagtgttacagctcttttagaatttgtctagcaggttttctgacttcggtcggaaaacccctcccaatttcactggtctacaatgaaagcaaaacagttctcttccccgctccccggtgtgtgagaggggctttgatccttctctggtttcctaggaaacgcgtatgtgctagagccacgctctgagacttccgcctcgtgcggtcccgcttcctttctgcctcctctggcctgcatccgtgggggaggtggctggctgcagggttctccggatctcttctgtgttcccactactcaagcaccgagtggcgttctatggcgtccgcctcggctcagcccgcggccctgagcgcggagcaggccaagggtgaggaaagagcctagtctgggtgtgggccgtcttctggggggagggcgcgatactattctttgcctctccaagtggggcccttgcccattagggcgaagggttgggaggacaagcttatcgggttgcttgcaggcctcggcccactaattccctgcctcttccctcctctgggctcgcccgccgtcctccgcggacctctctgggatgcttccgtctcgcagtggtcctggcggaggtgattcaagcgttctcggccccagagaatgccgtgcgcatggacgag

SEQ ID NO: 31859 - DNA, 1459 bp, Mus musculus
aagcctggtgggattggagccttgccactctctggtcccggggcttttctggaaactcaactctatgtgagaaccagtggtttttactccttgaatgatagataggaaggagcttacttagtagctctgcctcctccttctaggcacaggaagtacacgagaagctccggggatggctgaaatccaatgtcaatgatggggtggctcagagcacccggatcatttatggaggtgagtggctttggctctagctaagacggaaatgggctaagacagactgaggctgccttgcacagagaggtggggcttaagtgttctgatcatagacctgaccaaactgtcttcttgttcctggtacaggttctgtgactggagcaacctgcaaagagctggcaagccagcctgacgtggacggcttccttgtgggtggcgcatctctcaagcctgaatttgtggacatcatcaatgccaaacaatgagcactgcccatccctctacctgcctgcatagcatggactaggttgcccagaagtttagtaactgctcccaccggtcacatgcttctgatgacatcatctgccccatcttgtggcctaatccacgctgtaccctcctgagccgtttccaccgccctattatggttgggaccaggccaatccctttaccacttacagtgggtagaatcaactgtcaccaaggtggctcctagtgaggggagggagtagaactgactgtccctttgggccctgacaagtgaaatcaccttccattggtttgggctggaaactcatggttggagcacaggaagtgggcttcgtgtcactttggcctgtcacttagatggccttggctctagcttcactcccaagttctactggatgtctgatgcagaaattcagagctttcgggtctgaattcggtatacatgagaccctaagaggcctgggatagtcccctcccccacggtgccaaagcccctgtattgtgtttgtgaaccatcctacatgtaagggaaataaacacctgggcctgagctttgtgggttgtcataattccttaagacagtgatggggctctagcctggggtgggggagtgtaaaacaaaacaaaaaacaataatgaaacaggttgtgacaatacatctcattttttacttcaaaaacctctttgtcccaggctgccatggtgtttaatatcatttctatatgtcttgctcctgtgagaaggggaggtgaaggggtccagccccccccccccagcttcaccagctttttaaagttgtctaggccagcgggtgcctctccacctgtccccacggtagggtgccagcacaccctgtactactgggtcatttgtagagcagatagcgcttcatggcagggggcaaaggcagagtggatatttgacccagccgggtgtcccccagagcatggcgcacacacaggcggctcaggtgcag

SEQ ID NO: 31860 - DNA, 1328 bp, Mus musculus
tgtctctaaatgaacaatctgaggtcatcaaatgggaaaataagatttcgaagctccatttagatgctagctggatggtagatttggggatgtggcatagaatcagtcgggatccttcccagaagcccctccaggttgatgtggagagcccaccgctcacccttctctgtccctttccccactccccaggtgggtgatctacaatgaccagaaagtgtgtgcctctgaaaagccacccaaggacctgggctacatctacttctaccagagagtggtcagctaagagcctgccctcagcccttccacttgaagcaggggacagaccatctggcatgagggacggctgagggatggacttcagcccctgctctgtaccctttttgtttttgtccccagcagtgggaaggagctggaggtcataggagaatggccaaacaaagaggaggggtactcattagactctggggacagagcagggatgggacaggaggggccaactgcctgtccacagtgggaccttgttgcttccttcccctgccccttgaatccacagtgctctgcttctctgtgatggcccaacccctgatgtggggcgggctcttacctgtgtgtgtgtgtggatgtggctttatgcatctttccaggggagggagcgactgcgcctcccctccccttaagtgtttgctcccttgtggtggggcagaggaggctctgagggaaataggaccctccccacaccctttgcccttctgcctcagcctccggtctgtctttatggtcctctggaaaaatgccaaaatacatgatgtgaataaaagtacgggggctgactggtttcagttctttgggggagacttactagttctggggaggattactggaaggggaaggtttagagaggcccaactggggtcctttgccgtcccccccccccaggcaatttccttttctctagctctagaaatgctcagaaaactgaggtggggggatgggaaataaagggaaaattcagaagcgaggctgcatcacccccccccccccaactgaccatgcacttggtctagccccactgttgctgggcaaatgaaggacctagggcagggtgggcagtccacactgactgatatcagctgactcctttacacggctgcagccagcctgcctccctccctgccccccacacactagtgtcccactctgctccatttggccaaggtctgacaactgcaaggaccccgtaatcaccagcgacgttggtgacacacttggcccccttccttgtgattactggaagggctcctcaaccgtgactttgctttatgctatga

SEQ ID NO: 31861 - DNA, 1464 bp, Mus musculus
aagatggagggaagagaagctagagtcacgtcctgggataacggaggacaagtaaactgtaagccctcgactttaagtccttactctaacaaaacctttcttaccacaggttctaagcgcagcagacgaaaagcaaacagcaaggttctagggaggtcccctctcaccatcctgcaggatgacaactcccctgggaccttgacactacgacaggtaaaggaagaggggggtgaaaattgtcaccaagtatctgtcatgggctggagagatgtctcagcaattaagagcactagctgctcttccagaggtctgggcttcaatttccagcaaccacatagtggcccacaaccactatataaggggtctgatgccttctgtcatgcagccatacatgcaaatagagcattcatacgtataaacaaaaaagagtatccctcattaaagtgggaggccgctttccccagctcttgcctctgcctccctcacagcacccctctggcccctcagctcatgtcctgccttctacagggtaagcggccttctgccctcagtgagaacgttaaggacctaaaggaaggagtcgttcttggaactggaagatttctcaaagctggaggaggagcacgggagccaaaccaggaccacgacaaggaaaatcagcattttgccttgttggagagctagggctgtgctggagtcatccccaagggcaccaaagaaagccctgttctgattcctctcaggcaccaactctggtacttggacatcgttcttttaaaatgttttatgtgtttcctgtatattaaagtagatgattttaaatgatgctttaagaagttagagcaaagctacaccgggtcttgtgtgtatagaatggcatcctaggggcctgtgagacctggatagatctctctcctgccacttctgagcctcctttatgtagcttaagctttgatgtccccagagctctgcctttggccctcttcacttcttgtttgggtttagctattgcttacctgcttgtaatttccaggtccccctctcgacataaacactcaacgttagttcccctaaaataagattcatgatctttccctcattgcctacgcctctccctgtggctggggaaaggtggtcatctcctagctactcaagcctaagcctcggctttgggcatcatattgaacatgacgtgtctgtgaggttgtcactagggcctggtgattatatattcttgtcgtcttctcccttgtcttgtcttgcctgaaagagggagggagggagggagggagagagagagagagagagagagagtgtgtgtgtgtgtgtgtgtgtgtgtgtgtgtgtgtgtgtgtgagtttttgttcatgttagatgattactctgttactgagtctggttccccttgcatctcttaccacctgcctcatccctcgatgggcctctagagggccaggcacttca

SEQ ID NO: 31862 - DNA, 1165 bp, Mus musculus
cctttaaagcaagggattaggaagggaggcgggtgagcctctggaaggggttgaatgatgaaaggggagaagtgctataaacaaatccctgacgttgggcgcttgagcggagtgggagagatgggggtgggaggagagtgagactccaagaaagtcaaagacagaggaacccaggagtcgggcctggatagtgtggtcgggtgagcctggggtttctactcatttccactcaggagtgctcagagaatgatctccagggagaagcagggaatagataaaggctcagggcagctagccgtgtgacaggttgaagagtgacagggcctgtggagctgaagaatagaagtggaagcaaggaatggtcaaaggagctgggggattgagtagtggcgggtgaggactgagacagggaaccccaaatgtcaggagacagacagacgagaggacggtagatgccgggctggagatggagcttttgcgtggctggtagaactggaaggccctgtatattaaaaaaaggctgaaggacctcaatctcaccaaaatgggcacccccgtgagtgagtcatagagaaagacgatggcgctgaccaagttggtgacctgcaaggatgtcttggcagattcagagccatccagcgaggaccgccgcttccctcgagtatcctccaccacaatggctggcacctcaaaagctggccgggtacccaacccccccagcccccctgctttggtgcccacactgccccccgctctccgggcctgccgagccctccggggccgggcccacagtgtctgatagaatgtgatagccacacagaccaaccccatgacaatgcccccaagaagcaggaggctgaagcagacaccaaaaccgaggccgatcttggagactatgaactggcagcctcgggcatagtagcgctccccgttgttgtgccagccgatggagggcagcgtggagaggatgaagctgaccatccagatgcccatgacggcatgcagcgcctgcttcttggcgttgctgaggcggtagttaacgggccatcgcaccatccacatgcgatggtaggagagcgaggcgaccgtgaagcaggtggccagggccagcgtgtagtaggtggacacaaagaccttgcagatgctctcgttccagtcatagtca

SEQ ID NO: 31863 - DNA, 1149 bp, Mus musculus
gagcaagtcaagaagaaactgtggggacagtagaggaagcttaaagatacagctgtagttctaggcagaaatgcttggcagagagagagagagagagagagagagagagagagagagagagagagagaggagacagagggggaagaggtgaagagggggcggtagggagacccgagtctgaggaagtaaacaaggggagtgccaccaccgagaggagggctcggctgctgggaatcagccccctcacactttccactgcgaagcgaaaccccgcgccttggtctgggggggcgggcagtggggaggagaagcagaaggactgggtctggaggagcagctcaagttctagctagctgcagtgggtttgcctgcactctgctctgggtcccagcccgggcctctgatcattatccatcctgctgtctccagtccccactcctggggcgtcctcttcaccctacattctttccctccgcctcacctcctccttgtagaacttctctctctctctctctctctctctctctctctctctctctctctctgtgtgtgtgtgtgtgtctgtctgtctgtctgtctctctctcctcccaggacctttttctaacctcccttggagggctggggaggcccgggccatagaggagatgagggaggacctgctccttggctttttgcttctgggactgctttgggaagctccaggtaaggtggagagtccagcagggacctctatggctgtctctttagctgtggtgatattccaatgcttttgttgaggggaggggtgtgtgtgtgtgtgtgtgtgtgtgttttgagacagggtttctttgtgttgccctggctgtcctgggactggctctgatgaccaggctggccttgaatttatagtgatccacttgcctctgcctccccagtgctgggattagaggcgtgcaccatcactttgtataagggcagatcccaaagctgcctcagcctcccttcaacagggaggcatgatgtttctttcttaggaaagccagggcatttctctattctccaatctcttggctcaatgcccttggcctctcttttgttccactagttgtgtcttcagggcctgggaaagagctccccgtggtgtgggcccaggagggagctcccgtcc

SEQ ID NO: 31864 - DNA, 2404 bp, Mus musculus
tgtgtttgttcttagacccatgagtgattacgtatgctagtgttgggcctgaggaatcggggcggttgtgatgcgagtttcccatcctcacgtattttgaggaagatgtagcaagagccagcagctgaagggagctcccttctgcagagtaggccctcattcagtccctcctcaggagcacatggctgcagggggcaactgccagaccttctcctcctccactgttatctcctactccaacactggggacggcgcgcccaaggtttaccaggagacgtcggagatgcgctctgccccaggcggggtgagtaaggaacccctctatctcagaggaggtaggatggatcggcatccacaggaaccagggtcatctgttttcaggactgggtcgtgggtggctggttcgtcccggggagatgtagccagggctttgtggggagaagtgaatgagcctattcacctcgtcccagatccgggagacacggaggactgtccgggactcagacagtggtctagagcagatgtccattgggcatcacattcgggatagggctcacatcctccagcgctcccgaaaccaccgcacaggggaccaggaagagcggcaggactacatcaacctggatgaaagtgagtgagcctgtcttcttctgggcagcagtccctgagctagttgctgtagactggagcatagctttctctaccatcccacaggtatctcaggcagagctgtgggtgagccctgtgcttaggctctgttgccagcttcagggctgagtcaggtgttgccagggagggggcagagcttgactgacgtcaggtgctgatggttgtagtttcctctatcgggattggtggcttttcttttccaccctttactttgtctttctcaaatgagtgctttattagctttcgtgatgtataactccagtaattgtgcctccccatggtgtgtaaccccagtagttgtgcctcaggcttgccagtggcatccaggaactgtgttgaagctaagatggctcccaacccccattctcccatgcatgatctcaacctttgccctggtttctgatctcagaatactgtggcttccatggctgctctctgtcctctttaggtgaggcagcagcatttgatgatgaatggagaagggagacatcccgatacagacagcagcgtcctctggaatttcgacggcatgaggcatctgtgggtggggggcgaagggctgaggggcctccccgcctggcgatccagggacctgaggactccccctcccgacagtcccgtcgttatgactggtgaaggccccaggctctcagcttctcatgtaagtgcctgagagggaatagtgggaatgtgacagaccagaggaggctggctggcagatcaatgtagttaagctgtcgtgggacaggagacttgctccttctgagtggctggaagatgctcctgaccccagacttctgtgtcctttctctgacaggctcatctttccttcctccaggtgcaggctgagcggctgagtaaccatccttgaaatgactgtcctttccaacctctatcccaatttaatattaaattaacaggcaagctggccccgcctctccctgggtctcagggagagccttctactgccccccttacctacgtttccatcttcacccctcactgcgtgtcccacccatcctgtatccactaacttgagttctcatgttgctgctccatctccaagccgcctcatcttcccgagcccctgccacgcatcgaagggttttggggaaagctctgggtttagggatctccgtccctcagctcccctgacccttgcccacctcttcctcagagccccactgcaggtgccatggtcctataagggctgtggagaaagtggactagttccaattctttgtcccttcccccacccatcacagaaacactttcctttacccttctctgcctttataaaaactaatgatttgtgcaacttgtaactaggtgtttatggaataaaggagaatggaaaaaagtgaagattctggctgtacttttgccccagttcaaccctgctcaatcctaccttctgccatcttggctccacatgtggcccagctgtcttagggtttcttttgctgtgatgaaacgccataaccaaggcagcatataaaagaaagcatttaattgggggattgcttgttgcagaggtatggccatcagggcggggaacagagcggcaggcaggcatgatgctagagcagttggcctacatctgctccacaagcaggatggagagagagactggaaatggcttggccttttggaacctcaaacccagtgacacaccttagtccttcctaaatagtccaccacaactgggcaccaaacattgaattatatgagcctg

SEQ ID NO: 31865 - DNA, 1457 bp, Mus musculus
ggctatccctcattcctttcatcctgataggttgccaaccttaagaaaaccattaaagttacgacagcagctgctgctgcagccacctcccaggatcctgagcaacacctgacagagctgagagaaccagcttctggcaccaaccagcgccagcccagcaagaaagcctccaagggcaaggggtgagcccatgcgggagccacttgtctctgggtaccccacttttacctcagggacctggctgctccactgctttagtcatttgcatggggtcgggagtgggggtgtcctctaggaattaggggaccccttgcatcccctctctctctcttccccttgccagactccgagggagcgccaagatttggtccaagtcgaactgaaaggacttgtttcttccctgggaatgtggggtcccagctgcctacctgcctaccccttaggagtcctcagagccttcctgtgcccctggccagctgataatgctagttcattacttttcatctcctccacccccaagcataagccacaccctctgtagggaggaggccagtgcaggtcatgttctgttggtacctcttatgtgttccatgctcttccccagcacgcttgctctcatcgtttttccgcactgtgtctgcccattacccctgtcattgagcaggttggcagtcctatggagggtgctggctcttaaccacccacacctacccctgcatgcctaatctgcagttcctcctcctccccttgcctagtgggctgcatctgaaaagccatggggaagggggtctccaccttcattccagccttagagttctggagccagtctgctaccctgggagtcgctggacattttcctcccagaaccccatcacactacaattgtttctttcctctctcatctccttgggcctggggatactgctgcttcagtgaccccagagcctgagaacagctatttttgagatgttaagaaatggttctttgttgctcatcatcttaggaagcccaatggaaatcctggaaggatttatatctcctcctgtggttctggtggggaaggaaatatagattgtatattaaaaataaaaaatatatatgaataggtctatatatattgacacatgacacagaaataaatctatgagaaatctatgtacaaaaatgccaggaactgggcctcttctgtctttgatgtttgttaacagggagaagattaatccccagtccactgtaaagccaagtgccaagtgaaaagaaccagacactttgcagactctgggcctagcagctaggaggcctagaccctggacagattgctccatccctcagcccatggtcagcagtcacgggcacctgctgaacaccgccatgtcctaacaatggagatgcagacaccatcactgactgtcctgcccaaggacctgcagtgtggtctgcttcctgtcacctcagag

SEQ ID NO: 31866 - DNA, 1127 bp, Mus musculus
cctgtctctagctgaagccaggaatctccccccactgactgacgcacagaagaataagcttcgacatctgtcagttgtcactctggctgccaaagtcaaggtaagtgacagccttgccagctgccagtccaaagccagagacgacctgttgtgaatccagggagtctaaggagagccattggcctcccctgtctgggtctgaactgaaactccatttctgcagtcacttagttaggagtctgtcagtttgaactgaagttctaagtcatcgtcttttgtgattggggtaaaaatagccactagaaggctggccggctcattcatcagatggagttccaggccaacagagcctcagagctagaactggggtccttctctacttactatagtaagatgtgtgtgacctacagtacctgtgtgcccctgtgggcacagactttttatatcacattctcccagttgttaactagaattgagtcctggtgatttttgctggaattaggcttgtggttgtagattcttccccaaggtcattccagtttgtaacatggctaagtcaacatgataaacagaaactccagacccctcctatctatcctctgatgtcaagctgatcaaaaacagtttccttagctacagccaaagaaatggcaccaggaagatgtcacactcgttctttcactatatagtgggaggtgggcataggagagcatctaccacatgtttttggattgtcctttttgagtctggtgccgtgtctcatgtcggcccagcgcttgggactctgaagcaaaaggattaatgtgaggtcaagtctagcctggactacataatgagttccaagccagcctgggctatagaatgagaccctgtgtcagaacgccatgaaagaaaaggaaggaagattattcttttctggtgatgtttttgaggccgtaatagggttttgctttagaaccaacattttccagaaaatggcttacggataggagtggagggatgtgggcctggacattggggaaaaactggaagaggattctgggaaatcctcctctgcttttgaaccccacaaattccggtctaacctctggacccagtgtatcccatatgcagtgttgctggaggcc

SEQ ID NO: 31867 - DNA, 1229 bp, Mus musculus
gggacactcactaatcccatgggcaagcccaagcgtttgtcctccagtgactggggtctcccattcccacccttgcacattcacatgaaagccttgcacactcacccacaccctcacaggccatagcacagtcacgctctccacgctgctcctctgccgtgtccccattcacgtctgctcagccggctcctagctctctccctcgtgttgcctatgtcctgccccctttacattctctgtgcccatctcagactgggcacgagcatttctggctccaatatatggcatagtgtgcccactctgcctcatcagcacccactggtctagcttctgtggcccttgcatgctgccctagaggtgggtgggaggtgagctaggggctccttgtaccatttgtcatggccccattcacatctgtgtctttccattccattccaaggatgctggtattactgagggctcccccacaggaacgggggtagtgaggcccagttgttaaactctgtcatcagaagtctgggtttgggggagtctcctgctgcactacatgagaagggactcccatgtcctcccttccctcccaagtcccttgttttgtcggtcctggctgtctgtgtgtatgtgtctgtatggaattcggagccccctcaacaggtcctccatctcccaccctcccctaaggcctcccttaatgtacctaggctgccaggaactgaagccagctggttcaaggccattgggagctctgcctccatatccacccttctctccctgagcccctcacgttccctcctcccctctcccttttccgttttttcagattcttccagtttctcgctcacctctccagctcccttctccctcttacctggctcctatgctgtgatatatatttttgtattatctctttcttcttgtggtgataatcttgtgggatgtaagtttcaaaattttcaaataaagcctttgcaagataatttagttgcctgttttgccttataattcccaacccctggcaccgtcccccagccccatacacagaagaggatggacaggaaggagaatgggagagaaaggggagatgaagaacttcttcagactagattgtcacctggcctgctctacctgaagctggagactgatggataccttaacttaggacaggatgaaggaaggaaccggagaggctccagaggagaaagagccctgaggggggagaacttgcatct

SEQ ID NO: 31868 - DNA, 1152 bp, Mus musculus
actggtttactacttcagtgccgagggtttccgtaacacccttcgcaacctgggcgccccgctgaataccaggcctttggctaccaatggggctgcaggcgtgctcaccgaactaccctcagaaagcacccaaaacactgggcaggatgccacaagtcaggttctactccagcctgccactctgggtacacccccggacaactgctcccaggattcggctctctgagaggacgcagtctaagtgaacgtagacttgtgcctccctcagaggcttagggtgtacatttgagggaggtgggctgggtacttggactttgaaacaactccagctctagtgtgcagaagggaacaagtgtgtaagcaaggaaaagaagagtgccactgctgacagctttagcttctgattatcacacagagaaaccctgctccagtatgtaggaagccaagcagtgagcatgcgcatggctaagagctggtacatggagcagaagagagatctcctaggtcgtcagtctgagagctaaagatctggtgaccttggtgaatcaactacacagacgctcatctgtcatcttcaaaaataaaactctgggctggtggtggaaccgagaacccacagcccgcacatgctgggccagtacattcccactgtattgtatcccagccttacctgctggcttttgtgtttactcaagggtgatggccactgtgtcaccagccctggcttccctgttcagatgggaggtataacacaaaggtttatttgctatggaccaaatagttctgacccatttcccaacttgtaacaatttcgacttgacacctggcatgtggtggctggggcagggcagagccatgcttggagtccctctcacttgctagttcttggttccttttctaagtcatccttttcccttctgcagctctcggggcctcttccatcctggatctttaatattcagtctcacttccctctctttcccaccccgttccttctcctcaccccgcccccttatatagtacatagcagagtctggccttgaactctttttgttttgttctgttttcaaggcaagagtcccactatgtagttcttgatgtcctggaactcattctgtacactaggctggccttgaactaacacacagagat

SEQ ID NO: 31869 - DNA, 2102 bp, Mus musculus
cctcacctgtgctgttgctcttttccctgcctgcctctgtttgccaatctatgtagaaaatgaggaagacccagacgaggatttatccgaagcagagactccaaagctcaagaagaagaaaaagcctaagaaacctcgagaccctaaaatccctaagagcaagcgccaaaaaaaggaggtgagtgggtgactgagtgttctggggagtgagaagagagaggaggaggaggcgctcaaggagagttgtgaggctgcgggtagtttttctcctggagctgggggtcaggttctggggcgagcctcaggactgtcctgggtgagcatgtgtgtagcatgtgtgtctgtctccctccccccctgctccagcgtttactcttatgccggcagctgggggacagctctggggaggggccagagtttgtggaggaggaggaagaggtggctctgcgctcagacagtgagggcagcgactatactcctggcaagaagaagaaaaagaagctcggacctaagaaagagaagaagagcaaatccaagcggaaggaggaggaggaagaggaggacgaggatgatgactcgaaggtgcctagatctctgtctgtcaagaccctgcccgtcctctctgtcctttctcccagataccaccctgccctgtagcacagcatctccatgtaggtgtgctcatttcttctgtattatttcctctgtacctcgctcgctcttggaagctgcagtttgacttcccagtcggttgtcttagccagtgagcactatgaagcagacccctgactctgccttctctgcaggaacctaagtcatcagcccagcttttagaagactggggtatggaagacatcgaccatgtgttctcagaggaggattatcggaccctcaccaactacaaggccttcagccaatttgttaggtaagtcaggaggagcctgtgcggtgggaagggaggagtctttctagaatttcttcttgtttgtttttctcttttctctttatatacgaccttactcttgtccatttctcttccagacccctgattgctgctaaaaaccccaagattgctgtctccaagatgatgatggtcttgggtgcaaagtggagggaattcagtaccaacaaccccttcaagggcagctccggagcatcagtggcagctgcggcggcggcggctgtggctgtggttgagagcatggtgacagctactgaagtcgcccctccccctccccctgtggaggtgccgatccgcaaggccaagaccaaggagggcaaaggtgcagtggaatttaatgaagagtctgggtgggcttgacaagtctgacagctaggaatgcggcattgcccctaagtctgtccctaatgggcaggagtgagccttgggtttagaagaaagccagggtgagccagctcatttcccatcatttgccttgtggtctacatttggctgtatcctgatcttaggtcccaatgctcggaggaagccgaaaggcagcccgcgagtgcctgacgccaagaagcccaaacccaagaaagtagctcctctgaagatcaagctgggagggttcggctccaagcggaagagatcctcggtgagacctggctcttgccaccggagaagggggagctgtgtgggggaggggcacatagggtactactgcttcagacaggtgtgactcggctccttctgggcagttctctccttggcctggacttttaactttgttttctgttttttcttccagagtgaggacgacgatttagatgtagagtctgacttcgacgatgccagtatcaacagctattctgtttcggatggttccaccagccgcagtagtcggagccgtaagaaactccggaccgctaaaaagaaaaagaaaggtgtgtttcttttctgtacttatgcgtaatgggataagatggcaatggccaggggaaaatctcccttaggagataagggttggggggaggtggtttttttctaataattgggctttccctcttccttgcccaggcgaggaggaggtgactgctgtggatggttatgagacagaccaccaggactattgcgaggtgtgccagcaaggcggcgagat

SEQ ID NO: 31870 - DNA, 1103 bp, Mus musculus
gagttgacctttgagttcatgctcatgcttgtgcgaccgtgctctgcccatagacactgatattcatattctttcagggtttgatgcatctccctgtggtactgaattgagattaagtggtgtctttttaacagtgtccagctcttaagggcaaagtgcagaagatcctaatttggaagtggggccagccaccgtctcccacaccagtgcctcggcctccagatgctgaccctaataccccgtcgcccaagcccttggaggggcggccagagaggcagttctttgtgaaatggcaaggcatgtcttactggcactgctcctgggtgtcagaactgcaggtaagcctgggacaggctgcacgtgtgaggtgacgccgcagaggtaagggcaggaagctggttggctgcagctcccggagggtctcctttctctttctgctccagttggagctgcactgtcaggtgatgttcagaaactaccagcggaagaatgatatggacgagccgccttctggggactttggtggagatgaagagaagagccggaagcgaaagaacaaggaccctaagtttgcagagatggaagagcgcttctaccgctatggaataaaaccggagtggatgatgatccaccgcatcctcaaccacaggtaccacgtctgctccctgggctcactcactacctgttaggtgccacgtctgctcctgggctcacttactacctgttaggtaccacgtctgctcctgggctcactcactacctgttaggtaccacgtctgctcctgggctcactcactccctgttaggtaccacgtctgctcctgggctcactcactccctgttaggtaccacgtctgctcctgggctcactcactccctgttaggtaccacgtctgctcctgggctcactcactacctgttaggtaccacgtctgcccctgggctcactcattacctgttaggtaccacgtctgctcctgggctcactcactccctgttaggtaccacgtctgctcctgggctcactcactccctgttaggtaccacgtctgctcctgggctcactcactacctgttaggggccacgtctgctcccgggctca

SEQ ID NO: 31871 - DNA, 1128 bp, Mus musculus
tgggttctattgactgggcctgcctcattgtggatgaagcccatcggctgaagaacaaccagtctaaggtgaggtgtgggaggaaacggcctccagttctagtccttggggaaattcatctctttgaaagaaccctaagtagagaagaagggaaagtggtctttatttccttcctcaccacggcagcccttctctggccaggcctttaagaaggatgccagccatgggatgagacacttagttcactggacagtgaaacagcttggcattctgttgcaatactctggtgccctcgtttcttgatttttatttctcttcaccagttctttcgagttttgaatggttactcactccagcacaagctgttgctaactggaactccgttacagaacaatctagaggaactgtttcatctgctcaactttctcacccctgagaggttccagtaagtgcgcctgtcagtcagtcagtccctagctctactcattcttgcccatttcctgtgttactttcctttcttccttgtttccccttctctaacaacttttttcttttttctgaagcaacttagaaggcttcttggaggagtttgcagacattgccaaagaggaccagattaaaaaactccacgacatgctggggcctcatatgttgcggcggctcaaagctgacgtcttcaagaatatgccatccaagacagagctgattgtgcgcgtggagttgagtcctatgcagaagtgagtgtgaagggatagaaacacactcagccttgtaacagacaccggccgtgctgccagcagcttcttccagagcttccaggcatctggtgacggaagcaagcggggcctgaaggaacctgatacctgggaggcggagcttgtagttcttagttttaccttcctgtgtcgaacatgaggatggcgtggtcgctgcttgttagcttagctccacagtgaggaatgttggagagatgatctcaggctgttggttgcatcattagtcattcaaaagaccctcagtccaaccggtccttgtgtcttgttcatgtaggaagtactacaagtatattctcacgcggaatttcgaagcacttaatgctcgaggtggtggcaaccaggtttctctgct

SEQ ID NO: 31872 - DNA, 1184 bp, Mus musculus
cagagcaccgtgctgacaattgcttggttttctgaagcgtctcaccttccttctctccttatttattggaattcaggagagaactcatggtgttttttgtttcttagcaccgggtgctcaacagttctgcttcttgctttccactcgagctgggggccttgggatcaatctggccactgcggacacagttattatatatgactctgactggaacccccataatgacatccaggtgagtagagtattcgctttgggaggtcctagcacttcataggaaccctccaggagagggttctgtcatgtgaaacgtaggtgtgaaacaacagacttcttttttttgagtgtcactatcttttaagcctgggaattagaattggttgcagtcctgttttaggtgatgtgactggaagttggtttctggagagagagctgggaaagagattgtatgtgaagaccagcttccgcttctgtctagtgttgtcttgatatcagtgacaagtcaggagaacataagattgctggttttgcttgaccaactccaggcctttagcagagcccaccgtattgggcaaaataagaaggtgatgatctaccggtttgtgacccgtgcatcagtggaggagcgcatcacgcaggtggcaaagaagaagatgatgctgacacatttagtggtacggcctggcctgggctccaagacaggctcaatgtctaaacaggagcttgatgatatcctcaaatttggcactgaggagctattcaaggatgaagccacggatggaggtgagctattcaggggcttcaattttgggtggagcttggtttctcagactctgggaagaaaggacctttgatagcaagggtcctgagggaactgcattttctcctgggctgctgctgaactgacttgggttgtgggcccctggttcttcataggaggagacaacaaggagggagaagacagcagtgttatccactatgacgataaggccattgaacgactgctggatcgaaaccaggatgagactgaagacacagaattgcagggcatgaatgaatatttgagctcattcaaagtggctcagtatgtggtacgggaagaagagatgggggtgagtatgggtccaaggcagtgctgttcttggtgattcctctcaacagtggaattaagagccagatgatatttg

SEQ ID NO: 31873 - DNA, 1193 bp, Mus musculus
agaagagaaaagctgagcccatcattgtggcagtggtgccacatgccacatcccagcacttgggaggcagaggcagatggatttctaagtttgaggacagccaggcctacacagagaaaccctgtctcggaaaaaaagaaaaaaacaaaacaagtcatattggggagggcgagaaagctgattttggtttaccatttcagaagctccagggatggtcaataggtcccagtgctaatgggcaatgggcttcgcttaatggggcaaacatactgaggaaactgctcatggggcaaaagaagaagagcagactgctttcttaatcgctccgtcgcgtgcacacttcagctctggaacttcttcccagcaggtctgaactccgtggagcctcgaaagctttcaggtttcaccaaagactggctatccgagctgtactgaaacgtggttcaaaactcaagacacctattctgtcctgcctagttcttttctggggacagtgtgtttgtgtgtgtgtgtgttttagttatacccagggtgaccttgaacttacggtgatcttccagcttcatccttctaaatgcttagattacaggtgtgaactatcatgttatatgtgtatctgtctgtctgtatttgtctgtctgtctgttatggagttacataataagtggtttggggagtaaaggcaggctaaatacaccttacctgaaatgcttgcaactaattgtttcagatatgggagaagttgggatttaggtagatttacagactgagtatccatacaccaaggtcagtagtctggactgctttttattgacgtcctgttaagacatttgtgggggtgggggggtggagggcacttggagggacggttcagcattctgagcactgattccagagttacaaacatctgtagctctagttccagggagtctgatgccatcttctggtctcctcaggcaccaggagtaattgtggtatacaaacttacatatagacaaaacaaacataaaattaaaagactaaaagtttcaaaggcagttaatacatttctatttcatatttttagattttgttttctttagttagggatcataagcctattctgtaattcagttgtggaggcaattaggttgtttcttgaaaatttgttttgttttttagtgtttatttggaggatataagtctgcagagtt

SEQ ID NO: 31874 - DNA, 1194 bp, Mus musculus
ttgagatacataaataccgtgtatgcgtgtatctgtgtaactttgttgttgttgttgtttgtttgttttcaaacagttgctaatttcttctgaggttaattaagaccagaatactttctgttctaaagatctcttgcagtgtttgtttgcgaagctcctccattttgcttgctaagacactaacctttttattctgctgtttctggaccttgccaggaggaaggccccgctatgtctcgtcgtaatagtttcttttactcaggctaactaagctacacgaaacctccgaggagccatgtcttgtctgttaaatttcttccaagtttttaggtccaagcaggcacatcaagtgtttacaaatcgagccatgcaaaggagctagcagatgggaactgtgaggaccaggggtagctggtggtgctgacttcagcacccctgagtcctggccctccctctgtcccaggaggaagaggaggtagaacgggaaatcataaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcacaggaggaccgaggtgtgtgtggccggccccgccccccacccacgggccgttccactagagcagtgggccccgctcatctgccctctctccctccagattggcaggacgaccagtccgacaaccagtccgattactcagtggcctcagaggaaggtgatgaagactttgacgaacggtcagaaggtgagagcggggccatcttgcgagttgtgtagctgttggcattgttgctgtcctgtcagagccgctcactcatctttctctttacagctccccgcaggcccagtcgcaagggcctgcggaatgataaagataagccattacctcctctgttggcccgtgttggtgggaatattgaagtaagtaccgtatgatcctatagtgggagaaaggcctgagattgccagacagttggtctttggtgagaagagatttgcttcctcttacagaggttttttttccttaggtacttggttttaatgctcgtcagcgaaaagcatttcttaatgcaattatgcgatatggcatgccacctcaggatgcttttaccactcagtggctt

SEQ ID NO: 31875 - DNA, 1140 bp, Mus musculus
gaagaaggaggaggaggagaaaaaggacgtgatgcttcagaatggagaaactcccaaggatcttagtgatgagaagcagaagaaaaacagcaaacagcgtttcatgttcaacattgcagatggtggttttactggtacggaatgcgggtcctgcagggaggctgggcttctggccagaaatcagggcagagtgggaacttggtatggactgtttgtccttctgggctctatgttagcgagctagatctggaccatattgagatggattggcgggggtgtgtgtgtgtgtgtatgtgtgtgtgtgtgtgtgtgtgtgtgtgtgtgacagacaagggtaccccttttttttaatctttggggatttttggagatagggtctcactgtagccctggctagcctgggattcagtatgtaaaaattgctgtccaccgcctaactttttcttttttaatttatattctcccagattatttgtcttcctttccactttctaaccttctgctaaattcctcctcagagttgcactcactgtggcagaatgaagagcgggcagccacagtcactaagaagacttacgagatctggcaccgtcgccatgattactggctgctggctggcattataaagtatccttgcctgagttgagattggggtctctgtgtaggggcctgaaggtttagtctgaggctcttgttcctttgtttttcctgagctctttatcaatagccacggctatgcccggtggcaggacatccagaatgacccacggtatgccatcctcaatgagcctttcaagggtgaaatgaatcgtggcaattttctagagatcaagaataaatttttagctcgaagattcaaggtgagcagaatgagacagatgtgccctcagttggctctgaaggtctctgcggaaaagaaggttctgtgaaggaccatcagccacacttgcacctccccccaagatacttacatttttattttatatttatgaatgttttgctttcatgtatatctgtccaccttgtctgtgcctggtgcctgcagtggtcagaggagttacagaaggttgtgagctaccctgtgtatgctggtagctgaacctgggctttctgtaggaacagctagtgctcttaaccatc

SEQ ID NO: 31876 - DNA, 1434 bp, Mus musculus
atgtgagaccagagccacttgcaactagaatgggaggaatagctgggtgggcaggccaggtaaagcgagtgtcaagagcgtatcctgtgtatgccagcgtgacaaccagccctgtgggccacagctgtgcccttgactaccacagctcacggcctctttctttctttttccctctgcagtcctgaaacagctggaggaactgttgagtgacatgaaagctgatgtgacgcggctcccagccaccattgcccgcatccccccagtcgctgtgaggttacagatgtcagagcggaacattctcagccgcctggcaaacagggcgccagaacctcccccacagcaggtagcccagcagcagtgaaagacccagagtgatatccacctccaccactcagcagtgaccttcctcactttctcttgtcccggctgcccctgggggccagagagacccttgccttccttctgcccatcttctgagttgtaaaggaacagccctgcgcagtggggcagggagggagggagaagcaatggtgcccttcctgctggagagacaagcagcagtagcgcagcgcccgcccgccatgtgcaggagctggcgggctggctgccttctggaccctggcttctccccaccgtgcgcctgttacaaactgttgtggattctgccaggctcgaagaaaatgatctgaatttcttcctctttttggttttattttgttggtttactttgtgttttctcctttttggggggtattcagagtgggccgggcccctgggcgagacacagctacctctgttggcatctttttaataccaggaacccagcggctccagccactgagcagctaaataaagttggaaaaaaaaaaaaaaagaaaaagaaccaaaagcataaaaaaccacagcaaatttcttgatgagaactgaaaataaaagtttccttgtattttagtgatctggttctgtgtgggtgagtgtgggttccaggtaccccaggaactggcttatcctggaagactgcctgtgctcctgacagggtgacattctggcgaacaagaggcttctggaccattgtttataggctctgatctttagcaaactgttcgcagagcactcctgcaggaagtagccacttgcctggtacagttgtgaagacattgggcaagtgttctaccatggaatacatatgcgtgaatatgtaattatagaagtataaattttttgagggtctaagtaacaactgcctgcccctgcctctcaagtgggggaattaaggatgtgttaccttaagtataaattttttgagggtctaagtaactactgcctgcccctgcctctcaagtgggggaattaaggatgttaccgtaccctaaaattttttccttggtttattgttatcactttttttttgtttgaagatttatttattattat

SEQ ID NO: 31877 - DNA, 1104 bp, Mus musculus
gcgagttcacaagcggatccaggacatcgtgggagtgctgcgggatttcggagctcagcgagaagagggccggtctcgagctgagtatctaagtcggcttcagaaggacctggccacttactattcttatggagacttcctgctgagcaagctcatggagctgttccctctgtctgaggtaccggcagctgctgcttccgcttcccttccctttgtacggctgtgatgccgtttacccgctcacactgtgtgctgagctcatgggctcttggctcagccctgatgcactgtctccatcgcagttgatcgagttcttagaagctaatgaggtgccccggccaatcacccttcggaccaacaccttgaaaacccgtcgccgagaccttgctcaggtcagtgtccttttaattcagaactggactctggctcacccgtgaatcaccctgcccagttgtagctgggtgtgttcttcagacctgagagtgccttgttccaagcctggcccccaggcctgcgatctgtgtgcctctgtgctgcctgcgcctgggatgcggcaccagcgtggggaagaactgcgacctaggggattggagggagggcaccaggaagccgagaaacgatgctcgccccaggaaaacataaaaaacacacaagagtaagattttattcttacacaaggattcgggagccccaggttaaagactttgcttctagccaggcagtggtggcgcatgcctttaatcccagcactcgggaggcagaggcaggcgaatttctgagttcgaggccagcctggtctacagagtgagttccaggacagccagggctatacagagaaaccctgtctcaaaaaaacaaaacaaaaaaaaagactttgcttctaaaatcagtagtgttaaccttgcatactgtcttagtcagggtttctattcctgcacaaacaatcatgaccaagaagcagttggggaggaaagggtttattcagcttacacttccatactgctgttcattaccaaggaagtcaggactggaactaaagcaggtcaggaagcaggagctgatgcagaggccatggagggatgttacttactggcttgctttctt

SEQ ID NO: 31878 - DNA, 1226 bp, Mus musculus
ggctctcctgggactggctctgttgacaaggctggcctggaactcggatccatctggccctacctcctaattgctgggattaaaggctgtgccaccaccactgcctggcaactgccttggtttttgtttgtttgttttttgagacagggtttctctgtatagccctggctgtcccggacctcactttgtagaccaggctggcctcactcagaaatctgcctgccttgtttcttaatgatcaagccatctgtttaatttttacctcaggaaactcggcagcagctacccctacagagcctgacctgaaggatcaggtcaccccaaagtctgagaacggtagtcagcccaccaagaaagcccgtggggctgtgaaggcaaagcagcagttgctgagacagccacattccaagaagcccttccagaagttgaacggcatcgccaaagggccaggcttgtccactgaaccttctgtcccagatgcccaagtgtctaccaggcccagtcagtctgctgggaatgctgacgtgaacagcaaacgaaagaggtctgagaagctgaagcagcggggacctaagtggaagccctctaaggaggctgctgtcccaaagccgagcgccccttccagggttgaggactcgagaacacctcctgtgccgactccctctgaaatccgtgctgccccaaggcctaaggactgtgctccatcccttggggaagccaaaaagaaacagaaaggaaagcagcagttagcacagcagcctgctaatggagctgctcccctgaaagaagatgctgtttccaagggaccctcagccccctttgtgtctccccacagttccaccaggcccccaccagcaaaaaggaggaaatcaatgacaaagggcaacagccagcctctgttgtcttaaatggacttggaaacttgacattgtctctgggttggaacttttagatcctgatgcaaggctggcctccccctgtgcatacatatgaaatttaatatacatattaccactcctagttgctgttgtgttttttgaggggactgggtactggcggtttgtaggaaagtgggcctgggtttctctggggagagacagttgtgcactattcaaatgactattcaaatggtaaatttctccctccatttcttagtcttcatgggaaaaagtaaaggagtccgacccagggtaccaggtagaagagagggcagtagggaagactgt

SEQ ID NO: 31879 - DNA, 1122 bp, Mus musculus
actccgcctttgcggggatgagcggcccggagtcttaagtattaggaacaaccccacgcgcccgttcagacccatcccgtaatccccagtccggggcttctttctttactttcgcgccctgaggagtcacgtgccaggagggaagcccctcccccatctcccccttcctcggggtcggtggcatggcgttgtgaggtgcatacctttgcgcatcatctcccaggcttgggcttcctttagggtaactggccgccgccatgttgcaaacgggaaggaaatgaatgaaccgccgttatgaaatcttgcttaggccttccttcttcctagcttgtgactaacctcattcctctcggctgggtggagtgtcctttatcctgtaggccaggtgatgcaaggcttccgtgctctcgagagagttctacctcacaatctgtctcaccttattagccttaaaagcccttgagccttattgtcctcgggcataatgcgtattctagattattctctgaaaatcaaagcggacttacagaggtccgcttgacctcccaaccccagaggtagttatggcgtagtgcagagccgtgggatggggagctgagtcatggtggttctgaaaagaaattttccaccacaaaatggctcctgtagtagcagccccttccatcccctgcacttcccatcacagcctcgcactgacccaggccctataggccaggatgtaaaggtcattaagaggattgggtgtccctgcgcctcagaatcctgcccttctccccgttccatcctccagaaaccagatctctccactccgccctgatctgaggttaaatttagccgtgtgacctttctggatctggggtctgagcgggctctccaccctgctccccctacacacatctgttgctccggctctcatttttgcccgagaagaacaggtgtttcgcgaacgagccctgggattagggttggaaaccccccacatgttttctcagtctttccccttagttcgagggacttggaggacacaggtgggcccgccctgtgctgctcacgctgacctttagccttgccctttgagcttgctgatgaatgagttcacaggtctgccctgtccagggggtg

SEQ ID NO: 31880 - DNA, 1375 bp, Mus musculus
ggatgcaagcccacatggggctcctatgagtggtccccaccctttttttgttcctttgtggtttgtttttggttttgaaatggtccccttgcctttcttttctagtctcaaggctacagcctctgacttctgtagactcagacaatgactttgtcacacctaagccgcgacgtaccaaacctggtcgtccacaaactcagcagcgcaagaagtcccagaggaaagccaaagttgtcttcttgagtgacgagtccagtgaggacggtatgatacaccctcccaacagatcagctgcctgtgtggggtcttccagtggggcttgcctagctgtggattcattcttcctggccatgtcttcctcactatgcagctcggctgactttcacagtgtgccgtgtgcgtgtgtgtttgtgtgtgtgtttgtgtgtgtgtgtgcacacgtgtgcgcgtgcgcacgcgcgcatgtgtttactttgagatccattttgccccatctttatgactcagcttttgttcctataattctttgaatagaactttcagcagagatgacagaagaagagacacccaagagaaccacccccatccgcagagcatctgggcgaagacacaggtcctaggagctgcctttgcctactcccgtccctgccgtgcagggtatcttactggatgatcttggattcagtgcccccccccccttgtagaagtgcttgttgtctgtggttttaacatggaaatggcctttgcattgaggtctttctcttagagccctgctgccactttccctttctccgagcctgtgccaattgctgttttctaatgaataaatgtttttatagacttttaagcatcctgtcctggctggtctgtcccatccttagccctgagctgtgtctggatcttcatggcccctgtggtgcctcatccttgcacaactgaaactctgctgtgcagaattatgcggtttctaggttcacgtgaacagttctcagcagtctggggtactttgcaccccagaaaacattcggtaatacctagagacttatttctgtttgccttgtggggcagggggctgcagtgaaagccttaagatgaaggccaccttcatgcacattgtgccccataacacagcatgtcaggagtacacaacttgagaaatgctgctctagacctaaggtttgtttcctctgtgcgccccaccccatcccccgaagactggcaaatgactcagcctggctaatggcagagattatgaaccccactcagttctataggtgacaaggtccatcgccccagagccagtccttcactacactaaggggtctgcaggaggtccagctgtaagccatgctgtgtgcccaccatccccaagccc

SEQ ID NO: 31881 - DNA, 2081 bp, Mus musculus
ttagcaaacttaaaaacttacaaaagagacctagtcattcccttctccattcagaaattctttctctttatggacttatttgtcattcctgtggacggttttataaatgatgtcttacggggagagagatggctcaagaggttaagcgcgcttgaagagaacctgagttcagatcccagaacatacatggtgtctcctaaccatctgtaactccaactccagggaaacccagtgtcctcttctggcctccgtgtgcagtgcacacatgtacgattgcatacatgccgggagagagactcataaaacaacaaaagtttaaagtctgtcttaaagcagggtgaagcggtgcacgcctttaatgcccgcccccgcctctctctctttcctcctgccactccctaatgccatctcttaagagacagaggcaggcagatctctgtgaatttgtggctagcccaatctacataaaagttttaggaaggactgggccatgtaagcacctgtctcaaaaaagaaaagtggtcacccaacatccctggcttctcttcctgcagactgcaagctctgaaactacaatggaggaagaactggggctggtggggggggccactgctgacgacacagaggcggagctcatccgaagcatctgtgagaaggagctgttggacggtaagaaagatcgctatgtgccctcccccagttgaatcaatctgtccctaacctggacatgttcttttgtcaggcaaccaggtactagctgcctttgttccactgctacttaaagtctgtaacaaccctggcttatacagcaacccagagctctgtgcggctgcgtcgctggcccttggcaagttctgcatgatcaggtaggcctagttggcttcatctcaaggaacatgagatggtacagccctcttgctttcctgatgggtctctctttgccctcagtgcccctttctgcgactcccagcttcgtcttctattcaccatgctggaaaagtcttcactccccactgtgcgatctaacctcatggttgccacaggggatctggctatccgcttccctaacctggtggatccctggactcctcatctgtatgcccggtaagagatccctgggccacctgagacccactaagagttcacgggctcctcccccacccgtggcactgacttcggtacctgctggctgttcaccctgtacaagcaggcccgaaatgggcactgggagctgaagcttccctctaaaatcttgcctacagatctcgtggtccctgactccagccttggagctgcttctaaactggcgtactgtggaacaatagatccttgttcttaaggccttcctattgttctcaaggtacaaacacgagttcttgatcttagtgactagagtttttattcctagcctccgagacccagctcaacaagtgcggaagacagcggggctggtgatgacgcacctgatcctgaaggacatggtgaaggtgaaggggcaggtgagcgagatggccgtgctgctcatcgaccctgtgcctcagatcgctgctctggccaagaatttcttcaatgagctctcccacaaggtgagagaagcagcttggggctttgtcggggagatggataggtcccacttctgccggctgctccccgcctcatctcatccttttcctcctacagggcaatgctatctataatctactccccgatatcatcagtcgcctgtcagacccagagggcggagtggaagaggagcccttccacaccatcatgaagtatggctctttagatctagagtagtgggggggggggcacacagacttaggatggatggatggatggatggatggatggatggatggatggaatgcaaagaatgaagaagaatgaacacagggtcttgcatgtgctaggcaagcactctgccgctgtcttcagctctagatggacattttagccgtactttctccacaagttacttgacctgtttgcccgtcttaaccgtatgaggttgacaggacttgctgcatagttgtggaggctcttacatagggtagggtgctgcttgagggtgagggtga

SEQ ID NO: 31882 - DNA, 1063 bp, Mus musculus
cctttccctagaggaaaaccagaaattgtagggagcaacttagacgccctggtgagggtggggctggatgagaagtctccccaggactacaggctggcccagcaggtgtgccttgccattgctaacatctcggacaggaggaaggtaggtcatggcgggtggctgtggctcagctgaggagagtgaagagcttcctgctggccttccgcaccctggcattctgttctcttctcctcagccttccctgggtgagcgtcaccctcccttccggctgcctcaggagcacaggttgtttgagcgacttcaggatatggtcacaaagggtaagctatccaggaggtgtaacgcaggtctgcttggtccctttcccagagagatcaccttctcctttctctctaggctttgcacacccagatcccctctggatcccattcaaagaagtagcagtgaccctgacctaccagttggcagagagccctgatgtgctctgtgcccagatgttgcaaggctgtgccaagcaagtcttggagaaacttgagaagaacgccactgaggcagaccccagtaagtgggcaggggcgtcattgctcaggggtggggtggacagccagcctctgtccaccccaaacctcggcccacggcatctcagtttgttcaggttgatgttgggccattctttgccgcgtctcaccttctccatgagtgaggagtgggtctggaagtttaatgggacttggctcttttccttctctcttctttagaggaaacagcccctaggctccccacattcctgctgatgaacctgctgtccctggctggggatgtggctctacagcagctggtgcatttggaacaagcagtgagtggagagctgggtcggcggcgagttctgcgagaggagcaggagcacagggccaaggagcccaaggagaaggtgcgtgagtggccaggggcacttccttctttccatgccctcagctccggacacacctttccagggacctctgcttctgtccttctgtaatgaagaatcggtctctctcccctgggaaggttagtgtca

SEQ ID NO: 31883 - DNA, 1190 bp, Mus musculus
tatgaagtgggaggattgggagttgaagggcagcctgggatacctagtgagttcatggccatctgacctcactgtaaaactgtttgtttacaacagttaagccataaaagtaacaaattattgaaagtctggtgcttccatccatagcaggttttacacaggtgtttgcagtaggtttttattttgctttggcttgtttttacatttacagcatttgtaaaggtcagaggacaattttggaaatcagttccctctctgtgggttctagcattgaagtcattaagccctgtggtaggcactctttcctactgagccatctggctagctctgggtttatgattttaaaagcttattcaagttctttgaggaccacagtaaaggctcaggggttttgtatttgactgcttagtaggaactgcttgtctttttaagcatgagacatgccttttctatagggtactgcatgtagggctggatgaagttgtcagatcccttacaaggccttcagggacatggctctagagctaaattggtgacaggctgctgctgttcttcttagacaggctattgttctcactcgggaagctaccagtcacttccaggagtctgaacccttcagtcacacagagccagaggagaacagcttcctgaatctcttgggactcatcttcaaaggtaatcctttcagtcagcaagcacagccttgggctgaaggagtggacacttgctctggaaggggagcagcccagtcagtcgtagggcacctttgcaaactagggaggtctgcaggaattgagaaaggaaccaaggtgcttcagagcacattgtaatttcatacattcacgttgttgaaagagatgtgcagggatgttggtagccactggactcccggtacacttgtgcaaaactgtcctgtacctctaattcctaggccccgaagcttccacacagggctctcatggggacacagacccagggctgacaggcagtaaagactctcccagtgtgcccgagccagagggatcccagagcaacgatgagctggtgaagcaggagatgctggtgcagtatctgcaggatgcctacggcttctcccagaagattacagaagccattggcatcatcagcaagatgatgtatgagaacacaactacaggtaggccgggtgctgatcggaacacagtcctgcc

SEQ ID NO: 31884 - DNA, 2022 bp, Mus musculus
tccgtcacctatggaaccactcagcaattgaagaagaatttgtcaggtggggagttaggacgcaacttgagcagatgatcttgagccgtgcaaaatgcggttctggtgctagataagccttttaaatccgtcatcccttagtgctgtttgcagtagtacataggagtgtctattacatgcatacatataatacatactgaatggaatgtgcgtttctctcttgtcccctcccccctttttgagagacaatgtctcactgcagccttggtcggcctggaagtctatgtagaccaaactgggtttgaactcacagaagttcacctgcctttgccttccaagtactgggattaaaggcatgtgccaccacaatgaaattctcatgttaatacccatacattcatgaagatgtgtttactgaaaatcccctaggtgaagctggtgcatggtgcacacctttaatcctagcacttgggaggcagaggcaagccaatctcttgagagtttgagactagcctggtcaacataaagacttctgggccatccagggctgtatagtggtgaggttctatctccaaataagtaaaggtcggggaggtagctgtcagtaaagcacctaccatgcaatcatgagggcttgagtttgatcctcagtactcacatcaaaagccaaatggagcgcagtgttaaggaggttgagacgggcagatgtctggatgcctggccggccagccccatatcccagctagaggccctgtctcaaaaaacaaggcaaacagctcctgagaaatgaaacccaaggttgacctctgatttccacatgcgcagacacacacacacactaaaaccaaagtgaaagtaaatggtcagttagctacagcagatgtaatttaaaggtctgtaaagatctaacttgccatttttaacaatgagaagtcttcgctaaccttgccttaccatcttcatcttatagtctggctttttgttgtcatggtaactggctgcaatttactaaatcctgaaggaaagaatccttggtgtagaatacgattagactgaaagagcggagaactagaaactttgagatggacatagtagggacaggattgagtaacggcagctgcctggtatctcgacttcagacagctcatttcttcctgttcattctttttttgtttagtttggttactggctgttgctaccgccttttggagaatcccaccattagtcaccagaagaaccgctccaccaaggaggccatagcacacctgcttggggtggccttggtccgctacaaccatatgctcagtgagttgccttccacttcgcttgctcgcttccgccccctgctctgcagctctccctgaatggctaacgttccatctcccaggtgccactgtgaagatcatccagatgttgcagcactttgagcacctgccccctgtgttggtgacagccgtgagtctgtgggcaacagactacgggatgaagagcatagtgggagagattgtaaggtaatcctcccagagtgtctgtgttcctggggcgttgggggagaaaggaagttaggggtcctttctccatgtgacgttggattccttcagccctgaagcctgttggcttcccttactgggaactcagtagctgagctttcttactgtatctgctttctcccctgcagagagattggacagaagtgtccacaggagctgagtcgagacacagcaggggcaaagggctttgcggctttcctcactgagctagcagagcgaatcccagctgtcctgatggccaacatgtgcattctgctagaccatctggatggagaggtagtctatctggggaagctcagatttgtagaggggttttagtgttgaaatcactctttctttcttcactttaatgtggttctgggaatcagcccaggaatttattcgtattaataataagcatgctctaaaagtcagaagtttttcctttcctttaaactttttttttttaaataaattttatgtgctggccagt

SEQ ID NO: 31885 - DNA, 1815 bp, Mus musculus
aagaactgatcaagggcccagtatggcttcgaggctggagaggaaatgaattgcagcgttgtgtccgaaagaagaaatttgtgggaaacaggatgttcattgaggacctgcataaccttaacaaacggatcagctatctctacaaacactttaaccgacatgggaagtacagataggacgggaaatgtgtcaccctggagaaggggaacaggacttatcccagcaaggagagagctttgtgtgctcgatgtaataaaaaaatggggctcctttggaatctgatatgcccagtgctacatttactcatgcactctgacgtctgcctcgttcctaagtcacatgatcttttgttactattacttacagcccagttatgcttgtggcctttataacaatcatttattgctggcactttctgacactggcacctcgtgtaagtttttaaagaatttatttttatttattttatcttatttttttgtaatcttggagctgaaacccagggacttgctcattctagggaactctgccactagccgcccaggcccttggaagtgtagctgctatttctaaagactctgccaccccaaaatgaactaggaaagtgaaattacactttgtactgctcttatcagttataagttagggaacttgtctgagtaccacagcatttcccatcctcttgaatagggcagttttgtggaggctgaccttgagtcatgcccagttttatgaagtgttaaagatcacacccagtattacccctgtgtgtgctaccctgtttgctttttttttttttttaggggaaaaaaatgtcatttaagaaagatattttagggctggtgagatggcactgactgctcttctgaaggtcctgagttcaaatcccagcagccacatggtggctcacaaccacccataatgagatctgacgccctcttctggtgcatctgaagtcagtcacagtgtacttatttttaataataaaaaagtctttgatcattggaccagagcaagtggagttgaccagagagagcaaggtcaactgaggcagcagaggtcctaaattcaattcccaacaaccacatgaagcctcacaaccatctgtacagctacagtgtactcacatacattaaataaatctttttttaaaaagaaagatattttaatacaggtttgagcatcagggctatgagagaggtgttcagaggtaaaacacttgagagcatgagtgtgggcttccctgagagactcttctatatggcatagtgctggcgtcttggatataccaagtactttatagtgagctatagaccctctgctgcactttgcttttgttagtatatattacaaaaataataggttttgctatgacattcttcatttacttcttttggttttttgagatagggttttctctatgtagccttggctatcctggaactcagtatgtagaccaggctagccttgaactcatggagataataccttagtgttggatctaaggcttaagccaccacattttccacaggtttttgaatttatgtttcaattgaaatcaattcagtgagaagtctggagatgacagaaaggtaatccagggaatttttcttgcattttttttttttttttaaacagtcttggggctggagagatgattccagccatctcccagggatgctcttgcaggttgcccaggttaattcccagctcacacatggtgactcaaggctgactatacttccagtttctgggcttcccatggagacaggcatgcacatgtgcacaggcatagctgcatgtattattgcatgt

SEQ ID NO: 31886 - DNA, 1199 bp, Mus musculus
tctttttaaaaagtcacagagtggagcaggccctcagtctctgccaagtgggatgcctggccagacgctggctgcatctgctaaccacctctgggtatcctggctgggtgcactgtcaatccctggcgcctcctctttgcaaatctgacacccagctgtccacagctctctgcctcaacgtccacggcaggtcaaccaagtcagctctgcctcgggctctcggaggtgggcctgactgatggctagccactgtctctgctgcccccctttcggccagcaagcgatcctaatccgcaatcccctctgagagccaggcttccgaagaaaggtggaggccgggttccgggcctgcagctctcacgtgctttcccggccaccccctcccgccctgcgtcgaggcggccaagcctgttcctcttccccccccccgtcgcgattgcgacaggccggcctctgctcccagggctccctgcccccgcccccggccggctcgctccactcccacttcctgagcccggcgctggagccctggaggccaggcccggccgctcccggcccccgggggcacgtcggcccagccgccaggcttgggaagtcgtggccaacgctgctcaggacgtccgggcttcccaccttcctcctaggactccacccggtctggtcagccgagccgaaaggccgccatgcgcctgccccgggcctcctctccctgcggcctggcctgggggccactcctgctgggactcagcgggcttctggtggcctctcagccccagctggtgagggaggggctaggtgggatggaccaggtttctctctagcccttctgccctccagagctgaccctgcctcattcttctctttctccgcctcctctggaaggtgcccccttatcgcatagaaaaccagacttgctgggaccaggacaaggaatactacgagcccatgcacgacgtctgctgctcccgctgtcccccaggtgagaacagtggctccaagtggcttgggtggtagaggtgagccagaatgagccagcactgctaaaactagccaggaaggagagtctacgaagcattagcattgtcccacggacactgagatttgaagaggtagcggcatgtagccatgaagacaggatggggacaaagagaccaaggagaggctccgaggcatgcagcaagcagaggcagcggacgcag

SEQ ID NO: 31887 - DNA, 1236 bp, Mus musculus
gctgtggctcagaggcagggcacttagctggaatgggcaaggccctgggtttcagtcccagcccagcaaagaaaagaggatggagagagtcctaatttgcatgctgtgttggaaacactgaagttaagacttaaagctgcatttttagggtctcaccctgaatattctctaaggaaatatctcggcagctgactgccggaatccgagtccctgccatccttcctgttatctggccttcatatctcctacaccagtatccttcctagaccttgctgttgccttgggcatttgtcttggcctgggtgatggtccttcccctcaggtcaggcagaccacgcccccttcctgtctttacagatcttcggcatgatcttcagcatgatcctgtgctgcgccatccgcaggagccgagaaatggtctagagtctgcccaaccccgagcaggaacaacggccctgaagactgtccgggccatttgggttttttttgccactaatattagtattcattatgcatttctaaataacagtcattctgtttgtctttttaatgctttattcattattgacatttgtagttgagggatccgggggttcaatttattttgatttttttttttggttgtttatttttgcttgttatgttaagcaaaaatcctgcaatgaaaggtactatatttgccagactctagacataagatattgtacataaagagaattttttttgcctttaaatagataaaagtatctatcagataaaaatcaggttgtaagttatattgaagacaatttgatacataataaaagattataacagtgtctcgggctgattgctggtattgctttctaaattagtttttagaactgcttgggtcaaaggtatttttcaggttttttttttttttttaaatctgttatcctgtctagccaggcatcattctctctgtagatcaggctgccctcaagttccaggcagccttccaatctcccaagtgctgatatcacccctgtgcaccagcccgcccacctctttcagctgtcttgtgttctttgggcagtagatgagaagtagactggaaggtaagtctcctcatctactagtaagggacccgaggcgtgatagattgggaaattctgatgacctacccgaggtcacagttttagtccacactaggatgagtccccagctcagcagtgtgtggtgtcttgggctctgctgagtctttgctatactcat

SEQ ID NO: 31888 - DNA, 1201 bp, Mus musculus
gggggatggtggggaacgttatacatgatttggttttgttgttgttctggggcccgtgaacttcaggaacggccccatattgatttgtttcccttggtttccaggtaacctctggtttgtcctgaatcccatgtttctgacatgagtgatttcctggaattgaatgggggaataatagaaggttttaaaaagtactgttagaaatcctaaattgccaggcgtgatggtgcacgcctttaatcccagcactgtggaggcagaggcaggcagatttctgagttcaaggccagcccggtctacaaagtgagttccaggacagccaaggttacacagagaaaccctgtctcgagaaaaaaaaaaaaaaaaagaaagaaagaaatcctaagtttagctgggtatagggacgtgtgactttaatcctagcattccagaggcagaggcaggtggatctcatggtctatagagtgagtttcaaggacagccaaggttacttatggataccctgtctcaaaaacagagataatttaagaaagaaaattactgaaataaccaaggtaatgccatctgacacacacacacacacacacacacacacacacacacacacactctagtcacatctatcttagcaaaacatttgaaatttccatgaccttgacaatggtccatatgtctaaaataaccattgtgttctgccaagaatgaccatttcaaggttactctgaccattctctattatctgtgtgggttttacctttaaaaacattgtacccctgagcttgggcaccgagagattctttagaggctcaagcccgctcttggtctggtcatcaatagaaaaaactaaaaacttttaattggcttaatcagcattgacattagtctatgtctcgcaggttattacaaaaagaaaacaacacaaaagaaactagcctagattcaagactggtgctgtgggaactggagagatggctccgtgactaagagcacttgctgctcttacaggggactcaagttaggtttccggcaaccacgcggtgtctcataaccacctataactcaagttcccagggatcccatgcctccttctgatctccaaaggcatcatgttgtaggcaaaacagtcttacacataaaataaatcttaaagactggggttgttgccaggcgtggtggcgcacgcctttaatcccagcactcc

SEQ ID NO: 31889 - DNA, 1194 bp, Mus musculus
cagtcgttcgtgcctcttgtcccacgcaactccagcttgtaccatgccggtcaaaggaggtagcaagtgcatcaaatacctgctcttcggatttaacttcatcttctgggtgagtgagaggcgactgtcggcgcgctcctctccgaggccacctgttctcaggcccgagacggcgtccggggcggagagtgtcccggcggccgagagcgccgggagccgctggtactgcgcgcgccaggcggactccgggcgagtagagaaaggcgcagcggctgccagctggccaggcgggactggcaggtgggcgggaggagcaagtgggtgggagagccgagggtcctggtggctccggctgtgcacttcgctcccgggtccttctaccgccgagtatttgagatgggctctgtgcctgctcccacccggagcacccccgagtgtgagagaggagtgagggaggagcggagcaaccttttcgagtaactcgatgccctccccggcccgcaaggctccttgccagcagggcagtcgagcgtctcccacttcggtggtcccacaagtgacaaggggtgctacggagggagaggaagtgggtgtggggagtcttccctgcacctggaggtcggacattccttgtttaggacctgaactctcaactgaaaacgtccatgcctctctctaagctacctgaaagactagattgtcttgattctttttcaagagcgataactatcttggctgtagagaactctgggagagttaagagaaaagaaggcggggaaggtgcctattggcgcctctagatgggataaatccggtgtttctgcatttcccaggtaatcaggtactgcgggcttgaagcctcgctctaaaaatgtccaggtggggccaaggggaatggccgttcacctgcagagggtccagaggcaggtgctagtagactctacagatgggcctctgggtagggcaacaagagagtgtccactctcccaaaactcagggacagaagcaaggaaatacacggaagacccttttgtcctgattctgagagggcacactcccaaacacaaatggacggaatttgctcccaggcaatcaggaaagagcttaactaggcaactcctgtgccaccagagactttgaacaacaacaactaaaaagtccactattccctttggagctggccaccgggatgct

SEQ ID NO: 31890 - DNA, 1578 bp, Mus musculus
tattaacaattttgtttgcttggattttttggcaacaaggtttgaccctaagacctcgtggcctcctcagtttaagagagcacccaggcctgagcactgaaacatgtaacacaaatgccttggcaagtttgtctttgtctttatatgtgtgttttgctccacagccagaaaagttgaagactttgaaggtgtcggagttggggttttcagattaggatgctttgcctgcctgtgcttttcctgattgtcagtgtgggtctttcttctgatctgttgcagctcatgatgggctctgtagagccggacctaaccctttgcttgcctttggtttctcctgcagctgcctctgggagcaggaactctagcagcaatgcattggcaggaacacctgccaagtccccgagtcagagcctgcgtctgggcctctcccgattagcgccagttaagcgcttgcatccaagtgccacaagcagccaagtgcggtagcaggaaaggactgctgggacccttgggactgcaagcagggttgtcatattcagcttccacataagagaacctttaatgggtcacatgaaggaccatgtctgtgtgtgattctggtctcatcaaagcctttctgtccttcagcaaagggttctgggacctctccttgtggcactcctgaagagtgtgttgtgttttcttgtgtttataagccactgtcactcgggctctgcggcacgtctgtaatcacatgtctcccagctctggcatgggagcatcctgggtccttcaggaggcattgctgaaatctttcccatactacatttcttcaggtttattccaagcttactctctttgtctaggtctttttagtaagaattctgcttttgtacatattaacatgttgactctactgcagcatgtgttcctacatgggacaggtggttagtgtacagcagatagaatctcatgacgctgtatgaacttttcaaaacctttaataaacatgaaaagatgtaagctatgctcattgataccatgtatgtacctgcatgtgtacgtgttgctaaaatgagtcttctgtggtcaaaataagcagggggaggagtgtcttcatcattgagatgaagcccaaggttgaaagctgtcacctccacgcccctgtcacagctgatgcatcgtctcaggaagctctggtttactgtcagtaaaagcaattatttttatagtaagaaatcaacttgtttctgattactttaataaagtctaatgtttactgtaaaatgtgcatgcctcgcctagttctcagctatgagacatctgtgttaccgtgaggacaagcagctttgatttaagtgaccattgcttttgtacatcttcttactcatatatatgcttacactgtattctccaccttacctgctccaccgtccttaaaatcccaatcttcagttagcaatctgcgtgattttggttctgatttttgagacagggcttcctatgtagcccaggctgtccttgaacctaccatccttccttctgccacggcctccctagtggtggtgggtgctgtgacacccacctagttacctggtt

SEQ ID NO: 31891 - DNA, 1345 bp, Mus musculus
gtctgtgttaatacgtgttagtgcttcaatgatcaccttcctgcttttagacaatggctgcttaggatgcatctgaagtcctttccttcctgtgttaggcactgacaaacaaggcaaagagaaaacagaaaatacgggtaaacctcctcatgtctctaactgcagtgtagccagtgatgatgtaggtaagttttgatattaataacagttttcattcacactgctatttttctcacttaagtttttatactcatagctagaacagccttccttgttaacagtcttcctatgataaggctctctctcatctcctggcctttgtttctttaagctttcgttttgttctctgactgaggacctgctgtcttccacactaggcagtcatgactactcaagcccttcatcccacagtaggtgcccacttaagagagggctgcatcttcccaggaacatctgggaaattctttggcaatgactcactggggtctcagacttacccttaaaaccagagtctgttcctgggagactaatggactctgtcccagcatggcctggtagtgtgttactaggcgcaaaggagggcagcagaggtcctagagtctgcctggagttctcagtggtgttcgtgtctccagaagatttggacaagatcacagaggagggggacgcctcgagtgttgaaggggagaggaagtcaccatctcaagccaaggctccgcggaggagagcaccttctgaaggcagcgatggcagcagtgctaacgacacggagtcggagagcgccactggtgagttgtagcccgcttcaagttaattctacgggaattcagtaagacttcttggagaccaggatgcatacaaggcactgtactgagcctttgaagaactcatagaacagttaaattgaacttggccacatagagagaagctgtctaggggtaacctttaagccatatctggacaaacagcattagaaaacaaaaagaagcaagtcacatttctgactgagggaaaggtgtgtgcactgaaacagactagcacgtgcgagaacttaaggaagttaagactggagagccaggctgggttccactagccatggaacaactcttgacctgttccaacaggcttcagctttttatataactagtagaaacatatgaagtattttgagttgaaagtaatatgaaactattttattatcagttgttttcagacttaatagaaatgagggcaaagggaaaatatggtgaccttgacaaaattgtaatgtgttaaaaatttaaaagaataagtctgtacattaataccaatcagatacggtgttttagattttaccatgctgtca

SEQ ID NO: 31892 - DNA, 1235 bp, Mus musculus
cttcatcatagactgtgaggaagcacgccagccatcgattcagtgcgtttgtatgaacctccaggagcacctgaacggagtgactgagaagcagcactgagtgtggagcccgtgcagtggagcctctgaagggagggacttggcctctgctgctgccattttagaagcagcggagaattcatgtgttgaagccccactggggttgtggctgtgtcagacgttagtggggaatccactcacagccagcctggcttttcctgtcattttctacactgatttttgtcactctgtcccattatgtctctgatctgttaacttatgaggacattgaggcttgcacatccggggatgagcagccttctttccacacacttccttttccttggcccttgtgatgtctaggtggtgttggcttttgaagataattgtatgatttcacactcgctcaccaagtgcttgcaagaaagaatggtttcagtaatacgctgcgtatttgcagtgatccaaagtgttcagagtgaagcttcagatcagtgttcaaggtaaagtgaccgaacactctagtgtcctggagaaactagctcttgggatttattattattattattattattattattattattattattattgcctcagaatacagcagagggactgaaggggtgggtgggcagttaagagtacttcctgttactcagaactccagttcagatcccgttacccatgttggggagctcacagctgcctggaactccagcattggagagccagtgccccctctgtgcctctgcagacacttggcacacatacacacaaataaaagtgatgaaagcagcctcgggggaagaaaggaatgcaccacttgatcaaaacacactaagaatcccctgagcagaaggaaaaaggagctctccaggcaaacagggtgggtgaggggttgctcaaattgtcctctgctttgtatctggcttgccagttgatctaaagaagaggtgctgaaaactgctatctagaaggcacagatgaagaaccttccctctaggtggccctgtaggaaagggattttgattgctgctcgggagtccttaattgggaaaccggattgaactgctgaaatgccagctcacaccacagcctcagggaaaggaattacatggggaaactgtaatcataacagcgggcccagataggcatcaaacaaacttaaacctagaaaaaggaaggaatatgtc

SEQ ID NO: 31893 - DNA, 1627 bp, Mus musculus
gatttggcttttaatttatcctgcagttgactttgataaatattgaagtccacggatcccagacagtgatggagggatgacactagtccacaagacccactgcagaaaaattgtgaaacctattttttcaggggtggtgccgcaaacctccaaccatagcatgaagaagaggatgaaggagaggaacaggagagtcaccagctgaaggacaaactggattacccagcaacacccctgtcttacatacacatgtgtgtgcatgcatgcagttctcatctctgttggaagggaccttccaggccccctcagcagctctgaacatccatctaaggaactccttccaggtgctcctgtgttgccctggctgcaaaccaaggtcgttacagataatgtgaaagactggagcaaggtggtcctggcctatgaacctttgtgggccattggaactggcaagacggcaacccctcagcaggcacaggaagtacacgagaagctccggagatggctgaaatccaatgtcaatgatggggtggctcagagcacccggatcatttatggaggttctatgactggagcaacctgcaaagagctggcaagccagcctgacgtggacggcttccttgtgggtggcgcatctctcaagcctgaatttgtggacatcatcaatgccaaacaatgagcactgcccatccctctacctgcctgcatagcatggactaggttgcccagaagttgagtaactgctcccaccggtcacatgcttctgatgacatcatctgccccatcttgtgtcctaatccacggtgtaccctcctgagccgtttccacctccctattatggttgggaccaggccaatccctttaccacttacagtgggtagaatcaactgtcaccaaggtggatcctggggaggggagggagtagaactgactgtccctttgggccctgacaagtgaaatcaccttccattggtttgagctggaaactcatggttggagcacaggaagtgggcttcgtgtcactttggcctgtcacttagatggccttggctctagcttcactcccaagttctactggatgtctgatgcagaaattcagagctttcaggtctgaattcggtatacatgagacccaaagaggcctgggatagtcccctcccccacggtgccgaagcccctgtattgtgtttgtgaaccaccctacatgtaaggaaaataaacacctgggcctgaaaaaaaaataacaagcctctgattaagccccacagagtgactggttcagatgacgggtctccaacctagagttcaagtcccaactctctagctgtgtgacctacttcttcccctgtagaagtgagatcaagaggtggcttaccaagagagggtcttagttcttaatcagaatggctcctccaaatatccccagtgtgaagctgaaacaagacacagcaaatctcaagaaggagggggagggggaggaggaggaggaggaggaggaggaccaccacgacgacgacgatgacaacaacaacaacaacaacaacagaaaacagactaaacactcttcccaaagccatggaaacagagaggggttgaaacaaaccttagcgttaggcacgatggtaca

SEQ ID NO: 31894 - DNA, 1147 bp, Mus musculus
caacatactcttgcatgcttgtgtatacacacacacacacacacacacttaaaacctttaaaagaagttgtcccattaaacagtaatgtctcaaattctaggtctgtggaacaggctctgcaccggcagagtttacgacaatttgacacaagctaaagtcattttagaagggggaacctctactgagaaatgcccccactagttaggcctgtgatgcattttctcgactgattattgatgtgagagggcccagctcgctatgattggtgccatcctgggtagtgtaagaaagcaggctgaagtggagcgagcgagttgagcagttgtctggtcacgtctcaaaaacccgtagcccttgcagtatggctgaacaactgactgaagagcagattgcagagttcaaagtagctttctcactatttgacaaggatggggatgggacaataacaacaaaggagctggagacagtgatgaggtccctggggcagaaccccacagaagcagagctgcaggacatgatcaatgaagtagatgcggatggtaatggcacaattgatttccctgaatttctgacaatgatggcaagaaaaatgaaagacacagacagtgaagaagaaattagagaagcattccgtgtgtttgataaggatgacaatggctatattagtgcagcagagtttcgccatgtgatgacaaaccttggagagaagttaacagatgaagaggtcgatgagatgatcagggaagcagacattgacggggacggtcaggtgaactatgaagagtttgtacaaataataacagtgaagtcaagacactgtacagaatgtgttaaatttcttgtacaaaattgtttatttgccttttctttgtttgtaacttatctgtaaaaggttccctcccctactgtaaaaaaaagatgcatgtatagtaattaggacttcattcctccatgttttcttcccttatcttactgtcattgtccttaaaccttattttagaaaattgatcaagtaacatgttgcatgtggcttactctggatatatctaacttagatggagttggtccaatgagggaacatctgggttatgccttttttaaagtagcttttaggaactgtcagcatgttgttgttgaagtgtggag

SEQ ID NO: 31895 - DNA, 3395 bp, Mus musculus
gtcttctgcacacatggttcaaagggactgaggtccactcacctgtgtgcagtcccaggctaggtctccagggtggcctcccagacagtatttcctttgttttctggctcatttcccagcacaccaggttatgcacactttacagtaggttctctagggcagtcccaagcgatgaaacggaggactgaccccaggccacaagagcatccctttaaagtcccctccttctcttccagatcctgggaatggccttttccatgacactgttccagcacatccaccggacaggtaaaaagtacgacgcctgaggctgcggcagcgcctggctccacccggacactgcgtgtgccagggaagaggacccgagtcatgtctcctgcctgctctccgatggccaccctgcaccacctgccggcctgccctcccctgcccacatccttggccttagacctcatggagggcagaggcccagggatgaggcatcatgcagagacctcagggcttgggcaactggattcctgcacctgcagacttgccaaagatgccggggcgggcagggtgtcagcgaggaagccccttcaacgatgggtgtctgcccctggccttcctcacactgacacttgttcctatgtggggtggagagtctgccccatggaggccactgccgtccatggctgcccagccagagagcctgccagggtgcagtgtggcaccgccaggtcaggccccctggagcaccctgcccgggtttttatactatagtgtaacttttttttttattttactctgattatgattattcaggaatattatctctcagataagtttagggttagctctctgatttataactttttactgtgttgatttccataatggtttgagtttccttttcctgtgggtggggatgggtagagagagaggacctccgtccacgttcagtcaggacacaccactgtgcaacactcacgaggctggaggtagggtgagaagtgccagccgtttttccaggactcaccttgagggagagggtgaggccatgatacggggccctgccaggcctggagaccatggatgaaggccagaagaggctggtggcatacacagcatgggccatgctactctggggtgagaggatgctgcctgaaccagggagccacatcagcagggcatgcttaggtcaggggacagtgaaacgctttgccgggaggagtggcagtcagaacactgtggcatttcctcttcctccctcggtcctccgtgggctttgacccgcgagcatcctgcatcccgaatggtcactctcacacattcctgctgctgcaaattcctctggttcagaccccgctctcctcaccctgatccggagagtggaagcagacatgttcctctgcccagactgaaacagagtctcaggacaacccaggaagggaggcagaccccaccagactcactcagttgcttactgccctgctgaggggaaaggaaagggccatgtgggtctcaggaccattcctccttaggatccattgctgtccacactggggggcagacactgtagcccatgtaacctcaaagacaagatacagaaactctgagaagtcaggcttccactgcccccacagcattggggagaagacccttgttagatgcccagtgctaggccaagcagtcttgccaacactgatacccaacacatgtccttccgtaaagacaggggcctgtggaactgactgagcacctatctgggatccagatcctcactctctctcgggccttcacgtggtagctgcttttctcgtgctatttggctctttacgctgtttcccaccaggccaggtgttctctggtctagcaatgacatccaaccaacctaaaacccctctgaccaccttgaataacagtgatgaccaggatgtggaactttcagtacgttcaggattcaagttttgggggtgagagaggatagcggggagctctcggcagattggtcccacaagttgccagttccaggagatggaattgtggtgttattggaggaatgacagctatcttcccccaaggtgcagagttcaggtagaaacaaacagaaagcaagcatggcgcctgctgcattatgagtgtggatgggtagggtgggtttgtttatgcctatctatgggtgtttaaaccttcattaacttcaacattgaggtcccactaccctaggaggcacttcgcctccctgcctcgtcacatctgtagagtgcttcagggtggtgctggttcctggagccttagctgaagtcctccctcctcaccaacctcacctcacctgtctgttcagcagagccagatcataagtcccaaactgccttttttgttttagctgtgtgtggttgcatagtcatctgcagagtcttcacggcacagaggtctccatgcacagagtggatgtcctgagaccctcacttatcgtggggcaatggccctcacatgctagaagaccacaccgagtaaggctaggggagatggctcagctcttctctgacactcttgggtctgagttcactgaggtcctgccatgaaatctcccttacctgcggcctcccttgcctaaggcagagccgtttccttcaggtaccacacaagcaatttgcagacctgactcagaaagtcctcttggtttgcaggtgacctcaaggaaatgcctggcgcagcctctggcatttctccacagccagctgcctcagtggggctcagagggtagggtctggacaggtgtctggtgcaggtctccttgcgcctctgtactctgcgctggcacattgtcatcctgtctccgccagcctggaccagcacctcagctgtcccccttgcacatgctctggcctgacttaagagttaagtggtcaagcccccagctcacttcaggtggatggaattggttgtcccctcctctctggacccctgcccaccctctggtggaggtgctaactagcagggacatggcacaggacagggagctgggtgccagatgcttggggtctgttctttgccccacggcccctggcatcccttctcatgttcccgttctctcatctccctcccctcctccatgatggtggcattctggcctcaccttcctgagtgggcattctgaggggagaggcctttgggcctccacttgccttgctgtcccttggtggccagagagccaggagtgcacgctattggtttcgaatgcactttctgcttgcaatgccttgtctgcatttccttcatcccaggtcccgctttaacgaacaccatgtttttagcatgtttttaaataaaaactgatcatgtgtcaaaagcacaaccagactgttatttagtggtgtgttttctccctggagccatggccaagatggagg

SEQ ID NO: 31896 - DNA, 1189 bp, Mus musculus
tctctctgggtcagactttcagactgtatgtgaagggtaacaaagacacctctccccgaggtctgcttgatcgtatgctagcttggctccttgtactcacccagtctccatgtggcctgtacttaagtgaccctggctgggtggtatgctctctggcctaccgctcatcttccttgagctctgtatcgtcacagtagattatatatttgcaggcaaagccacaaacagtctaaaggcaggagccagcatagtagggttctgagagctcatacccagatttcaggctgctgtttttttttatcctagtctctgtggtgatgggagctttttaaaataaggtcagttaatcccattcctgaaggctccaccttcacgggcttgtcaccctcccttcttacacagtcacattggggttaagatttcaatccatgaattttgagagggaaacaaattcagctggaagcctggtctatgtatgtgagcccatgcatgtgtgttatatatttgcttgggtataaaacagttgacactgtcacaatctatgcatctacgtgtaaatgtaaatctctctaagttacatgcttcttgcagtttactctctgagtgtgtgtgtgtgtgtgtgtgtgtgtgtgtgtgtggcataaactgccattttccaagcatctgcttctatcggtggatctagatgagcaaaagctctcagactgaagcagcatgccccctcctcaggaaaacacccctgtattgaacccgctaagaacaaatctcggcggtgctgttccgcacccagggtgcagtgcagggcatttggtttttctggcccagcaacttcagttttggggatcagcacctcattctcctctctaggcaccttcctcagcgtgtgaaagggtgcagcagttcacaggcccggaaggagagctgagccataggccatggtgggctggaccacggcggccttggatacctgagtatcaggtactgatgggccgacccctggcactggataggtgtgttcttattgtgtttccttgtcaggagtcagcctcccaggagagggtctggtacggccgtgtgctcagccctggcactcgagcagagtgccttggttggacgagaccttccacgatgggatgatgctgagttctccaatggagattgatggtatggacaccaagaaacgggtgag

SEQ ID NO: 31897 - DNA, 1190 bp, Mus musculus
gtctgagacaagtcttctgtagtccaatctgctctcagacttactatatagctgaggagagacttgaactcctgctccttctgcctgcatctcctctggactaggaccgggtacattatggaagccagcttgagtaattcaggatttttttctatgtgctttcctgtctgatgccattgatgactatgggagagattgagctagcttccacccacagggaacatggagtctcagatgcctacgtgttcagcccattcatcaaccttgatgcagagctgagaacacagataagggatccacggtggcacggtggggactgtgacgaaccaaagatgctgtgcatgcgcaccgtgagcgtgatcttcaggctcagctgattgtttgttgagcccggcgttgccagaacttacatttctttttctccctctctgggtcatggtcttcttgctctgtagcagaatgcccagacctgtagaacacaattgcaaatatttggctatgcaaaagaggagctaagtgcttaaagtccaaatgggaaacatgattcttttgtttaaaataactacttccaagcagagctccattcctgccggcatctgggctccaggtctgcgtagcaggagcggccgccactgtggaccctgagcgaggtgctgattctctttgtccttgacctcaggggttggggtccccatggtcagacatgaacatggtgaagtttcctttctagagtcttccccagtcctctgctgacatgacacggtcggcaagcacctttggaattccccagaggtcaagggtctggatctgttgaggaacctttatgcttcttttcttcctgggatcttctgatattcttttctctgcctctctcttttctctttcttttctttttctttctctttctctttttctcttcctttttctttttctcttcctttattttatttatttgtttattattcttttgaggcagggtttattggctgtcttggaactcactctgtagaccaggctggtcttggactcacaaaaaattcacctgcctcttctacctaagtgttgcaattgaagatgtgcaccacgactttcccaggaaccttccgttgttaaagggaagctttaactcttggtttccaggttaaaaatctcttagcctgattctaaacaattgacatttaaaaggcatg

SEQ ID NO: 31898 - DNA, 1156 bp, Mus musculus
tttatttgagaaccagcaggagctttggttaggtggtcctagcttcagggcttacaatgagagtggctattactcaaatcatatccattgatcccctacctgaaagcctatgttcacattaattcacagggtgaagaacctgcttagtaatacacaaggagcagtctgatggagagcttcactcatggcatcccagtccgtggcttcacccatcacatctttgtctggcctgtaggttatcgtcaacagaggcttgcttgcaggagacttgctggggatttcacacaccttttaggtattaaccaagcagcctggagttcaacacccaatctaaaagctgtggacagaaagaggaaagaaatgagtatggttatcagggacttggaagccctgcagtgacaaaatacggagcaaaacaagtgcccaaagtatgaagcaaaagtgcaccaccaggagcgaactgactgatcctgtggtgccagtgatcccattgtaccttgcatttttcaaatgaactgaagtgtctgaatgagctggcagagctgagaaggatgcacccgagtgcccagtggactcagccaggaacatcaccagatgttggggatccacacccaagggtccctatgcttccactctaaccggggctggtgctgttggttacactgcttcaagcaatctggagcagaggtggaaggtccaacctgggagggtttgtgtgtgcccagctcgaacgaggtattctgtgggaaagcagacgtgagcagggcagcagaggtggtggtgcagggaagaggtgagcagcactctggagtcagtccacactaactcagtgcacagccttagggcaacacacttattttgcactgtacctcagtttcctgcctgtaaagtaggtatcaagttatcaaccctatttatgagcaatgctttacagtgctgagcacatcctccagttcccaaatacatgcattggcatgaactgacttgaatggaggggacaggctagtgaactatgcagtaaggttgtgaggtccccacaacaattggcctccacagatgggagagataagactatgaaagacatggaagaggtctcccttgaaagatgagaaatatttattgatgttatttcttcattttgaggagctaggagttg

SEQ ID NO: 31899 - DNA, 1159 bp, Mus musculus
aaataacatgaaccaagataattagggatctcctggggcagcagaactgtagggtaagaaactaggaaggctgagaaaccattggtccttctattctggagaattataagtggcctgccatgcacatatcctacactcccccaccaaggaagttatggtgttggtgctgtgtctcctactttatccatatagcttgctgcctaagtattttattttgaccacagccaacagatcactgaatgggaaaggtgccatctgcctctacaggacactctgtagtactacttagctgtcctattgcagcagataagaaatagcagaaatagcctcaggaaaactctagaagaactttctctggtttctcctactcagcagtttttgtaggaattttctagattagagggtattcttcctgttttcctcaaatgttttcattttcttcatcagttgctagtggccacttcaggccagtgtacctgtctctgataactttggagctgaccataccaaggccatcttgggagacctatgtgatcaggggaaggtgattccttaatccatgtcctcttggggctgagggcacttggttgggaatctagtgatagctagaaatgtctgggaagctcagggatcatttctatactggttaggaatgcaaataccacaaagctgagttattgagaattacctgggctgagcagagagtgtagggtgagaagcagggaaggctggaaatccctgtatggttcacatggccagtatttactgaagtttcatggcaaccagtgcatatgcagggaaaggatgcacgttggcctaaggactatggtggtggaaggcaaagcaggaagcacccactcttgctctcaggatcttgccactgttctcagtacctctcaggatccaaaacattgcttccttgaagaatatcttgcaataaatctgagccagattgagactctatgtggctaagaccacaggctagtagatagaagcactaggcctcagaacatagttgggcaacactgaaatttgtttacccctgttccacctgcagtgatcacagcagggacatgaaggaagccttgcagtacattgcatgcacgcatggacacattcagaaggactggctctgtgagagcttctctcaggaggcttc

SEQ ID NO: 31900 - DNA, 1416 bp, Mus musculus
aggctaaaggcaaaagagagtgaaccaggcatgaccagtgtcattgggtctgtgagatgaccaagagtccccagagtcctggggatagagagccctccatcttgggagtggaaaccttatggtgtgttatctagttagcaggaaatgttagagacaggtgaaaatgtagggacaggtgaaaggtctgttgcctcacagggtctgacactgatggagcagattgtgtcaacaatgtgtcacaggaatggaaagaatgtgccctgagtccacctccccaccccaccccaccccaaaaaaaccccataaaaccaaaaatcaaataaatgaataaacacacacacacacacacacacacacacacacacacacacacagagagagagagagagagagagagagagagagagagagagagagcttgtctatgtatatgtgtaagtggctgtgtcctagtcctcttccataggccttgtgtccctagtctatgcacactcagtctttcccaggctgggggttgagtcagatggcagaggttggaggactgagggaaggcagtgactgtgggccagtataacacctctctggccaccaggccagaacagtgggagctgcctccagggttgctacccaggggccacctgggtctgacccctgctgaaaacctgctagagctatggttgcagggttcggtggcaccttggacaacctatctaacagatcagaaggaaaactacctttccccccaaagacttgactgtgtagaatgtagctaactaatatgcccagccaggcacctggctgcacagctataattccctctgccccccaactcccaggagaagaacgagatcatcatggactacacagtgaagcctaatctctgaaataaatttctttaaaaagtgtctggaacttggcttttgtacatacacttagtgaattagaaagggcacaggtatgtgtgtgccttcctagagagccagagcccaggccacgggaatggtggcttttattattattttttttttacactcacagatgtctaatattcaattttaaggtttttgtaattttttttctatgtaagcccccttcatctcttcaaatcctcagtaaagtctgctacaaacacagatatctgcgctcgtgtgatttctttgtacagaaatggagttctgtgcctgttacggagcacccagaccaggagtgcccatagggcaggtgcacactggagcacacagaccagcggtgcgcacagggcaggtgagcactgggacagggcctgctgagcagagcctatgggaacaggacccgaactcagtgctgaaggagttagaatactcttgaaaagggcgtcctaggaggctggctgtggttccacagcactactgggcatcttactcagctcaactgctc

SEQ ID NO: 31901 - DNA, 1123 bp, Mus musculus
agccgcccagtctttctgtagccccaaattccttctccttaactcagagcaatttaacccatatgctgctccctaccgtgttaggatggtggctagacccaggcctcctcccttcctactgcactatgtaaaggtcctgctatcaaacagggccagggtcccagaaagactactgcatccctgaccttgtgaccaggattcaccagtccacgtgcaggcctatgtttgcagcccttccctcccccccaccccccaacatcctagccctggcctcctcccctgcttatgccgcccaggagcagagctcctgcaagccccagcctcagacatttcagacttcgatgtatgtagtcagcctttttggaacatgaagggtataaccttttcctattggaagcaggtccgttcagatgttcggtcccagtgtgggtcctaagtttttcctgtgttaactgacctcagtggcctaatggaaagtcaccatataagactgtcttactgcctctccattcaagttaacatggcacttgacttagggaacctcacttatcctgccaagctggtactgtgctgaaaccatttgtcttttttaggtgagatcttcctctcttgcctgggctattgattccagtgatcctcctgcctcagcttcctgggactacaggtgttcctcactgtgccctgctttcctattttaaagactgaaaaaacaaggcccagagagctttgggaagttgcttaggttgttggttgtatttttttcatttgttttgtgagtggttgtttgacttctgaggtgtggcagactctgggaatgcgtccatgatcagaatagacagggtggctaggagtttactttggactgaggggagggcagtgactggaaaccagttaaggagacttgtaggtagtgggaagtgctgggtgtgtgtgtgtgtgtgtgtgtgtgtgtgtgtgtgtgtgtgtgtgtgtgtacccaaggtcagcttcactttaagggaggctgttgaggtctgacctctgcactgaccactgtagagaagacaagtggatcggaaggaacattccgagggagaatggagaggcctggagacagggaggggatgggtgtgccccaggggtg

SEQ ID NO: 31902 - DNA, 1209 bp, Mus musculus
gttgtggcccctcaggctttcctggcagccctggtgcctgctcactgcttccttcatccccatacagagcctctctgagttgggtccagacctcatgtccctgtcctcttttctgttctcttccctctgtccatgctgatgcggtctgcactcagatccacccaattcttgcctggaatactgcagtctcctcttcactggctccctgtgattcccaaagctatgcttctctggccatgctattcccagcctttaagatgcttctaggcagcgtggttcctgttggtgagctctgagctctgcagtggatctgcctgactcctgagcctcagcctcctgtgctccctgctcggcctctgggctgtggccgctgctcctgggccatggatcctctcacctgcccccacccaggttaggtgcccactgtttgcccacccagggctctgcagacctctgtctagccgaggtagtcttctttgccgttcctgtttgttctaggccagctgtatctgcgtatccttgtgggtcctcacactctgcacaccttcctgggtgccctggggctaaaggaaggaaggaaaggatcaatggatgccctcagcatgggctggtgtgttcagcatggctggcttctctcctggactgttctttcttggtctcctctgccttttgtttaccctgggctaagtccacggcttctgtccaggatgctagaggccacgaggctcacagaagaaaaatctggatcctgaagaccttgcctctaccctgtctccctctgtcccatcccttttccacaaggaagaaggaatgaaaaactgcccagctcagcagcagggagcttgcctagattgctatctgcatcagaaccacagctcccatcttaaatggaataagggatagtttactctggagccattaggattgagcatggcctgggaacacggatttaggctaccccaaactccatgtcccaacgtggaaatggactcacacatgaatcaagacaactttaaaatacactggtggctacaccagagaggcaggcacaatgagatacagggagctattctacaggtctaagatgctctgtgctgacgcccttggcttttagagtggcagaaactagtgttctgctaagttaacagctttgagaggtggctatttattgccacgtggtattagttcagatacagagtgaggtaagga

SEQ ID NO: 31903 - DNA, 1235 bp, Mus musculus
acttcaaggacagcataggatctataagacccggtctcaggaaaccctaatgaggggctgaagtcagcccttgagagcactgactgcccttccaaaggtcctgagttcaaatcccagcaaccacatggtggctcacaaccatccataatgagatctgacgccctcttctggagtgtctgaagtcagctacagtgaacttaacatataataataaaaaataaatctttgggccagagcagaagtcctgacttcaattcccaaaaagaaaagaaaaagagaaagagggccgagcaggaggcgccatcatgggtgttgacattcgccacaacaaggaccgaaaggttcggcgcaaggagcccaagagccaggacatgtacctgcggctgcttgtcaagctgtacaggtttctggccagacggaccaactccaccttcaatcaggttgtgttgaagaggttgttcatgagccgaaccaaccggccacctctgtccctgtcccgcatgatccgaaagatgaagcttcctggccgcgagaacaagactgctgtggttgtggggacggtcacagatgatgtgcggattctggaagttcccaagctgaaggtgtgtgcactgcgggtgagcagccgggcccggagtcgcatcctcaaggctgggggtaagatcctcacctttgaccagctggccctggagtctcccaagggccggggcactgtgctcctgtctggtcctcggaagggccgagaggtataccgacattttggcaaggccccaggaaccccacacagccataccaaaccctatgtccgttccaagggccggaagtttgagcgcgccagaggccgaagggccagcagaggctacaaaaactaaccctggatcttaactgttaataaaaaaaagcattggaaaaaagaaaaaagaaaaaaagaaaaagagaaagaaagtgaaagagaaagagaaggagaaagagaaggagaaagagaaagagaaaagaaaaccataatgagtatgtaaataaataaattgggttaaaagggaaagaaaaacctaaggaaaataaaaccagaaactgtatataatatccccctttctagatcagtatgttgcctacacagtataagaaagaactttttttttttttttttttttaaatttcaagacaggctctccctttgtagcctgagcagtaaactcatgagtgtcctgcctcagtcttcccagtgttagagaaac

SEQ ID NO: 31904 - DNA, 2345 bp, Mus musculus
ctggactataactacccactgtgcgcacttcaagccttcgccatcgggctgtccagctttgacagcaagctggcgtgtgaatgagaagcagcaagcaggggatttcttcaccacagagccttcaagagcagaaagctgctgcctctgcccctgcccctgcccctgcccctgcccctgcccctgcccctgcccctgcccctgcccctgcccctgcccctgcccctgccctagcacaagaagagcaacattctgcccctctggtgaatgatccagtgtgtgtgtgtgtgtgaatgtgcatgtgtgtgtttgtttatacatgcatacacattcacacatggatgcatgcttccacgtactcgttcatgccttctctgaacttcagagacctggtcatagattacaacttctcatgtgtgagagatggcttaaagcacagggaagtagacacccaggcacactggtgtctcctgatcgcacaacagactctgtgtggtgagtgtagctttcatgtgctcgggcacttccaacagaatcaggttctaatgatttaatacttgggcctcctgttttgaaggccctttcaaaagggggcttttcccttggatgcctttagcccaggagcctgcagccttcctcagccaatggtctgatagtgtctcttgcactgaccccagtcaggtcctttagcacaaaacagccataactagttggtgcacaaagagtgtagctgtgtcccaataaaactttatttacaaagtgggcattggcctagtttggcctgtgactctggttcgcaggcctgccttggctgtgtccctgtcctccaaggctggagcatcttccaggctagatgtggagaggcggggggtggtttacttttcagtagcagcagactgacattttatttttatttttactttatttttttttcccatggatctctgtgtagccctggctatcctggaacttattctgtagaccaggctggcctcagagatccacctgcctctgccccccaagtgctggaattaaaggcttacactactgtgcctggccatagacagactcttaagaggaattcttgccgaatctactcttggtagcttttgcctcatggagattatggctgcagagtgtcatatatcatcttgggacatgtgacactagtttgttcgtgggtctgaaaggctctgctgtccccagcctgcctcttgcttattctcagagtaggttggtgggcagccatctcagaagcatgactgtggccagatcttcggaatctttgctctctggaatcttaatctagtgtctccttagaggcagcaagagtcttggtgaggaggtcacctcgccgacactccacaggctttgcctgtcagctttgtcctccagcctcgaaacctggcccacaccagtggagacactgccctgcatgctgagtctttgagatcttgaacatctcgaacatctcccagcgaatcatgacaaattcctcaaggtccccagcctacagtgtacctgaacttaagaattcaaaaactttgggtctacattcagtggtcccccactctcaaactggcaactgctccgtggtttttcctgtatggaggaggtccctgcatccctgcatcctgttgctccatgctcacagctgtgtgacgactacagcgtgagatctgggaggtgagacctgtgctaaggccagtgtcttgcctgtcccttcagatgtcactgtctctgcctctggcaggcgtcccatcaagtgccttgttcataaatgtgctctgaaacctgacacacctctgctttcccagacgagccacctttgttgagtgaaaactgctctctgtctccacttgaagggggtggggctatgactttctgcccagcctagagagctgtatactcccatttcatggactctgcttgagtgtgcaggttttacatgaattctatttataccttttgtatgccacataaataaagataatttatataaagatgtcgctttcccagaataccatcccttgggtttctcctgttgtgttctttaagctctttgagccaagtagcagcagaattgggtctttggggtggaggtgggggcaccacagactaagaacccagtttaggaggcagcataaaagtgtcatactcacgatcttggagctctgcatgaattgtggaactcagcagactgcactaggggcccaggatggccaggccaaatcatcttggacactggtcagcctcctggatctaacagtaaaactgtgtgtgtgtgtgtgtgtgtgtgtgtgtgtgtgtgtgttaggatcttgtggctattcaaggctatactggaa

SEQ ID NO: 31905 - DNA, 1202 bp, Mus musculus
ggaccccacaggggaccaggagtgggctgcagctgggggaaggggctgctattctaagtgctccttggttttcctgttcctttgttttgtttgggattgaacctatagccttaagtatgaagcattctacagctgagctataccagtagccaattttgttttgtctttgagacagagtcttactatgtaatcctggctgtcctggaactcactctgtagactaggctggcctcagactcagagatctgcctgtccagtgctgggattataggcatgagctaccacctcctggccatttgtgagggttgctttaaggaatcatagaaacaagatgcacatacaacacttaggccaggttgtcttgggacattctgagtacttgatatatagtttaaaacaaaaagaaagagccagatggggctcaatgcacaggcttagcaggcttaaggccctgtaccatccccagcacaaaacaaagcaggggggagggaagaagagagaaggcagagagaagaagaaaaatgtctctagcatgggcttgtgttagcatctttttcttagcttttgtgggcactgatttcctctgggcccctagaggctgtgtggtagtgggtgggcctgtgtggtagtaggtatgcccttttgtgaaagtaggcaatacctgggaatggacactttctctaaaggagaattgattggttgcaattagcccatggtaacgtatacatggaaaaaaatgaaataataggctttcagagtgattttgtctttatgtgctttctttcttgttgtttttgaaacagtgcctttgacgatgagaccctgaggcttcggcagctgaagctggacaatcaggtgagcaggggctcctggaggactgcccaggctggtgctgaagtcccgtcagggtctcacagcaggactagaagggcagggtcactaatggttactcattaatactgtgtgaacttaggagtcgctgggccaacacttgaagacggtagcaatacacggttttattaataatcagcgaagagcccctagctcctataaggcttagaagaatgttgtagctgggcatggtagcactaactgggaatcccagccccagagaggctgagacagctccctgggagttcactgccactctgagcaaagaggataaaagaattatttactttagttagcccatataaaagaca

SEQ ID NO: 31906 - DNA, 1383 bp, Mus musculus
acttaagcccttggctttgtttttttgtttgtttgtttgtttggtttggtttgggttttcgagacagagtttctctgtgtagccctggctgtcctggaactcactctgtagaccaggctggccttgaactcagaaatccgcctgcctctgcctctgcctctgcctttgcctcccaagtgctgggattaaaggcgtgcgccaccaactgcccagcaagcccttggtttttgaggcatgttctttactgctgagctacctttcctactctgtctacagtgagcttgtaattctctgaattcacaagacagctgtttggttatttaaggtttcatgtaactcaggatggtctctctagccacaggcaaccttgagcttggcattctcctgcctcccctcctacgggctgaggtcctgggcacgctccaccatatcctacttggtttggcttttgagaggttttatgtgtagcccaagcgtgacttgaactcctgatctcttgcctcagttgggctaatgagcatgtgccccatgttcagctgtagccatctttgcatgtggtgcctgcccctcagcctccagtgaccttcctgctttctgcttctcccagctctccttctacagaaagccttctctgacgtgaaccgtactatactgagatgtggctgtttccttctagtcagctctctcttctccttcctttccttcttccttgccattgtcccctcttttgcagttctggggactgaaacctaaggctttgtgcatgttaggcaagtgctgtaccactgtgcctcaaaaatggggacctctgtatcattgcaggaacttagtactcagtactgtgactaagtacttgctcatctttaattcctggcatttagcatggcacaataacatgagttcagcaggtgctcattgagtgagtttccttgaatatatatatgaataagataatgtttctcatggtggtataggaagctgttttcagccgggcagtggtggcacatgccagcacttgggagtcagaggcaggtggatttctgagttccaggccagcctgcttggtccatagagcgagttccaggacagccagtgctatacagagaaaccctgtcttgaaaaaccaaaaaaaaaaaaaaaaaaaaagagagagagaaaaggaagctgttttctttacaacctgagtctgattggtaatttctggtagccttgttagcctgatgtcatgaagaattggggggagggtgtcacccacatgattttccccctctctcctttttgtttcttctttccaggcatggtttgcaactggatcctgacccagaccaggaaggcaacctgcatcatgtggttaccaactgctcttcatttacctattgatgc

SEQ ID NO: 31907 - DNA, 1195 bp, Mus musculus
taaaggagctgagaacgcggtgtaagatctgttacccattacacagaagagagggaaaccctgaagtaaatagagaagggagagctgctttgaccgggaggaggcctgctgaatacaaaggcctaagatgtagtgagtgtggtatgctatgagacaggaggcagggtcttcgcctttctgaattttgttcttatttaatatttgaaggaacccggttagaagttgtaagcagctaggtatgtggcacgtaccaataatcctggtgtgagacaaaagggcctcacattagtctagtctgggctacataataagactgtgtttgaagagtgagcagagtgtggtggtgcacacctttaattccagcacccaggaggcagaggcaggcagatctctgaattccaggccagccaggtctacattgccagccccaggctagccaaggctacataacaagactctatctcaaagattaataaaaataggcaaaggctgagcagaaacgagccaaaacctgacttcgattttgtttgggtaagagattatatagctaaaactgagatgggatgtggccctatttcctatttcatggattgtggattgattgactaaaagcaaactgagccggagaattcacctgcttcctgtctgctaaggtgatgtgcccagctgctgtcaagttcccgctgctgagactcctcaacactgtaccctggatctgtgagccagagcaggcccttctttccttaacttgccttcccagtggggccagcctgtgatcccatcatgtgggaggtggagactacatagtgcatttgaagccaggggaggctatgcgagaccctgtctcacaaaagccaaaataattctatgagggctggtctatagccaagaggtacagttactgcctaatgtgctgaggcctgaggttcagtctgaaagccaaaaagaatatattcaaaaccatgcaaagtcgggattgctggatgctaagtacatgcgacttaatccgtaactcggttgacatctccttatatgctagagaatctgggctgttctttttgttgttgttgtgttgttgtttgtcttttaacaaaacctagatgtgattacaaacttctatttgaaaacctagtggttactcaacccaaccccacagtcatgtggcctcacctggttttcagacccaatgttgaca

SEQ ID NO: 31908 - DNA, 2125 bp, Mus musculus
tctgggccctgacaacatcaactggtctcagttcatcccttagctgcgatagaggcaaggccttgcccctgccactcaagccgcctgctatcctggcacttgtgtggctcagggtaccccaagccgtctgagggaagctagcaggcaagggctgagctgtgccctttgacctaattatgtcaagatgatagccgcatctaagccacaccaggacctatgcaagcagtaggatcccccagagtccgagtcctccactccctgctggcaagtgaagtgggtgtgacgagccatgaggaccaggaagtgcccattagtcactcggtgctcctggcagggtaacccttataaatggtgtcagctccccaagttgtcctgtaactataaatgtaagcgtatttccttagctcattatccagagatggccaggatggggagagggacggggttgcactttgcttctgcttgtggcctctgggggaaggacctgcagtgcagtctctccacactgtgggttctgctataggcttctagagatacaggttgccgtgccaggatcctgcttactgccctttcctcgcagctccccaagtctccaagtcagtggtactgcatgaagaaatcctgctgtgaaagcctattggattcgggtgtagggagatgggtgtgcctgaagcaaaagcatgggtactcacaggagtcctattaggtgtttctctgatagtgttcccaatcatgccagggagtctaccactgagatctcaggctgaggcctgagaaggagaaagtgacccctcacttgcctggcttccttagcttgctcctgagctttgcaaaaaaccaccctagaccccactctacaagctacagaacaacactactgtaactacctactaaataaagcccgtggcactggtcttggaattgagcgagaggtggagcctgggggtgatgggcaaggcctgcccctgctgcatgggccttccacagatgctctctcccgcacccttcttggactctgaggttgccagctttgtctgttgcgatgattcatatctataatctcagcctttgagaggtagaggctggaggatcagccctctatgctacatgagatcctgccaacagagtccagttcccactgttccctgccctgcccacctcttccttgccaccccagaccttgttccatgggaccagactctgacttaggtccttgttgatcccttggtaacaacagcagttatagtcctccaattccctcccattccattcagtattcaggcctgaaagccgaaactgttgtaggtgtctcattaccacctctatcccagctccaagcccaggagccagcccccttcctgctcctgagccttcccaggcaaggctctcgctcagcagctcctgttaccaagtttgtaaccagaactgacagcgaaaagcatcagggactgaggagcctcccaggacaggcaagggcctcctcccagcagcaccagtcaggaagcatcaccatagcaaccctagcagcaaacaatggtaccagaaagggctttcctccaaagccgcctctcctggctctgtggctcagaggaagaatggccaacatcccgaagaaaacatccctccaaaagtcaagcctgagccaagtatctcgtaccagggagcctttcctgaaggtagagtggggcccaacaacgcagccagcctttcaggttgtcctgagcagtagtctctggtacataagccagtttctgctttcatcctgtggtaccctaagttggagctcagaacagaaaggagaagcctgggcaacaggttgaagaggccttatctaaaggacttgggatcagaaatgtgcttagctttgggatttacttttggattttggagtatgtgtatgtatgtcaaactatgttgggcaaggaccccaaacttaatataaaattcctttgtttcatatgtacctcgtacacagcctggaggtgatttaatgcatgcagcatttttaggatgtctatgatttgactgaggctcatcacaaaggtcaaatgtggaattttccactttgagacgccatgcctttgcccagggtgggtgggtggatatttttttagcatttgtgata

SEQ ID NO: 31909 - DNA, 2125 bp, Mus musculus; identical to SEQ ID NO: 31908

SEQ ID NO: 31910 - DNA, 1194 bp, Mus musculus
tggcgtgcggaacagaaaattttgattgacagtatcgctctgagaccgtcactgcaggaggcttagttgggccagagcctctagtagttattttttgttttagctttaaaatttatgtgtagagtgttttgcttgcatgtgtgtctgtgtaccgtgtgtgagcagtgcccgtaaaagccagaagaggaacgctgggtcccctagaactggcgttagagacatttgtgagctgccactgctggggattaaaccccattcctctggaagagctaatgtcctatcgctgagtcatcactccagccatattttatttttttatcattaattttaagaagacaggttgttggttctcttgcacagttcagtgattgtcaggataggaggttgtaaaagcctgtttcccgcgttatttcctttcgtagccgcaattcccttgcaaaacatctttacatttcaaagcccattttttaacctgtaaattgcatttaataatatccctctacctatagctttccctccccccccccccattccccatgctaccatgcttgcccacactcttggctgctattgccacactgttgtattgctcctacactggaattaaccggtagatatctctgctgcctccaacctaccgcagataccccataatcagtgtggaccatgcgaggcttctactgtgcctacccagaattgactcaggtgtctggcgactttgtagtgttacctcttcgttgaaatacaaaagcaatttctacctactttttttctttcctaggcagttgatgcttttctcgtcatttaaataaataaatgcacattaagcaggtagaacgatgacaggcacacagttaaggctctggaactgttagtgttaacagtattagcagccccaccccacccccgccgccaggcctaccataggaaatattaaaaaaaaaaaaaaatgggactgtacctagtatgttcagatttctttctttctttctttctttctttttttttttttttttttttttggttttttcgagacagggtttctctgtatggccctggctgtcctggaactcactttgtagaccaggctggcctcgaactcagaaatccgcctgcctctgcctccccagtgctgggattaaaggtgtgcgccaccacacccagctttcagatttcatttcttgacaccattac

SEQ ID NO: 31911 - DNA, 1641 bp, Mus musculus
aaaaaaaaaaaaaaaaaaaaaaaagattttagttagcatataaagaaatgggaacagaaaacctcaaaactctgtgatatatgtccttgctgggcagggcctgtgctgatatatccttaggacttagtaccactgaagaaacatgggatcaccattaaagaacattgttgactgctctaggatatagcacaatagtagagtgcttgccaagcacactcaagaccctcaggtcagtcccagaagcacaaagagaaaatagtttccgaaatctctgacatccagcagtagtgtgctgaatggactcgtcagttcagaacgcgcatgtgtgtgcagctgctgtaaacaggtgcaggattgctgtgcctatgcaatttctcgtgttggaaagtgtcttgcttaggaattcagcctctgcctcttgctcatcttacaggtgaaggcagaagtggcagcaggagaccatcccactgatgctgagatgaagggtgagcggaacaatgtggccgagaaccagtctcgggtggagacagaagcgtagcctgcctcttccgctgcccacctctgcagctgctccctgctcccttcttactccaccctgttagttttgtaaaaactgaagaattttgagtgaattagacctttatttttctatctgtttggatgatggctttgggggagaagggagaagagaaggctgagggtgaaatggggggtagttttagatggtgtcaaccctacttttcttcccccgttacacacaagtgtatatcctttcacacgtacatcagaatgttaatttattttgctccctctgttagctccattttcacgtggtagaaggggggacgtgatagggatggggtctgataagccagggtggagaagaaaactcctggacagccattttcccatctcttccctctgtggttttccaagcctgtgtctccgtgcaggtgctaggggcatgggtacaccgctgttgcatccattgcctctcttaccttgctctcctgagttggtattcctgataacgccctctggtatcacagtgatcacctctagacagcccctaccagtacctccgctcctctcagtttcctcatccaggttgtccctgtcctgtccctatcccctcagcctctttaatgcacgctgaaggtccaggcacacctcaagtcctgtgcttgagcaataaagtggaaacaacaaaacctgggtgtcaggcaaccctttatgttgagttctcaggtggggcatgcagagaatgtgggcggggcaggatgaataagttcctattttggtccaacctaagtgtggcgtgtgcagactatggcaaggcaggaaaccgtccctctgctcgaacaccctgagctccattgtagactccagcagcccagcagaatactggggtggtttcccccaaacaagagggaaggtgcacgcctttaatcccagcacttgggaggcagaggcaggcagatttctgagttcgaggccaacctggtctacagagtgagttccaggacagccagggatagacagagaaaccctgtctcgaaaaaaaaaaaaaaaaaaaaaaagagttgtgagtcacaagttggatgcctggaatcacacctaggtcctcagtcaaagaaaaac

SEQ ID NO: 31912 - DNA, 2519 bp, Mus musculus
gtaatacttgagtctggaaggacagaaagatgctctctgttttcacctaatttttgagttagttgcttagtgtgataggtttcctctttcaaatttgtcttaaaaatatattcaatgttctgttttcaaaagaacaaaaccaaaaatattcagtctttctttgccattgatactcctatttgttgtctccaaatcttcttggaaagcttaaatttaagtgcaatagtaaactgactagggtttgtagctcttaggaggttgagactcatttatggtagtcactgcctagtccttaacagtcacatgaccacagtatgcttttgttgtatgaaagcctttataagaacagaaagaaatctcctgtagtctgtggtcagttggtttagatggctttgtttccttgaacctgggggcagtggggcagacagcagctgttgactcttgtcgacatcatctgctaagagcagtgaatgtctacactagaaagggaggctgactatgtgaggggggtgtaaatccacccaagtatgagcatacctagttcctgtgggaagaaattcattctctatgttgcaataatcagacccagcatttcgtcggggataacatgtatgatggtaacgtcttcgctcatcagtttcctacagagtactgcacgtatgtcacaggtggtattattgtcagtgaactgggaaaactcggtgtagatcaaggtaccatacactgagtgtgatccacttctgtggctcagcactcaaggtctcaaaggcctgtccgccattgctgacttagctagccttctggctatgttacagcctgaagccggtagataacacatgggttgtgaatactcattggaggcttttctgagttaggccccagcagcctctgggtctggtcccaccttgttaaactcttgcacagtttttaatcactctttttccagctcctggttctggatcatctcctcaaaggcatagaactgtttctgttctcaccagtgtggcttttgctctctgtccctggtgcttgcaggatggccatgtgctgggagcattccgactctcccatcttttctctatagtttccttcttctttcatatgtttctgcaaacccaccttgggctagtttcgttctttcatatgttctctaaacccaccttgggctagtttcgttctttcatatgttctctaaacccaccttgggctagtttcgttctttcatatgttctctaaacccaccttgggctagtttcgttctttcatatgttctctaaaccggcctcgggaccctctgcccaggaatagcaagtccagtaacctgctgactgttgggagcgacggctacttttgatcctgctatctagggacttggctcatgaagggcttgacgtacttgctgtagaggataaaggcatgttcaaggttgcttgctcaagtaaacagatgctgtgtagatgacttgctccagagtgggtgtgctgacagggtggagtattgaattccactgccttctcaagctggggaaggaactttaccctgtctttggtggaagggtgataatttccatggtcaggcatgagacccaaaagcctctgattcagaaatctgccttcagaatatagccacattggaggaatctgttgtcctgagatccatcttgtttgaatacgggcatcttctgacacagagaagaggtaataatgtcagtcacagttacaggggattaaggatgcagtaatatggtttgtctgggttgctgacgctcaataccatgtgtgtccaatatggagactagtcactggtcacttgggattttccaatttatttatggatgattccgtggaagctcccaacgttctaatgggtgctgatagatttggagggagaatggtgtcataaagcaggcagtagctaataggaaggccagatatctagccagaagatggggttgggtggagagaatggtggggagatacagcaaccctgactggctgagtctaggcaggtgagagcctgtaaggcaggcatgacaatactttcctctggctcctaacttagggagatcatctcagtgtgtcttataagtgttcattaacaacgttacttataatttgcaggtgatattttcatgtgggttcccaaatagggaggatcataaggaacagggcagccataggaacccagtgccaagtgtgggctaaggtgctaaggcaggagatccttcagggaactgtgataccctaaggagagtaggaaaggaggtacttggactgaggcttggaagatgataggtgtttcccagtgcacaaggccaagaagggcatcccaggtaagccagagcacagcgttacatatgcttggctatttaaagaaacaggaaagtttgtcctgctccaaagtgaaaaatgtcttcactctcttctctcctttgaatcagattctctttattttcagaatcaaagactattgctcttttaagtctgaaacttaggaaggcttctacaggcttccttcca

SEQ ID NO: 31913 - DNA, 1152 bp, Mus musculus
cagctaacagcatcgaaaagtcaaagtgccaccatgcgcagccacaaagctttctcttcaagtctgtttgaagaggctctgtgtatgacgcacagatctccccttcacctcagcaaaggccaaatcagcaggtgaaattatctgggaaacatcgacagagaaacttttgtctagtaggatatataaaatctttgtggcatgcaggtagatgacacgattcctgagtaatttatcctaaaagagacattgtctttttaaatggacagagagggtagaaaaagagagactgtttgatccctctaagaaccggacacaaaaccagctgcatgcacatgcaatgctttgtgggaagggaagggggttgcaagtggtgttgagttaggaggacagagactccaaccagagaggacggatggtccgtgttgcaatctggggctgtttgtctgcgtggatttcatctctctcaccgcggcatcgattgtatgcaaggcctcgctgcctaatctatatgattttaacttatttattttgggactgtttttcagcatatgatatataagatttgggggcttgaggaaagactgtgatagactgaggtgtttgttgatgagagactgaatttgacttgttggatgggcccatggattttgaaatgctcgtggtaagcagaattctaatcctggatacctagacctggaaatcattaagtgtgttattttatatggcaataaagcctttgcagatgttaaaccaggaccatgagatgtgaaaattgttttgagctacccaggtggtgtcaatgtcattctaaggatggttataaaagggagacaggcaggtgaggtttgaagatggagtgctgcgtgctagctttgaaggttaaaggaagggagtggcagaggtgtttaggcaaagcaagaacattgggtcttctctggagttcaagatctaaggtagtcctgccaagaaacctgtgttgttatgtgcccggaaatgtgtactaacccatcagggcagcaatagggatccaacacacaaattcatgaagaaaaatggcttccatcatttttttttacatttttgattttttctttttgaaaataattatgaaattagtatactttacttcagaaataaaaccctaaaatccag

SEQ ID NO: 31914 - DNA, 1128 bp, Mus musculus
acggagaagtaaccttgaggattccaccatcatatatgccttacacttgtccaattcataccgtattccttcacctcaaaggagtgttctattttcttccctgagtccttctgcactacaaccttgtagatacccagagctggctcaacagacagtgggaaagagagctggtggagtcctcctgccagatggatattttgccattgaaaaattcggttcctcttgggagtctatggaaagatattatgagttgtgtaaacaattgagacaattgtgtaaataatttgattagaggtcagcttatcaggtaataataacactgggagttaatagggagttggtgaattagtgctaatgtcgttaaccaactaaacaaagaaacaaagaaacaaacacactgtagacctgagtaagggacagtgatgtcaccagcgatgggatcctttgacccctgcagctgtgccaccccagatgctacaggtcttgtctgatcttagaagccaaccgggttagtacttagaagggagaccctgcatatgtgtgtcacagtggacttccttctgatatatatgtccgttctagccagagatatttggaaagccacaaaatcacaccatcataaagtactgcggtccttttcctttcctttcccaaagaacttgagggagcagagaagataggatttgcttagtggagaggaactggaatctgaaaggagacacaaagatcttgcggaacttgtagggcatcgtcattctgaccgagatgtacagtttggtacttacctcaatataaacgacagggaactgagaagaaaaaaaaaagcagcatgagtgtgcggtgaagtttaaaaagagagcatctttgtaattacagtctttaaactttaccgagcttattgcttcctttttcatacaaagacttatttccttgttctgtaccagatgtcctttttaattagttctttgagaattttgtaaaatgagtttggaccatattcactcttcccacactccctcctctacccacccgccttcgtgtccccctccccccatcaggtccaatggtgctgcactcatagtcatggacgtcagagataaccatgacatcaggtgacagagcctacat

SEQ ID NO: 31915 - DNA, 1221 bp, Mus musculus
caattcatcctcgaaacaaacaaacaaactgctccgatatggaaggaaatgaatgaaagaaacatcggagctcacagtcagagccacagagtcaccggcagacaccctgagaccttatcacactcccctgccctcaccagcacactagagatctaattctgcagtctctttacctggaccattgtgtctgcttacctagaaaaagccctgggcactgcaagagggcgcaagccaaggaggaatacagagaattcagaggaatgcacgcctgaaggtgcgggagtgtgtttgctggggtgaccggcagggggcgcggggcgaaaagaggcttcgggcggggctcgtgaggttgcggttccctagagtgaggggtggctgacgttaggcgggaagtgtgcgtgagaccggcagagaaccgcatgagccaggttgacggtgcggtttggggcgaaggcctgctgggcgttgtaccctacaatctcctcgttggagaaagcggtgacgtcatagaatacatagctaagtagaatcgttgcagcagcaacgcctgccggtcctggtggcgcaggccggtaggatttgctgaaggaggcagaggcagaaggatctggagttcgaggacagcctggtctacacactttttttttctttaattcccagttttctcctggaaaacactcactttttttctaagtacaacacgaaaacaaattcacggccacacgccacccccaaacacatctctagaactgacaccattccgagatccagtttcctcacagaccctcacgcccacgcacccagatcgcatccttcgcgtcctccgggcgcataggcaccagtgcagctcacacgctcttgtccacgcagagctgcacacgcccgaccctcctgtcttctccccacgccacgcttccgtcctgacacgacccccttcttccaatccgtgtcctcagttctcgggcgaagcagcgatcagtagtcggccggcgagaaatggtcgccgccaagagttcggttttgtttgtatttgattttgagaggaattcggggaatgatgaaagtttcaatagcaatgacgttcagccacgcctggtagctacatgagctcaagaatgtgcctcctgggcgggctggagagatggctcagccgttaaaggctaggctcacaaccaaaaatataagagttcggttcccagcacccacggctgtctctccagc

SEQ ID NO: 31916 - DNA, 1167 bp, Mus musculus
ggaaaaaatggatgacaggtttaggtcctaccatgtacaaaaataaatcagaatgagttaaagagataaacaaaactctaacattctaaaatttcgatagcaaaacatagaggaaaatactaatgtcattgtatgtggtgacttcttggttgtgacatcaaagtactgtccagagacgcgggaataagcaaaagaggctgcatggatcttgaagatgttttacaatggtctcagttaagtctgaaagcatagctgctgctgctaggctcaggaattgcctgagggtgagggagtgcgcttcccgggaagaccggcagggggcgcagaagcgagaagcgccttcagggcttttgaggcaatgattccttagagaaaggggtggtggtcatgagttcgggagtgttcgcgaggcctgtttaatgctatggtttgggttgcctgaaggcagggcttaggactgcaactaaggttccggactcctccttcatgggcggggctagtgacgccatgatagatcatagctaagtatgttcgaaacggccgctgtaactgccggtactggtggtgcaggccggtaggatttgctgaaggaggcagaggcaggaggatctggagttcgaggacagcctggtctacacatttttttttctcgccaagaaaagaccagctaccgaatgaaataaagtacccatgcccactaaaattccaacacccaagaaacctcatcgcagcctcgggtcaccctcttcaagctcggaaaccggcacccagctcataccagttcttacagacacacaggcacacatatacctatgcacgccctcactccacactcctctctcccccgacgggctccctttccctcacaatacccctgctcagccagcacaacccttaagttacatttctctacttctacacgctcaagggctctgcctctagacatcaacttcagggctcattgtctggcctcacagggaacagccagcacagagatccgcattcccagtctctgctccacaccctgcatgtgatacacagatttgtcctctcctgtctgccctattctcctagcatcgtgacctcttttcctcttcactgtgcctggtacactttctgtctccaccagctgcctttgctggtgacccatagtctttccccatcctc

SEQ ID NO: 31917 - DNA, 1206 bp, Mus musculus
atctggagttcgaggacagcctggtctacacatttttttttcctcccagtttcaacaaaaccacaaatccacggctccactgcgccccgaaacaaacttccaacctccacaaggcctctttttatgtttcttcctcctgaaatctgatcggctactcgcaccccaacccgaaccagcttcttcagccgcaccggctactgctccacgctgcttacaaacctttatccacgcacacgtccgaccctcacgcctgcccacgccgcactccacacccctctcttccctacaggccttctctacaatccgcctgcttagccctctcgcgacccttttctacagttctgcacgtgcggaacgagtcagcagccaccgttcagagaaaatgttcgctgcaaagagtccgttttttctcgcttcgagtgttcggttttatgtacaaagaaagaaagtgaggattacttagagtcagaaacaggctcagcggaagcgcggttgcgcaacgcctaacttgctacttcagggaaagaatacagggcgtcgtcgggctggagagatggctcagccgttaaaggctaggctcacaaccaaaaatataagagttcggttcccagcacccacggctgtctctccagccaccttttttgtcggacaccgcacccacacacacagactactaatatagataaaagacaactcttagaaaatgttatcggctgtaacgaaatggaaaacaatgatttaaataaagcaaacaagcaagtaaagaactaacgttccacaccctgcgtatggccggaggatttgcgcgctggcgtctgccctagtcacttagcgtgatgacttctttcatgctgttgctagtgactccaaatcaactcgacgtcgtcctctcctccctcctctctttactactcctctcattttgaaaaaagtagttttggcatacatggaccgcctcaagcaccaggacctaggaactcctgacagctttgctcttctcttgggctcagctggcctcaactattcaccaggttgcttagagttctcccttccctagatagtttgtggcgattccatcacatccaggatgggaccactctcctcgtctctggcaaccattgtgtttgtctgctcactgaccgaggtccggaaagaccgactcgtcactgcacctctggtatgcccccatgtggtcaagacccctaa

SEQ ID NO: 31918 - DNA, 1207 bp, Mus musculus
tccctgtgttcaagagaatttctttttaacagtgttgcagatctattcaaatgtttaaaataatgcttaaattcaaagagttttgcttctagtgaactgtaatcactagaaaattttgcctctaggtatggctaatgtaaccttacattatgtaagaaaaaattttattgtttctgcttctatacaagaagccaagagttttaatctttcagtgtatattgtttcttaagtgaaaagtattttattaactaatgcttcttaaagtttaccttaaatccttgctctcacccaaaagattcagagacaatatccttttattacttagggttttagtttactacaaaagtttctacaaaaaataaagcttttataattgttattaattggtaattaaaaattagttgtgcccaaaacaattctctggccaaaaagaaaacattattgtaaagtcatttttctcatcctcccagccaatcgttggcccatgtgggcccaactagcttctgtggggcggagtcttaagacacagttttccctgttccagcacagatgatctagttgtgtgctgtagatggtgttttaaaatgctgaacaatcaaaccttaatttgtatattaacagtcaatgccatatctctaagctcgcaattgcttaaattgttcatccctcagatactattaattctcaaatttacaattgcttatgcatatttctagttaataaataaataaattatgcacatgtgactcttaataactttgcaagccttctagttacaactgctccttaagaaaattgattaaaagtgcaattagtcactgcccctttacagccatgtatttaaaatattttgtcaactagttattaattcaaaagtttaggtattataaaattttaaaactttaacttcttaaaagacaaaaaagaaaaaaattgtatccccgtgcatactatttagtgcgttcccatgcacactattaaagtcttacctttattttcaaaatttaatattttaatgtcaaagagtttaataaatgctttatagtatcttaaagggatctacttattggcttatagattgatcctaaaacagctaccttattaaaaaagggaaaaacaggttttctccacagaatgctgcagaagcatattagtaaattcgtgtgacgaactggtaggtaagttgactcatgtcctgattaaattg

SEQ ID NO: 31919 - DNA, 1395 bp, Mus musculus
tgtgctgggtgatagcagcattccttgtttctctaggcagactggatagtcccccttcaggacctatattaatccactcagctgtgtgtagggttaggctaatagccagcaagccccaatagtcctgtttctaccttttacagctctgccttttacagtgttcatcatcattcaagactttttatatactaattatatactgactcttctactttgtagaagtatttcattaaaaagtaagaattttcatcccattatgcctatgtaagacatatacctagtttttagagccttgtaagtaattttgaattgtatggaaataatttttgcctgtttgtcctaacttttggtcattgtatatcactcttaaaatttgattttaatttcttccaggtgacctaaagaattaatgaccattcaaaaacaaggcaaaaaagcacacccacgaccttaccaacaccaaagaaacatctaagcaataaaatggaagactaaccaagaattggacattagaatgtttactgctattctctacgaaactaacaactacaaagggaacgagccagcaagtgtccatcaagctgtatcccgggaacctgcacaggcgcaggagagcagcctccccagtttcagcaacctagtgctttctatttttttcctggtttttactgttttggtaatatgaattaaaagaagaaatattaataccacatggggattgccccaaccaaagaaatctgaaatatatagtaaatgctctttttcctttgttgttcattttggatgctggtgctaaacttccaagtgtcatgatttaagaagaaattttatgcccttatttattcctaggatgaggggagaacgtttttgctttctcacatagctctctctgaaatgtgcagtaacaagttcctcaaaaataaaatttttaccttcaaaggaaaggctgtgtaactagtgtgtatttcccttttctcctcttcctccctccacctcttcttgtgtggatgttggtgtaccacatgagtgcctggtgcacttaggggcccaaagagggtgttggaaagtcacaggcagcttcgagctgccatgggtattaagaatcagctgagtcctttagaagagcagcctgcgctttttaccatctccccagccctgttaaatgctgagccaggcacagatgagttaatgttttgtgttttgttgtgagtttgagatcataggaactgggtgggtatctttgaaatgtgcaacccagagataaactcatttctggtaggcatgaggtttacaggctgaatttctaggctggtcattagagcaacagcaggatggctgtgaggtgaagtttcagatcctctgttgattatttgtgggcttatgaaatgttcttaa

SEQ ID NO: 31920 - DNA, 1811 bp, Mus musculus
ttcctgccttcagacttcggaacatttgcatgtgttttattggttaaacataccagctgattatcaataagggtttattaaagcaaaaacaaaacagactgggaaagaatttgtgctgcagccttccttacatggttgtttccagtttgcagtaatggttagtgactccttccttgctaaggagtctccgtaagaatcttgctttcttccagatcgtcttgtgtgcaggcagcagcctgggccatgcttctttctccattttccttggtgcctatcatagtgccgtgtaggaccctatgtattttactgtattgtttgtttactacaaatttgtaaataagcaaaagaacaacagaatggagaaatacgggtttcaccaaaacatcattccatctgcattgcctgcactggtctggtctgtgggtgattgagcaagtaatcatttgactcaatagtagacaaacctcatgcccttgagtactcctgcccaccccacccttcaacccacacatcccacctccgacatgtagctctcttatgtaacttctgttccctgctctaggggacctgctcgcccacgacctgcccctgctattggagaggctgaagacaaagaaaaccagcaagcggctaatggtccaaaccagccgtctgcccgccgtggattccgacgtccctacaactataggcgccgttcccgtcccctcaacgctgtttcacaagatggcaaagaggtaaagccagcaggcaggagagatacacgcagatcaccttgaggagttatgccatcttttttaaagtcctaaggatggtctttctccgtgtgaaactggacacttaatcaagcacaacattgcttacttaggcttcatctgtagacagtattttcttcctgcaacgtgagctgagcgtttgacttgagcttgttaagcagtctctggaggaattagactagcagggattgggagcttagtatgaagggcaacagttaatagcagagaactgccggtgaacaaggacagagtaacacagccatggcacgctgtggactcttagcacagccgtggcacgctgtgggctctaggtggaaaggtatttattgggcaagtagaagccacttagtctctgacccacacataaaaggcaaaacccacgttgttatttctcttcctaggcaagaaaattaacttttgagaccatttacccttaaaggctactacacagtcctctgaaggagtttgtggtttgctctgtttcagaccaaggcaggtgaagcaccaactgagaaccccgctccagctaccgaacagagcagtgccgagtgaccctggctcccaggcaccgtaaccaccagcagggtgagcctggttcctgttctctcagcagcacactgcgattccactgtgcccgcagtggtctctgttgcacctgggaggttggaggccgggggggggggggggggggttggttggttggttggttggttgggggagcaggagcggggtatggttggatgttcagtatattggagattgacccttatatagtgtcaatccctaagttgaggtataaatatggagacaggtttaatggttgccactttttgtgagtcagttcttttgaacatgggatctagaaggcttggataacaagtagcacatttactcactgagccaactcgctggcccagttttatctatctatttagacaatgctttttttaaaaaaacctagtgtagatgtgtctgtgtggggctatgtgcatgtgagtgccagttcccactgagttctgaagagtatcagatcctcga

SEQ ID NO: 31921 - DNA, 1177 bp, Mus musculus
tccaaaaacatacttttaaatgctaaacttatcataagcggataaaaaagcttcaaggaagacctataggtaagggtatgcttaagctttgtcaggactgggttgaagccagtccttccttatctcctgccagtccgacacctccctcaactgcttctagctatgggtaacatgaacactgaaacctatgtaccttagtgggtcagtgcatctgagtttaaagcagttgaacatgcccagttgctcagaaatacaatattttcttttaatataaatatgttattttgtctgctttttggtgctgggaactagttcttctcacatactaggtgagagcagtgccggctgagccctaagaataaggctcaagcccttcagatagtcttttcagcattgaaagggtcagatcttaatgtgtgaaaagctaggtgccctgtgctaaggaaggggataggctgttgtggtaggaatgagttttcatttctttcctgtcatttgtaaaaatagccaatgagtagcaggctcagttactggagcttcaggctggtaacaaagctcttgcctcagatttgctttttaaagccagtctcctgcacaggactgtgtgctttgacccttcttgccctgtgtcctggctcatttccagctgtcattgccctttaggctggtgagattggggagatgaaggatggagtccccgagggaacacagctccaggctcatcggaatccgacttaccgcccgaggttccgcaggtatgaaagagggcactgtgggtctgttacatggccatgcttgttatttgaagatatggttgctttggtcatgagcctgatcgtttgtagtggggagtagcccagggcttcacacacattgagatattcattctctttacaaccagaaagaatgctgttctctctttaactgtgactggtcatgacctgcaacttgaagtggcataaataaacctctttattttgtttgttttgacacaggatcttaactgtgtagccaagtcttgcttcatatttattatgtacccttggctggcctctaatttgaactcctttttgcctcagctctcggcctccaaagtctggaatttataggtgtttgacactatatctgatttaatgcctaatttttactaaactaaacaataagcattaattaatgg

SEQ ID NO: 31922 - DNA, 2722 bp, Mus musculus
ggggttatatgcaaatatgtgcagtgctggtggagatcagaagaggatattagatcctctggagttataggcaggtgtctacataatgtgtgtatgggagcccagctcaagtctttctttgcaagagcagtgtgtgctcataactactgagccatcactccaacatgccacccaccatgtataagcttctgtaaccaaaccatgcccatgtttatacaaggtctcatgtaggcatttttgccctcatggaaggagctagagagaaaatctcaggagcctcttggcttgatctaacagcctgagtcaatgtcttgactgagtgactgcatctctctactactgactgggatatgattggggtacagtttgaagcgtcctacaaatcaggaaagacatgtacactgtggtgtaagggtgtttagaaatgcaggttaatggaagaatgggggaatttgtttgttttaagcaaaatatagatattatctggctaacatgaaattgatgaacacatttcagtattggaatgcacctccaatggtattttctgtttccttggcagacggccatcaagaaaaacaacccacgcaagtatctgcgcagtgtgggggatggagaaactgtagagtttgatgtagttgaaggagaaaaggtgagaagctttgtaatgaaagtgtgtctgcacatagttttattgtataacatgtggcctttcagcctctgaaataatatttaatttttttgtgataggaggaagtggaagcagaaatatttttactggatgccattataaatattcagtatgctatatattttagtttcttgtttaataaaggaactctggaataaagcctccaaaatgtaagacacattttagtttggacctcacactgttttggtccagacatgtaacccaattagtagagtgcttgcttggcattcatgaagcccatggttcagttcctagcaccacataaactaggcatggtggtccgtgatccctgcactagaaaggctgaagaaggaggaagaatgttgcaagtttgaggccagtctatgctacacagtaacattctgtctcaaaagtatacccctagcacctcgaggacaaaaacgtttgactgcagccaattaagccgaccagctttctctcttggtggatcctggtgtgcaatggctgcatacagcagcctcctgggttgtgtatgctgcctatttcttgtataggttgctctaagggacccaggagataaaactttccttgtctctaatctcacactgtccagaatttaggctccagacaggtatgcaggatgactttgggaagcaccagggctttgatagctaggattcaccctggccagatcatgatatacttctgcacctagctgcatagtaaagaatacgtgattaaagtcgcagacaggccaggctcacatttccctgtctctagagtatcctatatatcaaagaagtagggcttttttttttttttttaaatccagatttgttgcaggtgaatttggtgatgtggtagctagggatatagctctgtgttagaatacttgctcatagcatgcttgaattctcagcttcattgcttacctcttagagaaaaagaaaaagtcaatgtcaacagtataacaggaaggcctaaaggagggctatgtggcgactattcctatatcaagggctttgtcttccttatttctgccaagctaagcagtaactcagatggttagagcagccggagctaaccactcaggattccagtagtaccttggggtaccacagggtttagcatgtgctaacgtttcatagtattttgtttcacttccattgaagtatcttgtattcatcattcattcatgtttgatgtatgaactgcttctaacttgactgaccagacaagggggtgggtggggtgtctcaagccagaggtcagggaccctaacatcacagtaggggttcttaaccctgtagctgactgctcctggaaggaggttacttggtttcttttaaatttggagacttttgttttcttcagggtgctgaagcagcaaacgtgactggcccagatggagttcctgtagaagggagtcgctatgctgctgaccggcgccggtacagacgcggctactatggcaggcgccgtggacctccccgtaatgtatgttctctgtgtccctaattattgatcgcaaatgttcccatatttaaaactgaatgaacttaggaacagataaataccgtatttgaaagcgccatattctagagataaggcacgtgatcattttttggaaggaaatttttagtgcccagagtttattcatagctacaggtcccattggaaacttgccagtcagaagttgtgtcatttaggatagagttggctgcaagtaacagacattcacttatctcgtaaccagatttgacaaaggtgccaagttgtccaaaggctttgtcttcctttggccagatcctcattttgtggtatttactggcaccaggattggggttcccatcacagctatgcagcctgtttcctgccttgatgctgagacagctggcctcaagaaagtctgcgtttgtctggcaagaaagagtggggctatcttaggaatcacggtgcatgcttgcctcagatgtgttgagtgacacgcctcggttaaggggctacttggtgtagccttttgttcttacttagttcaaagtaaagtggtgc

SEQ ID NO: 31923 - DNA, 1419 bp, Mus musculus
tgttattacagatttgagtagggacaggaatactttacagggattactggaatgatttataattttaatggtttaaagtcacatatcagtaagatatggtgacaatgctttaagctttctagattagttctgtgcatattaatatagaagttctaatataaaatggttcatgctagttgccaattgtcctacagaactgaggacaaaaaattctttaattgctgaaagttatggcacactgtctgccattaggtaagcagagggaagaacttctgccagtaataactgcactccattctaagacaaaatgttatgtttaaagctgacattttcaggtcaggggattatgacgttagaacataattatgattgaaatgctgaagaagtgacagggatccaacacaaagaaaagagaacaccctgtctcaagctttgagtattttggaacatgtcactcataatgcaagcaacttcctcttattcaagccatgcacccttctcttgctggtaaaatcactggcatgctgttcaagattgataactcagaattacttcacatgctcaagtctccagagtccctctgctcaaaagttgatgaagctgtcgctgtactacaagcccaccaagtgaaagaggctgcccagagagcagtgaacagtgtcactggtgttccaactgtctaaattaatcagggaccacaaacagaaacttttgcttcaccgaagaaaaatatcttaaacatcgataaatttaaatattatttaaaaaattgcaaaatataaaataaatttaaaaaggaaaggaaactttgaaccttatgtaccaagcaaacgccaggtctagcagacagtgcttgtcctagattacttgatttaaaacaacaacaacaaaaatacaaaaaccaatagtaaaatataaaaacaaattaatattttatagaccctgggaaaggaattttcagcaaagtacaaaaatttaaagcatttctttctttaattttgtaattctttactgtggaatagcttgggacatccattctatttaaaggagcagaactgatgagcaaggaaatgtgatttggattataaaattcttgctagcaacttataagttgcttgcaggaccaagataaaagccttctatactcccaaggtgacatggcactcaaaatcattacttttttcccatataacattgccaatgatgagccttggcttggaggggggttctgagagaaagagtgcctgggaagggtgcaaagaatgactcaaattgaaattgtggttctaaactctgttctgcttgatatagcttttccagtcggcttctctctttgcttgttattctataagatctccctctttatgtgctaccttcttttctaaaagatctctgtacccatgtcctgcttctttatga

SEQ ID NO: 31924 - DNA, 1201 bp, Mus musculus
tatgagcatccacttctgtgtttgctaggctccagcatagcctcacaagggacagctatatcagggtcctatcagcaaaatattggtagtgtatacaatggtgtcagcatttggaggcagattatgggatggatgtccgggtatggcagtctctagatggttcatcctttggttttgaagaatgaaaaattactggcctcttgtgagaacatgaactttttacctcggagcccaccccctcccatctgaaaaacatttttgagataaaggcctcctagaacaacctcaaaatgaaccgggtacattgccaaatgataggacatgactccttagttacgtagattccttgataggacatgactccttagttacgtagattcctttggcagaactccctagtgatgtaaacttgtactttccctgcccagttctccccctttgagttttactatataagcctgtgaaaaattctggctgaccgtcgagactcctctaccctgtgcaaaggtgtatgagtttcgaccccagagctctggtctgtgtgctttcatgttgctgctttatttcgaccccagagctctggtctgtgtgctttcatgttgctgctttatttcgaccccagagctctggtctgtgtgctttcatgttgctactttattaaatcttaccttctacattttatgtatggtctcagtgtcttcttgggtacgcagctgtcccgggacttgagtgtctgagtgagggtctcccttcgggggtctttcagtttcagctccaagctttgtctctgtaactccttccatgggtgttttgttcccaattctaagaagggcaaagtgtccacactttggtctttcttcttcttgagtttcatgtgttttgtaaaatgtattttgtatcttgggtattctaagattctgggataatatccacttatcagtgagtacatatcatgtgagtccttttgtgattgggatacctcactaaggttgaggccctccaggtccatccatttgcctaggaatttcataaactcattctttttaatagctgagtagtactccattttgtaaatgtaccacattttctgtatccattcctctgttgaggggcatctgggtcctttccagcttctggctattataaataaggctgctatgaacatagtggagcatgtttccttcttaccagttggaacatc

SEQ ID NO: 31925 - DNA, 1199 bp, Mus musculus
ttctaatttggggtaggggctcagtttgtgttttttcacgagatgaagatggagcacggtggctgccagagagattaattcgtcagatgaacacagattctgactcttctggtaagtatcattctaaagactaaaattccttttgtgcttaaaattcagctgagagcaacagctctcaaagctgtttgtgtctacagctactctctgaaccagctcccgacaggaggctggagactagcctcagctttacaatttgcatttgaataaagtacctagacttccctgaaagaagttctgctttcctactttctcactgtctttcaagattttgtctttcaagcaggtaaatcaacattctcgaggcagaccagcggatgtgcatccccgcccccctagagcacacaggtggcagctgttacccccagtctcaggacatttccagcacgtggttttcagtctgagttaaaaatttaggtttacctagagggctagaagagtagatatttctatattaataaagattggtttttattttgatagacaggcttagccccttagctgacctctggcttttcacccttgctgttactgcaaggtgtcctcagctcaataggctgtggaaaaaacagggatgaggaggaacgacttccagctcctattttagccacaaatcgtggtgttactaacgacataattcttgcttaggctttgctaattctgaggttgataattctcctttaggagctgcacagcactcagaactgtgcatactggtttgtgattgtacaaattcagtatgggcaccgcttggtgcagaagtactgcaagggaaggtccggcttgaccatttctgagtttcctgtgagataaacccggtttgaaagaggttggtaccaaattttggttaaaaataaaaaatattctccggctctacctcgcctccccaaaaggtaccaagagccacatgtgtgggttttacccacgggaggaatcgggtccatgtccacccaagccaaggttaaaagcccactcatctacggatgagaaaatcatttgatcacctcagttaagcgttgccttatttaacttaattaatagggggagagagattggagacgtactattgaaagggcaagcccttcactgcctcccacccaaataaaaaagccaattggccttgtactacaagagccggtcac

SEQ ID NO: 31926 - DNA, 1129 bp, Mus musculus
attggagacgtactattgaaagggcaagcccttcactgcctcccacccaaataaaagagccggtcgaacgccttctccctgtttcccacctatcttccaaaaatgcggaggaatatcaacttagtgttattttcacatcgttcagtcaaacttagccagagttccaacgccctacttaaaattcaactagaaagttacctaccaagtactaattagcattataaagtcagagtctgcagctccaggcctttcagttagttgtttactagaaaggacagtcttaagccagatacagtttaccataagaaaagttaaagaatcccagtgaagcaagttttttctttagccctagattccaggcagaactattgagcatagataatttttccccctcaggccagctttttctttttttttaattttgttaataaaagggaggagatgtagtctcccctcccctagcctgaaacctgcttgctcggggtggagcttcctgctcattcgttctgccacgcccactgctggaacctgaggagccacacacatgcacctttctactggaccggagattattcggcgggaatcgggtcccctcccccttccttcgcaacaataaaatttgagctttgatcagaatgaaattgtcttagctccgttttttcttccgccccgtctagattcctctcttacagctcgagcggccttctcagtcgaaccgttcacgttgcgagctgctggtggccacaacaatcccctttgcagtttcacctcctaaaatcccctataatatctctcctccccctgcttctgtgaaggtgattcccccatacccgccatcaccctacccacactcttctcatagctcttcaattccccatacactggagaatcaatccttcctaagactaagggccttccctcccattaatgccagataacttcatcctcttgtacatagatagctggaaccattggtcctcttttgttggtgttttaatccctgggagctctaaggtatctggttgcttgatatcattgttcttcctatggggttgcaaacacttgcagttcattcagctattcccttacgcctccaatgaggtccctaggctttatgtctgatgattgg

SEQ ID NO: 31927 - DNA, 1160 bp, Mus musculus
ttttcagttatggtgtgttacaaatgcagactctatgcccgtatacacttacataaggtgatagatcactttgtcctactgtctcagtgaatgttacatgaatattgagcagacacagttattttcctcgacctttgatccttgcaaaatgtgtactaaatgttggctaaattacatcagctcacggagctctgccctttaaagggacagcggcacggagatcccctgtccctagcagttacataactgccagcagccaaccttcctcgggaagctgacaggaagaggcggagcccacgccgccccgcgccacccggagggagcggcggccgctggcagtgggggcgaaagcggcggccgcttcgtcccggccacggctcatctggctcgggaactgcacggagcttcggagaccctcggcctggtgggacaacgccatgggtcccgccgacgccccgtccgccctagcgctcagggcagtgggccctgcggccgccaccccgtatggtgtcttctgcaaggggctgtcccgcaccctgctcgccttcttcgagctggcctggcagctgcgcatgaacttcccgtacttctacatcgcgggctccgtgatcctcaacatccgcctgcaggtacacatttagagccttgtctgcgttgccccgccacccgggaccgcaagatggccgcttcccaggtcgccccgcggcaccttcaagaagcgcgagaagaacgtgcaatcttgcgagagctggcttgcgcacaggcagtcggctcccaacctctcctatcagggatttggaggtgggaaagctagctgggttaagcaaggatgttgttccagcatcagaggagctatccaaggaagtatccaaggaaccactcatctgtaaattcctggcaagtcttaggatatgacaaagggcacaagatgcattatgagaaaggaaggctgagattttcaagaacacagatttacaccaaacttacgttctgaattaatctttgagaatactggactgtaagctagacattgaataagaagcctgttatgtcaagaatgtgacttaaaaagcattgcatctctcttcctcccacaagaggatatattgaatctgggtcaaagtcagactacaggaaaatatactccccaaatatgccag

SEQ ID NO: 31928 - DNA, 1232 bp, Mus musculus
gcggttccagtgtccagaggcactcttccagccttccttcctgggcatggagtcctgtggtatccatgagaccacctcaactccatcatgaagtgtgatgtggatatctgcaaagacctgtatgccaatacagtgctgtctggtggtaccaccatgtacccaggcattgctgacaggatgcagaaggagatcacagccctagcacccagcacgatgaagattaagatcattgctccccctgagcgcaagtactcagtctggatcagtggctccattctggcctcactgtccaccttccagcagatgtggatcagcaaacaggagtatgatgagtcgggcccctccatcgtccactgcaaatgcttctagatggactgagcaggtgccaggcatctgctgcatgagctgatattgaagtatcgatttgccctggcaaatgtacacacctcatgctagcctcatgaaactggaataagcctttgaaaagaaatttgtccttgaagcttgtatctgatatcagcactggatcgtagaacttgttgctgatttttgaccttgtattcaagttaactgctcccttggtatacgtttaataccctgtgcatatcttgatttagtccttagttcatgtggctcagtcacttgggggctggggagagcacgctgtggatgagaaagccctagcctggtggatctctgtgagcatcatggagtgatttatgcagggtattaaccaacagcagacttccaggatttctcgaggctggcaagggttcctgaaccagttaccactccttcttgccagtctaacagggtgggaaagtccgagccttaggacccagtttcagttctggtttcttccctcctgaccaccatcggttgttagttgccttgagttgggaacatttgcatcgacacctgtaaatgtattcattctctaatttatgtaaggttttttgtactcaattctttaagaaatgacaaatttgccttccggtccgagcagcaccgaggtagctagggcgcagagtcggctgacacccgccagctacccacaacacccaccatgggatcttaagacttctgaggatagggatctgcccggcacgggattgcctgagcatcagcagcagacatcttggttccaggaccccgccaagtgtatcctgcacagctccagagaataccagatggcgaaaggcaaacataagaatcctactaacagaaatcaa

SEQ ID NO: 31929 - DNA, 1104 bp, Mus musculus
ctattgaaagggcaagcccttcactgcctcccacccaaataaaaaagccaattggccttgtactacaagagccagtcgaactccttctccctgtttcccacctatcatccaaaaaagcggagaaatatcaacttagtgttattatagtgtatttcacatttgttcagtcaaacttagccagagttccaacgccctacttaaaattcaactaaaaagttacctaccaagtactaattagcattataaagtcagagcctacagctccaggcttttcagttagttgttcactaagataagaaaggacagtcttagccttatacagtttaccataagaaaagttaaggaatcccatgaaaacaagttttttctttagccctagattccaggcagaactattgagcatagataatttttcccccctcaggccagctttttcttttttttaattttgttaataaaagggaggagatgtagtctcccctcccccagcctgaaacctgcttgctcggggtggagcttcctgctcattcgttctgccacgcccactgctggaacctgaggagtcacacacgtgcacctttctactggacccgagattattcggcgggaatcgggtcccctcccccttccttcataactagtgtcgcaacaataaaatttgagccttgatcagagtaactgtcttggctacattcttttctctcgccacctagcccctcttctcttccaggtttccaaaatgcctttccaggctagaacccaggttgtggtctgctggccggacacaacagaccaggagtttaaatactcctgagcctctggggagcagctctcattcaaaccaccacaagaggggaaggaccagggagttaagtttgatttgggatgccagagacagtcatggcttggacaacaaattagaatgcatcatctctgagttctctcctcttagacaaatagcagaaacgactaaagtggctcggtttttgtttatgctttgtgatttttaaattttaaacaaaatgtacataaacacttccaaagaattggatgctacatgttaagaaaccagactcatctttttcttgaagtgggtttttccac

SEQ ID NO: 31930 - DNA, 3840 bp, Mus musculus
gtctgtaactctcaccctctcccttcccctacacctgttgtagtctcatggtgtttctggtttcgttttttgtttttgttttttaagaacatgcagtttgactattcattgttcatacagggaagacatcacatgttgttttcctatggaaatatatctattatatatatattattaatttttttgttgttgttgcaaatctcaccaagtacggccagcttggctggtcaggaaagagaaaacttgcagaaggaatcaggttcctctttttcctgccacatagatctggtgtgtcctgtccaagtcaggtcttagatgagaaaggaaaacaaaatgagagagatactttcaaacaatggaaaagaagagttctgtctccatctccctctctcgccgctcatccccgcccctttctccttcccccttctctgcctgctatgcacttcacaggcttttcatcagagctagcctcactagcacctgaactacacagtgacccggctgctctgtgacagtcagaccccttgggcacccatctgaggaaggccagacatctccccccaccaaatgctgctgtattctagaaagaacaatgggaggatcgagcataagataggacagagggtggccacaggatttgcaaggcccaggcagtttgggattgtcctgaaagtgctacacattaggaaaatatgagagaccacacaggcctggtagtttaggagcaagaacaggtcaccaatgttgtcccaagacatcatgcccttgtgggattgtcaccaccccacacacacactccaagtcctagcctttttcttctatgctggtcctcatggaacacagaacacacatgagggaggatgctggaatttagtctcaggcacagccggtatttgcgcagacaggaaattcctcagatttagactttttccttttttccgtctgtcatggctgtatttcaggaggacatatctgtggctcttctccacctcgacataaggtcagtagcatcttccaagatgagggtaatgctattccttaggatttttgatagcagggattttattttatttatttatttatttttgggatttttttttttgagacagggtttttctgtgtatccctggaattcactctgtagaccagactaggactcagagatctacctgcctctgcctcccaagcactgagattaaaggtgtgcgcccccatgcttagctttttttccttttctagccatctaagtggactctttgaagttcactgttttaaaacccagataatgaggcctgcctttcaaaaccaccccttgtccttcctgtgttctcccacatcatggaatgagcctctcccagccctcctgggtgtgtctctgcttggtcagacgcaggacacaggtgaggctgacagaccagagctgacctacaactactcctaagtggggcacatagaggctaggaggacctggacaagtcactctcccgacgtcagctcacaggcggactgtggttcacagacactggaattgagttgactgggtatctttagtcttgctgtgacttccccgtgcctcccccacaacccacaatctgccttcaaagaggtcagtgacctgggtgaggggttccctcttaatattcatggggaatgatgagagtcacgtgctatgtgtttcttgaaagcatgacaggggttcctttttttggcctctaaaaatgactggtaccttatatcaaatggggagattaagccaaatacttgtgttgtatgagccactgggaggaagagcaagtgagaaagggtgtgctttttgtttttgttttgactgaggtcctttgtgtgaatataaaatgagaaactacaacacttcatactggccactttgcccatgcgtagaactcagtcctttaactgcccaaagaattgtccatatgaactgtgtaaggaaattcctctgttccctaaggagtcttggatgacagctttggccacttacgttagaaatgctcatggcagtgccgtctttatttcacacctggtgttgccataattgatttctttgattctcttacctgcaaaagcccttgtttgttttttggagagaaaatatggccagggttgtctgggttgtcagggttgtgcagtgctctcaggcttcagactcacagaatttagatttagccaatcagaccttggaggaaacaccacaatgggggtcctgttttgtctttttggtttttgagttttggttttttgtttgtttgtttttttacaatcaactatgatcttctagatcgacattaaagcgacattaagttcaagaggtgatagaaggaatctaaaagctcctttagtggcctttttctgcagccattgtgggttgagtcaggaaaggaatttgcagggaagcattgccatgtggaggatgggcattgccacctaggtcctgggattctgtcctgagtcctcggccgggctgtcttcaggtctccttcagcagaaaccaggggcagctggtcagatgttgacagcagcttctcttccgataattttcatccaaggccacttagtgccacttggagacagggtccctgatgtcccatatctggttttggaaagagaatggtcctcataagaaaagaacaaaacaggcttcttgcctagtacattcaggtccctctgatccagcatctttttacactaataccttgtccagataagaatgtcactccagctgacatctagatgtctgtgaggagtccctggaatgaccactcttgtcttttcacactgttcgggatccaaccataaacacagtttggcccattcactgttgttggcagaagacaacctgagagaggtcgtgtcactttccgtgggagcagacagcatgacacacagttgggatcagtatctagccggcctgcacttagcagcaggataagcgttcagaaggcagttagaaattattctggtttaaacccccatttgatccatccccggcaaagagacgaaagatgccaagggtggtttttactgcccagtcattcggtgctagttagagctgctgtgcgttctcagcctgctcctcttctgaacagaaaccaaaattggacgtcatgagaaacccagtggagcaggggtacagagggacaccccagaaccctgcctatcaacaaggcacacgggactcacccagcactcttttggccccatccgcatcaacactaaacaacttcaaatgcgcccgactcttttcaccctcacaggtgaaccctcttctggagacttctctttgtgacggcacccacctgcaagccagatgaatctagaatgactttttgttgttgttgttgtttagtttctaatctcttgtttatgaggtgtggggtttataagggactgaatcaaatgaatgtaacaaaaaaagaaaaaaaaacaaacaaaaaatgccttttctcagggccagtgagttgcaaataatttttaaagaaaaacctataattacatcatctcaataaattttttataaaaaaaaaaaaatcaagtcccaagtctctgtttttaataatatgaaatggagtcagacaggcaaggcactctgatgatgcaaatcctgtctactctattatggaataaagtgcactcctggtttctcctggcaggaagccgctgttacccggcgttctgcaggccagctttagacaagaggccccaggaaggtcacagcagatcactctactctgagctgctgccacaggtagaaaaatctgcctcaaggaactccagtcagagatgccaaggatggaccaggtcccttggtgacagcagggatta

SEQ ID NO: 31931 - DNA, 1198 bp, Mus musculus
gtgatcaagtggggagggccccttgtgggtgggaccatctctgggctggtagtcttgggttctataagaaagcaagctgagcaagccagaggaagcaagtcagtaagtaacatccctccatagcctctgcatcagctcctgctccctgacctgcttgagttccagtcctgacttctttcagtgatgaacagcagtgtggaaatgtaagctgaataaaccctttcctccccaacttgcttcttggtcatgatgtttgtgcaggaatagaaatcctgactaagacagaacctttgagacctcccgcccccagacacatgttagcatatctattggcattgtacttgttcagttcttgttagctaggcatattgttgggatatcattggtaaaacttgcccgtaatttctaggagacaatctcacagcagatttcctggtcctctgtttcttaaaacttttctggcccattgtggtggtgtgaatatgactggcccatggaaagtagcactgttaggagatggtcttattgttattgtggatatatatatatatatatatattcacatagaacttttggctactccagcatcatgtctgcctggatgccatgctcccaccttgatgataatggactgaacttctgaacctgtaaaccagccccaattaaatattgtcctttgtgagagttgccttggtcatggtgtctcttcaacagaaatgaaaagcctaagacacctgtcttctgctatgttctctgagccttaggtacaggagttgtgctgtaaatgtatcagttgggactagacacttggtgatcaccttttcctctgtgttttgaccagttgtggttttctgtaattgtctgtttattgcaaagaaaagtttcattgatgaagggtgagaatttcacttatctgtggatatgaggatatatatttagagtttagttaggagttttgccagtttagtataatggcaatagcatactctcctctaaggtccatgacctcacttgcttcaagcacttggctaggtttccaggaccaggtgtgattttctttctcttgagaggaccttataaatccaattagagagctgttggttaccatcaagatacaaatgccactattgttcccttggtgttattgtgcaaaactggttgttgttgttgtggttcagagacatcagagatggatagg

SEQ ID NO: 31932 - DNA, 4766 bp, Mus musculus
tatgctcctagccggaggatgacctcggtggcaacagccaagggctacaccagtgacgtgaactatgactcagaacctgtgcccccaccgcccacaccccgaagccagtacttgtcagcggaggagaactatgaaagctgccccccttccccatacacggagaggagttactcccaccacctctacccgccaccaccctccccctgcacggactcctcctgaggagggcccctcctcctctgactgcctccaccgggacatgtaaatacacatctggttgagatctggagggggggagggagctatagagaagagtgaggcagactctgtacagttaacattataaagtgggtgggtgctggagatatttgtacagaagaaaagaatatttatatattttcttaaaacagcagttttgctgcttgtgccataaaagtttgtataaaaaataaatttgtactaaaagttttatttttgcaaactaaatacacagagcatgccttaagcccagtgaagagactgagtacaaaggaaacaggaaaagaaaggcatcactgaccaggagtgtctgggttttaacgataccaaaaaataaaaaggagaaagtaattccatcttagagtagcaaacttggaagtagccaaattgcctttgggttaactaacatttgagggccgacaagtcgagaacccatgaaagaagaaataacagtactaactttggacacagggctttgttttctccaggaatccagcaattttcacgaggaaaatagatagttgtgagatccgttttgagtgctgctgttgtaggagctgaagcgtctctcgcgggagctgctgagagctctcgcctgtcacagtccatggtaacaccagctgttctcacggtctgcctcccaacaccttggagactgttttgccaagagccatgatttatttaagctttttaatctgaggagttgattaaatggaatttactaaacacgaaattgaattgatttcagtatacctactctgttcgttcagcaattggctgagtttttaagttgttggctgtttttgcataatcaaaagttagccatattattggtcttccacaattgttttaatgctcattaaagtgtctttttagaacatataagaatgcttaaaaatcacaaatctaactgttatattcttgtaaattagctttgtatccttgcagcatacaatatcacagtgtgaaatcattttatgtattttgttagtaaaacatttcaatgtgctctcgttagaaacagtctgtttaaacagaaattcttattgttagtaggcgtcccctagatgaactgtttgtgacattttcactttctgtggaccagcttttctcagagtgatgtttgcaggcatagctctgccgatgtgctgtgaggtagcttctcggtatgcgctgtgaatgagtgtgttcacacggcccacagtctgtccttagtctcctcctgtgtctctctgtgtgctctctcctaccccattatggattaagataatttcacagatttaacagtgggattaaatgagaagacaccgtgaacttctcagctgcagaaatttgagcagtggagacaatggaagtctcctgtcacatgcctgacctactgtcacataccgggccgctatgtctgtcactgttggggctggctgtgggatgaccctgctggggactagtttcctgctttcacatgtgcctagcactcctctcctaaagctgaactttttttaagctagtatgatttttaccttaacaggtgtcgattaattattgaatacattttaaaaattatatattgaattgtagctatgaatttcagagcctaaggggaaacaatgaaagaattgatttcagaatttggcagagtttgagcgactttaaaaaaacaaaacaaaacgcctaagaacgtttttaaagagaaaaaactcctttctgactaatgcgtagttgttgtggacagcttagtgagaatcaggggccttgcatctaagtaaagggcaatctacctgtgtcctgcatttcagtcagataagcattaactcttcctgttactgagacgaagtgcacagagccttaagacagactggacactgaacttgcctcctgtgacgcacaggctactcaacacttacgtgaagatgggagggtagcaatactgggtatcggtcagaattggagaattctttatgtttacattttcaatgtgcgtctttatctggtgggcttcccatgtaggagagacttgcactgtcgtgtgccgggaacggtgtggcttgtttcatctcagtccaagtgcttgtgctgagtggcagtggcctcttgcaaaatactaacttgtgtgccagtttgttgaaatgatttgaaggcggttcaggtcagtctcagtagcctctttctggggccgctcagccgcagtgaagattgctcagggtacgtcttagtgagggtcgttaaatcaaaagttaggaagatgatgatactcaagttacatggacagttacgtttaaataaactgtgtctcaattattgaacataagagaaaatgagggaaaagacagttttaaattaggctgcatctagattcattactcaagaggaaacatgaataaatttgattagatttcatagttacaagggtatttactttgaacgcatatcttaaagtgtgcctgctcactgatcggagagggtatgaggtgagcttttgtctagcttgcttttgtacactgcagtaagcttttctgccgtgcagtcttctagaactaagactcagacttgactcatttggagcccaagtcttctaaccaaggcccaagagttcttgcttaggtcagataaatggcacaggaagataaggtttaatttagagtcggtgggtagaatgttattagtattttccttctgttttaaaattttacaatctttttcgcaatgaatactaacttgtaaaaaaatggccatctattttaggtaacagtttttgggggacaacatgtttttgtcttgtcaaaaaggcccgtcagtgaaaacagttgagttcatagctgtgttagttacctcaccagttaattgagatttgtctagtgaccaagaaggctttctgcagggaagtcggcttccctgcaaggcacagaaacaaaagtcttgttcagttccaatagttctgctttcagtgactacagtgcttagtgtagcccttataactttatagaaacaattaccaactgatttcttactcaaaattagactatagataggagtttgggtatcagttggttggcagtatttaagaattcacaaatgagagccgtgcatgagtgtgggtacagactgagtcctaaacaagtttgccattaagcattagttaaaatgtcagaatccctgtttaatctcctggggtttcctcaccccaggcctaaaacaggctgtgagaagagacgtgctttgaggacccggaaggcactgctttgtaagaatgtcaagattaggcttttgaaaccttagattttcaagtcaaggactttgggcctcaaatacaaaacgacacatttgtgacctaaatactgtgcctcacagatccatacagcccgtggctttctccgactgaacagctcactgaactcagcttacacctgagtaagggcggtggggaggtggcagatgcgcgggtttaccttgatgacctaagagtcacctccttcagggaaggaaactgtcattttaaacattgtttaacattttcacaaggcgtttagaaagcactcctgattttattcctagggaatttttaggattacaaattgatgtcttgtactcagaatatggcccgacacactcatcattgggtttttcccttcttcccttagagtgctagacagcttgcttctgcttcactgtccacttggggcttgctttggtttttgtttgtttgttttgttttttgtttttgtttttttgtttttttgtttttccatcaaatacgagaaagttgagggagtggtatagctacatatatccatgtggctgtgtatctgtatcgatgcctaaatatgagtattcagaggaaaggaaggcaagggactgctcccatcagtccggtgagaggaggctggagagaggatacaggaggctgaacctgaccggccttgttgcaagtgaaggatctggtgctgcttttgctgtttgtcctttttgagtctgaacgttttcttaagctttaatctttatcattgtcttaaagtcagctggtgtttcttgtacatcgactttggaatgatggtgctttgcaaggatgtatttatattataatggccaacatttggtcagcccttgtccgcttattcacttccccccttttgtaaaataagtgctttaattataaactgtataaataccttgtataaccccccccccttttgattattacaaacagctgaattgtaacaaatgaaatgttgatttttataataaaacagtggaaaaatcagtggaaaaaatgaaaatgactgtgctttgtgtgattaacactgccgtatttcccacactgcaaaggcagctttgaggtctgcatggagaactgaaaagggcggcgggctggctttgggctgaagcacctgtgcctacaaagaacctcgggcttcctgatgtgttctcattggtggagttggatgggcgatgccctttctgtctctctccctaattagccatgaagtggtggtatggagctcagtgtgtcg

SEQ ID NO: 31933 - DNA, 1212 bp, Mus musculus
catttatatctctgttcttagatgttgagtccaggatagcataggattaatccactacctgtgagtcagatggactgtgtgtgttctgagaagtcaggtcgagtggcagtagaattgttttttatagatgtctcaagtgtttaccaccgttgtctcatctagacaagagttgttttgatctgttttattgtgtcagcttttcataaaatttgaattcaaaatggattctgctaaaaagaaattgaatcctgctatcccaagttctttgttacatttcataactagaaaattctacatggattgggattaactcctagttgcacatgtctggtcttgcacccttttctgctacatttaagtcttatggggaagcgcttggatttcccttacttctaggatctacctggtattcatgggataactgctgaaagtgggatttgggcacacaaatcattgctgttaaatactttccttttctaaggtgccaacaggatcgtgctagaagactctaatatattacagcctgtgggcctgaccgtgtttgaaaactggctctattggattgataaacagcagcagatgattgaaaaaattgacatgactggtcgagaaggaagaaccaaggtccaggctcgaattgctcagctgagtgacatccatgcagtaaaggagctgaaccttcaggagtacagtaagtgaagtggacagtgagtgcccagggctgctgtgctgtaagaaacaagacatggcttcatggtttcaaccgttttcttcgttatttgtttttatatttagaaaaacattgtgttgaagtgttaaatcgagtgtgatttgagtttttcaaaattatcatgaagacaggtaaagaagtatagtcctgcaatcttagcactagggtgaaggcaggaagattgtgagttagacatagtctcagtaaaacctagccctgggatgtagctcagtggtaaagcactggctttgcatccacaaggcctgggtttgatctttagtctaagtagataaatgagtagtagtgtatacttgaacgactgagaaccacctttgttgatacatactcaagtataataagtagtatccattttgggtaatctactcctttgtagatagttgaccatctcaatatcaacacagattgatgtagcacccatattatgatagaaaacagatcataagtaacggctatattgcata

SEQ ID NO: 31934 - DNA, 1249 bp, Mus musculus
gtatattatcttgacctttttaaaaagataggcggggtggggcggggcaggagaacctggagaaaggttaactggtagctcctcttagttgtgcttagcagtgagacgctccagcacactgttgcctgggagactgactgactgcagagtgcatgccccagagcgctacagaaagagcttgagtatgctcactgtaaaaagtacacccctgaggagatagagatacttaacaactataaaatataaacagacattgaaatatcaggtttactcaattatatataatttttgtttgtttccacatggctggacatttttaaatagatttaaaagtattttacctccatttatctttttaaatttgtgtttgtgttttgtaaggccttgctcgtgttaggcagtggttctgccaatcagctgtactttctgtgtttatcttaccaagactagtctcaacttctctgattcttcagcaattttttattttctcctattatctttaggtatatgtattttaccaatcttcaggaaagatctcctaaaattgaacgggctgcattggatggtacagaacgagaggtcctctttttcagtggcttaagtaaaccaattgctttggctcttgatagcaagctgggcaagctcttctgggctgactcagatctccggcgaattgaaagcagtgatctctcaggtacccagaagtgtctctgtattttaatttgagttttaaaatggtttcagtgctgtgaatttgtattcttcccatgttatttttatacatgattataattttatcattagatatatttagcatcatgttagttaaggagatctttaattacttcctttgttccctaattactcactagttttattgatctgaaaatcatgtatcttttcctaattcttctcctcgacttttacactcttgtcttctctgaactctagcctgtgactggtctctcaactcatttttctatataaaagtttgcatgtgtaaacattcacaaacaaattttacatatgcagacatctgacttgtgactcctcgtgtctcttgttaagtctggagagtattctcaaccaaggaagagctggctgtgctcctacttggctcaagttggtactcacccttcacaaaggcatcacgtacattctcacactgttaacgttttacttttatggtcctctgcttgtaatcagttacctcttctatcataaatcatgatggcctcgctagtgacca

SEQ ID NO: 31935 - DNA, 1177 bp, Mus musculus
tgtgtagtatgttctcttgagctgtataactaaatatattttctggctttgcctttgatgtgagcctttcaaaagccactgtttattttgacattagtgtacccttgcagctagtttttaaagaaagttgatttatataagttggaaggtaaaccagtatttaaaaatctgaagttgcttacactcagaaattcagaaagatattttagtaaagtgtacaggattcttagaccagattgttaatccttttcttgatactagttttacaagtgttagtgctgcggtaaagaaatcatggtttgcctctggctcccgtctgggtagaacggttggattggatgactgaagagagccctatggccacacctttgcaggagtgcagggcacagttagctggagatgaccaggtgcttggagaatggagccatggctttttatccatttacttgactttcttttttttttttcaagttcgttcagttactatacatgactgtgactccttttttcagaaaatcaagctgactgttaaatttccactgttttgaatccaggtttatgtattggactgagtggggaggcaagcctaagattgacagggctgctatggatggaagtgaacgcactacattagttccaaatgtaggccgagcaaatggtctcaccatcgactatgctaaaaggcggctttactggacagacctggacactaacctaatagaatcctcagatatgctcggtaagcctcactgtttcttgcttaggtgtttatggaaactcactggctgccctcgtttggatgctctggctgacactttgtatcagcggctattctagaattgcatctttgtatctttgttgttgttgttagtagacccctgttacttggatttatttatatattatgcaaagttttattactattgggtctgtactgatacttgtgaagggattctgctatgcacatgcattccccgtccttttgtggaagggagaatgaagtactgaactctgagtctcatgcacaggagagaaaatcaaagtcacaataaaccatcggagtttgaagagacttagcgacttagagatgacttttaggcaggagtcagactacgcatggactacttttagaggtctcacctggttttaggattgtttttaaatgaagtattctgtt

SEQ ID NO: 31936 - DNA, 2470 bp, Mus musculus
cattatcatcaaggtgggagcatggcagaatccaggcaggcatggcgcaggaggagctgagagttctatgtcttcatccaaaggctgctagtggaagactgacttccaggcaactagggtgaggatcttacacccacacccacagtgacacacctactccaaccaggtcacacctattccaacaaggccacatcttcagatggtgccactccctggtccaaggatatacaaaccatcacactaggtataaaatatctagtgatcatttctacatgcccttattgtccaggagctgttagtaaatcacaagtgtgggccaagcctgatttggagaggttaactactatggcacttgacctgactcttctgcttcacagtagcactttctagttctactctagttggtattcttttaaattcagttaatttttattcctgaagacatctgcattcttttatagagagtgactaaattttgcctgtggctttccaatgtttggttgatttttctttgttgatttaggtgccactgaactattgctgttagcccgacggacagacttgaggcgaatttctttggatacacccgattttactgacattgttctgcagttagaagatatccggcatgccattgccatagactatgaccctgtagaaggctacatatactggacggatgacgaagtgagggctatccgtcgctccttcatagatggatctggcagtcagtttgtggtcacggcccagattgctcatcctgatggtattgctgttgactgggttgcaaggaacctgtactggacagacactggcacggatcgtatagaagtgacaaggctcaatgggaccatgaggaagatcttgatttcagaggacttagaggagccccgggctatcgtgttagatcccatggttgggtaagaagtgctgacattagcaatctgttttctacaggtacctagagacacagttcaggtgacatgaactcttggagtcagttgtttttctgtaaacagtttgcatccgctttagagtgtagcgattagaatatggtctcacaggattgacacagtaaaaggcttctgactatcttgactaacttatttctgagttaagctcgactcactgatctgggtgtggtttgtacgttttgctcagatcgatatcttggtcatgaaaaaatatggaaagaaattattttcaaaactctgtgccctttccccagcagatttgattttatcctattcagttgttcctgtgggaattatgttactgtatagttcttgtgagtgactcacatttctgtgagcctatttgagggctgatacattgacagatatatgcctcagtttacaccagtgccttggagccacttccatccaggagcctcagctgtcacttagaaccacagagagtgttagttatttggggattcagtttgtcacctgactagttgtactaggtaactttctctaccagagttgacaagccatcaagcagagtggcatgacatggcaagaaagagaaatatagtagaaaaaaaatatgtgtagtaatggagtctaatgagagtccattgggagacatttccatcaactccagagagcagttttgatctgggagtgtacttgtatactgctgtgatgaacattagaaacgctctctaccgaagcttaagtcctattatttttcttccctcctcccatggcattgataattacattggtaatgtaatgtgtacagtgggcttcacttttgttctctgctttcagctcaggattgattgattgattgattgattgattgattgattgattgattttctgtctttataggtacatgtattggacagactggggagaaatcccaaaaatagagcgagctgctctggacggatctgaccgagtagttcttgtcaacacttcccttggttggccaaacggcttagccctggattatgatgaaggcacaatatactggggagatgccaaaacagacaaaattgaggtttgtttctttttaaaaatatttaaaaccaattttataatggtttctaggccagtagtactttggttcacatagcctctgagcagttgtctggaattccaggatatcatttccagaaatcttcctccatgttcacagatctcaggacagtaggttgtcttgcagctaatcctagggtttctgagtttcgtaggtacaggaaatgtggattctgttgtttctggtcttagcagcttttgtaaatgattggctttgttttgagtgaagttcctgcctaaattttctacagcctgttttctgcaaaccaaaattatataagatccacataggcaaacctggcagtcttaagtcaggaaagcaaaatgcacgtgggtgcatgcatgcatgtgtgcaactttttgttgttttgggtgttggatttggtggcaggatatagtaagtattcagttggttacatgaa

SEQ ID NO: 31937 - DNA, 1170 bp, Mus musculus
gcctatcttttttagcatcacgtgaatgccttcagtggcaattattaaaatcataagatcgaaaactaggctcaggctctttgctcttgagtatcaaggaggggcagaccttgttgccttttccgtcttctgggttgccagctgtcatccctgggacttcttcattgcttatttttcatggaagaatagaaaatatgagtgcgaaggcagtttttgagaagggaggctgacagcaatgttaagagatttgggcttctgtgtcttgtgacttagtttgcctacttccaaggcagggaccattctgagtgttcagtatgtttttttgacaacataaatatatttgaatttgctattcaaattgtttttcacagatgaatttaatctacatgtattttccttagtatgtttatgtattggtgtgaactgttttcagtgttgaagtcataaaagaaaaaatttgaagtgtgagtttttctttttgtgttaacaggcaggcagtggttaaaggttcccttccacatccttttgccttgacgttatttgaggacacattgtactggactgactggaatacacactctattttggcttgcaacaaatatactggcgagggtctgcgtgaaattcattctaacatcttctctcccatggatatacatgctttcagccaacagaggcagccaaatggtaagtgatctggatttttaaattccagtttggaacagctctgtaagcactctgatgtctggcttgagtgaggcacagaaggaggaagggcatatccaaggtggcgaaggagtaacaagcacagcgtgcacatagagctcaggttagacaccgaactctagaaccttgtcacctgatacccttccccatgtcatgtcttgtctttcattgggggttggggtgatacaagagaacagcaatgaattaaaattgagacagctcatctgctgtttatgcataaatgcatttcttgttcatattattttcttactatatttgaatgtgttcatgtgagtgtgctcaaaaaataccagcttactaggaaacttctgttaacctagcttgtgaattccagcacctacatgtgcagtgtaaataaactacctgcttagacattggcgtgtgttcttcctcttgctcttatgcagtttttttttcagcttg

SEQ ID NO: 31938 - DNA, 1320 bp, Mus musculus
gcagacagacagctgcagagtatgggtgttccagtaactcagctttttagtatgtataaagcttttaaattttatctgacactctcaataagaaaagacagacagaaaattaatttcacttctttttttaaagtgctagaaagtgtgaaaagattttagccagttcactattgctatttttctcatttttaaaaaaagtacggggttctacttttgtgtgtggttgtgtgtttgtttgagattatgtgtagcacatgtgtacaatgcgcacagagaccagaaggcgcgggatccctggtggctgtgagctatcggatgtggtgctgggaacccaatccaggtcctctgcaggagcagtgagtgatctcagcctgggagccagctctccacctcttagttcccattttatttttgatagtatttagtcacaaatggtgatttgactttataagattcattttataagatctgatacattttcttcttccttacatatttttctttttgtttcagcggcccctttgttgctttatgcaaacagacgggacttgagattggttgatgctacaaatggcaaagagaatgcaacgattgtagttggaggcttggaggatgcagctgcggtggactttgtgtttggtcatggcttgatatactggagtgatgtcagcgaagaagccattaaacgaacagaatttaacaaaactgaaagtgtacagaatgttgttgtttctggattattgtccccggatgggctggcatgtgattggcttggagaaaaattgtactggacagattctgaaactaatcgtattgaagtttctaatttagatggatctttacgaaaagttttattttggcaagagttggatcaacccagagctattgccttagatccatcaagtgggtaagtgtataatgtacaaaaggcactccagtttctattcctagtcttccttgattggtaaatacccctcactgctaggggacaaaagaaaggtaaaggacttttggggtttcattgtcaagtagacttgtctatggaaagttgagtttgttcttaaaagacagtgtgtatccaccatgtattctctgttggtgggggtgcaaattaataaaaccagtttggatacttctcaaaaaaattaaaagtagaacaaccatgtaacccagctatttcattcctggatgtctgtctggagaactacttaccataccttaagagacacttgtatgtgtgtgtctgtaactgctttattcactatagtgaagcattggaatcaacccaaaaatcaacagatgggttatgtatgtatgtgt

SEQ ID NO: 31939 - DNA, 1211 bp, Mus musculus
ggaaatgttagtgccgtgccctgtcacagttccatggttgggttccttgtgcgcatcccagaatacgacagtgtcaggcaaagcgtagatgatgcttagactgtgaatggtgccttcccagccctgcggtcaagtcagggcgtggggcctcggagacctagcaaaggaggagctgagcctgacacagtctgctgctcccatcacggctggccacttagacaccagaaccacagtccctagtcagctctttaaactttatattacttaatgtgtagagtaaaatgttggccttcaaaagcatttaaacggtgccttgctgaagtatatagcagaaagtagttataatacatggttgctattcttaccttttcttttttccctcccataagtaacaaatgatctagaatagtctggggcttacttttttatttttcttttatctttttggatcatctattagctctttcttacaatgatgaaacagaaatatcttttgtggggtgtaaacatgatcaagtcgggctggcgaggtggctcagtgattaagagcactgactgctattcccgaggtcctgagttcaaatcccagcaaccacatggtggcttacaaccatctgtaatgagatctgacgccctcttccggtgtgtctgaagacaactacagtgtaattacatataataaaaaataaatctttaaaaaaaatgatcaagtcatcttgttatgttaccctttctagtaacttaggggcaatgttttagcttgctgagactgcctggaaagttctttgtgcacacgtatagggccttgtgtcagagaaatgtttcagaagatctgcaaatagatcaagaacatagggaaggcaaacagaaggaagttagtcatctttgttgcttcagaactgagcaaacgttttgggagagcgaagttcctgctggacatcactgaataagaatgagttgatgtcacagttggccagaagcaacttttttttttcctttttttcttttttgtcatacaaagagtacagcaggatggggaggagagagtgaagacaaggggaaaagaattgtaggggaaatgaactggagaaggaatgtaagaatggctcacttgttgtgagtagcattgctatgtataaaagctgtgcttttcttatcaggaggagtccgccttacaggagctgggagcagggatgtttcctggctcctct

SEQ ID NO: 31940 - DNA, 1206 bp, Mus musculus
ctgtgaagagctgggttgagacccactgcccgggacaacagggtaagccgactgtaatgttttgtctgttcacttcctgcagatggatctgtccgtggaaaccctcttttgcttcatgcaggagcgccagaaaagatacgccaagtatgcagagcagatccagaaggtgaatgagatgtcggccatcctgcgccgcatccagatgggcatagaccagacggtgccactgatggagcggctgaacagcatgctgccagaggctgagcgcctggagcccttcagcatgaagcctgagcgggagcggcactagcaggcgcctgcctgcgcacacagctcctccagccttcccctgggccctgacgtttgcctagatgtgtctgacccacatggacttcccagtgtggtagttcttgagaaccgaagttgggacagttgaatttccagaaatcctgtaaagaactttgcatcaagagttatttttattttgctccgattgtttgaattaaaagtgtaagtagtctagctactgcagtgaaactgtggagaaaatgctaaggacctgttcactttggcgcctcgtgagacttgacgcaggctctctgatctgtggctgtaaacataagtgctgactggctccagctactgttgctatgcattggcccccatcacatcaaggaggtatctggcactgtcttcctgccctgccagaacaccatctttttgtttttccggtaccacgccccttttgtgggtcactggaaactgaagactgccgtcatgcactcatgaaggtgtttcccattagaaccgcttttccattcagagctcaggcttctgccagcctggcagaccttggcttccataacaaggtttgcactgacacttgctcccaccctctctcatgcgagacccttggccctccactgatgtgccaggaacactaaagaggcgacggagcctctgcccgccctgccgactgtagggcgtgaagctggggaaagagctgcccgtcacaggactgctgtggaaggaagagacgcaataagtgcaggggacgggcccgaagataagagctgggtctgaggggctgtcagggctgggagtctacagcctccccttcgtccctgtgttcctccagaatccagagagattctgtcaggtgttagaagagcctcggtgtttttataagattaaaatgaatctgat

SEQ ID NO: 31941 - DNA, 2189 bp, Mus musculus
tgacagctgaaggatacggacatcattctgctggatgaactatttaggagccttgcctagatctacttataaccaatccagtacctcagacaagacatttggggccatcaccactaccatgtctagtagaccattttctaggcattgtgaataagtaggtaacttgtcactttccagactatgcacaaaatcccagtgggcctgttgcccatgtaaccctcctgtcagcttgaatgaagaggggaaaccaactagagtttagcttcgccagagattgggcagtcagatagcttagagacttaagccagggatggaacactgaacagtctccctccctccctccctccctgtaacataagaattctctttagtgggattgttacttcttcacttggccacagacctggtttagagataagcatgaatcactgggcttggtagcagaccgacagaacctcaggttctcacttctgtttcgtgtcctggaataaaactatggcaagacttgggaaggtaaaacctgaagcaggaaatggatttccttggctttttttctctatggtatgcaacgagggtaatatttctagaatcttcttaaacttccaaacttaaccatgggctttggtaagcaagaactagtcagaataaaacatactagaaaggttaagagggcgttgttgaattttgtttagttttgaatacaggaaagctcttttccaaagctatcccagcatgctttccagggaaggggcatatcagagggaaggaccacagtggtgtcttggtccctgacatacaatcactgtgtagactcaatcctggcagctgaggataggagataagaacaagaagtgtgtacacgatagtccatatctgcccttaaacttcctggcttgagttgtatcctctagagtacggtcctccttacggccttaattcactcacgtcagcagggtgtgggtgtggggtagatgttgtcattgttctttactgtaagtgtagctaggggctgactcatatctcaggtttttctgttagtgaaatggatggtcctttggctaggatgtgacttactgtttcctatactgattgctgaaaccagcatagagtgacggtggttggaagctgacaggcttgattgtgaggaggattaggggcctcgtgaacagactgggtctgtacagataagctgtgtgtgggcataaggtgaaggtagagcagatactgcacagggagcacgttgccactcttggagattctgttcagcaatcttcttagatatatatcaaaatgtctaaagttctcaaagcttcacagtaaattttgatacattgtgtacacacacttaagtatgtaacaatccaccttcttaaaatctggtcacaccggtaagatgtaatttatttaagaatgaaaacaacggctccaacatgaagtatgttccagaagactggggacttggcttcagtagcttcgggcagtgcgttacctaatgccagatgtcctgtagagaagtgctctctggactgtgtggctgacagtcatacactacagctgtcagtccttcgtcactaatgtcgtatcagttcttggaatcacgactaccatgctgaaagggctgcctctgaggcacattgtgggtggtggtggttaggtctcctcacgtaagcacagggaagtctgtgaagtctactgggatggtacaaaatggactctgtgagaaatgctggaaaccgttcaggccgtttataaagttagagtggaaagactatataaatgtttaatatgaatatcgtgtccttgagtaaaaggcaagctgttgaatggttcacttgtgcatctctcattctcaagtgtcacgtatgttaatatgatgaaataaaatcagaactggtacctatttgtacgtaagtgtgagacgtggcttctccttgcagatcccaccctcggtgggaaccacactgtcacaggaccacaagtgacagttttaaccatttggagtggaggtggcagctgatccatccatgtgtcattcacatggagcagagacagatgccagtctgtgttccctatgccaagcacacactgaggaagcattcctaccttcctgacttcaggacacacaaagacagctgcctgcctgtgcacctaccacaaacaattccatagtccttaagggaaaacaggag

SEQ ID NO: 31942 - DNA, 1160 bp, Mus musculus
atgccttgttttggttttttttgaagtttttatattttgaggttagtataacccctttttaatgaaaccatgtctagttattcctttttgtttgttcaaatgaaacagtgcattaagtatggaattagattaatgaagtaaatattatgaatcatacactctctagtctgatactcatttttctgaccccatgttttgttttctgtctttctttctctcttcatataggttgtcagcccagtgtaaagctgttggagtgagggcagaaaggtaaaggatgatgtaatgcctggctgccctagagcatcttttgttgtgggatgggtattcccatcatctctatgaatctagtgtgaggggctgctttgtggaaggaatcctttgcaagagcatatcaacaggaaagagaaagagacattcagttggagggctcttgctgaaatggatttaactctcctcttgccagtcaccactagcctgacctcatacatttttagtacaatggagtggctgagcctttgagcacagcaccattacatcatcgtggcaaattaaagaacgaggtggggaaagaggacttattgttgtcatggcccatgagatgattggaactcaaattgttactgagagcttggtggctctgctggaaagtggaacggaaaaagtgctgctaattgatagccgaccatttgtggaatacaatacgtctcacattttggaagccattaatatcaactgctccaaactgatgaagcgaaggttgcaacaggacaaagtattaattacagaacttatccaacattctgcaaagcataaggtaatttctttcttttatgactttttaagaaagcagacatactaattcagaaaatattttaattgaagcttcttttttaagtatagaaagtaatttgaggaaattttgattgcttttagatttggtaatcttgcaatacctaaaaatatattaacaattatactgtcactttaaaaagatttatttatttgtttatttatttaatgatatgagtacactgtagctgtctccagacacaccagaaggggagaatcagttcccattatagatggttgtgaataatcatgaagttgctgggaattgaactcaggacctctggaagagcgtactcttacctgctgag

SEQ ID NO: 31943 - DNA, 2440 bp, Mus musculus
cgtttgcaccttagccctgtggctttcatggttaatttctacttgtcctatgtaattgatggatttgtgtgtgtgtgtttagttgtcacttcttttcttgtttttaatcaccctacaaaaagaaaccaaataggctgtttgtctcccgtggttctcagcctttatggacccaatattactcctttctagttacttgagtaatgtttgcttgtctgtgagccattccagcataagctgtgagtattaacagatatacacacttctatttttataacccatagtgatatgcctgttttaaagaatgtccataacaaagcccaatacaaggcccctgacagcctcattttgctcttcctctgactgtatttatgaaagctggctagggccaaatccatgcttggagaataattagccacagtttatttttaagtgaaaagttctcttagtagcatccgttaccttaacctgcagtatgtgtgacgtggtttctgctgtatgtctccatgtacacacattggcacacacatttgcttgtgcactcagctgaggcatggggtttttctaaagcgtacagaatgaacgtagctgctgagactgggtatctgctgtgtagagcacaggccatcctgctgctgacgctatggctgctgctgttggcagaatactcagttcttccctgacatgagtgtccttatgaatgtgttctgagccagagagaaagaagcctactgtgtgcttgtacctgctttagcctgtgcccccactgtgctggggcatcctgagctgcaccctgtactgcagcctggggcctggtgggtatttggagtcgcatgtggctctgtatggttcccagcacagccgaatttgcacgtggagtgtggttaggggcaaagctcatagtaggagaggttcagagacaaggaatttctactttactcgcttctctcactagttcagtcatatgtattctctgttgctgctaattacaattgttcctccctctgatgaagcaggaatttgacttccagaaaaagaagtatttgccacagactggcagttgaagggaggtatcatagttacaggcatgtccaaccttttgatgttgtgacttgaagcctgagaattgaatgttttaagtgagtttacagtttagtgctgggccacattcctagttattctgaggtatacgcagcctgcaagctgcggttcagacgtgcctggaaggttgtctgtgaggtgggacgagagatggactgtgtagcttgtgatctcttgacaggcatgtctcctgaccagttgccttctgttagctgaagatcccttgagcgcaggcgtggaactcagatctccatgctaggtgtgtgtgcccgccgacagagcacctgcccagcttgctgggattcgctgtgttttagaaaaatgggcattaagggtatttaatgtcttcttaggaccataagtggagacaaggactgttgatgttcaggcccttcgaatgtaagtgttttcaatgtagtgttctgactgggatggcgtgttctgccagtggggcgactcagtcgtagactcttactttgcagaactttgtgttgctttgtttgttactttttgaattctccaggaaaaaaaaatgtttttaaagcaaacattccaggatgagtgtggcctctcagtggaatgtctcactgtgcttgaagcctctgcaggttgtacttgtagtttcagggtcatcccaggttgtccttgtaaccacacggtcatccacaagtagaagagatggactttggagtgaatgttgattacgctttgagttttctctagggcctgtatctctttagtgttttggagccatcaaaccaagataatggccctcagcatctgaagggggcatggtgattgctcagctactgtgctggcccttctcccgaatctgtgatctaattaatcactgttccagattccaacagctgcagcatctcttgtcactcccatccatcgaggcactgcaggctaactgcagttccttcccagaggagagcaagctgggaggacagagcccaaggccattctctagggcaggaagaggccaagtgcctggcttctttttttttttttttttttcagagattaaggagaaaatatatttgcacattcacaccaatccaactctgccactctagcatctgcttcccacgtactggagcaactggtgcaatatggagttgatctggtcaggtcaacatttaggctgtaggtgaagttattaatttgttttctgtccttatctaaaatgttcctgggatgcccaaatcagagctttagtgctgcggtccctgccactgcctgcctcgtggacacgctcagcggcaccagctgtaacttcagcgtctttgccccacagtgggtctgctttggctggtgatagaaacacaggtttaag

SEQ ID NO: 31944 - DNA, 2037 bp, Mus musculus
ctggcagattagttgcctgccaggaggaattactttccttgatcaaaaaaattaacactggggaaggctggaatcacttgaggggactataatgcagtatttgcaccccaagatatttaccttaaagtggaatcagaatgaggttcccaagcaagaacttgccaccaaggccccaaaggatagggacggtcgtatccttatgaatcccactaaaacttaggctgggaatgacagttttcctttccagtctcagttcatgagaacccatttcccagaggttcgttttgagccaatagcctattttgaaccatttgaactgtagaaaaatggcaaatatatacttacatgtatgttcttaagagaaaaactaggtacccatagtgcacgtttgattaggagtgtgaatagagctgccgtggctcgagttctttttatcttttgcttttgttttggtttttggttttttgagatagggtttctctgtgtaacaaacagctcgggctattctgggaattgctctgtagaccacgctggcttcgaactcacagagatctgtattgtctctgcctcctgagtgctgagattagaggttgtgtgccatcacctctgggtacttttttatttttttttaaagttgtgccttgtatgctggtaaattttggagagaaaggaacttcatacttaaaaaaaaaattagactggaaagttcagaagtactaatgctcccacagaattgattttaaccctgaggttacaaagcagaagttaaatgaacagctagaggaagcagccttcccacacgtcagcaccgtatgctaatttgctggaacaggacggtttggatgtttataggggaaatggatagtagatgttaggaccaactgagaaggtccaacacaagtgtggatttttccatgtgtcaaaaatctcatcaccccacttgcctaattagagtaacccagcccctaaatttacatagattgactattcatatgctctaactacttataatagtttataagctccttatgaagaaaaccagcattctctatttctaaagcccacttataacccagcatacaaatagatcttaacagtttattattaacttttcaggtcctcatttattgaaatttaaaaataaatgaaggaatatagagatggcacagggttccagcttgttgtgtttataaatcataaagtcatgatataccttctacagacatagcattttttcagagatggaaaatggccattagagtcactttccatattataccctctataaagttgtcgaattggatgggagttctttctaactagccatcacacctgtagctttagttgctttgtgtggcttctggcctagcttttcagatgagccgcctggatttttacctggcctgttctgataaagaggcatttattagccaagcaaccataagactctagtcaaaagcactcgtgcagatatgctgcatatgagtaagaaattgcaattttgtaaacattcctcgacttggtggggaggaataattttataattgcatttccaggtatttttcaagattacgaaaatatgctactctgatgtgttatggttcctgaatttcttttctttctcaccctctttgacccagattttatagagcgagtttctcaacctctgcacagttgacattttgagccaaattattctttgttgtggtaggcagtcctgtgcattttagaatgtttggcattatctctggcctcccccacaagatgccagtagcaatcttcttcccgaagctgtgacaatcagaaatgtctcttagacatttccaaatgtcccctggggcatgggagggtttcacaaaattgcccacttgttaaggaccctgactctaataccacacaaaacagaacaaaaatccagcaaagataggatcggagatacctgtagtcttcagacctttagtgcctgtatttatccatcattactgaagtatttgttaactaagctagcaacaaaataatttctgtactttggcaatg

SEQ ID NO: 31945 - DNA, 1252 bp, Mus musculus
agaaaaatatttgacttgcataaagagaagcaacctgggtgggggtgggggggggaagggtttgaattcctttctttaaagatgtagtgtccctttcggtaagaatggatcctttatttttaaaataatcaaaatttgaataattgctacacatggttgctatttatttctacatgaagcttattctcacttggaggttctgaagattctgttatagagcaagaaatggcttaatttttttttttaattggaatttaccagtttattgtttagcagtaattaccccaggtaacactgggcaaaaatctggggtgcataatagggaattctgaattcttagatttgattatcccagatcatttttgctaagaaaaattcttatttctttttttcacagtgaacataatcctaaatccttggatatttttagaagtctgtaactttacacaaataatgaaataatttttaattcaaagtttctcaccctacttgttaatttgcccccaaggaaagttgtttttttttttttttttttttttaaggaaaaaaggacacttgtagagtaagtgaaatggatactacatctttaaacagcgtttcttcattgcctgtgtatgagaaaaacttggaagtgtgcctgtgtatataactctgtaaagacactgaaaattatactaacttatttatgttaaaaagagatttttttttaatctagacaatatacaagccaaagtggcatgttttgtgcatttgtaaatgctgtattggatagactagccccccccccgcctttgttaaatagtatggctgtgcttaaaaggttgcatactgagccaagtataatttttgtaatgtgtgaaaaagatgccaattattgttacacatcaagcaatcaataaagaaaacttccgtagttatttattgagtgcaactgtcctgtgctttactgagcctgagctagtcagcctggcatgccccagatacaatgggaaggcaaacatctacatttaggcctacatttcagtcagatgatttgggggtgggggggtgatgggggtgatgggggtggggtggggggtgtgggtattcttagtggccattttcatcttagtcctatatgggtagacaaggcttaactggaaagaggaaaagccacattttcatgtaagactgtcagcagcccccatttagttaaaatatttatgttttctaggatatgagtgtgtgagaaccaaaggggggggcttacata

SEQ ID NO: 31946 - DNA, 1239 bp, Mus musculus
aggtcacactgtaggttcagtgccagcctgggccttaccgtaagtctgaggccagtttgtattatactgtgagacctgccacacctgcacagatgagggattgaccttaggtggggcagtttggcaatcaggaagtacaggcatggagaagctgggatggggtgggctgtgccctctgatagttgtgccaacaaggaccgggaaagtcagcatgtttgttttactgtatacacgggtgggcttagctattctccagagtgggcctgtcagggagcagtcttggctctacacatcccactatacatcccagaggaggaacctctgcttggtattttctccacactgtcaacaccagcacacggatgggtgtctgcgcctgaccacagaaggcgtgctgtccccatatcccttgttttgtgattttaggatacctacctggtttatattctcaatgaactggctggaaactcctttatgatattctgcagcacctgtaacaacactcagagaacagctttgctgctccgaaatctcgggttcactgccatccccctccatggacagatgagtcaggtaagagttctttacaggaagcaaaccctgtgtcggtagatgagtgagcagagacggcgccagagccagttgcacgctcctggttcatgggcagccgtgctccttgcacatcctggtcttgtgtgctctgtgtgttgccttacactctctgcccttacactctcatgttcaggcagcgtgtggtaagactggagtaggtcacatgggcctgctgaggtggctcgattggtaaagtaccttccgtgcaaacatgaggacctgagtttgagccctagaaacatccaaagctgggtgtggtgacacgtgcgacagccaacttagcctaaccagtgagcttcaggtcagtgagctggaactgtgggagctgggaaccaaatctcctgcaaatcactgagacatctctccatcctcaggaaagaggtctcaaagagaaaaagattgtcacaacaccctctggcctctgcatgcgtgttcatgtgcatactgtgtgcaccgagtatacacataaatatacatccacacaaaagaacatttcacaggcacttgtctggcttgtaagcttttgatgtagtaacagtgttgactctctggtcttaagtattttttgttgtttccatacttgttttgactatgaagccccagcctggacttagaagggaaaaagta

SEQ ID NO: 31947 - DNA, 1300 bp, Mus musculus
gtgcaccaccatgaccagcacatgtaatcactttttgatggctatatcgcatgctgtagcatggtttacaatggtgatttgttttctccactttaactagggctgtgcttaataaatatcctagtagcctcttatttccttaaaggaaacttctagaagtgagattgaccagagagtacacatacagtagaattcatacagaatgcctgattgtcccctagaaaagccagagcaggtcatgtgaccacatctgggccagccagtctcatttcactttggtgctttggtctctgtatgaggtcagcgtttctgttcatttggagttgattcttagccttttcgggcattctctgacctgaggatggggcacgggggttgctgttaactccagtcagtcacatcgtgtttgctgccttgcaggagttaagggagcacggagaaaagaagaaacggaagcgagaggatgcaggagatgatgatgataaggagggcgccattggtgtgaggaacaaggtggctgggggcaaaatgaagaagcggaaaggccgctaatgctttagaaagacttctgctcgcctgctcgccagctgtgagattctgtccagagaccactcggccagctgggagaacgttcctcgggattgcagtgtcattgcaatgggacaacttttacagtgttgacacaggactggccgctcttcagcttgcattcctcacctgtgacacaagtgccgtgtgctcttcatgctgcacctctgccttcccacctgcaagccacggcctggcggatggagagcgctgactgtagttaactgtaaagcttctacagaatggtgtgtacgccaccttatctcagccggcattcagcctgatgtgggtcaataattattatgattaaagatgtatttttattacctgtgtgtgtctgtgtgtgcacttttatgcagctacccagaggccagaggagttggcctcccctggagctggagctgcaggcagttttgagtcaccgctgtggatgctgtggatgctgagaatcaagttcaggtcctctagaagagcagtattcaaactctttggagaccttgttattgaaggctttgtagctcctgctgatggggacctgttcgtgtcattatatggcagcttaattggttgtctttaattgaattaagacattaattggcatgttgaaaaatgaagagcaagatgatggatggctttaaagagaagttctgtttagaggaagctgcactttcctgctattggtgcggcagcaaagggcttcagagccccaggt

SEQ ID NO: 31948 - DNA, 1265 bp, Mus musculus
tctcataaggagggctcatagtcagcttgggaccactgctgccttccgttccccgagttacagtgtttagttgcaatattgcatacaacactcataacaccaggaaaaacattgcatatttacagatgagctgaaatagaccccctttgggggtcacctctctggcatgcttgtcccaaccgtggccctatcttctctctaaaagacttgtcttctccgcaaggtcatgtcctttcttaccagcccttgctcttcaatctttaggcaatttggaggctatgccaaggaagcagactatgttgctcatgccacccagctacggaccacactggagggcacaccagcgacctaccagggtgatgtctattactgtgccggatatgaccctcccatgaagccctatggacgccgtaacgaggtctggcttgtgaaggcatgagtcacttgatgaactgagaacgtcctggaagggtgccactgtgtcccctgacttagggtcaaggggcgggagggtggggggaggtacttcttcagctccaatgttccttcaaaatccctcactgctgattttctgaaataagccaagattggcagcatcattcttgagttagaaagttctggggcagaccagaaaaaaaatcccagtggcatttcctctgccactaaaaactgatttttaataattatcgaatttgtatttttgttagtgaggaaatatgtgacttatgcatgaactttcttctgtgattcttttaagaactttgtctagaaagaaaccaaaaatacaaatctttgacgtatgcagtggagacagttttaaattatttcccagttctatagtcctttaagaacatttattttacgtgtgtgtgtgtgtgtgtgtgtgtgtgtgtgtgtgtgtgtgtgtgtgtgtgtgtgttcatgtgtgggcaggtactctcagagcccatcagtaggcatcaaatcccatggagttagagtaacagggaattcagagccgtcagacttgagttgctgagaactgaaccaagacctctggatgagcagaaagcacgctgaacagcgctgagccatctctccagccccaagatggatagttttaacagagtgctgttgatggtgttcactgtattttgagatctggagtctgcagaaccttctccaagggtcccatggaaagaggctgtgttctggatgcctggctgtctccgagcttccagacagcacatctgtgaacaatcgctgagggtcaggtctacagctgc

SEQ ID NO: 31949 - DNA, 1838 bp, Mus musculus
tcaccccaggatttcaagatttaatatgttttcttggttgtcaggagtattttttttttaattatttaccaggctggacagtggaggcacatacctttaatcctagcaattgggaggcagaggctggtggatctctgagtttgaggccactgtggtctacaagtttctgaacagccagggctacacagagaaaccttgtgttggaaaaaaaattatgtatcttatgtgtatggatgttttgacgacatgtatgtccacgaacccaagcctctctctgatttatcctgtagagtcaatgtagagtttgtgtagaagcagagttcaggccgtctgccacctctgtgtccggggagactgccacccctcccaggacgcatgctcagaatagcagtctttccacctttactgaaagctgttcttaaaggatattcaaatcacaggcagttctaagaagtgaggtttttgtcaaacttctttagctggcatgtagtattcaacttgctaacttgtttccatagaaacagcggggaaaccatagacattttgtgagagacagcctacagaagagaattgttctagaagtttatcaggaacaatcacgcctcacggctctgagaaaatctaacgtgggaacagactcggtgtaaagaaagttaactcaagagccagagcctcaggctggctgtggggtgcacacatagaaccccaggaccagggaggctgaggtaggaaggttactgcagggccgaggacagcctgggctacatagtgagtccctgcctcaaatttataggtgaatacatacgtgcatacatgaataagtgaataacaaatttaaagtcaaagccatggccatgtttgttagtgacattcaatcaaatgcagaagctaataagaagcgcagatatttgggctggcaagatgctcctgtgggcaaaagcgcttgccaccaagactggtaacctgagtttaacccctggttcccacagggacagccatggttagagattgcactagagaacgttggaagttattttcccatccaactgcagctattaactgctgttctgcccttctcttaaaagaaaagcatttactttatgtgtgtgggtgttttgcaaatttgtaggcctgtgtactacatgcatgcctggtgcccaaggaggtcagaagagggctgcagatcccctaaaactagagtcgcacctagttgtgagccaccttgtaggttctgggaatcaaagctgggtgctgtggaagagcagtgctcttcaccgctgaaccgtatctccagctccgcctaaatcaaccaagagtctattatgtggcaaattggcctcacactaagctgaggatgaccttggatttcagattctgccacggtttcctgagtgttagagtaagaggcactcaccgctgcattcaccgctgtgcctggtttatgtggtgctggggcaaatccggctttgtgcatgctaggccagcagtacaccttaaactgatgtgcaccccagcctccttatgtgttttggggacaggattttttttttctattgatacatttaaaaagctatatgtatatgcatgtgtcttagggttttactgctgtgaacaggcaccatgaccaaggcaagtcttataaggacaacatttaactggggctggcttacaggttcagaggttcagtccattatcatcaaggcaggagcatggcagtgaccaggcaggcatggtgcaggaggagctgagagttctacatcttcatctgaaggctgctagcagaatactgacttccaggcagctaggagtagggtcttaaagctcatgccatcggtgac

SEQ ID NO: 31950 - DNA, 2381 bp, Mus musculus
ccctttcccttaaaaaaatatctgggacaagtttaaagttgaagagcttggtcattgagaaggaccaagtccctgggactcacaaactgttggaactaaaccacaagaccgggaaaggaagaaacattcccatgtttagatttcccattgctttggaaatcccatttaaagagggtaataatggccccttccctacagatctagtgcaacggaattctccggattcagaacaacttgacggactggctcctgtctctcctgcatcagttctcttgagagaggatgacttcagggttgtgcagcacttgggatcactgtcctgcggcagcgtgttgaagctgagatgtagcatggtccgcttagctggggaacctcacgacctttccgtccccacgctaaccccttctcccgagaactctgtgtggatactttggaaatgtgaatcttatagctgttttaatttttttttgtacctttaatttataaacccttgtggggaaagccagtgacctacaagcaggatatatgttgttttgccttaggccctgtgtgtctctctgtgtatgtgtgtgtgtctctgtatgtgtgtgtgtgcccagtgttgtaacaattattcttgagatatgccccaagcttcagggattccgtttcctgtcctggtgaagttcatctggcttggccatcttgatgcggctggatggcctatctctggtcctgagggtcgcgcaccactgttttccctctgcccgcctatactgtggttcctttccacagcagtgaggaacactggaggttgtgctgggggctcgttatcctgtgtgctcatctgtctgtctcctagactctccacccgcagagtgcagacacgcttctatcacagagagagcaagggtgcctcggaccagggccttgtgccaagcccttagagctttgatggctctgcagctgtgatctttgattctgcagcaatggcagagggtttgcatgcgcactgtcctcagtcccatggccttgtcctgccgtagctctgccctctcgccctgagtctttcttctctggggcatctccatctcttcccgcttcctctcttattcagggatctgtttctggacttctgcttcttgggtccggtatgcaaccactctggccccgtgtccttccctccttgtagagctttgaaagcatattctgagaaagttctcttgtaaatactgtaacttttttataatgaccaagttctttagaattattgccatccttttctgcccccttctaggtaagtgtgtgacctcttttaactctttcaaatgtctatgtcattatctgtcatgctgtctgttctcatggtggccaatgaaaacacacttctcttgagggaaagccagattctcatctcacttgggcatgtatgtctttttagcttctgttaataaatttcaggaaacgtagattctaggtttaaggggctaactatgagttgcccacaagaggtgttatgggtagcagaggttggtccttggaccacccagcagattggcctcaccagacttgttggtacgtctgccagaaagagcagaaaagcatatttggaagtcatatgggaccaggttgaccttggggagggggaaacaatgaataggatcctttagagtctggagatgattctaggttatttctagtaagttgaatttctgccagtgaaagggtttagaatatagtttggagtgtggactagttttcagtggaccaacacgggagatgggtgggggtcctctggcctgcttgagcccttgtaggcccagtgttctctgcagtgttgttctcagagaagccagcctgtgcaggaagggggaagatacaaggctgctcaatggagtgcttgggttgttgctcggcctggaggctgtttatgctggttgagtcttagctgagaggaagctccacagacaatatccctgaattaacatcctaacttcttcctagaagtgtgaatcgcttccctgctgaatgcaatgcaaactctaggcttacttcctgttgcagctggttatagaaaggtagctgagggttgagatggcttcatctggcctcctgtcaaaggcctcctctaaaccctcctccttgtaggcaacaacttccccagatattcaagataggaagtgttcaatgagggcagcccacagaatcagcctgagcacacctcagtagtgctgtctgcatggcaagggtctcccctcctctcagcctctcccttccttcctttgtaagccctcctgcctctgccctgcacagcacccccacaggcccccaaacatgtggtgcggtgataccgactaaccccaggaatgtgaattgctgtccacgttacctgcattgaggag

SEQ ID NO: 31951 - DNA, 2356 bp, Mus musculus
ggggggtggggagagggaaggaagagggggagaggcccaaacccaaaccatatctggggcggtgggattctctactgccaagcacccatccttggaagaaagttgttggctgatatgctgatgcttccttgacgtcaccagagagtcctcctctagccaccaaatatggccccgtccatcctcaattacatacactcggggcctccccagctgccataccactggcgccactcttgagggtggctgctgggtcacacactgaggtcttccacatccatattatcaagttctgatggtggttcaggtcttagcaagagcagatattgctctatgctgaggctaagtctggaagccactttgtccttgtgacctaaaaacaaacatcaaatccagatcccatgtgcctgtagtgggagctttggccaggaagccaatgtgcatatttggtggcctttctaacaaaagtataggaagagagatggtttgtaagttcaagctgatggaattggtttagccaagaaatggaagtttctaccccagaggatcttggagacaggtggggacaggcagtgctcctcagtcacgtgtcaccgagctgtcccacatggaggcctcctattgtgaactttgctagactctcacttacagccaaggcagcttttctggagtttttctagattctctagagccaaagatgataatgcctcacaaaacatagggtcaaagcatatgcccaccgcagtgctatagtaagtttgtgggtttttaggattcccccaaagcactcaatgtatcttgtatatgtaacaggggagaaatgcatgtgttcctttgacatacaattctgaactaggaatatttgaggaagtccaatgatgaccaacaacactggggaccagaatataacatctaaatgcagtagtcactattgctttgacctgggctggagtggtctcctctcaacagctttcatcacactattttccagctaaagatggcaaagctgtaagccaattaacatatacaccaacctaaactaaagaaccagtcctgagggtgtgagaaaggtgctatctggttatggattattaagcaaaccgtatttcatttatgttgagaagagaatgcctgccctcagggaaaaaaatgtcattgtgtgagatgaataaagtcctggtgatgggcagacagtttctcttttaaaacaggagaaactcttagggcatccagacagatggtagctaaattgttggggctgcaggggtattcctgtataagacttagaggtagtatgatatctcagatttctgccttaaagggctttctttttagaaatagtttcttttattgcccttagaagatcacccccaggaagagtatgagctatcttttctacatttcttttcctaggaatattcttatccatttcttatatacatttcttttgggagggagtttttatgctatagttgctggtatttatgtaaagggaccattactaagtgtatttctctagcatattatgtttaagggactgttcaaggtaggttactgaactgccgggctgatgttagagacactggccagaaaagctataataagttcttaaattataatttgatcactatacatttgttctatgctgccttatgttcataagaatatcaacagacagctagagccagaaaaagatagtcacattttgttaaaaagttgaattatgactggagtgaaccgtgcattcccttgccttttactttttttctgtgacatttacgtctcatgtaatttgcatcgcattggtgggttattctagtactgtatttggcttcttcattaataggatatttcacatactataattgtaaatattttgatacaaatgtttataactctagggatataaaaacaaattctgattccctacattgtgtgactgttttctttttcaaaagtgtgagataatatagagaatggtgacatttattcctcctcattaatttgcctgctggtttgatttggtgaacttgacatttatttgaaacattaagatactttctggtaaaaccctaaggatttctctaataattatttcaggcagctgaatgttagcaaatatagctttgccttgctttaattagacctcgtaggcaaaaatggaatttcataagctaatagattagaaaggggttgttatcgtcttaaataagagtagcttatgacattaagaaatgaggcacttctaaagtttggttgaagtagccagctcctttaatgtgtcttctcagttcacagtgatgcacaaagggctgggataactgacttctgcagaaacctcctatgttaactggggcta

SEQ ID NO: 31952 - DNA, 1099 bp, Mus musculus
tttaataattaaaaataaccttaatttctcattagttggttggactctgtctccatccttttctctgcttgtcccgtgttgcctactttccaaacgccttctgctaattgtagaattagcagatagaacattctcgagcattacttcatacttttaacaaagttggttcagaaacacatgatctatttcccttcagtgaggttttacagcttaggagatcaggtctgagtcaatgcattccatgttactatgtgtaagaatcaggattaaggcaatctgtaaaatgcctgtttgtaattgaatccaccaatttcctttctggagtaaacagtaatcagattataaaacttggtgttttcactggggtgggaagatgtgattgacctaagtttgtgatggcaagccacgctgaacttgaagaagatgaagaaattaaaaagggtgaactagctctgtactcttgatatattcacctctcctctgtgccctttggcttctcaaaatgagtaattgcagctacaatgatcatgtggcttttctcctcagaatattctagactggagaatggagacggctagtggggagtggtcctgaggtctgtagatgagtcttgaagactcagggtgtattgtttatcggtacctttctgtaaaaaagtctgagactgtttctaaagtcagtccacctccatgtctgagcaatcaccagcagccagcagtagcaggcttctccttccgatagagctcatgagggcttgggggtgaaagactattttttagtggggataaccagagtgtcttggtgtgaatattaccctcttttgtcttccaaactattcaaccccctttcttttgcttctggacttttttctcagcttggtgaagaacattatttcaaaaccacgctctgttctacttgtcgctgaatttatttctcatctatctttttttccctctcattttaatatattctaaacagctcgtacctgacatgcaacagctcattggtagaaggatttaaaaagcattggcttcctctatactcagggcagagctggagcgagcgtaccatcatcagtgtgctcaaatgaaaacaaaca

SEQ ID NO: 31953 - DNA, 1541 bp, Mus musculus
cgcctctgatggattattactctgctggcggtggcattcccagacactcccttagtcttttgctgcatagcaagttggaggcataaggcgcttaaggaggcataaagtgactttttatcctgtgcttcaaaccctacagtgtcacagtgataatgtctatgaatacttggcttgccatctataaactccgtcttaaggagggagtgatgatgtttggaaaaggtgtccgaatgcccaagtgacctttagctggcagacaagaatgtgtccaacagtcgtgtagtgaaggccacacactctatcaagtcttgagagcctatgtaaaggagcagtttgcctggagacacttcttctggtaccttacccacgagggcatcctgtacctgtgccacctctggagctcatacctgctgctctgtgctgcagccatcccgagactggcagggtgaatgaagacctacaggagtaacaagagaggttggggtgattagagatgcctacagaagaagcactgtgtccccaggacaacaagaaagaaagaaaaaggaaaaaaagtgttgccagggcgcgtgcggttgagtcggggttcgcggcggccggtctctcgttctcatcgcagacacttctactgcaaacatggtcaacgtaccaaaaacccgaaggactttctgtaagaaatgtggcaagcatcagcctcacaaagtgacccagtataagaagggcaaggattccctgtatgcccaaggaaagcggcgctacggtcgcaagcagagtggctacggtgggcagacaaagccaatctttcgaaagaaggccaaaaccacaaagaagattgtgctcaggcttgagtgtgttgagcccaactgcagatccaagaggatgctggccattaagagatgcaagcattttgaactgggaggcgacaagaagaggaagggccaagtgatccagttctaaaacttgtgttctctgagaggaaaatactgaagcagtagagaaatgacctgctagagaataaagatactgttaatgataagccaaggtgcatccctgagaagttataccatccaatagatctggtaaaaggttcactgcagaaggggagaggagtgaggccctgaggaagggatagaggcagtgagagccacgtagacaatcgggaagcagaactgtgaacagagaaaagaaaaaagatggggcatgcacacacagagagaatgccagaaacagagagagacacaggagggcagagaaagagatctgggatgactggttggggggctttcatcactgaaatcacagggaatggggaacctaatagcagtgatgactaaatggttgctagatccttgagggcaatcagcagaactgcctgtgtgctaacaggtacactcgtacactctacatatacaatacattagtgctgctttatataaaggcacaaaacttgatctccttattttccatttgcttatttgtttattacattttgcagtactagacatgacactcagtcttgtttgtgttaggcaataaatctg

SEQ ID NO: 31954 - DNA, 1677 bp, Mus musculus
tgagaactccgaccgagtaattattaaggttttgtcagtgttttaaatttatatgatctaaattttaccctttttaattttcattaagcctgtagttaaatgactcttatctcagtttattaaaatccttttctttttatttaaagattcagaatggatagtgtagaagaacctcagaaaaaagtcttcaaggctcggaaaacaatgagagcgagcgatcgccagcagctcgatgctgtgcacagagtcaagggggagctgctgagagccgacgggaagctgctgaacgggagccatgagaatggagacttggatcccacttcacccttggaaaacacagattgtattcaagatcgagaagaagtgaatggtattgatgggatttgttttcagtcagaagaaagtacaacggaatggaaagagaccccttgtatgcccaatgttgctgtaaaaaacaaacaagaagatttgaatagtgaagctttgtcccccagtataacttgtgatctttcttctagagtaaccactgaaccaggttctggtagtccagcctctgataacccaggctgtggtaccccagtctctgataacccagcctccgataacccagcctctgacaacccagcctctgacaacccagactctggtgatctggctgcaggagagctggccactacagtacaggctactggtgactctgcctgtgaggagcctccctccagtgatccctcttccagtgatcccacttccagtgagccctcttccagtgagcccacctgtagtgagcccatctctggagatcctgtttctgaagaagccgcctctcatgatcttgtctctggtgattccacttgtagcgagccagtttctggtgagccggtgtctcatgaagcagcttcgagtgagccagctacaagtgagccagcttcagatgaaccggtcgcaagggtcgtggcggcctgcgaactggctcctggggagtcagccttggatgattgtgccccctccggtgattcacagtctgatgagccaccttctagtgaggactcccttcctaggtctgtctgcagcggactggcttctggtgagctgactcctggggagctctctgtggaaccagccaccgacactgttaaaccaagctcatcggcagtttgtgaagcaggtcctgaccctgacaagacagagccgagtagcaataacagtgatgattgtccaggcaagagtgaagacgacgaacacttagaccaaattcaaagtaaagactcctgtgatgagggaaataaagtgaacagtaatgtcgtcgagaaggaagaacctctcgaaacacacagtgcaattatttgttctgatctacctccagaaaacacaacgaagatagcggaggatcccatcgctgagcctgctctcgaggaagaggccatctccagcagcatggaagttgaccaaagcgaaaaggatgagcataaaagtcctgcagaacctgtagccgctgtcagtgaggaccccgccgaggaggacaaggaggatactgtcgtagacaacacggactccatggaaacagatgagatcattccgattttggaaaaactcgcacccaccgaggatgaactcagttgcttttcaaaagcttctctccttccagtcgaaacaagtcaagatttggaggataaaatg

SEQ ID NO: 31955 - DNA, 1104 bp, Mus musculus
ctctacttggctatgttaactacctcttggagtactgtcactgctctaaaggttgaatgacttgggaatggcgcagtcagaatgaatgactgtctttcagcagttttcgcagaaggaggaggattaaataattgagaatgtgcatagctagtagatctctggggcatagtgatggcggttacatgttaaagtattcccatgtgctgtggaattcagtatagcaaagctatagacagctctctgtcttgatgttaaaatgtttcaaggaaagaatgctgtcttcagtgtacattgctaagcagtgggaagttctgtttgtcatgctgaaatcctttattccatctttaaagctgagcgttgtatgcctgctgagttcttgtgatcttgggagtgactaggatgaccgacagagtgtggtcttggctgactgtagtgtgaagcctataacttacacagcagactcagcagtgctgcttgctttgttgtttttctcagatgagttttctagacgaaaacgttctaagtcagaagacatggacagtgtagagtccaaacgccggcgatatatggatgaagaatacgaggctgagtttcaagtaaagatcacagctaaaggtgacatcaaccagaagcttcaaaaggtagcacacatttcatgtcaaatgtgtcaagaatgtcacaagctgcacgcttggagattttcagcatgatcctattattctgtgtttaccttgacataatctagtcagcttgaagacagtgacaagctatgaaatctatgataaattttattcctctatttggctacaatagttttattttaaaacatggtagtaaatattaaaatagaaggaagctatgacatttctctattattattaaaaaattaaggtttttgaacatttctttttctatatgaacactattatacaatgcagaagaaacaaactttatttagtagactttaatttctataatattaagttggtacaatctaaaaccctttttcatgttagtttaaggcatgatagagacaagacttcggatggattaggaaaagtgaatgttcagagtaaagatttttttgaaacttccctgtatatg

SEQ ID NO: 31956 - DNA, 1105 bp, Mus musculus
aggactttataggctttcctgcctgtttggaagctgacattcagaggttgagtagccaacccaaggctgtgtgtgctgtctgcgagcccacactccccagtgcttatagctatgtattcactaaggtatcttctgaaattgttctgtaattgctagaaaccaatccatctcttcttctgttaggagcccccacgccctctgcatccagcgcccttaccagaagccccacagccccagcgtctgcccccggaagctgccagcacttctctgcctcagaaaccacacttgaagttagcacgagttcagagtcagaatggcattgttctgtcgtggagcgtcctggaagtggaccgaagctgtgctactgttgacagctaccatctctatgcttaccacgaggagcccagtgccaccgtgccctcacagtggaagaagatcggggaagtcaaggccctgcccttgcccatggcttgcactctcacgcagtttgtgtctggcagcaagtactactttgcagtgcgcgccaaggacatttatggccgctttgggcctttctgtgacccacagtccacggacgtgatctcttcctcccagaacagttagaccttggagtcgtttagcttctacttttgaaagtttcacatcttgggcttgtttttaatcttgtgcatgaaatccactgtaaaaatccaccttgtgcaagatctcccggacatgtgactgtatacactacgtttgtttataaccggaagcaaaataaattcagcccataaagcaagccttccctgaacaattcaaacttcggggttttgaaatgtatatttattccttgctttttggttttgagttttgaaactggggaatatgtatgggtgtttgtgtgttttcttcttttgttttgaatttttaaatttctagttgtgtgtgtatcacagtgcgatctcctgttttcctctcaaatttacctctcttccagaaggaagtatattgctgagcgaatctgaggtgcagagcaggtgtgattctgcctccagaggaggctagaaggtcaaagaatctaaataaaacccgaaggaaggaaggaaggaaggaaggaaggaaggaa

SEQ ID NO: 31957 - DNA, 2856 bp, Mus musculus
caggaggtcgttcctgctttagtctgaacggtttcggtggtgccaagtggactctgatttcatcagctctgggtagagcctaaacgctatcctctgggtcattccacactgcaggtagatctgcttgctttactagttcttattccttcaaaatgttagcagactcaggctcagccttgcatttccaaggcatggcagctgcagggaatcgaatcaggcaggtgttttcgagacctgaggagagggccaagtgtttagggatgagtgaggcctctggagtctgaaggcactggtgagctgtcttcccttacggtattttacgtccttgcaaagtctacctttgcaagctgcaccagccgttttgttcacttgtcctggtattaaaagcaggagctccgttccctgtgtgcatttgcctctatgatggcttggcttacagaaggaatcgttgagttataaagaaattgtctttgctgacttcacggggtggtgttctgtcatcttcggcgtgaactttggttaatgaaggaagcctgcagctggcaggtgtaattgctcctgtcactctgagaaagaggagagcacgcgagacccacttcccacaagttgagcttggggagcagtcatgcagctaggacctcacgggcatgggaaacggttgcccaggtcactgcaaagggtttggaaaggaagaaatgatttctaactgtacatgagcacctctgtaccaggagtgtttctgtcatgtgggtacagtgttggtcttcttttcagcatcattcctgtctctaatagaaagtgcatattcaaaatggtcttcaccagtgggtctgctcactcgctactgaaagtctctctagatgaatatgtttgtttatagtcagtaattattttatatttactagttcttttttaaaaagttttcctagtgttaatataatcatgtgaagaaagcccaatggaattcatattattttattgttttggcttttacttgggtgtttttttgtcaaaggaaaaaaaaaaaatcccaaatagtggctctagatgtagatttactgtagaaagtaattacggaaacctgtttattccagattggaaagaaggtatagacagaaacgagttgggaagaggaaatgcacttgtggatcggctcctcagctcaccgagcaggacgcgtgcctcgggcagcagtggtgctggcttcccggagtgtgcgccgcttacacgaggcagaatgtgggtgctgaggggccttggctttttctttggctgtctgtggggagagtgggggacagtttccaccctgggatctcttctcaaagtgttataaagaagctccattgtcccattttgggggattcaagtttgctacattttttagcctgacaatactggtaagtgttgtcttagtgggagtcctggaaacttctggaatctgtagatgaagcgacagatgcttctcgagtaactagcagtgacagctgtctgtcactccctcatttgcactttgtctgagtacttttcaccctgttttaagtgtgagtaagcctctttatgttctggcgaatggcatacagaagcagcttgttgtagcagttcactttacacggtggctctgtccctggctccaggctccagtccatccttctacatctgcagagtgctttctgtactgtgtgatgcagtatgactttatgaaaggaacagagctttcttccttggaaatacctgttgggatagcatttgcctcacagagcagtgttccccccccccccacctatgccagataaaggatacttttgcaagcgtgaggcatctcttcagagctctcttccagtgttggacaggtgttctgggggcttgctccaatcgctttaaatatcctcccagttgccacttagtgtgacatggcagggatgcccatttcttccctggtgtctcccagtactgtctgatttagaatgctctgtgtggcatcctctcttgacaggctgtgatttcaccccgtaggtaccacaaagaaagcctttcaagtgttctcctgactccgtaggccatttccgtatcctcaatatggtcaaattttcccacttcccagtgattgggtggcctggttggctctcatggaactacacatgtccttgtgctataggcaataactgtgtaatcatgtgtgagtctgtcttccttaatcattttcagggcaaatggctttaaaaaaatatttaagggacacataaagattagagcaattatgaggggtttgttggagcaggagactaatttgtaaaactcatcgccttgagtcagcagagagggaggaggtgaagtcactgctcccatctgccaatgactgtcatgtttgagcttttgttttgtgttttctatgttagccttactctgaatacctacctatcatttaaatatttaaatgtattttctctcccttcttctttttgtaaataagggaacaaagcaatcaaacaccttctgggggatcctagcttgaggattttatcaaccatttcaaatgtaaatgtgaaaatcagtccctgtaggaaactcgcatccgaatttctgtttgttgcagttgaaaatgtaaataagatgctgtaagaccctccttaaggtctaatgctaactgggcagtagcaggttggttgccctatttttattaggttttgaaggttttcattttctttctttcctaaatgtacagtagaatggtgtccgtgtgtaagtgtcgactgtagtggggtttgtccagcaagcctgaactttatactttgaaataaatgactgagtttttaacattctgagtaccctgactcattccaagagttctcagtcctt

SEQ ID NO: 31958 - DNA, 1239 bp, Mus musculus
ttgcttaactccccgttttcgctgccctccctccgttccttccttattaggctggtatggatcttggaatatctacagctgaccttaggctccgggcaatcttgtatcggctaccctagtgctgggattgcagactcgaaccacccagttaactacatcctggcagccaatcccaacaagtttgaggatgcctgtgaactatgtaaattaggactagaaatttgagcttttgattgggagacatctggatgggcgggggctctgcttccgcgagctgattgggtacggtacctgcctgtcacgggcggcagcggctgcagtttggcgaggcagttccggggtggcgcgcgtcgtcccggaactgagcgagccggtgttggagttccaggcgcggggtcgagcatgtccgggcgaggcaagcagggcggtaaggtgcgcgccaaggccaagtcgcgctcgtcgcgcgcgggcctgcagttccccgtgggccgcgttcaccggctgctgcggaagggcaactacgcggagcgcgtgggcgcgggagcgcccgtgtacctggcggcggtgctggagtacctgacggccgagatcctggagctggcgggcaacgcggcgagggacaacaagaagacgcgcatcatccctcgtcacctgcagctggccatccgcaacgacgaggagctcaacaagctgctgggccgtgtgaccatcgcgcagggcggcgtcctgcccaatatccaggccgtgctgctgcccaagaagacggagagccagaaggtgaagagcaagtgaacccgacagacgggtgcagagcccgcccgccacagtccgcagccaataaagtcggtgaaaagcgagtaatctagagagctgtgtagtcgcgggaccgagggggtgttgggtggggacgagttccaactttgagcgtgacgcaggccacctgtgtggccatgtgcgagccggaggaacccagcgggtggattgggagagccccgtcgcatcaccgtgggcaggagaagcggacctagtgcccagaggctactctggaattggctttgcctaactccccagtcttagggaaaagtggtagggaaggtgttgcgagctgtgaacaagaagttgcctcgcttgtcatacataggaaggttgagctatatgtaccctagccatttggaaaagacaggaacttgggatccttggtgggtgctagttatttatggtagtatttaagctaataga

SEQ ID NO: 31959 - DNA, 1267 bp, Mus musculus
ccatcgagaagaaagccacagcgaccatcagtgccaagccccagatcaccaatcccaaggcagaggtcacacggtttgtgcccactgcactgagggtacgccgagagaataagggggctactgctgttccccaaagaaggtcagaggatgactctgctgtgcctgttgccaaagcagccccgagatctggtccttcagttgctgtctcagtacaaactaaggacgatgtttatgaagcctttatgaaagagatggaagggctgctgtgacagggcctcctgccaggacaggcttctgttcagagtactggtttgtggaacaagaggctcttattacagtgaagagcaatgtccactgtcaggtgttttccaagtccagttccaggagcctcctcatgtttgcctgctgggatccctgcacaaggtgtttctttacaatagaccaggatgtgaagcactgctgctaacccctgctccctgtgacatcaccatctcctccctctcttcctctctccattttgggaattctgtcagcgaggtcttagttacttgtttttgactcatgtgccgtgggcactagagtagagaattctggaggaaaaaagtttatttcatcttgacttttgtgtttgagttatttttaatattttcctgtaaatattttgtaatattttccttgtagtgaaatggattacagtatcatttcctaattcaaaacaggatatgtgggaagaaaatatacaattctgggattaaagttacttcccacaagctaaactcttttgagtgtttcatggacaaataaaatgttccataccaagataccttctgtgtttgtgtaatgtgtaaacagttcatctggctggtgggcagaaacaaacaagtttgtagtttggttctcaggaactgccatttctcatgcagaatgagaatggattttattagaatgtaaaaggtaactttgaaatctacagggataaagaggaagaattccttcaagattatattgacttcccagaacgtcagaggggtgcacaatgtctccactttgactgctaggatgggggactccagaggacacagagctgtgggggtggtggtgtgtgaaagttcccaaggctcatatacgtggacgtggttttccccagttggtggcactgttggggaagcttgagagcctggctttgttggaagaagtacatcctggaggcaggccttgagagttggaaagactccttctccagttctggtctgtgcctgctgccgtg

SEQ ID NO: 31960 - DNA, 1118 bp, Mus musculus
gaccctgtcttgacatactaattattttactatttaccaagatgtaactgctttgttaaggctactgagtgactgacagtgcttgcgttgctgggtgtctttgcatgtgtaggtaggtgttcagttttggcagagtgctcaagcaggagcatttggtatcacgtgtgactctctgaagaatcttctataatctctgttggtttgctcttggtttattatttagccaaaattcaaattttccctatctagcatagtatttttttatttaactatattcctaccccctcccccttttaaacaagttttcctgttaagtagttggtaacaatataactgggtagaaaaaaatacttaaaagtgcatcattttcactgaagtttaaacattactgagaagaattctcagctgtttctagaggtttaaacatgtgattagaaaccaaggagaaatttgagtttcttcttagactcttgaggcaaaggaaggtaaaatgtccggagtgcccgcttctttcttagtagtcttcctcgctcttgttttccaaagaacaaaaaacagcgcatgatggtccgggctgcagttttgaagatgaaagaccccaaacaaattatccgggacatggagaaattggatgaaatgggtaagagtattggaaagcggcagacttagcaaaggctgtcatggtctgctgtgtatagaggcagcacagcctaggaaatggaaaaccctgatggctgccatcggtacggcactttgttttaatgctatggaaagaaagatagactgttgcaagctagagacctcataatctagaagagggcaccatcatttagtaggagctaattactgtaactagctaacaaaaccttgtctggccaactcactttataatttttccgatttaatgatattttcactttacatttatgttagtggaataagaaaagatatacaccattgcatacactagcaagattttatcgaaaggacccagatgtagctgtctcttgtgagaccatgccagggcctagcaaacacagaagtggatgctcacagtcagctattggatggatcacagggctcccaatggaggagctagagaaagtacccaaggagct

SEQ ID NO: 31961 - DNA, 1175 bp, Mus musculus
agtatataaaaaggtgttagcagaaaatgtccttttttcttgggaaagaattttgttatgtagccttgggactcattatgtgccctggctgaccttgacctcatgacagtcctcttgaccgagcctcacaagtactgaggttagaagcatgcaccaccatactggctgaaaatgtactatcaaatgaaatttcatgtcttaacctgaaatcagtgtctctgttggatgctgtaggggggaagccttggagcctcatttaaaaatttgtggcaacttagtttctctcctcaccaagtcctcacaattgaatttacaagtagattttgttcattgtttcttgaaatagtaactatttttatcgttgatgtaacaaaataccagccgatagcaacttggttagaaggataccttcagccttaggttcatacatgtgaacacttgctccccagctgtagcacatttggggtaggggttacaggcatggccttgctgtaggaagtgcatcacaaggcgggggtgggggtggggtggggggcgttgagagtttagaacctcgccttacttcctattccctctttcttgtttgtgattgaagatatttctaggttcctcttccagccacctgctgtcttgcttcctctgctgttatgaacttcctaaaataaactatcttctttagttgccttggtcatggtattttattaaagcaacaaaaaagttaactattcacaacttaagggaggacaggttgtgtttgggctctcagtttgaagaggtatgatccttcctggtggagaaggcatggctgcaggagagggaggcagctggtaacattgtgttccaagtgagaaaacagatgaatggggtatttgccttaattttccccctccctaccccccctttttttcctttaccaggattctggctcatgagaggacaccatcaaccttcacagtggctcttctctccagcaccctcaaagacacaccccgagctgtgtctcctaggtgacactaagtctgatcaggttgacaatgatgggtaatgatgacattaggcatgggtaagactaggaaatccagtcctgcatcttagccatcctgttacctcttcagagaatgtcatctggctgataaccctctttctttaaagtatacatgatataacgtgccagc

SEQ ID NO: 31962 - DNA, 1482 bp, Mus musculus
ttgtctgcgccatgtttattcttcaggacagtaatggaagctccgagttacaagagatcatgcggagacggcaggagaagatcagcgccgctgcgagcgactcgggagtggagtctttcgatgaagggagcagccactgagtccatgaacttccttattcttggtgtggtcattgaacagtgatggacatgctttgttttaagaagccttgaagggaatgtcaaagctgtcgtcttggtatatgtaatttatcgccatataaagaaacagtatatgcctgagtaagcagaggacccgctgcttctgtgcacattagtttgattaaaactgagaagcgggtaggtgagatggctcagcaagtaaaggtgcttgctgccaagcccaatgacccaagttcgagtccctgggtctacatggtaggagagagctggcttctgcaagttgtcctctgatcaccacacataaataaataacaaatgtaatttacaaacttttaaaagaaaatgtaatttaaaaagccagacgttctagactgttctgggcttgggaaatattttttttcactttcctaagatgtactttcctttgctacattaattatcgcagccttgttcgatgatctaagtggggatatttgacaatggcagatttattcattgcaacaaggaaagacacagccattgatgaaaaaaaagaaagtctcagctttcagtgactgggatacctgttgtccagggaggaggctcagttagactaccctctgcttacttgaggtctgacatgcccaatgagagtgtatttagctttatttaaagttcttaatgccaacagttttaaaaatcacatttaaatgaactgtacaaggtagccagaccttgaatgtatgaatagactatataatatgtccccgagaaactttgttactctcagctctgttgattgcgaaatcttgcatagattatgctttgatttagtttcttttctgcttattgtgtaaaatgtaattaaacatgagaaagcacgagtcaagagtaaggcatatgcactcacaatcaatcaaagtagcccgtgtcggtgtttattacagtattttgcttaatgaaggcctcagttataaatattgatataaataagtagtcaaagaatatcgggccatcttatgtgttttatctgtgtaacagggacacttaatttacatgtactttaaccccatgaaagagtctagatagagagaagacacatagctaaccttcaacaaatgttatttttggaaacacaggttttgtcatgaaacgtaatgttatttcacatatataaaaaaaagatgttatgtaagaatgttgtatattttaacataagtccatttagagagattatctagattcattaatttttcatagtgcctttttcacaaaagtcagctggagagagtctgcaataaacagtatttgctgtatattaataaatagcttctatctcatc

SEQ ID NO: 31963 - DNA, 1243 bp, Mus musculus
aggctgagaagtgatattgtcccttggaaatctgcttcttgtttccatcctgctatgaggataactttctatgtctgtgatgtgtgtgtcaagaaaacattatgttgtgtgtatttgtgtattttcaacatttgctgagatctgaggggaatctagggttttgccaaaaacccttcccttttttaatactttttgtttctgatttgttttgctttttgagacagattctcacatagcactgcttggcctcaaacttactatgcagccaaaggtggccacgaactcttgatcttcctacctctgcctcccgtgtaatgggattataggcatgtaccacaccacacctggcttctagaccattcttgtaagccatctggctggtgtcagcactgtgggactttactcagaattttctccgggaacttaggcacatgtctgagctctgtggagtttgtattgcctcatccagggatctgtttataaggctttctgtctgacaaccacagggactgactctgctctcctcaaagaagaggagagaactccagattcctctacatgtgagtccatcactggtggtccctgtttctgttgtccttatttatcaacttttctgctttggcttggttcttcaacatggacttcctacaaaagacattccaagctttctggcttctatcgtcctttcatttcgtttgggagatagccagataccaactccctccagagctttccgaactgtaggagagaaggcagctggcttcctggggccagcttgactgcccacttaggttttactaccagcttctcagtagctactgtgttgaagccacttctgctgtatcctcttcttgttcttcctcctcctcctcctctctctccttcctctcctcctccttgagagccagagtcttaccaggtagtctctcggatgacctcacatttctgggcatcttcttgccttagtcttaaaagtgtggtgactgcaggcacttgtcacagtgctaagaggaaatttcttcacctttccttatttgaagattatctttatgtgtgtgtgtgtgtgtgtgtgtgtgtgtgcgtgtgtccacacgcacacatgtcacatgtgtaggcatgcctctggaggcctaaagagccagctagagtgattatgagctgccgggtatggatgctgagctgaacttgggtctcctggaagagaagaaagctctcttagcactggacgacctctttagccctg

SEQ ID NO: 31964 - DNA, 1145 bp, Mus musculus
acgtttacccactgagctatctcaccagttcttttttagctatgtcttgtagtcggcttgcttgggatgcatggtgtaggtgttcagggagggaagtaagtaccagtcgtgggaaaagttattagttgtttttgttggtggtaacaaatgtgatcactgttgttttctgacattttctaaagatgtgtgctgcttctaattcctctatgactagttagcctgtctagcctttgctcagctcagctactgagcagagcaggaggcaggagcattattctgtgacttactgtccttgagcccctttcagggttacaatgctgtagggtgggggcttcaggatttctattcttgttcttcactctgctgccaagttcagagtcctgtcagttccaccttgcccttcatctgcctcctgcttgggtttgggagtttacagaatataaatcgttaaaaccctttccccccaaataggacaagtgtcttaattgaggtcaggctaacacctagagtgacagaatcttcccccagtgccccgttggcacacagagagaactcacacagccaaagaatggtgtgaaactgtgtccccaaagtgtgtccactgggataaggcatatgcccagttggacgcccagggcagcagctctcttgccaacttctggtgttctgtttggtctcaggccagatggcaacatagcagcaggtggaccatcaacccaggcctttcttctgcctcctcagggctaggataaaatgcccagctgtctcttcccttgtaggagtgagcctgtgcaatcactaattgcccttactgttacttaatatttacatagctttgttgacatttgtaactgtagtaccactgatatggatgtatttggattataaaggctttgagttgcttggttagagtaagtggaacccatttaccagcaagtcggcaagatgaaagggcttcctgagtgggcatggaggaggtggacagacctgtattagactgaaccagtagactgtgatggttagacacacccttactgagcctgtatgaattaaatagtctctggacctgttatcatgcacctgtttcctgacagtcatgagacaggagcacacaaaaggcgctcccttgagtctaaatgtatccc

SEQ ID NO: 31965 - DNA, 1219 bp, Mus musculus
ggttatctgtgggcctaatggaacagtgtttccggtgttggaacacacgtgcagtcattaaacactggactctttctgattgctctagcagttatatttggtaacattgtaattgttgttagtattttctttagagattaggaagttgaaaacggtttaggaaaaagaataaggatgtgaggggaaataactgtaagtctgtctgtctctttgaaagtactgtgtgtgtgtgtgtgtgtgtgtttctttgtttttgtttttcaagtcagggttactttgtttagtcctagctgtcctagaatgagctatgtagatcaggctggccatgaactcagaactcagagatcctcctcctgcctctccagtgcactaccaccttcacccagctacttttaatatatattattccagttctctctaatggtcctgttgttcacaggtaacggcgatgatacaatatagaatgtgatggttgtatgtgcctcaccttaacgtttttagttacgtgtccttatttatgcatatgtgtgtgattggagataagaggacagctttctggaattgtttttctcctaccacatgcattccaggactggcgctcaagtcaccaggctgcaggaagcacttacccaccatgccatctcacctgactgcttgtttcaagacagtttatttatgtagccctgactgtcttggaacttgctctacaggctagaccaggctggcctggaactcagggagccacctgcctctgcaccaggctggcctggaactcagggagccacctgcctctgcaccaggctggcctggaactcagggagccacgtgcctctgcttcccaagtgctgggataaaaggcgtacatcactgctctccagcttgacttttaaaatttaaaagaaaatgtactcgtgatgctagagaaaacacttaacctgtactgtgagcaaaggtctgtcatatttaaaatctgtcacatttaaaatctgctgtttcctttggaggctggaggaggggtttcgatgccttgaacttcagtaagtggcttctgagagcctgtgcagactgcacttgactgttcagtcctacgtgcaaagttaagttctccactgcgttgccatgcactgttctgtcccctgtaacagtgtgctcagctgtgtgcgggctcacatgtgaggaatctccagccccgttctgatgtgttttaaaaacgttatta

SEQ ID NO: 31966 - DNA, 1197 bp, Mus musculus
aataagacctatacatcaaacttatagtttaaggttatgttgacagctaatatttctatgaaattataccctaatacaaagataaaatttaaagggaaaattaaggttgaacaatatagaattacagagagtattaaggtcgaacatacagttcatgtgaagttcactttatccaggcctcttctgtttgactctaggcagtccacttgccaaaagaaaaccagatatgggtttgggatgtcttgctgggagggtttcttgggtcaaagggtcagtgatgattttagtttcttgccgagcgtctctgtgtgtgtgtgtaatttcagagaaaaaaaaaaaaccctaaagctcatttgagtcagaaaagaatggttttgacagatttctctgccatttgaggaccagtcaaaggaaaaacattttgagggcatgtctcaaaataactagcagaaggttctgttggttatttgttaacctgcttctactatgttggttatttgttaacctgcttctactatttcaagtcttacaatatctgtaaggagcaagattaatttcatgtcagtcctcagggtccatctttcccagtctacagttgaaggagagttgatctgagtatataaatctatgtatgtaagctgtggagtaggcagacctggatttcaatcctaatgtcactattggctttggcaaaaagaaaattctgaataacattttcccaattttctaaagcggtgattcattttaagggttagagatggtgtaaagtaaaatttgtagctcctggcagagattgtcaattaacaatcctagttttctataccatctatcaaaaccagctatttcgaacactggacatgctcaagtggatgtcagtctgttgggaatgttggatggaggaagattctggatgaaggcagtagaccgaacttaatcataaaacccatcactgcccccttttagtctccatcttggcctgctaattcacggtctcttgaatgagcttttgcttgcctcgcaaagcaggtaggcccagctatttaagccaagttttgtttaatagtctgccttggcttctttggaagtcaattgccttggaagttagaagggccagggtgtctgggggcgtagctgtgacaacggaggtattgtagaaggtaagaaaatgccaggttcagaagagaagactggcagatc

SEQ ID NO: 31967 - DNA, 1099 bp, Mus musculus
cttcctttcctttcctttcttttctttccctttctttctttctttctttctttctttctttctttctttctttctttctttctttcttccttccttccttccttccttccttcctttctttctttctctctccatctctctctctctctccctccctccctccctccctccctccctccctccctccctccctccctccctcccttctttccttccttccttcctttctccttttggtatgctgaatgacataccattcagccctcaccaaccactgtgagagtgaaagagtagtaaactcaatgctccaaggtatgctaatcattaaacagatagcaacattccttcctccacccaccggcttcctgggttcaaagaatattcattcaaagaaagtcaccctgacccaccctgaccattgctggaacctgcaatgcaaatgtgctattgttaggggctcttagaaactgtcttgagagttaacaattaccaggtattccttgtgacacccgtgactttgtacttccttgtgattcttatctggtatttttggtattttccaacaacgcccttcccacctccttgagttgtgttttttttcctttagaaaccccctttctcagctactcagggcgccatagtcctctacccctgcgtggtgtatgaccgtgggcccgagagcgctcttgaataaaaatcctcttgcaatttgcagcaagaacgtttctcgttggtgattttggggtgtcgcctctcctgagtcagaacgtgggggagccctcacgttgtgggtctttcaagagcaactctgagcagcattgcagagtctagtgtttaaagatcaacactgataacgtgtttatttagtaaatgagcaaatagacaaattcaattgtatcaacaaaacccactattagtctgacctcttgccatgtaagtgccaacaaattttgcagacaccaaaagtcccttctgatagttggtaccagataatctcagacttctgttactctgtttaaaagaaaatccttgtgctctaaactgaccatagctcagtgggtaaattgtttgctgcatatgcatgaggacctaagtatag

SEQ ID NO: 31968 - DNA, 1193 bp, Mus musculus
tttgctggccatccactaaacgccagtcacttatctgtcaccaggatataaatgttgttagcataaccactctattagggaagtcattactgtttgtgagttgtgacggtgtatgccgggaggggggtgggaaggagagcgacagaatggttgctactgggtaggcagttagatgtgagatgattatggaaaagtgtgtctgtagcttagcaatgagaaggttacaactctacaacagcatcctacaagggacggactcggcggctcccaacactgggtagcaacgggacgccgcgcgcttgacgtcgtcagagcagcatgggttcggtctccgagctcgcgcctgcgcacactgcttctcgcgctgctgctgggaactaccgccttcccgccagtcgtcacttccggctgacgcgacgcgtcgggcgacgtcacgtcctgccgctaccggtagggaccgtgagtggcggcaggccggctctccggcgctcccctcccctcctccctccctccctgtccctcccttggcggccgcgagtcgcggggactctggagccggcctccttcggcgtgagtgcgggggcctcaagcagcctgaggcgccgcggcagagaaggaggacgaccgcgaccctcggtccccgctccgcgtcaccgcgctcgccgccgccatggccatgaggcagacgccgctcacttgctcgggccacacgcggcccgtggtggatttggccttcagcggcatcacgccttacggctactttctgatcagcgcttgcaaaggtgagctgagcccgcgacggccgcggctcccgagtgccgacgggtgggtgggtcgtggctgccagcgacagccatcgcgctgctgggactagagggtcgcccctggccgggctttatgcgtccctcctccccaccgttgttagtgctccccaacacctcgcctttctacccacacaactacattgtgtttgccaaggatttacgggaagaagaaattaggccaggccgagaggagtgccctttatgtcctctcactcattgtttcatcctttgtggtgtgagcctcatttttttttttccccgacgaaagtgtacgttaggtttatgtggtccaaagtaaaaagcggctatctagatcgttttgacaccgcatgtcactggcatccagcccacggtttttcagaagttttt

SEQ ID NO: 31969 - DNA, 1099 bp, Mus musculus
aacagctgctgatagcagtttcatgtgttggggactgaaagcctgagccccagccgaaccctgaacagttataaaaacatttagcatccctctgtactgtagtaattcctactgtaaaatatcactctagcttgatgcttttatttacttttttcagcgttgagccttcaaactggcctttatatgctaggcaaatgcctgtccctgactttttgattttttaagggggccctgagttctctttccttagcctcttgagtgctggtatgcagacataggccactgcttggcctgcatgacccttttgtatttactaaaataatgcatgtttgtagaaaaaatagagtgaaattttcaaaagaaaaataatctggcattgtcactgctctgagtgggtgggacttgggagaacggagctgataaaggaggtggactaaagtttcatgcagtcgccaactttattcagaccatcagacagtttataaactctgaggacaaaggtcatgtgagtaaagttatctttgagttcaaactgtagagtcacacggatagttaaacatgtaattgcataatagcaacaagcagtaatgaataatctgaagtaaagacatcgctatccactgcacctgggaggtcaacagcaacacattccaagaacaattctatgttttaagaaaactgaattcatgaggctagttttcttggagagttctcacaaaactctttcctggactgtgtgtctataaacctgaccccagagagtggctaaggcaaggaggatgttgagttgaagatctggactccatactgattctgtctccagccaagacactgatgtccagaaagtgtctcctgttcagaaaatggagttcccgctactccgtgtctccctgagatgacatccacttgggtctaccaatgtagcaatcttttgaacttttttgctcgttagtggtttttttttcctttgaaatccatttatacttagctgaatctatgtttactgtgcattgggtttcaggattcaggaataattttaatgtggctagacagttatttatacagttttaaattttttgtagacatctatgtttttatg

SEQ ID NO: 31970 - DNA, 1812 bp, Mus musculus
gaagcagtgtttaatggttaaggttttgaactgcatggccttatactagtatttgattactacaggacccaaaaaagcgtgatttaatgaaatgctgattgggtagttggagtcagtgaaagcttatcctgaagggagaggggtggggttaaacaattggtgaaatggcttgagctctgcttgggtgtttggagtcctgggataaggccatgtttagtagctgtctgttctctcctcctcacctcagcatatttgaaaagaccttgtcatttcttccttgtacagaaatgtagattttcttcttctctttattaaattgactatgattttatcttttaaatgcagaagaaattgcttcagagaattcagattccatctattcatcaactcctgaagttaaggcctgagcatcagacgtgtgctgccgaaaccatatgttcatggactaaacaagcagagacaagcatccgccttcagagttactgtctgcctgaggcaaagagggcagaaaatattggggcatatgagttagctccagtgcacgaacagctactcagtgttgcccgtgagtgaaaatggctgagtgtctgaggtgcaggcaggaggattgtgctcacatagtgccatagcctgctgtttggaatgaaaagccaacttacaatctccattttacacctaaatttcttttagctgtttatgttatgaagaagaaaaatatattggcctatttttctgactttcccttaaagaagaatgcctttttgtccttgcctagtgatgaagaggaggaaatacatgataaagtaaccggtttgatctctttcattgtacaaggactgcttcagaacagctcatatttttagttatctaaataaaatgcctctaaaataataatttttctctttttttggaaattctgatacatttgaatactaaaactaactattcaaagttttctatatcatacacagccagccagagcaaagacagtttggttatagagtctgaactaaacatttcctaaatttgaaattgaattatttaaacttgaaattttcatatcttttgttgtgtgttcatttatttccttctggatggatacaattgcttctcttgtctctttaaacatgcatgttagttactaaaacagaaaaacacttaggaagagcaagtaaacaagttgaaatctcagttctgaaaatattctgaaaaactgctgtacgtagtctaacatctgctcggttgtacaaataaccacatgatttaatgaaactgggttaatcattaattttcagtatttatgatataccaaactttctcatatttaaacttgggtcattcaaaaagtcaacctttaataaattggataataaatttgtagtttatttacttattttacaatgtgaagagattaagttagtaatttggaaatacagatgaacagcttgtattaatttgctttctggtaatttatcttctgagtggcctttagtactttgatcagaaaagtctcgactagtttgtgactagaagttggcggcactacaggcggttcctgggagagccagggaagcccgtcacaggcattgatgagcctcaggcagtggtgttcccctgtccatgtttaacatgcttggttttctgctctgtagcagtattgttcatgtatcaagattagactgagagtctgaccctaaataaaattgagtgcatcttttgtaatggaagtcgcttggattcctgaagttgataaattaagggcatttcttattttgtgccattgctttcctattgctgcagcacgtttgtagc

SEQ ID NO: 31971 - DNA, 1159 bp, Mus musculus
gtaagcatttaaaaatggtctgggagacttctggagctggggaatgctcaagtcacaggcctgacctggaaagacagggaacaggtagggtgatgacctggctgggctccaagcccaggagctggagaaaagtttaagtggtacaggaccgaagaggcgtggctttggtagggcgttgcaaaaggggcgtggctctgggcggggacttgacaggaaggaggaaggccaggcccgtgtggcgacctggagcaagggttggctttcagcggtggccacaatggctgctcactgccggggcacagagctcggtaagggccagcgggttgcgctccccttcgccaggttgggggtgggggtgcccagggcgatccccggagggcggagacctgaactgaggcagaactcggggacagccctgtcgccaggctctatgcagtcttaaccctttaagcggaagcaaggaagggttaattagatctttgcactatgtagctctgtggtcgcagtaaaccaacccgagtgaaaagcctgccgggtacttgtgtgccattcatttactgccggactcacgtagccattcccaaagttggctgtgctggtggtcatcgccgtctgctaaaaatgattttaaatgcttagacaaaatgttctttttaaaactatttttcaccttattgatactagttcagatatttctgggaaaaaaaattaaaagtctgtaattcaaacgtagcaaaaacgtgactgagccaaatgtcaatgacttaactttgcataatagattgtttgctttgtatcctggaccctcttaggtgtgtgattttgggtaaattactcactctgtgcttatataccggcatctgtaaagtagttatttattaggaagctacttctgtctgaaggtggtttggatagtgtgaggaggggatacttggagccgctggtatatttctctgcacttagtgttgaataagcaacgataatgagcgcactaagttcttttcatagggactgattttgagtggctgtgagtgatacacagggttactcttttcagaagggacttgccagtctagactttagaagtgtttagaattgcatgcttgacaggtagtctctgtaccaggttaatggcactttagtccctctctccaacaga

SEQ ID NO: 31972 - DNA, 1488 bp, Mus musculus
gacacactgtccttggaaggagtggaggctgaccacatcagaactgagcgagtctccacctcctgcaagggaagctgcatcagttatatagatcaggtgtaaattctgctgaaaggcgtactaacgcagtacggagggaagttactattgtgcaatagtgtaattactacttaatgtgtatgcttgcttaattattaattaacgaaactggctttcctcacagatttaccatcacgtgactggacgctacgcggcttatcatgatcttccgatgtcttaggtcagcagccaacccagaaaagcatcttgcaacaaattgttcaaaaaaaaatgtttttgcataattgctaaggttatgtaattttggaacagctaactgactttccccattaaaatctcccctgaaatcaactcaaaacaataaagggaaacaaaccagctgaatctaaatgtggattcagatcaggaaaggttgaaatggtcttcgttaccaggaggtctacatttattaattttgtgaagattccctctgaaaaaaactcagaataaaatgtttctagtagcctgtactgcagaaaattctgaacgtacagtgaagttaagttgcctgagacctgagatcctagggcaggcagggctgtggagggaagggtgcttgctaccaaacctggcacacctgttcagctctgagcaaccacagggtggacggggagagccggctccaaaggctggcctctgacattcacacattcgtgtcccctacctctgacacataataaatacacttaaaactgtgataaaaatgagaatgggtgctatagcaagaggatactctgcccccctgtgctgcctaccaatgtggagccctgccccgggtgtccacctgactctctgtgctatactaaacatttagtaattgttttgctaatgagattgtgatgttgttgcaagaaaatgtggatatcgctgaatttttaaatacaaaaaatctctgtgcttatttatttattttgtttattttcggcggtgccctgggggtgggtggtatgggctggaacttaaaaaatccttccagcaggaggaggtgttgctagtgttggtatacatctttaactccggagttcaggtgtagagccaggtggatcactatgggatcaaggccagcctggtctacagagaaatcctgtctcaaaaaatgaaaaaaaaaaaaattctgggagcatctcctgcctggcttgggagcacctcctgcctggcttgggaggaccttctgcctggcttggaaggacctcctgcctggcttgggagtacttcctacctggcttgggaggacctcctgcctggcttgggagtacctcctgcctggcttgggaatacttcctacctggcttgggaggacctcctgcccagcttgggagcatcactctgcctggcttggtggtctttgttgtctttatctctttaaattatttcttttaatgaagaaaa

SEQ ID NO: 31973 - DNA, 1199 bp, Mus musculus
tgggagcagctcacaaccatgtgtaattcctgggatttgacaccctcacatcagttcacataaaatataattaagtatttttgttgttgttgttattgtttttttcgagacagggtttctctgtgtagccctggctgtcctgaaactcactctgtagaccaggctggccttgaactcagaaatctgcctgtctctgtctcccaagtgctgggattaaaggcgtgcgccaccactgcccagcccagtaattttttttttttttttttttttcttaagaaaaaactgttaagagcttgatcagaagctggtttgaacagcagaaatgttcaaaatactttttgtgtgtgttgagcactaatctaatggcatttgtattatttaatcttagacttcccgtgtgtccttaaaaagacacacatgaaataatagaaaatgcagcccagtgcagaatagggcagagatgaactcaaacagacttaagaaagcagttccaggccaggtcagcaggtcacagagggaacccagtggatgctaactgaaataggacacatcatttaatctcgtagcttccagcttctggctttcctcctactctgaggcagttacccagcctgtctacagcagagctagcctctggctctgactcttcactcttaagcttgttggtgctgtgtcttttaaacatttttccaataaattgcatgagctttacaaaatacttgtagcttgttttttgttatcattactattttttgttgttgttttggttgtagagtaatagtaaaatataaaaggaagaaaaaggctcaaattagagtaacctaaacttcatcattttatctagctagtgtccataaccctgaccactgaagctcggagctgttaatcacacttatcatgactctgcttgactggtcgccatggtttgtggctgtgcgactctagctggccttgcccttgcttgtccagtctcagatttgactctctgcctctgtgtctctttttcttgagtgaaatctgcttttactcagctttcgcacattataatgagccagccttccatggcctgtcgcatcccaagtttgtcctcctatttctcaaaggtcagagatcagctgtttattttcctgtttctagagaaagttctgtgacttatgtggtctgcagcttactgtgtgtgcatatatcacctttatgta

SEQ ID NO: 31974 - DNA, 1208 bp, Mus musculus
ccagtgagcatccagtattgatagtgtagcagaagccaatggcctcgagccagaacggtgactcattgcagtgaccatttgcaagcagagctgcttggacaaaaggacattctgtgtgacatatcgcagttcagtggtgggatttttttcttttctttttccttttttaggggaggttgcaagggcagaggatagatacggaaggatggggagatgaatggagttggggtacatgatgtaaagttcaaaaaaaatcaataaaaagttaataaaaataaaaaagggtttaaggccagcctcgaaaacaaaacccaaacctgtaaatggttagagaacaattaactttatgctaatgtactgggcatttatttaaaggcgaccaagggatgctgagagcagagagctattaggatctcaacctggccagcacttttactgataatacacctctctcggttggactggttctgttctatagaggcagctgtccctactcgacatcttatatcattggcacctccaacatcttgacatctccagtataatcaagatttcactctcacaacttgatccaatggcctctctctctctctctctctctctctctctctctctctctctctctctctctctctctctctctctctcagcttccagtcaagtgcttctgccataggcctggcctgatgagcttttcttaaccaaagagggagcttccccaaccctttactcttgtcttcttcatgtctctaaagccagagccaagtatccagtgctgcccagttctgagacttggaatataatctggcagtctttttaaattatattttcataaactgatttttttattttattttttttctttccattttttattaggtatttagctcattatcataaactgatttgttgatggcttacattcccatgactttaggcatttagggattttttaaaaacaaattagcaactagatatttttcaaacattagttcatttaatgtttataattccataaaataagaaatagtgttctcattcaacacatgactaagccaaatcttaaagagccttttgcaaagcgggtaggcagactagagcctgggtgtgagacctctcccgcacaccctgtgaagctcgctgctgacctggggacctttccttccctgccctcttcccaaagcctctctgttgttctccctgccgac

SEQ ID NO: 31975 - DNA, 1157 bp, Mus musculus
tgagtaatgtgaccttaggctctagacagcttggcaataagctctcttgtagtctagaaagcacagtggctagagaggactcgtgtgactaccagacagtggggacacaaggcacccacagccttttgagctcactgcttcctaagctctctgtcttccttatgcttacttctgttttttattttcattttgggtatgaatatcatgggtgttgggcctggggttgggggtgcccaagaggccgaaagctgaggtggatgtgagtcacctcatgtggatactggaagagcagcaagcattccgctgctgagtcatctctccagcccctgatggctttagtttcaattaattcattataatagagaaataatttcatgcacagcacacatgtctttagcagatgttttttaaaagaaggaatttttttttcatttatatataaatgtctggaaattgttacaagtaggcattttcattcacaaactcttattatgatgccagacattaaaagaatatggatatgataacctgggtagcctggagcttgctatgcagaccgcactggccttgaactcacagagatccaactgcctgtattccccccgcccaagtcctggggttgcaggtgtgcgtgccttccttctctgcctttccctctgcattgcagtattttccataatcacaaagagaaggtatatccctccaaaagagaacttctcactgaataacaataatataattttacataccagtaagaactaactaactgtagtgtatgtgcctcatagccaagtgtgcacccagtcgttacatgtggtcccagtcatatctgttgaaggactttgggggttttgttgttgttgttgaaaggtcctgtccaacccaagctcccttagacctgccgcatgcctccagagtgcacaggtgccaccacagctgctggaacagtattgacgcattgctgccagtcacaagtccgtgtcagagactctgcaagagccagagatggctcagcagttcaaagtacttgctacttcccagaagacccaggttcgattcccagcaccatgttgggtggctcacaactgcgtgtaactgcaggggcagtggatttgactcttctgtcctccttgtatgtgctccggcacacacatagc

SEQ ID NO: 31976 - DNA, 1158 bp, Mus musculus
ttctatccatttgttggaacagcaatacaagcaaattaaccctggactatgtcccaccagagcacctggccatgtatgtgaagtccaggccgtagttcaggtttctcatattgccctggcagggagtgggtctctggtggcattttctctcagtctgtcatagcatcatccacacgtgcagcagaatctgcagtgagcggcctgtgccagccctcctggcagcgctgcagctgtgccctggagacatcctgcccacactcaggctgaggagccagggctgccctttggacaaagccatgattatgatgtagtctggggcggaggcttgacatttcgaaaccgttgggttggagccaggatagagcgagctgagggtgacttccttcattgcttctttggggcttttttattattattactgttcccaatagtaatgtgtgtactgtatatctaatgtgtatgtgtgatggatatgccacatgagtgtgccatgacaagagtgtgaaggccaaaggacagctttgtggatccagttctgtcctgcccctatgtccattctgaggtttgaacttgagttatcagtgagggcataggcactgctaaactgtctcactgtccctcacacacaccagactccacactgtgtgcacagaacctcccttactcagaaatttgtgcttacaagtaaatcgttttcctggaaaatgggagtgagaatctatacgccgtttctatatgttttctcagcatccactgcctcttacaatgctgggagcttttgagttcctataaactccagagtagccctggagtaacagcagcatgagctgtcaggcaggcagtcttcaggtgtccccagccggccgcacagcggcctctcacctgggctctgccttcaccctgtcttggcctttgtagtagctctgcgctttgactcgaagctcctgtggttgtgggttggcttccgtgctgggttgaggagcttcgctagagttaggaatgaccagttgtgccaccacgcccagcctcatatgtttttttaaaaaagttatttttgtgcctttaaaaaatgacttaattgataatagatcatgcagggcagggcgccttctttctgggtcaggttcactgctccctgctttcagtagcagagggtgt

SEQ ID NO: 31977 - DNA, 1320 bp, Mus musculus
gtgcctgtccgtatgttctgggttagggttttccaggccatgcctgtcacctgctgttctgcctcagtcactttgggacgtagcagtcatgtgctttgcagatgtcagaagtaatctcccgtcctcgtgtttttcagctgcactggcgtctgttgagagctcacagagctgaagctgtggacctcagtggtgtaagaagatgtacaatataccttaactctatgaaattcatagttcggatgctgctgaccacagagcatcattttatcacctttggaaaatgtttattccaaactagctttaatggcccgtacgtgcactccgtagtgtcaaggtcaccgtcctccgcagtccgcccacccgcccgcttgctgctatttgagttcagagcgtatcagtcaggtgctttctccctcatgctccatcagagcttgcttggttgcagttcccaggtctggatgcttaagtctcagtgaacttgggtctcttgcttttcagtgaggctatgctttccttcgaagcttgtttgcttccctccttttttcttcccattttggcttctgcagtacttcatttgacacttgatttgtaaaaattttatataaatatatttaaaatgtgccattttctcactgctcagtgaagtctgtcctgttttctgctctaacccctcctcagtgagactgcaccatcagcagtccctgcctcgctccgtctgcttccacacaaatgctgttgcttagctttcctttcaaaagccaaacaattacaagcgtaggtattttgaagtactggacatttatgtcattgggatagatgtgtacagcaataagcaggcttttagatccagtacttggtttgtgtacagatgtaattatgttcattgtgtggaagttacacagtgaacacatgtaataaggctgcttactagagtttaatgcaaatgttcatagctcatttctttttttatcatgttaaataaatgttgatgttcttaaatcactggtgttagaatctttttccttttctatctatctatctatctatctatctatctatctatctatctatctatctatctattgctctccagggtttcaggatttcaccatgttgctctggctggcctggaacttgctatgtagactggctttgagagactgcctggctctgctccccaagtattggaggtagaggcaccaccatgtcttttcatgcaaaagtagagactctgagaccaggagtgtagctgagaggtagagcatttcctcagcatgtgggagccctatgttcaacttcaacagcagaaaaaagaaaatg

SEQ ID NO: 31978 - DNA, 1211 bp, Mus musculus
gctctgtgtgtgtgtgtgtgtgtgtgtgagagagagagagagagagtgtgtgtgtgtgagagagagagtgtgtgtgtgtgagtgtgtgtgtgtgtgtgtgagagagagagagagtgtgtgtgtgtgtgtgtgagagagagagtgtgtgtgtgtgagagagagagagagagagagagagagagagagagagagagagagagagagtgtgtgtgtgtgtggcagtggtgatggttagattttaagatatattcacagtggatcattctctcaagctatcttccaattcttggcagtcctgcctctgccccacaccacccagttttgtatttgatcttgaggcactgttgtatttttgccttgtactttattgccaactaatctcaaagcattgcagtggcatggagaatgtgctcagtatgttagttgtaaggagcagaatgttggatgtattcagtatttataagatcgtaatggttttggtgactttctaacagtaacagcccttttcttctcttatagcataagcagtacgctaatggacatagacagcacaatttccagtggacgctcaaccccggccatgatgaatggacaggggagcacgactgcttcaagcaaacacattgcctataactgttgctgggaccagtgccaggcatgcttcaactccagcccagacctggcagaccacattcgctccatacatgtcgatggtcagcgtggaggggttggttttgccattctttttcactctttgtttgtttgtttggttgtattatttataattgcaaataggattttttttcttcatgagaggaattggtgaatttccctcttaaatattgttattaccctatctgcttgctaggattacatgataaaaattttagatttcagtttgttcctagataggttgttttgaagaaacaaaccctttaaagctgtagtagacgtatataaatggacacagtgactcccaaggttctggcactggagaggagaacatctgggaaccagtgtcacttgtgcgactcctgtgggaggcagcctgagagatggtgccagggttgtacatgtagccagtacatgtaatttgaagggattagagccatcattccagccccctttaaaattttatttacttttatgtgtatagttgcttttgactctacatagtgacatgctcaggttctggtctcctagaactccag

SEQ ID NO: 31979 - DNA, 1089 bp, Mus musculus
tcctagtgctctgcaggaaaggagggaggctccgggaattgagtccagcctggtgtaaataacaaggtggaggccagggctccttccatagggagaccctgtcatagtgtaaatagaagatctggggatggctacagccattagccggccagcttgctgttcctgttagacctggtttgttaagacacatcttttctctaggaagatgatgctgtctatgcttctgtgcagtggacagagaacagccaggccactgccaagaggtgcactagttaaataacatagttagttttgaagtgaattagtgaagggaatgcttttgttcgttcctagagtcagttacagctctgcttacctgctgagaccatccatgacccacaccacaagcagtaacgccaactctttttccttttcagtgtgtagttggtggctgcaatgccagctttgcttctcagggagggctagctcgccatgtacccacacacttcagtcagcagaactcctcaaaagtttctagccagccaaaggccaaagaagaatctccttctaaagctggaatgaacaagcggaggaaactaaagaacaaaagacggcgctcattacgtaagtgctcacttagaaaagtctctgtgggaaaagaatgagactctagtgagaaatgtttgtagatgctaaaagaggattaagtgtatgtggttttagaatataaaatgcttatatttagagaattagataagtaggtggtagctagtttgatttgttataaattagaaacattgaaaacatggctatatttgtttctataagcactttagaaaattttgagcatgtcagaggtaaaaataaaataaattaaataccttgataacttgataaagtataggatgtgtgtgaactgtgaaacaacttgaacatatgaaaattatgctcttaactgctgggttctatataggacactcctttgatattttgggttaaaataattacacagtaggcttacaagtgttgggagttaggaattagccgtaactacagagctgggcgggccccaggcttgactctttggatccactgatcagcacctctgga

SEQ ID NO: 31980 - DNA, 2596 bp, Mus musculus
caatgggcttagggaaagttgcacattacagtcaaccccttccttcctcctttactttaagtccagtatttagagtactatttatggctagtgtggacattctgtgagtgaaggaggtcttctgtggaatatattaatatatactgcagtccacatggcatggaatggcgctgtgggagactgcgcagacactctctggcaactcagtggaacagcttctgaaaaggctttgcatgctcgctgcttaagctgctttttttcttcccccctagtgattacagtagttttattggagagacaaacaattgcccttaaaaacaccaaaagcactgtaagataaccatcttgacagtgtgtattgatttgaagtcctgatagaaaatatttagacagtggagattatcaaaagataactaacctttcagttatgataaatagatgtgattggttgccatttgtgttcttttgcagaactctgataagaaaaatgttcaatttgtatttaagcaaacagtgaacgacatttgcaatcaactaaaaattcgtctatcgaattaggtctgagaatcactgttaaagagtattgccgtgtgtctggtggctcccttttcaggactagggtctctctctctctctcatggggacagcgtgttaatatttacctacataactcttttgttaatggtttttgaaaaaaacctcagtttcaaattatttgagtaatctccatattttcatttaacctctgactctttaatttttttcctgaggaaagtgtttttttttttaattttttttaatgttaaaaaattgtattttttttaaaaatatcttcaaactgaatcttttaagcaccaaagttggttttgaaaaggaaaataaaatcactttcttgcttggcaggcaagaagccatatggaatttttttaacttttacagaaatgtgtaacttgtcagtactgtatcaaacaaatgttgcatagagataatagagcgttgcttgtaaataattcagcagatttgtaatatatttttctattatgaaatgtactgtagatgttttctagaggcatgaaagtcaatgtatatattatggtagaaataatattgaaggaaattgtaattcactagtgctgccagagggattgctaacaaagcacctttaggagagatgtctgcagactgaagggactgtgtactactgttaatgtctaagaacaaagcattgggcgggcgtccttccagaaagtctctgagggaggacggagacccataatagaagtttatggcactccctctgacagtggctgagtcgctgttccttactgttgggagcggtaccgtaaagtaagcgcctgctatgcagtcaggctgcagaaagcactccttccttggagtcctcactccctacagtgacagcaataccagcagtttttactctaaattttttaaagaatagacaaatataaatttaattctttggttccaaaatgggaaagattccatgatacatagatcatttctcatttgcttaaaaaagaaagaccacacgcacaaggtcctaaaaggatgggggggctttagcaggtgaagaggtaggcatggaacagtcatggagcctgagggacgagggggaagcactgcggatgggcacgctcgctcgggaacggtcggctaagacgctctgtagctaacaggagtctattttcagaagaagaaagcagtgtgtttttactatgtttttccttttgcttaagcacttcatcacttgttttattctgtatctgcgaagtactctccgatctcctatgttcctttaacattttggtttgttaaaatattgccaaatagagtgtttgagacatatagtttgtactagtatttttattttacttctcatgttcttgtaagtcattaattgaccgatgattgtagaccttgcttgagtattttttctaataaaacaaagcaaattatacttagcttcaaattgtaacaattcaatttaattttaggatgacatctggaaatacacattcaacattttctttaggtgcatagagaacattcattactgtcaatgtagaaaatttgtgatgtcaaaccatgctgctggttgttgattagcctctgcgtgcccaggtatccagggtccctttgcttgtcattgacttgggcttgacacttgtaagtgagctagtttggtaacttgtgcgtgtgcatatctacatatacattcaaatgtgattggaaagttaagtctgtaacatccattaatgtttcttcttacccagctccgatcttgctctgcctgtctgtatatgacatttatggtggacctgggttgtttctgccccaaatccatgtctggacagtacagaccataggccctgctctcattttcagagctgttgcttgtcttttcctgcctattggagtactgagacttgaggggcccgagagcctgaggtgttacgtctgctctatacagaggtgcttactcatatcatgtagctggtaacatttttggagcagtgaacacagaccacacagtttgtactcaatatggccatgttgatagtagtagtgagcacgg

SEQ ID NO: 31981 - DNA, 1368 bp, Mus musculus
tgtctttcagggattgaatgagagtctgtaagtcagactctgttacaaccacaaggaacgtttgttctagcgaaaagaatcttgaagtaggaaatgttgtaaaaattttaaattctttatttttctagtaaacctgttcatacattaatgtggttgcacattaattctgaatttcagatgaaaagaaaataaagtggacaatacttaaccctcaagtattttcacatgtgtctatctcattgaacataaaaagccgggtgtgctgactaaagccctgcatttgggaggacgaagcaagaggatttccaagagttcaaggcccgagtgatatcctgaggcaaacaaaccaaaaaggaaagaagaaatactgataattagagttttttttctctgtgtcacacattagggaaataggtgccattgaggtggctctcgatgaaggtgttgggcaacaggcatggtggcctgagttccatgcctgggagtcacgtggtctgaagcgagaacagaccggagaattgtcttccccaacaagtaaatgtgcaaatgatcttctgcaaaggtagaatttgccagagttaaaaacatggatgatctgttgtttgcgttgaactgttttcttgatgcatggttaacaagagatgagataatattgactgaatatcaaagtgggtaaatgtggttgaagcagtgtaaatagtttgagtaacagctttacttttttaatttttataatactcctgtataaatcctaaaggcaaaccaaattttagacggtgtggacttcgagtagaaagcctgacacagtgatgtgtctgacaagacctcaggttgcagagatacataaacatatgtggtttatttgtaaagaaaatttcaaaccatatgttatttggaagtcttttttaaaaagcagagtggcactttgtgaggttttaatttaagatatttttctattctatttcataaaaggttaaaaagtttgtgtataaatattttttttaattgttcaagaatcttatgacctggtgtagggcattttgcaattctaacactatagctttaatataaataacatttgtagaggttttctttgtaataaaggcgagaatattttgtaatttctattatttcctttagaacctgaataaccttaaatataggcatgaaatgttgtattatgacttttatattgttaaaatttaaaaacaaaacttatccaactttatttctttcccaagttaagtttgtagtgtcacacgggactgttaatctgcaaagagggtgtaagcaggctagagcaggttttttctaggtcagttgcgtctcagagatgagcaaggtgatgatagatgtgtttaacctcac

SEQ ID NO: 31982 - DNA, 1163 bp, Mus musculus
tgctggcacggactcaccctcagccacaccctcttttattaaggacagctgcccacatttgagtagacaatgtagacagagctgatgattcccaggggttctgagactcctgagctcgtgagcaaactgaacggctgaagttaccagggtacccattggccactctcttgcagggtgcactgtctgaagctcgtcaggtggaacaagtggattcgaagggggaagagcaaagctcaggtaactcccagaagtctaaaagcaggcttcagccatctggctctaagaacgcaggcgctaagaaaagaaaacttgatgatgcttgagtgtcacgtaatattgtacaatgtaactgttctgtatgttcatgtctgggtcatttttataatctgctataatttttgaaacaacttcatgttttatacatataaagctgtattttcagagcttaccttatacaataatgaaaaatacaacttttatgtaaagttgtctaaatgtaatatatctcacattaagtccacataacttttgtaagcccgttcgccttgctgtaactagctgtcgtcttctgacgtgactctcctttaaagcagtactatgctgacatgggctctcctttccaaatgggtgacattttaagctgagcaatgtagatgacttctagtgagaagagttgctgttataattcagataaaacagtcctcagcaccaagtgtgtcagcaagaatggcctgcatattctaagtaaatcacgacagcagcctcctgaggccgcagcctgactttgacgttcaggcaaacagaggagctggtgtatttgtatgagtcaaggtttatcgtcaactctagaggaggagtgttcatctgcaaatgagtcattaaacgagttcatctgaagaattttctttatttctttccaacatccagtctggtgtctgcattctctacttgagtgcccatgcactccgtgtggttatgtttccccatgtactttcttttctctttattttgtactttgtattcctgaagagatttcaatttcaatcaaaataatcctctatgtcgatatttggatctaggagatcctccccgtatgatgaaaggtccatttggtttaagattaaattttcaaatgtttcctctaagtccgtttcaccaattaa

SEQ ID NO: 31983 - DNA, 1101 bp, Mus musculus
aacacccatgtatacatacaaacaattaaaaactgttgtacaaaacatatttactattaaatttaatgaaatattttaggaaattataattttgtctatgtgtggagattattctcaggcctggtctctaaatgcaaaacactttggcccaagtccagcctttaactcagctcagtcatgctgggtgctttagctctgtgacctccttagtcacccctgactgtccttcccgtgcctggctgagcaccaccctcctaattttcagttattggcaagtgtttccattaggttctgatataataaccataaaacagtcactatgctttgttttgagtacttagttatacaaattacaaaattactatgttttaatggttcataaatattaaaagttttatgcacttttgtgatttgtatatattctggtagctttatgtggaaagcgaccattcacgtcccatttatagtctttatccttttaatttttctctttctagattttccatggttcggaaaggtaaaagatgtgctgcaaaatgtttttaaactgcaaaaattcagacctctgcagctggaaaccatcaatgtcaccatggctagaaaggatatctttcttgtcatgcccacaggaggagggaagagcttatgctaccagctacctgcgctgtgctcagacggtatgtacaggaggaagtggctgatacgactcgaacccatgcctcaccagactgtttttgtctactaccctggctacacgggagaaagagcttatgtgaggacagagagaaatggtgaagtctgggttgggcatagagagttcacagtgcttacaggcattcaggtaggcttcagtgggagagggcatggggtgagatagctctgggccaggtgagatagcctgcgctacacaaatgcctctgaacccaccagagtgaactgtgtcctcccttgtggcatgggggagaggagggctctgaatgacatctgaagcaagagaaggaggaatatgcaggaagctgaggctagatgagcacataatgtgtgttatggagcataatgtgtgttgtgtgtggagctaggggcataatgtgtgttgtggag

SEQ ID NO: 31984 - DNA, 1202 bp, Mus musculus
gcaggttatcacagcactgtttgtcacgtcacacatttcatcagcttgcttgggatgactggaagctgttatcatgcactgcatcagtccaaacacggaggtgtctgtgcggttcagttgccaggtggcttgcttgcagagacttaggagactgttagaccagttttgtgtgacatgatgagaatggcaactgtcatttattacacatttagcttctgaccagggcccgtcaggaactccctacgtgttgaatgaaccactgaactttcccagcattactttgatcttagtaagagcatattatggacacttggtagaaggggacattgaagttcattgatgttctgctgagatcatttagctgggaaggggactagtccgaggttctgactctagaacatgctcttagccctctgctctcctacttttaggcttgtaatgtagacagaggactttccagaacccaatagggaacctcacagtgtttgttctctctcctctctcctctcccagctttgacagaggaactggaatccgtagccagtgagcttcatgccattgacatccagattcaggaactcacagagaggcggcaagagctccttcagagaaagtcagtcctgacagggaaaatcaaacagtacttggaggactcttcggctgaggcgagcagcgacttggacacatcaccagctgcttggaataaagaaggtttgccactctcctgccttgccattgtcgtaatcaagaatgaaatcactctgtggatcagtgtgtaccgggagataaagctggcatggggaacttgcaggcagatattctttattcatgtgctataatattttacatgtaaacttggaacttgggttttgttttctgtgtgtatggtcttagtagcaaacatcagtgtcaaaaaaaaaaaaaaaagaaagaaagaaagaaagaaagaaagaaagaaagaaagaaagaaagaaaagtatatcagctaagattttaagcattaactaaaacaaaaagttagctaaaccctccaaacagaccctgccccttgggttttttctttgtttgtttttggttttgttttgttctttctgagactcaatctttaaccctggctgttctgaaactaatgtagaccagtttggcctccaactcacagagatctgactgcctcctgaatgcctggattaaatgcatgtgcc

SEQ ID NO: 31985 - DNA, 1114 bp, Mus musculus
tgtctgcatggccaccccccaaatcttccattccattcatagaaacctccacagagacaactgcagcatcagggagtacatttgagcgtcacagtttaatgcaggcaggccatccaggccttgctagtgtctgcttgaataggccattttattccctgttcagtcaagttggaacctgctgtagatatggatcttctatcccatcacatcttcctccttcatggagtggagataggcaaagaatgaggcctgtgagggcagccgggcctgccaacatgctcaccccagtccctgttcctgctgctgggcatgagtgcagggactcatgaggactctggtatctgtcacatcagaggccaagcaaactcctcactagggggctgtctaaccctctctgtgttgcgttgtctttctcccctaggttctgtttgtggccggcttggcttttgtaattggtctcgagagaacgttcagattcttcttccagaggcacaaggtgaaggccactgggtttttcctgggcggtgtgttcgtggtcctcattggttggcctctgataggcatgatcttcgaaatttatggattctttctcttgttcaggtgaggcccttcttttctttcttttcgttcgtgagccagagtctgagagaactattgcagaaaccaaggtagttgggctagtgtgggagacttttcctgaatgaccgctacttatattgagtttttattgtaagtttaggtcagtcaactaaaaaaatgtttcctaaatgtaaatgactgcctgagtgagataataaagtatttataaaatatcctcagtgctacaaaattcattttattgccatttgtgaggtgtgtccagcatttggtattcctaacaggatgggtgggtacgtggatctgtcactgtgttacataatgttgcttcatagtggctgctacctgctgctacctgatggcagtgtgctcagcgcacgcgcgtggtgaggaacccggtactgagcactctggaaatgccgtcagttagccagaacactgtgcatgtgagaagacagacagtgctcatcagtcacctaagacataaaaattagttaaggactagacctgtcttagg

SEQ ID NO: 31986 - DNA, 2656 bp, Mus musculus
caaagtcccaacagctgtggcagaagcagcggcagaagcagcggcaggcttgtgaggcctgaggtccgaagatggggaggatgaagcctgtccgatgcttagtgacttgaaggctgtttcctagtcttgctgcagtatgtgaaacagccgttcgtacagaaccatggtgtctgttactttctttttttttttagaagattcaggaacaccaataggcatttgatttttttatgatgtccattgtggtggcccagacatatctaggtatgctgggtttctaataatgatgcctggattggattatgtcatctccatgtatcgacccaaggaagcccagtttcatgtgtgaatcactcctttttttttttttttttttttttttgtaaacatagataaaataaaacttttgtggtccttttgaatcttaatattttggagccagataaaaatctgaactacatagtcatttttgaaatacgcagaggtcattctgagctgtcacgtcctcagtcatagctgaccacgttctttcttgactctacagcagtctggaagtgcagatctctcgagtgtggcctgggtgtgttcatacaatctgtgccgtgcagaggccgagcagagagcgttctgaccatggagtagcctgctgcagaggctattggagcagttttgggaccctaaaccatacacaccatatgagttctccatgccatgatgtagtttttctctttgggttcttaatgaaatctggccattgtctcccaccttgctttcataacttacagtgacgttgaaggtgtgcaacatggtaaaggttgttgtgtgactgtgagaggggctgattacttcatcttgatttttcctcttttttcagctttattgcaatatccaaaaattagcatgcaccgcatctgcttccctcgctgttgtccacctgagttaggaagtaaaagcttttcgttctgactaaattggccatagcttcttataaacaagacgctggggaagcatgaccttcccatcgtctgccgctggtttgcccacaggaaccgtgatgttttcctgtcggacaccggagcacctcgtcagacacagcactatttatcttaccactaatgattgcactatttatttttaacagtctcgaagctttttaatgcataaaatcataattgaaattatatttatttacaagccacttctataagacattacaatgttgtttttagctaaatttctcagtgccaggagaattcccagccttgcctatctacagaaggaagaactggttcgtagtgggatggctcgttcttgtggatcactgtcgtgtttggtacttgcatctgacttatggtgtaacctgtgaaaactcgataagtggagaatcctacctcaatagctcatgggataataaaagacctggcgttgtgtctgatgttcctcaaaacgtcacacctttcctgacgtgtcaatgctatgctttgagaactgacctgtgtaaggtgccctgtatatttataataggctttggcctatatgattgacagtggctaggtatcactcgtgttagaataagagtctgccattttactcctttgtagacatgactctatcaaagtggttttcacactacagcaagcatccctttcagcagtctgatttcagaaaacactggacctgggaagaatgagaggctcatagtccttagtaaggctgaggcagctttcagtttagggtgagactagtctgcagtgagcctaaactgcttggcctccctcgcggcttttctcaagcagaacctcgaggctctgcttttaaacaaagcagccctcagacttctagaagtcctattgtgagttccctcaaccctacccccttcttaaaggagccttctgtctttaacaaaaaacaaacagatactttggttattccccccaggtggaagacaaggtccagtccttagccttaagtgtttctgtcatgttcaagtgtatcttctgtaacagaaacatacttgcagtgtttcttttcccttctaattctctggagtgcagctgctgtagaagtctcatggtcaaatcatatactctaacaatggcgtattgtaaatacacttgtctgacctcaataaaagggtacttttctattcagtggtggtcaagtttatctttactttgaagtttttaaacttaaataacactataaaataacatacctaacataccctatttttaaaaatgggcattgtgtaattttgtctgtcaaatgcccttgaacatttttatatccaaatcgcttaaatgtggtcatatagcaactattcccaaaaacacatttggaagctatttaaatttatgagagaatttagagtggattgagagagagcttgggagttctgagctctgggagggatccagacttggttcctgacaacgatgttgaggctcatgaccttcagtgcctgcaggtccaggggatctggggtcctcttgggtcctctagcaccaagcatacatgtcgtgcacacacatgcagtcaaaaaactcatacacataaataatgaatattcagtgccttgagccatatgctgtttttaaaaatgtcaaactcctctgggcatgttggtgcagacaggttcctgtgagttctggggcaa

SEQ ID NO: 31987 - DNA, 1278 bp, Mus musculus
tagtacacataaactcacagatacatagtaaaacatccttttgatcttgtttgttttttaagacaagtttctttgtatagccctggttgtcctggaacttgctgcctagaccagaaagcaccaatcaatcaatcaaatcttaaaatgagttgatagaaagttactcattgagcaaagagttaaaagccatggaaaggttcatatagcaaattgtattttagcagaaaacatttgacttaaaaactaaatactgactactttcctgtaactagttttgtcgtagaataggtttgcacagtctataaatataaatctgaactcaaaacccaagtttatgggacatatggaccaattagatgaaaactagggaattaatttgtgcttatcaaacttgctatagttgtttggatccaacgtgattcttcagatcattccctcatggcctcattggatgctttctttgctctcacagggaatgtacggcattgagaatgaagtcttcctcagtctcccgtgcatcctcaatgctcgggggctgaccagcgtcatcaatcagaagctgaaggacgatgaggtcgctcagctcaggaagagtgcggacaccctgtgggacatccagaaagacctcaaagacctgtgactgccagtctctaggctgtagaacacaaacctccaatgtgaccatgaacctttagtcttcagccatgtatgtaggtcacagtttgcttcttccctgacatgtgatatgagctcacagatcaaagcccaggcttgtttgatgtttgcactaggagctcctgatcaaataaagttagcaattgcagcatacttctgcctgcctttttctctggttccttgagatggtgtctccctgtgtagccagcgctagcctggaactgcgctcttctggccgcatgcagccttcctggtgttgagattacaggctcaccttgtgtgttctttaatggtttctggaaagttgtgatacgtttcttaaatgattcttctagacctccgatgtccttaaattctaccatctatgttcctgtaaccaccttccaggcagtgccagaatattcgatcagaatgtgccctatgagtttcatgttttgagaatatatttacagtttgaaagttttttgattatgatcatgtatgatcacatgtaggtatgtgcgtctaagaccagctgagtaagataccctgaaactgagtcactggcggttgtaagccccctgacgtcagtgttgagacacacgccagggtccacagcaagag

SEQ ID NO: 31988 - DNA, 1156 bp, Mus musculus
gaccagagtactccattagtacagtctgggcccgggagaaggctggtgtgtaatggcagtcacttcccatctggtaaccagaggttgctccctaggatatgtctggtaaaaagagagaaatggcctttgaaagtcatttaacctctaactctctaacctccacatgagagccctggcacatgcttaccaccactaccccacccacagatatccattgacacagctgttccaagtctaccgtggcaggcagtgtgtcagaatcggctagtggactttctctagcacatactgtggagtcacactgtcaccaccaccgtcagtaagctggacgtgtcaggagtcgatgtcttagggctgctacagaggctgtacaatccaggcaaagggccagcaggctctgacacataacactttttactgtttgctttttaacttacacattttaaggaagaacttgggggacagtgccactgacagagagaaaaggagccacctcctgtcccacaccagcagcccatgcacacgagtggactgtgccagcatctgtgtttagtggcatgttcagagctgtgtgagatgtgcttagctgatccctgctgcatgcacacgtggaactagttgcctgaatcagcatcaagcctgtagagttgacagcctggtgctatcagcatggtcttaaagaagaaaagttgctgatgtgcacagtgactacacacagattgtgcacgaagcagacacggacagatgacaccggcctcacgaggcccacacgagcctgtgttcttgaggtgctgggataactttggagcccaatatagagaacagtccaatagcacatttgctatagaaagcaccacccatgtgatacataggattcctgctgtacccattttccatgaggctcaaagaggcttccatatgaatgactgtgtgctcatcatcaaagagtgaactgtactaacattagagagaaaaacagaaggcttcgcctcatataggaactgtgccatttatgtaggcataggcggagagtcagacttcagaaggcattgacaaaggagtagtgataattatcctggatcgtaacgtttgtttgcattaaagaaaatgctgctgtggtgaatatgtatggcttaaacaccccttcaccacacac

SEQ ID NO: 31989 - DNA, 1099 bp, Mus musculus
ctatggagataacaaatacctcacagttcctgtgctgtgtctttgaaagtctggaattccgaagtccagaatatgtctataaactcctaaatgtgaggccacaagatttagtctcagccctatacaactcctgttgtgtaagtgggagagtcttatatctgtacatcacacacacacacacacacacacacacacacacacacacacgaatagtaatagtgtctagtatctgccttattctcagccttaacatgtcctctgacattttcacacacatcccagagataaatgattgacacatggcacaaatgaaaaggttatcccgactactgaaccttgctcactgtaataaggacggcatcccgcgcctcctccttgttggggttctcgctgctgctagcatttgtagtttcttctgctgttatggcaaaagaataaataacataaagaagtgagctgtaatattgtgagcatttgaatagcagcccttgactctcacttgtgggagcacaaaagaagaattgcattttacggttgcttgtttatctagacggtcagtctctctgttgtgttaaaagccttcctggatttgctttatggttgaagctgttgggactcaatcaatgactcacagttgcttgagagttttatggtgtgatatcctgcttctgtgtaattagagctcctctggatatctctcactttcaaatgtgtgttatcttagcaactgtttcaagataccaggagatgtgttgccatggggtctttcgggttaggatgaagagatgaaggatgtggcgtggactaggcagctgtatagagaaaactcagaggtggtacctggtttcccatgtgggtctaagcagtcttggaacctccaggttcctgcctcctccaagcagtgccctcctgggtgcctgagcttggtgaaataaacctacacatatctctctgtcacctgccttttgagtcatactctcaagatgagttatagtttagttttcctatcaagatggtgggaaatgtcaccttgatgttgaccactggatgtggttaccatatacgatgtacacagcaagagttggtgtcaacttcctgt

SEQ ID NO: 31990 - DNA, 1152 bp, Mus musculus
tttcttctagttttcattcaaaactcagacttgttcagttgctgtggccttacagtgaagttttaggattcttgttgctattgttcgtttgggatagtggctgggcctggatctcactgtgtagaaaaggctggcctctaactcacagaaatctgcttgtctctgcttcccagatgctgggctattttaatatctgataaggaaccgcttactatttcttgtcataattttctcttaggtgcaattgagatagtttttcaacttcactgaaacttcttgagtttcagtaatttattcattcttactacaaaattgaaacttcttgcctgagcataagatatatttcattaatattcaaagcttattttacttccctacatagagtattcaggcttgtttttcatagattgccatagttctatggagataactttaaaggtatgtcaagcccatccttcactcttctgtgacctcaccacaaagcaccctgcttgccctgcagtgtctgagaggttgttgtttggatactaaggtactgacagttattttcatccagctctctcattagaagtctcacagtaacagtttcctggctcgtcccttccagtttgctaggaatagactgatctgtgtacgtcgtttgtaaatggcgatagtttcctctttcctcacagttgtttcttatgcttccctgttctttaatgaggacaagtttggtgttcccttctgcgtttttcatgctgagtttcattactttctctccttacttggctctcagtactcattggcttctggctctgtgaccctgagtcaacggctcacttaaggaacagagtaaaggtttcagaggcagagaagggctgagcaagggttcaaattcagggtcctctgctcccagctcactctctgaacactgccccgtgcaacctaagtagaaaggacgtggggccagcaaggtggctcagcgggtaaaatggcttgtcacgggagcatgagaacctgacttcagtactggaaacccacgatggaaagaacttgacctcaaaatgctgtcttctctctctctctctctctctctctctctctctctctctctctctctctctctctctctctctctcacacacacacacacacacacacacacaaata

SEQ ID NO: 31991 - DNA, 1103 bp, Mus musculus
aacatgggatttgttgctttagcaacatccagctttcaccaccttccaatcataaggcatggcctcttattgtcaccttataggtctctgattaagagcaggcttaactatcttgtcatggatcactgggctttctggatttcttttctccactcttgctagatcgtttttaatcctgtgcctgactggctctgccggattcgcttttctcccagagccgtgtacagcaggcatgtggtcccctcgcctgcatgcgtctgagcttctgtctgctgtttccacaggcacagtgtctcataaatgtcagtggggacgcggtggtgtttgttcgtgactccgacttagaggtcatgtcatctcagcagcctgctgccaactgccagccctcatgtaccggagaagttacaacttgaagacagcggctcaactggctcaaccgagtgaaattcatgtgtctccattgtgtgtcaccctcttctcagcccagaggcccggcgtggggtggggtactgaggagcagggatgcggctggatagcttgtgtgcacatctgggagagttgagaatttctgatcttgacattttgtttgtccagtctacacagacaggccccatggattctggtaccttcagttatgggagttatttgtaatttgtgttgatttttaataaaagtataattaaaaatgaaatggaaagcttatcaagagtctagggtaggaagctcctgtggctttgaaaaccaagcaggaatccaattgctaatgagtccatagctgatttgtaaatggaggaaacttgtgtgtattttcagagaatgactgcagctttctcagtgtcttctgcttgaagtgaggactttgttagctggatgggtgatgtgtttgttagctggatgggtagtgtgttagaccatcttttaaaggaaggtttacggtgtgggtctgtagaattgcctgagtgctctcaggaacttctcagaggtgtccgcacccaggagcggaggatgcctcaggactggctgtcctcatggaggagggagggggcacctcacgactggccgttgcttcatatttaattgtctagaagaggcttggctccaac

SEQ ID NO: 31992 - DNA, 1167 bp, Mus musculus
ctattttactgttagcttcccaaagcatcttttagacagccacgatcgactgttaaggtttaagttacatggctgtttaagcaaaaaagtctgggaaagacaaacaggaccgtattacacctgatgttacctaggctgcctgcagggctccagtgctggagtgttccgacaaaggtggaacttactggaatgtcacaactttgacactctcctggataacttgttcctacagcagctccccctgctctggcgctctcctgtctcactctgtgccatcattgtgtgtctcgctgcaccgcatcgacatcttcctttgcaggaatgccattttccttcccagactccattccagcacctcctcatgtctctttctctctctctctctctctctctctctccctctctctctctctctctctcgattgcatgcgatgcatgataacttcttttctctcatgacatggcttagcctcacagacagctgaatgttatcacctctgtttggaagccttaggggattatcagtttgcagggtctgttcttaatgtgtccttctctttctctaattttagctgtgactgttgaaaaagcaagtgccatgggtgatggaaatttccggaatcgctctgctccaccttgtgcaagtcccacagttggggttgttaagatgacgccgctttctttcatccctggagcaaagataaccaagtacctcggcatcattaacatgtttttcattcgggaaaccacttctctccgcgaggtaacttacaaaacggaaggttgtttaagcccatttgtttgtagaagttgtagatccttgttgtaaaacacataattttctcctgtatttgaaactgcactgccgggacacgtgcaggtttctaatgaggtggtttgggttctttttttttttttttctttttggtttttgagacaggctttctctgtgtagccctggctgtcctggaactcactgtagaccaggctggcctcgaactcagaaatccgcctgcctctgcctcccgagtgctgggactaaaggcgtgcgccaccacgcccggcatttatgggtgtaaagtttataggattgtgattacatttcaaaatcagggccactctcttgtgccatttgtaacatgggaatttaacctaagtagaaaggga

SEQ ID NO: 31993 - DNA, 1113 bp, Mus musculus
ataagaagacagggtccgtgtgctggggagggcaatgttttaagggaggaatgagagctagtacctgggaacatcacacagcagaaaaccagccacacacatcagcaccactgcctagctgcgtccctccctcccctccaacttaaggtcaccctctgactttatcaacaactccctctagtggtagcaaacctttgtgaagctaagtgattgacacctccagagattgctaggaatcacgcccagaatcacacccttcctagcagccttgggtagcactcagacagaggttgtcctggggtcttaggtatttgttgtgtatatgtaagatattgtgaaaaggtgaaaggactgctaaagcctctctactcttgttcttcacgctcagccgggcgtggtggcgcacgcctttagtcccagcactcgggaggcagaggcaggcggatttctgagttcgaggccagcctggtttacagagtgagttccaggacagccagggctacacagagaaactctgtctcgaaaaaccaaccaaacaaacaaacagacaaaaaatactgcagtggtcttcacgctctctctgtactagcatatttgtatttttgtctcaaggaattataaaactgaaagaaaaagaatagctcattagaaacactgaaaatatttggggcatccaatttttttttaaagtatcaattaagcaaatacattgtctatctctaatgtattggtcgtttggtaatattttcagatttgtaaaatttaattactcaaaatatgacttgtacagagcattctcctcagtggggcagccttgcatgtggcagctaacatggagagcgtgcagcagttgcagtcctccgaatgtggagttgcttaaggactgcaggccacaggatgactgggacggtcacaaacgtgtaaacattgatcataatgtccacggacggcatatctaacagggtacggtcttcctgattcagcagactgagggatgtagcaagtctagaaagagatgggaatacaggaagaagccagaccggtcctgacatatattcagcagcttaaaagtctctagagactgcacaggacaggaagtggctcgacacatac

SEQ ID NO: 31994 - DNA, 1238 bp, Mus musculus
tgtcacttagcactgtgtaagctggttgggagtggggaggtttgcagccaaagcatttcctgtcttaccgtttggttcctatggacaaccaagagttgatttgtttctttgtttctgtgtgtatgtgtttgtattcattaaccgttaggaaatgctacctttgctgtctctccatcggtttctatgactacccctcccaaccccatctttgtctcagaagtcagctctgtcagtgtgacgcagctgctccttggaggaggactggcactgatttcatggtcgctagtaatttatcagtcagtgcacactgctctggtgtaaggtgcattgtctatgacagatacactgtatggaatagatggtgtttaaatgacttaaggattttagaaatgccctatgactttgtttgctatttatcttttattgagcctgactaggtatcggaccctgatcagagtgccttcttacttttaaaatatatttatataggattgaagagaatttaccggtgggctgcggattctgccatataccatatgatgaactgaacatgccgtttcccgctcatctcacatattgctataactgcaggaagcaaaaagtccctgatgttctcttcacaactatcgatctgcccacagacgcagtggttgttggtaaaggttgtcttattcaggcaaggtatgtttgtgacagctgaattggtatccttgagaaaccatgaggtatagagacatagacttgaacgatatacactgtttcttatttgtttgatcctgaaccaacttggcaactctatcttgtatttatctcatctacagctgtcagtaaaaacacactctataacactcaagtttgtacgcacagaatcggtttaacatttcaagtctgttgtatatgtgtttattatatttatgacttagtttgtcttctagtttggagtatggctaaatatctgctttagagacctctaaaatattctggaacagggtgggttttttgttttcttttaaagaacagtgcttcctccatgcaaaattcagctgtttatcattggataggacatcctggactgtgacacatacagcagatagctttaagtgtctagttcaccaacaacggccaggtttcctggtcccttggatgtttcttttttttttttaatttatttatttattatatgtaagtacactgtagctgtcttcagacactactatctgaagagggtgtcagatctc

SEQ ID NO: 31995 - DNA, 1114 bp, Mus musculus
gagagagaaattagggaaacaactcccttcataatagccacaaataatataaaatgtcttggggtaactctaactaaacaagtgaaagatctgtatgataataacttcaagtctttcaagaaagaaatagaagaagatcttaaaatggagagatctcccatgctcatggattggcagaagtaacatagtaaaaatggctgtcctgccaaaggcaaactatagattcaatgcaatccccatcaaaatcctgacacaattcttcaaagacacagaaagagcaattctcaaattcatctggaaaggcaaaaaacgcagaattgcgaaaacaattataacaataaaagaatagctgggggaaccaccatccctaacctcaagctacactacagagcaatagtgataaaactgcatggtattggtacagagatagacactgtgatcaatggaatagaattgaaaacccagaaataaaaccacacacttacagtcagttgatttttgacaaagacgccaaaaatatacaatggaaaaaagaaagcatcttcaataaatggtgttggtctaattatctgtttgtatataaaagaatgaaaatagatccatatttgtcacctcgtacaaagctcaagtccaagtggatcaaggacctcaacataaaaccagatacactgaatctaatagaagagaaagtggggaagatccttcaactcattgacacagggagaaatttcctaaacagaacttcaatggctcatgctctaagataacaattgataaatggaacctcatgaaactggaaagcttctgtaaggcaaaggacatagtcaataagacaaatcagcaatctacatattggggaaaaaaatctttactaaccccacatccgatagagggctaatatccagattatataaagaagttaatcaccaggctggtgagatggctcagtgggtaagagcacccgactgctcttccagactgctcttctgaaggtccggagttcaaatcccagcaaccacatggtggctcacaaccatccataacgagaactgactccctcttctggagtgtctgaagacagctacagtgtacttacatacaaataaataaatct

SEQ ID NO: 31996 - DNA, 1177 bp, Mus musculus
atttgattgttatgtttgctctcactgcgttccttctcctgcatttctgatcatcttctgaacctacatctttgctactttcctccacagcaccttacccacaggggccggggatctacctgtgtcccagctccacccccctctcttgtggttcctttcaccttaagtcccgcctcctctcggaatctagccttacccctcatcactctagccttgtcagccccgttctgaggaaaagtgtttctttcagtgaagagctgttcctggctgcttctggtaggatcacattatgtcagcttttttttaaataatccctttgttttaaatcatctctgaaaacatgttattttatgccatagagaatgactgtgtgctttatgtgtgtgagtgatttcactgacagttaatcagaaccacacatatgtcactgacgcttacttgatggctattatcagtagtcactgagttttctgtttaacaaagattatgtgtcaggatgtggctgtggatgtttgctgtcactctcaggaccgaggtctcactcagtgtccttgtagatgctctgttcccctctctccatacctgctccatccacatccgacctgtgccatcctgttgctaaaccagaaggctacatgagaaaattattctgtttgaaccagtttaagtctcattttggtgctattcttttattatacacttgttttctttccattccattaatcaagttattctgctatgttttctggtactttatttatcactgcaaacttaccttttattttgtgattttaaatatgcttcatataaagatcttagttttgtttccagttagcattgtgtagtctctaaaaaccttaagattactgtaagaaaaacttttgttttcagagatcagaatgggactacacacatgctaacccttgtttccttatccaagaacagctaaaaatgtaaacatggattaactcctccctaaggcactgcagtgaacttgaccggatgcatctttagctttgagagccagtgtgagccatcccatctccatagatcgtgggccatacttgtccttgtgttactatcaaaacaatgacgacaacaaatgctagggaaaatgtaatattagccttaaaatacatctaagggtgaggaaatagaattctttcatccatgacta

SEQ ID NO: 31997 - DNA, 1567 bp, Mus musculus
atttaatctattacatagattgttgccctttcaaacttgttctgcagggtgttgtagggtaggtggtaggtagagcttgagacagttactctgtcttgagctcactatgtagtgcaggctaaccttgaactcaggctccttttgagtgctgctgttatagtgtgagtcatgacatctggcttttctcagacctctctgttccagttcttttgtgtgtatttgtggccatgaacatgctgtgaccgtcagcagaagtcagtgaacactctcctttctctgctgcccccccccccccccccggctccccctaacttgaagcccagtgtcaggtgtgctgctgggtgctcctctgtgctatgtcaatgaatagagctaatcctttaaaaagcttctgagccctgtgtgttcttctccctccttgatcttattgccatgcattcatatcgggctagtctgtcttccccaagtggactcactcactcctcaagtgccttccccagtggtgctggggagcaaacaaagcttgtctgctgaggaagcacactatttctgagggttctccaaaaggcttttgacagtcaaaagtaggtatgtttctgagctttggagattgagccccaagtctggtggatactaactgtgtactctaaactatacccaaacttgtggtgtttctttccagttaacattttactcacggtatctttaatcccggccttagaaagtcgagtagcatttctctttcttttcttgtcctctggcagctgttcacagatgggatcacaaacaagctcatcgcctgctatgtgggtgacaccatggaagatgtagttctggtgaggatttacggcaacaagactgaactgttagtcgaccgagacgaggaagtgaaaagtttccgcgtgctgcaggctcacggctgtgcacctcagctctactgcacctttaataacggactgtgctatgagtttatccagggcgaagctttggacccgcagcatgtctgcaacccagccattttcaggtaaatttgcaaattttttcttttgaaaaagaatgctatgcacactaaagaaatattaataaattaaaaaattacacatttagttttcatgtatggaggggaggaaggagaggagggagaaggagagggggcagctagaggtgggagggaagggaggatgtatggagagacaggagaagggagagagagaaagagaatatgaatgacgagagagaaagagacagagacagagagagtttgagtgtatgagtttgagtgttttttgccacagcacattgtttgtggttagtggaaaacttgcttgtgtgagttttctttttccctgtgggtttctggaaccaaattcaggccatcagaattgcacagcaagcagtttacctgctgtaacatttagctggctttttagacacttttttttttttttggcttttcgagatagggtttctctgtatagccctggctgtcctggaacttactctgtagacaaggctggcctccaactcagaaatcctcctgcctctgcctcccgagtgctgggatcaa

SEQ ID NO: 31998 - DNA, 1112 bp, Mus musculus
ctttaactgcacgttaaagggaatttgttacttcctttggaatataggtttaaatatcatttatattttatctttttgcatatccatttcatagaacaaacttgtttataaaactaaaaataagggaccaaaaaaatcagattactttgtcataggtacttttcattaaacatttgtcagtctcagctcttgatgatttacatgtaaatcaaagagaagaattaggttctaatttggtgttagaggtcaaaatccctctccatgtctctctgtccctttccttccagtaagagttcatgttgtattgcttgctccttgtcttttgagtgttagtaaggaaagactctgttatgtgttctctttatcagtcagtagttttgtgtttattggaaaggctgattagatcttggatttctatgttaatagttgatacataagctctaagacactgtagttagtgttcaggtaaaacttaaaattcaagaacgcctgacctgatgttctttgttgtgatttcaggtgaggagctagtagctctgagataatgaaagcatgtgacctatttgaatctgtagttacaagtagaagataaccacattttagtccaacaagttggtaagcttaatgcatttggcctaggagcattgctttgacactccagaggtgatttgagaacaggcagtatgggagccaggtgtgtgtaggtacatcttgtatcccagcacataggaggcagaggcaggcagatgtagtctacttagttccaggacagctagagctactgagaccccatctcaagtgggggctgaggaaaccacaaaagggggctggagagctggctctgcctttaaaggcgaggctctcaaccacagcagcagcaaaggcaaattggctacacctgttttagctggcccttcctttactgtagcatgtgaaagctgagctttttgaaggtacttgtacttagaataatggattaaaatttgcattttatttacgtacacatttgatctgttatcttaaagtcatcctcttgaactccctattttctgcttatcttgtgagatataagtagataaaaataaggaagtgagtgggctggacctgatatc

SEQ ID NO: 31999 - DNA, 1099 bp, Mus musculus
acagctgttgccagtccctgctcttacagtgagagtgatgtgtgctggcctgggctggaggtgggtatttcctcgctcacatcctcttgccaagctcttacacagaattcctgtgaactttcctcaccgctgtttctccatgtctaagagctgggctggaaagggtccgactctcaaataggtgacttttcttttcatttgtaataagataaggtcaagacatgtgtcttgttataattatatagccttgtttagttcgtttttggctttaacatgctttaataaatggaagactagttttcttgcattgagatttgaccagtttaactggatttttcctacagtggtgagggcttcaagcagtagtaaaaaaaatcaaaaatatttttgaaaattcaaattcatccattatttgctttgtgttgtgtgtcactggtgcaattatttaaagattataaaaatcaatgctagcctttaagctgatcattttttttaaaggttaaggatgccctgagaatctggatgatctagaagcccctccttgggaagtgagtgtgcacatcagattctagggtgtgttttcattatctgttcacctttgagacctcaaggagaaattcttgtctgaaggaattagttattaagagtaatggacattattaatactgggaaatattaaaaaaaattaaactcacggtgaaaagaaacaacatgttctgttgctaggagaatatttcccagtgctgtaatttgatttttctggcaccctaaagatcataagacctctttaattttacattgttgcagaatcttaaatttaaggttgagttccactttgtaatgatttgaaacagaatagttaatgcagattttaaacatttctttcctttaaagctttgtgtcttgtacaatgtgagtttgccaaattctcttcatctgctacagattaggtatgccattgctgctgccatgtggcggcgccccgtgcttcttaaacgcactgactggagctttgtcgcctcacttgttcacatgcacggagcctggtaacagccccatctgtattttgttagcttcattttcttatctttagatttca

SEQ ID NO: 32000 - DNA, 1761 bp, Mus musculus
ttcttctttcttcttcatcaccccttcctttggaaaagatggaagtagaaaatggcagagttggggtatatgggcatgcagctggacatggtgtttgttttcctttgtggggtggacctaggaggactggacatggagagtattgtggtgcactgtgtgaaactgccaaataatcaataaagatgtgtttatcctgtgtgttatcaaacgctgttaggacgaggtgcttttggctctgctctccctttactgcttaaaatacccagaggcccttactccatggtagcccggggcgcctgctgaggactgctcagtgggagcagtgacgtcatccgcttcctaagatgagcagcagctctgtgccttgcttagagttacgctaggtcagagtgcaggtccattgtgtgatggaaggtatggccagcaggagtgagaggctgcacggcttctctctgggaaacttggtggcagtgcataagcacgtgaagggcgtttctcagtcgtctgtgtctcctcaggtgtcagcgatgtagactatagtctctatccagatcgagagctccagggccagtggctgcgctcttaccttgaagcttacaaggagtataagggctttggcagtgatgtcactgagaaggaagtcgagactctcttcattcaagtcaatcagtttgcgttggtgagtaaagtcagcgaaacgttctgagtgttggtaaccaggtgctcatcacctggcaaaacaagttttagtttgtaaattttgttgaaaatagtgaaaagtgtggttgcttgcagtctgcctcattaatttcctggttttaaggacacactctgttgttgctttacccacttgtctatctgtgcctgagttcactttgaaaatactgagttatcttctgagaatattgtcgttcattagcacagcttacagctgatgtgctaagacattcctgagtattaggacggttctttcagctactttataaatttcaagtatgattttatgaaattggctttgggagcattggccatcttttcagagagcctacagtgatggcccacaactagactgttgatgctcttaggttcaggcactgattctccagagaccctggcagcgcagtgcacgtgagtggctgtgtcgatgtgacagctgctgtctcatgtcgcatggtcgagctgctgggcacagtactcacttccagaaagaagtggacttaacagacttcatgcagcgttcacatgctgtagattctaggattgtatctgaacacagcccattaaccagatgctaggtgctcacggctgctctagctgaggaatactggaagtaaagttcttcagaatgcttataaattagaatgaccaggtgattttttttttttggtaaaagttaacacccatctttacaatttttagtgaagtataattacgaataaacttaaatatgacttaaggggaaaacctcaaggtggtccaggcttccagtaccagctcttgggaagcagacacagatctatctagatcttaacaccagtctggccacacagcaaggaaaaccagcctggactatatgagaccttatttccaacaagtaaaccaagcttcctgcaaacaagcatcctgacctcggtgtatgacttgggcccatagccttgtcatagccttgtcatagccttgtgtgccaggcctcggggctgcggttgcaggtgtccttggccatgctggctctcgcagacagtcacacgtgtcacttttatg

SEQ ID NO: 32001 - DNA, 1197 bp, Mus musculus
gctcacttgtaaccatgaagacctgtgtttagccccccagcatctacctacaagtgggcatgacagacctgtccttccagtcctatctgagtggccttctgaccagccagccagttcagtcggtcagatagctcctgtctcaagaaatggctcagcaggtaaagtgctagctgtgtaaacagtaggcccggagtttgggtccacagtgcccagtgtaaagagctaggtaggtatgatagccctcctctaatctaagttcagtgcagggattcccagaacagcctgactagctaggctagctcagctctgggtcaagagagagaccctgcctccgtgtacaaggtggagagagaacaaggaagacgccttttcatacacatgcatctctgatgcatatccctacacacaggcattcacatagacacacatgcaaaactatagggtggaacgtgatagtgtgtccatgtgcacacaggtgcatacggccccacatcattacgcactctgatagaaaaagataaagggcatcaaagtaaacagtgctctgtgtgtgtgtgtgtgtgtgtgtgtgtgtgtgtgtgtgtgtgtgtaccacatgtgggattctgagaacaacttggaggtgtgagtgttctcaccaccatgtgaggatcaggcattgaacctgtgtccttaggcttcatggcaaaacgtttattcactgagccatctcactggctgaagaaccaactgttctattaatattacccctttagcattttctttacgtttatgtgcagttttctagtatatagtatgttcactatattctgaggtctgataccaacttctggttgttcataaataaaactagttagttgttgaatctctcttctcttttcacagttctactgatctcttacgtgacgtctgtccatttcagttctggaaatgtcttgttgcattgctttctgtttgcagaatacagagcgtgtggtaggatttttacacaggtgtgcacaggcgtgtgcaggtgcaagctccaattccctttaagaccctctgctagctgctgtttaactagtttgctctccgtaaagcaactctggtttcctcttgtggagcactgaggtgtttgagtggatgagtaactcctccactcttttcccattaaggtctttgtccggcttttttgtcaaggctacacttcctaatagt

SEQ ID NO: 32002 - DNA, 3821 bp, Mus musculus
ggtaggaggacttgttttgatttatcttggttttgtcagtctagtttttattttgtggatgtgtagggggaggcaactatttcatgaaagaaagttaggtctttgaggtagacaagaaggctttaatctttgaagactgctctgtgggttgagcagtcaggggtaactttacttagattagtcagacaggctttgcactttggtcacataagtgcttatgtacaaagttggctccatggatctgcatatttaaagtatgcactacagatctatcctaagattgtctggtgttccacatgacttatgttctcagccaagtgctttcaaatacttggattgtctcaaggtgttcaaacctaataaagtagaaacatgccatttgaaatggtaaattctagccacatatatacactcttaaatatgtgtctctaacagtgttagacctggcttcggtttctacctccccagtgctgtcatgttcatgtttgtttttatgaaccacgttacttactgtaagatcattacaattttgctgacttccttgaatggaaacaaataatgacaagctcgttacaacgttcaagcaaacctgaaaaaagaaaaaacaactggcttagtggaattttcattcatggttgaaacattgtcgtaggatgataaaaatgtgagcctcctgattcttttctttcctccttaaaatccgagagtgtgtgtcatgtggaaaccctggagaagacagtgttgctagtctgttcctgttcgtgagaatgctttgaatggaggctcactgtgctgcggcggctgcggctgctgccggtgctgctggactgcaaagcagccagcggaaatgtgacaggctcctgtggcgtgagtgcaatgacagcgaggcgtccttgttcaccctgctagcacgtaagagatcgtggagagagaccagcacacgggaactcttgcccccattccttggccagatttgggtgctctgatgcacccgcttctcatacagcttttggggatcatggtgtagactatcaagaggattcaaaatgtctttctttgtattgaccatgtaagggattctaaagagggtatattgggactgttctgaagagcatccctctaaaatgtgtcctgtggcttgctagatatcagttgccttcttttgttcagctaaggaacttgaatgccttacctaatcactcaactggtagtaagctcgttttgtaaatgtgaaagtggatgttagaagtggcattcatggatgttcaatgtaatcaatagaccgtagtggcctggatgctttcacaagcaaaattccccatttctgccctccacccccatcctgtttccctggcacactgtatgaccttcaacctgaccagtgatatttgatagccttcctctccctctgtgctaccaccatttctggaaatgagatgtggtggccccgtcttgctgttggcatgatctgcctgagatgaacatgagcacaaccctcatcaactaggtctgcttggagtgtaaataggacggtgtaaataagctgctgcaattagtgtgagtgttgtcttgcctaaagagtgtgtagttctgcattttcctttgtagaagtttttctgtcactaaatgatccagcctgttgtcattaggctgggaaccgagcagtaagatagcaggaactggaaggaaggtttaatggtttagttaacgttggcatttatttatttagcctctcagtgcctaatacgacttttctccattttttacttggctattaattttttttgtaggttagattctgggaagcagtatatttatagagctcatctttgagtcacaatttgaaactaaaggaaactaaaaatataatttgtttgtaaactgaagtgtggtccccttttctattttcagagtttgttgacactttctacaaaaacttgaaattcaatgtgaatgtaaatctcatccatacgagacacagggcaaatgacgtctctcacgtttgtcaggcctctcctctggagtggctcagtgtgggccaactagttttctctccctgacccccaaatgtttattttaactttgtgttgctaacaaaaaagaattcccgcaaacactcgaaagaaaagttagaatatttgaaaagtactcagttgtctcagttgtccgcagagcccgtgtctcctggtgacctcactgactgacttacagagggcagtaggatcaggtgggactttacttttttctctctaacttgcttttaagcattttatcctgcattccagagtactgtagacttaagtattccctgttaacgtgtcacctgtcaccatgctttgtcctggggttgtcctcgtggcagcagcttctgctacctcacagggaaggtgtgtgcaggtggagagcctcctgacaggtctctggcttcaactgctgctgattttcctctgtcagattgtaggctggcctttactgtgaagctgagctgcatcctctggcccgttcctgttctgagtaggtggtgagccgcctttccccacagtgacagcagtgttcagtcttgggtttgacaaatgctatcagctgctccagacaaaacatccccatttctggaatttcagtccatgtttctgtaaacgaaaatactgaaggctttgcattactttgaattcttgaaggctaaattcagtgacacgttacagaatgagttagattggttttagcagtttttaatgctgaaaattttcacttttggctcagtttgatacgggaagaaaccccaaagtatttggattagaaacaagtcgtgatgcttgatcgataagcactttaactcctgtgttggctgacgcttctttctctcctggactgtagactatggcaccaccaacctatctttgtccattgtgcattgtatggcgtatgcacttgcaaaaatactctttaaaatagttataattttatcttttggttgtcttacccatggtggtcctttagatcctgtcaagtaagttttaataaaacactaggtagttatagaaaactgagaacaccacattgtcttttgattagtttgcgaaggtggagcaggaaagcctatccgattggaattgcaggcttcctagctgcaaactcttgagagctaggttgaaacccaatgacacctgcagagcggtggagggcggggagtgcctgttgtccacccctgcactgtggcgtgctgctgtttgttgtaggtagcgacgtactgagtgttccttgttagtaatctggagtcgtcctctgtatttacatgtactaaagtaactgtaaactaatggaacttgtaagaactttcctgtatttaggagcttttgtacagcaaggtcacatgtcctgattgaaagaagaagacatgctattacctatcatatgcaagggaaaaagctgaagtgaggagttgtctttgcattagctgtctgttgaattggggagctatggcacaggatcttaaatttgtgtttctcaaatgtgaattgtagtctaatgctgctttgtatagactaagtgctatggctagtctcagcactgaccgtggagtgatacctcgcagtgagcgcagcctttgttctagcttccccgactccgcagcactgtctgcgtgctggacagcttgcttatctgtctgctagcagagatacttcctgctttttcctttgttgttacatatttttatgtttgaaatttaatttttactactgttaatttaagtaaaatttgttccatgtataaattggcattgccagtgaaaatcaacagcctcattcatgacgctgctgaag

SEQ ID NO: 32003 - DNA, 1175 bp, Mus musculus
aatatttcatgtctgatgccttcatttcaacaatataaatcaaatcagtgatgtaacaggaaactgccccagcctccctggccttctccctgtccctttccccctctctatgctctgtctctctgcctctgtctctctctcctctctcctgtctccctctctctcccccactgtatatgtgtgtgtgtgtgggggggggtgtgcccgcgcacatgtgtgcctgttccatctttccccagggttctctgccttagacaatttgattctcataaaagtctcccaaactataagacatcagttaactgttgtaactgccgcttagcattaagcagcctgtcacagtggctcactagaccactggggattgttgccccaaggactcacacatatgggtatgtgagcccagaatagaggcctttcatgaaactgactggggttttatcaaattgctggtacatgattatacctactcccctcccaggttgctacctagtaacagtcagtttgcttatgcctaaacacccccttaaggtctagcagaaacctcagccataagagactattgataatttctgaaaagaaattgttgagacttccgagctcattccagatcttctgtcttactttgtttcaggattatagctcatccacattttaatctgatttttggttatggatggttgtctgaatgatagacctcccccccttcttaggatcattttcagccctccaagttcagtgggtcagctgcaactcactccatgatatttagaatgtcttcctgtctgtctgatattaaatccttttctagctgacatccagtgttatcagtttatgcattcaggtctagtgacagatgcttgtgtccccagtgcagagttggtgatggaactgatcactgttgctcccatgtcccatggtttgtaaatcagtgaactccagtgattgctcatgtgtgtgggaatccagtccctctatgacaacttggacacccccctatgcaacagtgaatgacagggacatgagctatctagtaaccaccagtaaccactagtcatcatggggatgtactgcacatttcttaactttcactttaaagcattttcaaagcctctggaaatttgcaagcagaggctaagaggagaagctgacctggcgactcgcatcccatattg

SEQ ID NO: 32004 - DNA, 1147 bp, Mus musculus
aacctaatccacaaggaagactgaaggcaagctcacggagagataaagaaacagacagacatgttgctaaaactcagtcccagcctctctgacccagctacactcaggagtctcatcacctccaatttcatctgattaagacaaagacaaagtaagcacgttttttttgagaacaaaaatgaacagccatgtgggtttttttttttcatagtattcttcttcggcaaaaagccaccgaacttttttttttttaaattgtttccaaggatgaaagtgactttgccaagcaaagtggcttcaaaacaggcctcaaaaatactaatagaaagacagatggttctactaagagcttggctgccaaaaaaaaaaaaaaaaaagatattaaaaaaaaaaagaaagaaagaaaaagtggtgctattgaagccggctgcaaagttatctggtgactacaaatacttttgtcccagagcgtgtgctagctttgcctgcagagcccaagcagccaaagtaaagactgtttcttctcttccctgtgcccagccatagacaaaccagtaggtgctgagcgcaaggaacagcccgagcatgcgcttggctctcttctgcaaaaggaaagtagtgctacgttaaagaactcctgttggagtaaaacaacccaccaggaaatttacttttttttattggacactgcctatcacttaaaaaaaaaatgctgattcgcctgttcctcctcacccctatcatgaaaagaacctgtgagccttgtgagctcacaaggtgcaaacaccaaaagcaggcagtgaggaggcggggcagtgacttgcccggagggaggactaacccaggcgagactgcggtgctcctcaaatgatgaaaattaagacccctgatgttttaacacagggggattgcctcctgggggcggggcatcacagctttgacttaaatcttatctaatagtagactctattttaaaaactgaatcattactttcttgtagagccacacttttatatgcactgatgtcacatcaaatgtcaaccaagtaatagatgttcaagtaataggtgataagacagagtatattgtcgactcagggctgatattgggaataatctctatccgaagcatagtaacagaaaagcaa

SEQ ID NO: 32005 - DNA, 1169 bp, Mus musculus
atacagtataggggttattttgccttttgtattcggaactgccgagccacatattgagccgatctatgttttaaaaccaggcactccactcttaacttgtaaagaggcttgctctctgtggggcaggggagggggatcctgcccttgttccttcaaatcctccttatggttatgatcatgatcctcctgtctcagtcttcctgataatccatgagcatggtccacctgcctcaaaatgtacctgttgtcaagtccctccaccccaggtcccacctttctacttctaagtctgtgatatgaaactgaacccagtgaatgtccagcagggtaagggaatgtccaatagggtatgaccacttagcactagaggaaacgaaatccccttctccaagaagcgagatgcccgtctcttggctgcccctccaaccccatttcgtgaggtgaactgtgaggaggtcacactctaaccctttcctgagccagatcttggcagcgttctcaagggcatctagcatgtatctcaatgagctagccttggcctgggaccttctcagtgatcttagctgagaaagtccctgctcgtcctgtgatggtgctgagtgtctggaatgttctggagcctcctggagagcagcagcagcagcagcaccgctttctatcgccgggaagtttgtttggaagagagtgacggacaggcacaaaatggctgaaggatttctgacagacaaagcttctcgttagtgacttgaaaggacgccttgatccaaaatagtattaaacaagtgtttcttcaatatgagatcattatgtgtctcttctaaatccaaatactaattgcaaccttgctgtgagcacgcagcattaagacggccatagccatggtaacagagtgccacgggaagccggagcctgtcatctgcacggtgtctttagtggtttgggtggcaggcagcacttcctactatgtctctaatgtccagctcaaagagggaaccacaccgcacaccttcaggtaattctgccttgcaggctctgttccctttgaacatcgcccgtctttataattaatctccgcgcaggatggcttgctaatgcccaggcaaaaatgcaagcacaaattaaatgttcagcaggcatggtacagtggccatttacatttcaaaattatg

SEQ ID NO: 32006 - DNA, 1198 bp, Mus musculus
atacttaggctagtttgagaaagactgacattcaacagagtggtcatacctaagacatcttttaggtgatttgaggcctaaatgataagaaaaagtcaggcataaaaatacgtaggagaagaaaattctagacagagaacagtaagcacagtagttctgggactgttgacaaatgaagacgaggatgaaggaagccaatggccaaagcatagcagagggtagagggttagatcaggatgaggtcagagtggttgcagtgccttatgggtaataggaaagggtttagattatatcctgggatcacaatggaggagtggcctaatctgatttataatttgaaaagatcgctgtggagaatgaactgtgggcatcctgtattattaatgaattgtaggactagagtcacggtttggtttggataaatgtccctccatatggcctatgtggtaaaggttggctctccagcctgtggttttgttagagatggttaaaccttcagggtgtggggctaatcagtttcctgccctttattttccagccatgatagcggcagttacagtccctatgctgcccccaacaaggtgggttcagagcaccaggacctatcagccatgaactggaccttataaaacgtcaattgaggtaaacctttgccctctataagctgattgactgatgcattagtttacaataacttaaagcacattaatgtgatgggtgactggctcaggagaaagtcaggctggcttggaccacttagaagtattcaggacagatgcaggggaagtttaggggtgctcaaccattatgaactgggatggaagtaagcaagactgactggaggataatgaaggtcggctctgttaagccgtgtcatgattaagacggccattagagttggggaagacaggattgtttgcttaggagggtatcaaaaaagggaagtcgagttttgccctttaggctttcaatacagagatcctgctgtatatatgcatttaaggctcactagtcagagctggatgcacacataaggacattgttatcatcttggcttgtggtggtagctgaagccatagaacggagtggtcccttacacccggccatgtaataaaagaaggcaagagaggcccatcccaaatcccaagtcgctctaagatgtcaaggtcaggagggaagctcccagtggaggaattaa

SEQ ID NO: 32007 - DNA, 1105 bp, Mus musculus
agtgagttaaagtctagtacactgacagacatctgcatggccatgtggtgaagacccagggcacctgtcactgaatgaacacaagagaaggacaaatggaggtggtgaagagagaagggacagtctatctttgggtgtgaactattcatgttttttgcagaggcctcctttttctgccaggtcctgggaccttcagccttcaaagtcagggccaagtacagttagtgttgccagtgagccagcccagtggcctgtcttgctagagttaaactttgagtttatattcctggtgcatagaggttctttactcctaacgtccagtatggaaaagcaccatggtgtgtaagctctgttgtgtctagtctttagtcatttcattctcagatacagaaagccccgaagccaaataattagcgatatgtagtctgtcttttccttcctccagagaattgtacaccactactcccatttctggatgaagggcaacagatttggaaattatgtggcttacaactaagatgtgtgccgtgccatgtggttgttccctctggctggtttcagaaggctgtgaaaatcttcccaaggggtggggatgagatggagatatatctcttcagaccccagggctctggcacctttcccaggaacaccgatgagacttctttcatttctccagagatttgaatcaggttccaaaaagctagtgggctgaatcactagcacgtgggaggatgaggcaggatgatagttgtgagtcttaggctagcctgagctacacactgagttctagtataacttggactactgacagacaccctctttctaacataatgaatgagctccaaacactaagacagttgaagcaggaggctgcaaattcaaccttcggtttcagtagcgtagcaagatggtctcaagattaaacttgtgggtttgcacacacctgcacacctgcagatcttctctggttgatgtccagtagggaacgctccaacagcatgtctacggctaccgcacagaggaagcctgaacgacacaggtataggatctgtgccctttgacttggtggctgagaacagatatgtaccgcaagtttcaacctcag

SEQ ID NO: 32008 - DNA, 1090 bp, Mus musculus
tgataacagactatgaaactgacctttgcaatggcttctttatggggatcaaaggaacatctgtaattccttttccctgttcattatttgtttaattgcaggggcgtaatgcagcatgagggttgaaattgtatccgggcaattacccattcttcaagactcactatcccaacactaattgatcgtttaaggcacaagacagtagagcattaggaccatgtaaagctaatctgctgggcaccatcaacaaattaatattattgctgatatttgcataattcactgcaattatttaatgtttaatcaggatgtgcagatgagactccccgggtcacacgggagtgggtgtaaccgggactaaacaggcctggaagctcacgaggattctcttattttgtatagctccatcttttcacaaacaagccagatttcctcagaacacatgagatacccaggagttcaggagtagagcaaacctgagccttggctaatgtggcttgccgatgcaatgtggttgttagagttacttatggaggactctattaagggtgctaaagaatggataaatgagcgatagctggcagcctatgtttgaaaaaattcaaagaagtgactgagaaactttgttagggagctatggtttttcctgatgtaaaaagaaagctttaaaggggcttgggagaaggctcagtggtaagagcacttgctactctggtagccaccctatagttcgctttcttgaacccacctagtagctcacaactatcttaattccagttccagagtatttgacagagtaaaggtcctcttctgacctttagggggagctacatgcatgtgatgtgatgggaagacacactgcttccaccacttgtatgtaaagtcttcttacaagagaaacaagctctgcggtgatgtgtctgctctgtgaagaggtagagagcctatctcagtcacactgggatacaatcctctttgtatcattttgttacttgttgcttggtaataatgtagctgaagacatcatcttgcggggctgagcgctcctgggctcctggtgacagctttgagcatgatgtagggaagactt

SEQ ID NO: 32009 - DNA, 1856 bp, Mus musculus
agtcttttacagtccaggctagccttaaatgcctgtcgatccttactgccttcacctcccaagtgctgggactacgggtaggtgccaacacactcattttctttttttagaagattcgcttttatttttaattatgtgtctatgggaatagagggggtggtatgtgcacatgaaacagagagggtgttgaatccgctggagcgggaattaaagacttttgaacccaggtgctgatagaagccaggtcctctggaagatcagtccgagctcttagctgcagagcccctgctgcagctgatggagcctgtggggttttgttgagctgctcgcttttagactgaagcacgtgtttttgcttttgtttcagtatggaagggtggagagtgactggacaatcgagctaccctgacggcaaagctcagggtatcggtgacggtgccacagaagagcgactcctgccctcgagctgggaccacctgtgaccatctagtcttgcacattgtagtcgcgttcctcatgtgttaccaaatgaggtttttttccttgagccacagaaagttgccagtgttcaatgccacctatatacatggtagcaattgcttactgtagtctccctcaccctgtaccagatccttagtaggagaatgggttcccaaaccaataagatgtctatgtgctggaagggctactgaggaaatgtcacaggcggcctccctgtgactcatgggcactctcagagcaggacactttgtttcttttgctggtgaggttcttttgttttttgttttggttgttttttttttgtttgtttgtttctaattggggcagatttgggctccccatgcagccctgctggcctggtgttccctaatgttcaccccggctggtctcagactcagagcagccttcccgtctccctcagccttctggatgctggggtgattgacaggcgtcctaccatgatttgtttttgttttttaatcaaaagttcggtcacctggatttcttttctccgttggtccctgggtccacgctaaggtgactgtcccttcttcgtatcacggtctgcactaatctcacccaaggtgtctgaggctggttgtccgcactgccctttttacgtaactataactggctgctcactgcgctgctatgagactaggggtcctgtgccttctagatctttgcatcctcaaagcccagcacatagtaggtattttcagtacatgtttactctaagaatgaacatagaagtgtactttctgtctctccatgctgaaaccctttcggaagccaggcctgatttgggcagcatgtagcagtatttacctcaggctgtctttcctgtccatggactcctccagacagcacagtcagttggaagaattgtcttatgttttaagattatcttggaattgaagcgattgccctggaaagatgaaatactaaccacatggaagtgacagatactatacattatgtgttaaatgccaaataaagggtcaggttgggagataaactctggatttgaatcttaatctacactttgaacccttctcttgaaggagcattgacgaagcgcctggctagtaacagacactaattccagaccatgttctccttggttaggaactgtgagtgaaaagttctctcatggcccagcttatccaggagaaagtcaggtcttgatagaaagcctcggaaggtcgacactcagccatggtacatggtttcctggtttccatagctttcagcttactgatggaacttgggtctcttcagagcctcagggggaagggctttataaaaactccacccattagagacagtccttaagacatttaacatttaaccat

SEQ ID NO: 32010 - DNA, 1166 bp, Mus musculus
ggtttgttttctgcctcttgcaaaatatatgaggccttactaagagttagattttataacttttgcccaagccagttttagtttcaatgtgtttcttcagttggggtgtttagcaggcgaaggggggttggagaggatgggtcaggatgaaaacttcagttcctagcacctatacctggcagctcatggctcacagctgcctgtaactgcagctccgggagatccacaggcacttgcgtacttgggcataaagtctctctctctctctctctctctctcacacacacacacacacacacacacacacacacacacacacacacacacacacacacaattaataaacaaacggttcctgtctctttacccatcttctctgtctcattgataatctaacaccatgtaacagagaaacctccttcgattctcctccttggaggatgaagatggatcccacagaatgcaggacagcaaccaactgcaacatttgcagagtcacaagccatgtctgtggggctctgtttcctcctgggtgttctggaactcgctctggctcctgggagtgtgttgtggttgcagaggaaaacgaatacttctcacccaaatgctatcatgtagccggctctgtctgggaaccaggggacagatgtcccatgtcatctgctctgtctggggaccaggggacagatgttctatttcttgacctcaggctggcggttacagcaggaggctaaattcattccatagaacagcctttgcgtgtgtgaacactgctgtttgggtttaactcggtgttgtcggagagctacgctaactgtaagaaaggtctctctctgtgtgaaaactgcacacacacacacacacacacacacacacccatgcatttctctgtctagctaacgagttatcccaaacacatttattttaagaccataaacacttaacaaatgacaagtacccttgggaacatcgccagtaccaatctcttctttctaaaaagtgattttcagaaaataaatggtccctgctgcagcccagcaaagagaattcattcattcatattttaaaattaaaaaatacttattatggaggctggggaaatggctccacaatccgtgattaggagcagtagctgctcttccaaaggatccaggttcagttcccag

SEQ ID NO: 32011 - DNA, 1099 bp, Mus musculus
ggagatcagtcagtttgttggagcctcaacccagggtatagcctatggttttcccaggcaagacaatgtcaagtattccttagccaaattataagaccactaattttccaaatttataagtggattatagtaatcttgggggttggcagagaaagagaaagactcaggtagacatgcgcctcctgtcccagtgtctggaacaattggtcctcccttccccccgttggtgtgtccacagtgcatgtatggagatcagaggataaatcgtggaagtgggttaactcttgccaccctgtgggatctgaagatgtaaggtcagtaggccttcgaaggaagtgagccatcttggccaccttcaagtcttaaacgctaactctctctctctctctctctctctctctctctctctctctctgtctctctctctgtctctctcttcctctctcttcctctctcttcctctctctctctctctctgtctctctctctctccccctagcaattatggagcctcccttctggcacagtgcgaggccgtggagaatggctgtcagcaggtcctgtggctgtacggcaaggacaaccagataactgaagtaggcacaatgaatcttttcctctactggataaacgaagacggaggtaattgctcttctggtgtcttgacagctgatgctgtcaagagcgcagggggcggggacatcgagggcagtgcggggctggggactatagtggctgctgtggagaccgcatcagggttggtttttattcttgtttctgctgtttggcttgaaaagcttgagactgatttcaaactgagctgctgtacatatggctcagcatgtaaaagccctggctgctcttgcagaggacctgagttctgttctgagcaaccacactgtggctcacaactgtctgtgactctaatttcaggggatccagccctcttctggactccaggggtactgcacccatgcacgcacacacagtgtatagcccaggataaccttgaagtcattataccacaagggctggctttgaaatgttagatcctccattctgtatggcaagaatatatgggattgtatcatacctggct

SEQ ID NO: 32012 - DNA, 1193 bp, Mus musculus
cagcaactgcaactgacagctgtgtttctccctctgaaatcataactcagaaagcaaaccaaaacggaacttaaagttcttttaaattacaatgatttgtttatgttgtgttgaccgtgcatgccgtagcatgtctgtggaggtctcaggtcagcttgtagtggttggctctcttctttccaccacgcgaggctcagggaccagactcaggtagtcagcttttcaggtgtggcagcaaacaagcatttatccactgaggcatctgtgtcccatccttttatcccccacacccaaatttaaatacgcattctcagtatattctttaaaaagctttgtgtcactaagctttgtttgggtgaccttctgggatgtggacacaggtctattttagactcttaagaaggatgtctcactgttggttacagaggcatggtttctctctttattacagccatctcttggcgtcaagaagccttccaaagccctactctttgtgatcctgagccccgtgggaccttatttttctagtggatcttttactccggtgtccctgtgggccaatccaaagtacatcagagcctggaaaggtgggactggagactgcaagatgggcgggtaagtcggtccctgtgtccttcctgtatagtgacagttgtgcgctttcaatggcggtgtgcttggtagagttcacaagcgagtagctgtctgtggtttaagatttagctttgtaaacgtgttagttgttggaggtgttgcttgtggcccctctaaggcagcagtgtggcatgggtattgtgtcccactcgaccggcaagaaagacgcaacaaactggaatcttccgtggcaaaagctttattgcttacttcttcaggaagaccttgaaccgggaaaatggcgccgcctttataacccgcagtgtgacgtttcagcaccccgatatggcgtgacggctcctgattcgttgctcgcccatcaccccactattacactccgagaatgggagtgactaggcgtgagttcactcttgcacctgcgtacaaggcttgtttactagttaggcacagcggaggccagcgccatcttataatggcgattgctcgcggcacggctctccacacatgggcatggagcagtgacttgaaccagggtcctttccagctagagactggccctggggatgatgctttcactt

SEQ ID NO: 32013 - DNA, 1185 bp, Mus musculus
taaaatccaactataattgataagagaccacagatgtccactttaaaataaagatcataacttgttacatttgagtgtaaaagtataactgatatgggagtatgctcaatagggatctaacatctttttcaaaaatctcatttatttatttgggggcagggaggtgagtgtagagttcagaagcaacttggctttctcgctatcatgtggttatcaggcttggcggcatgaccccttacctgctgagctgagccatcttgaagcctcagagaatctaacgtcttatcttttccttatgaataattcatagttttccagagggattcacagatttttttttttttaaagcatttattccgggtacctctcacgatgtttcatgttaggaaagagtgaataaaagctgttgaaggagccaatcggcactgcaacatggggacagttttgaaaattgagcttctgtctgctctctgatctgggagtctgactgtctgtcctttgctggaactcaatagggattctgtcctttcagatgtttgacaaggaggagctcctaaagtgtattcttcagcttctacagatcgaccaagaatgggttccctactccacctctgccagcctctacatccgccccacatttatcggaactgaggtacggcctggctctatttaggggatatatatatatatatatatatatatatatatatatatatatatatataatttaaagtctttaaaaaaatttatttttatgtgtacataagtgggcttgtgtgagccaccacgtgtgtggatgtcagaattgcatcttgggtattgattcttctactatgtgtgctgtggggatggagcttgggtagtttggattggcagaaagtaccttcatcctcagagtcatcttgtatgccccaaaggtaattttcattttttttttaatcactcaccccactaccaccacgtgagcacacaaacacacacaacacacacacacacacaaacacacactacacttccacatacccctccctgtacacacctgtcccagtaattttttgacctcccttgatggctagttctggggtgtggctccctcatgacagacccttggagatcgatgcggtcatgctgtagaaagtttgtcagagagaacgcttggttttatttttattatcctgaatcctt

SEQ ID NO: 32014 - DNA, 1173 bp, Mus musculus
tgtctgtcttggcagttgggattacaagtatgtactaccatgcctggctttcatttatgtcgattctaggattgaactcaggtcccatgtttgcatgcatctatgtgatcatttgtgtgtgtgtgtgtgtgtgtgtgtgtgtgtgtgtgtgtgtgtgtgtgtgtatgtggctggcatgagatcaccatggtgtgcctgtggaggtcagaggacaacccacaggagtggactctctccccctccccctccccttccctctcccctcttcccttcctcttccttggccttccaagattcatacttaacttctgaccaggagtggtggagtggtgctagaatgcttagattgccctgttctgctggctgatcaggttgagtactgaaaggacctttctattccctttctgttcccacattgctcccccccctcccctctccattccagttaaggccaaggatagcaacgtaaccactgagattgtcttagtcaccttctgagacttttctcttctcctcagctgtttgaaggcttgaaagcctttcggggagttgataacaagatccgattgttccggccggacctcaacatggatagaatgtgccgatctgctgtgaggaccacgctgccggtatgaacatttgcattcccttctatttcatggttattctgctctcacacccccccccccccaaaaaaaatctttgctgaataattgcatcagaccatatgagagtgaatgctgacttatgtatgtgatgccttcaattagaggtcagagggcaccttgagaatcagttctctgtactacacgggatgatggcaagccccttaatgtgctgagcatcttaaattgtacattttagtacggctgtacgaagaagaaaattaaaacccagcccagggaggttaaaccacttgtccaaggtcactcagaaggaggacagcaaagtgatctgcggtttcctggtccatgcagtcatggaattgattaaacttcatctctgctcagcacccccaagacctgacttgttgttggcacaggttacttggatagccagccatcctcacatctgacacctctgcaataagatcatgctcctgttccatgatcacgctagtgcactgtgatcatgttagtgcagtgtgatcatgctaataatgcagtgtgatca

SEQ ID NO: 32015 - DNA, 1218 bp, Mus musculus
gggaggtgcatgtacagtgcttgggtgtagctcagaggacaacttgtggagtcttggttttcccctttcaccatgtaggtcctaggatcaagctcaggtttgctggtttggtggcaagtgtctttacttgctttgtcaccttgtcaggccctgttgcagagattttgaacaattgactgaactctgagcacaggtttggtctatttggttctcagtgttaacggtatgatattggggttgttatttgagacttgattgggtcagtttttttagacaaggttggaacttctgaatctcctgcctccacagtctttcagtggtcaaacccggggcttctgcaagcaccccaccaactgcagcgagtcctcagacacccccagtgttaaattctgtgctgggtgtggtcgtgtcatcaccaaggaatggtgttcacattggacctttggaccatctagcccatgcagtgtgggctccaggcactttccctttctcctctacaggccaaagatctcatcatcacaccagccactgtcttaaaagagaagccggacccggattcgctggtctttggagctacgtttactgaccacatgctgacggtggagtggtcctctgcgtctggatgggagaaacctcacattaagccttttggaaacttgcccatacatcccgctgcctctgttttgcactacgctgtggaagtaagtgcttgggagcacccgtgggccgtgattctctggccttgcaagcttctttagggtcggggacaggccctgctgtcttaactggaggttgtcataaacatcttcaaacttctcctgcagccaagtggattgccgataagtctcagagctagttttgcaggttggcttggcttatctgtgatattagtaaaatgtgatatgtgtgtgtgtgtgtgtgtgtgtgtgtgtgtgtgtgtgtgtgtgtgaaaatctcagcacttggtaacctaagactggatgggccgaaagttcaaggctaaccgagactatgcctttctttctggacagcctaggccacagaatcccaaagaaccctaaagcaatgagtattactaatttattaggtgctctctacttctcagatctttgagtgattgtgaagggtcggtcacaggatggggcgctgtgctaactgctttcttataaccagcctgtgggatggcattgagcacgctccttcaccgtggagtgtttg

SEQ ID NO: 32016 - DNA, 1130 bp, Mus musculus
aaaaaccacggagcacgtttacagtcccagactgcgatttctttcccttgcattgtttggtttatgtatgggcacggtctctgcttcccagcggagttattggagggacagagatcttattaaagcacttgacagccctccatccttctccaccagcccccagcctgaagggttttgcagatcttcgtgggtgcttggctctgccactttcctggctctgatactcactgtcaattgtcacccatagtacagaatgtccctgtgacctcacatcctggcagggttcagagagggactggaacttgagtcgtctgttttgaaccacaggggacactcagtgttcagggacagtgctaggagcacgaagcggaatggtgaattcaggataagccctctgctcacaaagcgatttgttttaaaccaaaatatagtaagatatactacagtgaggtgctgtggattctgtctgtgtgatttctggtgtgttaacgcaattttcctgtagcacttccgagaggcccacattggtcacgtgtgagtcacgtgaccagtcagtggagcgggggctcagttctttaagcacctccaggactcagctctaataaacgaaacatttcgggtcacattggctgacctagaactatacaggctggccttgaactcttgctaccttttaaagacaataattcaataaatcaatatctcaaaaaattattgtatgcatttcaactgaaatgactttatggttttatgcaaagcattcagtgcaagatagagctcatagtgaaaaatagtgtatctgttaattgaaatttgtacacgtcctctgcgtagcaatagtaaagcgtgacctactctccttgcgttttaggtgtggactgagagtatcgataatctggggactagaaatgacaggttttattgcttggctttgcatggtgctgattgttgaacccaggcctttgcacacactaagagcctctattactgagtcacacacttagccgtgatccctgcttcttacagttttctatctgctaaggaactgctgctttcctggtctctcctccatcctcttcttattattctgttctcaatcctcacatattaaaaaagtgagggtgctagct

SEQ ID NO: 32017 - DNA, 1215 bp, Mus musculus
gtgaggaccatttcacattaaattacttctgtatgtgcacatcaaaggatgcaaactaagagacgactacagagcgtagaccacagactgagagtgagagttccatccagggctcagatggtggaaggagagaaccggctcctgccagttggcccttatccaccactgtccctgtccatctagccacccgctcctattcaaaatctattatatttatttaaatgttataaaaattagagagaaaaggagttggtaagagtggttgtatttgagagttgtctgtggggtgtggagcgtgagagcgagacggaaaaacccaaactcttctttattatccaaaatataccttaaaacttcccagttctgagactagatcctagtacagcgtatgattgggggagggactggggaggtagcaaatgaatcaaagacgctttcagatttgtcctcctctgctacctcccctcctgcgatacaaatcactggaggggatcagtgtctccaccctggagtgagccagaggtcggactgtagctcgcggctgagccagtcgctgctgatgcaatccgcagcggagcgcgcccagctctccatcttccgcgcttgccgaccgaccctgagcgccacgtgtcactgcacagccgcctcctccagaggagactcacatttgcacccaggagccggagccacgacccaagccacgagaaatgaaggtaagcgtattgctgaagttcatgctggaatgcagctactcacccacccggaatatctcggacactgggtggagagaggaggatggaaggaccaacttgctttgtcccccgtcctgggctactaagcgtggggatctggcctcgtatccacccgcagatgctcccgctccggttcttgtcctggttctgtaaatgcggtacccagatttagaggatgccacagcgcctctcctacatgctccctaggcgggaagaaggaccgtatcgttgcgtttgagctgcccagagatagggtttggcgaggatgctcggacgctcttctgggtagttgtaatagaagggggaggaggaccctcttatctgccgaaagcagatcgcttgtcttttaaggtccaggttccaagtggaagcttccgagttacggaccactcgagcttcaggaccagagagtgcaggcggtgaactctaattatcatctgagatagctagcccagaggccagc

SEQ ID NO: 32018 - DNA, 1166 bp, Mus musculus
caaacccgactccagtaacttcaacagtgcatctctctggaaaatctggtttgttatcttatcactacaggctcagcacagtctgtagcctattggaatctgctacagcttcatgcatttactctgtaacctatacatccatatgtatatatatcagtacatttgctgtgtgctgtatgatatgagaattaatattagtaactaaaactagaatcaaagaacctgccatttagccgggcggtggtggcacactcctttaatcccagcacttgggaggcaaaggcaggtggatttctgagttcaaggtgaaagtataacaacataaaaacagaattctaggcctttaggcccaggcttgggaatgtggcctttgtaaaggtatgctaatcataaaacaaatagcgacattcctccatccacccgcttcctgggttcaaagagtgctcattcaaagaaagtcacccagaacctgcaatgcaaatgtgctatagttaggggctcttagaagctgtcttgagagttaattaccaggtattccttgtgactcttgtaactttacacttccttgtgactcttaactggtatctttggtatcttccaataacgccctccccacttccttgagttgtggtttcttcctttaaatacccccttacccagctactcggggcgacacggtcctctacccctgcgtggtgtatgaccatgggcccgagagcgctcttgaataaaaatcctcttgcaatttgcagcaagacccgtttcttgtgggtgattttggggtgtcgcctctcctgagtcagaacgtgggggagtcctcacattgtgggtctttcaaaggccagcctggtctacaaagtgagttccaggacagccagggctacacagagaaaccctggctcaaaaaaaaaaaaaaaaaaaagaacctgccatttgcccgaaccatgctaccaagcaagtaagtgggaccataggacactgccactgaaactgtaggctcttgggaattgttacaatacattccgacatggtgaaaagacacaagtgtatccacctatgtttctggcatatctcactcatgacaatgtgtagttataactcaataaaatgttactcttaaaagtcaggtatgacttagtttttaaaaagctgaacagatagactgc

SEQ ID NO: 32019 - DNA, 1190 bp, Mus musculus
tttagtacctttcatgataatataattttgaaagaaaatacacttaatttttaaacatgttatagccaattttcttaagtctatttcttcatttactgatgagattgtcactatcgaatggtgtctgacaggcttgccctttagcttctagagtgtctttgtccttgttttttgttgttttgttagcccatctagtatactaaagtgcatattcaaggctctctacagacacctcaaaatgatttaaatgcagttatcaaaataagacatgtgaaggtgacctctatcttgagaagctcagtgggtgactagcattgtgtagctattattcccattattctttgtgctgctggcctgccttaagttctgaaccacttcaagtagctttcatgaggagttgtaatgttcctctatttctgccattaaagctggtatattttctgtcgacctgtaaccgagtccatgtggcagtggacctaacccaggcaggactgtaagtttaagcaaaaatgtttatgtaatgtttttagcaacgttataaataacatttctaacttaaaagctgcaaatagtgttgcttataggattctgtatcaggctggagagatggctcagtggttaagagcactgactgctcttccagaggtcctgaatttaattcccagcaaccatatggtggcttacaaccatctgtaatgggatctgatgtccacttctggtgtgtctgaacacagacagtgtactcatagaataaataaataaacgaataaatcttaaagtcttaaaggagtctttatcaactaccaagcagacatttccaccaagaaatacctatagccaggatggggatgaggctcagtgttaagtacttgcctaaggaacacgtgaggctccaaaattgagccttaaccacaattaaaactacataattacacacttcatagtcaccataactatttttattacattacaatgattaggagcagtacggttcatgacaaaaatattacaaatttcagatcacttcacagcacgtactcctataaacatttaaaagttaattttaattaagagtggtcacttttaaatttaatgtttgatatgaccaacattccctaggtcagcgcaaccaaaggatggaaaacaactggatcacactgcatatgtcccataacaaacaaacaaacaaa

SEQ ID NO: 32020 - DNA, 1206 bp, Mus musculus
catgaattctgcattgaaaaattgaacagataataccaatagctgtaaattctgtcaaaacatgaaaattatttctaaagaagtacattagttttcaaagaacagttattagaatcagatctgtggtttagttcaataatttgaagtgcctgtttgggatggtggtaggcattttagatgaatttgggaaaaataaagttctgcagaaatgccagtttcagaccccgctaacccgctgagtgggctgtgtgctgtgttagctccagtgccccaatcccgtttcatgtcttcatgttgaaacacttctgcatttttatttgagtgccaatttcttactagtgctatttcttagtgtaacatgtttacctgggatgtattttaactatttttgtatagtgtaaactgaaacatgcacattttgtacattgtgctttccttctttccattccttttctttctgttttgtttgtttgtttgtttgtttgtttgttatgggacatatgcagtgtgatccagttgttttccatcctttggttgcgctgacctagggaatgttggtcatatcaaacattaaatttaaaagtgaccactcttaattaaaattaacttttaaatgtttataggagtacgtgctgtgaagtgatctgaaatttgtaatatttttgtcatgaaccgtactgctcctaatcattgtaatgtaataaaaatagttatggtgactatgaagtgtgtaattatgtagttttaattgtggttaaggctcaattttggagcctcacgtgttccttaggcaagtacttaacactgagcctcatccccatcctggctataggtatttcttggtggaaatgtctgcttggtagttgataaagactcctttaagactttaagatttattcgtttatttatttattctatgagtacactgtctgtgttcagacacaccagaagtggacatcagatcccattacagatggttgtaagccaccatatggttgctgggaattaaattcaggacctctggaagagcagtcagtgctcttaaccactgagccatctctccagcctgatacagaatcctataagcaacactatttgcagcttttaagttagaaatgttatttataacgttgctaaaaacattacataaacatttttgcttaaacttacagtcctgcctgggttaggtccactgccacatggact

SEQ ID NO: 32021 - DNA, 2983 bp, Mus musculus
gtggcttagactgttgggtgcttgttctccagacccctctagtgtcgaggtttgaagcattggtaggttaagattcctttcagtacttcctacaggatgagcaaacaaggtgaagcatggccactttctgttcagctttcctttgactctagtgtgaacttgggattgaaggtctaaagttggctcctgaagctctgctcctagaatgctcttgtcactcccggggttaggaggttgggaattactttgactgaatcagttttagtcacaactcatttaggtattttactttaatgaaacataggtgtagactttaatgactaatgttgaatgttctttgaagacggggtatttatatgacaaattttgaatagctaaatggtaaagcagtaataagacaattttggagggtggtcaagtacaccaccggtcagacaatttcacttatcatcagaggacaggggcatcacagcttttaaggcaccaatatctacagataatgtggcttactgtctgaagtccagaaacttggggggacaattaagatgtatggacacctaccatacatggaggcaggcatggggagctgagtggctaagtttgctagtagagaaacattagtgggaatcaagtccttttggagaaaaagccatttgttagacttacattgtgcatcacttactatgtcgcctgttgtgaaagtcagagcttccatttaaattatcagcacgcctgagccgggaaatggcttagtggttaggagcacccagctaacacttgtcagtaactcctgtccctggggatctaatgtctagtttgggcctccattgggtactggactcacatggtgcagacatatatgcaggcaaaacactcataccataaaataaagttgttataaatgtcaggtagtttgctttgaaagaaagagtaacttgaaagtatacaagtaataattattttgaaattactaaatatctaaattactaaatatcaggtattttgttagatattttaatacctaaatttaaataataatttaaatttaataatttaaaagtctaaaaacatcaactatccatgaagagatatagcctaaagaattcttaagcccattcggttgccaaaatataaccataaaacagaactacactctgggtactcaagcgtccattaacagtgaaagtctgtcatctgagcatggcaagccatcgcatattaacatgtcttatatatactttttttttatatttcagggtgttgacgatgccttctatacattagtccgagaaattcgaaaacataaagaaaagatgagcaaagatgggaagaagaagaagaagaagtcaaggacaaggtgtacagttatgtgaatactttgtactctttcttaaggcacacttaagtaaaagtgtgatttttgtacattacactaaattattagcatttgttttagcattacctaatctttttttttcttctgttcgtgcaaactgtcagcttttatctcaaatgcttattttaaaagaacagtggaaaccttcttttttctaagtgccagtattccctgggttttggacttaaactagcaatgcctgtggaagagactaaagacctgagactctgtcttgggatttggtgcatgcagttgattccttgctagttctcttaccaactgtgaacactgatgggaagcaggataatgaagcttccggaccatccctgctctgtgtccatctactcatccaatggagtcattagcagtcaatcgccgcttcactggacactgaggggtcacagacttaggctccctttgagtcgcgtccagcgtgtcctagactttatcatctttcagaggcgtaggcagactgttcacaaaggctttctgtagctttccactgcaattaatcttggtcactccctcaaatagtatattttttctagaaaaggggaaaaatggaaaaaaaaaggcaatggaaaatgttgaaatccattcagtttccatgttagctaaattactgtaagattcctataatagcttttcctggtaaggcagacccagtatgaaatagtaataaccatttgggctatatttacatgctactaaatttttgtaataattcaaacaactttagcatatataaaaagttctcataagaattaagtacaattcccctttgtcagattgttcttatcctaactttcaagtcttttttgaatttctgttgttgaaagtagttttaatggttgtgaagctgaagatgatctgagacagttatagcttggcaggtgttgaggagaccagagttgcagggttgggccttacgtgaacctgtgacgaacgctactgggttttgcagcactgctgcattcaatgttggcgacgcattgtttggtcaacataggggataaggagactttgatggcttagtataatgcattctcaccatgtaacagtcctactgacaaatcaagaaatttgtttataataataaaaaatttttaaaaatttcgatgttcgcttcaaggttgagattttggggtaggaggctacaacaagagtaaatcttaaagcaaggttttaagaaggtttgaaaatgcaggtttgactagtctctcaactctagctaaacaaacattcccaagtacttcccaaatctgataggtatttaaaattatctaatgctttaagaatagttaacaggaaaaaaatctcctcagtgcacttaaagcaacccttcacatcatttgaaatgagatggaaatatcactggactatgaggactggatgtctgtctgattttaagcaaatcactgtctgcttggttttgaatcatctcaaagacattaacctcccagccgtgtaacatagtttacatgttgacacacctagttatcaagctcagcacaatctgtaactgttttacatggattaacatcttcactgccagtcttgggcaaattgtgcaagaggtaaaattta

SEQ ID NO: 32022 - DNA, 1204 bp, Mus musculus
acaaattccctctcctggagctccccctttaaagtctagacagtgaacttcaatgacctggccaccgagtagcttatcataggacatatgtgttgagcagagctcatggctctggcgacctgaagagagacatgatatattcatttaaagaaaagttgaggttgggccactgggcttcctttttttccgacatcttagcgaggctgctgtggtctacacgactctctgagcttcgccatgccgcccaaagacgacaagaagaagaaagatgccggaaagtcggccaaaaagaataaagacccagtaaataaatctggtggcaaggccaagaagaagaagtggtccaaaggcaaagttcgggacaagttgaacaatcttgtcctgttcgacaaagcaacatacgacaagctctgtaaggaggttctgaactataagcttattactccagccgtggtctctgagagactgaagattcgcggttccttggccagggcagcccttcaggagctccttagtaaaggacttatcaagctggtttcaaagcacagagcccaagtaatttacaccagaaacacaaagggtggggacgctccagctgctggcgaagatgcatgaacaggttcaatcagctgtacatttgggaaaataaaactttattgaatcaaaaaaagaaaagttgaagctatttcactttgaatgggatcgtaagtatattaggtaatcagaactcctccttagtcctaaagcaattttatttacacactgtgttctgctcccacttgactttaagatctggagcaatgatcttactccactcatctctgagtcctccgcagagagtggagtagtgctgttacagtccaataaaaatacattactgtgtacctagatcatatactccaaatacatctatcctacctggcaaagtactgtgacttattatctagtattggataataatcctcaaaggaggattaccaatgttcttagtaacattcatgttcagagagtttcagtctttgactctccgttatagccaagcaagtgcaaggtcaaagtcagacagaagcacaggtcggggtcacctgccagtgcccttttctcttcactatagactgtgttattttgcctcccttgtgctaagcaagtctctgttgcaaagcttttggaccattaacagagacaaacatctttaccccgaact

SEQ ID NO: 32023 - DNA, 1099 bp, Mus musculus
agcctcatgtgatggcttacatttctaattctagaacttgagaggctggggcaagaggattatcactagagagttcagagcggaacaagctgctctctctctcgtgtgtgtgtatgtgttgagatatggttggacttgaatgtacttactctttccttctgagaactggaattccataatcctgcacaaccatacctagtggaagtcagttttaacagagataaaaggagtgcctgagcattcttggaaataaagtttgaaaatagacaccaaggtactactcaaaattgtataggtgtgtcatgcagtttcatgtttctgttctggtttccagcgtgagtgtatctctatccacgtggggcaggcaggtgtccagattggcaatgcctgctgggagctgtactgccttgaacatggtattcagcctgacggtcagatgccaagcgacaaaaccattggcggcggggacgactcattcaacacattcttcagtgagactggagccggcaagcacgtgcccagggcagtgtttgtggacctggagcccactgtggtcggtaggtgcttggggcctgagtggaggctttcctgggaaactggggtgtctcggaaaagcccaccgagacctgtgcagagtagacaggatgtacatatacatagtatgtagaattgtgactttgttgggtgagaaaattaaagttgtatgagctgtatgatatgtgtactcttagtgatatatatttcctaggagaaactgttgacatttgtgcttaatggaattgaacagtccttgcctgaaatactcacactacgtatggtctttctctctctagatgaagtacgcaccggaacctaccggcagcttttccacccagagcagctcatcactgggaaggaagatgcagccaacaattatgccagaggtcattataccattggcaaggagattgttgacctggtcctggaccggatccgaaaactggtaagagggttgtagaagaggcttcatatgatggttgtcccggtcaagggggtcacaggtagtgggggagttattttggcaaaaaggttagaatcaagaatctatcatgagtaccaa

SEQ ID NO: 32024 - DNA, 1115 bp, Mus musculus
tgcatatttttatgctagaagacttccattctcttatcctaaaggatctgaccgagcactcagtgggtaggaagaagtgtaagccattgcttttgtaggtaaaccaggactcacagtcactctctgcacaaccctagtgactcacaagcatgcacagaaagcagggactgtggggtgctgctgagcagtaggaggtggggtggattaggcctggccttcttcctctccttcaccgtacctgtctgcagggtgaccacataaaacagtgtagttctgaaaacgagacaccttagtcccctccagtgctgcactggtagtgagctctgtctgcggacagttctgcatgttctgtactgcttaggctttgtctgtacagctccatagtgtgttctgtggacagacagaaactctgacaagcagtcccaagaaccagtcgcacaggagacagatcccccagttcactccagttctcgacactggaaggcaggaatcggggttttcactgccggcttcccttgcacactcttgttggatgtgctttctctgtgcttgcctgttctttgggtaagttgatgtctaaatgggtgaagtattattttgtaagatttaagcatggcgtttacatgcatttaatcatgagacttcatgtcactcagagacactagttttgcacacaagcttcctatacttttaaaaattataattggtgatgcacatgctagatttatatctttttatgtttactaatattgtatatatgcatgtgcatgagatttttttcatgttaataatttctttaatcttaaaattaaacatttagcaattctcattctcaaaagagtcttgctatcttaaattattctttgaaatagcagataggtactttacattaaacactacactgcaaaccacttaatatttctcttgttacaaaggagatttcatagaagataaattattgtagatcattaaatactaccaccttcagacaaatggagcagtaattaattattgctatttctattctgtttcaccccaaagaacatttgaatcatcctctccagagcatagtgggatttttatagccagtgaagtacaattctgtatagcactgt

SEQ ID NO: 32025 - DNA, 1111 bp, Mus musculus
ggactgaccctgcgtctctcctgaggaagctcagaatgttcaaatctatgcaggtttagaagttcaggtcagcacctggggccaccactctttgctgtgggggacacattttcagtgttttttctttgcttcatctatccccagaagttctgaacacttatacatttgaccagagtgtaaattctctcagttgggggaaatagaaagtagaatttctaagcaagccagaaggatgcttataattcagatctgaacggtatgctgccacggctttgagaggtttgctgtcttctgaggctgccccaggcggcctggactggtggacattctgatgctaactgagaacagttttcagccatgtcctccgctgcattactgatggttgcatgtcccgccatgacagtgctctccgatcttttctgtctaggtcgaactggaaggtacaccctgatagagaaatggagagacactgagcggcacttggcaccgcatgaaaaccccatcgtgtctttgaacaagtgggggcagtatgctagtgacgtgcagctcatcttgcgtcggactgggccatctctcagtgagcgacccacctcggacagtgtggcccgaattcctgaaagaactttgtatcgacagagccttccccccttagccaagctccggcctcaggcggacaagtccatcagaaggagggagcctaagcgaaagtctctcaccttcacagggggcgccaaagggctgacggacatttttggaaaaggcaaagagactgagttcaggcagaaggtgctgagtaactgcagggcaacagcagaggagctgaaaaggctgatccggctgcagacggggaagctgcaggccatcgagaagcagctggagtccagtgaggcagagatccggttctgggagcagaagtacagctgtagcctggaggaggagattgtccgcctggagcagaggatcaagagaaacgacgtggagatcgaggaggaagagttctgggaaaacgaattacagatcgaacaagagaacgagaagcagctgcaggatcagctggaggagatacggcagaaggtgacagactgtgaaggcaggctgaaggactacctgg

SEQ ID NO: 32026 - DNA, 1301 bp, Mus musculus
ctgaacatggagcctttcactcttcgcagtattgacatgttgtccagcagctggaatgcaaagcctttgtttgtatttgtagcattttgagaccattaggaaagcattgatctacgtttatacatgaatacaccctgaattaagagcaaagaagttatgtgactgcttagtttaatttattccatgtaattgattaatgtatgaatgttgctctctaatgttttattaatacttatcctgtgacttaattctgttaagtgttgtgggactctgactgtgtgcatgttggcagactccatctgagctttgctcatgtacagcttcggagcctcctggggcgctccaccatccagactgactccacggaactcgccacacttatctggagcctctcttagcccttgcttaagtgagataattcagcttgctttctagtctggaagttaattgttcctttacagtattccaaacatgacatcacagaaatatcgtaaaggaagtaaattgttcgtgtaaaatgtttgtgatctcagacggtcctggtgcactctgtgaggctctcctgccttcctgcctcctcctgtgggtccccatgagaaggtcccacgagaaggagaggtccctgggggtctgattgctgtgctttgggaatcacgcgcaggtgatatacttgagaacaacccacttcctttttggactttatgccatgcacagcagggtgaatgttgcttgccaagacgtcgacgtggacagagtgcttgttctagacatagagacagaggagagagcacccaggtcaggcattttttaccaaggaataaaattaaattcagagtatgttttttatttttaagtttgactttataggatattagtctccatttatatttgtatcatttgtgtataaagccaaaaatgagtcagtactttgctctcgagcagtgacttcactgcagtcaacagtaatatttagacaggagctgccaggtgcctcagcccttcccattctccagtaaatttggtacagtataactaagactttaatctgaaatttaaagtagcttttaatcctgaagagaatgcatcctctgtattatttacatgcaataatatgaaagtgggttagcatagtgatgccgcaaccacactcaaggtgagctgaggtgggtgaccacacccaacttacttctggtttgatgaatgttcgatgaagccgagaatgctgctttattttagtttccaatgaaaagatttaagactggctgtgaagtagtagacacttgtagagaactgaaatttgt

SEQ ID NO: 32027 - DNA, 1100 bp, Mus musculus
gggtcttgctgtcactgcctcgcaggtgacttgagaagtaaattattctttctgaaataaccattgcctgaacacatttgctccagatttgtagcaactgtttcatatctctatatatttaaaaagaataattcaaagtccgagtaacttgcagctttcggtggcacgggtgagtccacaggcccagggcctgccttactctcagactcttcctctgttgagtcattgcattgatcagataaattgaaaccttgctcataaaggaagacactgtacaaatggattatcttccatttaaaccaaaatgttggtggtaggtaggttacactctatgaaaaaaatgaaagatgaagctgggcgtggtggctcatgaccgtgattccagcactctggaggttgaggcaggacagttgccaggaagcccaggctatcctaagttacaggggaagttctaggatagcctggggtctggtgtgagaccctgtggaaagaaagagaattgcacagatcccctgacacactcagttgtgaactgtctggcttactgaggaacctaaagaagggcggcttcccaccagctcgcagcagtcctggctctccaccaccgtcacctctgaacctggaagctgccagctactctcccggcctcccggcctccccgactggtggggtgcagccttgagagttgacaagcacgttgagaagctgtgctgtgtcacgagtcacagggccttcacaggctcatcactgtccagtgttttctaaagcttttttagctcggggtgggggtgggggggggaaacaactaatttgtgtaggaacatctgaaaatattttagtctgctgtcacagtttttacctattgtgactataaatgaattggcttatgaaccctacctttggctacatgtcagaggggtacagccaatggtattaaaaaactaccaaatgcaaaattttgcatatggagaagtatacaggttctaaataataaattagatcacaaatttttgtgtctttttaattagtactacaggttacattatgtggtttttctacaggtattaaatatattacaagtttttttcttaccaatgaat

SEQ ID NO: 32028 - DNA, 1867 bp, Mus musculus
ctgctttctgtgccacacttcataaaattggcttttaaaatatgtatccctcttggagctgtcttaagggactcagccaaaccagcagtttctgtttctgcatgtttctcatcttgggttttccttattttcttacagcaagaaaataaaggcttgagagagatccttcagataactcgagaatcctttttgaaccttcggaaggatgatgcgtcagagagtacgtctctatctgccttagtgactaacagtgacctgagtctgaggaagagctgagtggctttctgtgcggtcactagaatgggcccagaagtgagtggatgagtgaacataaagcccaacttcagtcagccttttccgtctggtatgtacagggacactggcaaagagacggcagcagaatgtataaccagtggtcataaactagatcccagtcacagtcagaaaggagacgctgagccacagagtgaacagcgagtcttcaaggtgctgctgagcactgcagtttcagaagtgctgttggcttcttagatgctacatagatcaccctgaatactcctaataaatgttggaaagcctaaattatcacaattttaaaagtaaggttggtgtggttttctgaatggaagactttgttctaagtcttaccttcctgttcagtgtcagagttggcatagcttgtgtacataaagctgctgagttggtgctcacctgcccatttgctcggccctcatcaaaggcagttcatgtttaaagactataggaatacgtcacttgcatcacaaacagaaggaacatacttacacctaattcccataactcttagctagcagttattcacgacttgcttaagtgtatgcatctcaggaaagaaagacaaagaatatactttctaagaaagacagccatatatagacacatttagtaggttgaactactttgaaagattatgttttggttctctgttaacaatgaacctggttcttcctcctcttttcatcatgtttaaggatacaagacagttcaccaatagacaagagttgacaatttaatgtaatgagataggtatggtcatttccaagttaatttggaattcctttattgttatttaagaaattactcttcatacacttacaaagtagatacaggttccaaaaatcaaagttctgagtctgagtctaagcctcatctagttcttataacctgtgaggtttttcctacaacctgtgactcagaaactggcagtgaagtgtggacacaaagggattgtgctttgcactttaaaaaaaaaaaaagcttcttaaggccacaggatacagaagtgtgctttcataccaactgcaacctaaacttttctgtagtgataagaataaaagattatgagatatggctgaaaatacactatacttgtatctgaagtccatactgaaattagcacagacagaaagttagacttttcaatatatcatttgttaagtacatattactttgcagtgtaattttatgtgtaatttcatgtattggcaaaattaaaaggacttttcactccagaacctttcattctgaagtttgaggtgagtggggtcataggtcagttaggaaagggccagttccccagatgttaaaccgttctcatgcagaggccttaatattttatatataagtgaatttacttttaagatttttctattgttttttggaaagtaacccttaatttaatggtactttctttcatgtagttttgtcccaggccagaattttaaaaagaagaaaagcggcacagacgagatgagtcagatcgatgtattgagcaggtctattgtgaaacgttatttgagaagtaattatttttataaaaaattattta

SEQ ID NO: 32029 - DNA, 1972 bp, Mus musculus
ccctccccacccctacaagctatggaagcaagagagagaacgcagagtgaccaacatcctggaccccagccatcacatccctcccctgagagagaggctttatggtcgggttgctcggatcaaagagctcttccagaaggaacagccggctggagagaggacacccttgcttctgtagaaggctgagggtcagtgtgcttgccctggagttctcgtctagactgcccagttgtcccaggtccatgcagggccagccagggtgggtgacagggtgacgcccccgtggatgtacagcagtggagttagaggattctaagtgatatggtgagaaaagtctccaaaaagttggccgtagatgtttttcctcattttccacagtcttgagaagttaccttttgatgattgatgtcttttataaaatacaccaaaaaataaaaatgtctccttgaagccctagtgttttgttcttgtagcttcttggacagttatgactcagtcagaacctgtggaggggaggcaggcagtgggtatttattcgctttgtgtgtagaagtttagggatttgatttgggtccttgaatgtcaagactaagggaaaagtaaccccccttttccttaaaagcagtctgattatatttggctgcatcttataataaaatcaggaacccttttcatttattttcaatattcaaacgatttattttaaaaactggcaaattatcctaacacgtaacaatgtagatttcctgttgttttgccagttagtgctttaagtggtaaataactaaattttttctgtaatctaaaatagctcagtttattaaagataataaaacttttatatgagtaagttatttatagcccattttgtgttggggccatttagagcagtgttggctgctgacccttctttcttaggttgcattagacggtgactggaccgtattttgtcagagagacatcaatgagaccttcctagcacctgtgaagttgtgctaatgattgctctgtataatcaaagcccctgtgctctgaagctcagagggattgatcacttagccaccaccatgggttctgtaaggagggacatgctcttgactcctctgaacggcagggctgagaactggcttccctgacgtgtgtggcccacagtgcgctggtttgtcagtggtgtgcttcttagtctcttcacagcaatgactatagccttgacatttcagggagtgggtggagtcttcagttgtggctttgaaaaaaggttctgaagttaaaacataatgaaaaattataaaatgaaccccttttggtttatttctgaaaatcctattctgttattactacctagcttcagcaatatatatatatattttaattgctatagggtttctggcttgtcacatgcttgcattttagttgtacagattgttggagaactattctttgtactgtcggaacacactgccagtcagagctaaaaaaggcagagtatgctttctcggagggaaatacaaaatatttgtaaattttcataatttttaataccatttgtataatttttgtaataaatacctactttgaaaaaaatgcttaatgtcctccttattaggatgtctccaggagtttataccagtcttgtatgtacttatataaatttaatctggaaaatacagttgttttaagaacttcacttaaggataacaggaagtgaagggaatccagggtgatatgttatggtttatgtagatttaaatgtatttactcattttttttcattatttattgactttacatcccaatatcagcccccccctcccacagctccttcccccatcccctattcttctcctcagaggaggaggtcctttggctatcaccccaccctggaacatcaagtcattgcaggactaggcgcagctcattgaggccagacaaggcagcccagctgggggaatagaatccacagacaggcaag

SEQ ID NO: 32030 - DNA, 1199 bp, Mus musculus
ccacatccacccctccaaactcctccctgtaactcctcccacacccacccctcctgactccctccaatttcctgccttctgccttttgtttttgtttgtttcaaatatttcactgagtctagttcatgctactcatatactcatgagtaagagtgtccggtggagcgtggctgacctgccaggggccacattcttaaagaaaactgactctcagtgctggaaagatgtctcaggtgttgagagcatttgctgctcttgcagaggacttggattcagttgccagctcccatttcaggtggctcacaactgcctgtaacttcagctctcggggatgtgactccctcttctgggctgatgggtacccacactcacacaatcttttaaaaagggaacctgagtccttccccagaaggcatcggctgccaatggctccagtgcactgctgacttgcatggtcctgtgtaggtctcatgcaggtgatcacagctttaaaagccacgtcaacaccacttgttatgttttgctttaggtggccaccctaacagctgacgataaaacagccgtgtccttctcttccctcccgggacaaggagtcatctataatgtcatcgtttgggatccgtccctcaatacttctgctgcttatgtgcccgtgcacacatacgcctgcagctttgagtcagtggatggtaactgtgcttttcctggtgagtatgtagacttcaacctggacagatttgtccttggctttgccacttgatttccaccagtgaagagcttaaggttgttaaaaacgttttgtcgagctttcattcactcagtcactagttgcctttggtaagaccccacattagggctgaggggatggctcactagttaagagcacttttgtaaaggaccaaggttcagttccagcactcacatggcagctcacaaccatgtataactccagttcttggtatctgatgccctctgctgacctccaagaataccaggtatcttagggttttactgctgtgaagagacaccatgaccaaggtaactcttataagagcaacatctaattggggctggcttacaagttcagaggttcagtccattatcatcaaggcaggtgcagtgtccagacaggaggagctgagaattctaaatcttcatctgaaggctgctagtggaagactgacttctaggcagctaga

SEQ ID NO: 32031 - DNA, 1981 bp, Mus musculus
tacaaatccaaagactgggtttttctcaattacacctacaaaaggtttgaagggctgacccagagaggctccattcctacatacatgaaagctgggaagttatgatgatcacagtcgcccatagccaggagaactcaggtagctgcatccgcaggctggctcggcatcagcaccaggagctctgggacagtgctgctctccagccagaggaacgactacagcttgggaatctgaggctgctatggctatgggaattgctcagcttttttttttctttttctttttttttgtattaactttattatacaaaggtactggaacaaaagaaacagacattccctcctaactgcactgcctacgtgcatgttgagaggtccatcctgcccatgtgctgcgcttccgattgcaacactaatccagccagaactgcattgcactgacggcaccatgacagcctgaggttgctctcagtgtccctgcttcactgcagagcccgtgggtctagaatcagtgaaaagccatcttctgtagctgctgttagtagaacatttgccctgttggtttggacattgtgggctctacatgaagacagtttctgtaccggctccaaggaacttaaggacgctgacttcaacgacattagaatttcctgtcaggctctcacgcagaccctgtgatagggaagatgagcttctgttagggtgagggcatttctcaccttcgctccggcatctccaaggctgacggtgctgagagattgtgacttgacgactgatgtgcacacatggagatggacctgaatgattgtcagctactcacttttaacaatgctgtagcattgttttagtttgaggatggtgagctgagtttcagaaatgaccatgaaagctgcttgtagaacctagtatgtttttattaaactattttttttaatgtcaaacttctgatcagtcaatggacactgtggagagcagagtgtggctcactgtggctttctgcagaggtggtacttgtccagctggtgaccctttgttcccttgattgcactagtgccattgttttccaatgaaccaaagatcctgaacagtggctgtcagcagggagtggagctccggctttacaggggagctgcgctcccttgacagaggccagccctgttcactgttagctcatcactgtggttaaagcccattatgaaatacaggaagtgggtgctggctgggagggtgtgactggagactgggcagaaaagtcagcatcagattcttggggtgtttccctaaggattacatcatcttttcttgcttagcattttgattctgaaacaactttctgaggagatgtagttttgtgagttgtagttgtagtaacttctcagggaatggctaatgtttatcatctatgattgatatagtgagactttatgggaggaatgcttctcctgagggcactgagcaatgccttgtgacccctctttcatcaaggccatcagctcctgatttattttggtgagtcctttaaggccccccccattttgctgttgagtctggtaatcaacaccacttgttatctactggctcagctgtagcctgatcaatcctatgccaagtatttggagaaagcactgaaaatggtagataagcctccctgactttagctgccttaatatctgcagggtatatgagcttctccaagtagtctgtctcaagggtacttaagcagcagagacccctgaatatagggattctaccttttcttttagaatgggacttttctagtgtgagtgtctaggttggataggagaccttgccaaattctctagctcaggtgtgataactacctaactatcgtagggtgggtgttgtcaatccaggtaactggggtagtttgagattagtgtacaggagaattaccaaacttatgtttccatgatgtagggacagagcactttgtctgatctctctgttgtggttgtaaaagc

SEQ ID NO: 32032 - DNA, 1226 bp, Mus musculus
tgttagtggtaggcaagagctcactttttaaaattaattggagactcccaaatgaaatacatacacaccgtgatataagattaggatttggagagaattggctttttagcaggctacatattttgcccaagcctcatggggatttctccccacagaatgatacaaagagtttgggctcagaggctctgggattccttgctatgcaaagaaagaggctggctgctcagaggcagagagagtcagacactgcctgctaatcaaaggctagagacaaatctaatttgatttgtttttaaggataaaagggaatatagcttcttcttcaggaaaacaccaaatggcagatgacgccgccggtgcagcgggaggacccgggggcccagaattaggaggccgtggccgtggtcgaggtcgtggggctcgtggaggtaaagctgaagacaaggagtggatccccgtcaccaagctgggccgcctggttaaggacatgaagatcaagtccttggaggagatctacctgttctccctgcccattaaggggtctgagatcattgacttcttcctgggagcgtccctaaaggataggttctgaaaatcatgccagtgcagaagcagactcgggctggtcagcggaccaggttcaaggctttcatcgctattggggactacagtggtcttggtgttaagtgctccaaggaggttgccactgccatccgaggggccatcatcttggccaagctttccatcgtccatgtgcggagaggctactgggggaacaagattggcaagccccacactgttccatgcaaggtgacaggccgccgtggctctgtgctggtgcgtctcatccctgcccccagaggcactggcattgtctctgctcctgtgcccaagaagctcctgatgatggccggtatagatgactgctacacttcagccagaggctgcaatgccaccctgggcaactttgtcaaggccacctttgatgccatctccaatacttacagctacctgacccccgacctctggaaagagactgtcttcaccaagtctccttatcaggaattcactgatcatcttgtgaaaacccacaccagagtctctgttcaggggacccaggctccagctgtggctaccacataagggtttttatacaagaaaaataaacgaattaagtctgctaaaaaaaaaaaagggaatataatggtaattgcttaaatgttctt

SEQ ID NO: 32033 - DNA, 1159 bp, Mus musculus
ctcatgtacacatagttgtacatattctcacatacacataagtatacatatgttcacacatagtcatacatgcagctcattgcacagtaccacctaagtacataacttatttcatggaattcaaagacttcatgctctctaaaatttcatgttttctgggaggcatggccccacctgactagtcgttccactagttctggtcacttttgagcctaccatgctccttttccatctgtcccccacagctggccttttcattaagcatcaaaccattcatatttactgtcaatgacactttttattttcatctatgtaagatttagagagatagatctacattattggattatttggtctgtcttttccctgttttttgtgatcattgctagtggctaggctgatttatctttttcaggtgtggtgtttttcctaacataaatcctattgctctctgactttctttggaaaccaggttctaaagccttggagtattccaatgggatttttgattgccaatctcccacctccccatttatgggaagcttgcgcgctctgcaccttgtggaagacctgcgtggattgttggagatgatggaaacggatgagaaggaaggattgagatgccagatcccagattcaacagcagaagtgcttattgagtggcttcaaaatcaaatggtaggcttctgtatgctccttctctgtgctgtcaatctcctgtgtgatccttctctgtgctgtcagtcttctgcatgtgccttctctgtgtgtgaatctttgcatgatccttctctgtgctgtcaatcttcttcatgttctttctttttgttgtcaatcttctgttgtttactataaaactgagagcatagattagcagatcagcagaagagaaaaaaacttacaaggcagaacatgagaccccagttcctctctgctgtaaagaaaacttagaatttttctttatatgaatggatattttgcctacccatatgtctgtgtaccaagcatatacagtgaaggtatcaggtttgtgtgtgtgtgtgtgtgtgtgtgtctgtctgtctgtctgcctgcctgtctcacaacagagaattgtgagccaccatgtcagtgctgggaattgagccatgctctgaaagaacagacagtgtagtcccta

SEQ ID NO: 32034 - DNA, 1198 bp, Mus musculus
gttaccattcaggctaaattctacttgataaacttctttggctcccacaaaaattgctgagcagtttggagcttggactttaatcttgactccatttgctttataatgaagaattttagggtattaccacatcaacttgaagcctttggatgcactcatatacccatcagaaaagtttttgttagaataactttggaaaaacaaaaaaaacaaacagaacctttacatcttaagtttctttttttttccctttgctaaactcatcattatgttgaactaaggagtcctgcctagccatgtcgattgtaccttacactcagactgtcagctgatggggcttcgtattatttcaatcagaacccaaatattttaaagctgtagaacattttctaatggctatcctgtccaacagcaggttgctcatgttttctgtcacacagggcccaaaggctttttgtaaagaaaatagaaagctacaaagcagctgttgagtggtatgtgtctatgagtgttttcagcagggttggagacaatctacttttcattcagggctactctaaatgagatcccctgtgttctggacaggagcttagacactgggggacaggtggacaggtcactttacagtgatagatctggtgatagctatttccaaatgtcagcagtatgccgtttttatgctctgcaggttataaagctgttcattgtgaaccttgtaacactgctggttatttctaattaaattatcagatgctaacatgctcccattcatgatttcatgacaatattggcttcttcctgtattggggttttagtttaacatgaataaataccaccatttgaaagctcagtttgttattagaacctggttaaaataccagcagactgttacagatgccaaatattctttatcaaggacaatgtaacaactgatgatatgtgataaagttaaaaacttttgattatatattttatttacaaaagtattatgcaaagtttgcattaccttatgagaggaaataaagtcaattgataattgccttgtgtatttgtcattgtttctttgttcagaaaaacaaagtcttcatttctggtggaaacagtaactgatttttgtttgtaaacttgcacgtttgattgagtttttttgaatcagacaaattgagatctctgcttaagaagtacatataaaaggaaa

SEQ ID NO: 32035 - DNA, 1176 bp, Mus musculus
tatatatatatatatatatatatatatataccctcctgcatatgttcagatggttttcctttatcttggtatgttcctcaggctggtcttgaactcctaggcatgagggtctgccatcctctgccttccagccttcagagagctgggactaaaggtgtacagtacagtattggctttctacaataaataatctgtaacttataacttcaaatgtaaggcatctaccatgtcagtggttgaaggaatgacaaaaaccaactcgtactgttcaatttccccctcttatggcttgaagatgcattcctttccacttcacccatctttcccaagtggcctgggggacaagtcagggcttgtagagagggtttgttgccccagctgcttggaaggctgaagcaggcagattccaagttaaaattcttcctggccttcagagtgaattccaggccagcctggataatgtagcaaaaccagaaagagtaggggaaaggtgtcttagagggatagcactagcctagaattttgaggcctcagattcaataccagtgtcccagcagtagaaagagtagccaaggacaggatgggcgctctctctctctctctctctctctctctctctctctctctctctctctctctctctccctccctccctccctccctccctctctctgtctctctctctctctctctccttccctccctccctccctcccttccttccttcctttcttttttttttctttcttctcttctttttctttttttcaggcatagtttctctgtatagtcctgattgtcttggttctcactctgtagaccaggctggccttgaactcagagatcatcctgcctctgcttcctgactgctgggattaaagtgtgccaccaccacccagctgaggataggcttttttttatcaggccacttgatgccatcccagtcccactctggtctcttctaggtccattacaggacaaaggaacctttagatcagagattatttgtagaaacatacctcgttctgatggctcagaggttaagagcacttgctgctcttgcataagattagtgttcagcgcttagcatccctgtctgacacccccttatgacctttataggcaaccacatgaatgtgcacacacacacagacacacaaataagcataaaaataa

SEQ ID NO: 32036 - DNA, 1285 bp, Mus musculus
attcttggaccaaatgaagttctaacactgacatccacaaagctctcaccccaggcttaacatgtagcctgtgtgcagtatatggctctggggtttagatgcacagactcccagcagaagtttgttgttcttgctgtcatctatgcttggagaagagagtcatgtcatagaactgggagggttttatgacatctgtctgcctgtgccctttctgagcattctgagagcacttggagttcagctggtgccgactgcagacttcgccaggatgatagtgttcctttggaaaccttcccttcctcagacaactccttatgcgatacttcgtatttctttccattctctgttgccttactccccctaccaccagcttctgaggggttctagctcccactgtgtagcaggaagtgtctgggagtacccccaagggagcttcctgtcaagtgtgcactcctactccgggaggcttctccccttggcaccagaaaggttctgagatgattgtgtgagaatctctaacttctgcgatctgagctaggacatattgtcaaagaacctacaaggtgggggatgctggcaagaaacgcatacggcttaggattaagcatgaaaccaaagagaccttgaccctgctgtgttctgttgtttctaacgccaagaacccaagcaaacttaaatgccttaggtttccgttcaagcagagggaaggcgaggatactgtagctctatactgggagaacagaggaaaatgtttctttttaataaatagttgtttatagactattagaggagcagtcctcataattccagggaaagttataagcctgtttggccaaagaggtaaatagaaggggccctgatgtctttgtcaaggtgttgggtgagcttagcttagcactgctgacgtgaggggctgcaggacaaagggatcatgctgaaggctgtcttgaccttacccaggagtacggggtctgtgtgtacactcgctctgtcagggtttgcacttaggagacctgtcaatcagtgctaccagacatcctgccagcctaccagagtgaagtgaatgccagttcctgcccctgcctccgagatagtcagtatgaagggagctgtgatctctggaagtagtgagctacatcaattccattccttggtgaccagaaacattaagtgttggtgtgagacagagcctagcctggggacactgactgagccactgtccctgggacaatgtgctctcatttcagccatggtgtagtcagagatgcccactttagtcaggcac

SEQ ID NO: 32037 - DNA, 1169 bp, Mus musculus
tgttggaagaagtgtttcattgtgggtaggatttcaggtttcaaaagcccaagccagtttcagtgcttcttcctcctcttcctgctgcacgcagatccatatgtacaactctcagctccctctaaaactgtaaccaaggcccaattaaatgtgtagtttgctgtggtcatggaatctcttcacagccctagatacctgagcaatcagtcttggactctatcagaaagctaaaccatagcctgtgcagatgagcaagcattgttcctactgattgctcggaagtaatgctgtgtagaatagcaaccaggcctgccttcaagtttctgcttgagttcctgcctcagtgatggactgcaacctagattgcaaacaaaataaatccctccttcatccaagttgtttatggtctatgtgttttatcgaggcaacatatgtaatgaatattcacatttaacaactataaagttgacctcttgatattcctgcccttcccagacacgttttacagcatctttaaatgataattctttcttttcctttttcagtaagtcaaccaaaaccactggagccatcttgatcctcttccttgttcaacaactcttataacactgagcaccaaataattggccttccccttgaaaagtatccagcttcaccattttcactgttgtcatagataggcgctctccctgtagcttgtatattggaacagaatcaccactgggctctgctgtggcccagtagtctgatctccatacagcagctagggtgaatctttgaaaatgctactcagaatgtttcttcattttacagaacccctgatagactctcttatttggagggaagaaaaacccttagtccagttggcaagaccttttagcatctgtatcttctcacacagagagaaaatgttatggaaaatggataaggcctgatcctcactcctgcacccatccttctgggttcattttctaccatttacttctagttgctgctcaagacaagatgtccttccttttcttgagtaaagagctactgttctgatggtttcttcagcctatgatacatctgaagctagctgtctcccgacaagctctcacttaacctcagatctctgctgagatgtcacattacaagctgtttccttggcatccacataagaaattacc

SEQ ID NO: 32038 - DNA, 1794 bp, Mus musculus
tggaaaatttatagtggaaataatttgctgtcgtttcagacttggatcctacaagcctgtccgttctgtaagtggtactgcaggtggtgcttgtcttaagtgctggtggtggtgttatgtctaaatagaaaggattgccccttataaagcctgtgattagagacatcctgtagagtggaactaacactctcgtcttgccttccttcccctctcaggtcccctttgcggatggccacacagacaaccacttacctcttttagagaacaacacacattagtaccttgtgggtggagaaaaactttttgcctgagacataaagccttttctaataataacatgttgtgcaatatattcaaagaaaaagaaaatatgagaacccggaaacatatttaaaaaagaaaaaaacagccaaggaaaacaacaaactgcagtcgtcttgtatatgttgtgtctgttacaaatgtcatagaagaaattatgcagctaactggagagtcagcccagccaacagtgccaggtgaagacagcacctctgatgcctcccagcaaacagacaatatggaaagcagatcctagaggatggacgtcaacccgagtttaaagaaaagggcattgataaatgcaaatgtgtgcgtcctttgtttttaaagatgtcagaataaaatgtgtaaaacatatggaaaactagtctagactttaaaaaaactgtaatcagctcacatggttaataaaggaaacagggactggccctgtgttacagccatattaatattaagccatattgacaagatggtgttgtccagtttggggttctgatgaaggtcactgcattcctttgaactccagttgctgactttcctgactgttgaaggttgagccttagaaaactaaggtgaagtttcctaaggcccaggtatatacttgctatgatgtgtaacaggtgtcactcacagcttgaacaagggacactgcagggagaagaaagcataaatgtttaaaaagataaacagtttgtaagatgtgaagggtaaagttgagtgttgtatgcttatgagtagtggaaaactggacatctgagacaggcaaggcagtgtccatacaagactgaagtctgaagcagcctagacacagctgtaaccctggacaggtgctgccctcaggctctgcacagaactgatgaggctacggtaacttgaaggagccctgtcaggtactgctaggaactgctgagtatgtgtgccagcctcatttcattctgtctttttgaaagataaaggttaagtcattgagtgagaagactgagtttcagtccctaccagacacaggacagtggtggcttcgagtgtggcctgtcacaatcagtgtttcaagtgaatgtttttaaggataaaaaaaaatgcttgaaagaaggtaggccatcagggaaggaggagacggcaacaaatcagcagcaaagtgtatgaaaaatggcattttatagaaaataggacattttggttaaagtgcgagaggttaagagtcaaggagttaaatgacttaatactattataatgttttaaaattttttttaaaagaatccaggaaatttcaaataatgagtcttttctgaggtttttgttctattttgttttggttttccccttaaattttatagtttgtctagaaacgggacagctctccagaattttgttagcaagaactggtcacttgagactgaatgttgctcttcatgtctacttactagggaattcagtcagttttcagggaagaaaatagtaatttagagttatttt

SEQ ID NO: 32039 - DNA, 1165 bp, Mus musculus
acttggtttttattccttgattaattctaagctcatgaaaaacctggtgtgtctacgatgaccatttccacactgttaagaatggtttagttctgggttcttggttgttttgttttgtttgaagtagtatcttgctctgaatgcacagccctccagcttttccttcctagtgcaggattacagatgtgcctctaacctcagcgataaccctggtagttgtctccaaagagcttctgtatggtccagggcagttcatcctatggaaaatgaaatgtcctatgtgggacactgtagcttggtaagaagtgcattttaggagccacaccacatgtttcttttcccttcctctcaggaacgcatcatcaaccatgctgcaggcagccacggcgtctctggaatatttatgaaatatgatctcagttctctcatggtgacagtcactgaggaacacatgcctttctggcagttttttgtaagactctgtggtataattggaggaatcttttcaacaacaggttaacattcatttctttgcctaatttccttttattttgttttgttttgaggtaaggtcttactgtgtagatctcactgggcttacaggcagtagctgccatgttctgatatctgatttcttatagtgtttattactttatcttgtgaagatagttcactgatggagtatgctgtagtgtgactctcactttttcaaggtccagcaccaacaaacaaacaaacagacaaaacataacatgatgattctattagaaataagaaatagtcacacacacacaaaaagaaatagtcacattttcatgttttaatatttggaacttctttgaattctaaagctctaaaatatatttcatatcctgtaagcacatccaattcacaggaatcagtaacgtaaggaagattattggtaagccacatacatcctgtgtattaattacagacagagctagaacagaatctgtgttccactactgacttggtagtccttagatagttcacttaccttttatgaattgtaattatctggtttgtaagtgtattgtagagttaaacaagaaaatgcccaggaagcatcacagatgtattgaaatttttttccctgtacactatgaagtcatgatggtggtggtttgatttaatcagtaatgct

SEQ ID NO: 32040 - DNA, 1222 bp, Mus musculus
tagcctccagttcactaccctgctgtttggcctgcacttagtttgttcttcatactacagcacttatttcagtgtctaacaggaataaacagtttgtacttaggtgtgaaaggtgagcttagacattgagcagagtgcctttggtgcccctgactctgtgtctgttacactgctagccacttgtatcgcttttactgagaaatcaactctgttctagactagaatcccgtcgtaaatacatggctcgtctaattcagaagcttcgctataggtgagcaagtcttggcttggtgtgtatcttactgtttttgttgcatttaggatgctgcagctgattcagagtaggctgcaggaagagcattcccttcaagacgtgatattcaagagtgcttttaaaagtgcatcaactgcactgccaccaaggtgagataggtgcttccactgtccacgtgttgaccagaaatttgctttggtataggcttggtattgctctgctgctctttcttagaaagtgtttatgtgttgaagacatcgatgattttgagcttttcattgagtgactttacttttgtatgtgtggtatatctccatagtaaatttttactatgtttaagaacaaactgtaggactgtataccttctggctaagaatttatttttactcttgtgtcagaataggtaacaagaattgttgtaatcatgaaagtgatttttcaaataaaaatatgcaacggctttatattggcttagatagaaaataacagtttgtaagtgggtcatgtgccttttcctgacgtcggtgtcatttccatacagcctgtaccacagtacagaaatacatgagggacacagggtgatgttggactctctttgattttcatagttcttctgcatgggacctagtcctttgagtagacttgaagatacataatgatgtatatttatctaactatagcagctatatagcaactctaagcagattcaaaccactgccctaatcctgacatttaagacattagctaaaagtttgtctttagggaatcttctttttcctgtgtgccccttttacaccactacatggtcacaatatccaatgtgcattaagacatctgaatatgccttgctttatagggaagatgattcatcactgactccagatgcgtgcagaatccatggtcatctctatgtcaataaagtagcagggaattttcacataactgtgg

SEQ ID NO: 32041 - DNA, 1183 bp, Mus musculus
ggtagtgtctggagtagaagtaggtctgtccttgcatttgtaagaaactacttctatgttaagtgcttttctcctttttgttcccaaaggtggcttctatttaaggttacctaatttcagattattaccaaaaatgaacttacttagggttttctttctcccttcaagcattttgttttctaatggctagtatacttggagtcttttacttttaattaccaattttcctggttggaagaatcttaattttgaaattgaatatggttgaacaaacagtgaataattagggctttctaggtttctagcacttttactagaaagctcgatctagagatgaagtatattttatccagaaataataaggtgagagtcaggtgtgtgctgcatacttgtaatcgtaataatatcaagaggctgggcaggaggatcaacagttcagaaccagcctgtactacaaaactctgtctcagaaagctaaaacaaacaaaaacccggaagtactaacatgaactactcctttttaatattttaagatttttatttatatgtatatgccatgttgtgaactccctgatggtgggtgctggaactgaaccccagtattgaccggtagtaatgagtgagaacagactgtttttattaagagtcatgttttgggctttctgcataccttcatacagcatttacacttggtgattggtttttgagttcaaagcagacatcttacagttaccttaagctctgactgttgccattcattaagctgaattgaactacaagatttctaaaacatgggagctttcagcttctgttggtctgcactccaaatattttgtcttaagacgtataaacctgaagatgagatctgctttctagatgcttcttactacttctctctgttctgcttctaaatgggtgctcaagtgtggagacctgcatggccctgccacatctgacagtgtgaacattagaattcacatttaactttagaattggctctcaggtggtacatttcattaaataattaggatctcaatctctttctttacaaacctggacgcaaagctttttgggatgtctgctttctctttctagatttaaagtttatttcaaatgaaatttattgtattaatttgatttgtcatttaacaaaacaggcctgttgtcccagtaatctagatgg

SEQ ID NO: 32042 - DNA, 1099 bp, Mus musculus
cattcgatatagcagtcctttaaggaagtgggtgtaggccctcaaaaccctttctagtaatgtacttcttccagtaagactcctcctttgaggttctaaaacctccctaaacactactaaatacaagcctactggggacagttctcattcaaaccaccacaaattgaattctggtatttggaagttaattttatgtgagcatggtcatatgaaagcaaagcattggttgaatcttatgtaaagccagctttggtagtacacatcgttaatcccagcacccaggaggcagcaacaagtgactcttgagtccacatcagcctgacctacatagtgagttccaggccagccagtgctgcacagtgagagcctgtctcagagtgaaaaggctgtaaatccttaagtattagatgctttcctggtagtttgctctcattcatccaggttccatttctaaggctggctctttctgttgtctgaatctctaccaggacatgtatgcatcactgagcactgatacttgaacatctggagcatctactgtataattccattccacagtaaagaaacagcattgaaggataccaacatagtgtgtgatggatggctttatgatggaaggaaaaaacttggaattgctgcttcttgattcaagtttcatgtccttagagaactattgtatctggtgtttagtctgagactgttgaaatatcccttagtttcttaggattattgattgtggagttgcagttaacaaaggtgactgtttttggagaagcagaaatgtttttgaatagtcactaagtaaaacttttgaagggccagagggatggcttagccattaaaacttgatattcttgcaaaggattagagttcagtttctcatatccatgtcaggctgttcacacaaaagaaaaaattttaaatgttcttattctgattttaaggaatgtaagtgaagttctaactgttgtgttttactgtctgaaatctacagtttcataggtgagttgatttatatttctggtgtccggctgattgacaggtactgacagctgcccttttctctttcagcaagttgcgaatcaacatagacattact

SEQ ID NO: 32043 - DNA, 1170 bp, Mus musculus
ctaaatggctgctgcacttagaaagatttcttagataaatgttatgtcttatgggtcagtgacttcatctcttggaatttatcctcaaaagcaatctcagcctcaaagctctttaatggcctatgtgtacttctgagtcgggtatgcacccaggctcacaaaggcatctgcagatgtttccagggttcctcaccgaccagtgtctccccagttctctcctgttggacagaaacatgtctgcccctacatgcgaaagagtgaaagctggagatacttagcaaccttgtgtagttacaccactttgagaaagccctgtgtgtgtgttgtttaatcttttcattcatctcttcttcccttcctctttgctccccttataaccatcttctgaaccatcctctactatatggtctgttctggtatcctggctagattgtgttggaagttgggcccaattctctttttcctcaaggcccctcaaggtttcctggaggttcctgttagtacctattttttttttgtaaagtcctattttgaaaacaataatagagcttaggaaaactaaaagccaaacatcttattgttgctttaggcatggtcttcttatagcccaggctgctcttcaattcactgtgtagcagaaggggatggtcttgaattcctgatcctcctgcttctaacttcctcaaaactcatttttaaccatgtatgatctgcttttctggaaaaggcccagagcaaaaagaaaaaaaagaagaaaaaatcttaattccaggaaaggttggctgtctgtcactccttgttcactatggctttctttgcaaatagaactgagtgacagccttatataagacccaggataggacaaactaacaggaggctttcctggtgtatagtgcaattctgaacatccacaaacactccagctcttctctaaaacccagtaggggtgtagtcaacaggaatgctctgggcctccagctttgcttcagttatagaacatatgaaattcaggattctggaattcaaaatatatgaaagccacagaccatgtaacaatgagaagagaacaatgagtctctgtcatgagcatcagtgatctggacttttagaaagagaatcagtccttattccagttggatatgggttcttgtgtgaaattggaaaaagttc

SEQ ID NO: 32044 - DNA, 1173 bp, Mus musculus
atgaaacaggcctctaaacttagggaacagagttcaattcccaaaccccatacactagctagaacaaactcctaggagtcattctaacttacgcatacaggcacgcacacgtacacacgctcatgtacgcacgcacgcacgcacgcacacttaagcatgtacacgcaaacacgcacgcgcaaacacatacccactcatgcgcacgcgcacactaaaggactaaatgtaataacaatagtatgaaatatgtcttcaagtgagttttgttgatcttacagactgcactttccctgaaggcaggtagctcctcatgtttttcatccagagtccaggcagaaaagccccttaactcagagcccgctcctccggcctccctccaacagatggcgctaggaagtcccgcctactggaaaggacccggatgggtggggtttctcggctgcgcgcgcagctcgcctcactccgcttgtgctctgggaaggagaagggcgtgtttccgcttgctcctccgccatggctcgtggtcccaagaaacacctgaagcgtgtggcggccccacgccactggatgctggacaaactgaccggtgtgttcgcgccccgtccgtctgccggcccgcaccgcctgcgggagtgcctgccgctcgccatcttcctgaggaacaggctcaagtacgccctgaccggcgacgaggtgaagaagatctgcatgcagcggctcattaaggtcgacggcaaggtcagaaccgatgtggcctacccagctggcttcatggatgtcatcagcatcgacaagagcggcgagaacttccgcctcgtctacgacaccaagggccgcttcgcggtacaccgcatcacgcccgaggaggccaagtacaagctgtgcaaggtgaggaaagtcttcgtgggtaccaagggcatcccgcacctcgtcacgcacgacgcgcgtaccatccgctaccctgacccgctcatcaaggtcaacgacaccgtgcagatctcgctagacagcggaaaaatcaccgatgccatcaagtttgataccggcaacctgtgcatggtaaccggaggcgccaacctgggtcgcatcggcgtcatcaccaaccgcgagcgccaccccggctcctttgacgtggtccacgtgaaagatgccaacggcaatggcttcgctacc

SEQ ID NO: 32045 - DNA, 1103 bp, Mus musculus
cagctgcctttgctacggccgctcgctgcggggcgagtttgtacacgacgatgtgtgggcgatcgtgaacaaccccgacgtgcggcccgggacaccgctgcgctgggccatcttcgctaacgacttctggggcaagggcctggcggacagcaccagccacaagtcctatcggccactgtgcgtgctgtccttcaggtgagcctgtgcgtcctggggtctagacgcctctccttggagaagggatggtacggcggggacacttctgacaggtccctcggtacctcctctaggttgttctcccctttctctcagttctacccctggtcttttagtcatcagccagatcctcctggatttatcttgtgttctggctgttcagtctggtcctctaggttctacgctttgcatctctgccctgttccgttctccaatctctgccccaggtcctctgggctctatgcttggcgctcctgattctatcttaagtgttctccagggtctgtcccaggccctcacaactctagtattctgtcagcgcagccccagattttctctgaacgaggttctctccgctctgccccgagatctcgttgctctggctgggttctctcgggtcggactctgatcctattgctccaggcttagtcctgaatccacctggctctacctctggtcattacccgggacagcttaaggttctcaaggctttgctcaggttctgaagcactacatcgttttcttctggctctgttttgggtactctccgcgctactcggggagatctctgctctgccctatatcttcccagctaaacctaggttctcccgcgcttcctggctgcggagttgggaccgagttctgcctgctatgtcccccggggcttcaaggatggcagacttctcgctggagcttttcctacccgcgattagcgggttccagagggtggcgatgctccaagttgtcagcttctccagggaggttgtactgctgggcagatgaggaataaagggaccggaccaggtggcctacgatgctcctgaagctgctatgctgtgggtgttccaggtaggagctagggagaggtgtcaggcaccctactctga

SEQ ID NO: 32046 - DNA, 1617 bp, Mus musculus
gtctctggcttcagaagcatccttgcttccttcaaccaccctgtgctcagaggcttctttcaaggcttggaatttaggctctggtttttcacaagacatctgtggttatcctaagaactgttaagttccgttttccatcacttttcccctcttgaatgggatgatgtttctttcaggatcataagtgtattgataatattgataacctgctaagttcagactttacccacctctcggcagccagcagcagggacttgttggtcactaggcttagcagaaagactgaaggtcttatgaatcatgtgcttaaatgatactacaggaattgtgggcatccaaatatgaaagcacaccgaagttctaagcagaaggtgatttctgggtgggggcttggtcagtagttaccattccaaccatgttggacagggcccaaaacattttatatgttttctttttttctttctcctttcagccctcccttctttctttgtgagatagagtctgtctctgtatgcaacccaggttggcctcaagattgcagtcctgactcagcctcctggccactgttaacacacccagatgctgggttttgttatgtagttctggctggactggaactcactctgtggcctaggctgacctcagacttgtggcagcccgtgctcagcttctaaggggttggaattacagccacgacaaatggtagatatttttttatttagtaacaagacacaacagatctaatttaaccatctgcttttcacagtctgaaatctctccagcctgatttagcttattagtctttgttattgctcggttgtcttttttataaattcttcaagggttggtctctcggtcagctgggtgaataggtgactgatgatgtcagtattgcagatggctcttcctgaactgttcaagagcagaatatgaaccactgtgctttcatctggcaaaatgaaaacatgttatcaggattggacatatttctggatgtgatacagattttgtttgtgtgaaatacctgcagcttaaatttccatcagcaactggcaggattttctaggtgattcctgaattacaaatcttgtatttttttttttttaatttaggttatttaatttttttgtcagaagtagctataaaaaagccatatgtttcagagagaaattaccctgtattttgccatctctcatttttcagggcaccaaagctgcatgccccccagcagttagaagggcaagattgcattgaaggggtttcagacctctgaagtagtcagttttctcccatgtcttctatggtttaattgtaacataggtagtatgccttcacactggatcccgggggcatgggttttggagatgttattttgtggtgaattgtcatctgcagtattaaagggaagacatattcctgcacatcaccataccttgtttttaaagccagagtcattgtatgatttttattaccagaagtgctaaccggaatgtgatctggttaccttggaaatgcaggaacttttatgaatgtactgtaaaataaaatgtgggctaattcccagaaactgaactctgtctgctctatgggatgttttctggaatgtggaggtgataa

SEQ ID NO: 32047 - DNA, 1159 bp, Mus musculus
ttcatttacattttctggaaatatttaaacttttatttttttaaactacaggaacccatagattagaaagttacttttggaaacttacaatctttttgttcacttattttatgtgtataaatgttttacctgcatgtatgtatgtgcaccaagtatgtgtctggttcttgcaaaggccagaagatgatttcagatctcctagaactgaagctaatagatagttttgagcctccatgtgggtgctaggaattaaacttgggtctcctggaagagcaataattgctttaaactgctaagcaatgtctgtagtcttcacatttttattattcttattataaattattattttctttataataatatagttatttttctagtctctgcctttatgttcatctttgctatcctgcttttttggtagtaaatgcatgcccatttttgggtatagggttagtacctgggtgtaatgtatgacttcctgatctgccagggttaattttttgtgtgtgtgttttggtttatcgagacacacacacacacacacacacactgtgtagctttggccatcctggaacttgttctatagaccaagctgaacttgaattcagagatccatttgcttctgctttctacacccacaaggaggcttacaactatctgtaatgggatctgctgcccccttctgctgtgtctgaagagagtgtcagggtactcataaaataagtcttttttttttttttttttttttttggtttttcgagacagggtttctctgtgtagccctggctgtcctggaactcactttgtagaccagactggcctcgaactcagaaatccacctgcctctgcctcctgagtgctgggattaaaggcgtgcgccaccacacccggctaaataaaataaatcttttaaaaaaagaaaaagttgtgtgctgccaccaccacctggccaaagttaagcaataagagggatcctatttgttaagcattttattaaataaacgtgtaaaagagctaggctttgtagcacagtcctgtaatcccagactgggagatgtagggggagaatcaagaatttgaggtcatcttcagttatatggtgagtttcaggacctcctgaacatgtgacagcctcaaaacaataaaattgagctgattg

SEQ ID NO: 32048 - DNA, 1104 bp, Mus musculus
cactccagcaaaagaaaataaactcaaggatgattatagccgccctcccccccaagtctgatgtctctctccctctctcaaggataagatcaaaattgatttcagaaagacacattgaggtgttcatatttatatcagactgaagaaaagttcatcaaataaacttccccctcttggaagggttctgtcatgtccttagtgatttaggaagtagccatgcttgcttggtccaattacttgtgtgttggatccaagatgtattttaaacaaatattggcatagatagtaaggagtttctgttgtcagtcaaatgaggatataaaacatagaaaaaaaaatcttatgctacacttgagcctcatataaagatagcctgtgttttgttgttgttgttgttggttttgtttttaattactatttctgcatttaaattatacactgttttcctttgtattattaacaatgtatgtcagaactggagttttctcccctcccccatctgaacataatataaaatctgaaaagtattgtgacaagcactttaacatatcagacaaactgacatgggttttcaggttttggagtacatttaaatatgacttttcatgctttgttctttacaataaaactgtggggttgatactttgttgttttgtttcactattggtggctcttactaaaaatttcataaaacaagagacttaaaaaccagagatagccggggcatggtggcgcacacatttaatcccagcactcgggaggcagaggcaggtggatttctgagttcaaggccagcctggtctacaaagtgagttccaggacagccagggctatacagagaaaccctgtctcaaaaaaaaaaaaaaaaaaaaaacagagataaggggcctggagagatggctcagaggttaagagcactgactgctcatccagaggtcctgaattcaattcccagcaaccacatggtggctcacaaccatgtgtaatgggatttgataccttcttctggagtgtctaaagacagtgacagcgtactcacatacataaaataaatacataaatctaacaaatacaaaaaaccaaacaagccgggcggtggtggcg

SEQ ID NO: 32049 - DNA, 1966 bp, Mus musculus
ataacagaagctgagagaaagaatgaagcctttctgggtgtttcagggaaatgtaaagcaattgtcccagagaagttaaaagccactgtggcagactgaggagtgaatttgactcaagagacaatttaggaactcctgaaacctttctagtttgatagcttatttatttttttgttaagcaaatgttagcaactacataaatctttatcttttggtgagtaagtttcggaactctaattaggcaccgataccttgttagtagcaaaattgcctcggcagagctccaggttttattccctgttgtagctgaaaacccaagccatggcctctcaggatccgtgtgcaatctcagggccctgggctcttgccagcagtgctgttttcctgtttactggaggaagggactaatagatcaagtacctcatgccctttatcagaaactctgaagaaaagggttgctgaggatacatttacacacccatggaaagaaagggcttagaacatgtctctagatgacctgtgtaacccagtggtttgtttacttagaataagggtgtttatagtagaatgagagtattctagagaccaatctacttactataggaaacatccacaaattaagatacagtccatcccagggttttattgctgtcttttcccatggggccatcctgatgctgagcgcttggtggacttttaagtcagtgttccacagttgagtcccaacagcaagtacagcctcttcattttataggtgaaaataggacacttcaaatcaaagactttgtattcttgccctctcccccttgacaacacaagggttagaatttatgctttttaccacacccgagagcatgaaaccaacctcggagacattcttactcaggatcatttcttctgttgaatcttcagtcaactgtacagataggaagctatgtttctgtgatgcagaataataaggactgaagcttgccttgccgcgttagattgttttgttgttgtttgtgaaacaggatctcactgtatatccctggctggccctggaacttcatttgtagaccaggctcacctggagagatctacctcctaagtgagggattcatgtgagagccctgcctaccaaactgttcttaatctcttaggcattacatctgtggttaaaaaatgggagcagagttgcattccagcttaagtttaaaactgttacttaaagtagtaccaaaaaaacaaaaaattacctataaagttttttgttccacatgatgtcctttggatgagctaatggctagccttatgccttgctcagacagctgggcctcgtgggagctgcttaactgacccatagcccattcctttgaatttcccactggcgatagatcttagccgtacaggataaatttaatatgtagaaacactgtaaagaccttagggtgtgataaaaaagaaaaatgtttccactgaatttggggttacccattgcaaatgataaagaagtaaggcttcttatgtgacctataacaaactgaatcaatatgggaaatgcatcacaatggtaacattgctcaaaacagatgcatataatcgtacaagctgacttctgtaaggaccatacaacaggcatccttcgtgctgtgctatttaaaaacaaacagacaaaaaacttagtacaaagctttagaatcaccgcatagaaaatgaaaatcaaaactttatttgcgtgtgtgcaaataaatttaaagcaaatacctgggaccaagattaatatcctacgtagtaactaaagttaaattggcaaggagaggtagctaagcagttaagagcactggctgctcttgcagaagacccaggttcattgccagcacccacatggtacctcacacccacctattactacagttccagaggatcggatgaactcttctaaccaccttgggcacccagcatagtgaacatacattcgtgtagg

SEQ ID NO: 32050 - DNA, 1146 bp, Mus musculus
agggaaggaaacctgtcttctgtccagggcaccatatggtttctggctggcttctttccttgcagggaacctccaaataatgataaagagagtcttcccatttcacccctcaaatccagagtactggcacttcatgataggaacctgccatatcattgcaccagataacttgttctgttgtcccagtgaagagtgttttttttctttgtttttgtttttgttttgttttgttttgttttgtttttctatttcagttgagaaaaaacagagaaaattagacacttggcttgggttgtagtttgcagatagtgcagtgtagttcgctgggagttgagtctcaggatctcttgaattcttttccagtgtatcacaagccttgggcttggccagtttgtccagtggcaaactccatgaaatctctgaaaaaggtagcttgcttgaagtgtttcctgcagacttacagttgaacatcccatagtattttgatttatgtttcaccaggatgtagacactattaattatttttgcagaacccaatgctggacagatccaagaaggaattggagaagctgtgaacaatattgtgaagcattttcacaaacctgagaaagaggtattttgggcaataaaactatatggtgggactttttatttccccttattagggtatttctatgtaacctggaacttactgtgttgaccagcctagcctcaaactcaagagatctacctgcctctgcctctgagtgctgggattaagggtgtgcaccaccactactgggctcatttgtaagcttcctattggctacaaaaatatcatctgttcagctaccctcagctctttaattctctagtgtggttgttatttggtggggggtgggggggtaagattactttattttatatgtttgagtgtttcccttgcttgtatgtctgtgtaccacatctgtgcctggtgcctggaaaggtagaagagggcattagatcccctggaactacgtctaaggtttgtgagccatagtgtgggtaccgggaacagaaacagatcctctgtaggaacagccaatgctctttaccactgtcatctctccagcccatctagtgtttttttaagcatagaaacaacagaatcccttgtcactgtgt

SEQ ID NO: 32051 - DNA, 1166 bp, Mus musculus
cttgagagttgggcatatcctactctctgactcattcggtcaaatctttgattagtcactttctctgcccctcaactagctatcactttcaaacatgactgattccatctataaactaaccttacttttctttcttttttttaaaaaaagatttatttattattatacataagtacgttgtagctgtcttcagacaccagaagagggtgtcagatctcattacgggtggttgtgagccaccgtgtggttgctgggatttgaactcaggaccttggaagaacagttgagccatctcgccagcccctaaccttacttttcattgtttgggactaaaggtatgcactaaagaaatgactgcattccagccacaccacaactactgtgatctagggagtacctgtattccagctgaatcacataaacttagaaagcctttggatgtgatcccttgccagagcagccatattgttgaactaaaattcctctacataaccagttatagctttaatctgtaatacctcctcactgccaagatttgtgttgaaagcctagtccatccccagtgaattcgtgttcataagtggatcttaagtgttgggattcagacctggaaccaagtggctgaaatgcatattttacataacaaagtgaacctgacctccaggttctcccacctgttacagggcacacaattggcatacccagccctctgtcatgaactgtccagctgacgtgctgggcttccccacccatagaagatcttccctatataacccagatattttggtctccctctctctccctccctctctcctgcattttctctccctgcttgtacactctttctctcattctcttccccatggcaacttccctggtcttgttccttgggaccagtgaacccacccttatccctggtcccttgctctctgcttcctggtcaccataatgtgagaagccatttctgctgcatactgtggttgccttaatatctcaccccacctcaacacaaagcaatggaaccagcagaccatggattggagcctctgaaacggagctagatcacttctcttttaagctgatttcctcagttattttgatatagtatcagaaagataacacttgagttccttatttatctttccagagatattttattaatactg

SEQ ID NO: 32052 - DNA, 1149 bp, Mus musculus
gtgctgtgcagtgtgtaaatctctctttaccttggatggattggtacagtacttttgtatctctgggacctactcttttgttcagtaccttgaaattcatatgaactttataatctgtaaagtttttatagaataaatattcatctgtgaaaatttggtaaataacattaatattttttaaatatctatttatttattatatgtaagtacactgtagctgtcttagacactccagaagaggcatctgatttcgttacggatggttgtgaaccaccatgtggttgctgggatttgaactcaggacctttggaagagtagtcggcactcttaacccctgagccatctcacagcccctacattaatatttcttaacacattaaaaaaatttaaaaagagctgggtgttgtggcacacgcctttaatcccagcacttgggaggcagaggcaggcagatttctgagtttaagacctgcctggtctacaaagtgagttccaggacagccatggctacacagagaaaccctgtctcgaaaaaccaaaacaaaaaataaataaataaataaaaaagaaaaggcaaatcaattatttgattcagctacaaatcagaggtgggaatgacaagactgagttagccacaaccaggctgactgcatctggcttcatatatatctctagtttttcttttgattggggcggaagttactccctagcacaggctatttttgaagtagcaacaatcttcctgtctcagccttccattcacatagtgttttttcatagaaaataataatgcaccagtattttcatataactgtatatattccttaatagtgcattaaaaaaagctgttaagtaggtgtttcctacaagattggtggcaatatgggagctgaatctacaaggaaatttctgcataatcctattaaaatcttgactaccactgaaggaaaatgagattttgtaacttgtgattcatgtaaaaaaagttgtctatgtctaaatcccatggcttggggccgagaacaaagcagaacaggcccaggcatgcatgccagggcagggctgttgttaagacattcctaagaacagcttgaccgtaaagatgaaaaggaatgcaagggcacaagcagggctatcttgtctgagtca

SEQ ID NO: 32053 - DNA, 1181 bp, Mus musculus
tggcccttgacgtttcactccagaagcccttgtagaaatatagttttagcagtcaaaatgaccagaccaagtctaaagctgcgaaaacaagattagcagttctcggagaaataactataacaaataataacagttctcctgtcccgcctcgcactaaattccaagaaaaaccacaaattgctctgaccttgctgccagaattcccccgcgacattggtagctgaccaatgagtttaaaaatattctgctgatttgctgacccatcataatatgattgtaaggcctgggggtcttacaccctcaggtgattctcatataaattctaggtgcaaggctgagcttttttctcccctcagactgtagaaggcacacctgcccggcactaggaccgcggccctggtgcaagcgctcgggggcggagtggggacccagctggacccgccccaacgaaggctgccaccaaacctctgcgcgctctgcgcttggcagaggcctcgtcccttgctattggcgtgtaagcacccgccgggcggcaggtctgcttcggatcgggcttttgttcggccccctgggctcggggctgggttttcgccacctctgtcccggcggaggggcgccgcccgggtcctcgctgtaccgcggggtcgctgcgcgccgggcgggcgcggtctgaggttgttggcccgagaagcaggcgggcttgttgcagctaagcgtcccttccggtttcggaaggagaagcagagctttgttttgtttttcggtttctttctgtctcggtcttccgctccttggcccccctgcgacccagcggaattgccttgcgctccgccttcgagcgcccaggcctgtgtgagcgccgcggcccgcagcatcttggaatctgtttgcatttgtggtacttaagagtgccttcctagaaaaatggaaaaacaggtaaagtgggtgagctggcttgcatttcagtaggccaactacagaacttgcgtggggatttaaattgtctgctgggtgtgttacagttaaggggaatcttaagtttgtttcttgttaccattcagatatactaaggtcttagttattgctccactcagcccccatcaggttctcttttatcagtccactaaaattactaaagaagtatttttgctttggtattaaagggcagtagtggacttgga

SEQ ID NO: 32054 - DNA, 1180 bp, Mus musculus
ggttaaggatatagaaggccagagatactatagatggactaaatcatacttttagaattccttgaattgttagcatttgtaattttgcagagttttagtggattttttttttttgggtgcttttattgtaaattagaaatactggttttcactttaatcactttagtgtactgtttgtacaaacttcattttgtaatgtgaaagcttgttaagcagtctggcaagtcaaaaaatatatatgtacaggaaaagtttaatatcttgtggtaggagttaaggcagcatgtgcaagggccactgaatggcactggcaggaggaattcaggatttgtcccagggcagacagcaggaaagtgctgtacctagacaaggaatgaaaacaaaatccctcacaatgtgaggtaatacgatggtgtgttaactaattctttcctactgtcagccttcctggggactcaggacccagcttcaaagtatagctctttggccaatggagtcctttgaacgaaaggagaaaagggacctctaatgtcagtctctctccactcttctcatcctcctgtctctaaactccttttcatgaagccaaccacagatgtggaaaggctattctgccctctaccctctgcttctttgtaagaattggctataagggttcctctgacctgtgtaggattgccagcctcactcacagaggttcttgccccaaacccagaggaaagtaccacaaggagaccaagaaaaagcagacagacaagtgtggctgaattttccatatgtccactcactactacctttttatctcatcatttttttaaagattttttaaagatttatttattatatgtaagtacactgtagctgtcttcagacactccagaagagggtgtcatatctcattacggatggttgtgagccacgatgtggttgctgggatttgaactcaggaccttcagaaaagtagtcagtgctcttaactgttgagccatctctccaggcccttatctcatcattttttaagttaaattagtttaccctatgtagatgggtgttttgtccacatgcaccgtgtgaggccagaaaagtacattggatctcttgggactggagtaacagatggtttctggaaattgaacttgggtactctagaagaccacctagttcttaactgctgagctat

SEQ ID NO: 32055 - DNA, 1268 bp, Mus musculus
tcagcattggacaattctctgaggtgaaaataaatatcaagcagccttacagtgaatctgttagaccttctggggatggtgttcaggcacttgttcaaaataatcaagaaaaaagaaaatatacctacaatcctaatacaaatcaagtaatagatacaaatgccacaaaagaaaagctggtgagggatattaaatctctagtagaaatcaaaaagaagttttcagaacttgcaagaaaaattaaaattaataaaagtcttttgatggcagctggttgtagtaaaacagctaatacttcttatactgaaccaattcagcattctgaattttcagcaaaagaaatgtctgctaaaaatggcaatgactgttccatggaattgctagcaacatgtctttctctttggaaaaaccaaccttcaaaaaccacagaagaaaatgttccaaaacctttagaagaaaaacagtgtaacacatcaagaatcagtacaaccgtagtgggcagtgccaatcccacaaatgaagttcatgttaagagtttgtgttctggtgttggaaattctcagaaaatgatgagctcatcacaaacagtattgccagttctcataccgagctgtgagtcttccggtgtagctgtaggaaaaggaacagagcttcagattgctgtggtgtcgcctttagttctttcagatactaataccttacctggaaaagactcagtgcctgaagttttacctgaaacactgtatccagttgttaaggaaggtagtgtttgtagcttacaaacccaaccaacagaaactgttgctttaccttttgatgttataggagctgtagcaagtaataacatatcagcagagattcctctgcctgttgataaggaaaagcagcacaaaccaatacagggtgatccagacatagctgatagcagcttaggaaaacactctcccctgggcactgaagttctgcctaagcctatggatagcaccattgtgagtggacctatgttacaaatcgaaagtatctgttctcttgcagaaggggatgtatcttacaattcccagatagctgagatattcaactctgtacaaactgagccccagaaaccttcacctaatcaggtaattgatagtcaacaagaacaagtatatgataccactgaaaataaagactttagcttacagaaagataagtgtgtacagtgtacagatgttcctcatgaggtccctgagcagccagagcctctgcagcctgaagagccagcatctagt

SEQ ID NO: 32056 - DNA, 1152 bp, Mus musculus
gagagcagccctgcaatagtggaatcactatttttgaaattaatcctgtttctaataactcaaaaactcctctgacccaagcaactgaggaaggccatttttctgcagtgcatggtgaaaagaccaaagcatctaaaacaaaagacaacagggagggacaggaattagcctgtcatttttcagctaaatgttacaaaaaagataaaaaaggtaattttaaaataaggcatgatacctcactgaaaatggagcaaaaactaaaaaatatttcatctaaatgtgacataccaaacccctcaaaatgcaataagatagcagcccctgaaatacttcacgtaacaacttctaactctgctaaaaatatgccattttctaaacaagcctctcaggaaagcctacagaagaaacacacgtcccaagacttgggtccagtaaaagcacctatagaactttcgtcaaacacagatccgtgcaggagtaatacctcttcagtacagtcagtatcaccagaaaagaaaaaactaaaattcaaagcaggtggctccaggttgaaatattttgaaaaaagaaagacggatcacgttattattccagatgtagaaataaaaaagaagaaatatgaaaagcaagaacagaacaaaaatgctggagacacactcaaattgtgcagtattcttacagagtcaaatgaaagagccagtgttcaagaaaagacagttccaagtcctgagtcctcagacccaaagggtagctcctctaagagtactagagttataacagtgcaggaatatttacaacggcagaaagacaaacaaataactgggaataatgcttccagaaacatctgtgtagaaactgtgctatgtgactcggggcacacgaagaccagtaagcattctgcagcagtaagctggggaaagttagttgaggggcagagtatcagtgcagagactgcaaaagaactggaacataattctagcagccatggtaaagacttcaagatccatcactctgaggcgtctagaacacacagtgtgtcaaataataataaaggaaagtttgatgggaagcagcctgataaaatgtttaaaaataagaccagtatgaataatgagtccaaccagatgcctctccaggtaaaagaacaaagga

SEQ ID NO: 32057 - DNA, 1401 bp, Mus musculus
tttgccgtgaaactcagactggccttgagttgaagattctccttccccaaccttgaaaatgctgagattataggcatgcactgccatttcagctatctggctttgttttctgttcccatacagatactgtacattttgtctcacttctgattgttgtatatttgttgtactgaacattaagtatcatttttattttctcagatagtgctgactcaagactttctaagagaagcctcagtgcagatgaatttgaaatactacaaaacccagtaaaagaatcaaatatcatgttccggacctacaaaaagatgtaccttgagaagagaagcagaagcctcgggagtagtccagttaaatagtcccaggaagtcatggtttttgtttttaccaagagaacacccctagtcttttcttttcaggctcccttgcagaaaatacctcaggacagtcacatcgggatttctcagccaaggagttcctgtatagcttttcactgatactatgtgactgaaatgttggattagctgctggtgagcaggcaaaaagaaagattgcatttgtctgggaattacaaagtgtatgctaatgatgcagtgatctgcattgttgaactgtgtttactgggttttttgttttgttttctttttttttttttttttttgagacagggtttctctgtagcccttgctgtcctggaactcactctgtagtccaagctggccttgaactcagagatccacctgcctctgcctcccgagtgctgggattaaaggcctgcaccaccacgcctggttcacgtttactgttttaagtcttgctggcacagtggtgcatacctgtgaccctaacatttgactcgtggacacaagaggatcaagaattcagggtcattctcaacagaatagtgagtctggtgaagtcagcttaggctacatgggagcctctctctaaaagcaaaacaacagcaaccaaaaaaggggaatgagggtggcttatacaaaccttactttgaaatgctgtcatcctgaggtaacttggttgtttgactggggctgtaaatagattcttgtttctaagcacattagcaaaatttatttttcagaaagtgcccattgtgaatgtcaaagtatattccaagtattttgtacctcattgtaaaggttttttcagaagtcttgttttatacttttgttaaagtgaatggagtttttggaagatgtcttaacattacttttcatacttgaaataaacatttattttttaaagaactacagtttaagtcttcatggttctgtaagggcctgtgattcctgaaaaatgataccctagattcaaactatgcaacaataaagagcatttattctgcagagaaccagcatggaagggtctaccacacatcgg

SEQ ID NO: 32058 - DNA, 1140 bp, Mus musculus
tggtcccccatgttcatgctcagccggcctgtgtaacaaaatgtgaggatctgctggaatgactgtggctgcacagcggccggcagttctaccacagcactgcggctgctgttgaagaggtcccggaagtaagagctactcgcggccagcgcagcacggtgggctttgaaggcatggcccgtcaccaccactgacacgtcacagtatagtcccttgtagccgctgctcattgaggcactcaaggatgctgttgccgaagtttggaatctccatctgcaaggtctgcgccatggcagcagctgcgctgtggccgcgctccagggcctcccggcgggctccacaacagcagctggggcccagcctgggcccagggcgcgcctccctgtgcctgggcctcggcctcagcctccgcctctgcggcctccgcagcctccacctcagcagcagtggtagccgcggcggccattcattgtggctattgctgatttttgagttcccgacatatgtacaaatcctctctccgataaatagagtgcaaatattgcctctaattctgaatgctgttgtttcactctgtcgattaattttgctgtacagatacttcttaatttaatataatgctagttttttgttttgtctttgttattcgtgtctctgaggtcttaattttaaaaagtattttctatactattgtctgaggtgtttctgctgtgatttctattggattgtagtttcattgcttacatataagatttttttatttattgttttgttttttgagataaagtctcactatgtagccttggaaggccttgaactcacagagatccacctgtctctaaaattcaagtttttggatcaaaggcatataccaccacacctagtgtcatataagtttttgatttacttagagttgattcttgtagggtaagatatagttcctttcttctacatatgtatatacagttttcccagcaccatttatcaaatggctatccattattcaactttatttattgaaaaatcatttgactgtagacatttaggtttccttgtggaattgccatctgtcctattacttatgtgtctgtttttatgcgagtactctaatagggccttacaactttagtaggcctatgc

SEQ ID NO: 32059 - DNA, 2351 bp, Mus musculus
gaagagcagaacttgataggcatagaatacagcttccacacagccccctcagcgaaggtcctccagtacctgcccaggacccttccatggatgtcacactcccctcctgtcacatacatacccccaccaccttagtcacgagctactgtctgtccctctccagaacctgcaggggtgctgcatgttcccagcctctctgcctccctgtcatcccacaccttttccccaaagcaagctgggctgggtcaagagaagacaggcatcaggtggaatctgtgaccttcctcaacactcacggggagccctggttccccttccttttaggcatttcccagcaccaggcccggctaggggacgggcaggactcaagaagagcctgcccctcactgtggctgcttgggactccacgggcccaggggtcttctggacccctcccaccatcccccagtgcttccatgtctccaaatgcgccttcctgtccctctcgtctgttcctgcaccttgggcctggggtaggtggggccaagagggactgtctactttacaaactgaggaaacaagcccaaaaggcatagagaaactctagaactgaccctctgtgacagcctccatcacgtcccttttagtcccaccctgctctgcctctttgggccccctcagcccaagaggtcattccaagagagcagtgctcctatgggcagttgagggtctcaggacaggtttccagtctggcagaatttgtgggtgtgcgtgcgtgcgtgcgtgcgtgcgtgcgtgcgtgcgtgcgtgcgtgcgtgtgtgtgtgtgtgtgtgtgtgtgtgtgtgcgcgcgtgcgtgcgtgcatgcatagagtgtttgcttttaaaaacatgaagatcaagaggcagcaagaccagggtcggaaccagggagcaggctgggagactgctgcccttctctcatccgaccctgggcagggctcccagcccccaccccgtgtacataacttttgtttgtttgtttgtttttttggtttttttgttttgttttgttttactttttattctttttgtgtatataatttttttaaactttttttagagaatgaaatattgaagtattgaaagacccacaacgtgaggactcccccatgttctgactcaggagaggcaacaccccaaaatcacccacaagaaacgggtcttgttgcaaattgcaagaggatttttattcaagagcgctctcgggcccacggtcatacaccacgcaggggtagaggaccgtggtgcgccgagtagttagattagagggtatttaaaggaagaaaccacaacttaaggaggtgggaagggcgttgttggaaaataccaaaaataccagttaagagtcacaaggaagtgcaaagttacaagagtcacaaggaatacctagtaagtgttaactctcaagacagcttctaagagcccctaacaatagcacatttgcattgcaggttctgggtgactttctttgaatgagcactctttaaacccaggaagcgggtgggtggaggaatgtcactatctgttttatgattagcatacctttacaaaggccacattcccaagcctgggcctataggcctagaattctgttttaactttgttatactttcagtataagatttccttttatttttcaaatcaatgggaatgtgtctgaggttccctgagtccctgggctgtggaaggcaggatgcagggaagactgaatgtgtgtgtgtggactgtgggggcatgtttccacaggggcccagtcccagtgccccaggactcccgtggttccaaccagtttcctctcccccgggactacagttttagggtgttcacaggtcccagttagctgagcccactcctgggggatgaggcagggcagggtccgcatctattgttactggtttgcggagcatttctctggccgcactcctttccactctagctctccaggagcagtcttttgggtgtcttgaatttgacatgtgagcacagggtttctgttactcccctccattaatgtcctttcacatctcactggttctgctctagccctgacctccccccctctccccaactctgcattctggctgccttttcagaggcagggggttgcaggattggagaaggtgggatggagccttttgagtcagatctggagacctgtctccaggccagcagcaccctctaatctgccatgatccctcttaacatctgatggtgtgagggaggtctgacttggcccccagtaccttagtcctgggtggccaagtggaggggagtagacatccctagctaaagcacaagcaccttagtcataccccctccctccgccctcgc

SEQ ID NO: 32060 - DNA, 2299 bp, Mus musculus
ctcaggtgtctggtgtgcactgggatttataggccgtgtttacaggttccagccctgcctgtgcttcctgcactgagtatctttgtgaatatctacctgatgatgcaaatgacttctgggacctggtttcgctttggaatctggatggtgatcggtgagtagcttgctggggaagagattctttggtaactgagtccagcagtcttctaattgcttgtctttgaaaggttctgaggccatgtggagaattccccagtgggaacctgggcaaaagggtgatcaattgcacctcactgtctattcccttttaggatttgctatctactttggatatgggatacagcacagcttggaagagaagaatgaccaacagccaacagcctcaagctcccagactctccaggaactccaggaacatactcccagtgttgacttaccttaactggagaaacgggatgcttccaggaccccatgggcatcagtttccttcccttcccttccctttccctttcctccctctttcccttcccccttttcctttcctccctctttcccttccttttattctctctctctctctctctctctctctctctctctctctctctctctctctgtgtgtgtgtgtgtgtggggcgggttgggaaggcagtactgggaattgaacttagagtcttgtgcgtctgaggcaaatgctccatcactgacctaatctcttgtaggtatctttaggtcaaggaaaagtttgaatatttgtgggctgtagatgggacttcttttcttactttctttttttttcttcttctctttttgggacttatatcattgtaattttgtgagcaaattccttaaccttttttttttttttggtgtgtgtattgaaattggatccatgattttgcatatgctaggcaagtagtactctaccactgagccacatccctagtccctttagttatttaactgacagcaaaatttaggtatttacatattatagaatggttaaaaaaactgattaatatatgtttctttttatgtttgggcagttagtcttctatggctaaggtcagacttgaacttgatcttctgaacattattatttatggagagagagaaaacacatgtgtcacagtgtttgtggagttcaaaggacaactttataggttccttctccctttccacttttcatggattgaactcaggtatttaggcttttgtggcaacagctttacccactgaggcatcttgttggcccctgtatcccctcccccacccataaacagtatcataactgagaactatcatgaactcatgacccttctgtcaccagttctccaagtgttggtattataagtgtggactgtgcttgttgttgttttttgttctgtttttcaagacacagggtttcttgatgtagttctggctatccctgtaacttactacagtaagttagatcaagctggccttgaacacagagatctcccccatgagtgcttagattaaaggcatgtgccacctctggcctatcttcatgctcagttactgtggtgctaaacattatgccagggttttaagcacatttggacaaccaatttaccaactgagctacaccccccaaccctatgtttatgttttgtgatgaaaacattaaatttttttaaacattttacagatctatagtgcattgttcatctgtggcaacatgtatatgaacttggaggatgtatattatgttaagtgaaataaatgaggtttgaacaaatatgactttatttttctgtgtgtgtatgtgggtacatctgtgctatgtgtgcatgtggacaccagagaacagcttgtgggagtcagttctgtcttgccatgtgggcttcaggcttgaactcaggtcatcagacttagtagcaagtgccttgactagctgagccatcttgccatctttttttttttcccccaaaacacagtttcattatttaaactaggttggtctccagctcaggcaaccttcctgtattgacctcttgagtgctgattgtagtgcatgccaccacacccagctagatggcctaatgctcaattcctataagattcagagacatgctgggtatgatggctgatacctgaaacatatttctggtagaaggatcacaagtttgaggtcagctcagctttcatggtgatgcagggagggaatatcaaacaagcaaaaaaaaacaagtatgggctggagagatggctccgttattaaacttgctacagtacctgggtttgatgcccagcattctcgttgatgcccagcatt

SEQ ID NO: 32061 - DNA, 1203 bp, Mus musculus
tcccttcttgtgtatctgggttgatttaactcttagttccaccacttttgtcctggtattgcaggtatgtgccaccacagccatgttagggttcttactgccttctttccattccctttcccgcaggaatcctcgccctgggagcacgagagtctgccctggtcaccagggttttcacaggagtgaatcttttggtgctgtgtttcgtctccctctctggcctcattaatggcaagctacacaactggcagcttacagaggatgactacaaactggctctgttagaatccaacaacactgacaggtcaggagtcccaaacaacacagctagctcagggcaggaaggggtgcagagagtaggggtctggttactgggccccaaactgtgccacaactgtggaagttgtgtataattatgtaaaaattatttttaaatttgagacttgtttctctttttttttccttttctttcccctttttctttctgtctttgtttctttcttttttcttttagttttttggagacagggtttctttgtgtatgtagccttccttggctgtcctgtagactaggctgagatctgcctgcctcagcctcctaagtgctggcattaaaggcttgtgccctgccccacccccataagcatttttggttctttcaagacaaggtctccatatatagctttaaaagtcctggatcttgctgtgtagagcaggctggccttgaactcaaagatccaccagcctctgcctcccaactaccaggagtaaaggtgtgcaccactatgcctggcaggtttgtttgttttaaaaatttatttatttattttatatatgtgagtacaatgtagctgtcttcagacaccagaagtgggcatcagatctcattacagatggctgtgagccaccatgtggttgttgggattgaactcaggacctctggaagagcagccagtgctctttttttttttttttaaagattttatttatttatttattatatgtaagtacactgtcgctgtcttcagacactccagaagagggagtcagatttcgttatggatggttgtgagccaccatgtggttgctgggatttgaactctggaccttcggaagagctgtcgggtgctcttacccactgagccatctcaccagcccgcagccagtgctcttaactgctgagccatctctcgagcctcattt

SEQ ID NO: 32062 - DNA, 1178 bp, Mus musculus
acctccggaagagcagtgggcgctcttagccactgagccatctcaccagccccctggctcagtcttaatacctttaatccaagagttttctgcttgaacattttaaactggattagagtcagcccgttgacaggaagtgaacataggattttaaagaaaaaaccatagagtttacgagggagtcagaagggctgatagagagacataccggaagtagaagggagggacctgagtttgaaggaggtgttttggagatgggcttgagggaggggattcattctgggacgaggtctgagaaggaaagtgagctgggtgctttctctgcctctctgagctagcaggctttcaccccagcatctggctctagagagtcttcattggtaaaatacaacggttgagattttgttaaaaacaacgcccaagtgcttgaattaaaggcataaaccaccacaccctgtcaggtgattattcaagatttctcatcttgttttccagcagagtttggatccctccaccaggcactaaagatgttatggcagaacctccatcagtttggccagaagttggttcgccggcggcccctggcggcaaacgaacagtctgagtcttccttgtctcgatgtctgaccactttggacctggtgtccttgggtgtgggcagtaccctgggtgcaggcgtgtatgtcctggccggggaggtggccagagagaaagctggaccgtccatcatcatctgcttcttaattgctgccctgtcttcagtgatgtcaggactctgttatgcggagtttggggccagggtaccatgctcgggttccgcatatctctacagctatgtcacagtgggccagctgttggctttcatcactggctggaacttaatactcaactatgtcattggtgaggagatgggggcagggttttatataagtaggccaggttggtcttgaactctctatgttaactgagaatgacctgaattttgcctctacctcctaaaaatgggatcacgggactccttgtttcatttttatgaatacagggtctcatgtagctcaggctgtccttgaccttgctatatatataacagaagaaggcctcaaatccctgatatacatgcttctacttcaccacactcagcctgccaggaattctttttcttttttcctttcctttcc

SEQ ID NO: 32063 - DNA, 1297 bp, Mus musculus
aggtcatcacggccatcttcattctactttttaaaaactagagccccttttttaaaaggcaggctagccgcgaactcagccttcctcgctcgcccccacggtttggctgggtttactaatcccgaggcagaggcaggcccatctgaggttggtctggtctccaaagaagacatttagaactaatgtgtgtggaaaaagagttgggcttttttttctgacttggtctacataatttcaagggaggaacgagcctatgtggggaaagtgagtagtctgggcgcgagtgaagtttggggaccagaaaccaaagctaggagttactgagggcaggtctagggagtctatgcagtacatttcattaactacgtggtttcattgtagaaattttgagtttcactataccttgagttagaccgatgtactaactcttccttgatttcatccaggtttccttcaggttggagtgaattttaagttctccacgttctttcctcctggtaaatgttttaacgtctggaccgcctcatcttgcggtactcaaactatgggggcacttttttttttctttaaaaagtgccgcctagttttaagccccgccggttgagaaaacggctatctggcacatttaccagccctggtgccacgtgttccgggttaactgcagcgtggtgagtacggattcgaagaaaggaatgagactgagtatagcgaaaggctagggatgggcatcctgcccagtagacggtaactgaggtggtcgttgtagggtacctgggggctccatgtgcgtcctgtcgctgcttggagctgttacacctatgtagcggccatcaaagtggaggccctctcttgagcctgaatgagaaagtgcttccactttgtgtgccactgcatggggaaaacatcatagctttgcatctgacgcatcggtttacaggagcggacaacctgtgtgggggtttaggcttggagtttaatgggtcctatcctaaagagggcggttcagttgggtgccacgagacgcggatggatgtaaggcagtcgtgagtccaggtgcattgtagattgttcttaagcttgacctccagcctgtgatactcaaactgggggctcttttggattttcatcggaagaaaagtgccgccaggttttgagtgtcaccggttgagaactcaaaacggctaagaactaagaattaagttttagtgggtcatgttttcactggggttgcatttctgggcaggtgggtgtcacatgtgggtttgagtccgaacacttgggcgcatgcggtactaaa

SEQ ID NO: 32064 - DNA, 1297 bp, Mus musculus; identical to SEQ ID NO: 32063

SEQ ID NO: 32065 - DNA, 1297 bp, Mus musculus; identical to SEQ ID NO: 32063

SEQ ID NO: 32066 - DNA, 1297 bp, Mus musculus; identical to SEQ ID NO: 32063

SEQ ID NO: 32067 - DNA, 1358 bp, Mus musculus
tttcaatttttttcctttttctccaaacagggtttctctgtagccctggctgtcctggagctaactcacttgtagaccagcctggcctcagctccatccacctgggattaaaagatcctatatatcttgcttgactactgtagttgctatatcttgcttgactactgtagttggactgatggttgtgagtcttgatatggttggattgaatttttaggacctgctggctgtagctgactttaacctggctcctagcacaaacaagcttggtggacagccgggtagataatacccataataccttttggctttacaatagcccaggctcatgagggctgggattacaggtgttacattgtgtgccctaagcataatcttcatggattctctttgtttttcaggtgttccagttgagttgaatgtaatcctgcctagcctggggtacttacttgccttcaacctgcctggctggctggtctggctaagaactgactataaagtttcaggtttattaccacagcaggtccctgtggaaatgcttcaatctgtggtactcaaactgtgtgacattttgttctttgtaagaagtgccgcagagtttgtagtgttgccgattgagaaactgcagttggcctaagtgttgcatcatttgggtgtcatctgtgggtatgattcagtctgtaatggggcaaaagtaaaagctgaggtgcacggaacctcacgggaagtgacccagatttgacaggtactgtattacatatagctgcatttatccttttggcattgaataatccttaatcttcagttcagttgtaggcatgtttggatctagcgaaattccatatagccatactcaaaatggaggccctatctaagcttttaagtggaaagtgcttcccttttgtgtgttgccatgtggagaaagcatcggaacttcaatcaaccagagactccttgcttgctcatcttggtgagactcaaatgtggggcacacttctggactgtacatagaaagtgctactacttttgagtctctcctgtgggcaccattcacaggtcggctgctttcatgcatgtgtagtgtgtatctgaatccagatgaaggtttcctggaactgggacatgtgggtgctattgaatgaaccaaggtgctatgggagcaaccagtgccctcagcctccaaacatgaataataaagtcttgttctcttgattttgctgctttctcagtttttgttttaaaacacccgccatggttcctagggataaaaaaagcttgcaagcatgcaagcacccttttaatcactggggttgagactaaaggtaatcctgggctatacagaaaaaccctgtctgaaa

SEQ ID NO: 32068 - DNA, 1358 bp, Mus musculus; identical to SEQ ID NO: 32067

SEQ ID NO: 32069 - DNA, 1358 bp, Mus musculus; identical to SEQ ID NO: 32067

SEQ ID NO: 32070 - DNA, 1358 bp, Mus musculus; identical to SEQ ID NO: 32067

SEQ ID NO: 32071 - DNA, 1885 bp, Mus musculus
cacagtttgcctcgttcattttttttctatctctatagtctttcctgtgggttttatcacctgcttattttcttgggagccctaagaaatcttgctttctttccctcacccctcaaaggtgctggccccacacatcccacactcctttacagttacccacactcttttgcagttctttactccaagggtctctttaggggcctcattgccaaagcatgcctgcctgcctgcctgccttagctgtgccttagtctgtgtgtgtgtgtgtgtgtgtgtgtgtgtgtgtgtgtgtgtgtgtgtgtgttaaggggattgggaagcaggccatataatgtacctctcctttaaattcaaaacaaagcaaacaaaatcctggaggtcagcaattcccggtggccagaagtcagcattatgcagtctctgcctctacttgtcactcaacgttgcaccaaattggctctagattttttttaccaggcttactgaaagcccaccacctagaggatagataccctagatgaagcaatggatgggcaccttttcctaaacgattctctgtgctatttaaacaaacccaacaaaaatatccacatggtatctctctctgtgtctctgtccctccccccacccccagggtttctctgtgtagccttggctgtcctgaatttgctctgtagacgaggctgccctctaactcaagatatctgcctgcttatgcctccctggtgctgggcttaagggtgtgtgccatcactgccaggccacccatatggtcttaagacaactctgaagtatttctgagcgtcagtaatggctgctcgcttatctcagtgttaaaaataacaaggtctgctttagcaggaatgagaagagaaggagcctttgccggccttaaaggcattaagatcattaagctcatcttttccttttctgaacacaaacaaagcaatcaactaaaaagccctttttttttttttaatagctttagagattttcttaatgtggcccattctggtctcaaacataattgtgtaggtgaggcttccattgaacccttgtctttctggctccaccttctgggtgctgagagtacagatataccaccataccctcgttgtgtagccccgttaaagagagaaggtccttagacatcttttcttgggctacagggtaggtttgggagtaacaggattggaatggcttgtgtgtgctgtacatgaacccgggtcctctcatgtgctgcttgcttcttgctgctgctttctgcttctttgacattactaggtatatatggataaataaatgtataaatatatatatatatattttaattttctggagctttgggttcctgtagctcctgctgtcagtcaccctttcccacccctcacatccataatgttctttttttaaaaaacaaaaacaaaaaaaaccctcaatataatgataacaggaagactcatgctttctttctctccgggtgggtggggaggaatgaaggactccaagagagaggtgagactcagattcttcagtttgatgacagaaggggcgtaggactaagacaaccttggcctcatcagaaaacagtggcagagcctgggtctccccccccccaaagttatgtatttattttaattttatgtacattgttgatttgccagcatgcatgtctgtgagggtattgggtcccctggaacgggagttacagacagttgtgagctgccatgtgggtacagggaattgaacccaggtcctgtagaggagaaccactgaactatctctccagcctccccgaatccccacccctttaagctggtctcatgtagacaaggctggcctcaaactcaatatgtagccaagtcctacctcctccagtgctggg

SEQ ID NO: 32072 - DNA, 1140 bp, Mus musculus
tcccatgctgtgagccccaaattaaatactttcttttatgagttgccttggtcatggtgtcttatacaatattagaaatcctagccaagatgagcagtattagttagccttgactgtcaatttgactcagcttacagtcatcagaaataagaggcctcaattgaggaattttctaggtcagattggtttgtggccatgtctgtgaggggttgtcctaattattaatcaatgtagaaaggctcatctcactttggatgacactactactcatgcaggtggtctggaactgcataaaaaaacccagctaagcagaaggcagagtgagcaagaaagcaagccataatttagagtttctttttttcttttaaagacttattttatgtgtatgagtattttatttgtatatgtatgtatatgtgtgtaccacattcatgctaggtacccagggaggcgagaagaggatgctgaagctcctacaactgcatttatggatggttgtgagttacatgtgggtgctgggaattgaacccaggtcctctagaacagcagccaatgctctgaaccactaggctatctctccagcccttctccatggtttctacctttagttcgtgccctgactcccttgatggtggattgtaacttatgtgatgagataaaccctttcctcctccaggctgcttttggtcagaatgtttttatcatggcaacaaaaaacaaagcagaatagacagaatgtatatacagaacataggttaaaaaaaaacacaccccactcatttcaactctcatcaaaccctacattttaagttcaaggattaaaactgcaaagaatggacagctgcccactggccaatgtccaagtggatggaagaaagtcagatctggttggtccttttggtgaggaaagatgctccttacaaagagcgtgggttatcttctctcagaatgttataccaagagcagtctcatccggctgggaatatctgctgtttgtgttgtttattgcagttttcctggctgaagcctggtgcagttagagggggtcacttaacagacccaggtacaacaacagactttccctatgccactgactgttgggttgttagggggagtttctgaccaccagattaacggagc

SEQ ID NO: 32073 - DNA, 1200 bp, Mus musculus
ccctaacaatagcacatttacatagctgtttccatgaaaggtcagggtgggtcagggtgactttctttgaaggaacattccctgaatccaggaagcaggtgagtggaggaatgtcgctttctgttttatgattagcatgccttggagcattgagtcacaaaggtcacattctcaagcctgggcctaaaggcctagaattttttgtttgtttgtttttatgttacactttttcattacataataatgtatattatatatgcgtgttgtatatatgtcatatatgtataataatatatttttctataaatactgtatgtataattatattggattttcaagatacggtttcttggtgaagccctgcctgtcctggaacttgctctttaggcacctcaaactcagagttccgcctactgctgcctcctaagtgctgagtctaaagctgtgaaccatcacccatcaccacaaggctgtataaatatattcatatataaatctgtgtgtgtgtgtgtgtgtgtgtgtgtatgtatgtatctgggttccaaggatataactgtgattgccagatttatgtagcatgcgcgcatgcacacacacaccacaacacacctgtgaaggtcagaggacaactttcaggaataggttctctccttccaccacatatgatccaagtcagatcatcagactggcagcaggtgcctttgctaggtgagccgtctctctagccctgctgtaagttagcagatggaagaattcttctgtagaatctttagaatcttctaagtaatacgaaagatcttgtccttgagagtctagaaaagaacacccagcctagacatcttaatttcagagtctaggagccgtgtgatgcccctcttctggccaccacgggcactgcatgcctgaaatgcaagcatagactgacttgcaagatagatggtaagagagtggacttacaaaaaaaaaaaaaaaacgaaaaaagagagagagagagagaggacttacagcatcatacaccatgaggcgtctattatttttttacatcccttcatttaaatggttcccagggagcaggacgatatgtcatatacaactctaagatctactttcttccagggtcctttgacaaactcaccttgaatatctggcccagctctgtggttcccaccagaggcaatgtgactctgctatgtatagcta

SEQ ID NO: 32074 - DNA, 1160 bp, Mus musculus
gacatctgtgtaggagagtccttaatgcattgaaatgttctttgtccacgcttttttttttcctttccttttcttttcttttcttttttcttttcttttgagatagggtttctctgtgtagccctggctgtcctgtaactcacttagtagaccaggctggccttgaactcagaaatccacctgcctctgcctcccaagtgctgggattgaaggggtgcaccaccaccgcccagtttgtccacacttttaagttaccctaacatgctctctccagatttctgttcatctcccagttcctttctctctgttggagagatctccctcacttccctgtgtctttgcgtctgttgaatctctggccctcactttcctttttccctggaatacagacacaaaccagctgttttctccaggactctggagagctgctgctctcagtggcgcatccttctgttttgcagtgcctgtgagagatgacgggaacatgcctgatgtgcccagccaccctcaggatcctctgggtccaagcttggactggctgaagaacctgtgaatgcctctgctgatggaagaggccccttccctgttgctctccaataaaaatgtgaaaactaataaccccacaatcttttctttcgtgggtttcttttgttgttgtgagacaaggaagtctcatatgtagtgtaggcagacctggaattcagtgtgtagtcagggtagcctccaaccctggaacctggatatgatcagaggtgggagcaataaacggtgacctagacaagtgtacatagggaatctgtttattggggagagggttagtcaaagggtgggctggccagggtagggtagggtagcaatttgtctggctctcgggaaacccaacttgaatccaaggcctcatctgcttcaaagccaaagtcttcctcaaccttaatctgaaaagatacggaacaagatgcgagggatatggagacccaggagacatactacccccaagcacactcaccaatcagcctatgggcactggtttcccaggttagacacttcccacaatcaatcactgacgaccatccctcagctgactttctcttcaagcactagcctggttttccaactcctctatcctacctgatagcaacccagtgttgccagtctgccca

SEQ ID NO: 32075 - DNA, 1171 bp, Mus musculus
gggcccgttcagcttccgtggagccgtcggcagccgctgccgggcctttccttgatccctgaatcccctactcggtcgtctagaacaatcccgggcccacttcctctatcaacaacccaaccctacttccggctttcgcgccctcttatcgcgatagcgcccgggctcggggcgcgaggaaagaggaaaaaaaaaaaaaaaaaaggcggcgggcgggcgctcgcctctctctcccccctcctcgcctgtcgcgatacgctccgcagcggcggcgccagctcctgcggtgagcgtcaggttcgactgggccggacccctttccctcttccctcagctccatcggccgacttcttgctccgcgaccctgctgcctgtcgcgacacggcctcagctcccgccgggcccaagccgcgcgctcgggcccagcttcggctcgggcgggcggggaccctctcctctctctgtcctcccgcgtccggactcccgcgtggcagagcgccggccccgggtgcgaggtgcccgtcctcctccgcgtctggctgggcttggagcggtgggcgcgctgcgggccgcggaggggtctttctgctctgggcgcggggcccactcctgcagtcatgccttccccgggagctccattcgggagcgttgcctcagtgcacccgaaagctccagcttgttggtgtcttgatagggggaagcctctttggaagagatggatcttgtggaggaaaaagtccccaagacccgagggtgcagttaacgttgtgagttggagcctaagccaaagtttccacctagtccttacagctctagcagtgaagtctcctagaggtccctttccaccaatcttctttttaaggaagcatggggtttgtgagtgtgtgtgtgtgtgtgtgtgtgtgtgtgtgtgtgttttgttttaacactccctccccaaaccttggattcaggactgtaccgtattgctcacttcctggcttcacatcttttgcatctttgaggtggggtatcagtggactctagctttggggatgcaggctccactacgatgcacggtctgcctcggtgggtgaagcttcctaagtggttaggtattgctgtgtgtggtgaggaccgcttagcttttctttctagatctgggtcggtggaatgcgagctcccatgcttt

SEQ ID NO: 32076 - DNA, 1114 bp, Mus musculus
cctgataaacggacagccagtttccttcccatggactctacctttatcactatcattaccgttgcgctgagataggatgtctatttccggcagaggtcagaatggtgggaggcctgggtaagacttgctgacaggtaagccaggcagaggccaagttgtagggtagcgcaggtattacaggtttctagggatctttagagccaaaagggtttgaggagagagaaatggatccttgagatgtcagaaacctcagatttgtcctcactgggacagaggatgggcaaacttctcactggcccatgttaggagggctggagcagaggcacccttggggtgccctagtgatgggggactgaggacaggttctgtgggggcaggagggctggccaggtgctctgcagcccctgagcctggccctgggctcgccagcagaagcaggaccggattgagggcttgaagcggcatatcgagaagcaccgctaccatgttcgtatgctggagaccatcctgcgaatgctggacaatgactccatcctggttgatgccatccgcaagatcaaggatgatgtggagtactacgttgactcatcccaggaccccgactttgaagagaacgaattcctctatgacgacctggacctcgaggacattcgtgaggccctgggctgaccttcatggcacagagggtgagggcaggaggcatggctgtaccagctaagcatgctgctcccctacccccacagcacaggcgctggtcgccacctccccccccagccacagccacatggaggacgagatcttcaaccagtctagcagtacacccacctcaacaacctccagctctcccatcccacccagcccagcaaactgcactacggtaagtgtccaaggttattaataagagggtggtcatggaggagtcaaaagcctagtcttgccttagagagggcagctcaggaagtgagctctaggctttttgtgctctgaggaacggatataaaaaacctgggtttccactcagttttagggtgcacatgggtctttggtggtggtagtcaggaggagttggggtgtggaaagctgaggagctgagcagctgggtgtctcccttctg

SEQ ID NO: 32077 - DNA, 1149 bp, Mus musculus
tcagacatttgacctagctgctttcttggtgtatgcgctccaaccttgacatcagtcttcctatcctgccctgctttggtccttgacacgaatatcttaaggcattgagtccctcagaatctcagttacagtgaagtgtgtatctccagagtgctagatggtacatatgttgcattgtaggccacctgttggtccctactcctcagtgtcacttaataaccttaggccttacgtttgtacctgcagcccatgtggggcaaaggccaggcttggcccccttcttcactcttaagatcaccaagggaagggtggagtctgacagtgcaagcttgtaggacaattggcttggtacttccatgcccctgacaactacctcttgtccatctgcctggcccagatctcagtctccctcttcatccactcactgaccaccttcttccccggccagggcacctacatctactttgactacgagaagtggggccagcggaagaaggaaggcttcacctttgagtaccgctacctggaggaccgggacctccagtgacaccggcccccctctaccctctccctccctcgcatgctgatccccctgcccaggtgagggccctgccctggaagactgggggaggcccaaggccatgggacaccctcccccccaggaagcagggaagggatagggaggttttctcttcctctctgccctaccctgggggcctgggggcaagggctgccccctcctcccctccccagtgagggacattttttggtaaacctattttcattttggaaaatatttatgaataaatagttttatatgacggctggcagctgaggcctctcctatccccacaagagagttcagtgggcaggagttgggttctgctggcggggtcgccgggccagctggggattgaactgggagttgtatcgtcgcctccgttcatctgtctcttctgcttccacctggccttgctgggatacctggccttgtacccgggccagcagggcctctgctcgagctctctcggctgcttcccgctgaagacgctcagcacggagcttttctagggaaggtggcctgcagggaggaaagcaagaacagaaagtgagagatgccacctacctggtccttggactcactgcaag

SEQ ID NO: 32078 - DNA, 1646 bp, Mus musculus
ggctggcctcgaactcagaaatccgcctgcctctgcctcccgagtgctgggatcaaaggcgtgcgccaccacgcccagctcaacaatatgattattaagaagctgtctgagcatgctagggatgcagcttagtgctgcattattgcccggtttgtgcagggtcctgagttcagttcccagtgacaatcatagcctctttggctttcaggatgcaggaaggaagagtgggcctgaactcctaaatctgagggaggagggctgagccctgtactcctgggcttgaggaagggaggcatgagacagtgaggactgaagcttgaacttgtgtgtcctgactcaatatcttcctccaggagtgcctggaccatgctgttgagtgcctactggcatggcctccaccctggttactacctaagcttcatgaccatcccgctgtgcctggctgctgagggctatttggagtcagccttgcggagacacctgagccccgggggccagaaagcctgggactgggtccactggttcctgaagatgcgtgcctacgactacatgtgcatgggctttgtgctcctttccatggctgacacactccggtactgggcctccatctacttctgggtccactttctagccctggcttgcttggggctggggctggttttgggtgggggcagccccagcaagaggaagacaccatcccaggccaccagcagccaagcgaaggaaaagctccgggaagagtgagctctgctgcattggcctgccttccagttcaagcttttttgggaattccatgaaccaggctgtttgtttggggtttttgtttgtttgtttgtttgtttcctttacccagcaagaatcccttgtttggctaagagcctggagaggatcccctcttcccaaataattcctctgccttctatttaaagctaaggtatccttctcttgggctctctcagcatcttgaccttttcagaccttcctctgctaacatcagggtattactatccactcttgaacctattatctctgcaacaatcttcagatgttcaaaaagccacacttcccaaaaatgcccttgcagggaccagtggtcatctggcatcttagacagactcccagtgggtccccagtatgggggcaggaacttcagggccaggttctgggagaggggagggatagccttcttgttttcctctttgtttttatcatcacaccagtgtttcagagaccatggtcttacacatgctgaaggagaagctaaaatgtgagaagccccaggggagcttgctcttacagcagcttctgcctgagccatttctgggctccccatacaacctaccacccagtgtcatccttggcctgtgacaggccagaatgtataaagctttcccaataaagtgttacacatgcatttgtttgtgagtataactgtgggcaacaaaccaaagacactgacccagaatgccagtgtgcatttgtgtgtgtattgggggggtggggtgggggggtctggctgccatgaagtttggccgctcaggaggctgtaaggacttcaattcccaggagacctttataggaaatgtaccgcagtcacccgggtcacctagtggccaggtgcagacctgtagcaggcccctccctcc

SEQ ID NO: 32079 - DNA, 3333 bp, Mus musculus
gatggtgtaaggtaacggagccattcgaatcttcatgaacatgctgagtaagagggtggggcgaaggtggctggaagttacaacacggttgtggaacaatcccattttcaagttttctaaggcggatttctctgagagccgagttggtgtcgccgtgtccctagcggggttttgctgcacatgcgccacaagattattttttaaaacgacactttactgcgcaggcgcagccggcctagcgaggtcaacatgccggtcgccagaagctgggtttgtcgcaaaacctatgtgaccccacggagacccttcgagaagtcgcgtctcgaccaggagctaaagttgattggtgagtggccaaagtagaatttcgaattgcggatccgggaagagttaggtagccatgatgtctgtctcccacgtgctcgttctggagcatcctgtgtggcgccagaggattgcagtttagttttgtgttctctagtcgccatgcacatgtagtaacccatggctcttgccccgcggtctcctcccaaccacgtgcaggagagtatggactccggaacaaacgtgaggtttggagggtcaagtttaccctggccaagatccgtaaggcggcccgggagctgttgacgctagacgagaaggatccccggcgtctgtttgaaggtgtgtatgagcctattttcgaaggagtggtggttgctgagtgttttagggcgtgggagatgtgactgaacaagttgggctagtggggattgagacagggtcttggtgtagattggcctggaactcaaatgtaagtcagtcttgccataaactgccagaaattcagaagtgctgggtatgtgtcacaaggattcttattggttattttatttacatttcaaatgttatttctcttcccagtttcctctctgcgacacccccccacccgccccccaatcacaccacaaggattctttttgagtttctagaatctagttctgtctgcattggacaaatggaggccaaagacaatgggagttgcactaatgctttttctgtcttaatactggatgttttatttagtttcatgtggtgtaagaggagtaatgattatttttccatccgggggacgtatttttgcatttgcatctgggtagcgtttatacaatgttaatccaggttgagcctatattttaacatatttatattccatacttagggtttcttataggtgactgggcctacatacacagttcatttaactcctgggagagtagtctgaggaataaatgtgtgctgtttgtgtatatattgttggcctgatggtactgtgtagctcagattgcctttgaactgttagccctagcttttcatgttgtgaaaatgaaaattgtttttaaagttgagcattagagctcttaatcttaggcttaaaggctggatgaaaaactgtaagcctgcgtgatgcctgttggtgaaagggtggcacagtggccatgtcagggtctcaagcctagggctctgggaagaaaagttatcaggcaccagagctccctacaaaaatgagtgaaagctgtagtcctctactcagagactggggaagtctgaggtcgggcctcattggctgctgctccccctgtcacaggcaatgctctcctgcggcggcttgttcgcattggggtgctggacgagggcaagatgaagctggattacatcctgggcctgaagattgaggatttcttggagaggcggctgcagacccaggtctttaagctgggcctggccaaatctattcaccatgcccgtgtgctcatccgccaacgtcacattaggtgagttgcagctgggcctgtaaatctttatttccctacttgtgccgttggtttcgttagctaagttgccattctatctcctgtgcagcctttggagctgacagatgtgagcttacccttgagggttcagaatcgtgccctgcaaacagcttatgggggactggggacagccttgtttccccatagcccagcgcaagggtcactgcggctcaagccgtacaccttgtgaaggtgtctgccaggcactcaagcagctggacaggtaacagctcttggtgccaccccccctggagggagattggagtcaatgttgaggtgacaaagctgtctgtggaggtacaatctaggccttcattgctatatttctacttgttaatttgccagttgagaatgcacctgtctgaagtgactggggtaaatgaaattgcatgctcgttaacccttctgtaaatgagcaccaatcatgacagctatacagagtgaagtctcagatttctttctcaccagctttcgtttatgggcagagatgtactcttgtctgaggtggtttgagaccacatggcattacaatgtggacaggaagcaaatcaaagcattagtatgggcactcttgttttccttccaagttactgagtctgaggtcaggagtgcctgtgagcctgcttgagtcaaagggcaggaccaaatggttcagcctcactttgtccccttattctgttcttcctgtccagggtccgcaagcaggtggtgaacatcccatccttcattgttcgcctggactctcagaagcacatcgacttctccctccgttctccttatggcggcggccgtccaggccgagtgaagaggaagaatgccaagaaaggccagggcggggctggagctggtgatgatgaggaagaggattaattaatacttggctgaactggaggattgtctagttttccagctgaaaaataaaaaagaattgatacttggtttattggtgtgcctctgtagtgagtgcaactgctccactacacataggctgtgctactgtccaactaacctattttggtaaatgttcccaagaagggagacatgttatctgcactgtgatacagtggaaagcaagccatttggagccagtctctagtgagattgctttgaatacttctagggtggctcttgtaagtcatctgcctcaagatgtggttttgctgagcaggagataagctagtgagatgtttgcctagggctgcttgagaacttccctatctaaagctttgtgttgtcctgggcaggagcgaagctggcttcctcattctctatttcccttgccgagaagcttgagtcagacaggaagatttgcagatacgcggtttgaactgagaaatgagagcaagagcaactgaaggacagctgcttgctacttctacatttcagtccttgagaaatcaagtcagctttttaagatttatcataaattagtacactgtagttgaccagaagagggtgtcagatctccttaagggtg

SEQ ID NO: 32080 - DNA, 1159 bp, Mus musculus
ccaggcaggaaaagatgaggcactcaataagttatcaagtaaaaacaaacatggcagagtcaaaagggaaatttattgtctggggaacaatatgtatgtagttctcatttgtttaaaaaacaaatagcatacatggcaaagaaaaacgtggttaatacataaacataattcaaaaagcttctattatctaacaaaaaagacctcaatttaataataagtaactgagaaaaacaaaaaccccaaaacaaatggataaaattgtcttttttgtctttgttgttgttgttttggagacagggtttctctgtgaaacagccctgggctgtcctggaactctctttgtagaccaggctggccttgaactcacagagaagagcctgcctcagcctctgcctccctagtgaggagattaacggcgtgtgacggcgtgtatcaccacacccaactaaagtgttcaaattctaatgattagcaaacacaatgtgctactttcccctttcgagtacctatttgttgtgggatttagagtggagtgtgggctggtgctggtctggaggcccagggaacaggttctctaaatatgctgcccagagactgtgaatcaccagctatgtgaaaataataataaacaaaacaaataaacaaacataaatatgcttacatgtgagaggataaaaactgcatctcttatcctggtaatcctttgagggaccagcttccagaaagaaataaacaagcaacccctggctcagttaaacgctggagacaaaactaatctgccacagtgggactcttcccaaagaccagcagctctgtaggggagatggcagagcagggtcctcaagtgactacagaagcaccaggggtatccctggttcttgcacaatgctggtttggattcctatgggtcctagtcctggcacctcagtgttaatgtaagcaagttatttgactcactgaacctctttttttggtttttcaagacagggtttctctgtgtagccctggctgtcctggaactcactctgtagacaaggctggcctcgaactcagaaacccacctgcctcttcctcccaagtgctgggattaaaggcgtgggccaccactgcccagtttttttttttttttttttgttgttgttgttgttgttttggtttg

SEQ ID NO: 32081 - DNA, 1179 bp, Mus musculus
cctccagcacggattcacgctcccgctcctcatccaggtctcccacgagacactttcggagaaggtgtgcaggcttgggctggaagggcgctgggggggaactgcgtggagcctgacccttgtgcttcaggcctgacttctctttcctgtgcagtgactcccattcagactctgacagctcctactcagggaatgagtgccaccctgtaggccgcaggaacccaccccccaagggtcggggtggtcgaggggcccacatggatcgaggtcggggcagggcgcagcgtggaaagaggtgaggtgcttagggtgtgatttcttcctaggcatgggtgggtggtattgggtctcacaggtgggggagatggccttcagagtggctaaagacattgactttcttttttaccctttctccccagacatgacctagctcccaccaaacgtagccgcaagaagatggcagcactggagtgcgaggacccagagcgtgagcttaagaagcaaaagagggcagcccgcttccaacatgggcactcacgtcgcctgcgccttgaacctttggtgctacagatgagtaacctggagagcagtggagctgaccctgactggcaggagctgcagattgtgggcacctgtcctgacattacaaagcactatctgcggctcacctgcgccccagacccgtcaactgtgcgacctgtggctgtaagtcccaggcattgtgtgtctgcccccagaatgtgttgggcataacataagatcgggcacatggaacatgttgggtgaaggaagtggtagctctggctgagaaaaatcctagcatgcaggcccttcacatctggggcatagcctggtcacaatctcccttatgaccagcaaagttaagggagacttatgtgtggggccctagagccagggagacttggagcactcacacctgctgtgtgttggtttgattttgtttgttcatagtggtgagtcactgatactggctttggtgctgctctggttgagtggggcacagtggctttggcctgtcagctgtctggccactcagctttgattctcttccctgaaggttttgaagaagtctctgtgcatggtcaagtcccactggaaggagaagcaggactatgcctttgcctgtgagcagatgaagtccattcggcaggacctgac

SEQ ID NO: 32082 - DNA, 1468 bp, Mus musculus
agcattgctccttgttcttgggccctcccttgtctgtttgcctcatcattttctcctcttgtctccatagcttccgccctgcgctgcccgtctcctacctgcaggccgagttggccttcgagggcgaggccgcctgccgggccttcctagagcccttgggcctgtcctacacgggcccggacaactccagcgtggactgccgcctcagcctggcgcagctgccagccttctaagcacccatcgagcacgggcgggagcagggctgtggcccagcgccgccttttcacattttttgagccatggacatgggttgtaaaaatttgtggggagtaggctccaggaagagccagcatccctgcccccgtttcccaccggggacctgtacagagatttttttctacatttttattttttgtctcagaggggataattgggagtgtatagtggagcagggtggggcggggctacaggttctgtgtgcacctgtcacctccactaacgctgtctcagtgttttctctctctctctcgagctcgtagtccagcgcctgactctgcgtcggcccatcccacgctggggccagcagaaagaagacaggctgtccaggccgcacccgctgcagtggggcaccagccggccacacccattgcctcggctgcctcttcatagactcttgctgcccagccgttggggcctcagtgtttggggtgagggaagccacttaaagactatgccccaccttcagctcctcaccccagaaactccagccagcaccaccgacacaaccagaccagcgccacaccgcactgaggactccaaggccttcgcgggaccatgccggccgggctgcctcgtcttactcaagttgtattaagttgtctccgtgtcccttcctccctctgccccaatgtttcttctgattttttttttttctttccctcctgcctcttcccttcccactccctggttcaacacaggtaaaatggttaccctcccttctttcctcccctctgccttcatggatcaccaactcacgtcatgtttccttctcttttctctgtgtgtgtgtttatttaagttacttttcttccttctccccttttctttttacccctcccccttctgccatgtaactggaggatgtgctatgaggttgcaaacagctggactgtcaggctgctttttcccagatgcctccctgcctccctccctccctctcccctcccttccttcattctccttgagcattgagtacagtacattttggaagcttgaaaccaaaattaaagagagagagcgagaacctgtttctgcttggcctgttttatccgaaatatgaaacctcggtcatttcagggaaatttctaccaagggaagatagctatgccctgctctacccatgcggcaaagccagagtttacttaggggctgccttcctagctcctggttcagggtgtactcaggctta

SEQ ID NO: 32083 - DNA, 1179 bp, Mus musculus
attttgagacctgaggaaagtgagggtctgttagttcgacaacttgctcttgaaaacgccaattcagcatgtagggctgccctgagaggtaaaaccaagagtttagatataaatggtatgatcaagctttgtaatgaggtagatgtgttttctcaacaagtttctaagtctattaacctggccattgggactgctctaactccagctccaagattggtgccgagccccattggcccaagttagaagtagacatctgtgtcctcacattgggtgcagatgcctcctggggcacccctgattattatatgcctcaattaacagcagttaacacaggtgaatttgggccccctcctcaaaagacgttttttctcatcatcggccgagtgtccagacttttacaaggcctaatggtgactcctatagtggttaacaccgactaccatggggagataaaaatcttagtctccgccatgcagggaccacttacccttagggctggagagcgcatagcccaaaccttaccactcccactattcggccattgcccttatttgaaagaggagcaaggaccatcctctctgggatcctcggaagtctactgggcacagaaaataaccgattcacggcccatgctgactttgtttctagaggacaaacagtttcaagggctcctggataccagggcagatgcgacagtaatttcctcaacacattggcctgcagcctggcccttacagcccacgaagggatggtgtaatccactgatcataaaatttactgctaagaggagaaacttagaggcttgagaaagttctcgccctctcacctggggcctaagattgtatcaagataactatgacaatggcctgacctttaaggttccgcttctaacaatcataaagcatccataggacttccaggtacccgcccccctgttcctgccccagggtgtgctacgaccctgtttcagcccactctccctgcggggaggcccccctcttccactgatttactgtggtctatattaaatgcttctgctttagccttgttgtataagacacaaagagataatgcgtcagaatctgaagattgttggatgtgcttttctgcttccccgcccttttatgagggcatagccttatttgaaaattttaccctgctttcagatgctaggcagct

SEQ ID NO: 32084 - DNA, 1127 bp, Mus musculus
ttttttttttttttacagagagggtctcactttgtaaccctggccttcctggaacttgctatgtagactaggctggccttgaactcacagagatctgccatgcctggaattaaaggcatgtattactatgcctgtcccaggtacctgtgcaggcctacctgtccaaggatggcaccatccacagtgggcgtctacctcctacatcagctagcaatcaagaaaatgctccacagacaatccctcaggacagtctggtctaagcagctcttcacatgagggtctctctctgtcttttacgaatgtcaggttgacaaccaaatgaaccagacagctcttgattgcaaactgcaaagggtcactgctcccttaaggatggtgtgggtctgaagctctcgccagactcagaaagggcagccgtggacaccttgtgtgctggacagtggctgtgatccagtggaaaccctggcagaccctgtcttggttagccccgaagtgctcaggacagagtgggatgaaaagctgctagctgctgccacagaaaaccagcgtgacctaggatcaggatctctccaattcctgtgtaattttaactgtagactcttaagcttgttgtttgattacagtaacatgttaggggtagtggcacatatcggtaactccagcacttaagagggagaggcaggaggatcaagagttcaaggccatcctctgccagcttgggctatacaagatcctgttaaagcaaagcaaaacagtgaaatctctaaacagctgattcatagatttaaaataaaaatgtttatttagagtgtgagtgtatatgtacatgtatgtgcacatgcccttgtatgtgcattcatgatggaggtcagaggacaacctgtgggaatctggtccctccttgtgagttcctgaggatccaactcagttaggcttggtagcgagggccttcacctctgacccatagtggcagctctgagtcataggttttagtttatccttctatatggactatgtggttcaggctaaacttgaactcccagtctccttgtcttgagcctctggggtccagagattacaggtcggccacaccctgtgtttacaatcaatgttaacattcaaataaa

SEQ ID NO: 32085 - DNA, 1207 bp, Mus musculus
ttcctataggaggccgcttttggattcatctctccttttggaggaatttgtggggtgttgcctgggacgggccatttaggtagagagaactgcagacacaaaggcctggaggtaggttccctgggacttcagggcagcttccagcctccaaggctgggttttgggttccctgagggtggagcaggggatttttatttttgactgttctgtggttgattgtagggcccttcttctggctgctgttcaagagtccccagctggcggcccagcccagcacatatctggccgtggcagaagaactggagaatgtttcggggaagtactttgatggactcagagagaaggctccatctcctgaggctgaagatgaggaagtagcccgcagactttggacggaaagtgcccgtttggtgggcttggccatggctcatggatcccctgggagaggacatgccattcccagataaccttcagagacccagatggagctgtgttaccaagactgctgctggccatgctctcatcatcctctaggggcagtattggtactattagaatctcaagactgtggatgttggctgccatgtcctcatcatcctttagggacagtgttgcactgttagaactcaagtctgtggatgctggctgctatgccctcatcatcctctaggtggcaatgttagttctagcatttatcgttagctggctacattgagttggaccacaggtaggcactggctcaggggatggcaggtccatgtactctgttggttactggggagatggtccatcaggtgcctcctttaggaatctaaaaggggaggctgataggggagacagtcactctggttatgggcagtgtccaaagacagtggacaccaaagctgctgtggtggactgattggtctactgttaaagagcaggcatagctatagatttttgtgggcccttatatactcctgcctcctctctgacttggctgttgttctagtttgctttctgttgctgtgataaacaccatgaccaaaatcaacctggggagaaaaagggcttatttaactcacaggttatagtttatcatggaagaggcaagccagggcaggaactcaggacagtaacttgaagcagataccaatggaggtgtgctcacaggcatatgtcaggtaccttgcttttatttttattattattattattatcttttttt

SEQ ID NO: 32086 - DNA, 1392 bp, Mus musculus
agtggagtaaggaagtagctcctgaccctaggtctcttctgctctcaccagcggcaggaacgctttgctgagaggcccgccctccttgaactggagagatttgtgagttgggctactggggtgggcccactgtgtcccagacttaccctgccccttgtccttacccgctctgaacctgccccatgccttgcaggagcgcagggctctggagcgcaaggcagcagagctggaagaggagctgaaggtaactggggcttgtgatggctgtagccagagcccagcctacccagcgccacccagctgactccaccctgtatcctaggccctctctgatctccgggctgacaaccagcggctcaaggatgagaatgcagcattgatccgagtcatcagcaaactatccaagtgactctggaggagttcccgcaccatatttatactgctgcttctgacacacgcaccctttccccccgcgtgaacatgagtgacagggctctgggggaaattgctgagaagccataacctctcgggacctcagaaccgggaggaaagcacagagtccccaggaaccaagggggactctctgagatcaggatagagatgggaggctgagccaagtagggagacgttgctgagagtggacaggcaccagagatgggaccaagaaggaagcaaggaccaagagacacaaagatcagtatccagaagcagagtggttgccccaggatcccacctcacgtgtgatgctacccagcactcctcctcctccccagcagggatgcaggaatgtgccaagagtcccactggcctctgccaggtgggcctgtagataggtccatgtgcaatagggagggatgtcttctatttttgctgcctcctccctacccattgtctggggagggggagaaggtatttttgagacaaagcacaggcaccataaataaagtgacattgccactcagtgactttgtctcctgattgtgggctcaggctgactgagcccatttggatagggtacagttgagggtagggggttggagtatgttcacaggtctgggagggcaccttgctaaagtgagcagctggagcaaagggtcccagacgatgtgggagggattagaaggaagcccttggtgctgtgatatggggctggggcacccagatttgccctcagttcctctgaaaggagtggagtaggtgtctgatattgaaaatgtgggatggatcacatagaaaactccggaagtgtagcttctctggggaaggaataagtgatggcaagttcctccagtcctccatggcctcatggattggaacagcaggagccagtcttgagatgcactgcacctccatcccatagtcaggagccgctgcctacactagcagctgggc

SEQ ID NO: 32087 - DNA, 1154 bp, Mus musculus
ttctcagtcagtacctcatgttgatcaaggagagcttcaattcatcagtctttaagctctgatttctctcctttgtgtccctctgggattcacagtgagagccgccatgccctatctccctcccctgtaatttcttctttcttttttagttgagataaggtcttgctgaaaaatcctgactagcctggtacttgatatatagttgtcctgcctcagcctcttagtgatgggattgcagtgatgacgaatcttgtgattttgtgataacctctttgtgtaggtttgtatttacactcatctgttcactaaatttgttgtcattatttttagctatattaaaagtcttactgttactctcattaaaagtagaggtaaatatttacttaatgtctgttaggtgctggcctcttgggctgatctcacactgcccatcctcgtagccttactggcatttcaggtatgaaccatagccatagccaccatagctaatgacagacatgtgatggactgggtcattctattctgatggctgtcctgtccactgaaagctcaccaggtgctagcacaccactgactcagttgttggacattgccacaagtgtttcgggtgtagcagtatccagttgaaaaccttggcttctagactagtgagatggctcagtaggtaaaagtgcttgccacataagggcctggtgacttgcattcatcctggcgccatggtggaaggaaaagaccaatccgtgactattgtcctctgatcttcctccgtgctgtggcacttatgctcacatcacacacagtgcacacacacagtaacagtaaataaaactttaagtttataagaagaaatccttggccttgggaagatataaacagcatgtaataggcaaagaaactgctaggtgaggaagtgctgatggattagggtgcatgactgggtaacatgctgcaggctcctacgatatgaaccaggagaggaacacagctagtactgatgtgggcaatagcatgtaggaatttagcaagaagcccaacatgccctgggatggaagcaggggtatcttgggaaatgagagggaggaagtctcagcccagacaggacctagtgctttgcagtctatcaggcatctatcaggcatctctgtctccccatg

SEQ ID NO: 32088 - DNA, 1136 bp, Mus musculus
cagatagggaaggaggagactgactcatctaatagcttggatgaaccttacaggctcaactgaagtaagctagccacacagagacaagtgtgcagttctcatttacatgagatactgagaataattacactagtagagctcccaaattcatggaggcagagcatcaagtgtggtgtccaggtgctgataacactaggagtagaactggctgtggtgcctttaatcctgtcacatctctgtagtcccagctctcaggaggcagaggcaggcggatctttgagtttgaggccagccttatctgcatggtgagttccaggacagcaagtgctacacagagagaccctgactcaataagctaaacaaacaaggggttgggggagttggctagatgtctcagtgggtagaagtgcttgctgtcaagcttgacaactgagtttgatcccggggacccacatggtggaagcagagaactgacctgtgattcccacacatatacccaaataaatgaatgtaataaaaatgtggtaggatagagttaccgttagagtgactgtttaatgtgtgtagaaatttagttcttcctatgcctgtaagtacatgtatgtgtgcacctatgtttggaggccagaggtcaaagtgaccctcagccgtactctttgagttttgagacagggttgctcagtagcttagagcttgtttggctcccgtctgccttcccgtgctgggattgcaagtggcccactgtgcctggcattttacgttgtccatctgcctccccgtgctgggattgcaagtggcccaccgtgcctggtgttttacattggtgctgggattgagctcaggctctcatgctcgtgtggtgcatgttttacaaactgagccacctttccaagcccagtgtgtcagtctttggagatggatctcaaatggcagcagctgctttggcgggcgtcacgtcaggtatgttctctcattgaggtgcttagcaaggcttctagcagtgtagtctgctgcgcaactggaacacagtagccccacctcagtgagccgcttctctgtgatgctctggcacatgcattcatgtcagacgcagagcccgcctgtcactatgcaggaggacttgtcaccctgtgacc

SEQ ID NO: 32089 - DNA, 1417 bp, Mus musculus
aggaaagagagagagagagcgagagagagagagaagtatattatatattatatatatatatatatatatatatatatatatatatatatatatatatatatatatatatatacatatacatatatatgttgagggaggagtaagaaagaaagccaggacaataactgggccagcagctctgaagcacaccttccccgtctgtcccagtaggggctggcgctggggttggaggccgctggcctgtgctctggtgcagatgctcttacccagcttcactcaggaccaccttggggtgtaacagagggtgtcatccggcccctggccctggggaacatccctagaggcccagaatgggggttgctgggtaccccatgccctgagggttccagcactgctgccaagtggccttgtcccagctccccctgccccccccaaggctggtgtgagtgtgcaagtatgtgtgcagagcttgtgtttcatactgcagatataaataaaggaagatagcagaacattcctgctgtgggactgtgagttctgggactcagagttgggtgaacttgctcttcatagcctagagagctacattctcttaggaccacacttgtgagagtgtgtgtgggtgtaggggatggggaatacttagacatcaggcagaacatcaggagttagcactctggggcgctctcatcctgatatgtgtacctccgtggccctgttccaaaatgcagatcagttagggctgtgctgactcagctctatcctctaacaggcctgctaaaaggagcaagaggtccctggactttggagctgagcgtcctgccattacggggataggaggcaccaggcatgtggtggtggcagaggcagaggcaggtggatctgtgtgagttcaagcccagccatgtctacaaactgagttccaggacagccagggctgggcagagaaaccctgtctcaaaaacaaaggtgtgggggctggtgagatggctcagtgggtaagagcacccgactgctcttccaaaggtcaggagttcaaatcccagcaaccacatggtggctcacaaccattcgtaacgagatctgactccctcttctggagtgtctgaggacagcgacagtgtacttacatataataaataaataaatctaaaaaaccaaaaacaaaaaaccaaaggtgtgggagagattaggagacaggaagctcccttgagaatggacatacaatgaagcatccctaagggggatggttgaggaacctagtagtttcttggcatccagtaggtccctatcttgttcatgggaaggctgcagaacatgagtgtacagtggtgtggtcgtccttccttccagggaatgtttgaatgacttcaggcacaatgcaggatttatttaaccagtgtttgtggcaggaccc

SEQ ID NO: 32090 - DNA, 1124 bp, Mus musculus
tcagctttgtatagataagtctttttctttgtttcttttcttttttttttttttttttttttctttttctgtctgatagtgtgatcaaattatttcatgttaaaacttttgctaagataaacaccactttatatatgactggagctttaagcttctgcctcataacttgattgaaaaccagttatgtgtgttaattttatatttgtatagtgtgcatgcagataaatgtatataccctaggtttgcagtaagatggaagcacacagtcagcatctagagctaggagcagtactgagccctctgtgcccccacatggctgctgtccctcctgccatgagctgcatctttacatgaatcagttttgtatctttccccactctttatacagtataaggaacccaatatagagtgggtcctgtgtctgaaattcatgtcactaaaatgttttgaggcagggattacaggtgtgtgccacaacccctggcttagacagcctgtaggagtccgttctctcctccacaatttgggtaccagaggttgaattcaggtggtcagacttggcggcaagtgactaactgctgagccatcttgctggtgcacacacacacacacttaagttgggatagattcattgtacaaaatggtagattttgtaaaacgacattttaatgtttgttattatccccttcttattctttcttccctcttgccaactaactgcccttttaaattttttttaaactattgctttttttccccttaacatgttatcctgcagatgatataatttcatactttatggctgaataaaactcagactttttgtgtatagatcccattttgtctagtgctctgtcgatggacactgaggctgatgctgtaacaggttgtaaataatgctgtaataatcatgcttgtgcttgtgtctttgcccccccccccctttttttgtctttgctttattttcattagagtcttcatatatgcccaggtgtgatagagctgccttatagagtatagcatatctagcattagttttttttttaaagaaatccctctgtctcttcctgtttttttcctcaaggtttttgtcgtgttgttttgttgagacatactatcgtgta

SEQ ID NO: 32091 - DNA, 1236 bp, Mus musculus
tatttttcttatgtatttccgcccctcctcccatccttaaggaaagtcaaatgagcaccaacacctattttaaatagagagcaacacttagtgttagaatgaaatggagatgtctgggcgtaacagtgatccttaagtgcaggatagagagccctctggggaaccagttattggtgcaggtcctaacagagtcaggaaaattaaccctgaaaggacgacagtcttgcttgtggagggatcctgcatgccccagctctctctcagtcactgggttcctgtttgcccatcttccctcaggtcccagccgtcggttcaaacgtgtggtagagaccatccaggcacagttgctgagtactcacgaccagccctccgtgcaggccttggcaggtaggtgacagatgtgtggtgggcacacatccagggtgaccagtgcaatctcaggtgtctctctgcttctcttaagctgactcacttcttggacttttggccagtgtcttgctgaggtctcccctgcactgttgggaatagatttcccccaagaggctggagtccaagaaaggagtttctcagctacctgaaagccctaaaacaacagtggcccccacgttggaagcaatggtgccacagagctctggagccagatctgccctgtgggagagtgatcagtcatcccagtgtgcctggaactaggggctaaagccaggggagataggacagattggtggccctctctgcaggacccaaatgctactggcattgaaaagcacagttctcaaatggcatccagggagcagagcagaggccaggcctcagggaactgtttataattcattcaggtttccataagagaataacataaactaaccagaggttagttcagatagaggtagactgtttgcctagcaatgagaaaggtctggattcagtccctaggagaaaaaaagaaatgcaataaacttgaacggggtgggtgtttggatttggtttggtttgtttaagacaggtttttttgtgtgaaaccttggctgtcctggaactttctctgtagaccagacactggctttgaactcacagagatctgcttgcctctccctcccaagtgctgggattacagaggtgtgtcaccaccttacaagtgaactgggtggctttttaagcaataggagagtgagtatggaaatgcgtacatgctgtagtccaagcattcaggaagctgaggcagggaggttgctatcc

SEQ ID NO: 32092 - DNA, 1121 bp, Mus musculus
agccagcctggtctacagagtgagttccaggacagccaaggctacatggaggatccctgtctcaaaaacacaagcaaatacatacatacatacatacatacatacatacatacatacgatagtattatctattttatgtatatgcacttttgcctgcatgtatgtctgtgcactgtgtacatgcttggtgtatgtggaggccagaagaaggcatcatatctcgagttacagggggttgtgatctgagaatggaatactgtcctctggaagagcagccagggctcctagccatggaacccaggaaattgtgttcagagactggaaggccaaggtcaaggcagcaagagagattttgtgtctgccaacagatcatttcctcattcttagagggcctcggtgtctctaacatggtggaacagcaagggagtaatttgtattttggtttttttcccagacttggtctcatatatctcagtctggccttaagcttggaatgtagttaacagatgactttgaactcctagtccgcctacctctgtcccagctgctaggattacaggcgtgtactaccagtctggctttcactgaggtcttttataatttcagggcactaatcccagaggccctatggatttaggtgtgatggtttcagcctgtgaattatgggggacacaacatttaacctgtagtagaagtgtctgccatagcagtcagagctacaaagatgacaattctatgtgactaaaaggttggcttaggcaagcaggctccattgtaggatgcaagagaggaacatgccaggtgcacaaggctggtgagatcagcctagcattcctctctgtctctgtcccttgtagaagggatcaggcaaagagaatctagcaatgaatatagcagccaccggaggacactagtggcttgactctggacagagctagtcttgactttgggttcatcacgtatgattgccattagtaagtgacctcagagatggtccctgaaacaatacagatttttcagcctgctgtccgggaggtgaggcacccagggtgacttcaggatgtcttcctgagagctgtcctctcttgctctgcagttcctacctttatctgtggccactt

SEQ ID NO: 32093 - DNA, 2755 bp, Mus musculus
agagaaaccctgtctcggaaaaaaaaaaaaaaaaaagaatgaggagtctatagggtagcctcgggatgagtgatcctaaatgctgggctggaggacaggggaatctggctgccaagtggacacaagccttgggagaatgggaaatagccacagaggcagaaaggcaaagagcagtggctcttgaaggactctgctggggacacagcttggcacttgtccacaagtcagaggaagaaggcaaggagtgccagtgcatcccgcctggaggtcaggttagctcactggctgacagggaggggtagacacagaaggcaagctcttaaggggctctgtggagagcaggctgcagccagagtagctaacaataaatggtggggtaactcattacagaacccttggacctgggtgcctggccaggttgtggagctggacagctcctgccctgcgctccaggctagggtgctgaagggggcatggcctcagtttgtgccctcagatgggaatactgcctgtgtgaaggtgctacgggacattgagccaggggatgaagtgacttgcttctatggtgagggcttcttcggcgagaagaatgagcactgtgaatgctatacctgtgagaggtaggcacggaccttgtgggcagggtgtggcagcctgccctgggacgtcaagggttgctgggctgcagtgcatcctcaggattcactctaaagtgtgtctggcccagcacatgcctttgcccttttctgttcctgcaggaaaggcgagggagctttcagacttcagcccagggagcctgagctgcgaccaaagcccctagacaagtatgagctccgagagacaaagaggcgtctgcagcagggcttggtcagcagccagcagagcctgatgagccggtgggcctgctcccacctgtccccactgcgccctgacccattctgtggtgagcgtgcctgttctctagcctttgggtcactttttctgacctgtccagaggaagagctgcacaggtcctgttgacaggctttcactttttctgtctcctccgacctctacagctgcctgccagccctcatgcctgctgcctgccagcccccacatggattacttgcccctttggctccagcgggcgcctcaaccccagcccatagtacctcccaggaagcgccaccgccgccgccgccccaggatccgccaggcttcattgcctcctgtcctccgcactgcctgtgtccccctgcaccgatggggaggctgtggtccccactgccagctacgtgctgaggccatggtgaccctacacctgcgcccccagactcgctggaccccacaacaggactggtactgggcccggcgctatgggctaccttctgtggggcgtgtggaacttacccgcctagccccagccctgccagctgctcctgcccctgctgggaacccaggtcctgtccccactcctgatttcatccctaagcaggcccttgcctttgctccgttctgcccacctaagcgcctccggctagtggtcagtcatggttctattgatctggacatcaatagtggtgagccatgatgggctgcttacagggagcggaatggagtgcagagtctatcttggagccctccagaagggaaggagagctgacccaggtctgatcctggtagtgtgttgtttgggacatccctagagagctgatccttgttctatgattgctgacccctgagccagccccaacccagcagggagccctggccatttgctgtacccatccctgcccccacctcaggactataggagtcaacctcctccctcagcctctccctcccagggagcaaagccataagggaggggggcactccatggcgactctctagaaggccaggcctcagggggtggaattgacttgggggtttgccttcccctgagctgctcccacagtggggagtgagttggctctcagctctacagttgatggaggtaggggcggtcagatgaggtgggtggtacccaggggcacatccttggctctgccccacgggtctcagggaggccaggtgtgacctcatctttttcacggtgctatccctggtgctactggggtgtcggggaggcttcctctccttcccacatcggaatgggggatgatgggggattggaagaacttgaactttttattaaaatattgtaagtccttaggaggttttttttttttttttgaatgtttttatgggatgtcagttggagggtgagatctcagcttgactgggaagatgaggtggtatgcctgcgagactgacaactatcctgatatgccttaagaagggagagggcagtggattctggggactgctggactaagataaagccctgtaactgcacaaacggtgcttataggacatgaccaaatgcattctctgctctggggaactgaggagataaccaagaactgatgaccgggtgcaaagtaacttgcctgaggccatacagggacttgtcacttctcaaccagatctagagcagggcctggtgtggtggcacccctttaatcccaatacttaaagaggcagaagcagatagatctgtgtgagttcaaggctagcctgatctacacagggagttccaggccagccaaggctacacagtgggtggacttattcaggagcagtttgagaggaggggatataaatggggccaagcagtttagccctgctgaagggtggagggaacctcttgtaacccagttgtcctcaacct

SEQ ID NO: 32094 - DNA, 1281 bp, Mus musculus
agacaagggcgcaaaaccgtttttttttttcaaaatatgtattagtgcccaccatgcgctaagtgcagactgaacagatcagggtgatgcgatgggaacatagctctaggaactctctctgcttttggatcctcacgaaaaccgagtcaccgagttccgaaaacttcctaccccaccccggcgcctcatcacggtacgcaccgcgagaactcgccgggaccttcagacgaagagctccgaaggttcccgagtcaaaaagactcggaggcggaacccaaggcccagaggaagctgggtagccgagttcaggcgcgccacgggaggaagcggaaatgcgttgccattttaaaggtgtcgtcccgcctctcgtgtctctctttccgtctccggccgccatagggagaggaggtgagtgtgaggcctctgtccgtcccgcgtggccgccatctcgctcccacggcctcggtctcctgcctgggctttctctccttgtacccaagcaccattcgctgccctcattccccaccggaagtggggcctcagcgtcccttcccccttctaagtctccgcggtgttagctcggcctgcctcctttgctcaccctttcctcggccgtgtaaagctcttgctcgctttttcccaacggtgctgccgcttacccagccgcctgtccacggcctgcttctttctgacatctttcacaccccccccccccccggcttctccccagccgccgccatgtccgcgcatctgcagtggatggtcgtccggaactgctccagtttcttgatcaagaggaataagcagacgtacagcacggtgagtcgggcccgcgtgtgaggggcactgtggctcttttgcgtatcggagcctccgggccttaacttaacatcgtgtacacctattccccaggagccaaataatctgaaagcccgaaactccttccgctacaacgggctaattcaccgcaagaccgtcggagtggagccggccgccgatggcaaaggggtcgtggtagttatgaaacgcagatccggtgagcctttgcacacgatagcgctccctttttccagggtccagaactgcccttcctctgacttcccggctgtgtaaggtgatctttaaattaagaagtgtagagagaaacttaagtacagtttctctatgtagacctcaatgtcctggaactctacatcaggttggtctagaactcagagatccacctgcctctgcttcctgagtgcttggattaagtgcatgcgctatgtccctcctgtatct

SEQ ID NO: 32095 - DNA, 1203 bp, Mus musculus
ccttcacaccttccttctctatcaagtcctcccttcgtaaaaacttctgtatcccctcctccgtccccgccgatcctttcttttctcctgctgagcccctctctcgtcgctccctttgtcctcccctcccaccgctgcaattcggctccgggatccgcagcctggcgtcccggtgtgcaccatgccggccctgctgctgctcgggaccgtcgcgctgctagcctccgcagcgggcccggcgggggcgcgcccatccaacgacacaagctcagtggccccgggcccgctgcccgcgctactcgcgcacctgcggcgcttgaccggggctctggcgggcggcgggagcgcggcaggtaccagcgccaacgccaccaagaccagccccgcgagtggcacgggcgcagcggcacgggcgcctcctccggccgagctctgccatggctactacgatgtcatgggccagtacgacgccaccttcaactgcagcaccggctcctaccgcttctgttgtggcacctgccactaccgtttctgctgcgagcaccgccacatgcgcctggcgcaggcctcctgctccaactacgacacgccacgctgggccaccacgcccccgccgctggctggaggcgccgggggcgctgggggtgcgggtgggggaccagggccgggccaggcagggtggctggaagggggccgggccgggggcgctgggggacgtgggggagagggcccagggggcagcacagcctacgtggtgtgcggagtcatcagtttcgccctggcggtgggcgtcggtgccaaagtggccttcagcaaggcgtcacgtgcacccagggcgcaccgggagatcaacgtgcccaggtaagtgtgaattgggattggagggacaggagggagcctggaacctggcactggggaacagacaatccgatggaggcggtttcttggtactgggaagtggagcaactgattaagtggcagggcttactctgtgagaggtcaaccggcttggggatgtggtctgggcaataagggtggcttggtgggggacagggcctgcgcctcagaatacgaacctgttggggcgtggccacacggatggctgaggtccaagttagttgtgggaagtaactaaagcccagtgacagaagcgacaaaaggacctggctgtagaaaagaattggtatagagagttcattcatt

SEQ ID NO: 32096 - DNA, 1173 bp, Mus musculus
tcatttacacttccaatgctataccaaaagtcccccatacccacccacccccgaccaaggcaaatcttataaaaaaccaacatttaattggggctggcttacaggttcataggttaagtccattaccttcaaggtgggagaatggcagtatccaggcaggcatggtgcaggcagaactgagagttctacatcttcattcaaaggctgctagtggaagactgacttccaggcaactagggtgaggatcttatacccacacccacagtgacacacccattccaaccaggtcacacctattccaacaaggccacaccttcagatggtgccactccctggtccaaggatatacaaaccatcacattccactccctggtccccatagacttgttcaaaaacatgagtctatgggggccatacttaaacatagcataatgcaaaatgcatttagtccaactttcaaagtcctcatagtctatagcagtcgcaacaatgttaaaattccaaagttcaaggtctcttctgagattcattcaacttaattaactgtaatccccaaagcaaggcaggaagccagctgggcaaactccaaactctgcatctccatggctgatgtcaaagcagtcttcagatctctactcctttttcacctttgttgactgcagcaaactgctttctcctgggctggttccactccctgttagcagctttcctcagcatgtatcccatggctctggcatctttaacatctttgagtctccacagcaatttcaatgttacagcttcttgtttcagtgtctgggattccacttgatcttttgggctcctcctaagggctggcatcacttctccagctctgccctctgtagcactctaagctcaggttgatccattccattacggctgctgttcttggtgatcatcccatggtactaacattgccaatacactggggtgtaccactccaactaggcttcaccaatagcctctcataggctctcttcagggtgccaagcctcaaatctttgcatgaccccttcagtcctgggccatcaactacagctgaggcttcaccttctccaatggcctcccctggtctctcacagtgctaagcctcagcttctctccatgatcccttcattcctgcacaagcagtaccacctgagtgattctttt

SEQ ID NO: 32097 - DNA, 2269 bp, Mus musculus
atgcaggagatatgcaggggttagtctcaaagtggagagcgatggccctggttctgggagcagagctctggattgtggttcacagtgggagcctgggcttggtttattttacacatttatagggttctgggcatggaatcctggcttcttgcgtgttagccaggcactctaccaactgcgcaatattcttacatctgtcaggagcagggaggttggctgggcctgagatgggtttggcctgtgttgattgggtttcaaagggctccccagctgtccaggactccctgaggatcacaggcataaggtgcctcccaactgtctacccaaccacagcctagagctgcaggctccaagctgcccccttgggctttctggggagggagcagaagattggagaaccttggagcctgtattggggttggctgtccctggtctcctgggcccagagcatgagagatgacatcggatgccacctgggggttaccagcagggagagtctggcagaagctgtcaggagtcaccaagggacgtggtgtaggagtgagcagaatgtcatcaaagagatcaagggttgaggtgtctagggcaactgggctcaggctggggctgccgtggggcgcttccatgggggcctctgcacacgccacccccaggaagggggacggaggcggcggaggtggccttcggaacggtggtctctgagcaggcgctttttgagacaggatggtcagagccaggtgctgggtggcggcttcaatcttggcaaactccctggagagggaggggaggagcgagggagatagggagggagcgagggagggaggagaggaggagagattcagttgttttcagttgtatgcctacaaagacccctcttctgagtgccgccctcccggctctcccttccccaccctgtgcttcatccggagatgagtctcttcttttcaggcccattcccccaacccccattacccgttattttcctggcccccgccttcatttccttgagtctgacaggttaatagtcttccctgggaagttctgattgctgtagggttgtgcaccgcacaaggaagttcctttagcccaatcctgggcacatcttgacagtgaagatttatcataaccctattccagtatatgaaaatttaatgtctcggggaaagagagcctttccaatcaataatcgcaaacgggagccgtgggccagcggtgcaccgccatattgataagcgagctttcttcaattctgcccacccccacctgtctcttgccagaagctccgatactctcctcgcactcccgccaccctagtggtcacgtggatggatttcacaaacagctggggctgaattgtgtttctccgaattctcttatttctaaaaattaatttttgttattatcttaacttttttacatttacttattttgtgtgtgtgtgtgtgtgtgtgtgtgtgtgtgtatgctccctctacctcctccctccccctctctccacaccacacgtgacagctttatgtgagtttctggtttgtttttttttgttttgttttgttttgttttgtttttttaatgtctatgtatttgtgtgagtgtatctggatgactgtggaggccagaggagggatatagacagttgtgagccaccgggcatgtgtgctgagaactgatctctgattcgttggaagagcagcaagttatttttaactactgagctatctcttcagccctgttcctggtattttactcagtaagtcaggcttggttgcaagtcccttcacttgctgagccatctagctgtcccatagctgctaatctgtatatatgtatatttctgtgggagtgagcgtgggtcgagaccaggaaacttgaaaaggcacaaggtgggagcaatgaagctccaagggcggaagacgcagatgcagggggtagtagaacgcctgtgatgcagcgggggaagaggaagactatgggcggaaggcaagtgagggtagcgaagggggaaagggggggacgggggggggagacaaggtgggtgggatctatgtgtgtagattgggttgatcccacccaccttgggttgatccgagaatttctggacctgccagcggttaaataatggcacagacacttattaatatctacaagaacttaggcctttagcttgggctacctcccagctagctcatctaattgaatcttagccaccacccgcgtggctagttctttaaatctctcagtcatccgattacccgctggcaaatctctt

SEQ ID NO: 32098 - DNA, 1146 bp, Mus musculus
ggtccaagaacataattgttggggaatttctctctgaaacctacagagactattcactttgagacccctggaatgtggcatgttcaaatcaactggcctccaagactgggtacatagtaatgaaaaacgggtctccactaacatctctctgaagataacatgtaggcacccccatgattttaaccaccctgtgagccagcattccagatccttcatctagagaatgggggtggggcaatatcttagactcctccaggaacccctcaaatgacacctgccagccactggtgaccccagaaaatgagtataaccgaaatctgccttccgccaattttgcttcctgtactgaaagaagatcagggtagatgccccccaccttcagttaacccactctcagattaggtctcccttactgcagaatggtctgaccctactgatcttcccccatcctgaacactagattagactggccctttaggttggactaacccagatgcacatactcctatccacttggaatgggctggtgtctggaatggttgtggcctaatcccactctccttagagtaatagggcagacattcccttatgctgtagagcacagtcctttgaccacgatttcccaatcctgtgacctggtggaggtggtagacattgaggctttccctaccccttgacttgtagtactttggtctttccatcactacaacttgactctttgttccaatgtcccaaggggatatgggaacttggccaggggtttctctcctgtgagcctcaacctgacccctgacccctctccccaatgtctctgggactccaataaacctcattcagtcattactgtcttgttttttgatcctggatttcagggaggtggggctctctccctcttggacttagattatgtcccctagggcctagagagatggctcagcagttaaaatgaatactctcctttcagaggaccagagttcagttcttggcacccacaccaggctgttcataaccacctgtaactcaagctccagtatttgcatgttgcctccatgagcttatatgtacaaagccacatacatatacacatttcttttgaatcttcaaaaacagactagagttactaaatgaatacaggtccttgaggga

SEQ ID NO: 32099 - DNA, 1158 bp, Mus musculus
gtttggtctcatctgtttgactttgcgtgttagcatggatgtgtgcttgccagtatgtgtattggacatctgaggacaacttttggtagtcagctctcgccttcctgcttgctgaggggtacactgggctaattggtcctaagcatttcttctgtcgctgcctgccatcttgcggtggaggtgttaggattgcatgtgtgcaccagtatattcttccccactttaaatgtgcaccactatataatgtgcaccactatattcttccccactttaaatgtgcaccactatattcttccccactttaaatgcacattcaggggcttgaactcaacctgctaggcttattgaacaaatgcttaccctctgggctgtcttcctagctcctcatttattagtcagcaagtacttatcaatatagacatctacagcaataaatttccctttgagcactgctttagctgtgtctcttctgtgttggtatgttgtgttttcattttcttatttattttttacttatttatgagactgagtcctctatagctcaggctggccttgaacttctctgtgtagctgaggctactcttgaactcctggtcttcctactgcttctctcgtaagtgctgggattacaagcctgtgccaccacaccctgctgtgttttcattttcattcatgcaaaacattctctagtttccctcatggtctcttcatagatctcctggaggagagggagcaagctagatgttgcttaagctcaacatgtcaacaaatatttgtcaagtacccacaccttttccacatatgcactgtggtaggtgctggggcataatggcaaacagaacaggctactttagtcctggccgccttagtaaacacgtggcaaaagcatgttggtggcactaactgtggtaaaagtaactggattataggctacatggatataggcaagaggacagaaacctaaatgggactcagggaggtatcgttgacttctggggaatgatgtcccagggcagacagggaatccacagagtttgttgttttatgaggtagagtctcatgtatcccaacctagcctcaaactcactatgtagatgaagctagccttgaatcctgcctcgggttcccaaatggtagggttatagatgtgcatcacca

SEQ ID NO: 32100 - DNA, 1126 bp, Mus musculus
gatgtagtataaggatgcagggagtgccatggaaggggcagggacaaaggtaccgattttgcttgcttccattagcacctttccaatgtgtttccacttctcatcaggtccccattacaactcttaaagacatttattctctccactggacagatgagaacactgaagctcagagagatctggtaaattcctcaaagtccccatagcctgcagtagagcaattggcttgatagccaggagagaaccccaacctgtaaggaagctataccctcacccccaaacggagggagtacaggttagaattacagaaaaattaggggtgctctctgggatctagtgggaggtgtgagagttactagtcaacagattctgccagacatggtgatgcacatctataaccctaccatttgggaacccgaggcaggattcaaggctagcttcatctacatagtgagtttgaggctaggttgggatacatgagactctacctcataaaacaacaaactctgtggattccctgtctgccctgggacatcattccccagaagtcaacgatacctccctgagtcccatttaggtttctgtcctcttgcctatatccatgtagcctataatccagttacttttaccacagttagtgccaccaacatgcttttgccacgtgtttactaaggcggccaggactaaagtagcctgttctgtttgccattatgccccagcacctaccacagtgcatatgtggaaaaggtgtgggtacttgacaaatatttgttgacatgttgagcttaagcaacatctagcttgctccctctcctccaggagatctatgaagagaccatgagggaaactagagaatgttttgcatgaatgaaaatgaaaacacagcagggtgtggtggcacaggcttgtaatcccagcacttacgagagaagcagtaggaagaccaggagttcaagagtagcctcagctacacagagaagttcaaggccagcctgagctatagaggactcagtctcataaataagtaaaaaataaataagaaaatgaaaacacaacataccaacacagaagagacacagctaaagcagtgctcaaagggaaatttattgctgtagatgtctatatt

SEQ ID NO: 32101 - DNA, 1168 bp, Mus musculus
cttggatggggggtggggtgggcaggggacagacgcggcttgtacagagcagagaacaataaatggtatcaacagggccgctggggtctgtccttgctgttcctagggggttccactgactggctggacacatcacctcacatcactctcttttcacctaggttgagtgaggatttgccatgtcccaggcattagcctgagtgaaacagggaagtcgccctctcaggaactgatttgagaccccgagactcccttccatgatgctctcagccaccatggaaacaccggaagccttctgtctgccaagccctgacctgggcgctagggagactgatgaattgatcggacatgacattcacactccagtaggctgggagagcatacctgaggaacttaacacagtctgcagacttactggagacggtctcatgtagtctaggctagctatggacttgctttgtaggtacagataggcttgattttcccccatttttgagacatggtctctctatgtaacccttggctctcctggaattctctgtggactaggctggttttgaatttacagaaatccacctgcctctctgcctctctggtgctgagattaaaggtgtgcaccaccatagctggctaatcttgaactttttttaaaatctagattttttaaaacatgtaaagagattcggtatatgggtgttttgcctgcgtgtatgtttgtgcaccgcttggtgcctggtgcccatggaagccagaagaggtcattgcatcctcaatctagagccacaggtgggtgtgagctacaggtgggtgttgggaatcacacaacaatcatctggaagtaactgctgagctattacttcagccccagattttatctgtcctctcagtttgacacatatctgtatctgtatgcgcgcgcgcacacacacacacacacacacacacacacacacacaaactttggttgtacacacaacctccactatgctcttatccctctcccaatcctgctgagccctttcttgccaacaagccagtcttactttcctgtcttttattttcttggtgacccattaagtttagtgagggttgcatgtataaacatgcgttggaaggcttatttacctgagcaggggcagctaaccagtagctctaccactgaggacta

SEQ ID NO: 32102 - DNA, 1142 bp, Mus musculus
cccttgtaccctgagcacccaaaggcggggaacggtgcccacggtcgacacccccatgccggttgcccattctgggacccttcgccacggtcgccccctcccacttgtgggacaaagggtgggggcgcatccccacgcgtgacctcccacgcactgcgcacgcgcccagctcccacttcggggaggggctttactcgcccacgcgagtgcgggaggaatgggcggctgggacaggggaacgcttgcaggatggaccccctaccccaagaatggaagttaggggtggttgtttctccatttatggcattgggttcggagatgggccatgatgaagggctttctcattcaggccaggtctccctgtggtgttgaccccacgaggaaccaaagaatttaagggccgagccccttcacaaccaagattcctctcgctgagccccctcgctctgggtacatactttggaagcctctgactctgtccagaagtatgggtcctttcctccctcagactggtgatccttccttactccggagggacaggtattccacctctccagggactgccgacttttggtgacctgcttctgtccagtgcccccaagggctcagttgctgggtctgcaggaagcctcctcgatatgaatgacagaaacaaccgttggcggacaagtgaggcacctggggaccctttcttttcccatccttggtctgacattctggttccctctgtccatgggacagcaatggttgggggtggtctataaggttcaggccacttctggggtgacctctgctgacctctctgcagtgaaggacgaagagacctttgagatctccattccctttgaagaggcaccccacttagactcacaaatcttataccgtctgagtccgtctcggagaaatgttgagggtgagctgagaaagggcattggagggactggagtcaggtggggtactgcctcaccctggggcatgacctccgtccctgctgttcttagagcctccagagggcgcctccccaaccctggccctgatgagcagtgttaaggcccagctgcacatggcactggagaggaactcgtggttgcagaagcgcattgaggacctggaggaggagagggacttcttgcggtgtcagc

SEQ ID NO: 32103 - DNA, 1184 bp, Mus musculus
ggatgttaaagctaagttcctgcttttgtgtagatctctgactgcaaagccagttccttgtagttctcgagtgtccctgctgatgttggcaacagggcctgagacctggcctagaagggccagttgttggagttgtgtacataagacaactacattatagcgttttgagcaagtgaagtttccttttcttaactgtccagcatcattatgtgggagaaggttcttgtcttgctggaagaaagcttgaccactttgtcaccttgcttgcctatgggtatttgtctctgacccagcctcactctatctcaactttagcccccttctcagttccttaagtctactgggagtttgtgtcctaggcccttggtattgtcacttcatctctggggttctttgtttttgagacttagcagcagggaagacatttgggatttgtaagtggcccctcttcgtggtgtggagccagagctgcctggttctgtgcttgtctcaatattccacagttcttgcctctgtctagctcttgattgttttattttattctttgcatgtatgcatgcaaattcttttctgttagtagttgaacccagactctgtactgaatgttttttgcttggtattcattccagaatacagcctggtacctaacttacttgcattacaatttcagtctgggcttcactgcttttttttctttccccgagacagggtttctctatgtagccctggctgtcctggaactcactttgtagaccaggctggcctcgaactcagaaatcggcctgcctctgcctcccaagtgcgccaccacgctgggctttttttttttttttttgcttttttagtattagtaaaggagttaaagatttcaaattttcctacttactgcaacagaaaaatacataatataaatgtgaggtgagtttaaaatctactttgaaaattttctcattgattttttttttttttttttttttcctactgccaatcttagaagtcaatacttttgggatacacctgtttcggttcttgagtatgtttgtttttgagataggatcttaatttaactcactagccaactctttttcttttcctgtgtcagcctgccacatgcctcatcactcctggttgtgttgctctgtatgggtgcgtgggttgatggttgagagatcggtggtactttg

SEQ ID NO: 32104 - DNA, 1154 bp, Mus musculus
agatccctccacatcactcttttctcctcccctcccgccctaccccttcttcccctgctcctccacccctccccgcccctgcactctacttgttctgcctctctgggcacccttcctgtccctttgcttgtctttctcttcctgcctgttgctctcctaccctttcctgccttgtttgcaatgggcatttcttccttgtgtcatcatgttttttgtttttgtttttttttcctcttgctgtcacatcctttcatcttttcttgaataacttttcctaactttttgggctccatggctcatccctcatgcctgtcctcctgtctggcccatttgctccctgtctcctgtcctttggtattgcttcttctctgttttctcattttcctcctgcattttttcctactattgacctctacacccctgacccatattccactgtccctttccctccccgttctcccttcccccattcctctccccttacccccaaacccctctgtgtctccctctctcacccttcccctcctctctccacctccctccccgcccttccctgtctcctattccctctgcaggaggctatgatggacttcttcaacgcccagatgcgcttgggagggttgactcaggcccctggcaacccagtcttggctgtgcagataaatcaagacaagaattttgcctttttggaggtgagttttccagtgataagggtaaggggtagtagggatggtctgtgctgcctactctgactgctttccctgcagctcattttccatttggctgctggagtagttctgtagtcctgtcctaccttatgccttcctatgctctacctcactgggaggactttgtggcttcttcctgctttgttggtttttgagactattctggcccagtccactctgcttaggctacattgatcttgcagagggctcgatgtttctccctatttggggcctaggttgaggcagtttactctcggtgtttatacgttacgtttgggcagttcgttagtttggaactgtctgtaaagacctagctcgactctggggtcatactcctaaaaaccgtggggtgttggcatgaccaaggctgcggaagaggtttttcagtgttcccttttcagactgcattgcccataagagtccact

SEQ ID NO: 32105 - DNA, 1190 bp, Mus musculus
acagagtggtggtcacaaaatactgtgaccctgattcttaccaccgtcgggacttctggtagaggtggctgggggagggtgggggcagggctggctggggactttccccccacctgtcccctcctcctttcccccctcttgaagaagatgggcagaggagtgacagccgaatgacagccggcagcaactggaatggcagcaattaaggggggtggggggtggggggctagggcaggaaggggactgggcaagtgcacacaggcccacacagacacatgcacccacacagacacagagggaacgggctgggatggggactgtgtgcacagcagggcgggtaggacctccacagccccttcccaaacagcctcttatcccttacacccctttcctcctctcttcccccatggtaggaacatagcgtgtttatattttatggccaaactattttgaattttgttgtctggccctcagtgccctgccctctccctttgcaggaccacagctcccgtcctttggcttctggtccttcctgttctccaccctggtttcttaagtagttggttcttctccttagtcttcctgactcaacccgtggtctctgtcccgctccccctctctgtggcagtttcatatttgctaatacgaatttgctcattaaacattttgttgtattttactttatggatcctcatctgtgtccagtgtgtccgcccgtctctttcggccgagggtgtggagggtggcacccagggaaggaggcaggcctgagggtcccgcgagggtagccacagtggaggcttcaaggcttggacctttacgcgtctccactgctgcgtagatgcggaagtgacgcaagggcataaggacgcgcagtcccgtgcgccggaaatggtgccggggtgggtttggtcgcggaagtggaggctgccgggcgaagtgcagagggcggggcacgtgagttcatttccgcttccggtccgctgccaccttcggttgcttcccgtccgctcggcggctcccctcccccgcccggctctctgcgcccctcccgggcgccggggcggcggggccgtcgctgtgcggccctccgtgcgtctgtgcgtgcgcacgtgcgcacttctgcttcccgcagctcggcgcgcgccccgcgacaccgaggccgagcgggggcagggggctgaccgtca

SEQ ID NO: 32106 - DNA, 1190 bp, Mus musculus; identical to SEQ ID NO: 32105

SEQ ID NO: 32107 - DNA, 1887 bp, Mus musculus
aatgaagtgctggttgtggcatagagatgcgtttccattggttcattcctagagggaaaaggtttgtcctccagcccttagatgtcatgacctgtcccagggctgtgggtgtctgcttggtttctgcgctgaagtgcttgctcatttgagactgcgagtgtcccgagtgtcccgtagacactcagagactgtacttctggagcactgtgggctctcctgagatcttgagtctatcattccctctgtcctccttctccacagtaagatcctcgcggtttttagtccaagctcagctcagcctgccccttcctgagacctcccaccgcctccccccacccccaccccccacccccacgtcctccctccctgctccccccaactcaggctgggcctgctactccatctgagcactgtcctggctttttcaggggagttggagttgctcgcaggagaggtgcctgctcgcagccctggggcattcgacatgagtggggttgggggatctctggctgagtctgtggggagtcccccacctgctgcaaccccaactcccacccccccaacacggaagactccggagtcattcctaggccctaatgcagcccttgtggatctggactcgctggtgagccgaccaggccccacaccaccaggatccaaggcttccaacccattccttccaagcggtgagtgtggcttgtgggactcctgtgtctttggtgtcttctgtggtccctacagggtagaagtttcatggagcaggcatgcttctccccacctgggtgtgtatccaagacttggacgctgggcagacaagcacttgctgactgctttttctctttgcaggagctccgcccacaggcccctctgtcaccaatcctttccagccagcaccccctgcaacgctcaccctgaaccagctccgtctcagtcctgtgcccccagttcctggagcgccacccacctacatctctcctcttggtggaggccctggcctgccccccatgatgcccccaggtcccccagcccccaacactaaccccttcctcctataatccagggtaggagggaggcctggttcagctggcttccccaatttctgctccctgggagatcagtattgtgagtgcatgtgaaatgggggggccctcccccacagtgcccttccccctcctggggcccactcacactacaccctcttcccaagtccccaccccacctccccttgagaaaaactggacatggggatggggaggggagccggccagaggaggacccttttctgtggcattagatgggggagggacagctggggttcccccacccattccacctccctctaaactcatgacaacccccaaatcagtgtttgagcctcctcgttcccttggcacccctggtgaatccttggtgatgattttggcaacttcgggaataaatggcaattctcatgggtgtggctcccttaaattctcatccacggttcagatgtcctgagaagcccctcttccagggcagactcaaggtttggccagagtcacttcttgacttcagctgagaatgaacctttctgaagctttgaattccctgattcagttcctggagctgggctggctgaggatggggaggacctgggctgtggtactgagtcctgcatcactgagtcctacacaggcatcactaattcatccagcttgctttggaagtcttgttagcctctgctggctaaacccagtggaccgccagatggcatctctaggccattgctatgtgtttttatcatgtgctagaccacctgtgattactatgtcagtgagtccttgagtggcctggtgggtaggtgctcctgtcagcttgcatatacagaggcatttgccaacagtgtcg

SEQ ID NO: 32108 - DNA, 1186 bp, Mus musculus
cattgaactggaagctcagacttccccctggtcattttgggcttttaatgcccttaagccaacaggctaaaaaaggaataacagtgttaggaggggtgatagatccagattaccatggggaaattggattatctcttcacaatggtgataagcaagattatgtctggagtgtaggagatcccttagggtgtctcttagtactaccatgtcctgtgattaaagtcaatgggaaactacaacaacctaatccaagcaggatgacaaaggacgcagacccatcaggaatgaaggtatgggtcaatcctccaggaaaagagccaagacctgctgaggtgctggctgaaggtgaaggaaatacagaatgggtagtagaggaaggtagttataaataccaattaaggccacgtaaccagttgcagaaacgaggattataaagtaatatgaatgcccattgtaaatttactaatgcgtttgcgattgtacgagggatagttatatcatgttaggcgtatttacaaccttgttattgtttcatgtgaacatgagatattatttgtgtcaagttgaaaaggggtggattgtagtggctattcctggttgtcaacctgacaatatttggaatgaactacaatccggaattggaaggctcaccagtgacccttatctggaggcttggagatccttatctggatcttggtttgaagatcttgagccacagtggctatggattccagaagattgaatctccgagtttaaggaacacacctttaatctgggctacacctttcatctgggattaaaggtgtggcggaacacacctttaatctgagctacaccttctgctggagacaatataaggacattggaagaagggagtctagcgcttgctccttcgcctacttgctgcgtgagactgagtaactgctagatccttggacttccattcacagctgcgactgaacaattgttgggaattgggctgccgactgtaagtcatcaataaattcctttactatatagagactatccatccgactgtaagtcatcaataaattcctttactatatagagactatccataagttctgtgactctagagaaccctgactaatacagatagttaaagcagagagaccctgagtctttcctcttaatgtcctatgacaagatacagaagggagtgcct

SEQ ID NO: 32109 - DNA, 1193 bp, Mus musculus
ctgcgccccctgcctgcgcgcgagaagccgcacgcgtgctgcgaatgcggcaagaccttctactggcgcgagcacctggtgcgccaccgcaagacacactctggcgcgcgacctttcgcctgctgggaatgtggcaagggcttcgggaggcgtgagcatgtgctccgtcaccagcgtatccatggccgggcggccgcggtagctcaagggacttcagcaccaggtccagagggtggtggtgcctttccgccctgggctctggggtagctggggttctaaacacctgctgcagggcgtcatccccttagagttctcccaaccccattgcctcttcccttttgggccccatatccactcctcccttccttctggagttctcagctttcacccacccctgcgaaagacccttctctccttccctcattccatccccttttcatggaggagagacttgccccaggacacccttcaagtgagaaagggggctcagggaaggagcagtgcccccactcctcccttccaaggatcttgatcttgaaccccaggacagagtcggggccaatggagagaagaggcctggacccggatctggttctctccatagcctaaaggaatgaggtggggagaggtacccgagaaagcttgtcacagatggcaggtcaccagcacctgagagagtaataaagtgactgactcagtgtgtacaggagtctgactctccggtgttgtgggagctgagcatctgaggcacaggggacttggggactcctcacacatcgcaggaagaaagactagactcggaaggtctggcagcagatcactcccatcctggttgtcctggctgtatatagcttcaggtaggtggaccgcccccgaaatccccttttctgagcaatagttcccgtttcgtaagtcatggtgcttgtaatgtcgcccacaaccattactaagttaataatattgctaggtgcctccggtccactcctaataaccaagtgccagccagcaggtctgaaagcacctcagttcttcacagtgaccgtccaggaatctagacctaacttctcttcaggatgcgcttctttgggtataaagtctgcccagtctgctgtggagcagactctgggacagtccttagcctggccctgctggctcttctgggtaccagctttgagctcctgggctctgcttcc

SEQ ID NO: 32110 - DNA, 1190 bp, Mus musculus
gatgtttaatagtagatgttacagatttattgcttaaagaagggactctgaggagcccaccagctctcaggggggttgggtttttatttgggtttagattgtcccatttggtgagtcttctatcctgtttttttattgctatgaagttacctatctgttccttctatagcagggactgggtttctgtctatgtccacaaagtgcagagatacctgattggttgactggctggggtcagagcatatatcctgatctcctttcaagtgtaagaagtgcagaatgagccacctcgtgcaaggggaaatgggaatacacggcagagaaaggcaaactgctggggacaaaaagccacaaagaaattgaaatgtattctatattgttgggaataaaaatccatttaaaaaacccaaccaaactgggctcattatggccccctccctcccgacatcctaaatggccttggcctcaatagtgaaggcgccatagcctcacgtcccccacacttggctgggaacttccattcactgcagatttatttcttttttcttttttttttttttctgttttgactgttgtgtgttgacatcatttgtttttgctttgttttgtttgtttgtctcttccctcagggttgatgggcagactgtccccagatggtaagtgtgaatctctgttctcagctcacaaggagtgacacagctacagaatgccttatgctttgtttatttggttctaaatttaaaataaaaaaaaattatgctgggtggtggcaagcccctttaaccccagcactcaggaggcagaggcaggcggatttctgagttcgaggccagcctggtctacagagagagttccagaacagccagggctacacagagaaaccctgtttccaaaaagaaagttatagtgagcaggcacatgcgccaaggcatgcatgtggaagtcagatgataccttgcacaagctggttccctctctccactgtgtaggtcttaggaatagaactcagatcttcagacttgctagaaggcaccttcacatgctgacccatattgctggcccaggtgtgtgtgagtgtgtgtgtgtacgtgtgtgagtgtgtatatgagtgtgtgagtatgtgtgagtgtgtgcgcgtgtgtgtgtgctggtgtgtgcatgagtgtgtgtgtgtgtgtgtgtgtgtgtgt

SEQ ID NO: 32111 - DNA, 1148 bp, Mus musculus
tttgcaagttacacagaggaaaactagaagtagtttgggggaactctgttcagatagggttgtacactggaggataggggatgaagggacaataatgcagacagaatcccaaacgggtcacaacaattctattgatttacttggttcagtccattgcaaagtccctgattgtacagtatgaatatattggatgtttctgatcggctgagccaaattctgcttttctctagtctagtgcggcttgaattttccttaattgaaatgccctagccgggcatggtggtgcacgcctttaatcctagcactcgggaggcagaggcaggcggatttctgagttcgaggccagcctggtctacaaagtgagttccaggacagccaaggctatacagagaaaccctgtctcaaacaaacaaacaaacaaacaacccccaccaccaccacccccaaaaaagaaatgccctaagctgagtgtgtttaaaatttcagacattttcaggatttcgaacattgctgactcttgtcagttgactcttaccccgcacccaatctgatctggacaatatccaaatccagacctggatgtgctgtctcaggctggtaatcccagcacttgggagatagatggaggtggtggtggtggtggtggtggtagtttggctggatttgaacctacagaaagagttgcaggatagccttggtctgtggagtgagagggccctgtctcaagaagtaaaaccaaatggaggctggagaggtgattcagtggttacaaacactttctgctttcctagaagacctgagttaggtgccacccacttaagacagtttacgattgcctgtggcttcgtgtggctttcaagggcatacacacatgcttacacaggcatatacacgtaaataaagtgaaataaactaaaaaacaatgaaaacaaggctaagggaaactattcaagcatcaccttggcactcgaaaaatcttgtaatggagccattttggattagggatgttcaacctgtgcaggtaggcaagggtgaactcaagctagagtccactcatactcacagataaggcaagggtgagctcaagctagagtccactcacactcacagataaggcaagggtgagacattaggagacggttggctgt

SEQ ID NO: 32112 - DNA, 1203 bp, Mus musculus
ccactttagaaatcaactggagattcctcagaaaattggaaatagatctacctgaagacccagctataccactcctgggcatacaaccacaaaatgtcccaccatgccacaatggcacgtgctccactgtgttcatagcggctttatttgttatagccagaagctagaaacaacccagatgtcccataacagatgaatggatatggaaaatgtggttcatttacacaacagaatactattcaactattaagaatgagaacatcttgagttttccaggtaaatggatggaactagaaaatatcctgagtgaggtaactcagaatcaaaaggatatgcatggaatatactcactaataagtggatattagccaaaaaagtacaggcttaatcctcagaactcaagaaggttaagtcaacgtgcccaagtgaggatgcttcaatctcacttgagagggagaagaaagcagactggcaggcaggcagagagaggagggagggagggagggagggagggagggagggagggagagagagagagagagagagagagagagagagagagagagagagagagagagagagagagagagagagaactgggtgggagaggggaacaagaggggcaggggaaaaggtgaacatgatcaggtattggatgggggaaccaggagtgaagccccaagggccagcagagtgaacctcaggattcattctaggctaccctctagaatgtaccagagatctggtaggtgagagaatctcaagactccaagagatggaccttagatgaaaggcacaacagtgatgaggggaacttgtagaatccacctcaggtagaaagacagggcatcaagtgtaggatggggttgccatctgtgatggtttgtatattctagtcccatggaatggcactattagaaggtgtggctctgttggagtaggtgtggccttgttggagtaggtgtgtcactgtgggtgtgggctttaagaccctcatcctagtcaatattctgctagcagccttcagactaagacgtagaactctcagcttgtcctgcaccatgcctcctggatgttgccatgctcctgaacctctgaaactgtaagctagctccagttaaatgtataagaagagttcttggtcatggtgtcagtgcacagcaacaaaaaccctaactaacaccatcccacagtcaaaagctg

SEQ ID NO: 32113 - DNA, 1391 bp, Mus musculus
aaattataattaatcatctatagtccaaacagttcccaggtccctgtggtctccatggcaacttggtggagtcagtctggctttcaagcccagagatggagaggttttttttctctgtggaatagagtgaaatgagaagtgacccaccttgactttaggcaatatgaggcatttgactctccagtttgtccagtgtaaaacaaacctgggcagggcaatggtggtgtttctccgtggttatcctaccacagtccaggcagtcttttgtagctgtgcccaaaaccttctgagaccttgggatggagggggtggtggttactgtcgggctttgggagattctgcctatcatgagcttaagtattgatatctattaacagacctctgacaagttggagaactgtgtctactggtcatatctgagttagacaacttatgtttgttaaattatttgagactgtatatagtaaatatatcacactataatttagtggcaatagcaaaaatcatttaccaagacagaataggaatgaacatcttaattgttaacaattaagtaactttgacaggttgcatagtatagaaaaacatattttgcattagtagagaaactcttggattagagttggtgtggaccagaatgtaaagaaataagaaagattatagtggtggcttgagaccatggtgacagaaagtgagtgtgtccaggcaggttcaggcctgtgacacgaactggtgggcgagcaggcagtgggatgggccagtcgacggagcaagagacaggagcacctgcatgtgcaattgaggctcgggcgtgggaagcattcgcagcctgaagaacacagatcgcaaggagccacaatagtggtggctagtggtggcgacagagtcaagagatcagggctgtgcacaaggaggcaccaggcctgctgtggtcatgggcaaagcaggcaccatggtggcaggaccaagggagggcagtgtgagtaagcaagtagggcaggacttcctcctagcagccagacatcccgacccagtgctttcagagacctcggtgggtgggggagggaagcacctaaagtagcggtctgtatcctagtaactccactcaaggctgagtaaagaaggcaagggcggcactgtgctgaggctggagaggaaaatgtgccggcagcaatcccatgcagggacagtttgtgcatgtggtggcaggggaacgtagcacagcatcctgtcccagacagggcgcaggaagcacaagagggcagggcaaaagttgctttctcgcagctgcagcagagctcgagcagccacaaggggtggtggtagccttggtgggcagaatgtgggagcagagtcctggacagagagagagagtgaaagagagaacaggg

SEQ ID NO: 32114 - DNA, 1234 bp, Mus musculus
gcgccgcccagaagctctgcgactctctcgcccgtcccagaaacagctggcactctgtattccacacggtcacccgtgcagcctgccctccgcggagtcccggagccaagaaggctcccgccggcgcctgtgccacaaacctctcaggccaggcagaccccgtgctctcaccaggaaggtggccggctgtcagaaaattaaatttaaggttggtaaacatggtggtactgttgttacaggtgctgttaactactgttgttacaggtgctactgttacaagtggtatctataatacctgcaaccttcagatgaggaggcctcttggaggcattcacctgtgtttctgtaaggaaggcagaggaaagggctggggatagtggagatggaatagaattgtaggggtatatcagtctataggggagatcaatcagtaggggagcgtctatactgtctgaaaagacgttaaagggcctattaacttcttttgggggtgaaatagtacatagttctttatattgggggcagtgattggggcagctctttgatttggacaacgggtaggtaaattggttctttctcacaatagttgggtacatgctgtgagatctgtagtagggtgatttttaggacgttgatctgtgggacaatggaccttgccaggaagcttggttaggtagagcgggtctgaatccctggaaacccgggtacacacttaagatggcaggaggcttcctgctccctgccagattcccagcctggaacatgtgccacacttcccacataaggaaatgtgtcctatggtcatgtaggcccagaacagagttctccatgctaacgaggtacctagagaccctgagggcttagccaataagctccccttcccaaaaattcctccatgcaaaaggtatttaatcctctggtccactctgaaaagttggtacacatccattttccacagtgaacaaccagtaaacagtttggaaccaaggaccgtctcttttattgagaactgtcatggggaacatggagaaggcctttacctacagagccgcagcttaactctcccacagaaggcctctctgcggttccagacacctgcccctaccttagcaaatgagctaagccagagctccagtttccttggtctcaggcttgtcgccatcctcagcctgcgggccaccaatggtcccagccttatcgtggcctgtggacccctgatccttcattccagggt

SEQ ID NO: 32115 - DNA, 1443 bp, Mus musculus
cattacccaccctggagggtaccaggcaccaacaatctctttaggcatagaatgtttatctttagtaaagctgtcccctttgaattattcctgataggtcatggtgagaactactcaccgactgattcctaaatctttagaataattagtggaaatattgaaaactgaattaggagaaaagccacaagaaaaactactttgggtagctataatcgggtactatatcccaaatgaagtctctttccttggcttctttgcatagaacttgagcagcagagccagttgttcatattcaaaatgagtatcattatacaggtgtgacacatacactttaagaaaccaaacatcacgaggtccaaagctacctctatgggtattggcccctggaggcaacagagaatcagccacaaatgtatgttcctttcataggaaacaatcttggattacttctcccaccaaaatccaaatcagctaggaagaagtgaaactttcataagtgaaattagttttggttctctgggtgtggaactcattacagccccctcatccccatcacttcagaattgcttgtagtcaccttaatgggagcaaaatcccatgtagctgtatgaaacttaggagggtctggcaaatagggccagaaaggtatggcagaatccaccatagtgacagggagcgtgagcaaaaataaatacctcaactgttaacagagaaagtatgccatcaaaagatattctgtggtgttaatggaagattattatatgtcaccaaagccgtggtcccttacttcagctgtccgcaggtaggtatctgtcccatctgtgtggagtctgtgactggaatatactcatgctcaggtctagcaaggtgcaattgttaaggtgactgagccaggaaatgacctgtaaattgagctaatgctgctgattggggcaccatgttactccttgagggatgatgctgtttgtgattgctccttctcttgggagctaggtagagtggatgatttggcatgccagatgagtccatctggaacccagatgggattctgcatctttaggaaaaataaaagcatagcctggtctggacgtcaaaaggacattcaggcctttctgttgtggtgtcagcaaatccttctacattaccaaagggtttatgtctggttttaaaaaccacactaactctggctaggctcggccccacagctagctaacgctttccagagagtgccacctattgctcctgctgactttgttaagctactgaacaactgtccctcctgagaacacctggaactactgctcatgtcccactgatgaccaccctggcagctggttctgccgaccgccaataaaccatccttccactgtgtcctttttcctacccccttttagccccgaaagaaaagaaaacactcgaaacttttatattttaaaactgacc

SEQ ID NO: 32116 - DNA, 1118 bp, Mus musculus
tagccagcgccatcttataatggctattgcttgtggcacggctctccacacgggatcatttcaatcttctcttgtacctgttgaggcatgttttgtgactgattatatggtcagtttcagagcaggtaccatgaggtgctgagaagaaggtatatccttttgtcttaggataaaatgttctatagctatctgttcaatccatttctttcctaacttctgtaagtttcattgtgtctttgtttagttttgtttccatgatccatccattgttgaaagtagagttttgaagtctcccactattattgtgtgcagtacaaggtgtgcttgaggctttagtaaagtttcttttatgaatgtggatgcccttgaatttggagcataggtgttcagaatttagagttcatcttggtagattttacctttgatgcatatgaagtgtccctctcatcttttttgataactttagtttgaaagtcgattttattcgatattggaacagctattccagcttgtttcttgggaccatttgattggaaaattgttttccagccttttactctgagttagtgtctgtttttgtccctgaggttggtttcctgtatgcagcaaaatattgggttctgtttatgtatcctgtctgttagtcttatgtctttttattggggaattgagtccagtgatattaagagatattaaggaaaagttattgttccttactgttatatttattattagagttggaattctgctcttgtggctatctttttaggtttgttgaaagattactttcttgctttttctacgatgttgtttccctccttgtgttggtgtttacccgttattatcctttgaaatgctggattcgtggaaagatactgtgtgaatttggttttgtcatggaatactttggtttctccatctatggtaattgagcgttttgctgggtatagtagcctgggttggcatttgtgttctcttagggtctgtatgacatctacccaggatcttctggctttcatagtctctggcaagaagttggtgtaattctgataggtctgcatttatatgttacttgacctttttcccttatggcttttattctttctttgtgttgtgcg

SEQ ID NO: 32117 - DNA, 1174 bp, Mus musculus
ggtatgctaccctttttattagttcctgatcgcgaccattggtcagggttatatctttgttcttcatattttgctgcctcctcctctaattcagcctcctcactggggtctagatcttcggaccctgaactatcaatctctaaggcctccaagtcatggataggataaaaattagtataaggctttttcttagtagagggctcagtttcactgcccttctttctttctccccttccttctgaatcccagggagggccctttttcttagacatgtctttcttttttcgagctcccattatcttgctctgttcggtttctgacatactgtcctgaacctcttctagtgttccctgtccctccacaatggcgggtcggcaggtttcatcctctagacagttttttatctgcttccaaattgccttggtgcccaggcgtaagtctccctcttcatgctacggtcaagatcccttcctagcttattccatgaggatacagttagagaccccgaacaggcataccagggagcaacgtgatccacctccttaacaaagttctgcagtgtacgggaggcgacctgcaggtcgcgttgctttagcactgcctgtaacacggtgatcactgactgtgaggagcctatgatagagtgagtgcctgcggctgatctatgcctgacttatggtattccttaagcaaagcgaaaataaacacggtgctccgctcccttatctaggagcttacaagatacctcggtgctgacgcttatctacgtcggactgaccacacctcaaatttcagcaccagcctcgatggacagaataagaagcaataagaaacagaatgagggccagggcaaccaagactagagcttctaccaccccttcctagggtgcatccagattaagaccaaaatcaaaagggataagaggttcacgatcagacatacctctccgaacttaccttttccctgcagttctgaatccaccccatctccgggggttctcctcaatgccagcaatgttgatcccgggtttccagcaccagatgacccgtgctaccatcttgccagcaagtacacacgcaggacactcggatccttcttcagtaaagctttaatacatctcgagagatagatgatcagcttcaggagaggagacccagagagcagaaaaccctt

SEQ ID NO: 32118 - DNA, 1210 bp, Mus musculus
gtagcctgttcatatatcaactgttcaattaaaggcatagctgcttctgtatctccaaatattctccctgctgcctctgtcattctagccgcaaaatctgagaacgactcctgggcgccctgagtgatcttggtcaaatgcctacttgcctctcccttcttagagagtgccttccatgccttaacagcggcagctgagatctgggcgtacgctccccaatgataatctgtttggttagcagcatgctgtccctgacctgtaagcaattcaaacgtccatgtcctttggtccccttccatggtggcattggcccttgcctgcgtctggcaggagtcctgccacaaggctttccattcaagatacattcccatactgggggctgcagcttttactacagtctgccaatcaccaggagtcatagtgtgagtcgcaagcctttcaacttgtgctacagtgaaattagcgctgactccataattacggactgcttctgcaagctccttaatctgtatatactctactggaatgtgaacatgccctccctcagctctttcaaaaactggaaatgcctgttgcattttcctctgttcctcttttggaataaatgagtctgaatgatacctctgcacataaggcggaggtgcactagaaccctgaagttgcggatccaaagaccggacaacgatttgacatttgtctctagctgctttcatgttattctgagactgattaactcgtctttcatctgactggtatctttcttcctcatagcctgttgcttccttctctaagtctgtttcctcagaggagctaagctctttatccgattctgagctactgacagctagctgcttaaacttatctagtggcgggtagaggctcctttccttatgcgcctctccagctcgttctcccttcttctctccctttccatccctttttctaatctctcccaaggcattctttcctttatatctcttttcctcaggctcaaggcccgtggaaaggtctaaattcttcagtgaactttgtttcctctctacttttactctctctccacgctctgcctctgatagactttcttgaatttcgtccaaaactttctgccccgcttctaccatttgctgacaatcctcatctgttaagcacgatttcaccaatttccacaacggcatgatccctgctttaagtttgccgttctgctgttccc

SEQ ID NO: 32119 - DNA, 1199 bp, Mus musculus
agtttgcaagaccaaggggcctctcttcccagtgatgtccgactaggccatcttctgctacatatgcagctagagacacaagctctggggtactggttagttcatattgttgttccacccatagggttgcagaccccttcagctccttgggtcctttctctagctcctccattgggggtcctatattccatccaatggttgactgtgagcatccacttctgtatttgccaggcactggcatagcctcacaagagacagcaatatcagggtcccttcagcaaaatcttgctggcataggcaatggtgtctgcgtttggtggctgattaggatttctatccccagaggtgtctccctttgggttttctttattgtttctacttccatttttagatcttggatggttttgttcaattccatcacctgtttggttgtgttttcctgtaattctttaaggacttgtacctgtttagcagtattctcctgtatttccttaagtgagttattaatgtccttcttaaaatcctctaccatgagatatgattttaaatctgagtcttgcttttcaggtgtgttggggtatccagaacttgctgtggtgggcgtactgggttctgatgatagccagtggtcttggtttctattagtaagattgttacatttgccttttgccatctggtaatctctggtgttagatgttctagatgtctctggctggagcttgttcctcctgtgattctgttagcctctgtcagcagtcctgggagtccaactctctcctgagtctcagtggtcagagcactctctgcaggcaagctctcctcttgcagggaaggtgcacagaagtctgcagctcagatccacctcatgagtcctggggtcagagccctccctggaggccgactctcctctggcaaggaaggtgcccaggggtctgggtctcagctctgccttctggctggggatgaaggcccaaagggaccctgttcaagaagctctgttgcttctgccacccacgtgctctcctgcgtagactgatctcagtgatccctaaattccgggtgtgctagggtgtgccccctttgcactgaggatggcatgaagctggagccaccagaaggaatgccagcctctggttgggtggggttccttggtccctgttcctgctggcacaggaccctccggtgtacgcaggcgcaag

SEQ ID NO: 32120 - DNA, 1099 bp, Mus musculus
ggattttcagggttcagattagtgtattgcaataaagcctttgcaaggcgttataaaaatcaagatggcttttcctgtttgtcctggatatccacttggagtttttcaaaaatttactggttttaaggctgccctacagagaccgctgaggaggcagattatgaatctatctctggctaaaataccacctgtggaattataattccattgaggatcttggtgtactgcctcagatccgcttggatatgctctgtctgtttgatgattttcatctgcatgtgttcttgcctgctcccaaactcgcctttgatcttcaggaagtaaattgttagtaagcattatatgtgcatagtggaaagtcaagctttaagattcagtggtatactgaaactgtttaataaaggtggaggagttagaggtctgctttctgtttgagaaaattcactcagcaagacaggaacattcactgagaaaggaacatgtactctgacaaggtcatctaccccagcaacttacctaaaaggaaggactgatgctgggtcaggtgtcccagggggagaaggacttaggggtttgactgtggccttagagcacatgataggaggggtaaaggtcggtgccaaagcagggcgatcaatgtgacctgcagctggcacaggaggaggggaagggtctggataggttgagcagggaggctgtggggtaacctggtgaggagaaactgaggcatcagtttaggttttcagaagcatggaaataggtctgcggcagaaaggaggaggttcgttagctggatcgaggtttgtagtgtcatctgatggaggtttcatggctaagagaagttggtttggggaacaagaagaacacagggaggagttggagtgaagataggtaaacacttgggcatagggaacctcttttcatttaccagatcactggcagtaagtgtgaagatcccgtaaagtgattggatctaacatgctattaagtggccatttggagccactgtgtaatgggtgctgaatccagatcttattgcataggtgtattagctttgatgccctcaagttgggcattaacttcagagagttgagatttt

SEQ ID NO: 32121 - DNA, 2043 bp, Mus musculus
gcccaatcaaggtgaagttcctatgacagcttgacaagagtgacttttaaagagcggttggttctttctaccttacctgaagattgagggtggtacggaatatgaaaatgccaggggatgtctagggccttagacatattttgaaaaatttggggagtaaattcaggacgattttctgaccggagaaaggctgggacactaagtcaggaggaggagatcagagactgtgtgagcccttttgttgtggaaaatgcctctacccaccccaagaaggtgtccaccaagaccaggagttacttggcatgtttgacagtgggcatgtgggtaaagccaagttgccagtcagttcctggaagggaacttctagcctgatgggtaggaaaaggggtgccacaatactttgagttgaagtctgacatctgacagatttttcaagaagcagtgatatatttaacaaaacttaagtcttcaggagtaggctgtaggtggttcttgacaaaataagacaatgcttggctgttaggatgaaagagttggtgaagatatgagtttggtgaatgtcagacggtgaaggtggggatgtggattgcagtataaagatgtcctggagagggtgagaggcccctaagggctgcagctctagctgtctcatcgggcttggttgtttcccttggaaacaatagttttatctgtctggtgggatctgcagtggacagtcccaatagctgtagggagatgggaggcctttagcatggccataattttgttcgcattaattattgatcctcccttagtcataaataacacatgctccttccaggtagctgtgtggggcaggaagatatggaaagcatatttggaatctgtgtagatgttgagggattgtccctgtgccagatggaaggcacaggttagggctattagttcatcctgttgattggtggtatgagcaggaagggcttgtacctccacctcctctggctatagccagcttatctggccccttcatgtagaaaggagcttccatctgtatatgaggtttagatgccctgaggcagtgtgccttcctatgtgcaaaggatgtgcttatagttctcctaaaggttcagtgcaggagtgagatagggactggttagtgtttggtctcggaagaagattggaaatattaagaggtgggcatgattggaaggtgagcgtggagtcttctactagtgctacctgaagagaaaaaaaccctggagggaggtagagtctgtaaccctttgcaagttaggagctgtgacaggtatgagaagagaagacagttataggagacccaaagggtagatttttttttttttttacttttgaataaggagttcagtgtctgataaggtatgaatccagggtgctcattcctgaatagttagatctaggttatttgacaggtatactaaaggtgcaaaagagttgctgacttgggaatccaagggcaaatctctcttttttcagttatgtagagggaaaaaggacaagtcaggtcggggaaatgtaaagctggagccctaaggagagcctgtgggagtccttgaaatgtaacaggtttgagaagagattcgtgggtggggcctaacgctgcttcatacaaggagcaagaaaggagggaaaaggaaggaacccaggaaaaaaatctagttattcctaggaataataaaacctccctttgcagaaagaacagttagagactaaatgtaattctttctatctaaggtaataatcttgtgagttgggtaattgttagtcccaaataggtgacctgtggagtggacagttggagtttagaagatgagaccctgctgggcgtggtggtgcacgcctttaatcccagcgctcggcaggcagaggcaggcggatttctgaattccaggacagccagggctatacagagaaaccctgtctcgaaaaaccagaaagaaaagagagagagagagagagagagagagagagagagagagagagagagagagagagagagagagagagagagagagagagagagagaga

SEQ ID NO: 32122 - DNA, 1140 bp, Mus musculus
ccaacccctgtccccggcactgcagcctggtgactgaccaacccctgtccctggcactgcagcctggtgactgaccaacccctgtccccggcactgcagcctggtgactgaccaacccctgtccctggcactgcagcctggtgattgaccaacccctgtccccggcactgcatcctgatgaccaacccctgtccccggcactgcagcctggtgaccaacccctctccccggcactgcagcctggtgactgaccaacccctgtccctggcactgcagcctggtgactgaccaacccctgtccccggcactgcagcctggtgactgaccaacccctgtccccagcactgcagcctggtgacccaacccctatgtgggtctcccaaatgaactgaaaccaaaagcaaaagtgggtagctcactggggtgagcagaaagatgcaaagtatacagtaaagaagtccacacccttatccttgatataacataaaacactaataaggggccaacttactgaacaatccatcaaagagggcaaagcagtagtgccatgagaagaagagattagggcacagtccttgtggcaacaggcaaatgaatctcccaaaatggaggttcactagtagccaaaaaatgaggatgttagtataggctgtagactacattgggcagcagatgttgcttggcgccatgcatggcctgcctacctcccaactgtactcatccctaggggttggggatgaggtggcacagaatcaatggcttgcctctgggagcaggtgagaatgcagggcagcaagttcatctgcgaattctcggggagcaccctttatattctcctctctcgtcacattggtccccaacaagtgtgccctccaagtggcagttctccattggctgtcattatctgcatcaccaatctctaggctctcagcaggtttcagtttgtcccgcatgggaaattgcctctgcggctgtgcagcctcactccctgttactgacatttatgtggaagaggccattacttcttcagtgaggcctgctgctgttccttctacacttttgtaaatcaaccattcagtagctctctccctgtctctgtctgtctgtctgtctgtctgtctgtctgtctgtctgtctctc

SEQ ID NO: 32123 - DNA, 1064 bp, Mus musculus
tgcatctataactcctgctctcttttctaggttttttcatctccagggctgtatccctttgtgttttccttaatgtttctatttcaacttttagatcctggatggttttgttcaattccttcacctgtttgattgtgttttcctgtatttaagagatttatgtgtttcctgtttaagggcttctacttgtttaactgtgttcacatgtatttctttaaggaaattatttgtgttcttttaaaagttctctgtcatcttcatgagatgagaatttagatctgaatattgcttttcaggtgtgtttggggtatcaaaggcttgctattgtgtagggtactgatgttgccaagtagtattagtttttgttgcttatgttcttgcacttgcctttcaccatctggttatcttttgtgttaactggccttgctgtctctggctggagcttctcccacctctgagcctggttatgttgggcctccttgggtcagactgtctctgggtgtgtgtgtggggaaggtgggtgctagagcacagggtctgccccctggtgtagatgagaacctgaaggaaggtttgtctcccgccttaggggatcccagttaggtcaggtattggggcaggggttgaggactctcctgtgagcaggggtggtgtgtgggggggtgggggggtgtcagaactcctggggtcaagctgtcctctgggtgggggcagggtgctgggtgggtgttgaagcataggatctatgtttggacacaggtgtgaactggcctgtttccatgttttctatcttaaaagaatgccttgcaaacacaatattttcctgtatttctttaagggatttatttgtttcctcttaaagggcttttacctgttttcctgtgttgtcctttatttctttaaggaggttatttatatcctcctttaaagacctctatcatcttcatgagatcgtattttaaatcatctatttagctgtattaggctttccagggcctgatttggtagaactgaactctgatggtgccaaatcacattggttttggttgcttatgttcttgtgc

SEQ ID NO: 32124 - DNA, 1139 bp, Mus musculus
gaaagcaatagagactgaaacctggtttctctctaactaaagtttaggtgtgggtctctccaactactctcattacctatgtatttgaagaccactttaatacacaaagactctagtaagtgttattttatgtatctgaaggtgattgtgacttgcaaaggcttcatcatattccatgcattcataggggttctctccagtgtgaattctttcatccccttgcctgtgatatacaaatgctttaccatgttggacatactcagagagtttctctgcggtatgactttttttatgcctgtgtatatacgtgacacacatgcaaggtttagcccatttattatactaatgcatctttttatctgtatgaattaattttacagtgttttctaaatgtaatgaggaatcagatattataaggaatcagatattataaggttgtatcactttgtttatatctatggtgttctctttcattatgggttgctttacatcttttaacagtgcctgtgataagagagtttattacatggattgtttttgatttgcatttccctgatgactaaggatgttgaacatttctctaagtgcttttcagactcctctgttggaactcctgagttgagaattctgtttaactctgtactccgctttttaatagggttatttgtttctctggagtctaactttgtgagttctttgtttattttggattttagccctctactgaatgtagggttggtaaagatcttttcccaatctggagattacagttttgtctattgacagtgtcctttgccttacagaagcttttcaattttatgaagtcccatatgttgattgttgatcttagagcataagctattggtattctgctcaggaaaatttcccctgtgttcaaggctctttcccactttctcttctattagattaagtatatctggttttatgtggaggtccttgatccacttggacttgaggtttgtacaaggagataagaatggatcaatttgcattcttctatatgctaaccaccagttgagccagcaccatttgttgaaaataatgtcttttttccactggatggttttagcttctttgtcaaagattaagtgaccctaattgtgtgggttcatttctga

SEQ ID NO: 32125 - DNA, 1177 bp, Mus musculus
tgtgtgtgtgggggggggggggctcaagacactacatagtaaagaagttctcagacaatctatgcctgagaaccccatgtctgccctgctttccaggatataggagcataggattccagctcttaacctgaagggttaggagattatatcagttggaactgcaaggccaggttcagctcaaggaaactgtcaagtcagggtctggtctatctgttttccatttagttgaagtccaagattcacaaacccaatatgcacaatggaattgcctgttgttattatatagcatattgatacctccctgcagggcagagatagtaagtaggtagtgattcccaaggcccctgggtttatagtgacccagtttggtgatatacctaagtcttttccagtagtgggccatacataggtctgccaggtctgctgtaaaggttggggtggactgcccaaggggcagctctgttttccttccagtttgagcacttgagagatgccataaacaggactggagcccataagggtttgattgtgtcagagcaccccagggaaaaacaactagtagaatagagttgaccttaaaaagccaaaaaggcttgatgatctgctgtcttacctttgctggatcctctggatggagtttgttccatggtctctggtctggatcatctgactgtccatctggaactggcttgatgtgtgaatgatgtctgatctgatcctgtcaaccttaacagcagttggtgtggtcaggatgacggtgtggcatcctttccaacatgggcccagagtctccttgtgatgccttcagaaaccagaccagatctcttgcttgtggccatgtggctttgcaggtggaagttggtagatgttctggaggatggggaaaacaatgtcttgggtggtctggagggcctgaagtgatttaacttatttatattcagacattaagaacttcagcctctggtttaggggaaagaatcagcaacctcccaaacataatttcacagggggtaaggccatgccataggtgtaggggatgttctgaatgtgcaacaatgcaaagggcaggctgactgtccagtcctcaccagtctcaagggttaatttaatttaggtctccttaagggccctttttatcctttctacctaccctgaactcaggtgatagtatgcacaa

SEQ ID NO: 32126 - DNA, 1396 bp, Mus musculus
tatactctttaataccttgtttattcttgttgctgtgcacagacttatatattacaactgtgtcaaaatgtgtattcaagatagctgttctagtatttcctgtgtaattacggtaaaatactttgaagtttccctatgttccttgtaatagtcgcctgataataaagtttagtatgtaatatcaccaccataagcatactatgtacccagtgaaaattggaaaataagtaaaattgaacagaaaactttgcccacactccccatacccaacaactgttaagatcttcatctgtgtccttcatttcatgtcattgcacaaatttgtgattaaaacagtgttaaatagatttgcataatgcctaaaacaaacagaaatgtgggaaacaattaaaaatagtgtttttttggggggggggttcatggttaaatgttttgtttaagatttcttgaataatcttcagtgtttgggtaacaaactttacgtatgtactctgcatcacaaatataaggcatactcaaagaaaactgggaaactgaagtgaagtcgagaaaaactgtatttccaacaaacttctggtaacgcctggatctgtgccccactggtgtgattgtgaggttttccatgacaagtgcgtagtgtcaacagcaggaagaaatgtggaaaggtgtggaatggcagggcagttgtggcggaattacagtgagctgtattttctcagtttctttgagggttctttgtcatagtgttctagcaggctgcccgtattgcttatatatgcagtacgtgaccattctagtagccttgaagatgtgcaaatgtagaagagaaactcacccatattgtcattacccaaagactgtgttaacatctccatttgttttctttgtcttgtttctgtgcacaggcttttggtttgttaatatggctgtagttggtctatcttgtaatagtgtcatcaataaaaataaagttaaaaataagataattctcagtctcttcctttgtcctgtttatgtgtttggggttggtaactttgcagggacttgtcactgttgataaaattatacatccaaaatgttagtggccccttagccatacaaatttttgatcttcaaatcatattcttaattaaaaaaataagcctttgtgtgtatgtacacgtgtgaatggatatttgtgtgtgagtacagacatagactctcatgtcccagtgtgtgtgtgaaggtcaaataacagcctcaggtgtcagccccaccttcccatcattcgagagaaggcccttttcagttcactatgtaccccccaggatagatgtcttgcaagttaagatttctataagagtgttaagattacagaagcatgcaacagctgcaggctttatgtgggctctgagat

SEQ ID NO: 32127 - DNA, 2318 bp, Mus musculus
ggtgcggagcaggcagacgacaagtacttcaaatgtgatgtgtgcgggcaactcttcaacgaccgcctctcccttgccagacaccagaattctcacactggttgagtaaccaggctgaagaaaagaagagcaaagccaaaccttcttcccagaaccagacccttaataaatcacaaagagagcctaaaccaacccataatgtctataagaaattcaccttcctgtatacataccggacttcacatcaaagactttcactctcatcacagactgaaaaaagaaaagacattgaacgcagggactctttcagttttagctgttccctatggaacatcagtgtatatttgggaaagctagagtgaacatctacatcttccatttcatctaagtaactagattgagggaaaacctagtgacaattccagaccacagaggttgccccagtcgactgtaaatgatacccctttcataccctatacataatgattcctgccatgtatataaatgagcaaatcagtgatacatatatttggatttagtgtgctatagaatttacagtttactctacagagctacctagcctggtactctgattttttccctgaggaggaagagagcaacaatttagcatatatttgtaagtattgtccatgcagaagcttttctgtgcatcatttgaaccccattagtatcctttccagtaatggagtgttctgtcccctacctcttagatagtcctgtgaaggtgtgggtgtgaaagatcgtgtgtctttgaatcctggctgtgtggaaacaggcattttagcttctacagccatttggtgtgcacccagaccccttgagactgattgtgtaaccctttacaatatatggatttgtctctgtgacccaaatcaacccatccctacatttatataccttacagtggttttcttgcaaaaaaaaaaaatgttacatttgaggtgttctttaaggtttgggtttttgttttctaaccaactcatcgtgtgtttgatagtgaattcatgaaacctgaagcttttccctgtaaatcttaatgtctttgcctttaaagagtgggtgacaaccatcgctagatcacagtagtgcctaatgaaaggttgggaaccacaggagaggctcttacattgtaaataaggaagcaaactgacaacctttcattagctgctgtgtgcttcctgccttaagtgacaagtggcagcgtcgcttgagtcacctgtgtggtgttgtattgtgcttgccacaagtcagtgtgctccctgggtgcccaggagctagaatccttagatctttgtgtctccagacttaattcccctgttctctatgtgtctgtcaaccccaagtctatcgcattttaagaaaagcaaacacacacacacacatacacacacacacacaaagctttctttatagttaatcctagcttacttaacatggactcaggttccccagcagccttaagtttttttgttaccatcgttctttctcatggagtctccttagtatttctgagctttccatttagtgtgccatctgtctccatgtcacctgatgtcacaaactgacttcccagcttgagattttctgcgtccgatacacggactgcgtgcgctcctttacttcccctcccctcatggctatagaaagacaattttttggccttcagttggctggggaaaaaaaaatttaaaaatttaaaaaattaaaaaaaataaagcggatctgtagccgaaagatcgcaagataagtacagatcatctgagaacgtgaacagagtttacctgctggagaaagcggtctgactctcagacttctagatctgtagatccggggctcatgagggagtgtgccagagcctcagtgaatgccaaagtcttcagaggttggagacctaaaggcaagaaatagaaatgagtgagccaaagaagggagttccaagatgacagcagatctaggaaggagaccagacagactaaagaagataccagcagcagggattggaaggtcagggtggtaaaaacaaattagaaagaagtgtcctggagagttggaagaaaggccttttggatggcttcgtgtaggtgaagaccagctgcatagagagagccccaggttggaactgacatccagagaaacagaggggcaatgattcactggtgaggctcccttgaaatggaagtcagtgtcatagccatctgggtaaatgtggggactcggtatcagtgacagacagtgtcacccccactagacccttttcagaaagtgactcatcaagaagtctgagttgagtgtccatt

SEQ ID NO: 32128 - DNA, 1160 bp, Mus musculus
aggacaatggatttgcactgtcttttgagagaggaagagaaggaggagaatcttatagttaacagaccttagaagagaggttggagccagaggcagggccttcatttcctttgcaattaagcatctaagtcctgggaaacatagctgtggccaaggcagacaggatccctgctctgagatgcttttgtcagtggcccatgtaaatattcatataaacactctgtatgtctgatgaatgttctgaacattctcaaagaaacagaacactaggaaaaattacagcatggagtctcaatgtggatcaaagaaaatgccttcagggcagcatttgacctctgagggttggggaggaatggtccaggcctgaggttggaggggatcccagcctttagtgtgagcataggcaaaggctttctacgtggaagccagacatctagcaaaccaaggaagagccagggagatggctgaggcacacagagctggattggtgatgtgaacttcacctagttttgttgctcacagtctcttccttgacagtgtgtcatgggttgctgacctaggaccttgtctgcctaatgcaaacatcgagctgctgttgatcccactgactcagaggagaaacaggggcactggatggtacaaattatactttgaggctgtgcaaaacagaaagttctcttgctatctctttaatcacatgcaaatccctaatggttccagtgcatagctcactgtgtgaaaacatgaactgtgccatgttggcatgactctcaggccacccctgccactcaaacttgtttacaactcatgtacacttaggtaccatagttgacggcaaacatagagccagcaactgctttaaggctacttaaatttactcatctttatacaaatgcaccattttgttttacagaagcaatgttgttcagactttatgcaaaagagacagacaaattaatattaaaactaatccatctgccactgctctcgggctctgtgtaccccagggatggtgacactttgcctcttacactgccaaagtcttaagtattttgctctctataccagtctccacactgtgagctctggtttcctgtattatcttagggacatctgggtaccctctggctctgttttttattgttagtagatgccaaggc

SEQ ID NO: 32129 - DNA, 1197 bp, Mus musculus
ttaagtaagcctgttatcttactatattgttcattatattatgctttttgtggttttggttttggttttggttttttgagatggggcttctctgtctgccttgactgtccgagaacttgcttcatagaccaggttggcctcaagagtttgagatctgcctgcctttgcctagtgagtattaaaggtgtgtgccaccacctactggcttactatctcttttgttacagcagaaagatcagactaatacagatgacttatttgcgttttgtttgttttgttttgtttttgaggcagatttttctcatgtagacaggctgtctttctcagcgtttctcaattgctgagattacagattagtgccaccctacctaatatgacatgtttcacttaaaatgtttgcctctattgtctgtatatatcaaacaagtattattttctttaaataaaaaagtcaatacagctaagtatagtgattatacgcctttgatcccagcactccggaggcagagacacttggatctcttgtgagtttaaggccagtctgatctacagactgagttccaggacagccagagttatatggtaagaccctctcttgaaaaaaaaaaaaaaaaactacatccttaaagttctgtctgacgtatgtacacacttgtcaaagtgtgtgtgtgtgtctgagctcagagaacacgttccaggagctggttctctctcctaccacatgagtcatcggaatcactctggtcctcagtttggcagcaggagctttgaacttacggagcaggcttgccaaccaagcattagtttctaatggagtgtttgatacggcacagaaaccgtttttagttggttggagcaatttcattccaaggtatggaccagatcctgcaagactgagggtctttatcgtgttttgccaaaacccccaagtatgctttgttgttctccctgaagggtatcctgtccccagcctggagctgctgcgccagcgggagcaagtgcaggagccatggacagtgagtggtcaagtccccctgcggaagcacctgcgtaggtaagagtctggaccaatggaaggaagggcttggaggtttggaccaggcatctcctggaaagcctcttttttttttctaaagatttatatttatttatatgtctgtgagtatatgccacacctgggtagtactgaccagagcg

SEQ ID NO: 32130 - DNA, 1246 bp, Mus musculus
cctagaggccttatgcctaatcatatttggcaaatggatataacccattatgcagaatttggaaaactaaaatatatacatgtttgcattgatacttgttcaggatttctttttgcttctctgcatacaggagaagcttcaaaaaacgtaattgaccattgcctacaagcatttaatgccatgggattgcctaaacttattaagacagacaatgggccatcttattccagtaaaaactttatttcattctgtaaagaattcggtattaaacataaaactggaattccttacaaccccatgggacaaggaatagttgaacgtgctcatcgcaccttaaagaattggctttttaaaacaaaagaggggcagctatatcccccaaggtcaccaaaggcccaccttgccttcaccttatttgtcctaaatttcttgcacaccgatatcaagggccagtctgcagcggatcgccactggcatccagttacttctaattcttatgcattggtaaaatggaaggaccccctgactaatgaatggaagggtccagatccagttctaatttggggtaggggctcagtttgtgttttttcacgagatgaagatggagcgcggtggctgccagagaggttaattcgtcagatgaacacagattctgactcttctggtaagtatcattctaaagactaaaattccttttgtgcttagaattcagctgagagcgaaagctcccaaagctgttttccagctactctctgagccagctcccgacaggaggccggagactagcctcagctttacaatttgcatttgaataaagtacctagacttcccggaaagaagttctgctttcctactttctcactgttgagattttgtctttcaagcaggtaaatcaacattctcgaagcggaccagcggatgtgcatccccgcccccctagagcacacaggtggctgctgttatctcctttccaaggacatttccagcacgtggctttcagtctgagttaaaaattaggtttaccaagagggctagaagagtagatatttctatattaataaagattggtttttattttgatagacaggcttagtcccttagctgacctctggcttttcacccttgctgttactgcaaggtgtccttaggctgtggaaaaaaacagggatgaggaggaacgacttccagctcctattttagccacaagtcgtggtgttactaatgacataattcttgcctaggtctt

SEQ ID NO: 32131 - DNA, 1199 bp, Mus musculus
ccctgacatggaggttacagattgaccctctgaggtttaagccccaataaactccttgttatcataagttgccttggtcatggtgtctcttcacagtaatagaaaagtaattaagccactatgtcaacttaactcatgttgctgagtgatgagcacagtagtcggagggaacatgaaactggctatcaatagaataggttcacagcctggtatactctgaggtagaaagctaagtgggaatgacttaagggtaccaggaatccctgacaaggaggattcatataaattcaactttctccattattcaggactgtttatcctttgaggatgtggctgtggacttctcctgggaggaatggacactgcttgatgactctcaaaggatgctgcaccagactttgatgtcagaaatatgaacactcatgtctttacttgtaagaccctgtcctgccatcatttcagagcatgtctaggctttcctttgttttttggtttttggtttttgtttttgtttttttttgtttttgtttttttggagggggggattgtgtttttttgtttttgtttgtttgtttgtttgtttgtttgttttttagagagagctgtatctttctcaaagctggcctgtgaatactaaatctttcccccacagtcttagagtataaaatacaggttaggaaccaagtcaagtttcacaacagctctgtttctctcaattgcagcaaaggcacacaggaatcaatttggggttaggaatttttggggtgtagtttgagacatcagtctatctttacaatcctagctgtgctggatgtgctatgtagacctggctgtcctctgacttgccaaggtcttcttgctctgtctattgagtattgtaattaatggacttcacaaacacatctggcctggtgtcaggagtcttgacactgacagctaccctgtgacctgatgacactctaaatatttgggatctttgtgactcaagtacttctggtgacatgccttatgtttgaatgtaactggaatttggcactggtaagttcattttattattttattttattttattttattttactttattttatatttttgcaaggcacccttaacagaattactctcactaggctttattcttatctactgtatggtgtacataacttaatacaaaactgtcattttttctatcatgtcct

SEQ ID NO: 32132 - DNA, 1215 bp, Mus musculus
ttaaattaaatggttaaactatgaaataatgcaagtggtaaataaatttgacctgaattttaactaaacttaaaaatttaaattatcccccagtcactgagcccgccgccgaggactcagctgcctccccctcgagccccctcgcttcccgacgctccgtcccccccccccgcccccgcccgccttctcccgcagccgccttccgcaggccgtttccaccgaggaaaaggaatcttatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgttgaaaaagaaatttgcctgcaatggtactgtaattgagcatccagaatatggagaagtaattcagctacagggtgaccagcgcgagaacatatgccagttcctgatagagactgggctggctaaggacgatcagctgaaggctcatgggatttaagagcttgtggctctctgaagcttaagtgaggatttccttgcaatgagtagaatttcccttctgtcccttgtcacaagtttaaaaccctcacagcttgtagaatgtaatcatttggggtccgcttttaacttggactagtgtaactccttcatgcaataaactgaaaagagccaaaaaaaaaattaaattatcttcagagaaacacattaaacattgaaacacagtccttatcgataaccagagtgtagtatctaaataccaatgcttaaaatgaggttacggagatcttcaggaaaataatgtgaaaaatagtactacatattatcaataccaattattgagtaacaatgcaagattattcaaatgcatttgattcatttgaaaagtacatataatggagagaaaatgttcaacccaaatcactgtgagaatcacagagaacatgtttattcttgtgagctgttctcaaaagacaatgtttattgtggactctacagaggagttgatgcctccagagtttagtcaccattgaaattagacttttaaggtgctattgacattatcctttgccttacagaagatttgcaattttatgaggtcccatttgtcaattcttgatcttagagcctagg

SEQ ID NO: 32133 - DNA, 1153 bp, Mus musculus
ctagaggaatgagctagtcaataatccagtgtccctgtgctagcaggttgaggttaggtgtctgcaatccacgtgctcgtgcataagaagaacatgtcttcccttacaggtccatgtttcaatgcaaggacaagaagccctcttttctgaaaacatgccattaaaagaagtcatcaagcttttgaaacaacagcaatctgcaacaaggccaacaccagataatgagcagatgccagtagacaccacacaagatagattattggccacaggttagttggtaacctagataaaagagtcatgttttgacggggtccattttgggtacattttcatagattgtcttctttccaaaggacaagaaaacagtgaaaatgaatgcaacacctcttgtaatgctactgaaggaaatgttggtgaaagatgtggtggaaatgaaatggactcccttcttattatccagaaagaacagcaccctgagcatgaagaggggaatgttgtttgtcgattccctcatggtgccagaagagcaagtcaaggcaactctagtcatcatgtagacttccggagtgctctgactcctgcggatgtccccatggaggaacaaccaaaggatttatccagagaaaacatctctgaggacaagaacaattgctataacacttccaggaatgcagctactcaagtatatagcagtgataatattcccaggaaaaaaacagactccctttccattaacaagagaatatatcatcctgagcctgaggtgggagatattccttatggagttcctcatgattctacaagagcaagtcaaggaacatctacatgcctgcaagagtcacttggggaatgtttttctgaaaaagaccctagggaggtaccagggttggagtctaggcaagaggagcctatctctgatcctgtccttcttggtaagaatcatgaggcaaacttaccatgtgaaagtcatcataagagattccgtagagatgccaaactatacaagtgtgaagaatgttctaggatgttcaaacatgccaggagcctttcatcccaccagagaactcacctgaataagaagagtgaattgctttgtttcacctgtcagaaaatgttcaaacgagtctctgaccgccgaacccatgagatcata

SEQ ID NO: 32134 - DNA, 1195 bp, Mus musculus
actgatggccagccttagccttgcctgatgagagagcaggggtcaccagaggaatccttactcagatttgttgccaggtaattttcttgcctgaaagctattgctgccatagctctgcttgtcaaggatgctgataagctcacgctgggacagcaaataactgtagtggcatcccacactcttgaaagcattatctaaaagccccctgatggatggatgacgaccaacgctcctgtggcacatcagagctttttgttgactgaatgagtgaccttccacctactgacctcaatctcaccacactactgcctgagacttcacctactcatcactgcgctgacattctggcagaagaaactggtacttaaaatgatctaaaggatctaaaggatcagatcagccttggcctgagagttcgagctggtacactgatgacagtagcctcgaggttaaaggtaagcagaaggcagggacagcaatacggtggtggacagaaaccaagtaatctaggccagcagcctccctaaagggacatcagcccaaaaagctaaacttgtgactttaatacaaagagggctgttgacatctgcagaaaaggacccaagatgctgtggctaaaggaaatcagatggcaaatctaaccgccaaacatgtggcccaaagagcaatgatcctggcagtcaaagagcctaaagattattatgatgtcagagaaaccagctttagatacacccctgaacactatcaagttatggacattgcttgacccacctgggggccaagaaattaaaaggtgtggttaggtcctttgactactatgttacaggactctctgacttggcaaaagaaatagtcaaaagctgcaaggcctgtgctatgacgaggtagaatttacagaaattaagccagctagatatggcaacaagtacttattagtgtttatagacaccttttcaagatggatagaagcttttcctaccaggactgagacgaccaatgtgatagccaagaagatcctaaaagaaatcttcccaaggtaatgaacctgctttgttacccagataaatcagggactggccaaaatattagagattggttagaagttacattgtgcatacaggctccaaagctcaggacaggtagaaaagataaataaaattctaaaagagactggtgcagacttggtgctccttcc

SEQ ID NO: 32135 - DNA, 1191 bp, Mus musculus
gtctagcctctgaagaatagaaagaagccaagtccaactaagcatccatcacatctgtcagtggtcccgcctcccttcttgtacaatccagaggaatatttttatcaactattttgtaaatgagagttttttagtagctctagaaacatttttaaaaggtgagggaatcccacctcatcccattttttttttaatgtatttttttttttaaagaggttaaatcatttgctggctgtttattttttggtacaaccagaaaatagcaggatacagaatcaggagaggctgtgaccatctcggggggtcaccataacattccgtagatggggctagttttatatcctatgatacaaagcatactaaatggcaatttggcatctcattcatgtatttgtgtctggaatattttcagttatatctggttccgtgtttctagtagaaccattttgtaagaaagccagtccttggcccttgccctgtcagaactgtgatgtctgtggtcatggcagtccattttcctaacagttgtgataatgtgctgtgaaagatggaaatcctgagtctgttctgtgtgtggcgtaacattgtgaattggtgggactgaggattacaggcattggttgttatgagaggtcttaggggaacttagcgagtcactggaacaagttcaaagaaaaacaatacgtagcttttcatttgtgtacatgaacacaatgtgacttcagagtttggttacgtgaacacagtatatggctcttttggggtatgtgtgataagaattggaaggtctgtactctgctccctgaccaataaaatctgttgtgaaagagtaaaaaacaaactcacacacacacacacacacacacacacacacacacacacacacaaaaaacaggcaaggaggaggtgtgcgtgaataccaatcagaatggttaacattaaaaactcaaatgatagcacatactgactaggatgtggaaaaggggaacacttctccatagctggtgggattgcaaacggctacacccactctggaaatcaacctggctgatcctcagaaaattggaaatagttctacctaaagacccaattatactgctcttagacatatacccaaaaagacccaattatactgctcttagacatatacccaaaagatgctccacaatatcacaaggacaagtgctccac

SEQ ID NO: 32136 - DNA, 1208 bp, Mus musculus
ttaccatgaagtaactcttataacctgattctatgtatttgaaacattatttaatagaataaaattctgtaaaaaaaaaaaacacctatttaaaacacctagtgataaagctacatgataaataaaggaggctattaaaaaatgactgatattttaaaacagctgtcttgtcaatctacaataggtaaaaggacatggccatatgcaagaaaagagatataaccttgttcatgcaatatttggagggaacttatcacagaaggataaaaacagactacaacaagattggaaattgctggtgagaatgaaggggaaatatattgcaaagcatatttctaaaaatatgaatacacataccttccatagcactgagtctttggagtaccttctaaagatgtcatgtatagaagagattgagtaagagatgaaaaatgtgcacaccaggatgaggatagtttgggtgtctgtgtcttcaggtgagtacttttagaaagggcatgtcatacactgtgtggcaagaggacattatagttcattaggtgcacagagcctaatgctggcgtgaaagtcacacacttacccagcaagctgagtctgctaggacggcatcttctggacctgggtgctcagcagcaagaactgtgctctaatgtctatgagccccacatagttggggtttgggggtgggtttctggtttaaatcaagtctgaggcagtgaccagtggtctcatgtctatggagtgtgacctgtgaatgctaagatctcttgaatttgagtattggttcttttttttatagagtgtaaaccaagttttatattctgtaatgcaaacaggtacctatctgtttctgaataaaactgtttacattcatcaagaataaaatgctgagcaccatggatatgcttgacttttcccttgtgtctgtagagggcactcaccatggagatacttgagcaggccatgagacccagagacaagccaccagagaagctgagtggaaacatatacagtgcggttgccacatttctggaagtaaaccatgaacagtactcaaaactcatcatgttagttttatttttgttgtaactggatcctaacagtcttgctggagtatgtttagaagcaggtacacaagccatctgactaagcaggatgtacttggtggctctgtgcttaagcattatctacctggagttgctggggct

SEQ ID NO: 32137 - DNA, 1200 bp, Mus musculus
aaagaactggaaaggggcagggccctcatcttaaaaacacactttggtctgatgttatattctgtaaaccatcagatgtgagggaagactccatttctgcagtattttaataccacttatactctggtcatttgacattgcacaaagtgttgagttgccttaaatgtgatctattggcgctttcttgagccctccttgcctcagttgcttccctgtttgttcacacataattcttgccatctattctggccttttcataggtacgtgataacaggtttacttcagaatccttaagagcaaaagctgtttcttagttcaagtcatgtcttcatatgtggagtggcttgcaaagatcacagaatatgccgacttcagactgggtttcagcccgttagtgagttgtgaggtccagtcagtggatggccactgagattacagaacagcgaagtggaataaaagtagatcagaatgcatcctgtagtaaaggcaaatactgttctgtgaaccttctcagcggagcgtctgagagctgctaccacatcaaatgtatttgttaaggggtacaaacatacaggttgaagaaacgatccgagctgagagaaccaaatgtggcctacataggtgatcttgtggttttgctttgaacttcagattacaacattgtttctattgcctgaacacaaatgtaattgccctgcagatacaaaaaggatgtctttttctgtcagtgtctgagtaggcagtttgtgtaacccccaaatcagaggcttaccataataaagtatttatttcttcattcatattatgcctcattgttttgtgattgtgcagctgcttccttgaatgttggtgatgggacattttcttccctacagtgagcgagtctgggaaccagacaccatcccggctgtagctttctttctatgggagtcttggaacatgtggggaagcctattctcttttacctgggagaagacacaaatcacttccattcataaagcctcagagcaatggctcagcttggggccacatatcagacatcctgcatgtcagatatctacattatgattcataactaccaaattacagttagaaagtagcaatgacaattgtatgattgggaggtcaccacaacatgaagagtattaaagggtcattaggaaggttgagaaccactgccttagaaagcggatcagatgg

SEQ ID NO: 32138 - DNA, 1174 bp, Mus musculus
gtggttgaaacacaggtttaaaacaataatgttaggaagttgaagatagggacagaggatgacacgatggagccaggtagagctcttacctgacagctataaggaaagcaggcagtttacctaccctcagagataaagagatcataagaaaatgctaagtgctagtgggtggtctaaggatcctcagtgcagatgctggggcaaaaaggaatgaatactgccattgtaggtggtaggggtgaggctgtccctgtagctaggttattctattctttcatttattcttcacataggtcctaaatgaccccagatagatgggtatgagattccatattggccattagacatacataggatgccctttaataaagacatacatttcataaaaggcatagtgaacaaatactgaagccagagctgctgggcctatagtgacctgtctataaataaccctgctctcttagggataaggtttcaatgtgggagacaagcagtatgcagatataaagtagtatgaaagaagtgtgaggacatgtcgggactatggaccttgagggaccacttcagagttcagccctgtaaaaaatgagaaaggtgcctgtagggtaagctggggttaggtagggagacagctgtcgtcatggacagattttattttgaattccttgattatttttagaaggaaaagccccaagccgttcctttgaatggtcctgcagaggacaatggtatatactggatttgggtgggttttggagtttattttatgtgtggtagtgttttgccttcatgtatgtgctacgtgcatgcctgatgccctcagaggtcaaaggaatcatcagatgccctggacccatagttatagaggtgagccaccatgtaggtgcaggaaattgaatctgggtactcttgccagagcaacaagtgtccttaactactgagccatctctccagctctgagatctagtaggtttttgtttttatatttaatttttttattaggtattcttttcatttacatttcaaatgctatcccctttcctagtttcttctctgaaagtccccccaccctgctccccaacccacccactcctgcttcctggccctggcattcccctctactggggcatataatctttgcaagacacgagctctagggggtactggttagttc

SEQ ID NO: 32139 - DNA, 1153 bp, Mus musculus
cactgttattagggaactcctgaagagaggactgaaaggtagtcaatgtaggaaaggcttcagggatgattcagcctataccaaacacgtagcgcatacactgaaataaagcaccgtcagcgaggaaggcattttcctagagacactcatttacctttacatcaggatactgaaactggaaagaacctgtgaagtcattcagtaggtaaccagacatcttgaacagtatcaccttattgtatgcaagcaaatgtttattatagagtcaaagcttggaagtgttatttgggagtgacacttttgtcagtttgtactttcctgtttccataaaggcgtagtggtgggacgtcttacacagtgctctacaaactaccacaggctgtagctagggttttctgtttgaatgcacttctgttttatggtcccgccagaacacagatgacgcatttagtgaggtgaaactggatataggacttgcttgtgattgaaatgaagttgaccctcttaagactaaaatactctccgtggtggaaagggctgcttctaagaaataggatccattgctttaggcgttgaacaagaaaatattgaattgtatttcagttatcacctgccttcactgttgttaattatttcagatactagtttgtgtagagttcaggtcctttgaagcaaaatccaaaggtttcattgccatcctaaaaatactcagatcattgtaaaagaaggcgtaaaagtagatttattgttactataattatggtcgtatttggttgtaggttagcagtggaagatagaattaagtggcttcttaggagactacaattgtgttctttttcctttttatttatacagttttatataataatttggtaacgtatataaaagtgaagctaaaaggaaacaaatttggagtctcttagatctttgccagtggatagaggccaaagatactgtcagacaacctacaaaggctagatcatggctacaggaagccataagcaactccaggtgtatactgacagatgcttctctggaatcagagcgtcccgaagcctagaatcatttcttttggaattttggatataaagattatggcattgtggagggagaggcgtaggagtctaaggatagggaagagaaagttaaagaa

SEQ ID NO: 32140 - DNA, 1424 bp, Mus musculus
gagagaccatttgagtgttcagagtgtgggaggaccttcaacgaccgctcagccatctctcagcacctgagaactcatactggagctaagccctaccactgtgagcgctgtgggaaagctttccgtcagagttcccaccttaccaggcatgagagaactcatactggtgagagaccatatgtgtgcatcaagtgtgggaaggcattcacacagagctcacaccttattgggcatcagaaaacacatgggataaaattcaagaagcagcccaaattgtagcctttgtgcctttcaaagcactatttttttttcagccttgagatgtactatgcagacactcagtatgacagataggctttgactaaggagagccccacaccttaaggacagctcaggacaccacctagcaggcagtgagtgaaaccatcagggagttcttaattgcttcatttatcctcaaaaggaaataaaatatctgaaaatgcatctaagtttaagaagtcaagtaccaaaaattgcactgatatttctatacaggataaaatgtgtaagtgaaaaaaaactaaaagtatatagctaaataagctattatatttgtgtggaacttttttttctgctgtgatagctattttttgttatcagtttgactacaactggaattaaactgatttaagctgaatatacctttgaggaatttttttcttaatctggattgcaccttctactggcaacctatataaaggacatggaagaaagaagcttgccctctttgcctgtttgctctcactagctagtctattctttcacttgcattagagcttacatacgggttctggcatctatcacctgagacatcctgcctcgtgaactgaacaactactggatttttggggattcttagaccttccactaataaacagccattgtcgtactagctggactatagcgtgtaagtcattcttgttaatatatgtgcatgtatatacatatgagaagagagattaattctaccagacacactacactagggtaccttgaataatatctgcttaataatcttgtttgtttgtttttgatttttgagacagggtttttctggataggagtggctgtcctacaactcactttgtaaaccaggctggcctcaaactcacaaatctgcctcctaagtgctgggattaaagatgtgagccacctggccattaacaaccttttatgttggtgatctcaaacagttctagcagattagtgtacaggtaggaggaaatcttcatgaatcatgggaggctcagaggtccagaagtctgtagtgaatccaggaacacatgagaatatcctctggccttacattaccatttttcctaaaagaccagttatgggagaagttcattactgttaagcaacaaaacactggcaataccagg

SEQ ID NO: 32141 - DNA, 1201 bp, Mus musculus
gaggccgaacctgaagcctgggcgtgaccgcttggatctcaccgtttctctgcgaaaaagggtgcctagggaaactcggcacgggccgagttagtcttcgcctcttgtttgcactgttttgacttcatactttgcacacacgggactccagggaaatcacttgggtcatataccataaacataaatctaggtttgcttagttttgtgatgactcttttgctcagtacacgttctaagtgcacaacggaaatctgatgggagctgatgagtatacggcttcatgaaccatcatactgtggtccatgtaccagctgattagcggggtgactgccgagttactttagaatcctgagtggttttcctgggtttggagagctgttcaaagctttctgggtctccccttcatgtcccagtttgccacaaagtgagagttcgtctgaagagtttggggtcagagtgactgctccagcatgtctaggcagtaacggtttcttgccattctcctgtccccaggatgactgagtgggaagcagccacaccagcggtggcagagacccctgacatcaagctctttgggaaatggagcactgatgacgtgcagatcaacgatatttctctgcaggtaaaaggaacttaatgattgttctttgtgatgatttttttaattgagaccaggtgtggatgagcttctagttcagaaaagggcataaaacaaccagtggatgtacaagacaggtagaagagcaataactggacagctacacccacgcctaatacaaactggcactaaaagatgttagagtgtggtttttatcccgtatttttctaatcgtgtgtctcttgagacagagtcagggtcttgctgtgtagcccttgctggctgcctggagctctttgagatcttgcctctgtctcccatgtgccactacacctgacttgatgtcccctttcgtttgtatattcagttagtgggtatcaattgaaaagatggctttagtcaactgaaccatgttggcacccttgtcaaaagcagttggtaagctgctatcagcctacagcaagaggaatttgagtatgagaccagttggtgctatgaatgttccctgctgccctcccctgaaaaatgtcagttggctatgggtactgttatggctaagttagtatgggagctatttgctttgccctcataacccattttgag

SEQ ID NO: 32142 - DNA, 2557 bp, Mus musculus
gtcttgaaaaaacaaacaaacaaaatatatccatagtaacatttttttaaaataatgtagttatttttatgtgtagtgatgttctgtctgtgaggttgtcaaatctgctgaagttacagacagttgtgagttgccgtgggggttcttggaatagaagttgagttctttggaagagcagtcaaaactctgagccatctctgcggccccccaagccccagacagggtttctctgtagtgttggttgtcctgtaactgtggaacaggctggccttaaactcacagaagtgctcctgcttctgcctcccaggtgctgagattaaaggtgtgtaccattaccgcctgactcaaagtgcagttacttaatacttgtaaaaactgaattctggtcccttgtttgcatattacaggaagtgttctctctccccttgcccctgaggcaagatctcactgtgcacccctggctgttctgaaattcactgtagaccaggctgatcttaaactgctagagatcctgtctcccaagtgttaggatgtagaagtgtgcacactgcgggcagcactttccccttttatgaatgggagtgtgacttaagcagtcactggtttggttttactttcttaaagctcatgttcacaacctgctggggacatgccatggcttgagtcagttctcagtctcctctaatctatctgaggctggtcccactactgactactccttcgtgcttctctctttaccacccaggattacattgctgtgaaggagaagtatgccaagtacctgccccacagtgccggacggtatgctgccaagcgcttccgcaaagcacaatgtcccatcgtggagcgccttactaactccatgatgatgcatggtcgtaacaacggcaagaagctcatgactgtgcgaattgtcaagcatgcctttgagatcatccacctgctcactggtgaggtaaggttttgtccttgattcataccaaagcttcatggtatacatgccaggttcattacctgggacaccgccaccttgtttagggttgaaaaggttgggggtggatatcaggctcacgcctcccttttctgccagaaccctctgcaggtcctggtgaatgctatcatcaacagtggcccccgagaagactcaacacgcattgggcgggccggtacagtgagacgacaggctgtggatgtgtccccactgcgtcgagtgaatcaggtgggtcagaggcttgtgaaggggtggggtaggagccatcagcacaagtgggtggggtcctgtcttgcatgttttaccaggaacctcacttcctccaggaaaccttcctggatttccactcggtatgaggcagatggtagtccagccttcccagtctggttcatctcatccctagtgtatactttcacaacaggctttgttttgtttcttcttgatttgtttgagtctattttgtggtggtacacgtacctacctgtaattttagctacttgaaaggcacagggtggattgcttgatacctgagtaccatggggacatcaagggttccagtcaaaagcatcaaatattttgctggcagttcttaagtctctttgttagttggggcccttgttttctcagccctctcagatcagctatctgataaggtatcaactccctaaagtagtaagtatatggtatctgttgaggtgggtcccaggtcactggcaggagggaccgtttgaggcctgagccctgtctgtcttgtctaggccatctggctgctgtgcacaggggctcgtgaggctgctttccggaacatcaagaccatcgccgagtgccttgcagatgagctcattaatgctgccaaggtgggtcagggcataccacttgggttgggcatttgggagtttgtccagcattcagagctaaccatctgtccttgcagggctcctccaattcctatgccatcaagaagaaagatgaactggagcgtgtggccaagtctaaccgctgatttcccagctgctgcctaataaactgtgtcctttggaacaactataccttcctgtgtgcttgtctaatcatttagggcatagggtacctcccatggtatagaggatgcagctcacctccctggcatggcattcaccagtaaacaaaaagaaaattgtattttcttaaagatttattatgtaagtacagtacactgtagctgtctccagatactccagaagagggagtcagatctcattatggatgggtgtgagccaccatatggttgctggggacttgtactcaggaccctcggaagtgcaatcagtgctcttaactgctgagccatctttctagccctggaactattattttcatgacgagtgcctgcagaattgtagcacctcagaactagtgctagtaagagggtgtaagcctggtgcccagggaagacccaacaagtattggggatgaggaacttgtgttggtctggtctaggtggatctagtttgttcactcccatagtgtggtttgtgtacaggcttcaagtgcccctatggagaccagtactaaaggctttgaaga

SEQ ID NO: 32143 - DNA, 1163 bp, Mus musculus
aggccctaagttgtgcgctagctgttacctaggagacacaaggagcgagagtccttccgggagcgctagctctgattggtcaggatgcctctctggccaatagaaaccaggtccgttgcgcacatgcgtaaggaggctaacccacagtcggctccgtcctacgtgagtcctacggctgcggttgcaagagaagaacggctgccaagtcaggagtgggaaccccccccggaactctgcagcaacgcgaccccaaggagaggagcgaagagtctcgcgcgtgagaggccttggaagcgtgctgtcgttcttgctgaggctcacgggagacgtagtccgagcgaagggggccgatccggcggagcagatgcaggattggccgggctggtagggcaacgcgcgaggcggggcgttctctgagtggcagtgggacgtgctcggtgtcacttcctggaagtgccccaacctcctggggctctcccacgcgtcagaggtgagctcactcctagctgggcgggcgcagcttcataatccggctcctcggatcaccgagagcacctcccagccgtcggacccacccctttcctgtgtcagagcctgacaccccaactcttgagtttctccagagcaggacggatgtcccaagagagccgatttaaaaccagaatcttaagagctgggacacaggttccagtttacaactccacacaaaacggggctgtttgattttggcttttgtttcagggtttcacatgcgtagtaagctgaggcagtatgaggcatccacaattcagctgcgatcagcgagctgtgcctcccaacccataataagctcctgagaatgcacccaggctttcagctctgccccaggtcttgtacctgtgtctcagagccaactcttcagctagcacagtggtctgcctcctgtctgaagcctcagggctccaggtcacccaggatgatggtcccaccccccttccctccgtgtcctgcttgaccctttgtctactggatgagccactttcatctcccaggagccctgtgttgtacccaaatgtttgagcccgtcatttgcagttttctagaaggtccctggacattccacccagtcatttatcttcaaaacaaaatacagctgctcaactgctgtggggctgcacctccca

SEQ ID NO: 32144 - DNA, 1182 bp, Mus musculus
tcaccagccccagacttggatttttggatttttgggtgggtaggctgtgtatataacagtcctgaagtgttcagccctatgggcaggggagtcgcagtcccattgttggctgctacatttctacaatgcaggaatggagtcccctttcaaccagaagccttttagatttaagactccacctccctcatcttgacgtccatgaatgttggacacctactcgtgagatgttcaggagggttcttgggggccaagctgccttaagggactttgaaccctggatgttaagcactaagtgttagagaacccagagtgaactgaatggctgtgttagataagtgggatgcaaaaatgggtaggacccagcttgccaactgaataacctagtgacctagtgtcaaagaaacccatgttagatctctcagctcacggaagtattatcctccgggtctcctgcccgtgtcttatgcgtccatacctcactgtaaggatcgggtgctaggggaagaagggctctagcctacaaggccaggctccagccctacctgtgtgtcttctgggcccgtagggttcctctgtggctgggcatcacaagcatagctcagcctccgagtcccaacgttatgagagctgcttagattcagcacaactcaaatagcaaggcaaaataaaacaaaatgtaataaatccactactgatagatcaggaatacggtctcaggagctgaactgcaattccccttcttgccctcagccagaatgttgcagagcttttttggtttttggtttttggtttttcgagaaagggtttctctgtatagccctggctgtcctggaactcactctgtagaccaggctggcctcgaactcagagatctgcctgcctctgcctccctagtgctggtgttacagagcttttaagcctgaaagccacaaatgtctgttgcaagttacatttttctaccaattaggattcacagataggtgacttcctcatgctgatgcttttgggttattgaactgtggtgagccaatttgcttggcattcacatctcaacttgccaaccaggatgtcagttgcccaggtacatgtctccgtgtctctttctaccaaccaggatgtcagttacctagggaggtctcgggaacataaactttgacccctgttgaaaatggaagttttatt

SEQ ID NO: 32145 - DNA, 1184 bp, Mus musculus
gagtatgggggcccgggtagggttaagtaggcctgctggtttaagagggggcggggaacgggtcctggcctctgccaatgcccgttaccaggtctggacaccgaggtgcagaatgtgatgggagatgtcaagaaatcagagggtgtgcatgcattcccatttttatcttggcagtggtggattgtccagtgtgcaaacagcagtgctactccaaagacatcgtggagaattattttatgcgtgatagtggcagtaaggcctcttctgattcccaggatgctaaccaggtatgtcctgtgggaaatcttggggaagagggaagcgtgaccttttccagagcctctcaccatcttcactagtttggattgtatccttatgcggtctcagtgtctgggagggcggcacagatttgagtgcattgtatgaattttagcttgtgtttactggcaagtaaatacaggtctgctgggttaggtctgcctgttctaaccccccacctttctatcactcacagtgctgcactagctgtgaagataatgccccagccactagctattgtgtggagtgctctgaaccactttgtgagacctgtgtggaggctcaccagcgggtgaaatacaccaaggaccacactgtgcgctccacaggtatgttggatttgtaggctgttggaactgcctctgtcttggttgactaaaatgcatacttgatggatagaacaaagaggattttcaggaacctgacacagaactcagaaatgcttgggtttcaggagcagactttggaggtttaggtggaaagggaaaggcctcaggcagagggtgtgtagggcatctgctaccattggtactaggaagtctcatggaggggtgtaggtcctggtagtgggtcacttagcataagcagctagtaaaggctagaacgaagtgacttccatctttgcagttggtggttctctggcacctggctttagaccaaagaaaaagtcaggagagttttttttcttctctctctctctttttttttggggggggggagggtgtcgagacagggtttctctgtagccctggctgtcctggaactcactctgtagaccaggctggcgttgaactctggtatctgcctgcctctgcctcccaagtgctgggattaaaggtgtgagccaccactgcccagctaaggac

SEQ ID NO: 32146 - DNA, 1103 bp, Mus musculus
taactcactatacaaatcaggttggtctcaaactccggtctgcttttgcctcccaagtcctgtgcctcagggcttttgaggacatctcactgtagaaacaagtctgtttttgaattcagtatatgcagttcaggcttaccttgaacttgagatcattctgtttcctaggtgctgataatatgattagaatttttgacagtgagtgctggtgttaacttctgtgagccatcagggccttgtttatttgggaatggttgttcattggtgagtgggaagataaccaggaaatagtaaggactttctctttacaagcttgcctttattccttattagttggtgtagtcattttgtgagtaaaaagcttccagacctagatctttatcaataaatgggccaaggttgtgggacaaactggaatggggtcagaaggggtttgttttgtttgccgcttgagttgaatggctgagggcataattcctgtttcctaggacctgctaagactcgagatggagagcgaacagtctactgtaatgtgcacaagcatgagcccctcgtgctgttctgtgagagctgtgacacactcacctgccgcgactgccagctcaacgctcacaaggaccatcagtgagtctgaaggcacactgggtagttggaaaccattatttctaagtttagcatgcaggctcactcttttgtggtctcaggtaccagtttttggaagatgcagtgaggaaccaacgtaaactcttggcttcactggtgaaacgtcttggggacaaacatgccacacttcagaaaaacaccaaggaggttcgaagctcgtaagttccgctgccaggggtattggggtaccagggcaaggttatccttgcttgattgtcttgtccattaggatccgccaggtgtctgatgtgcagaagcgagtgcaggttgatgtcaagatggccattctgcagatcatgaaggagctgaataagcggggtcgagttctggtcaatgatgcccaggtaaaacttagggctgcaagggtattaaccaacctctcctttcttgttttttggtttttttttgttttttgtttttttgagacagggtttctctgt

SEQ ID NO: 32147 - DNA, 2700 bp, Mus musculus
attgtgcccaatgggaattctcttatcttcattcaggcaagattgtggctgagcgtcctggtacgaactccacaggtcctgggcccatggctcctccaagagccccaggccctctaagcaagcaaggttctggcagtagccaggtgagctggggagagaaacaaaggagagggaatgagtgagaatgagggccatgggggctactgtaccttgctgatggcacatgttctgttctgtctctagcccatggaagtacaagagggatatggctttgggtcaggtaagtagttgtgccttggaaattgggctgggtgagtaccccgtctctgtcttttctgccaactcttttgtcttctgagcagatgatccctattcaagtgcagagccgcatgtatcaggcatgaagcggtaagtgtggcagcccattgaagtagcaggtgggtacagtattggtgtggtaggaatatatgtgagctcatgacaagatacacttaacaggtcccgctctggtgagggagaggtaagtggcctcttaaggaaggtgccacgtgtgagccttgaacgcctggatctggacctcacctctgacagccagccaccagtcttcaaggtctttcctggaagcactactgaggactacaatctgattgttattgagcgtggtgctgctgcagcagctgctggtcaggctgggactgtgccaccaggagcccctggtgccccaccccttcctggcatggccattgtcaaggtaagatgtacaggatggtccttagagagtgaaacctgtcaccctaagattttgatactaagaatcaaactgtcttataggaagaagagacagaagctgctattggagctcccccggctgcccccgagggtcctgaaaccaagcctgtgttgatgcctctgactgaaggtcctggtgccgagggacctcgtctagcttcacctagtggcagtaccagctcaggcttggaggtggtggctcctgaggttacctcagccccagtaagtgggccaggtatcctggatgacagtgccactatctgccgtgtctgccagaaaccaggtgacctggtcatgtgtaaccagtgcgaattttgcttccacctggattgccacctccctgccctgcaggatgttccagggtatgtgtgaggctgggcaggatcagatagattgtggagagagagctggttgtcatcttttacatttcctaatcttcctcatcctagggaggaatggagttgctcactctgccacgtgctccctgacctaaaggaggaagatggaagcctcagcctggatggagcagatagcactggtgtggtagctaaactctcaccagccaaccagcgggtaagagctgaatgcatgtgttgtgtggcccagtagctgaagctttccaagctacaactctgatatctcttgtattgtctagaaatgtgagcgtgttctcctggccctgttctgccatgaaccatgccgtcccttgcatcagctggctaccgactctacattctccatggtaagtcccagaacaggagaggttgcaggtgccaagaggtggtgacccccctcaatgtctatgttgtctctccctacaggagcagcctggtggtaccctagacctgaccttgattcgtgctcgcctccaagagaagctgtcacctccttatagctccccccaggagtttgctcaagatgtgggccgcatgttcaaacagttcaacaagctgactgaggtgagcctgcagaatgaagccgggggtgggggagtatagcaggcaggggaaagaaaagccaggacccactcacgtgtgtattcttaattggaacaggacaaggcagatgttcagtccatcatcggcttgcagcgcttctttgagacacgcatgaatgatgcctttggtgacaccaagttttctgctgtgctggtagaaccaccaccattgaaccttcccagtgctggcctaagttctcaggagctctctggccctggtgatggcccctgaagctggggctcttgtggtcagcccagtccagctctggtctctgtattttcaccccataccctgtcctttggtggcctgactcctgttcttgctggccccatcgtcccctcagtccctcttcacaaaatggtttttacttctgtggatttaataaaaacttcactgagtcagttgctcatgcctcagctgtctggggactgttcctgaggttttaagactcattctacaggtgaccttacttccctctttttggccaggtgaaacatttgtacactgtccttggtaagacttggatggagcccggcgtggtggtgcacgcctttaatcccagcacttgggaggcagaggcagccggatttctgagttccaggccagcctggtctacaaagtgagttccaggagccagggctatacagagaaactctgagacagagtttggatggaggcctcaggtgtgcagtgcctcccagtggccagatacaaatttagacacgaagcaacttaactgcttacatttaatcaactgcttacatttaatcaaagtgggttgtgtgagattctcaaagggtttttttgtttttttaaatattatttcttcagacactccaagaagagggcatcagatctcattacagatggttgtgagccaccatgtggttgctgggatttgaacttatgacct

SEQ ID NO: 32148 - DNA, 1178 bp, Mus musculus
ttaagctaccatacaggaaatctcaaggatgagatgggatcttgggcttgtaataagatggagacgaggaaggacagtggaggtgggtggttgatgagaaggggtgacttagtgttggggggccggtgtcatggtccttgaattgcggtggacagataaacagtagtgagtggagataatgactagagatagaaaacctcaggtttaaggtgctcagggttcttggaagcaagggttatgggagtagaggttcttggggactatgttgtgggaacttgtggaggacttagctgggtaagggttttcccaagagatgggcagttatacttgaagatgcttgtatatgggatactgtgtatccagaagagtccacgtagagactggaaagtggaaagaatatggagtagtacagactgagttaaagtacaccacacaaagctcttcaggtctagaaagcgaacttatgggttctgctgacacatgcccagacctcctttcttttacctgtttctctccctttccatgctgtccaaacctagacattaacgagctgaacctgcccaagacgtgtgacatcagcttctcagacccagacgacctcctcaacttcaagctggtgatctgtcctgatgaagtaagagtaaaacagggcaggattcccaagaacagaccaggggtggccccataagagtagggtcttcattcactctcccccttcctcttccagggcttctacaaaagtggcaagtttgtattcagctttaaggtgagtctcaagtgtacaaaggtagctctgtggagaagactgggtacaaccaaaacaccttcccatctcctttctctttttacaccttcccatctcctttctctttttctggagccaggtgggacagggttacccacatgaccctcccaaggtgaagtgtgaaacaatggtttatcatcccaacattgacctcgagggcaacgtctgcctcaacatcctcaggtgagggcactgccttcctttccctcccaagacctgccttccaggtatcctcagccttctgtggacactgcatctatctctgtccttccctcccctttatggtcaatctgtttctgtcttagttgtttttctaatgacctgaccttggctttctctgtgtcctgccctgtcccgtatcttcactcttaga

SEQ ID NO: 32149 - DNA, 1193 bp, Mus musculus
gtaggacacctggtgacatgagttggggacatggtcatagagataagtagagcccaggcatgggctgagggatctctattcttgcacttgtatgtagacagagttttcaagttaggagtttatagaaagaaccttcatgggctggatgtggtggtatacacttgaaatcccagtatacccttggtatctcaagttctctaccaacttggaatatgtagcaagatcctgtcttataaaatcaaggagtggggttgtggcttagcagttgactgctttcctagaatctaccagtgagtggctaagagtgtgcttgcctagaatccacaccctggaatttgccactgcctgcttaggtctgtcctatctgggttatgggtatggtatagtccagcagcagaatattttcttcatatgcccaaggcctgggttctaccccttcttccagcaccatggaagaaaacaaaagaccttgtcatcttgctgtcttctctccaacccatccctagtgaggttcctgacctggatcgaatcatccctgtgctgctggaacatggcctggaacgtctcccagagcactgcaagctgagcccaggtatcactccatgggccctcaaagctggggcagctattttctatgtgtgaacaactatacccagacagtttctgagtacttcttccctttgctgagacccttgtcttttccccctcagctctctcttgtgaactgagcagggcatggagtgcagcagcaaaaaatgtccagaaggcagtggcttggccacagaatttgctatgtgcatacatgttcagagcaaggcaggcagctgtggcagcatgtggctgtgctccagtgttcatctagggacctgggttccttctatctcatccttctatttgcttcctttcactctaaagcctatatgatcagggaaagggggggagtaacattgcttgtaaaggatatgaccatattacttgttctgttatttgttacttctgtgcctatttatgacctttattagcttccagggaggctggtatgaggacccaagtttctcttctgaaatgtgggtagtcctctcccttatgtcagcagaagtgagtagtagtccaaagacacattggtagcttttgcctttcccctggcccccctaacttgctttctttcctcccaggggtccctcttaaaccaa

SEQ ID NO: 32150 - DNA, 1176 bp, Mus musculus
tatatggacttcatggtcctaacccttgttgggcggggttaaaaatgtaataactggggcctggcattcagcatgtaaaagtgtttgacaggcaagtttcatggtatgactgcagtccttgaaacctatgtgaagatggatggaaagaacatgtgccacagaattatctgacctccatatgcatgccttgccatatccatacctgcatactatgataaacaaacaaataataagaactaaattataactccacaaagtgtttatctgtcaccaggaagctggtggctccccactaggtctttctgagttcagcatgctagtgggatctgcctttctctgattccttcttctgcagttaaagctctaatacagcagtcctgctggttgttgattcatccttccccaaggtgttctataaccacatcattacgtgtgactcttgtgtatgctgtcaaggtctggacttacaccgtttttgtttcctgagtgttgtctactttttttttctcatagtccctggttcgccagccccctgtctcgacgccggcagctgctccgtgagaacttcgtggagacagagggtgagtttgtcttcaccacctctttggacaccaaggacaccgagcagattgctgagttcttggagcagtcagtgaagggtgagtgtaactactcttctctcccaaggtttgaagctttgctgtacctgtgctgaccattttcccatctcccaaaccctgagatttgcctggaatcctgcctgcttatatcttgtgagccactgcttccttagttaggcttccatgtttcccacagactcctgtgagggcctgatggtgaagaccttggatgttgatgccacttatgagattgccaagaggtcacacaactggctcaaggtgattctggcctctgcttgtctttcccagtatggatgtctatccctactgtgcacagtctccatccactccctagtgagtgtgggtttccattacatgattctaccccagtcagatgtcctcctgaagtaaagcgtggttaatggctcttccgggaactcactgtgaactccctagcctaagccttagggatatcatggtgaggaagccaagtctggtcttcatgtcccttgtccttgtgtccttgttgcatgaggtgtacaaaggagaggcttct

SEQ ID NO: 32151 - DNA, 1141 bp, Mus musculus
attaaatccctgactgcttttcagcactcatggttatcaggatgctaataacataagtaagtatagaatcttatattttctgagttttacagtacatcaggtaccaagatttcaaacatgctgacacccccattgagttaaggcccaggtcaggaaagaagagatcagatagggagtcacttgtcagcctactgcagttggagcccagcagagcccctcccctactactatcctctctcacaggtggacaaagaaaaagggatctctcttcgttttcctcggttcattcgtgtccgtaaagacaagcagccagagcaggccactaccagtaaccaggtgaggccctgggtagagggttggttctggctaggagctgtagagatgggagagctggggagctgctgatacccccttctcccactctcctcaggttgcctctttgtaccggaagcagagtcagattcagaaccaacaaagctcagacttggactccgacgttgaagactattaacctcctgctctcctgggcctggggtggaggttgcgagaacatgggcactgttggattggtggtgttgattggtgtgtgtggagtcacaggagtgagatcctggggctggaatgctttattttcttcaataaatgacttcttagatgcctacttggtgaggaggtctacattgagctctgtggtatcgctgtgagctcacacagagcatatgaccatatgttgaacaagttcccctgcagtctggcagcttccagccacttgtgccatggaacactcaaaacatggctattgccgcttaggactagaacagttcattttatttgccacatgttgtcggtgctagtcagtggacagcggcaatcaagagctgacatggtttagcttctttaaactcccagtactctgccaggttgacactcttagctctctttatagaggaggattcagatactgcctgcacccttgccaggagcatcagcacttagtactccaattcagtagctctgctggcagtcactcccacatctttctaacaagatccccatgctcttggcagagactggtgcccaggtgtgtggttcccatttgtgccacctactgtcttgtcaccagacatcacctcaatcttta

SEQ ID NO: 32152 - DNA, 1226 bp, Mus musculus
ataaattaatttgttagatgaacacagattctaaatcttctaaagtatcaccttgaggactaaaattcctcttttgcttaaaagtcagcttgaggactcaggctccgaaaaaaagctactctctgagccagctcctgacaggaggccggagactagcctcagctttacaatttgcatttaaataaagtacctagagttccccaaaagaagttctgctttcctactttctcactgtccgagattttgtctttcaagcaggtaaatcaacattctcgaggcggaccagcggatgtgcatccccgcgcccctagagcacacaggtggctgctgttatctcctttccaaggacatttccagcatgtggctttcagtctgagttaaaaattaggtttaccaagagggctagaaaagtagatatttctatattaataaagattggtttttattttgatagacaggcttagtcccttagctgacctctggcttttcacccttgctgttactgcaaggtgtccttaggctgtggaaaaaacagggatgaggaggaacgacttccagctcctattttagccacaaatcgtggtgttactaacgacatagttcttgcttaggctttgctaattctgaggttgataattctcctttaggagctgcacagcactcagaactgtgcatactggtttgtgattgtacaaattcagtatgggcatcgcttggtgcagaggtactgcaagggaaggtccggcttgaccatttctgagtttcctgtgagataaacccggtttaaaagaggttggtatcatattttggttaaaaatcaaaaatattttccggctctgcctcgcctccccaaaagatacccagagccacatgtgtgggtcttatcaatacccacgggaggaatcgggtccatgtccacccaagccaaggttaaaagcccactcatctacggatgagaaaatcatttgatcacctcagttaagcattgccttatttaacttaattaataggggggagagagattggagacgtactattgaaagggcaagcccttcactgcctcccacccaaataaaaaagccaattggccttgtactacaagagccggtcgaactccttctccctgtttcccacctatcatccaaaaaagcggagaaatatcaacttagtgttattatagtgtatttcacatttgttcagtcaaacttagccagagttccaacgcc

SEQ ID NO: 32153 - DNA, 1286 bp, Mus musculus
gaataagcatgaagacctgcatttagagtcacagaatccctgtaaaagcctccaacatgtgcctgtaaacccagtattaggaaaggatggtcaaaatgatcccagtggctcactggccagcaagtctctttaaaatggcaagcttaaggtgctagaaaatgaagtgtttctgttgattgtattgatgccaatctcaggcctccaaacacatgtgcacagatgtgattacccctacactcccatacacatatgcacccatgtgtacaccacagagggaataaagaccatctctatttaaattatatttgtttaatattgggtgagaacttttattgcaacagggtcagaggacagtttgcaggaaacagttctccccttcgaccatatgtggaaccagggtatcaaactagagtcagcagtattggtggcaagtacctctatccactgagccatctcactgaccccaagacattccattaaaaggaaataaaggcatatgttctgagtgtttgtaaatcttactcctgctatagttgttactcctgatatagtatgtgggtcttctgtgtctcttgcagactagtggactgccaacttatgcagaactgctgtgaggacctggcctgtatgatcacaacaaccaagcacttaaaaagtttggatcttggtaacaacgccctgggtgacaaaggagtcataaccctgtgcgagggactgaagcaaagtagcagctccctgaggagacttgggtaacttcctggggtaacctctttgaggggctgagttcagtggaggtgagaggacctgaacatgaaaccagggtgctgctgtcatgttaatgactccataaagtcatacagtatttacctcggagtcatgggtctgggtgtcccggatcttcaagtggagaaccttcagatagatgctcattgaacttcccccttggtgctggaaatacagaaactaatactttggtggtccagcacatttaattgagcaggaagaatgaatacagaacaactaggaacagtggtgtttcttaagactttagtcatcatgtcatccacctgggagtctgttagaccagagtcctacccaggtatggtggctcacacctgtcattccagcacacaagaggatgaaggaggatcatcttgggtctgatgcctgggctacattgagttctgtgagatctaatttgtgagtgtgcatgcatgcacaatcacatatgcactcatacactcccacacatacacacaacacacataaatagaaataaaactaac

SEQ ID NO: 32154 - DNA, 1154 bp, Mus musculus
aatggttccacatagtttgctgtcctcttctggcctgaaagggcacatgcatacatacatagacatgtacaaatttttttcaacaaaacaaaacaaaacaaaacaaaacaaaaacaagtaggtgcctacagaggaaagagaccatgtgcatgcacatgaacacacagaaagttgaagacagctctaattacaagaattaagtagataggtatgtacacagttctgaaatttgatggcattgaggtagactaatgaagatgaactaacccttaaatcctgtgaccaataccccattgtgtcacctaagctatgcaacacagaaaactagtgcagaatgtacatgttatgttccaaatggtgtttatctttgcctatgtctgctgcttatttgtacttctgaggcaagggcttgacatcacagacaactaggggcataaactaagtagaggcttgctttaaacccctctgtagattagacaaattgagtaattagactgactgccttattaactcttcctctctgttgcagaaagcacaatgtatccttcagaaaatgacagtagagcaatcctgaaagaccatggatcagaagaagtggaacagactttaggtttgcaggctgggtagggttgtacatatgggtatacttaaatatacattttattggttttgatttgagaaattagacccaataattctaatatgtgtgcatgcaggattggagtttggttatccacatagggttttcagagctacatataattcaggctccaagaaatcccacacatctgtcctctgttggcacacacaaaaccgaagacacctgcagttataagttttatttacaagctcattacattataatagcaagatgctagcacaggtctgaaatttgaaggcattgaggatgagtaagaataactcttaatgcctataacccagcacctcatattcacacctatcctaaggcactcagaataactagtgtagaatgcacatgttataggttgcaaatgggagcatctttgcctgcctatgtcggctgttttaatgaacttgtgatacaaaggacctgacatcacagactacatggaacacaatctgagcagggacttacttgccttaactctttatgtagtttggacatgaagtat

SEQ ID NO: 32155 - DNA, 1160 bp, Mus musculus
agactgcttgaatccctgcacctgactgatcctcagctcctaatttacatattttctgcctatcaagcaaccatacaagccaaacagtgtgaaccaagttccccttccactttctcccagtattacccaccatgatatccccttcacacaacaacctgaaacacatcatgatgcccactaactcaacaggtatccagtgggctgctgtatcttggccaatccgctatttgacttctattcagaggacctgcacttacatatctctccaaactcactttttggaatctttgcaccctacaaactttcaaatccattatccgcattcacatttggtaccacactggtttcagagtaattgcttagagccctactcttatgggtataattctacttgtttttttgtcttttgagtcagagtgtctctactggtccaggctattctagacttactgaacatcaaagggctcaggtctcttcttggctggtacacaaaagcacagtagctgggccagcaacatggggtcttaccagccttcttgttctgtcatctatgaaccctgcatgcttatgttttccagtgttaacatctatgtggaaacatctgcaatgctcctgccttttctccacactgcccactcaactctggggatgtgttggacctcaacatccaaacaggtacaccagctgcagaatgatcacaaaaagctcttcatctgctagctccctctctcctccatgagattagccaccctcaacatagccaatgtataaaaaatatattcaggacaaacattcacctgacaaacactagttctctttatcttgttcagatttccttctgtttgtacacttcctcagggaacagccttatataccttgtctgggcaggaacctcaaagctccacccactctttggctcctcccactctgtggaccttcaaattcagtagataaacacacccttcagtgccactgggattttggccccaccctagagattccttgtccttttgattgaattacatttttttttgttttgtttatttgtaagttagtatctgtcagtgcaggaagttgtcttcacagtctataaggtgtctagttctcccaagaaaacaaattccttgctatttaggggaaaacatactacaatacattgc

SEQ ID NO: 32156 - DNA, 1287 bp, Mus musculus
gcggcggcgggagaaagctgctcgcaagctggtgagcaccctgctctgtgacccttgtggccacacagggccctcggacagaagtgggtgacagggcaaacagctgtcgagtgacccgataccagtgccatcaaaggagaggtcatggctttgtgggccctgggtgaggaaggccctgggcagagtggcactaggctgagctcttaccctctgtccacagcgggtgcagcaggctgcactgagggcagcccggcttcagcaccaagaacttttcaggctgcgtgggatcaaggcccaggtggcccgaaggctggcagaactggcacgccggagggagcagcggcgcatacggcgactggcagaggctgacaagccccgaaggctgggacggctcaagtgaggcacaggctagggctccaggaaatgggggtctgcaagttatatcatgcttttttcttggctctgtgagagccaaatccctgagtgtctcaaccctgtgttctgtaggtaccaggctcctgacattgatgtgcagctcagctctgagttgtctggctcactcaggacactgaaggtacttgccatgagggtagcagagtgttatagggaccctgtgcccagtgatgataaccatccttgctccccgtgcctactcgggctgtgggcgacaccatggctgccctgggctgggccagttgggccattgcctggggactgagggcacagggtcagggtgaggtggggagggcaggtgctggtgtgagtttctgaccctcagaaggccttttgtcacagtctcttgtcagccctagtgagtctcctcaagctgtgctggggcctagcctggctttgaggtttccattttttgcagttgtagcctctgtcctctgagcctagctaggatagcacacattgacttcagtatagagccccctggagctcagcagggtgtagctgggggtactctgtggaggctttaggaagatgcagagctctgtctgaaccccagtgctatctaggaccctgctaaagtctctctgaccctctgtcccacagccagaaggtcacattctccgagacaggttcaagagcttccagaagagaaatatgattgagccccgagaacgagccaagtaagatctgccactgtgggaaggataggggtggggtgggggggtgggttgagacacttccatactcccccccccaaccccctgagataagggatgctcatcacattttccccttccccaggttcaagcgcaaatacaaagtgaagctggtgga

SEQ ID NO: 32157 - DNA, 1287 bp, Mus musculus; identical to SEQ ID NO: 32156

SEQ ID NO: 32158 - DNA, 1211 bp, Mus musculus
ccttgtatgagttgggacacacacatgccatgcatgcatgtcaaggtataaggacagttttaagatgtcagttacctctttccacactgggaactggaatagaactcggggcatgaggattgtaaggccagtgcttttacccactgagcactcttgcttacgttcatccccgggattcttatcacctacttataggtgcagatggggaaactgaggttgggttaagcaagccacaggttgcacagtgaagcctgcaactgagtcagggtttggtctgtgcccagtcacttttagatggaaaattcttggattgtggtggtcttgagacagagtgtccctttgttgacctcagctcttgccttcttctcttgactgcctccagctccatgtgcaggaagctgccgccaaccacctaaaccctgagcccagccagcctgcccccagcgtggacctggacttcctagaagatgatatcttgggctcccctgcagcaggaggaggtggagggggcggcggggccccagaccagccctgtgacatccttcagcagagtcttcaggaggccaacatcacagaacagaccctggaggctgaggctgaactggacctgggccccttccagctgcccaccctacagcccgctgacaatggggcaggtgctactggagccgcaggagccacggcagtgactgcaggaccccaggctctcttcccaggcagcgcggatctgctggggctgcaagccccgcccactgtactgacccaccaggccctggtgccaccccaggatgtggtcaacaaggccttgagcgtccagcccttcctgcagcctgtgggcctgggcaatgtgacccttcagcccatttcaggcctccagggccttcccaatggcagtcctgggaatgctgcagcagccaccttgggtctgacacctattcaagtggtgggccagcccgtcatggctctcaacccacccacctcccagctcttggcaaagcaggtacctgtcagtggctacctggcctcagcagctggtccttcagagccagtgacactggcatctgccggcgtgtccccccagggagccggcctggtcatccagaaaaatcttccagccgcagtgaccaccacactcaacgggaactcggtgtttgccgggacaggggctgccactgcagcagccagtggggcaccctcgggacagccgctgg

SEQ ID NO: 32159 - DNA, 1191 bp, Mus musculus
gcagaaggtgtggcccagattaaaggtgtgtaccaccccatctggatctgggacttgctttgtcccaggctgaccttgaactcacagatctcctgggattaaaaggatgtactaccctgcctgggcctaagcttctcatagccactgtgcctcaagatccccatgctaagatccagatcagaaacctgtgtcttccagcctcaagatctggatcacaggtgagccatccaattctggattgtggttcattccagatatagttaagttgacaaccaggaacagccattacaaggagtatacaccaagaacaaggcttgctggtctaggtgcagttggtttgagatagtgactggcgacagctgggaaaggggaggaagggaggactaaagcactgcaggaagtaggagcagtcacgtggatagactgagatagactcgtgcctggatcgatcggtgcatgggaggaaaactgaaaaagttatatggctggtgggagggtggaagagaagggaccaggcagaccatttagaactggttcctgtgtaaagcctgaggtttacactgaataaggttaggaatcaaggaaaggtgctggctgacagccatgagccaacctgggttcttcctgtgtgttgaacgagaatgagatggcagagggtggggcacagcagggttgtgctgctgtggaaggaaggattgcggcttctgtcctagagctgtggtgcagggggcacctaagccctcagagaacaacttccttcccagggaagcagccagtcagagcctattggcaagagttctttctcatttggttctgtagactgagggggctgttgcttttgctttttttctgtacttgagatgaaactcaggtccctgaatgtgctggacaagcactatgccactgagccacacttccagctctctcaatgggggattctaggcaggggctctaccactgagccacgcccccagcccctcactgggggattctaggcaggggctctaccactgatctacgcccccagcccttcactgggggattctagggaggagctctgccattgagccacgcccccagaccttcacttggacaatctaggcatgccccctgcctttggttttcagaaaaaggttctccctatacattccaggctgaccctgaactcttcaccattgtcctgcttaacca

SEQ ID NO: 32160 - DNA, 1176 bp, Mus musculus
caattctagagacgatcgccagagggagtaagaaggttcgttttcactgcacagttttttcccaagtgactatgacgtaaagcgaaacaggaggcggagctaaactgctgggtcagtcaaacctggagcatgaacctagaggcgtcacatgagcgccgcgacactggtcaggtgattagtgtgacccagttccgccgaggcgtggcagaacaagtctatagagcctgctgattggttggagggagtcaaaggtcgcgctttgggggcggtgggctcttggcggttcgggcttatgattggcttatttggtgtcacgtggcaatgcgcttgtgggggttccaggaggctagcggcgtgtgctcacgtgttgggggggggggggtcaaggtgctgagtgcggtagccggagggggcgtgccgggaggagagtgcctcgcagcttgagcccactggttggttcgcagggttcacgtggggtggcaggcctgggtgacgtcaacgcagcgggcggagctccgctgagtgcgcggtgtccggggcctgtgagtcgtcgccaggctgtgtcgggcctgagccgagcagctgcgcgacgtcatggacaactccgggaagcaggctgaggctatggcgctgctggctgaagcggagcgcaaggtgaagaactcgcagtccttcttctccggcctctttgggtgagcaatgggcgaggctgggcccaaggcggggaagagcgggctcttctgctctgcactttgggagcccctcagcggccttgcaggccctggccgtggccctatggctgacgacacccgctgactggtggccgcgcctttcccaggccggtgcccgtggatctgtgcggcccaggctgccggggtgaggacaccagaccgaggggacccgggctggggcgtccttgggcatgatgagccggagtacgaggtgtgagggtgagtggggccctgctaagagtgactgatggcgaggcctggactgagaggtggagacttgtgcttggggaacaagcatgaatggacagtgacactggttttagccaagacaatggtgatgggaggatgaggcacacaagagaatcattagggtggtaggaccaccgcctactaggtggtcctcaagtctggagtctgaacacacccaggaggtggcaaatacctc

SEQ ID NO: 32161 - DNA, 1466 bp, Mus musculus
tgtctgaagagcctgcccccgtggacagcaaggctggctggacccctctgctgattgtttccctttcccactccaccctgaacatttgtttccaactgtgtctaccttggttctctagccagtacttgctgctgacgtcactctctgggtgccctcagtaaccaggcccctgacttggcacggaggtgggagaggcagtgtttccatgcctccatgcctcaattccacccacaaagccagggtgcttggaggtcttttaaactacaagtcttttcctgccaacttatactccaagctttgcaggctgaggtgacagggtgctctctaggaaacctcaggactggggccagggagggttccaggagagcagtgtgtcatggctcaccctctctgtgccataggtgaaggaatatgactccatctccagactggaccagtggcttaccaccatgcttctgcgcataaagaagaccattcagggtgacgaggaggacctgcgctaggcctccagccactgccttccacccatctgtctatcacagaggtggagccagcacctcccaccaggagtctgaaggagtgggtgcaatgtgggccacattctccagcaccaggcgagctctcctggatggctggtcacccgctgcgtccttcaccctgccgtttatttaagcccccagaggtgccctcctgccctggaaagtccacctggacagattctccaattcagacttctgtgtgcttcaggaaccagaggtcagggtctggtcccatctcctgaccagcagtgtactaaggctgtttccatatctcctaccttgtcccctagcagagataagaacacaggtagctctgagacttgctctccctggctgggggtaacctctgcccctggagccttcccttgttcctacaatgccaacctctcaggttagacccagccctggagctcatggggtgccttggccctgccctgcgcacctgcttctctccatgcatccaggtctatcgacctgaagctgcagctggcccaaaaaggacaataaaacctgccacttttgcatgagcctcttgagctgtccctttgaccctcggtgcccttccctttggaccttggctgtcctggaggagttggaggtttctgcagctgagcctcagaaccagagtgctttctagaagctgtggactggcccaagatgacgggagcctcatacccatttcaccctgcagggggtctgccagggctggcctccttccatgggattgccctgactgaagcagacagcctaggagaaaaagttggccttccacacatctcgctctgctcccctgtccctccagtgtccccaacagcttcattcagttgataatttggccctcagctttggagaaccctgaggctggaggctgacaactttttttaccatgggattgccaagaagccttgtgagaatgtcccagcctgc

SEQ ID NO: 32162 - DNA, 1169 bp, Mus musculus
ccctctaatgtagtctgttttgagccatctctgtctttcctctgattactttcctactccttcctcccctttctctttccacttatttatttatgtgtctggtgcttagtatcagactcactgtgctatgtcccccaacccttgggtttgcaaggcagagtcacattgtatagccaagctgttccagaattcagtccctgtgtctcagctaccggagcaccatgcccagccttctgctgatctccaatctcagttctttctacttgggtctaatttgcccctcccacaggaagttgacctaaagctgtatcccccacccaagtctagcctctgttccctcctacttgggagatcaattctcatccaacaccctgtggtctagtctctgcccagtatggtctgacatgtgtccctctcctgtcacagcttaccgtcctctcttgtccccacagcacagcctgatccaggcctctgaactggtcttgacacggcttcgtcatcaagtggagcagaggaaacatcagcagggccttggggacagagttgggcccaggcctgtggaacacccagcctcctgagcactccatcttctcaggtgtgggcacctcgtatctatcattgttgatggggagcgaagcatcttagaagaggagtgtgccccttggactccctcagaaggggaattctaagagtccctgacccaccctggtgtgctgtgtgaccctagctgataactcctgtctgagccatttgaaaagggatgttctcagccaacctctgctcccatcaggtgttggtccctgaggaccatttacacattcagagcaacaaagctgtcctggctgtcttaatttcctttgtctggcaagcatctatcaagtacttactgtgtgccaggttctacaatgtttaattcactctcaaagaactgaggaggaggaggacttcgcagagattcctaggttagacccagagaaaagaaagaaagttacagtgtgtggagggtgcatttttgaaaactatggagccattctctgctctggtgagctaaactcaggaagtagagtcccagacaaatgccactgaggttcattgtctcaacctaggatgaataaggccacagacaaggagtcagcactgaggggcaagtgagaactcaccaggggctt

SEQ ID NO: 32163 - DNA, 1198 bp, Mus musculus
acagggtcttccctgtctctcccaaaacccaaaaagggaggagggagaagcaaagggaagtctgcttgggatcctggtgggttcataattacgcatgagtgtttgctaattaggggctgctaattagatatatcattaaaggccttgtctagggggctaactgtgtatcggctctttaagaatcacccctctccccgcccctgcctacacacacacacacacacacacacacactccactccttttcgggaagttctgccaacatactgcctccctcccccagagcgggctcctggtctgtgggtgtgaattgagggtaggctgtgggttagacttcgagaggaactttcagactgacatagaaggtggaaattcctggagacaaggctcgaggcaccccaaggcatttctaatgggcagcaggctcaggtgacagctcctcgggctgccttttctctataataggcaactgggttaccataacaacctgagggtggagccaggagctcagaccttgggcaccttctggggggagtggatgctgggtgatctgtgcaaattgtttcacttctctgagccttgatcctctactttgtgaactgagtgaaagagtcctctccaaaggccaggggtgtcattgtggagagcacagtcagagccccaaggaagagcgggcttcaggccccaagggagaaacagcagaggctagaatgcctgaaacagagcaggggggccagaggccatgcaagcaagggagggatccacagtcctctgagactggagttgtggaatatcctggaaggagaatggacgggcgctcctgtgtgcttattttttatttgttattgtgtggatgtggatggtcagaggacaactgtgtagagtcaattctctcttcctatctcttctttggccatggcacacttaaaccctcctcaaaataaataaaatgtaataaaacataaacacagaaagacaaaaatagacgctcatacccagaacctactacagccccctcaagagccaagctgcaatgcctggaattgcccagtggactcctggcctccagctgacactggtttcacagtgttctttgtacctggcatccttcactcagccatgcatctcaggatcaggttcctctatgtcatcacggttagccacagtcccctctctgcttaggggcagtatactactc

SEQ ID NO: 32164 - DNA, 1150 bp, Mus musculus
taagactgctgcctctatttgcataatttattcatgggcctggcctaattcgtacacccacatgcataatttatttgtggtgcccaagactcactcattcacgctgtgcatgatctgttaactgctgtcacttaatagattctactctagaagtacccagatataaaagtgctctagagttggcatcaaagtagagactgcagggtttatctgggcatgaggcttatgcctgtcatcccaacactaggaaagctgaggcaggaggattgttgtaagctcaagttcagcctgggtagcacagtgagaatgtggagatgtcggtgtaactaaagggtgaagtaagtccctagcgtccatgaagtcttgggttccatacccagcataggaagaaacaagaaagaaaaggagaggaggaaacgggaaaggaggggaaaagaaagaaagactagaggatcagagcgtgggaaagcttgcacccagatcacgactagagcattgagcttcctagcagccctggtgaaaaggacagcatcctggcttagggtccagaacagcctatgtgtgtgtgaggtgaaggatttcgtgtgagtgtacacatgtgtgccggcacagagctcaatgtcagggggcttcctcaattactctccacattatatgttgagtcaggtaccctctctgaacttagagattggctagactgtatagcccctgagctcaggggtcctgcctctacctcctcagcatgggggtcaaaacctcacccagtatatacaaacatacacacacacacacacacacacacatatatataagagagagaggagagagagctgtaaggaattctagacactgtgggtgttgtagggagcagcagagtggaggtgacatagaagctggctttgatgtagaaggtagaaggaagatggaggacaccacagctccagatggagaagaggtccagatggactttttatttatactcagggaagaaaatgaggtgggaggggctgggggcttttgctgattaatggagaaactccattaatgaacacacacacacagagagggagagagagagagagagggagagagagagagagagggagatcctttttctggacaggcaagattgctcagtgggtagcggtgc

SEQ ID NO: 32165 - DNA, 1781 bp, Mus musculus
ggttggttggttggttggttggtttgtgacaaagtcctactgtttgtgtagcccacctgcactctgctggccttgtacttcctgagatgtgaatgccattccagggactaaactcgaatatttaactctgaagctagggaaaagcctctgtttaagcttggtcatgattgtgttaggcctcttgcttttttctctgtttgtttgtttgtgtgtgtgtttgtttgttataaatggtgtttttctagacatagtttttctctaggctaagctggcctggaactcaacatcgatccacctgcctctgcctcccaagtcctaggattagagctatgtcgccacctcccatcctaagcagaagcttttacccagagggctcttggcccttcctttgtcattttcattgtagtttttccctggcccacgttagaaggcccgtcaatgtggtggtcttctgtctctactctgaagctgagccctcttctcctctctccaggccctgtctcaaagggaccctcctcacaacaacttcttcttcttcgacggcatgaaggggagtggaattgtggagtgccttggtccccagtgagctgaggtgtgtacaaggccaccgagtcacctgccctctctccggatcatttttctagagcaagcaggccagacttcatcctgcctttgtcttcgaagctatcagggaactgcggggtcccaaatatgataatcacgtggcacctctggcattgctcccttgggctgtcactggggactggcagtgcctagtgagagagagcatcatacttcatgatgtcagagtgtcttgtcacggtttggacttaacttccctctatagtcagcagaggggatccgaggcccagtgctgcctggagaactgagaatagacctctgttgttgacccttcctcaggctggagcctgggtgttggaagggagagactgtcacccagttgtcatgtcttttggttgtgagcctatgcaccttacctttaatggttgaaccatcttttcagcccaaacagtttatttctaaaaagtagatttaatgctaggggccattatgcaggcttgtaatcctagatgttgggatgccggggcaggatttactgtaaatttcagggccaagttggtctacataatgtaccaagaacctttctcaaaatataataaagggcatattccagagttagggtggggcactgttacccagctccttatactgggcacccgggcccctgacaggagtgggttggggggcagttggtttggtcttccttctaggagtatgagggcagcctgtctagtttgtagatccccttggttgctggataaaggatgataataaagtgtctttctcttaaacttgcttgtctcctctgttttagaaacatgggtgggtagctggtgtcctattttccttaaacctgaaaagtctcacaccctcttatgcttaaaagattcctactgtctccagcccagcctccttgcttcctttgtccttttgataatacagcagttgcactgcagacaggacacatggatgcttaggctcctgcctgtgtgctgagggtctcagtactaacaggctgaagtcacgtgggtgagctagagcgcccagcttaaccatggtgggtggcacactcctgtcctgtctgcacctaggaggctgagacaggaaggtcacaagttgaaagccagccccttctgtgcagcaagttggtgaggtggaaagcagaatcctatggctataagatagggcttcccctgcaa

SEQ ID NO: 32166 - DNA, 1229 bp, Mus musculus
cctcttcaattaattatgaaggccggagttcaaatcccagctactcacacgaacaaataagtaaaatataatttaaaaagagaaaccatggggccgggtgatggtggcgcatgcctttaatcccagcacttgggaggcagaggcaggcggatttctgagttcaaggccagcctggtctacagagtgagttccaggacagccagggctatacagagaaaccctgtctcgaaaaaccaaaaaaaaaagaaagagagagagaccgtgacctggttgtggtggtggtatgcctctgttaccattacttgagtaatggaggcaggaagatcacgtgagcttttttttttttttttttaaagattttatttattgttatatgtaagtacactgtagctgtctttagacacaacagaagagggcttcggatctcattgtggatggttgtgagccaccatgtggctactgggatttgaactcaggacctttggaagagcagtcagttagttctcttacccgctgagccatctcaccagctccaactcttttctttttaaagtcaagcattggtgtaagaacttacctcaaaaagagagagagggagggtaggctggagagatggctcagaaatgaactattcgtaactccagcttcaggcagttctgctgaaggcaggtctctgagggcacctgcactcataagcacatatcccacacacagcccaaaccccacacacatacatagatgtacacatacagtgggacgggaagcctaaaaacccaaagcgtcacctaaaaagaagtgcgccagtattgaacacaggacactgcgcttattagtctctagaaagatgtctgtttttaagatttgtttattcactttacgtatatgtgtacattgtggctgtcttcagacacaccagaagagtgcatcctgtcccattacagatggttctttgtgattcctgggaattgaactcaggacgtctagaagagcaggcagtgttcttaactgctgagccatctctccagcccaaagaaaagttgtgtttgtttgtttcagtggtttatacacccatcccaccccctgtcccattttagtggggaagatctagtaccctgaatgtactagatatgcaatcagccattgtgctgtacctccagccccaaagctgtgttcagcagtgcatcatctcctgacagggatcttaaaatgaaaatctttgtgtatactca

SEQ ID NO: 32167 - DNA, 1181 bp, Mus musculus
caaagctccagttccaggttagcttgggctacctgagactttgtccccaaaccaacagaaaggtctttaatatgtggatagtaattgctggtgttgtgtgggtctccccccccccccccaaaaaaaaacaaaacaaaacaaaacaaaaaaccattgggcgtagaacctggggacttagacatgtgtttgggtctagtgcagtgtttaatctcattttagagaaagcagttaggaaagcaaacagaaggcaatggtttctttagccggtgttagacaagaaaatcttgtactagggaaagcaatttgaagtggctggtattggtttcacaaaactgagaaataatgggaccaaacccatatttaaggaaagccgttggttggaacattcatttaaagtttcattgagggttagaggttctgtgcaggttccacagcactgggactaagttttctagcaagacaaaactgcattttctgtcccttacttttgtgtttgtgttgggatagctttatctgtgagcctgatgccgaggaattattaagctctaattttagtgtctattcacaggactgtaattacccggagtgaacaaacctggagtcctttctttttgaggcccagtcaggctttctctgctgggttgcctgagtttggtggggagagacattgttaacaaatggaggaacacaaaaggagctttgtgggcggctctgtcagtttataaatcacaccctcttacaagtgtgacacttggccctggtgtgaagggttttatggcttaagggccttctctgattgaggcccacattttgcattcatatggaaaaagcccttgctttgttagccattcacagctggaagtttccctggaatcccttctgatgatgcccactagggtggatatggaagcttcatttgggagccacttttctgtcactatgaggagaatgtggggaccccaggccagtacttggcagtcttggtgtgccattcctgagcgctctgccggcactttgccctttgtgcaatgtcttccttacagagggcagaaattgaagatatcaaaatattccccagctgacattgttagtcagctgttacaatgggactattcagctgggattccaaccctgagctcttgagggcgcacagcatgcagcacattccttctgacaatccc

SEQ ID NO: 32168 - DNA, 1195 bp, Mus musculus
ttaaaaaaacagaaacaataaacagaaccctgccagctgatagaggcttctaaagatcttccagcttggtttcttagccttgtgatccaggttactgctgaaagtgctgtgtccgcgtttgctcttggacacctgtgcagcaggctccactgcgcaggccctggtgtgggcctcacacagggctggaagcagcactcctttacttacacttgagttgtaccagagtctacaacagactccaagaccgtgcttttctctccataagtctttaaaatctgatcgagatctgatagttggtacccttcatagcgctgggatttttagccacatagggttggtgcctgctgtcttggacagtgcagccatgaatagacaggtagtgagagaccagctactgaggacaggagtagctgtgtgtccagagtgccaagtcatccctcgagggaactagaggcactgtagtcttaatgggccaaattgcatggcttcctaaaggaggaggcctcaaggaagacataggaaatgggaccctatcttccttgttgttgtagtctgtagccatgtgaggctcactgttccaatcaccccacaggtagccgaggccgaggcaggggctacaggggccgtgggagtcgaggaggatctcgaggccgaggcatgggcaggggcagcagaggccgaggccgaggctccatgggagagcacccagaggacgaagaggacttgtatgaagaggagatagaggtaaggttttccatagctcttggggccagcagtgtgattggcaggttctctgggctacgagtcctttgggtgggcttgctgagactaagaccagaggatgttggtggggtacccaagggaaggaagacttggagtgtcagacacacttttaaaaggttcctcttggtgctgggcagtggtggcgcacgcctttaatcccagcacttgggaggcagaggcaggcagatttctgagttcgaggccagcctggtctacacaggatagccagggctacacagagaaaccctgtctcgaaaaaacaaaaaaacaaaacaaaaccaaaaaaccttagtgggtgaagcaggaaaaggtagatagcaaaaaccctgttctgagacagggcttctctgagtcttctagaatgtctcctgcctcttatggcaggcatgggagggatgtacagaatacacac

SEQ ID NO: 32169 - DNA, 1184 bp, Mus musculus
caggacatgtacaacaagaagatcccctctttgtttgagattgtggtgcggcccacggggcagctagctgagaagctgggcgtgaggtgagtatattgtccacagaagcacaggagcattggcctggcagggctctgcccttgatgaggctgtcagacgccatttggactccgggcctcaggctccaagtgaacactgcaggtttactggttgggagctgctgcctttccttagcagcttcatcacaagtaccatttcctcttctaggttccctggacctggtggaccctcggggccaatgggtcctggccccaacatgggacccccagggccaatggggggacccatgcatcctgacatgcaccctgacatgcacccagacatgcaccccgacatgcaccctgacatgcaccccgacatgcaccccgacatgcaccctgacatgcatcctgacatgccaatgggtcctggcatgaaccctggccctcccatgggtcctggtggccccccaatgatgccctatggtcctggagactccccacattctggaatgatgcctcctatcccgccagcccagaacttctatgagaacttctacccgcagcaagagggcatggaaatggagcctggtcttgttggagatgcaggtatgtaggcaacagctaggctgtagagctgggctcaccaaagtgggatggagatcagaagtggcttttcttccttgtccagtcttacagcagcattccagtcccattcccattctataggtgttttaagtattatgggaccctttgccttgtgggagccgaaggactcttgtgtttgttgtcagtgagggaaacagtactcaggtcttagcatcaattatgagcaaggcagaaataccttaggaagctgtgcttatggtgcctgggatcagtcaggaggaaggcaggtgccctagacaaggtccttcttctgggtagaggtgggctcaataactgtgcttgtatgacaccatcggctggacaggttcttgcctctgtcctgtgatgtgagcaaccttagtgtccagtatagtcaagaatagctgctgtggctgactgtgggaaaatcagaaaggaggagggacctgccccaggccaaagctcaaagagtgtgtgtggtctctgtccttgctatagttgcattttagtagagggaac

SEQ ID NO: 32170 - DNA, 1099 bp, Mus musculus
ctctctcaggtgacactggaaactggtactcaagtgatgaggatgaagggggaagcagtgtcacatccatcctgaagaccttgaggcaacagacgtcaagccgaccccaggcttcagttggggaaccgagcagcagtgggctgggggatccccgtctccagaagggacaccccacaggaagtcggctgtctgacccccgcctcagccgggaccccagactcagccgccatgcagagacttcaggagggtctggcccaggggactcggggccctctgaccctcggttggctcgtgctctgcccacctccaaggctgaaggcagccttcattccagccctgcaggccccagcagttcaaaaggacagccccctgcagaagaggaggaaggggagagagccttgcgtgaaaaggcggtgaacattcccctggaccctctgcctggacacccactacgggaccctcgctctcagctgcaacagttcagccacatcaagaaggatgtgaccctgagcaagccgagctttgctcgcacagtgctctggaaccctgaagacctgatccccctgcccatccccaagcaggacgtgcccccagtgcctgctgccctgcagtccctacctgctctagatcctaggctacaccgttccacaccccctgggcctccaaacacccggcagcgtccaggctccacagatcccagcacctctggctctaacctacctgactttgaactcctctctcgaatcctcaagaccgtcaatgtcaatacccctggtcagagtgaaaagcccagtgatccgagggtgcggaagacccctactgaccccagattacagaagccagcagatcctgtggcagcctcccgtgcagccaagccctgtcccactgaagcatcgcctcctgctgccagcccaagcggggattcatccccaccggccacggctccctatgacccccgagtgctggctgctggtggcttgggccagggcagcagcagcgggcagagcagtgtgctgagtggtatcagcttatatgacccaaggactcccaatgcaggtggcaaaactgcagagccagcttctgacacaagtgctcagcc

SEQ ID NO: 32171 - DNA, 2706 bp, Mus musculus
caggatccctgaaggacgtttttaaaggctttgaccccacagcctcccccttctgccagtagtgtcactgggggccagtgctccctccactccaccaccctcccagggtgacatttaagggcagcaaccagagttacaggcgggaggtggggcaggtgggcagggtgttctttcttcacatttttcttcccttttttccccatttttaaatagtactttctttgagtcataaattgtatctaaccatcttgggttctggtcagtgctgcaggctcctgggctcccctctgcccagtgagcaacttataccctgcactggatagtggcaagtacccagcctgggacttccctggaactgagggatgcatagctgtctggggaagcactgacggccactcactcaccctgtgctgctgcaagtttgacagaaccacatcacatcgtggagaagctggtgcaggagttcctagagccccagggtcaactgtcctctctagcatgcagcctgtgacagcttgcttcaggacaaagcaacagtgaagtgagaaaatgtcaacaggagagaaagggcccggcaaccctctggccctaacctgctctagcctgtacatcccacatcctccgtccgtctgtccatccagggtttgtctgtcctgaaagtgacacccaccagctctgcgggagactcttggtagacagacctgtggggtagcaggcctggcaggagtgggacagccccttgaagcattctccctcagtattacctaccctgtgccactggcctgaccctcgagacagctcaaggatccgtggtgtggccacctgccagacccccaaggagagaggccaagagtggccctggcacagtgtgtctgctagctgcttccacaccccttagccatgttatctgtagagtaccggatagtgtttgctttttcctcccaagctgacagaagctgggcatcagtgatctgttgtgttggattaataggtccttccccaaatgggacctgaggaaatagcaggtgtccagctgatgtgttgggccttttctaggaaagggaccaagccccttcaagtggggaggcccagagttacctgccatatcccacatagtggaggcgttcccgcagccgccaccactagcctccttagggctggccttgtccaaagaatgggggtgggagcgccaaggggcagagactctccttgaccctctccctaaggttggatcagggaactgggtaagacctgcagaaggtttctctgagtcactcaccaggccctacaagtccgctttcttgcaggctgcctcttttatattgggtctcttggcccaactgcttccttcttgttaataaggagacctgacgcacacagccagtggattcccctccacctcgggaggggacaggctcccacatcccatcccaccctccacaccccaaagagaaatcccttcaaaacagtttggggcctgtagccagggtgggaggggcttgtgccccacagcctcacaacccttggggtcagtgcaccaagatcaagttggttggtttgtcttgtgttttttattttgttttattttcttaaacaatcatcaatgagatttgtctttgggccccagccttggccacgaggccctgaggccaaggctggggccctggtgagcataggataggtagggtgagtacagtgtggcagtgtttgggtcccgacacccctttgaaaaccccctttttgtaaaagccaggcttggtagtgggcacctgtcatcccagcactcaggaggcagggtcaggaggattacaggttcaaagccagtctggtctatattagaaaaagaaaactgtccttttgctaaagaaaaattaaatgaatttttaaggctgaaatctgtgggtaagatggagtctggagctttcctcttggaacagttaaccgaagaccctcatgggcaaggacatccgcttgactccccactcaccatcaggccacacttttaaagaaaaattgttctctaaccaggattgtaacaaatgtgtaaatagtatttctgagttgaaagtcgatggtgcaaatatgtatataacgtactgtatttttacaatgatcgtcgcatggctctcccacccccttttgtactcagtatctgtcttccagaaacctcacctgccttctctctcatgtggtctcttaatccagtaattgtattactgccattaaaggatgcagttattttaaacagtctgtgagtctagtctcatctctgccctgtcagggaacaaagaaggagggtggggagttgtctggtttgtttcattacagtgagatgaaggccagggtttcatgcattctggggagcaccaggcctggtacattccccagccctcagacactcaaataacagtgataaccaatgcaggtgtgcaggcatgtgatcctagcacttaggaggctaaggcaggaggatgcagagtttgaggccagcttgggctagacctgagatgaaaggaaaaaaaaaaaaatcagtcatgtaagacttcatataactagaaccctgattatacattcagaaatgcatgcaggctgcctgtggctgtatttacccacctactgtgctctcagccctctgacagtctccaggttggccttgaattcctgaaactcggccttcaattcctgtgtgctaggtttctaggtaca

SEQ ID NO: 32172 - DNA, 3713 bp, Mus musculus
atgcctggtacccatgaagccagaagagagcacaagaacccctcggactggaggtacagatggttgtgagccaccatgtgggttctgggaactgaactcaggccatctgaaagagcaacaagtactcttaaccttgaagccatctctccaggactgccccccccaccccaccccttcccgtgttattttgaggcagtcgcagtagcccgagtaagccttccgttagctagcactgctccagcctctcactagctgacgttagaagccttgtcccgccctgtgctcgtactgactcatcctccccacccgtcaccctgtcagccccttgggatacgctggaccctgtaactattgactactgctccttcttccacaggcttcttcctgctgggtggcctgtgcgtggtgtggggcggagcctcctatgcggtgggtctggcagcgctgcggggacccatgcaactgtcgcttgctggtgctgccgctggtgtgggggcagtgttggctgccagtctgctctgggcttgtgcagtaggtctctacatgggccagttggaactggacgtggaactggtgcctgaggatgatggggcagccagtacagaaggcccagatgaagcgggcaggccaccccctgagtaaacaacagggctgtggggactggctgggcctgacgactgggacattaaaacctgacccttccgcagttcaagactctgagtgatagctcctgttatctggggaggtggggaggggagaagagggcaacctttggggacgaggctcagtgggtaaaggcacttgctcctaagcctggcgacctgagtttgatactcaggacctgcgtggtagaagaagagacctaatttccacaccataccacacatggacacacatacaagtaaatcagttcaaaggaacaaggccaagcaatcatgagaggcagcatccccggggagggagccccttagggcatggtgtttaattctcaagaatgactccaggacttgatctgtgtctcaggtttggccctctggtgttacactgtcttcagtctcccttccgctgcaccctagtacctgtgggccccggatagggcaagcccagcgtagggtaaaaggcctctggaagcgaggggcctgcgcccagcctgtgcagatgtggatacatcaggctcaactccgcagggccatagcggatggtgcctggggtgcacaggccccgcacaacgggtggcaggaagcctgcatgaaggagggcgggtgaggggtctccgggagttgtcaagccccacggcagcactggatcatgcttcagggctcccgcccggatgacagaagtgaattctggccgaggtggagccggtggatccgagagctcctcttctccactgtcctctgagcctctagcttccttcgggctggcctccactttgatgcgtttgcctcgggcctgagggtccttgtccttgtcctggtccgcaggcacagcctgcttcccgtcaactggaggctcttcctctgaagaagatactttatagttattctttgctgagctctactgctgtaccacacccacagccccttacagcctgcacccgcgggagagggggaagaggtcaagatagaggctctaccactgccaagctatgcccccagcccctcactgggggatcctaggcaggggctctaccactgccaagccacgcccccagcccctcactgggggatcctaggcagggctctatcactgagccacgcccccagcccctcactgggggattctaggcaggggctttaccactgagccacactcccagcccctcactgggggattctagggaggggctctaccactgcgccacactcccagtcccttagtgatggattctcctcaggcctacagttgagccagattctaagccttcttttgattttctatgtgtggatgagggtatggaggtgaacatcaacactggtgctcttcctctatcgctatcatcatcatcattattaccgtgttgtgtgtatacaatggaggcgtacatgccgccatgaaggtgtgcaccaggtcagaggacagctttgctgagtcgggtttctatttctacctttattgggattctgaggatcaaactcaggtcatcacgtttggattgttacccactgagccatctctacggtcgcatttgtgattgctctgtgtgtgtgagtgtgggtgcacaggccccatgatatacatgtgggggtcacagggcaaggcctttctacctgatgaaccatctcactggattaacgagacagagacacttactgaacctagagctcatacatttctggctaggctggctggccagccgactcctgggatctacatgtgtctgtcccaacactgaggtcacccaggtgagtgctggagatccaagcacaggtcttttgtttgcttgggttttgtttttgttttcgacacagggtttctctgtgtagccctggctgccttggaactcactctatggatcaggctggcctggagctcacagaggtccgcctgcctctgcctcccgagtgctgggatgacagatgggtgcataccaccacccggcccacactcaggattttatgcatgcacagcaagccctgtattcacggggtcacctccccaggcccttttactctttgagacatggtcttgctaagttgtccaggctaacattggcatctccctgtctcagcctccccagtagctggggttaaagcccttcactaccacaccagcctcaaagaaggcttctgaaagaatgtgtgtccccagcccttgctcttgaagtgtaggcacagtggggtaggtctgcagttcccaagccccagcgattctccctcctcaccccgcccccaccccccaggcacagagtaggcacattcccacagcacagctaagagccatccagccctgatattgccagtaaagcccaggctgagaaggcccagctagacctctacaaatgatggaaccctccagcacgccctcctacagcaatagaactttgatggtactggacatatctcacctgtattgttctgagacagctactggccacatattttgccagtgactatttgaaatatggtggataaatttgaggatgaagatgtttaattttggagtaggatgaaggttccccctccctcccccaagacaaggtctcacaatgttgttctggctggcctggagctcactctgtagacaaggctggccttgaactcagagatctgcctgccgctgcctcccaactgctttgattaaaggtgtgcaccatcatgacctgcctgattgtgttgttttcgagggaaggtctcgctctgtagctctcctagtctagaactcattatgcagaccaggttggcttcgaacttacagagaccctcctgcctctgactggtggggataagggcttgtccttgaggcactgctccccaccccagctggttttaattgtttagatccctctcatgtgtttcagtgctttgcctgcatgcatgtgtctgtacactgtgtggaggccaggagagagagagagagagagagagagagagagagagagagagagcacattagatccactggaactggagtcacatggttgtgcatcaccatgtgggtgctgggaacataaccccagtcctctgcaagagcagtcagtactctatcactca

SEQ ID NO: 32173 - DNA, 1252 bp, Mus musculus
aagcgtggtagttaaaaattgacccaaagcagacagacatggcagagtttaactttcatcccagacggcagacggaggcagagagttctaggccatctaggactacacagagagaccttgtctaagataggaaagaaagtaagcaagcttgaactcagggtcatagaaccgggtcagtaggtcaaggagcacattcccttcccaagcctgtctgtcagagtttgatctctctgtgctcaaagagaagatcaactgtgggctggagcacatgcttgatccatatatatacatatatatggatcaactcctgaagattgttcttctaggggagttgaagagctggagcagcagttaagaacactggctgctcttccagaggaccggggtttgatgtccagaatctacatggtggctcacaagtgtgtgtaactccaatttcagggggatctagtgccctcttctggcctctgtgggcaccagtgtacatgtgcatgcaggcaaaatacacaaatacataaaataaaagcctcttagaaaatgaaccaagtctacggctataccaccctgaacgtgcccgatcttgtctgatctcggaagctaagcagggtcgggcctggttagtacttcgatgggagaccgcctggaaataccgggtgctgtaggcttaaaaaaaaaaaagacaatgaaccaagtagctaccatcttccccctttgggtctcattttctcagggtcttccttccaatcttcagagagctactttggtgtagaatagcaggggcctaagtttttgaatttggttgtctgtcgaccggatgttgagccacccccacacacgttcctgaccagttggttctgatgcacaggtgggcattgtggaagtggccaagagacgacccggcccggggtgctgtgaccagagtgagcctctatctcttgaagcttccggatggccctctaagtgttgaggggctggacaccgtcagggctctctcagcccccctttttccctccctggggctccaggacaatagacaagatgtttatccccccgccggcgcacatgttgttcgcggtaatgacagtaatcagcctcgctaatgcggcattctctcagcgccagtcaattcgcctaattaccgcctgggaagccggattatttaaatttaaatggtgatttattgcggggcttaatcaatgctattttctctccccccacctcctctctgggtaccagggcaggaagggaatag

SEQ ID NO: 32174 - DNA, 2173 bp, Mus musculus
ctggcatggcccaacagcacagcaagaggagagctttgtgcctatacccagtgtgtggctttcctccaaccccttcccagacttgtgatccattccctgcagcaaaggaacactggaagaaagatggagctcctccacagagacagaaagaaaccacagcaagaaaacagacctcaagtttccactctgacctgccaggtggccactgggtaaacaagtccttttgtctatgtatgacagcaaagcaaggacacctgggcagtaactgcaaccacagccccctccccccactccctaagaacacagcccttggaaggattgttagcatggcccccacccctcctgccaaccagcacactacatacactactatagaaacactacaggtgtgtgcacacagcactcaggttggcatgtttggtgttgaaatggggtcatttcattccatgttatgaatgcaaccagaaagggtgtctgggatatgagcagatgtggcatcttccagaaatgatcatctggttatggaatgaagggacctgttctcaagcaaaggtcatcacagtgacccaacccagacacttccccagcagcctccccatactctgctcctgatgtggcaacccttgtcggctcctgcctttgccccccactttaatctaagcactgggccatgaaatctgacactaaggtaccctgagcataggaggggcatgggtcgcaccattgcactttagaaataacacggagtgttcccaagggcctcaggtggactgccaccctgcctttatctctgtaggataagaggaggatgactggcctctggcccaggtcctggctgtctccctatctctaatacttggcaacataaggtgcttgcaaacactaaggctgccccctgcaaagtaaactccaagacaaaccaaacccaaggtacaaatgtgttacacataaatgttttccttcctgggggtctgtgttggatgttgtgggcctggagtcaataggaacatacaatgtgtgtagtgtccgctaaggttgcagttggtcccctgccctgacttcatgccccaagcctcagctattggaatggcttccattcagtagcttctgtgttggtcctttgtagagatggaagtggagccatcctgctgtgaacagttatgaaccaggggaggctgctgcatgtgcctattatgttggcagtgggtggcaggcagaggcaggcacgcgattagtagagccctgcttgggcctcactttgtggacaccaggctggtgcacctcccttttcaggcactctgagtgtccttcccacccatgacaaggcaaccacagaagtcagaacaatcaggcttgagtgggtggccaggtcagctactgcccttcccagaaagccctggaggtgaccatagcctgtcaccacccaacatcaccacgggctgggttttgtgtttcacattgggtagtatgcattctgtctgcactgtcccaccttctcatctctaccttttaagggatatggaaaggtctggagctctgtctgaccccacactctccattttccccagccaaggcagacagcagcactagcagacggtcttagaaccttcacactgtctctaccactacatggaatgacataaaagcaacttgtaggccagaggggtggggtgaacccttctgtggtctgtacccctggtctagtgggaggaatccctgaagacctgcatcccctaagtgaggaccctacagggtaccttgtgctctgcccccagacccatagccttagcagtgggccaactacaatcctcatctcctaaagtcatctacagatggcaggtggaagaaagtggttctccattccacatccactgccagtgtgcatggggagggcaggggatggactgggtcactctaggactgcagcagccagggacactgtagagaggctaaggctagaggcactattacccaaccatgaagccacccaagtagtggagccaggacataagttattgttcacattaaagaatcatgttccctgtgtacattttaagcaaaggaaaagtcttgggattgtatgggaataaaacttgtttgaaaatttggaatagtgctgctgtcagcttatttttctggtacttgtattttctatgttaaatgatctttatat

SEQ ID NO: 32175 - DNA, 1183 bp, Mus musculus
tagggtctctgctctgcagaggtaagaaaacagtcacattgcttgaatatcttgtgatcatatagctccgtttggttttgtttggttttggttttggtttttttgagacagggtttctctgtagccctggctgccctggaattcattttgtagaccaggctggtctcgaacttagagagagatccacctgccttagaaatctgcctgcctctgcctcccaagtgctgggattaaaggcatgcgccaccaccgcccagcatacctcggtttttacacacaaatgaatgtgagatacaacaaagggaagtgcctcaaggttttctgtttttgagatgacaatattttacttgtgtggatgctctattttattgacttagggttcctacgtagctctttgccttccagtttcacactacagtttctctctattttctcctagctgatttcaaggatctttgaggaggtcctgaagcaggtgcctatcactgtggatttccaagcattattaaacttaaaattataggcttgggagccagtgcatacctttaatttgagcactaaagggggcaaagacatgcagatctctgtgagtttgaggctaatctgccctacatggcaagttccaggtcagccagggaaacagtaagacactgactcaaaccacttatcccatcccaccccccaccccctaccccccataggaaaaagtaaaacaaaactatagacttgggaggttggagagaatattcagcatttaagagcactgtatgttcttgcagaagtctggggtttgagtctcaccacccacaaagcagaatctttaaggtggaaaatacagatacttgggctaggtgtgtagctcagtgctagagcacttacctggcatgtgcaaggacctgagtgtgattcttcacacttcctgagcacacacagagacaggaatctgtgtcctcttaaccctttcacccttcagccactgccaagctaagctgctactctctgaactttgccagattgcatctctgtccccccaaacactgactcgtctgaacatattccaatctcttaaattaaattacatcatctcttgtttctgccctctctctctctctctctctctctctctctctctctctctctctctctcagtttatcctgcttgtgtgatcttgctgcagaaaag

SEQ ID NO: 32176 - DNA, 1873 bp, Mus musculus
catcagtgtggtgggattgtcaggcactgagaaggagaaaggccagtgcggcattgggaagtcttgtctgtgtaaccgctttgtgcgcccaagtgctgatgagtttcacctggaccacacttctgtccttagcaccagtgactttggtgggcgggtggtcaataatgaccactttctgtactggggagaagttagccgctccctggaggattgtgtggaatgtaagatgcacattgtggagcagactgagtttattgacgatcagacttttcaacctcatcgaagcacggcactgcagccctacatcaagagagccgcagccaccaagcttgcttcagctgaaaaactcatgtatttttgcactgaccagctgggactggagcaagactttgagcagaaacagatgccagatgggaagctgctggttgacggtttccttctgggcattgatgttagcaggggcatgaacaggaacttcgatgatcagctcaaatttgtctccaatctctacaatcagcttgcaaaaacaaaaaagcccatagtggtagtcctgactaagtgtgatgagggcgttgagcggtacattagagatgcacatacttttgccttaagcaaaaagaacctccaggttgtagagacctctgcaaggtccaatgtgaatgtggacttggctttcagcaccttagtgcaactcattgataagagtcgagggaagacaaaaatcatcccttactttgaagctctcaagcagcagagtcagcagatagctacagcaaaggacaagtatgagtggttagtgagccgcattgtgaaaaatcacaatgagaactggccgagtgtcagccgaaagatgcaggcctcccctgagtaccaggactatgtctacctggaagggacacagaaggccaagaagctcttcctgcagcacattcaccgcctcaagcatgagcatattgagcgtcggagaaagctgtacctggcagctctgccattggcttttgaagccctcatacctaatctagatgaagtggaccacctgagctgtattaaagcaaaaaagctgttagagaccaagccagagttcttaaagtggtttgttgtacttgaagaaacaccatgggatgccaccagccacattgacaacatggaaaatgagcggattccctttgacttgatggatactgtccctgctgagcagttgtatgagacccacttggagaagctgaggaacgagaggaagagagctgagatgcgaagggctttcaaagaaaacctggagacctctcctttcataactcctgggaaaccttgggaagaagctcgtagttttattatgaatgaagacttctaccagtggctggaagaatctgtgtacatggacatctatggcaagcaccaaaagcagattatagaccgagcaaaggaagagttccaagagttgcttttggagtactcagaattgttttatgagctggagctggacgctaagcccagcaaggagaagatgggtgtcatccaggatgttctgggcgaagagcagagatttaaagcattgcagaagctccaagcagagcgtgatgccctcattctgaagcacatccattttgtgtaccacccgacgaaggagacatgcccaagctgtccagcttgtgtagatgctaagattgaacacttgatcagttctcgctttatcagaccatctgatcggaatcagaagaactctctgtctgacctcaatattgataggatcaatttggttatcttaggcaaagatggccttgcccgagagttggccaatgaaattcgagctctttgtacaaatgatgacaagtatgtaatagatggtaaaatgtatgagctttctctgaggcca

SEQ ID NO: 32177 - DNA, 1275 bp, Mus musculus
aggcaactcttataaaggaaaacatttagttggtactggcttacaggctcagagattcagtccattgtcatcacagcgacgtgtagacagacatagtgctggaggaggagctgagagttttctacatcttgatctgaagaattgtggatccgtggaattgtgtcacttcctccaacaagaccacacccactctgtaaatggccacaggtgacctgtaaggatggttccctactctcttgacccagaaaaccccacaaaatcatgcaaaccaagaggttcaaaccttcatgttcactttaagaacacgtgggaaactacccaggccatcaagggtttgcatatccacaaagccaccaagtatctgaaggatgtcactttaaagaagcaatgtgtgccattctggcggtataatggtagagttggtagatgcacccaggccaaacaatggggctggatacagggacagtggtcataaaagagtgctgaatttttgctgcacgtgcttaaaaatgcagaaaaatgctgaacttaagggtttagatgtggattctctagtcattgaacacattcaggtgaacaaggcagctaagatgcgccgacgaacctacagagctcatggccggattaacccatatatgagccccccctgccacattgagatgatcctcactgagaaggaacagattgttccaaagccagaagaggaggctgcacagaagaaaaagatatcccagaagaaactgaagaaacaaaaactcatggcccggggataaattcagcataaaataaatgcagataaagtttaaaaaaaaaaagaacacacctactccaacactccaacaaggctacactccctaatagagctacttcctgtaggccattgggggccattttatttaaactaccacactgagcctgtttttggttttgtttgtttgttttgtgtgaggcactgtcatcctttcattgatagccagactgtagttattgctgatacattgcatggagattccagtgtcaaatgacattcacatcagagtcacagagccttgttcatggactgtggtgtctgtaacttggaggaagggctgtagtttgcaggctctgtaaagagatagaggagggaaccaaaagacagtagtttgaagtgggaaattctggttttgttggagactcagttgtgtcgtgtgatagttttctggaaactgtctttgaccggttggtttactgaagtgaggacacttgagaggatgttttgctgagaacagacacatg

SEQ ID NO: 32178 - DNA, 1175 bp, Mus musculus
ctggtttgcatagtgactacctttggcctagtggctcactttgcctgcccttatggttggttattatgatttggtcagcaaagcagcagtacattttgaactatgggtcagatattaatgtcacagctattaacatcacagctatggacaaggtcagggcggtttgtgttttggttttgtttgtttgtttgtttttgtttttgtttttgtttttgtttttgtttttgttttcagaattcagtgtggggaaagggagggtaatttctctgggaactgctaatcttgttatggttatttttctgagaacagctcattttgttttggcagctgtagactcagtcattttcaccactatgtttctgaaagtcccctcagaggggaaggggctgggtggtcttgaactcattttggattctacaatctagtaagctgaaccagcactccgaggcaagttcagtgcacacctgttcaggacgtaggcccctacactcccacccaagacagaggtttggtctgtggttgtgtattgtaacgctaaatactggccccagtatctgactgccctcaggaggagatcctcagcgatcctctggcacaccaagtgatactgtgtaaccttgcttcttaatttgaaactattgtttgaacaaagaggcctacagcctgtagcagggcagaagagaggtaggtggggttttggtccccagtcttggggtctgaggcagagaccatgaggaagggaggagggaggagaaggaggaggaggaagttgccatggggtagttagattgtgagcacatggccaagagagcgggcctgttggaggagtggcccaggcagaacgtggcaagtgatatctctcggttactgacaggacattagaccaactaacatagagagttgatacctgcctagctctagtgttcttttgttttgttttgttttgtttcgtttttgtttttgtttttcaggacagggtttctctgtgtagctctggctgtcctggagctcactttgtagactaggctggcttcaaactcagaaatccacctgcctctgcctcccaagtgctgggattaaaggcgtgcgccaccactgctcaccgcatcagccatgaaaatgcataatgtgtactagccattgatttccatagactggagcctaaacacagaggt

SEQ ID NO: 32179 - DNA, 1496 bp, Mus musculus
atctggaaatttgatttttctctccagagcccgaaacgctcggtccactccttctagggctccagtacccaagagtccgagagccaggcgtcctaatcctgggatctcggtctcccggagcaaggcatcccggatctatgccacttgggttgagcttcctgaagacctcagctacctgagtttccttactccttcagggagtcaaagaaccctctgaagagctgttccctactccaacaaggcgctctcaactcccagttttcggggattcgacatcaccaggaaaaataaagggatctccgcatacagctcagggagcctaggaccctccagtttccgagatccggtggacgcataacttcaaggaccgctgcaaagtttcagcctccattctcggtcctaaggacgtcacacctagtctccaggctcacaaggaacctccctgttacggctcagcatggcagtggatccccctaaggctgaccccaaaggggtagtagcggtggattccaccgcgaacggtggccccgcgctgggatccagagaggaccagagtgcgaaagcaggtggttgctgcggttcccgtgaccgggtgcgccgctgcattcgcgccaacctgctggtgctgctcacggtggctgcggtggtggctggcgtggggctggggctgggggtctcggcggcgggcggtgctgacgcgctgggtcccgcgcgcttgaccgctttcgccttcccgggagagctgctgctgcgtctgctgaagatgatcatcctgccgctcgtggtgtgcagcctgatcggaggtgcagccagcttggaccctagcgcgctcggtcgtgtgggcgcctgggcgctgctctttttcctggtcaccacactgctcgcgtcggcgctcggcgtgggtttggccctggcgctgaagccgggcgccgccgttaccgccatcacctccatcaacgactctgttgtagacccctgtgcccgcagtgcaccaaccaaagaggtgctggattcctttctagatctcgtgaggtacgttcccgccaggcagtggggtggttaggggccagtgcaagcgtgcaatctttctgctttaccccctctgagtacagggattacccgtgtgtgccgccactagtcaccaaggttgagtcctccagattgagtcatgccttctagaatctaggaaaataaggtaacggtgacaggaccgctaacatcttggaagggtgaacttttacggaagttctccaaatttgggggcgggcctaaacatggagggcttttagaggaaggaaaaataataagccttcttagtcttgttacgctttttggagacagtacagggtctcgtacagccaagcctgtccttgaactctccttagcgccctacctccatcaccctagtggctgggatgaaggagcatcatttagcttactgaaaacaagtctgctacaagtatctcaggctgctctcttgcctcggcctccttcct

SEQ ID NO: 32180 - DNA, 1226 bp, Mus musculus
ataaaagtagctctgaggatgtagatcagtagtagagtgggcaaggtccttgtgttctatcatggggggcggggggggggtgggagattggtgggggttaggctcagggcttaaggttttgtttttgtttttgtttttttttgccaagcctgatgacttgaggttgctctctggtcacaagagatgaagaaaacagactcctgcacacaagtaggggcacacatgctcctcctccccccccccccccccccccagtaattaaatgtttatggccaggcaccgtggcgcaggcctttaatcacagcacaatggcataggcaggtggatctcctcagtgagttcaaggccaactagggctatacagtgagacactatcaaaaaaaaaaaaaaaagtagggtggagttgtatgtgtggaggatgtgactgcagtctaagtactttatgatccccttcttaagccaccaagagagaatcccattgccactctccaggaagccagccccgtccctctctgcctgcgctgcctcctccccaccctcccatgacagcatctaacatcggtgtctgtttctgcaggaatattttcccctccaatctggtgtctgctgccttccgctctgtgagtcctctggggcttaggggtgggatggtgaccgataagaaaagggaaatgcgtgtatgagtttgccaagagcattctgagtttgccactgagactcatccctgcctttctcactaagaaatgagattctggggagctggccagacaaccagacaacaggtgctgtgtgagctgacagcctcaagtttgattctcagaacacgcagttgtcctctgacctccagacacattcggggggccacatgggccacacacacatacacacaaagttaagttttaaaaagaaatgagattatgggcttggtggagcctgtactactagctcagaaaggctgaggttcagcagaaagttcaggctacacaaggggatagcatctcaataagtgaaactggcatgaacggctcgtacctgtaatcccagtgcttgggaagtggatggggaaggaccaggagttcaaggttatcattgactgcatagggagttagaagtcagcctgggctacaagagaccttgtctttaaaaagggaaaggacgggaggaatgagggatgcttggggctggtttggggctttgtgtagctttggtaacaatggacactgatt

SEQ ID NO: 32181 - DNA, 1527 bp, Mus musculus
ttggagtcttataaggaaccctggaagagcagtgagccattgtagcttgcagtcgtgactcctaggcctggcagcttacgctcagttctgtcgtagctaccttaatcctcctgtgtctcagtttcctcatctgtacaatggggaggtagcaaagtgcctgctacacaaggatgaggccctggatttggatctctaaccccatatgacccctagactcggcagacggatggatctctgagcttgtgggcctgtcagtctagctgattgagctcattcatggccagttcagtgagagctgctgtcacagaaaataaggatgtgaggtgtagtgcacacatctttaattccagtacttgggaggccaaggcaggagaatctcttgagtttgaaggcagcctggtttacatactgagttccaggacagctatgtagactctgactcctaaatcaactcttctagtgggtgaaggcaggccacctgggccctggcctcctgcctccccttccttccgtctcacattattgttgtgtcccccttttagggacaggtcctgtactgtcctcaacgtggaaggtgatgcttttggggctggactgcttcagagttacgtggatcgaaccaagatgccgagctcagagcccgaattgatccaggtgaagaacgaggtgtctctgaatccactgcccctcgccacagaggaggggaatcccctcctgaaacagtaccagggacccaccggggactccagtgccacgttcgaaaaggaatctgtcatgtgaatatcaggagggactttctacgccctggtgacttcacgttggaagccgggtcttgcgagctggagaaatggactggatgagggctctaggggtgggctgtttacacactccaggaatctaggggtcggtgtctccttcctggagaggctattaggagccttgttgctggggtgcatatgcttatatgtgaatgtgtccacaaatcccaccccctctccgttctgtcccccattcaaggaatgacattctcagtcacccagagccatctggcctaccctctcaggaaatgggttgtcctgtagagttctctacccttttaaaggcaaaagtattgggatgcaatactatcttaatgtccctatctgtggtgtgtgtgcacttgctgtgaccttcccagtagtccctccatgacagaaaacactcccatgagtctcgagggaaagccaagaataaatgtcactccagaacacatttttttttagcaataaaatggtgtcaaatgtattgaccatggccctagagtctgagtaataccaggtgtgttgtcacatgtctttcctttctgcactggggaagcagcttccgaggttcgtgcctggggaaggacacgggcaggagattcagaagctaaagggcatcctgggctgtgacactgtcccaaaccttttatgctggacacagtgtcacacaccttcaatcctagtactgcggggcagaggaaggcagatacctgagttcgaccctggc

SEQ ID NO: 32182 - DNA, 1131 bp, Mus musculus
ggacgcttggctccagtgcttgcttcctccactagagggcacttctgtcccgcttcagttcgtgtttgatgaccgctcgcggctctgcttcatcaccttcatctctggttttcttggagtggctctgggaggtgggacagcactggccacctcctctcctccccgaatgtggcactttcctttgagagtgctgcttgatgtatctgctgcttctaaccccatcttgctcttggaggactgactgggctctctctggtttgggatctggccaatgcattacctctttatttcagccctctgcacctgttccccgccttccccctcccttctaggaagggataaaccttcgccatagctcacatttacaaagagctttcgggctcaggcatacactcggaagtgacagctgctattacgtccattttccggggaggaaaactgaggccaaaatgacagtcacttgccagtaatcagatattttaggaagtggctagtaagggacttgaattcagatcaccgtttcaaggcccacacttcatttcctctctaggttctgctgtagaaatagtacccaagtggagccttgccatggctgtgccactcaaacaggtttaaaaaaaaattctcatttaattatgcatataaattatgttcaaaccagtctgtatattgttaaataagacttaaattatgctactttaaagtttaaaaattcaagacaaatagagccgtttgtttccttgcttcattctacagcttgttccacacactccctgaatctccccacacccaccctgcaccccatgaggagcaggagtttaaggcaggtgtctaactttctaggccaaactggcttcaaacttacggtcctcctgtctctgcctgtggagcgctgggattacaagtgtgcaccacaatatctggtccaaaggaggaggaggatttttattggtggtccttgacccaacctctgtccttgctgcaaatcctaggcgagcctgcaagtcatagccctccctcctcagtctccctggcgctagggttacaggtctgtgccaccacgcccttgtcccggctttttatttatttttaaagcacaggaacagggatgtaggcctcgggtttttctag

SEQ ID NO: 32183 - DNA, 1453 bp, Mus musculus
cgcaagaagcatgaggaggccatccatgcagtggcctgccatcccagcaaggcacttattgccagtgctggtgctgatgccctagccaaggtcttcgtatgatcccacctggcctcgccctggctgcacagtgtcagggagcggggccaggcagtggggctgaggtaaggatcagggccatttgtgttctagataggaatgcagacacccagtgtccttgccccagaagacacccctatacccaccccacctccatgatccacttgcctgtcagttgggttgtgccaaagcccacagtcctgtgggataaatgaggcttcccggagaagatagagggaggaattggagctagtgaggggcactgtcctaaccagctgccttgcctttgtctctccaggcagcccccagcctcaccttcagaggctctgagtcttggcctctttcatcttcctggagcctggtggtgctaaaggccctttccccaggagtcacccctcaaggatggcctctggggtttctgctcatgccccaaccccaactcctgacatagctgtcgtcctgagtttgacacagcccaggctgggtgtcctttgggatctgattttgaccaagatgaaagaagatgccaggctccctcctagagtgccaccctccctcattcatcagatgaagggctgtgcagagaggggtctcctggggccctcctatgtgggccccaggttgtccttttggacctcagtccattcctcttgcttcccaacactaaccaagcctctggggccaggccttcctgggaagggcctccactcctctggggcattgtcctagccacaggccctccttgagatgtagagagagggtggagtgggccctgtgcccctagttctctgtatatctgtataaaggaatgggattttaatggcacccaccccacgttatcactgtgtgatagtctgtcagtctcctccttgctccacactttggcctctatttatttcactctttatttgggtcccaccttatgccctcggttcccctttcaggttcctgttcataagccccttcctttttgccccaacttgtatgtgaaaaaaattgtctcaataaaccctttggagtaagataggttttccaggccatctgtcaaggggatggtggacagtaggggaaggccactccctctgccttggttgagtggagtctggagagagggatatatggtagattgggggtctgtggtcgactgggatggggaacgaggtgacatgtgtggggggggtggaaatggaagcacatggccacatctccatgatcctccccttcctgtccctcaacttgtgctcccccgcgcagtgagctagggagcagatgctgggatggagcagtgaacatttagttgaagaccccttgcctgctcaggggctgagaacaaaagcccctttcctgccccatg

SEQ ID NO: 32184 - DNA, 1133 bp, Mus musculus
ctccgtgggccacactctccccatctgtacaatgggtgtacgcaaatgcagtaattctgttcgggtctctcctccttcacccccgttttaattttagaagcttagtctgttctccacttctctgacatagccttctcattcctcttttccttgcccagatagggtccccttctcattcacaaagtgccccctccatgtccctggacccttaggataccccctggggcccccaagtcagagactgtctgactcaggttatgcctacagagtgccatgccctggaagaggaagtggcactgtcttaggggctttgagggtcaagtaggagttgccaacacctggaaaggactctttctgctccatccttggacagtcatggggaattgggaggttagagagaggaaggaagatggtttcaatctcgtgcctctccccacggggggtgggggacgctgaatgaccctcagctgttccaatccagtgggtttttttgatttgtttgtttttgtttttttttttttattaaagaaattactgtatttattatgacaatggtgactccccggtgcatggggggccagattctgtgtgtttctctaacctctttgtaaataaatgcacagtgttacatacccctggattcttgttctgcactgaatgagagctgcgtccctttcaacctgcatgtatggagcgccttcagtttgctgtggagcggcagtgagcccagccaggtggtgggcaccaggctgaatttgaatgtcgcttcacggccatttttctttcccagtgactctgactttctagttatatctggacattgttatgtattcctaagaagggcaagtgaagaccagggctggggcgttggctcagtgggtcaagcccttgccgtaccggcgtgaggatgtgagtgctggtcctcagacgccttggaaagcctgactcactagtgttcatatgcgaccccagtgctcctgtggagacaggagacttcctgggagctcaagggccagccaccctggtatatgaagtgctaaactgcagactatggcgaggtagaaggcaagggccggcaccctggcttgtcctcaggtctccacacatgaagcactgtttgtgtgtacctcata

SEQ ID NO: 32185 - DNA, 2412 bp, Mus musculus
ctttgacaaggtaagcagtcagccctaggacagatgtcaaacagcaaagccacagtgcccaccccacccccgcttcagagccccctcacccagtgctgtgtgggggtggcagttgacagtccctgccctctgcagccctaccagcaggggagcctgagtgacaagcctttttccccaacccccaggatgggaatggctatattagcgctgccgagctgcgtcacgtcatgacgaacctgggggagaagctgacagatgaggaagtggatgagatgatccgagaggccgacattgatggagatggccaggtcaattatgaaggtgagttgcattgggctcatcgtccgtgtcccagagctgggaggactgtgagggctcagccggtgactgacggactcaaccctgttatctcttggcagagtttgtacagatgatgactgcgaagtgaaggcccgggcagctggccatgcccgttctcctgatctcttctcgcgctctcctctcttcaacactcccctgcgtacccggttctagcaaacagcaattgattgactgagaatctgataaagcaccaaaagatttgtcccaagctgcatgactgctctctctccttcctcctgactgtccctccacgccctcaccgcttcctttggccttccccttccattcccagtctccaggcctgatgcattcacaaggtgaaccccattgccctgccctggggagcctctgccctcctcctccagcccggatggctctcctccggttttggtttgtttccttttgtttgcccttcttttgggtgccggggtggccaccattcctgtccctgctcagtggggaggggagcaaggccttctgccaggtggaggagcatgtcccctgccactgtcgcatgcaccccagccctgtgactctgtgtgcaagcccagcagcctgtggggcggggtgccaagaggggatgacgggacgttccaggaccgagggagttgaggatgtgacccaggacggggggcgggggggggggttgtgtgtgtggaagggtgggaagaggcaggaaggccttggaagctaacatgctttcgctactggagggggactgcatagagtggacggcactcgggtctcgctgccgctgttctgaaaccatctggctggctttctgaggtcaggctgggtggggggctgtcatcggccatgctgccgatcatactcgccctcctcatccctccagccatgtcccgctgttctgtaaatacctggtgctaacatcccatgccgctcccccgtggcacccccagccacctgcccagttcagggctggtccaggaatggatgtgggggatggtcgctgtgtaatgtgccggtgatctttttttccccttcccctttatgccccttaaaactttgatttttgtcctaaacatgccgggccaactaaagggtggggagaggagagatgcgccccaccatgctcacaagaaccaacctgcaataaacacttctatgggccgccgcgcagagcacgcagcgggcacctcctgcccctccgtggtgacttggcatcgctttctgccctcgccctgcctgccccactccccagcggagagcatgatccgcacccttgcttctgactctagcctctgggacacgtcagtcaacgcgggcagttcggtctgggttcctttcctttctctgttctcatctggccccccagggtgatcttgttgctttttgctgggacctgccagctttgagactctccaccccttggcaccagccttaagggagggagggacagagcaaatcaggagacccagcctagagttgagggcaagggcaggtaggcgtgaggctgtggactttgcggaatgtttcggggttttattttggttttttgtttttccttttttttttttttttttaaacaaacaaacaaaccgggcaatattgtgttcagttcaagctgtgaagaaaaatatatatcaatgttttccaataaaatacagtgactacctgtctggactcttccgtctgtcctcagccttcctctgtggacaggtcgccaagagcaaggcgctgccctggctgggcagtcagggtctgtgtatgaagactgcgaagaacggcccgtcaccaggagagcagctgaaggaccctgactcaggagaaggaaggatgctacagccagaggaactacagagaccttgtgacaggagaggacatgggtggggagcagaggatgacagggccttcgtactcacggtgggtctcacaggtggccacctgggtatgccacccaggagcctggaggggcactaacggcatctgtagtagcaggagtgctgcaaaggggattcgacttgaagtgaaaagcagagcagctttgtccctgagttcgaggccagcctg

SEQ ID NO: 32186 - DNA, 1099 bp, Mus musculus
ctgcctgcccatccttccagacaccggtttctggccgaacagttgggatttgctgtgagccacctctggccctgactgggccttagggagaagcaagagtgttgggcactatgggcattagggggtcttggaagggttaagggccgtgtgtgcgtgtgtgtgttcgcgcgcatgtgtgcacgcgtgtgtgtgcatgcgtgttcgcgcgcgtgtgtgtgcgtgtgtgttgaggggaaagtattccataaatgaaagtttgtgagggctgagaactggaggaggaataaaaatgggaggagaggaggggaatgctggggggcggggctggaggaagagggagaagaggggcagggaggaagagggaaggaagggaaggcgttggcattagcttactctcctgaggctctgcaggtgggaaagaggggaagccaactcccccacccccacccccaccccaccctagcccttgtccacgggttgaattggtaatataccctgccaaaatgttctgctttggaaaacttaggtgaaatccagatttctgggtttctaggcaagccctgccccctcctactgtgactccccagctgtcactggccactcctcagctgtctgcccttgtaactcttgacttaatataacaatggagtcccttgttcacccctctccccactgtgtgcagtatataccccagatctccttaaagggtcaagtgtccctatcatgtaagaagcagttgctgtgccccaccctggcctcattggtccctaactaagcctgactgctgctggccaggctccagccctcagctgtccctgagagcagccgcctcagctgtgtgttttcctgtagtgctacgtgccagaagccccggctgggctgcccagctccgtgtttccatgtgtagataatgctttgccctgcacagcactttgaaaccctcttgttcccgcgtgtgcgaatgtgtgcgtgtgtgtgcgtgtgttcaactttctatccccaggaagtgaccggttcgtggtacctggaccctctaggatggaacagaagttctgaccagcctcacacccagaccgtccagctcctcagtggggacata

SEQ ID NO: 32187 - DNA, 1196 bp, Mus musculus
tcccccacctttccgtggctttcctccagcccttcactgtggtttctttggcaccaccatctctccatggcaagtgtgtctccctcttctctcctctcctctgcatccccttcctgtctcagacctcgctccctccctctgttccccaccttctcataatctccagccccaaccacacaagcccctctgcccctgttcctacagtgaccagatgggaaacaaagcctcctacatccacctccagggctccgacctgcggccccagttccaccaattcacagcagtggtgagtgacctgggacagggcactgcctgggcgagtgctttgtatgggcaagtctcctgactgtctctctccttctgtccctgctgcagcctcaccccaatgtcaagcccatggcatacgccaacacgcttctgcagctaggaatgatgtgaggctgtcagcagcagtgagccgggacttgcccagctgaatggccccgccctcggcctgctgccccgccccagggcaacgttggacccccttttactttgtaaagtttgtatttattcccctttaggttgcagagggggtgggggcagcgtggggcagcagacgacaggctcctggtcagagaaaggagactggaggtagggcacagcctgggcatttggaggaaggccagcctgggtaggggtggggccaagaggaggtcttgccccttcacctgcatggctcctcccctggtaaagcaataggaccctgccataggaagaccccaaaagagggtcatcagggaggcctcctcctggtagcctcagggtggggcaaggctggggcccaccccccagctattttatgttctgtaattaactatgttaaaataaaataaagtcattattgtaagtcaaacctcatctcaaacccacctcgacgtgtgtccaccacgtacaagcccctccagggtgggtacagtttggttctgggtgcccctcagtgatgtggacatcacaggacaagagtcaccacagaagtatcgtcggacccctgagacctgtgcaggctgcaggctgacctcagacccctcagaagcctctgttctagctgagctttgcaaggaaacggcatagtgggtggagcatgcggagccttctgaaccctcatctcccaacagcaccgcaaagtccatgctcagtgctctgggctcccaagc

SEQ ID NO: 32188 - DNA, 1230 bp, Mus musculus
ccgtggcaaatgtgggaagactctgggtcagatttcacctcaaacaacttatggagtctcagccttccaactgccccccagctctgcttgccatgtctgctcctgacttcatgctggccccagacgctgcctaaataatgacttcatttgtgatcttcctgtgttagggggagccagcgacttcctccactccacagacctataatctctggatcttgaatacttgactcccacctttactgtttgtagactgtgcaacttctagccttccctggacctaggctataccactttctctcttccttgcacctagacatgtagctcctggtctttgttggctctagactgaaaacccttgggccttctctggttctagagatctctgggttctctgattctagactttctacttcttggttctaaaacatacaatccatggcttttccctggctctctgactccatatttctcatcttttttctgtttctagaatgtgaaacctgtgagcttcattggctgtagactgtaccaccagtggtctcctctagtttgtgactcatgacctctggccttcccttgttctagacactgtggcctctggcctccatggttctaaactgtgttgttcctgccttcttttgttctagactgttcaatctctgacattctctagttctagtctgtacagtctccagtcttttacctgactctagactgcaggcctttggacctggctctggttctagaccatgccacttctctggccttttctctgattctagactttaggccctctggttttctgtggttctagaacaggggttctcaaccttcctaatgctgcaaccctctaatacagtttctcatgttgtagtgaccactgactataaatttatttcattgctgcttcataactgtaattttgcatctgttatgaatcataatgtaaatatctggtatgcaggatatctgatatctgatcctcaaagtggtcacagcccacagattgagagctgctgttctagactctacagcctatgagcttctttgattctaggttatgctgcctctggtcttcactggttctaaactagatgaccactagccttctctggcattccctggttctagactgtgctgtcattgacttccccctggttctacactgtgttatcattggcttcccccctggttctagacagcatcatttccaacatggtctgttaaaga

SEQ ID NO: 32189 - DNA, 1266 bp, Mus musculus
ttctaaagactaaaattccttttgtgcttaaaattcagctgagagcaacagctctcaaagctgttctccagctactctctgaaccagctcccgacaggaggccggagactagcctcagctttacaatttgcatttgaataaagtacctagacttccccgaaagaagttctgctttcctactttctcactgtctttcaagattttgtctttcaagcaggtaaatcaacattcccgaggcggaccagtggatgtgcatccccgccccccctagagcacacaggtggcagctgttacccccagtctcaggacatttccagcacgtggttttcagtctgagttaaaaatttaggtttacctagagggcaagaagagcagatatttccatattaataaagattggtttttattttgatagacaggcttagccccttagctgacctctggcttttcacccttgctgttactgcaaggtgtccttagctcaataggctgtagaaaaaacagggatgaggaggaacgacttccagctcctattttagccacaaatcgtggtgttactaacgacataattcttgcttgggctttgctaattctgaggttgataattctcctttaggagctacacaacactcagaactgtgcatactggtttgtgattgtacaaattcagtatgggcactgcttggtgcagagatacttactgcaagggaaggtccggcttgaccatttctgagtttcctgtgagataaacccggtttaaaagaggttggtaccaaattttggttaaaaataaaaaatattctccggctctacctcgtctccccaaaaggtaccgagagccacatgtgtgggttttacccacgggaggaatcgggtccatgtccacccaagccaaggttaaaagcccactcatctacggatgagaaaatcatttgatcacctcagttaagcgttgccttatttaacttaattaataggggagagagagattggagacgtactattgaaagggcaagcccttcactgcctcccacccaaataaaagagccggtcgaacgccttctccctgtttcccacctatcttccaaaaatgcggaggaattcaacttagtgttattttcacatcgttcagtcaaacttagccagagttccaacgccctacttaaaattcaactagaaagttacctaccaagtactaattagcattataaagtcagagtctgcagctccaggcctttcagttagttgtttactagaaaggacagt

SEQ ID NO: 32190 - DNA, 1169 bp, Mus musculus
tggtgttgctgtgttttggggatagggcttctgtgttgggatcttgttatgcaacccaggctggcctcaaagttttggcaacatttcctgcctctgtctgagtgctgggatagctagctggtgtgcaccatcatgcagagccgagagtcagttcctggatctaccgatgatctcgggagaatgcgctcactgttctgagcctcattccttgtctgaaagatgagtttaaaaatgatgccttcctaccagagctgttagcgagggttgaacagataatagcataggaagcacggagaactgggttgagtgtggccgtcccggtacttgggaggctgaatcctgagttctgagccagagtggaacccactctccaaagaccaagattggagagagcgctggctgcccttctggaggacctggttcaattcccagcaaccacatggcagcccacaactctctgtaactccagctccagaggcaacgctgtcttttggcctctgtagacaccaggtgtgcctctaggtctctgtcttgtccccattttcaggaccctggccatggaccagcccgctggcctgcaggtggactacatcttccggggtgtggagcacgctgtgcgggttgtggtttctgggcaggtgctggagctggaggtggaggaccggatgacagctgaccagtggcgtggagagtttgatgccaactgtgagtgtgcttgcgggggtgggctccccttcctcccggagctgaggctgagccaagctgtgtgtgttcttgcctcttctgaagctcttcaaggcggggcaggagtgtggctcccattgatctggccagaggcaacgggggtgggcagagctggagaacttactccagcatattgcctttgtgctgggcaagtggtcagacctcaggaagaacttttctttccactcagtcattgaagacttgactcataagacggggaactttaaacagttcagcattttctgtaacatgctggagtcggccctcacccaggtaaggaccagtttcagggtcggggaggtttctgttacccagagtttggggtgtggggctgtggatggctacctggtgtaggcagggtgcttggtcttcagaccttctcttgcacatgccagggggtctgattctctctctctctctctctc

SEQ ID NO: 32191 - DNA, 6073 bp, Mus musculus
gaggaggggagggagccttcaggtcacctggaatgaggtgcctctcccaaacacaacatcctgcctctctgattgcagttccagaacctggggaagagacccaagtaggagtagaggtagccacccaggagtcagagctgaagtgaggggtttcaaacatagacactcaccccggtccgagcccccaggatccccacatttcctcagctcctctctccccctgcagtattccctggaatggaagtgtaactttctccgttgagcagagctattcctgctgggaatgactccagctctgggatgctgcaggtcctgtgagccacactattgtgcgaggcccaggagcagctggctgtaacatcttagggctcttcctagaggaacgagggtccgtgttgtgatgtcactgaatcaagtatttaccgggtgcttccagtaactccctatgatgtcataggaaggatttcctcagaggctacttccggtactggttagagaaaatcatttcctgtgaggtcccaacaaaaggcctcaaaggtcgcttctgtagatggcagaggcatgtacttcctgtggaatctcgaggtcacttcctgtggcatcatagggatgaagcatgcgcttccggtgttggacagtggccagtccctaagattccccctcctccctctacactcctctttggtgggtgttggccctgggtgagggggaatccttaggaagaatgggacttgggtttaacatggaagattgtaagggggaaaaaaaatcctgtcagggttatctctgtccagacacgctatctgtgaacttgccttgacaggcacgaatgggagacgaagctagtgaaaatgaatgattgctaaagatccccccttccccacccctgccttttgtgtgcatgcctgtgtctacgtggtttcatttcattgatggatgagccaaatgtatggtggctctgtcaggccagtgtgatctggtgtagagttcagtgagccttgcaaagtttagggtatctcgggctgaaatgccttgcgcagtctgccgaatttgaagcttggcggcttccagggagctggtgtatgttgacgatcttgattggtcagaaatgttccagtgtgctcagccttattagactcagaggagctaggagattctctggaagtacgacaaaccaggctaccctgggagttgtcttgggagtggctcacttggcatggtggctctggtcagctctgaagagtcagggcctgaaaaacctatagactaggattgctgagacatccccctgtcccctaacatcgccccctctctgttggagagcaccttcaatttcctccaaccccaagcagggtcctcagagccctgtctccatcatcagcatctctgggggagggacaccccatgcccactccctcctccatccattcctaggtcttccagaccctgctcttctccatggctttggggatatctggcctccttgtttctatccctacaaaggagctgggaggagagagaccacccagatgatgcctactacagccttcaagcctgggaggccccccctaccccgtgctagagagccaccccaaaatcaaaatgtgaaaatccctagaaagcaatagccttcgaggtacctcgcactgactccccctcccccagcccttccacaggaatgggaggctatggcttgagcactggggtgacttttttccatgtcctcatctccccagtgaggggcaggccccatttccttgacacacccccatctcccacctcctatcgctgctgcccctttatccctaatctccaccctgagcccagatggagattttagtgccaaaacaattcttgataccactttgtacatatcttctacagttggggctgctgagattggaggtgggggccggcccacagggccattgctcccctccacctcttaaatgaccttacagtatttcatgtagctccacctgcatgtgggtagtaaagtatctagctggaatccccccccccccgcgcgcgcgcgcccgtaaaaccctcaggctccatgaggaggggaaggaataggggtgaagcaatgtccaggatgggtaggtgggataaagacactctatttgtaaatcatctgtgccctctcttggacagcctgctttccataagcccattggctggagtctgggtccattccctgtgtgacatgcccgtgttctcagggatccattcccccaccagccagggctatctgaaaagtagtttgctagcttagtaagctggtccactcaccatgttggtgagtgaggagtggcacacctccccacccgcattgtaccctgggaaattccatcatcttccctatcccttgaaaatcccttctgaaatccaacctcagtctttctgtactgtagttggtccagaagggatacataatgcaggtcagggatgagaattacttttaaaataatagtaataacaaagctcattccccgccccttctgcctgttagccaatcagatcgcaaaggatctgaccggcctccttgcatcccactcttcagcaccagtaggtgcttagtaagatagttaagtgttgcctgcattgaactgtctcatctgccctcctgcttccgatacccctgcccccagcattctcctctgcctccctaaggcccactgggttttcctcttgtggttgcccctcccccacggttctctgtcctgtctctacctttgtctgtattcttctcctcctgaattctcgactctcatttcccctttaaaagcaaaaagtgccaaacttcctcggaactgagccgatctggggtggggggatgaggatcttagatggagggaggaaaccacctctcttagaggggggggggccttaagaggcaaagaaaacactttaggatgctgagctaaattggatccccttcctcgttcctctcaccctgagttttttcttagaatctttataagaaaaaaagaaaaagaaaaaaaaaacattttcaactaacccctacttttttggattcctctcccccaaattccaccagccaaggagaaccccctttgcctttctctgggcaaatccattgaaactggggatggagagaaagactccaccctcttttgctagcccaacggggtggctgctggggaaggacctcaaagcatgacaagaggggttcgaaagtgccaaatttcaccttcttcatcctgtcttgggcagggctctgagccagcctgcccggtcatcagctttgccctctcccagccatctctccgtgggcgggaaaattttgccgcaataattagcagggcagggatcggaaggcagggattttgcagtctctgtctgtactggacttggaggtgggaattatgggagcgtggcaagagtctttaaaatggttggggacctatactcggaatattacggtaccacttgttttcccacggtatttttttttttttcctctctccactcttgaccaaccaaatcccttggaatatcggacctccgttcccacctcagttctgtttcttcagcccgcccctgtggccaacaccatccttattactttatggctagctggtctccagctatttgaaaaaggagaggaggttctcccttgcatggactcttgctgtttcgagcctaacaggttaatttgcaaaagcgttcaccagagcagcggtgaaggtggcaatctaggcgtccaggatgctccactaggttgtacacctgtcggacagccagacaggccttctgcccagggcatcagccccaagcgccatccggaattgaggccggcgtcgtcaaaacctgaactggttgtcaccatgggggagcacagaaccgcaatacccaggtcggggggcagagaagcctggtttacgctttgtggagtgtggacaccgagccttgcggtccgagccctctctccaccacagtcagcggtctcgatgccccagctggtgtgtccgttccatcgggtccccacggctatcatcggaggcatagacaacctcccgcttagtggcaggagggagggaaagtctctggagggtggtggtggtgaagactgctggtttttaaccccttctcagacagtctaggacactggtctccttagaattaatatagggagaccctcctccttcctcccttccccccaccccctcccaccccccacaaaaccaccaacctctcatcttctaagtgactccatcaccaccggccaccacgggaacctgcggcctcattgctccagcccgccccactcgaccgtcagactcgctccatcgaactcttttaattaaccctttctgtgttcatcccacggaaaacctgtgtgtctggcagggaagccaggggggtggatgctaagggcagttgctaccttccctccatctcctcccagcgcccatgcctccccatgccatgccccaatccttatccctcaccccttaggatccgcctcccctgggggcacagggatcttctagaaatacctttgcagtttggctttgcaaaggccggcctagggggcgtggcctccccatcggagcgctcactctgactgtcctccccgttgcccccacccactccccacgccttcattgtaaatagtcacttttgtacttggtttgagccaggcgacgtggggagtgtctctctctttctctctctctctctctctctctctctctctctctctctctctctctctcttatttgtgttggcatctcaactcctggaggcatggtccacatcccggttcgatttgggagaaacccaaggtgtgccccgccaaaatgttaaggatctcgagagaacagtattaactcggacagctggctggggtgcacaggtcctccgaccgggaggagggagagaaagcctttgttcttgagatcctgtgaaatgggttcgttctccgagctttctgaagaaccttggtggagctgagaattgaatctctcctctgcttcctctgttggaggctggctcaaaaagaatggctttgggatggggcagtctttggagaattgactgctgaattcttcctgggacctgaagctaacctctggtaggcttgttttcttgcaaagaggtagtcagatgaacatccctctccaaccgttagaggaaaggtccaagccccgcggctggccctgcctgctgccactctgccgcattatagtttgcgggtgggacgggcagtgaagtggccatgcctccagtttctccattcaaacccctcttaactgatttccttccatcctctttgaccagcgccgccgcccacttcctctctgccacctccagaagctcttggctggggtcaccgcactctcttccctatccccccatcgccatgcctgggccatgcccacatctcccacccactcacccaccccccagtgtccgttgtgtgacctagtgcaccatgtattagcttccatggacccccccccccacctacccactccccgctcccaccacacccctcccccaccccttctccctcggcgacttcacctttttttgccgcgataaacgtcatctcagcatctgtgtctaatgttgtcttttttgcttggcatcacacacgccttcttaacccatccccttccctctccctcctccctgacacctccaccctcatcctcaactcttttcccctttgtcccccatcccccacccagggctctgggcatttaagggaggggggacctttaaggatggtctcagaggagggaggggtgtgttctctgatttgggtgaacaaatgagagtaagcatggccaaagaaagtaagtgtttcaaggctgaacttgtccatccaatatccagtcctgggaaccatggtcaccagcagccacacatacacagaacccacagacagctcctggacacccgtgtccactgggagcagctcctcgactccagtagcaccagaatagcccggggccaggtgcttggagcgatgcaagaccccacctcagacccctgagattttgcccatctgagccaccaaccttgccaactgtagaatga

SEQ ID NO: 32192 - DNA, 1223 bp, Mus musculus
ggtgcacagcaggggcacctggcggcgttccggggggcgccatggcgtccgtgcaagcgtcccgccgccagtggtgctacctgtgcgacctgcccaagatgccgtgggccatggtgtgggacttcagcgaggctgtgtgccgcgggtgcgtgaatttcgagggcgcggaccgcatcgagctgctcatcgacgccgcccgccagctcaagcgcagccacgtgctccccgagggccgctcgcccggacccccggctctcaagcacccgacttccaaggacctagcctccacgggctcccagggctcccagttgccacccccgcaggcccaggcgcagccatcggggaccggcggtagcgtctcaggcccggaccgctatgacagggctacttcatccagccgcctggcgctgccttcgccggctttggagtacaccctggggtcccgcttggccaacgggctgggccgcgaggaggccgtggcggaaggggcacgcagggctttgcttggctccatccccagcttgatgccccccgggctgctggcagctgcagtgtctggccttggaggccgagctctgacgctggcacctggcttaagccccgctcgtccacttttcggctccgatttcgagaaggagaagcagcagaggaatgcggactgcttggcagaactgaacgaggccatgcggggccgggcggaggagtggcatgggcgtcccaaggctgtaagggaacagctactggctctgtccgcctgtgcccctttcaatgttcgattcaagaaggaccacgggctggtgggacgggtgttcgcctttgatgccactgcccgccctccgggctatgagttcgagctgaagctcttcaccgaatacccctgtggttctggcaatgtttacgcgggggtccttgcagtggctcgccagatgtttcatgatgctcttcgagagccagggaaggccctggcctcatcgggcttcaagtacctcgagtatgaacggcgccatggttcaggggaatggcgccagttaggagagctgcttacggatggggtccgcagcttccgagagcctgctcctgcggaggccctgccccagcagtacccagaaccggcccctgctgctctgtgtggcccacctccaagagccccatcccgaaacctggcgcccactccacgccgtcgcaaagcatcccctgagcccgagggcgagacagctgggaag

SEQ ID NO: 32193 - DNA, 1184 bp, Mus musculus
gcctacgccatctgagcccgaggcccagagtggggatgatgtggggggtctggactgcgcctcacctccttcgtccacaccttatttcagcggcctggagctcccgggggaactaaagttggatgcgccctataacttcaaccaccctttctctatcaacaacctgatgtcagaacagacatcgacaccttccaaactggatgtggggtttgggggctacggggctgagagtggggagcctggagtctactaccagagcctctattcccgctctctgcttaatgcatcctagcagcgcaattgggaacgccatgatgggcgtgggctgcaacgttcttgggctctgatctttctggttacactttgcttgtcccattaattaacatcttatttggtctattactgtgatatgacccattggctactgtggtaactgccatggactctttggtaggcctagggttggggtattaggaaggcagatgcgtttggaagtgctgcgaaggtggtcatgttggacatattgtgaaggcagttagactggtgtactatgaaagctgccatattaagtgaagccattgggtgattgatccactgggtgcctgatggtcgtgatgttggatgacacatgtctggtcctttggatgatgtgttggacatcttgattgaccttttgagtatgtgacagaacacatcttctttggctcattttatcctgggatcgcctcttttttttcctcttctttttctttttctttttctttttttcttttccttttttcttttttttttcttttttggcagacttcttggttcagcagatgccaaattggccaccatatcacatggtgtcttttttgacattctggatgcatggaaggtcactgtattggcaaggtgacatctcagcatgctgctatgcaccaagatagatggttaccacaggcctgccatcaccatctccttggtggaggttgggtgaggggaagaggtgagcagaccctatgagttttctctgaagcccatccccaccctgtctgtgagaaagggctagtgtgggtgtcgggagttcctactgaggtcaagttcttgtctggggcttgggaatactgcctgtgtttggccattaaaaaggcaccatctccatctcttagtgtctttttcttggtggaccctgtgaggct

SEQ ID NO: 32194 - DNA, 1111 bp, Mus musculus
taaagactgtttataattagcatgcctcagtagcatacacctgtcatcccaggaggcagcggtaggaagtcagggtcagggtcatccttggatgtatagtgagtttgaggacagcctggggtgcatgagaccctgacctgcaaacctctaatgggccagtgagacagctcgggggtgaacgtgtttgctgtcaaacccaaagtgtgatccctggaaggagaaaactgcacacatgtgccctggcatatgcatgtgtatccccatacagataaataagatgtaaccatgaggacttgtgttccaatctataatgtccacagagaagccaaggtgatgtgcacccaaaccacagcattggataggacaggcacatgtaggttctgggcattttcctggtcaaccagtcttgctgaaacagccagctctgggttccatgggtaatctgttttagaaagtaatgtgggtctggctaaatggccctcagctggtaaagttacttgctgcctgtcccaaagacctgagtttttcgtccctgggacccattggaaagaaccaactccacaaaagggtcctctgacctctgtacacatatacacgcacaacacataaataaaatgtagaaaaagaaaacagggcagagtgggagcacacacattgagtccaggccaaccagggctacacagagatactcttgtctcattaaaaaataaagtggagccctgccgtggtggcgcatgtctttaatcccagcactcgggaggcagaggcaggtggatttctgggttcaaggccagcctggtctacacagagaaatcctgcagcaaaagaaaaaataaataagcaaacaaataaataaatagagaagtgaagatacaagtctgccttccatgtgtgtatgcagtctagcacaccagtacacacataccacacaagcacactcatgcatgccacacaaacattaagagaacctgcttgtgatacataccttgaggctgtgacaacggctgtgcctctggaatgaaatagtctggctccatccttggatcatttgttaggtgggctacatagtgtggtaggtgctgtgcgtgtacagcggagcctggggtcaggt

SEQ ID NO: 32195 - DNA, 1206 bp, Mus musculus
acaggtgacaaaagagagtcttctcgatcctttccctatgcagtgaagtgcctggttacttactgcctccttacctaggagcctggggtggcttgctgataatgatagcttgtttcttctttgtccactgacacatgatgtgagactgctatgtttatgcttcttcatgctgcctcccttgattggttggttgactgatgagtcattgattgatttggttgtttagagagaatgtctcaccaggctggccttcaacttgagcgctctgggtactggaattatagatgttagccactgtacccaattgcactgggcattcctgaccctggctgcaggagtgcaaggcacgattgaagtctgccccagtggccagccacactgccacatgtgctcacctacttacttctaggtgcgcatcaagatcctggccagcctcgtaacacagttcgactccggattcaaggcagaggtgctgtcctttatcctggaagatgtccgggcccgtctggacctggcttttgcctggctctaccaggaatataatgcctacctggcagcagggacctcaggcactctggacaaatatgaggattgcctcatctgcctgctctctggactacaagagaaaccagaccagaaagatgggtaatgggttggccataagccccatgtcccctccagtgtctcatttctcttttctccttggtgccacccaagcttgacctctcgccctctccatgtccctctctgtgaagtgtgtgcagaccatgctggggatgggggtggggtgttccgactctgctacttggtctgagtgacctgtcaccctctgggcttcatattcccatgtgtactgacagttcccagagatgggacagtggctcagtggtgagcaccaccctggcatgaagcccttagttgcatcccgttctagcaaaaggaagaaagtgtcagagagggagcacctgcgctccatctgccagtcagcagctttcaggcaccagactctaacctgcctaaagctgggccccagggtcggggaagctgttgtgagcttggggccacaacatgtggctgccttgcaagacctggtctttcttgggcaggatctttaccaaggtggttttggaggccccactgatcactgagagtgccttggaggtgatacggaagtactgtgaggatgaggtgagctggctgccgctc

SEQ ID NO: 32196 - DNA, 1112 bp, Mus musculus
aagtggaccccagtttcttttctctccactgtcgtcccctgtatgcccaggacacctggggccacattactgtggaagtgctactctgggtcagtggagacggccgagctgtttgttcctagctaggacagcagctttaggcctggggggcagatcccagctggggcagcagctccaaggcctttgggtggctccttctccgggttctggcagaagcccaggtgctgtctaatccacctttctcctcttgttctccccagggcatctcctcccaaccaggcagctcccccagtggcactgtggtgtgaaatgtggatgtcccatgttcccggcctcctagccataaccctccccgctgacctcaagaatcactgtattaacaagactaatcatgatggaaggactgctccaagccccacgctgcacacatactgggggtcccctaggttggcccagccatggggatgtagtgtcctgtgtggccttggccctgtcctccacccactgccaagtacaatgacctgttctctgaaacatcagtgttaaccatatccctgtcccagcatgtgactgttcactcctgggagagacttagcccacagtacccctgggtgagagggcagggcaggggccatccccactcctgcccaaactccaccccttgctatggtctgtgattttgaaagtgttaaattatggaagccctgagggccctccttgttcccctggacctcttatttatactaaagtccttgtttgcacagtgtttctgttccctggggcagggtagggtgggggttgcagtacttggcctccaagctgtgctctgaccaaaggaagcccaatcttagctgtttccccatccctagccccgagcagagagccctctgaaagatgagtctcgacccccaaagtcaagaggctgagatggccttcctactaggtccttggagatgtttgaaacttgttttaaacaccaggactatccaagcatgctctccttggggagaggaggatgctggaattgactgcactccctgcctcctctgaacatgcctttgcagtctgctgcccctggcccatttatgactggccatctagtgccagctgga

SEQ ID NO: 32197 - DNA, 1180 bp, Mus musculus
taagccccacccttcaacctgattcgtgcgctttgcctcccctctagctcccactcaagccattggttgtctctattggactctccattggcctgcggggcggtttcctttccacaacagagatattgcgcgggatttagggcagaccagaagtattttattcgcaagggtcgggagtggaggtcgtaggtggggacagacaataaataccgaggaatgtcgagtctcaatgcatctaaaacgtgggtcccggagtctgtcagtgagtcagataacaagatcaataaatacccacactgctttgggggaggggggagtgcagctgtggctccgttgttagagtgcagacgtgtacacggggaaggagttgcagcaacccccaggagtgaggctgtccgaagccaaagactccgtgtgtgctggcagaggtcttgctgatccatcactatgggaatgggatgtccctggaaatagggggctcatgcttatggcttgtaactgatggctgggagagtgaaaaagtgaaatcggatgagctgagcagtttgcccatccacgtcggggctgagtaaagcaaggtcggcgaatgcccagctgctgcagcagcggtggctaccagctctgcaggaaccaggggtgctgggcacgagccctgttcctccctccccggccgccaggtggcaggcctggatcacaggagcggagctgggtggggacccaggctcacagaagtgtggagcggagcggtggggggggggggggggcgcgatgggcacagagacgctttgggtcgctccctggtcgctcgaccttcctaggaggcctaaatgaaagatggcttggagtcttagggttcagggggcgaaggtggctcccgggaaacaccagactggggtgagaccgccggtataggccaccaacccagtgcagcccagtgtggcggcagcagccagagcagcggcgaacaggagcaggcaacgcgcctcggataggccaggcctagggatctgcaggagagaaggttggattagcactaggctacaggggcccactggctcctgggagccgcccagcctatacccatagatgggcctctgagcgcatctctggtccccacagcccgcagctaaagttggtctgctcgcaagaaagagctcctgttggaactcgtcattggcta

SEQ ID NO: 32198 - DNA, 1375 bp, Mus musculus
catagtggcacgtgcctgtactcccaatactcaggaggcagagacaagtctgagttctggggcagccaggcttctacagtgagatgttgtggggtggggcggaggttcatggagagagatgattgaagtttaggttgcggatagaaagggccaaggtttggatgtaccatggtggcagatgacaagatataaggatagagtaaggtttgaaagaagaatcaactgccaggcatgatggtgagcctctgtcatctcagaccttaggcagtggagtcaggagaattgagaattcaaggtcagcggtgggtggaagaggttaggtagatgagccggggcaggctaccatggaaatgtctctcctgcctccagaaaagactgcaccagaaagggggctggggagacactggacagtgtggctttgatcacgtacatttccaacttgaacccatctcacccctgggttctctatccaggagtctcctcaataaacccaagagtgagatgaccccagaggagctgcagaagcgggaggaggaggaattcaacacaggtcccctctcagtgctcacgcagtcggtcaagaacaacacgcaagtgctcattaactgtcgcaacaacaagaagctgctgggccgggtgaaggcctttgacaggtgagtgctgtcttggggagggctgggtctgggtccgaggggcctgaaggaaaggtcattccagaaggataataaggtgggcacacacggtgacaaagcacctttaatctcagcactcggggaatcactatgagttggaggccagccagtgtctcatggcacgacctagctcaaaaatgtagaaagtggcgatgcttaacctttttataatacatatcttacgtgtttaggtgttttgtctgcatatgagtctgtatgctatggacatgtctagtagttatcagaatcccctggcaggaaattggactggaatttcgatatttgatttgtttatctgtagaccagacatcagtgtcaaatatcttgtattgctttgtagtttgttttgagacagggtctttactatgtagctcgaactggctacagatgtggcagaggctaaccttacacttctaatcctcctgctcccatctcccgagcgctgggattacaggattgcatgaagcatgccgtcctgctttattgttttagttagcatgggacttgccttgtgacttagccatacacatctggcactgtactttgctcttattcactgtcctcaagcaagcatttgtggaaagaactgatccaagtgtgaacaatggccacccggccccatgaggacaggactgtgcagcactggagtgcgcgtgttgggagccgtgtctaaccccagcacc

SEQ ID NO: 32199 - DNA, 1176 bp, Mus musculus
gcttggagagccccacctagcagggtcctgctttctttcagtctgttcttcctttcctcacagtgctaagaggctgtggctgtggctcagcgagttcagccgtgagttgtcgctccaggtcaggcctctctcccactgctgatccatctgaggatgttggcgctcagcccttgtgttgtgcttcactttgttctaagacagagcctcactctgtagccctgcctggcctggaactatgtggaccaggctagccttgaacttgagctccctacctctgcctcctcctcagtgctgggattaaaggtgtgcctggctgcctgccccttatcctcacagctaggaaggccattgtggctgctacagctgagagagtacagggaagaagtccccggcacttcagtagtcatgaagcagaagcccgccctgtagttcctgcctgtctcaggtgatccacactcctgggaggaagagacagccttacgttctgtccagttccttgatgcactgtgcagtgacggcaaatgtcttgttttgtttttttggcttttgaagacaaagtgttgtacagttctgggtgctggcctggaacttgtggccatcctcttgcttcggaggtcttttgagtgctaggattttagacttgtactgcaacttttcccgtggcctccattacaaagtgtgttacacgtgcttccaaggagctgagggtgacattgggcaggaagaccctggttcacttgtgtttatttctttctagtgtgctgctcattttcctagtttgccacatgcaataagcaagactgtggtccttcaaagatgcccacttttgtattagttgtattctcatcactgtaaccaaatacctgaggcagactaattgtataaagaaaagaggtttatttagctcagagcctgggtatcatttgcatcggctcagctcttttcatggcctacttgctgttctgggacatcactgtgtctgtggctcgtctctgcttataatgccatcaggattctgcaattctgtccttgacttccatcctagtgatcttagggcctagaggctccacttttgagtctttaccgtctaagtctgtactctcttaaccactagcagaaatttctggggactacactcctgctggagctctagggggaaaaacactcgaaggttag

SEQ ID NO: 32200 - DNA, 2428 bp, Mus musculus
accccatttcctccctaggcacagacggatcctagctggctcgattctgacctgtctcagtcgcagccccgctgccctatcctgaaatgtccctgaaccttgtttcgggtggcacatatttcctcctgtccttctgtggtatttttcagttgggtgggttagatgtcacacacacacctgtctgacccttcataccccttaggtctgggtccctctaccctttctgttgccccaccttccttgctcgatccccccagacatgacttactgctgggaatgtgatggaggaaacagagtaacctgttctcccaccgttctggaagccagcggcagaggtcagggtgtttgggccccactttcttctggcttcaggggccccagatctcctagactctgtgtcctgtcttcatgtggctttctcttcccccacctgtctcttgcaaggacacctgccctgaatacaagacccaccctaaatttaggatgaccatattgaaagagcctttattacatctctgaagaccctttttctaaatggagacacacaggccccaggattcagacatggagttttcttttgaaggccctctattcagcttgctgccttctgccattttaaaatgcaaggcccctactatgctgtttggctcttccggcagcctactcatggcttctggggttgggctaaccactatagctccagaaggattgtgggtgcagcagtcactgtcatggttgtccagttcctgatggagctgcagaataaggaggcctcctaaggatatatgaggggcataattaatacggaccttcaaactgggccagtgatcattaacaatagagaaatccgggcttggtagctcatatctgaaattccagcactctgaggctgaggcaggaatgagcctgggtcccatcgtgagttcctggacagcctgctgaaccacagggagagaccctgtctttaaaaaaaaaaaaaaaggcaaaaagtaaaaaagacaaccaagccagacagtggtgatacacgccattaatcccagcacttgggaagcagaggcaggtggattctgatcgagaccagcctggtctacagagtgagttccaggatagccagggctacacagagaaaccctgtctccaaaaaaacaaaacaaaagtaaaagaaaaaaagacaaccttggaggaaaggcagaggttttggctctgggggaaaaggagccgagactcatcctgtgaactcttcccacattgggaaactaaggctcaggaaaagggaagctaggtgacttggccaagaccccatagctcaggagggaccagaggacccagaagattctggctgcagggcaagatgagataaggcccaacctcttcccagtggccagaggcactgggttctgccctcttatcagaaaagccccaggccacacccaagatgtctgactataggtaacaggttcattctccctggcccttgtccctagaggtggcacttgtagggctcccccaaggggatgaaaatgacccatccccaggattccccagactgaaaccaatactgaaactgtacctcagtttcttctagaagaagctgaagttggtgtctttaaatttaggagcagctgagttaggtgaaagctgaactagggacagaggacacacatggctaggtgatgaggggaggacagagtgaggagccaggaaagctgcctgtttgccatggttacccctgtggagtcactaagagttccagggccagccctggccaccttgccctgggtcagtctatagcagttatggcaaagccaagaccggtgagggcgctgagctccatcaggtcagtccttactccaacagaccagcctcactggtggtgaagagccccataggaatggtttctctgcttgcttgggaggaaacaggcaccaagaggaaatgtcacctttgggtcacccaagcatgaaagtaggcctcggggcccaccctgacccagtggagccttcacatggtcctggtgtatgtggacatggcagcctctcccatgatgacagtgcaggaagccaccgtggtgtggtgtgtggttccagaagcctctggggcaggaggccagagcagctttcatggctctgactccctactcatgcaatgttacatatccccacaaagggagaaggaggacaataaatttatgaatgaagctggttgtcttcaattttatttgtgtgtgcttttaattgaaaaaaaatcaaagggggatggagagatggctgagaggttaagagcactgactgctcttccagaggacctgaattcaattcccagcaaccacatggtggctcacaaccatctgtaatgggatccaatgccctcttctggtgcatctgaaaacagggacagtgcactcacatatgcgacataaataaataaa

SEQ ID NO: 32201 - DNA, 1134 bp, Mus musculus
tacttaaaggtggaaattgatgagatcccttgcttaaccaagggtacccccatcccccaaaaaataaactgagaagtccacggagcgagttggagtggagaacctacacccccagatctctactaaagaatttgatagtggagacagctagagatcaaagaaaggccccttgtctcttccaccaagctttcccctccaactccggagtgaggctcagggtgcacccccacgccacaagaccgggaaaggagtgcaattgcggaagcccaaggttccgcgttgccttttaaacgctctccatcccccgcctggaggcgtccacggcccctttaaggcgcagggaattgtgggtacggggagtggaattttggaacgaaatgtagcaaagagagtacagtagtaagagtaaccgcgtaggtgcagccggccgagggggtgcgccggcgaggttcggacgctgcaccccgctttccatcgcaggggatcccagcacatcagaacaccggtgggaggaggcgcctgaagacccgccccggcccggtccacgttctccccaggaagctggactctatggggcgggaccccgagagagactgagcagaacctggagccagccccgcacccctgcacttccaatcaggggcgccccgggagcactccccgtgggcgcgccgcccgccctccgcgcagccatgaggtgagccccgaaccctccagccgggtcccagccgggagccggctccgcgccccgcctttgtccccctccccccctccagcgcatttggggctagatttaggggacacagcgctttgggcgtcccagatctgagccggtgccttctggaacgatctctaaatatcgacaccccgtttctccacactactccctaaaggcttggggcggtgccggctgaggttctcttgatggctttcaggtttaggggcgctctcgggactcagaatttgaagacttttggggggagcacctctgagttctcagatagtcagatcctcgcagggatgatctagtataagcgggctcagagttaccgcccccaaactcaaaaccaggtgggaggctggctagagaaccctagccctaaaactcttgagtctcaggttgtggttggaatt

SEQ ID NO: 32202 - DNA, 1330 bp, Mus musculus
caggtacacaggattgtcagcatgcacttgtacctgctgagcctccacagctcgtgtctttgacttagaatcatctaagcctctagattatagaatcctcatttctttcccgttgcagaagaagctccatctacagcctcttctacccccgattccacggaaggtaagtggagtggtgtgtgtgtgtgtgtgtgtgtgtgtgtgtgtgtgacaaggtgtcatgactggatagtctggagaggctgagaacccttcttctactgcaggagggaatgacgactcagattttcgggagctgcacacagcccgggaattctcagaggatgaagaggaggagaccacatcgcaggactggggcacccccagggagctgaccttttcctacattgccttcgacggcgtggtgggctctgggggccgtagggactcagttgttcgtcgtccccggccccagggacgttcagtctcagaaccacgggacccaccccaacagtccggcctgggtgacagcttggaaagcatccctagcctgagccagtccccagagccagggcgccgcggtgaccctgaccccgtgcctccagctgagcgcccgctggaggaactgaggctgcggctggaccagcttggctgggttgtccggagtgcgggatctggggaggattcggccaccagcagctccacccctctggaaaatgaggagcctgatggattggaggccagcgaggctggagaaggtgagatctcggaggtgtgtggagggtgtgtggctaaccaggatacatccaagaagaaagcaagctcatggctttccctctctctgacaccagagacgaatctggaactccgacttgctcagtctctacatttgcaacttgaggtcctgactcctcaacttagccctagctccgggaccccccaggcgcatactccatccccacaaagatctcaagattcgaactccggtcctgatgatgagcctctgctgaatgtggtagaagagcattggcggctgctggagcaggagccaatcacggcccagtgcctcgatagcacagaccaatcagaattcatgttggagccgctccttctaggtaagcagtttgtgagcaaaggacttggctacggaggaccatgtacagctatgacagaggtgaagagatttacacttaaatgtgacgggaccagcttggcacaggacccaagaacagtggagaagggagtcccccaaaattccctttacctgagtgtgtggtttgatgggtctctccaatacacattcacactggtaactatctctaggacctcctgcactcaaggcacaagctct

SEQ ID NO: 32203 - DNA, 1166 bp, Mus musculus
gaccaatcagttgagccacatcaaagctaagtaagtacatgagaagatgacagggaggagagtggagcctgggatatttgcttgtgggttttcttttgtctcccccccccccccgccccgcccccagctccccacttcctatctcaaagcaggtcatcaggtggagggcaggtgctatcttctgcacctcctccatctcaagtcacacctcatggcccctaattttgctccctcaggatccgagctaagatcccggggaccggaacccttgccccaacagcatcagtctccggatccaaagccaaagccgaatgagaggggtgtctttgcccgatggacgcctgcctataccccagcagccctcttcccttccatttcccgtgcatccacaccctctcccactcggccgagccatttcccagtgggaagtgcctgagcgacccggactacatttcctaagaggctctgctctaagagtccaggaaaaggccgcggagcctgctgggacttgtagttgaatagtcaggacgctgccctgcacttccgtgacccaccgctggaggcgccgtgaggggttggtgcctctgaagccaccaacccctatgctggggctttgcatggggcccaggcgagccttgagcttggatttacactgtaataaagagtcctgtggaaaattcactgcattctgtgttttaaagtccctccacgtacatcttcctacacggaaaagaattaaaacaaacaaacaaaaacattaaacaaaacaaaaagaacctctagcgataatgttatccttaaatcccagcattcaagagtcagaggcaggtgaatctgcacagtgagtttcaggacagccagggctatgtagaaagcccctgtctcaaaacaaccatcaagccggtggcgcacgcctttaatcccagcactccggaggcagaggcaggtggatttctgtgttcgaggccagcctggtctacaaagtgagttccaggacagcctgggctatacagagaaaccctgtctcgaaaaaaactttaaaaaccccccaaaactaaaacaaacaaacaaaaccatcaacaaaaagaaatgattgggggatgcaagaatgatgatctggtaaaggaagcagtggtctgagttgaatccccatggtagagagaccg

SEQ ID NO: 32204 - DNA, 1205 bp, Mus musculus
ggctaatcacatagatataaaaagggatggtttttagcgtctaaacgcaaggggagttggttgtcaactccatcaccttagggactcagtagattccctacatacttgcagttctataaagcaacggcaggtgtcgctctgcggccgcgtgccgtcagaccctacggtctcgcttgcagaaaatctcgaattctgctacgaatgggccgcgtgagaagtttttccattaaaaacaaacaaacaaacaaacaaacaaaaataaaactgacttttcactttgcaaaaaattctgcttttagttagggagacaggcactttaggcgctgcttcccagaatgcaaggcgctatgcaaatgaagctacttactttttagttagtagagtcattcacggaacactttactgaggaaacacatgttcacaagaaaaagtgaaaaaaaatgttcgaaaccattgaaattaattatctactgtataccacaaataatgaccataagtgaaaaaagtagtagtatctggcctttatataactaaccgaaaatagctcctttcgcccggatgatcctcagtggtctggggtgcaggcttcaaacctgtagctgtttagcgacagagtggttcaattccacctttcgggcgggagtatctatcccattttgctccctgcaattcacattcttgtacaaaagcgaccagcgcgcagttaacctctctgaagccacccctattctcatttattctctcttcatacttacactttttttcctcccaggaatttccgaccaaatacatctcaaagatggatttaaattagtctccaaaattctaggatcttgctgtctctccttaaacgatttgctcatccagtcatctgctcttttatgtatttaatcacgcatgcattattagtcatttttgttcatttgttcactccggctcagtcctgtctctgcgttggagcagtaatggggatagagttgtgatcacacctttagccctggtcttttgaggtaactgagccagtggagagagcagggcaccaggcaattgtgtttttaatgaactcgagcatagaaggtcgtctcacaaggagtcctgagcagggtggccttgagacacacacttaatggaagacaagctgacagaagagcgagaatgggggaaccgaggcttgagcaaatgccttctcttttccaagaaccccc

SEQ ID NO: 32205 - DNA, 1197 bp, Mus musculus
tttgagccccagggggctctagcacccagcaagaaaaaagagagaggcgcacgcctttaatcccagcactgggcaggcagaggcaggcagatttctgagttcgaggccagcctggtctacaaagagttctaggacagccagggctacacagagaaaccctgtctcaaaaaaccaaaaaaaaaaaaaaaaaaagaaagaaagaaaaaagagaggacagaaagcaatggagcccgggtctaaggtgattgacccaagacaatccgaggaaccagagcccaaggccagtcaaagatcctccaagaagaaaaagagggatcaggaaactgaggtgcaagacaccattccccaatgagagatgtcttccacggacaggagaagcagcagaggagacttgcacaggagccgtaataacaccctggggaaggggagaaggagggactcgccaggctgaggtcagaaaccagctgtatagacactccctgcccctcccccaagcaaacacgcagagccactggagcctgggcatggaaaattctttattgtgacactgggcctaggtggcagcaggtcatcgaggcactttgaggaagggttcgtgtagtacttcaaagagcctgcgggcctgggggcaaggggagaagagaacctgtcattaaagctgtcgctggcccgcctgtttggaatggggttctgcctcttattctcctggctgaggagcttcgggtgtctgggttctacatgaggctggcccggaggtggatggaaatggacctaaaaactagtacatcgctgggcgtggtggcgcacgcctttgatcccagcattcgggaggcaaaggcaggtggatttcggagttcaaggccagcctggtctacccagaaaccctgtctcaaaaaacaaaaacaaaaactagtacatcgctgggcggtggtggtgcacacctttgatcccagcactcgggaagctgaggcaggaggatcggaagtgcaaggccagcctcagctacattaagtaaataaaacaaaccaacaaaatgtcttacttttgatacatggggtcaagtatcctgggctgggctgggctggctagctgtttggccaaggatggctttgaactcaacctttgatcctctgccctatatggctgctgtaagcatgctcaccacacttagtttagccagtgctgggatcagagcta

SEQ ID NO: 32206 - DNA, 1168 bp, Mus musculus
agtaggtggaatgtctagcgcgtgccctgggttcaatgcccagtactgtaaacaaataaacatttaatatattatgctagaaataaatacatctgtcatataaatgctaagatcaagacattatgcacatcccagagtagtctagtagccactctgaggtcacagagccctgaagctggttgctttccagaagctgtagtttttttggaagctcctggctaccctccctctaatggggttctcctcctgccaggcctcctcaaatcccctgccgagctggagcccgagcccgagctggaggtgctactggctcctgtggaggaggccggggatgcagatgaaggcacggtcacgcggcccctcagccctaccaggctgcagccagcgctgccaccggaagcacagactgtacccgagctggaggaggtggcccgagtgctggcagagattcctcgacccctcaaacgcagaggctccatggagcagagccctgcagtggcgctgcctcccacccacaagaaacaataccaacagatcatcaatagactcttccatcggcacggcggcccagggcctggagggcctgagccggagctgtccacaattacagagggatctgaagccagggcagggccccctgctcccgccccaccagctcctatcccacccccagccccaccccagagcagccctccagagcagcctcagagcatggtaagtcataggaggagcctggagtgtatgctcttctctgatacagttgctgtaacaaaaaaagcctctgccagatagtgatttaaatgagatctactgttgcacctagaccctgaccccaggctaaccaatattgagatctgtggggcttcaataccaagatggcaccagctatgctacaaaggagcctgggaaatgtagtcttttgtgtagatagggctgggctcagggaaagagagacggaccagagggaccgggcaccttggtttcctctgcctgtgccttatcccagcattccttcatgaatctcaattttacactgcaattagtgtgggattttggtatgacactggatttacctagagaccagacagtctctgatacctactttttctgggcacctactctgtcttcttgtgaagagagaatctcagttctcaaaactctgatcatg

SEQ ID NO: 32207 - DNA, 1171 bp, Mus musculus
ggcagggcagtggtgggaagcagaggcaggtggatttctgagttcgaggccagcctgtactacagagtgagttccaggacagccagggctacacagagaaaccttgtctcgaaaaaacaaacaaaaaaacaaaaaaaaacacccgaaaaacaaaaaaatcaagacggtctccaatttctctgttattctctcttaaacactattttcacgacttggacaaccagaacagaacctggaggagcgaagcagcaatgaactctatcgattctctcgactctcttctttctgtgttctgctcgaagtcctcggcgatcctcagcgatgcctcgggcaccacttctctccgaagtccgccctctcaccgccatgcgcacgcgccaattttccgattggcagagtgacgggaggactcggccaatggcgtcccgaggaaggtgtgtctctgggtcacgccccctcgttgaatattcaggagcgggcgtgtggacgccgcgatcagccgccatgaagtgagatggggtctctgaaagagcgggcggctctgcggtgggcaatggggcggcgggtgggcgtcgccggggctggggcgcggcgtggagaggctgcggagaccggtccgggtggcttcggggtccctggcggcgagacgccacgagggcgggcgggcgggcggagcggaggccgaggcggctcgagagcaccgggcaccgacgcctcaccgccgccaggctcaacgtggacgggctgctggtctacttcccgtacgactacatctacccggagcagttctcctacatgctggagctcaagcgcacgctggacgccaaggtgggtggcgaggctgccctccttgcattctgatgcctctggcaggcaaacgtcctggtcggggcccgggccttgctatcccagcacccggaagacccaggcaggagcatcgctgcgattttggaggccagccggggctacacagcgagaccgtgtactaacaacaattgtaaataacaaggcgaggaatgtcgctcagttggtagggtgctagcctagctagcaggggtgaaactctgggttccatcctggcaccgcataaactgactgatagtaattacaattatgcctgtaattctagagacagggtggctgaggacagattgctcgagtttgaagtaca

SEQ ID NO: 32208 - DNA, 1298 bp, Mus musculus
cccagtaccagtgcaccgcctttaattgcagggagcgatctacaagagctgcccaggcagggtgcagggtgaccacccacccttcctgatccttgagaagctgtggcctctgcagccagtccacttagcgcgggctcagatcttgtgtgctgatgctcagggtccgaggggcctcactcaggtgccgggttgagagctgggagagctgagagcacaggaatggttagagttcttttccagttgacattggagccacttcatgccctgcccaccagctcctccctaccttgagtccccaggaggcggccccacctttcctggcttgctgagcctgccagcagcaccccactccatcactgactcctcacctgcgtccgggcagccctgggaccatccacgttcagcatattgagtgacatggctctcttcatcctgaagaggagcccaaaaagacaggagtgagacagggaagactgcagatccctggctctgactgatgtcacggatggttcctgacagactgctgacctctcccggcactcacccggcagcccctgccatgccctctcctcggaggcgggagaccagcttctcgcttcctcgcctgatggattcccggagcttagagaaggaactgctcctgcgcaggacctggggagggcacagtgatgtgtggggacatggtgggggcccaacaaggacctgaggtggagcctgcttacctgctgctgtgtatcgcctgctgtgcctccctggggggctcctgtgggacagaagggacatggaggcaggtgtgaggaatgccaccatgcaggagggggtgcaggaaggtgcaggggtgggctcaccaagtggggcgggcagggcctcctggctgaggatctccttgtatagctcctctgcctgctgatacttgttctgtttcaggtaggctgaggcctgcggggagggagggcaggggtagggtgtggacatcttgtttaggcctgggaacgtctcagacctgcccgccttccccagcatcctgcctcagcttactgcagtgcagagccacccgcgcaggagaccaggctacctgccactgggtcctgcatctctgtgccagtctcctacctcagtgggtgaaatgttcggggtcacccaccatgacacaataaaatctgataggactttgtgaactggggtttgcttctgatatttttgtactgaaggggctgtaagatccttcagtctctctcctccctacagtgtccccaggacaggacagacctggcatgccttaccaggttgttcttagt

SEQ ID NO: 32209 - DNA, 1182 bp, Mus musculus
aacggaccccgcccctcccgcccctccccctgacgtcccttcctccccggccccttggtcgcctccctccgccgccgccccgggccggctccgcgccccctccccggcccccgcccgtgcaccctcccgcctgcccgccgcccagatggcgccccgggttccccttgcacggggccactaggaccctcggtgtcttctcccctcccccgtcctgccctctcttgctctcgctctgcgaggactcgggcgtccacggcgcccagcttttgagctcgcgtccccaggtcggctggggggggggaggggaagagaggggaccccgggatccccaccccccccgcccggccgcccctgtccctttcccttctgggaccccagagaagatgtcttcgaggacggcgctggccccgggcaacgatcgaaactcggacacggtgagtggggcccagccccttggggagccctgcctgagtccagccatagaacccctcgccctcccggaccactgaccccgccagtctcgactcctttccgggctccacagcccagaccaacgcttcccatgactttgaggcctctctgctccctcctccccacagccccagcccagcccgacccctaggggcgcccctgtctttggactcttctccggtccctctgcagaacgcttccgcccggtctcttccctccaggaagccccctcccctgcccgccggcagcccctcccttcctcggctgccccggctgtcccccgctcgcccgctcgcccgcagcttggcctcgactcttcccggatggcacgggcccctgttccccgaagcgcagccctgtctcccccctcccccctcaaggctcgacccagtctggccctgttgtcctccctgcttcttgccgagttggggtgctggtttcccctgctacccctggccagtccccagctccgcctgggctcctgctagctgcctcccccaggaagccaaacggcacctgggcgcagggccctgcccgcttccttcaaggtgtctccactccctggcctgaccctgctgtgccaggttgccctgtccttggatcctagtcgcctctggggtccccttggtgggacccgtccagtctttctaagggaagccttggcttccaaccctgcgggcttcctcccatccaagactagggttccaggcc

SEQ ID NO: 32210 - DNA, 1363 bp, Mus musculus
ccgagcaggacccgggacctagagcctaggctgtcactctgtgtccccccacctgactctgcctcttggtgaacattcgtaccacctgtggcatctgactctgtttttgttcctggatcaccgaggcctccaatgcgtggtagcatttgatcaatgccgacagaagccgaatcctcgcatcttctttgatattcttagcacaattccgggctccccaacccaggttctgtggctatcaagtagcttagcccctatccattctggtcctgtttcctaaattcagctttactcttgggcaaagccagaggtttgctttcttttgttgagcctttctgaatttaggctttggggggtagtggtgtctctctagtttacatccctaaatgatgatcactcctgacccgaggataccttcctcttacacatatccctcttaccgaccgctgtggccaaatgcagaccaacctagggcctgggtagtaaccctaattcttaggcctttgtgtcaggggcagcgcctcctggtgttttgatcgctatagagacatgacaccacaaatacaaatctaccactcactgtgtctctttctggatgctaaaaggacttggattctgacctctatgggcctcgaggataacaggttctttttgcctctttgggtttggctctttgggtgtctttttggccactccttttgtctctgtcttaatgaggattcagtgaccttatgtggaagggagctcgggtggtggggtgagactgtagctcagtggtgtcgtgtacgcttagtgtgggcggccctgggttcaattcctaggaccaccctgcttcaaaagaaacaaacaagcacattctttgtttgtttgttttgtttttgttttgttttttgagacagggtttctctgtgtagtcctggctgtcctggaactcactttgtagaccaggctggcctcaaactcagaaattcacctgcttctgcctcccaagtgctgggattaaaggcgtgtgccaccactgcccggtcaaactagaacattcttagatgcctgtgtcccctttaaaaatttacccagggtggggggtggggtggggctggaaagtagaggtcctgagttcaaaccccagaaaccacatggtggctcacaaccatctgtattgagatctgatgccctcttctggtgtgtctgaagacagctacaatgtacttatatataataaataaattattaaaaaatttaccctcttgattctaactatcagctgatatgctattttgtttttacatcaactagagtcagggtttttattggtaattaggcgtggagattggggatttagctcagggttacagctcttgcctag

SEQ ID NO: 32211 - DNA, 1147 bp, Mus musculus
ctgcctggccctgatctttgctttttattgtatgtcacatgtcccagcacagatcacatttctcccagcatgctctctttatatattgcctggttttcccacccatgatcacgtgatcatgatcctaccggtcagccctagaaacagagtgactggccactctgctcttaggggtcagtagggtccctgctttgtctcctccaggaatataagagactcaaaatatccaagaacctttggaggctctgctgtccccatgtcagtaagatgtctggggtaggggcttcttcctctgcccaccgtccctgccttccccccccctgcattctattgtcctctcacccctgaccctgccactccagtcctttcaggtcagcagatacttaattgatccttgcccagggacaggcagagggaggccagcactgacctcagctgtgtctctgtcaccatcactgtgaggaggtagtgcccgtgtgggaaagtgaggccgctgtatccaggtcacagtccaggatgtccaccccagggagtgttgagtctgtggaaggagacttgagcttctgacgacccttcaggcccctctgctctcttggctggcaccttctgtgtctctgtcactgttgtgttaaatatttaatattaattgggggttccagatagaagacacttttatatttataataagccttagtcagcacaagagctgggcagacatctaccctcttgcagtagaacttctggggaacattgaaacagcttgagccacggagagttggactttccttgtttgtcacagtagggaacatggacacaggcgatagagctttgtgatagagctggtgtgaactctgagggaagcagtggcccccaggtaccccaggctcgcccaacgccaggcaattctaggttctagatccttggaacacagccacctccttaatggggttctttctccagctaatggtgtcacgttggccaggggttgtcacctgctctgatggacacagatgctgtacagagtatcacaataagacaaagtgatttatggcttgacttcccctgaggatcccaagggacagggctgccttccttttgcacacaaagaaactaagacacggggctggtgagatggctcagtgggtaa

SEQ ID NO: 32212 - DNA, 1167 bp, Mus musculus
tcactgtgttttgctaccgttctagggctgaaacccaaggtctcttgcatcggcaaagccttctttgcactacaccgtctttcattttactagcacagaaagccagctacttttgttttgttttgttgttgtttattgagacatggactcttggtactctctatgtagactaggctggcctctacccctactaccccctgcccattttcttttgtgaaaaattatatttatcagtctgggtggggttggtgcacatgtgccacagagctgaaggtaaaaggacagcttagttctctttctaccctactgtgtggattctgagattgacctcgggttgtcaggcttgcaggcaagagccttcccacctgcagaaccatcgcaccagccagaaacttagtaattttttcttttttctggagacaagttctctctatgtagctcttgtcctcgcttttgatgtataccaggctggctttgaactcacacatcccactagggccctggtgcagctggggctctgagtgctgcctcccttttgctcatccttcgctgcaggtcaccttcagaatctagttccgagtcccgctcccgctctcgctccccgagcccaggccgcgaggaaaaaatcactttcatcaccagttttggaggcagcgacgaggaggcagctgctgcagctgctgcagccgccgcatccggggctgccccagggaagccccctgcgcctccccaaacgggtggccccgctccaggccgtaatgccagcacccggtcggtaacgctcacgcccgccctagcggacctccgggaggagggacgggccctctaggacagtgtcgctcacaaaccctgttttccccgtgctcccacagccgccgctcctcttcgtcctccgcctccaggacctccagctcccgatccagttcgcgctccagttcgcgctcccgccgtggctattaccgctctggccgccacgcacgctcccgctcccgctcctggtcccgctcacgctcccgttcccggcgctactcacgctcccgcagccgcggacggcggcactcagacggcggttcccgcgacggacaccgctactcacgctcccctgcccggcgcggcgggtacgtgccccgccgaaggagcaggtctgtgacttatgttaaggagcag

SEQ ID NO: 32213 - DNA, 1159 bp, Mus musculus
gcaggatgctgcccagcatgctcaaggcccagggttccatcctcactgcaccgtcagtgttgcctgcccctcgagcatgctcgtgagtcctcagttctggggagcttctcagtctccccacttgatgcagtgtttcgggcttctttcctctggccccgtgtgttcaaggctcagttgtgttgtaagatagcacgttggtccattttatggctgagtaaggccccactttatacatagtctgctgggttgttagcactttctggctcctgtgagctggagtgaaccttagcatgtgtaagatctgtacctaggagttgtggtatgatgataattttttgttgaactcttcattcattgtagtttattttgttttgtttttttcagtgccaggggtggagctaggtagagcaaggacctcctgctagtcaggcagcggctctgtcactgagcacagacagcctcagcctgggttagcttgtgtgggactgagtttcatggtgccttgcctgtgtgatgttgctgccccagaggctgcaccaggtccagggctcgaactgtgctacaaatggatgacttgggatggggttgaagacgtaggggtaacacttgagacagtgtatgtctgtagctcaggtaggcttttaatttgtaatcctcctgccttagttctgaagtagctgggatagataggcctggctggcaggatgcctcagctagagcagagttaagcacccctggccacacctgggaggacacaggtccctgtcccttagggtgtggcccagggacttgacccagaggccaagtgaccactaggtctacttaaagtagggaggcatggtgggccttggcttcttggtgacctctgacctgtccatccctgcagaagaaagaccccgctcagttcctgcaggtgcatggccgagcctgcaaggttcacctggattctgcagttgccctggctgctgagagccctgtgaacatgtaagattgggggagggggcagcatagtgtctgaaggggcttgggggtactctagagactgcagtagaagcttggataaggacagtcttgtatagtcaggccaggaagactgtgcatgtgcggttgactcgcagagaagttatgtaggtgctcacagtagaggagttaggactga

SEQ ID NO: 32214 - DNA, 1169 bp, Mus musculus
cacaccctagcccctcactgggggattctaggcaggggctgtgccactgagccacgcccccagcccctcactgggggattctaggcaggggctctaccactgagccacgcccccagcccctcactgggggattgtaaggcagattctactaatgaactctatctgtatttgaggcaagtttatgtgaggaaattgttggtctttactgccaaggacttaggagccatgggagtcttctacgcaaaagagaaacgggttggtattaacaaaatccctttggctgtgtgaaatgcacaaatacaaactggcaactgccttagtccaatcgggagatagatggtgggtggagcaacagtggcagatggcgcctcctggaaaagtgaatatgtttttgaagtagaggcacagccttgggagtgctgcgtggcgttccttctggcacttgtctgtattcgcagcactggaaaggcagagacaagaggagcttgtgttggagaacttggctacacagtgagaccctgtctcaaaaagccaaggggagggaggggctggagagctggctcaatggttaagagtgctagtcatgttcgggagacagaggcaggtggatttctgagttcgaggccagcctggtctacaaagtgagttccaggacagccagggctacacagagaaaccctgtctcgaaaaacaaaaaaacaaaacaaaaaaaaagaagtgctagccattctcccagagaagccgactttgatttctagcactcatgttgagagactcacaacggcctgtaaccccagctccaggacatctgacaccttcttcaggcctctgcacctggacacttgttggtacacacccctgtatagacaggtgcatacacatactttttacagatctttagaagattgaaaagctagctcagtagttgagaagactggctgctcttccagtggacggtggttcgattcccagtgtccatgtggctgctcacaaccaattttaacttcaattctaaaggttctgacgccctcttctggcttctgagggcacgggtccttccaagtgatacacagacatatgcaggcaacacagacacacacacactaaaattaagtgaaaaaaactttaagaaaatcaagggtgagccggagcacacctttcatctcaac

SEQ ID NO: 32215 - DNA, 1184 bp, Mus musculus
atggtaaggcccagcggacacagggatacagtgggcggggaggagcctcatctccactgcggtgggccatctccctcacacagtcccttcccccagatgtggttttcttcatctacctctaccaacggtggatctaccgcgtcgaccccacccgtgtgaacgagttcggtatgagtggagaggatgtctcagcagcggcatccagggcccaggcatccactgcagcaggggctctcacacctgcacccagcacagctgtcagcggagaggatgcctccacagtcccaaaggccacttctggggcctgcactgccagccagccccaggaagcccctccaaagccagcagaggacaagaaaaaggattagccactgcagtcctccttatctgctcctggtgactgaccaccaccacctcccgggcccctcccttaccctctctgtcgccctcttcctggacagatcaggccggggcggcaggaggcccccagggccagggcccggtgtgtgagatggggccgggcaggttggggctggctgtgtgtatgtggaggcaccgtccatcgtcttgtctatccgtctgttcctatgtgtttgcagacatctcgccctgccagcccaacaccatcgggaatcatggtgaagccaatatggcgccgagggtgggccaggcggggaaggggccagggctcctctgtgggacgcctgtggtcctccatcatcttgtccctcatcccccgaccaccctgctcccagaccgccaccctttaacacagtctggatttaataaattcatatgggtgtttaacttaagctcaaccaccgcacctcctctgccttccttgtccggaccatgcagctggctcaggtcttcaagagacctggaggtgatgacggagtggaatctggggttgttcagcatttaacaccctgggttaaccctgtgctgcataaaacagtggtgttgtatgcctgtaagtcagagctaacttagatggcagaggcttgcaaggtggctcagtgggtgaaggtacttgccatgcaaccctgataacctggctttgcacttccattgtgctacaaggccacacaacctaagttgatcaccaaaccacacagaggcaggagggaagcaactatagtgttatctgacctccacacacacactgtagcacacatacccaa

SEQ ID NO: 32216 - DNA, 1167 bp, Mus musculus
aggacctaggggattttcacagtaggggattttttggggtcacattagggcaggggaactgggaagagtgaggaagggcagggggcggttctggctggggagtggcaggagccaggtcccagctgaccttgactttccctttacagctggaccgggagcatagagtggcaggaatcttcccttgcccaaccttcaaagacaagtccacctatattgaatcttcaaccaaagtatatgatgatgtgagtgactcccatggccctggggtggtctccaagcacctacactcatcaggggcaggctgggcccttggtcttgcctgccagtatcactgccaggcccatatcacaccctgtgttccccgcctgccacagctacttcctggccaagtccagagttcccagagccacctggaaattcccctggcctagcctgctggaccaggtgtgggtggatgaggacaaggagtggaagcactgagcagggcccgcagagctggcctgttctgtgacccccaccccaccatcaccccacagatggcgttccggtacctgtcatggatcctctttcccttgctgggctgctatgccgtctacagccttctgtacctggagcacaagggctggtactcctgggtgctcagcatgctctacggtttcctgctgacctttggtgagcaggcccagctctaccctgcctggaaggcatgtccacacagttccaggcccatcattcttgtaggccacagccttggggctggctgccaggcctggccttgaccccacatctaggacctgtgcctgcagaccatctgaggctcatgttctcatgcttctttctgtaagcacagcagccaagccctgtcctggcactcactggcctccagacagtgcccacccagtgtgggcagccttgggaatagggagctataaggattcctctggccaggtctacagagaggaatccatgtgctgggggaatcccaaagtgcagagagaaggcaggcactcacaatgagtactgagtacagacgagggcagagcagtaaatgtgtacgtaggtggagtttaggaaccccactgaggaaagatgcttaacagtccccagaactgaccaggagagataatataaagatcaggaaatgcttgaaattgggaagctggggtt

SEQ ID NO: 32217 - DNA, 1231 bp, Mus musculus
acaccatgctgggccagagcacagaggagatacgggcgcggctctccacacacctgcgcaagatgcgcaagcgcttgatgcgggatgccgaggatctgcagaagcgcctagctgtgtacaaggcaggggcacgcgagggcgccgagcgcggtgtgagtgccatccgtgagcgcctggggcctctggtggagcaaggtcgccagcgcactgccaacctaggcgctggggccgcccagcctctgcgcgatcgcgcccaggcttttggtgaccgcatccgagggcggctggaggaagtgggcaaccaggcccgtgaccgcctagaggaggtgcgtgagcacatggaggaggtgcgctccaagatggaggaacagacccagcaaatacgcctgcaggcggagatcttccaggcccgcctcaagggctggttcgagccaatagtggaagacatgcatcgccagtgggcaaacctgatggagaagatacaggcctctgtggctaccaaccccatcatcaccccagtggcccaggagaatcaatgagtatccttctcctgtcctgcaacaacatccatatccagccaggtggccctgtctcaagcacctctctggccctctggtggcccttgcttaataaagattctccgagcacattctgagtctctgtgagtgattccaatcagcttcagcctcagtttattgttttttgccttacctagcacacattccatggccctgtcactatctgtagagggaggtggttttgcagcaatagaaatgaagcctaggacctagcaacataaaagaacaagtgatctaccactgagccacgcccacagcccctcactgggggattctaggcaggggctctaccactgagccacccgcagcccctcactggggaatcatatctaccactgagtcacgcccctccagcccctcactacgggaattctagtcagtagctctaccactgagccacacccacagcctctggggctcttcaccgccccctacccctggattctaggcatgggctcattttatttatttatttatttaagatttgtttatcttatgtataaggtacactgcagctgtcttcaggcgtcaggtcccattacagatggttgtgagccaccatgtggttgctgggaattgaactcaggacttatagaagagtagtcagtgctcttaactgctgagccatctctccagcacccagtacaggctct

SEQ ID NO: 32218 - DNA, 1194 bp, Mus musculus
tagatcttctgaaagagatgacagtgctcctaaccgctggaccactgttctggcctggtgaaacaagcctttagccccagccctagggaggcagagacactagattgcctgagttgaaggccagcctggtctgcatagtgagactgtctctaaaacaaagaaatctgagcgtgatgatgcaaacctctcatttcaacgctcaggaagacttgtgcaaggagagccagcctgccctgtgagtgttcagttggtgtggtcaaacaccatgcccagtgccacactggaaagggttggatttgtttaggtgtatagatccagaaagataagaccctgtcctgacaatgggacatgacagcaagtggcagaagcaaagcaagagagaccattaaaaatgacattagctttgacacttcagtctgcccccagtaacgtatttcctcaagcaggccatgcccgggcctctccaactggggtgcaagtgttctgatgcctgagactacagggcattcatttctcattcagaccaccacctggtctacctaggtagggtaggtagggaaaggaaagggataaaatggaggttaaatagagaaggcgtgtggcaggcaccatggttaacttcctaggttccatcctcgtggagcaaaaccctgcagtgccatccatcaggcaggaaccatgattgcggggcgtggttcagccctgggctgctgctgtctgcccagccatgtgcaccctagtgacactggtgaagcttggtgagcgcgcgccctgtggggtcaggcgtggcctaagtcccaggtgatggaactgtccttagtctacctgcctgtagtacttagacttggcttttggtcatgaacagggcacagtgttcccacgtgcagacagacaggtaggacgggccaagatgggtaccgacgtctgcccccctgcacttctctcttccttcttcatggtgtgcaggagttcctgatcgcctgtctgtccactgagtggaagtgtaccgagcctaccccgtagggtgtacttaagcgttgataatggattagtggataagaaacctgagtcacctctggggagtgtccgtcccaggatggacctccacataaaaagcacatacagattttagcggtatactggggtgaggcttgccacctgcctagatccaccagtgaggtgctcatggagtgg

SEQ ID NO: 32219 - DNA, 1193 bp, Mus musculus
ggctatgaagggaaggaggtgagcaagtgagcagccaaggtgttgggacatgggtgattccttcctgcagtaatatccctaacatactgttctttatctcatcctgggggtgaggggctgggtttggggacaacttagtgatgacctggatgcttgaaccagatagagcacctggaatgtcaagattttttcttgggtgttctctagggggtgctagagagccacagaaatttggcgagggagatgggtcagatgggtgcttcaggtatgttcctcgggatggagagaaggggtgtggagctggtgggagcgggaggtagaggtctgagctacagctctcctcgtgctccctgtggggttttgtttgtgtttggagatactgacctgtggcagaggatgatcttaacctgtcagttctcctgcctttgcctcccctaagtgctgccattgcaggcctaagtcctcattcttggttttatctggtgctggaactcaaacctggacatactagacaagcattctcactgactgatacgtccttagcaggtttttttgtgtggagtaagcatgtgtgcattcctgtgtagtagcatgtgtgcgggtgtcttgcaaaagccagagtgggacatctgatccaaaagctcactgtttaggcttagacaggctgccaagcaagcttacaggacccaccatctctacaggggtagagtgacaggcatgatacttagaccatgcaatacatgtggcaggggtttgaacatgggttctcatgcttgcatgtaggagtgctcttacctagtttataccaactcaagcccttcctggactctgtgtaaaccaggctggaatccaactcaggtcttgccctcccgtctgtctcccaagtatagggattaaaatgtgtgccaccatgcctactacttttttgtttttaaatctctctacagtcttatagtaagtacactgtagctgtcttcagactcaccagaagggggcatcagatctcattacggatggttgtgagccaccatgtggttgcttgggatttaaactcaggaccttcggaagagcagtcagtgctcttagccactgagccatctctccagccccctctctacagtcttccacctccactagcaagcagatcaaggaatgaaagcctccccgggcactgcactagagtggcagggggc

SEQ ID NO: 32220 - DNA, 1189 bp, Mus musculus
atgagcaggtaggcgtgtcaatgcgtgtgctatcgacaaatagcgaactagctccagccccgcggcgtcgcgaaccaatgaacttgggatacacgagccaataggaaggtagaggaagctgcactgactgatttcgactaggaaccaataggagtagggcttcaacagaagggtggaacttcctgctaattctccaatagaatgtctttcttctagggcggtgggcggatctcggaggacaccgaaccaatagaatccatggggcgggaaaacagcggtggcggcggcggcagcgggttcggttgcgcttagcgcacggggtaggagcggagcccaggccgggaagaggagccgccgcggccgccagtgagagccgagtccgctttgggtgggaagggcctggggttgcatccgggggtgtgcgtgtcgccccgatccctgccctctgacctttcccctcgcagataccatggggaacgtgttggctgccagctctccgcccgcagggccaccgccgcctcctacgccgtccctcgtggggctcccgccgccgcctccttcgccgccaggcttcactctgccgccgctcggcggcggcctgggcactgggtcaagcactggccgtggttcggaacggactcccggggctgcggccagcggcgctgcggcggcctcggaagatgggagctgcggatgcctgcccaacccggggacgttcgaggagtgccaccggaagtgcaagggtgaggggcgccaggcccgagtagccccagggaaagggaagggaccccccggaggattggcgcacatcgttgcaatcattaaacagaacgttggaagctgatgatggattggaagggtgggaccttgaacttggggctcgaaactgcgatcagatgatgaactcgttggggaagaatgccacagcaggagggagaagtcttagggtactgagagccaggggaccaaccccaccaagattcaggagtgtgatcaggaagggaattatagtccaaggtcacggtgtcaagaggttttccccaatgttcctgtgaggggttcgacccaaggatcctagcctaggatcttttgacaatttgatcataagagggaggacattcttactctcgatagttaagtgtgttaacttactaaatactgaggacagttctgtgtggtgagaactgta

SEQ ID NO: 32221 - DNA, 2030 bp, Mus musculus
aggcagaaaactcggagactgagacgggcagatctggcccaccagaacagccagagctacataaaaagaaaagaaaagaaaagagagaggagagagacagagagagagagagagagagagagagagagagagagagagagagagacagacagacagagaacccagaggtcaaattttcttgggtaaggattgggtttcagagatcaaagaggaagactgagacagggtaaggaggtccgtgctgggcttgggttagaagtgactgtacagagaagtttggtcgagggagaaaggatggcagtggtgtagttggatctgattggcagggggcagatctaggatgccatcctgagactgaggtgactttgacatcttgcttttgctccctccccacttctaggagatgcctcggtatcacgagctgcccactctggaagagcggtcagggcccctgctgttgggggctacaggcctgggaccttctcttctggtgcctccaggacccaatgttgtggagggggtttccctgagtctcgaagatgaggaggaagatgatgaggaggaagacttcctggataaaatcaaccctatttatgatgccctgtcctaccccagcccctctgactcctaccagagcaaagacttttttgtgtcacgggccatgtatgtgtgagggaggcacaggggctctgacgtctcacctttcacccttgacccatgagctttccaccagtaatctaggacactctgacttccaggcagaccagggacaactatcacccattgcaatccacctgtgacttcttagtgactccaccatgacgtccaatctatgatgtctgaggcaggcaaacctgcacaactggaaacctggagatttttatctcccttggcagggagctcaccatatccttctgcaccacctgtgaccccccccccccccccaaggactcctaagactacgaccctttgaccatgccactcagtatctcaagaacccttaaagtcccaaaggaatcggaccttgcacttgtcctcaggcaatagagtccaacagatatgcaagaacgggatcaggggctccctgttgctcagacctgagccctccaggcagcagaagctcacctgatccctccccaccctgctccccaaaggtgaaaaggagaggattccccaatgtaaggtaggacctccccatctccacctactcctgcaggcaggaatctcaggtttctcacaccctctcctcagcacccaggttcctgtctccagagcatgaattccaggtccaatgctagaggggagaacctaatgcaagtgtgccttgccaccccaagtttgggagactctgctcttatcctgaggactactgaattcttttaacccctacccagtgagatgagaactacatatccctctttaggggatggtgtgtgtatgtgtgtgtgatggagaatctgggcatctgggttgggaattttattttgtaagcatttcctacataatatgagtttctactttgataaagtcttgtgttttctgtgagatgtgaagtgagtggggtacaatgaggcctgaagcttgaaaggcatccgtgatctgtaagtcaacagagaatggactcccctccctccccaaaaagtcaaaaaaaaatgccccagaaattaatgagtcataagcaaaaccgcatcaaccaaaagaaaaaacggtaggcatgcaagaagtgtctaagatcatgaggcaaatactattttcaatgaagcccccaaggcgtgatgggtaatggagctaaacgaatgagccagaagcaaagtaagaaacgagggctgtaggcgtagtgggtagtcgccagaaggtaaaagattccaagatagttcattagagaaaggccggaaggatgggaaacgtgaacaggcagacacgagctaaaccgagccaagggattgaagctcaatgaatgggggaatgaatgctgggtaatgggaaaggaatgaatgggccaaagatagaagctacagtgacgcaaggag

SEQ ID NO: 32222 - DNA, 1178 bp, Mus musculus
gagagcttgcctgagctatactacagcaaaatggtgtctaaaaacaaacaaaaacaacctgtgggggcagtgagatgactcaaccggtaaaggtgcttgccgccaagcttggtgacctgagttcgaaactcactacaacttatccctcaacctccacaagtgtactatggcacacacgtgctcacacacccatataaagtaaataaatgtttaaaatcgaagcaaacaaaaccaaaaccagcgtggcagctcactcctttggtctcaggaatttgaagtcatccatcctatctacatagcaagtctgaagtcatcatgggctacttgacatcctatctcccaacatttccccccatccaaaaacagaaaagaaaaagaagctttattgaagttagacttttgggttctgaggaagacgaaagagtctctgactctcttgaatcgggagaggtgtcgcgtaggcttctatccctagattcaaaaagcctgaggtgagagcacagctttactctgatccctcactgtcactattccccagaccccgctccacctggctgtcatcaccacattaccagacatggtccggctcttggtgacagctggtgccagccccatggccctggatcgtcacggccagactgcaattcacctggcatgcgagcaccgcagccccagctgcctgcaggccctgctggacagcgcaacctcaggctccgtggacctggaggttcgcaattatgaaggtgagtccccagaggggacaaggtgaggttgacaccattcaagcccaagccggggtttgactgactgtggcttccccttcttcaagggctcactgccctgcacgtggccgtgaacaccgggtgccaggaggctgttctgctgctcctggagcgtggcgcggacatcgatgcagtggtgagccaaccaggcagccggcgaggggcgtggtctggcgcgtggaggtgtggctcaggaggcggagctagcgaagggcgccagggtggcagaaatgttcacgtagttaaggcgctggaggctggaccagagggagggatgctcagagccttcagagagagactgaaacacctgtcctctcgcaggatatcaagagcggccgctccccactcatccacgccgtggagaacaacagcctgaacatggtgcaactcctgctg

SEQ ID NO: 32223 - DNA, 2465 bp, Mus musculus
ggaactttctcaagggggcagggcagagagctgcagggtggcattgggagccgggattttctaggtccccagcttgtgcaccactaggagggaatggaaacttttggagatgggacctagtgagagaaggctagatcattgctccaagtgtgtttttagagggaattttgaaagcattcatctgatttttgagagcagactatcctttgaactcactgtctagccaaggttggcccacctgcctctatctccccagtgatgggattacaggcctgtgccattgcatccagctctctgttttttggaggacatctccctatgtagcctagaatagattctgatgatcctcctacctctgacaccagagtgccaaggttccaagatatgcctacctcctgatccttgcctatggccactgcttaggggcctagtgggccgcctccttgagcgtctcacttctccgggaagaccgtttacttgatggaggccctgactgaagtgtgatgtctgttgtcccccatccagaacgtccagtattcatctgtgaacggcgactgtagactgaacatggagccaaacagcacaaggtgacggtgctgggtagacagaactaaggaacttgaaggcatagcaactggaaccctactctcataaatgaagaagcctccagagagactggctgctcagtgtgatgagcatagcaagtttggggggtctcccaggatgctgccgaattccacgttgtcaaaaggacccatggaggccagtgtgttggctcactcttgacatctcagcaagctgggggggggggggggagcataaagcaaggttgagtctagcttgggctatagagcaaagccctgtccatacacaaacaagctaaggggctttgagacggtcagaaactgaagtcttgctttgggtaaggtaaatcctctaccgcatgtatgtgctagacttgaaagacttccacacagacctctttataagttgactccattggggctatcccctcctctctggacaaggtctctgtatgtagccaaggctaggctcaaactcacagagatatgtctgcttctacctccccagtgctagagttgaaagtatttgtgccactgcacttttctaggtcttcttttaatgaagtaaagtatatatttataaaaagctatttagttatatatatatatatttttgagactatttcatagagcccaagctaacctcaaacttactatgtagccaagagtgatggtaaactaatttattttaatttatttgtcttcaattttaaccatcacccaacccctgctcccttccatatcttctttcaatccatttcattgtctttttcttcccagacactattctgacttacgtctccattacaaacattttattgaactacataaaaatgtgtgaaccacaaaaaaaaaatgtatttgtcaaaattgtagttgtctttctgaggctgacctgagttctctgataccattctctccagttgtatccagtttcctgtaaacaatgtgactttgtttttctcagtagctaaaacatcccaattatgtgagtgtacactttctttactcattcctctgtgggccaccagctgggttggttccatatctgagctattgtgcatggaattgtctctgtggtgggtttagtaaactcccaggaatgcctgtacatgtttgtagaggccagaagaaggcacaaaatcttgagccaggcttacatgcacttgtgagtagccccacataggtgctaagaacccagttcaggtcctctgctgtgggatggtgggctgtgcacagaaagcctggtcccggtctagcaaaggtctggaactccggagccggtgggctgtgatttacaccagcatgggatggaaggagttggacctcgcctcctgggcacctggctcctgtcacatagctacagcctcccacagcccccctatagggaggtatgcagcatcaatcacatagtagctgcactaagccctcccacatgcaaataaggtttccccaaactctcagtccaagccaatgaaaagtacctgctgtcaaaccctaaatcatccccaaaactctgtaagtcctatcagggaataaaatgtgtgtgaaaactactccattgtccgagcctttgtcctatgagctgtaacatttgggaagagatctgctctcccgaaacgccgtttgaagccctgcccaactcccagcccaacctgactctgtgcagggtggctcgaaatgatggtgtattagtcagggttctctagagtcacagaacttatggatagtctctagatagtaaaggaatttattgatgacttacagtcggcagcccaattcccaacaattgttcagtcgcagctgtgaatggaagtccaaggatctagcagttactcagtctcacgcagcaagcaggcgaaggagcaagagcaagagctc

SEQ ID NO: 32224 - DNA, 1208 bp, Mus musculus
tccaggacagtaaaaccctgtctcgaaaacaaacacacagaaacaaaaacaaacaaagaaaaaaagtatcgcgcactgggaagattgagaaccactgacctagaatgtgcttcatgagaccttatttctttttttaaacagtttcactgtgtaactcagacgaggctggatttgtctacggtggacccggctgacacagaactcacagatctgcctgccttccaaagtgctgtgattaaagacatttgaagcctagccccctgccccccattatttttaattaaaaaaaaaatccgggatgatctcacgtggcccaggctggccttaaacccgctttcaattctgatgatcctcttgcctccatcctccccacccgactcaggtgctgggatgacaggtttacagaacactaatcgtcagggtcgttcactcatcaaccagcccggcagacgtgcttggctgtgtgcgcctgcccagcaggggaccgccctcaatgggccgtccctaggcggcacccgcttagctgagattccagcacttgacttcagggtttcggagagataaggcgcttggccgttactaactggactacaaagagctggatcggaccggaaccacatggctcaactcgcccgagccacccgctccccgctgtcatggctgctgctgctgttctgctatgcactccggaaagcgggtaagtagccccgcgccccgcgccccgcgccccgcgccccgcgccccggcctgtgcgcacctcgagaggccctcccaggccacccgatcccttcttcccggcccaaagtcctaggtctggattctggagcagagattccagaaaatagggcgtggtgactcacaccggccaccggagtacaggggaggatgaggtaggagggttgccttgagttccaacgtagcctagactcgggaatgagaaccggatttgctccacttcgcgcacgcttgcgcacgcgcacacacacacacacacacgcgcgcgcgcgcgcacacacacgcacgcacgcgcgcaaaagatgttttattattgtaaaataaatgactcgtacactgagaaaaagtctgggtgactcatgccaggaaccttaaccctagtggccacactctctccagcaagttaatcgtgactgactcagagttgatttattagttcattttcctttcgctgagttggagactgaagcctc

SEQ ID NO: 32225 - DNA, 1207 bp, Mus musculus
agttcttatgtatatccatccacagtaaaaactcttcttgagttaggcaggctctggccattttaaaccaaccacgaagagtcccaagcaatttaaattgcaaaggttcctctaagtgatcctaatccatacctaaagattctccctgttaaaacaaaaacaaaacagttttagaggcaggcagatttctgagttcgaggccagcctggtctacagagtgagttccaggacagccagggctacacagagaaaccctgtttcaaaaaaaacaaaaacaaacaaaaaaccccaaccaaagattcccctatagctgaggttggcttgtggcagcagcaggcccgataggccccttccatttctttttatgtttttcagggggtcttgtggaattgcttatatttcaatgctgcgtggtaggccagttacatttatgatgttttgttaatttcctttctgagtcagattcctcctctgatgtttatttttcctcttctgatgcgtcactgccctctcctgagctcttttttcagccttttctgtagagggataaacattgttcttagatcctgagtgaaactgtagcgacggaggtgaagctagtatcttctgagcacctatgactttttgtcatccaccagtgccttcctaagcgtattccaaatagcaatcactgtaaggggcatgtcgaatcctccagtctctgtaaaccagttctcccgtgtatgcacatctacagttaccccttctgaaaaccaaggactgactgactgtacaaagtgaagaaaggcagtcggctggctagtgccaaccttaatgcctgtttctttaagagtatgattaataccatctgtaaagaactctctgtagattttactttgccccatcctgattcaattcagtgcttccagtagttgatggaatctctgttggtagctacaaactatttacgtttacagggtcagtaccagatagcaggccagtgcttaatactagccaataaaactcccactaaaagtgacaagcagctgtgtatttatcaataacctattggatgcctctttcaggctgaacacacagatcccattttagagctttatacttagcagcaaacaatcggggtgccttcttttcaggtggaaggggcactgccttttcaggcaggggtgctttctttccagttgtcttctttcaggccacacagattcgg

SEQ ID NO: 32226 - DNA, 1168 bp, Mus musculus
actcatcagagagttcacactggtgagaagcccttccaatgcaatgagtgccagaagcggttcagtcaggtctcacacctccagtcccaccagagagtgcacactggggagaagccctacaaatgtgaccggtgtgggaaagctttcagccagaagtctgggctccaagtccataagagaattcacactggggagaagccgttcaagtgtgaggagtgtgggaaggaattcatctggagctcagggcttagtgctcaccggaaggttcatacaggagagaaaccctacagacgtcggcagtatgggaagggcctcatcaggcctcacacttccgattaacagtctgtttcaatgtaaacatagcaggagcattatatcaatcctgtaagaaaataataggaaacaaaatataagttagctattatacaatgagaaaaaccattatgacacatggcgaattacatagtcagatagcattctgataggaaatgatatatgtagatttatatttaacaattttatataccctggatataggattagaagtccaatcagatgcaattagggaccatgtctccagtatcttcctttgattcggtctctggcatgggtggagcgtctccagatgatgatggctgaagtggtcatgaaggaagtggcaggtatcgaagtctctgtctatggagaagacgtggcacaatcaagtggtctggcatctatagggtcctataaatatataaacagaacttcttctgaaaaaaacatctagtcttttttattgtccaattagtaggtttttattagaggcttgagattttcaaagggcgacttattttttgttctatgataacagtatgtgtggcatgaattagttaaactgctctatgcttccaacaggttgcacatgcacacctgcccaagagctctctggattcataaatgaaagatgcatgcacatactagttaattttgatatgccttggctggcttaaaggctgggcacttctaatccttcccaaggctagcaaacactaccctccaatattccagagttaacattctttaatatctatagctcatctctgataccccggacccagtcagggaagtggccactagggccacttacctgaatttttacatggctagtccatcctatacccctgca

SEQ ID NO: 32227 - DNA, 1113 bp, Mus musculus
gcactaaacccctaaaagtgtacgcaagcctctaattaaatgtttccttttataagcgttgccttggtcatgatgtcccttcacagcaacagaagagtggcccagatagcccatgttctaccaccaggtcactcccacagcccctcactaggggattctgggcagtgctctacaactgagccggtcccccacccctcatagggggtttctatgcagaaactctgactctgctgcctaattaggcaactgcagctgtgcagtttccctgttagcttttataatgtaatacagtatgggatctcaattttaaaaaaaaatgtatccacagcaagatctgctggccctctcctttaatcacagcacttgggaggcagaggcagacagatctgtcagttcgaggccagcctggactactgggggagttccaggacagccagggctacacagagaaaccctgcctcggaaaaacaaaacaacaacaaaaacaaagaagtatccacagttgactttcatggaatttcagaaatgaataaaccgaaaagcaacacagaagagcgacctaccaaaaggaatccccttagttaaaaaggttcaccgaagctttgccattccggggaatatagtccccagagagtgcagccactgaggaattctgggaattgtagttccaacgccagtagtggtcaaggtcgtttccgctcccgggaggggaggatgtttgtgagtgcttcctgtgaggtgaaaacctgggccatcgctctgcatttcctttgcgcctgtgctcctgatgtatcccctcagtgaccgcatctgcggcccaggaacaagcccggcatccaggtcctctctcgctgggctctgcctgaggcggggctgccctacactgacacacctcagccccttgcagagccccaggagaggctagcttcccaggggagcctggcaggggagctatgatgagagatggcccatgtcctgaatccttaagtggtatgcaactttactttttatgtgattccacccctatttatttatttatttatttatttaaataaacaatatttttattttgttaaagttattaaataaatgtatttaataattagaagaaag

SEQ ID NO: 32228 - DNA, 1219 bp, Mus musculus
gaggagttgggagcacaggcagaacccactcactgaacgcttagaacaaggctcaggctcctgccattgtctgaaccagggcctgaggggaggacaggccccaggctgtgtagctgctgttgaataagtttgtccatcacagtgctggaggggaggggagacactattaccacagagcacaacgctaagtggagacttggaccttcatccaagtcctgccctcagcctccttgggacagggcatagaaacagggctactcgatcagggtcgacagcattgttgaaggctctgggaagctcacttgtaagctggaacttatttgggccttagtttgccaccctgactacagacctccacacacaggttccactacgctgcccgcatctgggatggggtgaagaagtcctcagccctggcagagtacagccgcctgctggcctgatgccgagggagcagcagcatgcagggaactgccctgtcctgtgggctgtcctgtggacagtgagggcacagccaccctccagcaagggaggagagtgacagaggcctggcagagggatcgtggcttcccgctgagagacgtgaggtgtctgaggccagcccctccctcaaatggggggctgctcacagggtgactaagagatcccaccccgagcctggtatgagcagcctttcccaaatctccatagagaccagcagcagcaggaggaggagtcaatgtgccaggaagcctgaccccactgagtctgactccaggccttccgtgggaaacggggttggggctggagagcttttcaagacgagggtctgatggttcgaataaatgtggtcacagagcctgctctggggtttgttctttctcgaacagagggcagctaatcctgtcactagagcctacataaagacagtgcctgacttaggctaaaaaggtagaattgtcaagtgcggtgactcggcctataagctcatggagagatagaaacaggatcaagagttcaaggccagcttcagccaaccacatgagaccctgactaaataaatgaatagataatagggccatcatgtaacatgctgtgtttgcccttagcccttctctcgcccttatggattgactcttggaaacagcttggatatccctggcctcagaccccaagcaatgtgtgcgcctcctccgctcacttgcacatggtggtccttctcggttctgcttcccaaagc

SEQ ID NO: 32229 - DNA, 2514 bp, Mus musculus
accaatgtgttcctacacccaagcacacctcatcacacaatacacctaattggaaatacttgaactgatcaatggagggcccaattcacatacccgtgtttcaattatatcgataagttccccccaatcatggggttttgatcagtgcctcacatattaaaggcaaacactctgctggaaccatgtacctagccctgtgctgggctgcaggtagggttctgggcaggggctctaccactgagccacgcccccagcccctcactgggggattctaggcaggggctctaccactgagccacgcccccagcccctcactgggggattctaggcaggggctccaccactgagctacatcatatttcaagacaaggtctcactaagttgcttgggctgtccttgaactcactttattccagacaggccttggaatttgggatcctaacccctcagcctcccaagtaactgggatcacaggcctgcctcacctcctggcttagtagttttccctgaacctgtgatgttccagtgggtcaagtacaaatagaatctgagatggatttcccccccccctcggtggctttatccacatacttggatcatagttcaacaatacagtctattgtgaaaaatcataacagcatgaaagtgagacattgcaaccacatttgggaagctgagaaatctttgtttcaccccaggaccacagcgctatggaatagtgtttcaaacagtaggtttcctcgcctcatttaacatagtctaggcactcctccacagccatgtccagggtgaacgtaaattctgtcagttaatattaaccatcacagcaggcatctaagaacttgctctgttacatgtgcacatgtgtggctaagcatgcacacactggcatgtgaatgtgctcacacacatacccagctcccaggtactgcagccccctctgagaagcttgacactcaaatgctactcctctactgcctgggccccacttcccttggtctggctacagtaacagccaaactcggtctcctattaagtgtcctgagctctctaaaccctccatgtcttttctggtattttgacatagcttaggcttgccttcacctcggcatgtagctggtgatggccttgaaatcctgatcctcctgcctgcatctctccagtgccagggtcaggcacgtggcatgatgccctgctctcactgtggcttgctttggtgccacctggcatccccgtcctgtgctttgctgctctcccttcttgaggcaggaggcccatgctagatgcatcgaaggagcatattgtagccattgtgtgtgtcctggtcagctccataaacttgtacagggcacttttgtgttttgtgattccttgcccatttttgttctgttacttgagatagaggatccaggctgtctcaaacacttggcgccaggtgcttctccggtcctagcctctccttgtcctgggttacaggtagaggtggctgccttttaaactatgatctcccacccccacccctgagatagggccttactctacagctctgggcgtctaaagagctgggattacaggtgtaaatgactacatatgttgcccatacaatcttttgttaggattttcaggcttttccagaatgtaagcaaagcagatagccaggcccctggaagcctccaaataggaaaggttcagtctccctcgtcacaggccacctgctgccagcagggtgctcccatgaggcacctcgggtctgaaagagcctgggcgcaggaactctgggaaatgtcagtcctccatgctggaattgcagctacacaatcttggcattgcccttgaaagacgagcaggtttcaaacgttggtgaatggatgaggtgccctcctcaacatggagagagtctcacacttctggctcatgaaggagctgtctgttggaatgtgggggacaaatctgtctggtaatcctgtggtgtgttttggaaaaaagaataaaagggtaggaatgctattatgtgtgtcttctatttaatttattaattttaattgtgtgggtgtgtgctgtgaaagatgcagttttcacctgctgagcatcttccctgccgggcaaggtggtgattttcaaatgcttttaagtttgtgatggccaagcagctgaactcttgagccagcgtgacccactgtcccccagtccagcctctccgtagacaagcacatggatgccctctctcagtctggctctggattttagccacagggacgacagcaaatgtgatgcaatcagaggcttcaagagtgcgcatgaattgaacttcctctctgctatccttgggctccctgctgtcactgccacactgaaaagcctacaaagctaagggttgggaatgtattcccttagaacctcccagtgaggggctgggggtgtggctcagtggtagagctcctgcctagaatcccccagtgaggggatgggggcgtggctcagtggtagagcccctgcctagaattccccagtgag

SEQ ID NO: 32230 - DNA, 1229 bp, Mus musculus
gctgccaaggcttttgctatcaataaatggtttggcctaaggtttaaaaaacataaagaaggaaaaaaggaaggaagggaaggaggaagggaggagaggaaaagaaggaggaagggggagggaagaaggggaagagagggagagagagaaagagagggaaagagagagacagagacagagagagacagagagagacagagacagaaaaaaaatgttcacaaatagaactgccttgagaattttcccctatgtacactcctttttatattttaccatcaagggcatgattaggtctcttgctgcagcaacgagagtgggagcacctggagcgcgagctcggaaggagaatccacgagttgtaagaaaatggcagacaagccggacatgggggaaatcgccagctttgataaggccaagctgaagaaaaccgagacgcaggagaagaacactctgccgaccaaagagaccattgaacaggaaaagaggagtgaaatctcctaaaagcctaggaagatttccccaccccaccccaccccgccccatcatctccaagaccccctcatgatgtggaggaagagccacctgcaagatggacgcgagccacaagctgcactgtgaaacccgggcactccgagccgatgccaccggcccgcgggtctctgaaggggacccctccactaatcggactgccaaatttcaccggtttgccctgggatattatagaaaattatttgtatgattgatgaaaataaaaacaccttgtggcaaaaaaaaaaaaaaaaaaaagggcatgattaaactcctgggcatttcatcatgtcaacttccattcttccttctgagtccctgttttcttccatcaccatttggagagttcctttaaccaccctcaaggacagcaagttcttagttttcctttgtaggtcacactcatcatctttgcccccagagcatctgcagaagtcaggtaagggaggagaaatggctttgctcaaggttttggagggaatgctccatggtctcttggccccgtgtgctcatgatcatcgcggtggcagggccatgaagtagcagaacctctctcagctcatggaagtcaggaaacagaaaggaagaagaaaccatggacaaaacaccctcaaagaccagtgctaatccacaccttccagcaaggcctcacttcctgaagtcaccacaacctgccaaaataatgtcaccaagtaggggcc

SEQ ID NO: 32231 - DNA, 2982 bp, Mus musculus
gagcagaagcagtttggggccagacctgctggtgtgagcttgtattcccagaatttgagagaccaaggcaatgctgagggggctgggctgagctacaggaagaccccagcattctggggtctaatgggttcctgtctggtttgatcaaaaagctcaggctcttaccaaattgtagccgtttgtcataacactgaaaaggggggtacagaggtggcattactttcttcgaagataggctagttctgttcaaagttagttttcagactatgtttgtagttttgtctggataatgagctggcttgttctgtcacttgcttttggggctggagtgcagtggggaaacaggctcatgttttaggtcctgagaaaaggctccatgggcctcctgtgttaggaccagggggcttgttgggagagtgacatttgtaggggaccacttccgttggagaaccaaagggagggtgagttagggctgggagaatagatttttccacagaagtttaacatgaaggcattggggagggaaacatacaaggtttttcatcccacacttaaagacggggtggtcagggtggggtccccaccctgctcttagcacaagtttcttctgttgttgttaggctgcagtgcttcatgaaaccttggtcttcgcaagtaagttcaaatccaaggtgccagcccctcctgagcagcaattctggggctttatctaaagttgtgcctttaaaatgtgccagagccaggtcttgttgaagaggagaataaaaagaaataggctgtcttgctgcttacagcctctaaatagttctttattcagtcaaaaggagtgcacacaagctctggaatggcaggcccatgccttgtaattagttggcaggtggtttcccacgagatgatttttatgtggtgctggaaaggacggctagaatccccattgcagaagcttttagccttgttgtgattccctccgtttgtccgctgtgcttgcagttggctagttctttggtgatgtgctgagattcaagcacccactgtgtccaggcagcctagtgagaccaaggttccccaccctgaggaagagcagagaggtatagagcatttgagtgggcctttaagattggggttgttggtgatgtcaccttgcaaaaaggttggaaatggctgttaatcctgacactgatacgggctgtgggttttttaaaaattaaagcaaaatgaacagagacaagctgtgggggcaatgtcttgggtgccagtccaatgctaaatggaacctgggcagtagtagatgagctgagtctgtcacagggctgttcatccctaaaatgaagttgcctggggccccagtaccatgcggctcttggctactgtgtagcttgcagatgtgaagaatgcatggcacggcttcagctcagtgccttgggttttcctgacgctggtttgataggccagaagagtgcccacaggacaataatccttgctcgacccatggttgaggcaaggcacattacaagttttgaggtgcccaccacagaaagtgcctgcatcaggcacatgggtatggccacacttgatgaggcttatctagaacatggggccagtcttggtgaggggcaaagatccaggggtgtcaaacaccagttttggtacatggtctcagttacacagttgtctaatttcacacagtgaaggacaagcaggtgacctcaggctccctcttgccccacccacagcttccacagcacggcacctgtacctccgaggtggtgctggggttggttccatgaccaagatctatggaggacggcagagaaacggtgtcagacccagccatttcagcagaggctctaagagtgtggcccgccgggtcctccaagccctggaggggctgaaaatggtggaaaaggaccaagatgggtatgcagggttgtggctgggccaggggtagtctttgcctgctggtggcatgtggtggggttgttggacctccctataaatgaaggtatggggccttcagaaagcaaaagggagggcctcacccagacctctctggctgacttgctctgactctgggaaggtaatttagcgactgtctgctttcattagcctactcgttaacttttcccaattgattttttcggggcttttgatctaatgcttgcacaaacgacaccccgtcaactcccaagggtctccctctcctgccccgggctcgttaggatgtggctggccacaagtgggacttggcaaacacagtgcagttccatcacttggtactttgtttgtgcaccacccctgggggggtgggctgtactcatccagggtttgttttgttttgttttgtttttctttgtacaggggccgcaagctgacgcctcagggacagagagacctggacaggatcgctggacaggtgagaggtgcacgttatgcgtctgttgaaacagagcgggggggggggggggctggaggccacactgggaaggggttaaaaataaggtatactagccaggcggtggtggcgcacgcctttaatcccagcacgcaggaggcagaggcaggcggatttctggaggtcagcctggtctgcagagtgagtgccaggactatacagagaaaccgtgtcttgggaaaaaattaaaaaaaataagatatactataattgctggagactgggtgcccaatgtggtatgaggcttctataaacttagacctgtagtcccgtacagatacttggtgttagggcttctagccactcttcctccttagtaccaggcaccaggtttacacagcttgggatggggtagagatgtggcagacaggttcaggcccagactttgtagagtgacttccttcctaccacattccatgtaaagtgatgctcaccctgaacagcagtggtgtaaagaggagccctgggatctgacaggcactccgtgcctaattttctctctacaagagactctaccacctaagggtctt

SEQ ID NO: 32232 - DNA, 1205 bp, Mus musculus
cctgtcccagtcatctctgctgccggacctccctcttctgcctgtctctgggcttcttccatccttgcctttccctcctcccctcctcctccctcttctctttaccctctgtttccggccttctctggccaggttctcctgggctccacctcggtcctattcagcttccttcctctcgttcccaccatctccctcttctcagtaagctctgcctccctcatggccctgctcttggtgtcccttgccctctctgtgctccaagctgcagtgtcctgggggccttgtccccctcacagttggggggcaggttctgccccctgcccgtccttgtgctgctgcttcggggaacccttggtgggtgtggggagctgggctgggcacacctggtccacctctgaccctgttgccctctctccccagaaggtggaagaggtgggtgcctgggccctgggtggggggagggccagccctcccccatctctcccagcccctccccctccccatggccacctcctccccttcaccccctgtgaggggaggggtgggtaggtacgtcaccctcccgattgagctaagtatggaaatcctttctccttgtccctttccctgaccccagcctcagggaagggagggggctggtcctgtgggccacagtgggttttgatctgcccaccacagttcagtacccttggggccactcccaaccccaggtacctccccaagttcactacttctgaccttctcttctctcttctgttgcttgtttcatccctgacccggtcttccctgtccctgtcctggtctgtcctggtctgtcctggtctgtcctgtctgtcctggtctgtcctgtccctgtccctgtccggtctatcctatccctgtccctgcctgatctcccctgttggctgtccctggtctgtcctgtctctgtcctggtctgtcctgtccctgtcctgtctctgttctggtttcccctgtccctgtcctggtctggtctgtcctgtccctgtccctgcctggtctcccctgttggctgtctcggtcctggcctctgcctgactctgtccttggcctcggggtccaggctatcagggcgtctagggcgctcagagagcctgcgggtgagtgaccgccgccggccttcccggggcagcctcggggctaagggccggggtgggggccgttcccggagcgacgtggacatg

SEQ ID NO: 32233 - DNA, 1099 bp, Mus musculus
agtcgctgagggccagcccctgtgcctggtttagctccctgtaaccctcctgtctctgtcctagcggctcaaggattaccagcggcgcctggacttgactcacctacggcagagcagtgaccctatgctgagcgagttcaaggtgaacccctagtcttccctcagctcaccttggccctgctgccctgggggttcttatgtacactgtggctgagactgcatcccgggagtctccacccccatctccttcccagagggtgtccatggtgacctctgacctcactccctggtccttggctgttcagctgccctcccctcccttcatcaccttagctgatcatggctccttcctgcctcagaacctggacatcactaagaagaagttggtccatgaaggccccctcacgtggcgagtgaccaaagacaaagctataggtgagtgcacccaaaggtggtggggccatgggtagaggccaggcctgacattgctgcctcacccacagaagtgcacgtgctcttgctggacgacctgctgctgctgctccagcgccaggacgagaggctgctgctcaagtcccacagccggacgctgacacctacccccgatggcaagaccatgctgcggccggtgctccggctcacctctgccatgacccgagaggtggccactggtgagctggggcaggtcatctgagcgcacttgtcctatggcatggggagtggaactctctaagagccacagagctcactctggggaggaacaaagacttggaagggtcctaatgaggcagaactgggcaggactaagtaaggatggcagagatgaggcatagactgtcattgcagaactcaagaggctaagggaagagagaggagcttgagtgtgaggtcagcttgggctataaaggaccaccctgcctcaagaaactaaaaatagccatgcttggtgacatatgcctttaatcccagcactcaagaggcagaggcaggcatgatctctgtgttcgaggccagcctggtctacagagtgagttccaggacagccagggctacacagaaaaaccctgtcaggagaaacaacaacaaaataagaaactaa

SEQ ID NO: 32234 - DNA, 1183 bp, Mus musculus
ggccctagtctgaagtgacctgagggctcctgggagaggtgaagctagacagcagaggtggggcagaggaaggttgttatggggacagggggctttggggaggcagggtaggggccaggtatgggagacactgatgtgaggagtctgtattattacatggaaggttccagagtctgtgacactagatgggtggaaagtgaccctggacacttgtgggaaagggtcgggtgggaacggctaccttacaccatctgttcccaggccgggaggtgagcccagcacatcagtatgccctggctggtggcgtctctttccccttcttctggctggccggtgctggctctgctgtcttctgggtcctgggtgagtacagggtctgtgtagggtgaggctgggagccaggcgaaagagcacagcctgaaccacccatccccctacaggagccacgctggtactcataggctcccacgctgccttccaccagatggagcctgcagatggcgaggagctgcagatggaacctgtgtaaagtgtcctccaggacctgccggcctctcctgccggccggctgtcccatctctgtctgttctcgtcctacctggccttgctgctcagctccgagccttccacctgaggcctcaaacccagggaggggcttttgtctttggaaataaagctgttacaattgctatttggccaatactttcctggtattttctcttttataggtaaggagaggggttactaaaacacgaggtctgaggctggagagatggctcagccccagatggcactggctgctcttccataggacctgggttcagttcccagcacgcacttgtactgcacacacccacccaccccccccccacacacacctaagcataattaaaaataaaaaaaagtcagctgggtggtgatggcacacacacatgcctttaatcgaagcactcaggaggcagaggtagggtggatctctgagtttgaggccagcctggtctacagagccaggtctgtaggcataggtcaggtatagctatatagtgagaaccctgttaaagaaagagagatggagggagggaaggcaggaagaggactatggccagagcaaccctcccaatgtgaatgaacccgaacagttggggagcagctgcaggtcctttaaggagcctgtcctgggcag

SEQ ID NO: 32235 - DNA, 1235 bp, Mus musculus
gccaggagatgctgcaggagctacgccacgccgtgtcttgccgaaagacctcgcgttcccgccggcgccggcgccctggtggcccgagccgggccctgctgtcgctgcgcgcagtccgcgagatgcgactcagcaacggcaagctctactcggccggcgcgggcggggacgcgggcgcgcacgggggtccgcagcgcctcctggacgaccccggacctcctgggggaccccggccccaggctcccacgccctgcacgcacgtgcgcgtctgccaggagtgcaggcgcatccaggcgctgcgagcttcgggggccggggcgcccccacgtggcctgggcaccccagccgaagccaccagcccgcctcggccgcggccaggccccaccggaccccgcgagctgaccgagcacgaatgaccgtggacggggccgggcgtgcgccccgactgactgcagggacgcgatgcgccccagacggacaggacgccgcgattttgccttcaattcctggtgaagtccgagcccggctccggagcaggcctgcgcctcctagtggacttgagcaagggtgtcgcggacgcccgcattctatcccgcaccgtggacgggaggagcgcagagaccgaggactctaagggccacggactgtgggggctgctcccggagttggaaagcggtccgcggggaggaccccaacctgggactgcccagatgccccaagacttgacacggctctccacacttctggaggtggggagggcctctggacatgtgggtgtcccctggtgcccctctcttctctttctctcttttttggggggagaaacctcagaaatttctatgagacgcccccagggagagggtctcttgggcccctatacctccccctgccacatcccagtcctgttggaataaaaaaaagaacaaaaccccaaaactgggaatacctgggttttattttctgggggagggaggtcaatggacgtttttagaccctgggagtttaccgaaaacagcaagagatttgcacactcgccaccttgcacaatgcccgctgcatgcaggtcagctcaggtcccagcagccgccccctctccattgaccttctcaggacagaaggaggctgcgacagagaccctgagacagatggagagatgcaggatctgagaaggcggagtaattgggagggaagactcgaaagaacgaaaccagatggggctggggggatgggagagc

SEQ ID NO: 32236 - DNA, 1961 bp, Mus musculus
acatgcatgaacatatgtgcacacacactgacaaacaaaacaaaacatgtctatccgttctggtaagcaatgaataaatgccatttagtcccaaggtcccagagcaagctaatgtctgggcacctgggtaccagtctcctacttcctcacaacacaagtgtacaggtcagacaacagcagatatggggtttcagaagcaagactgccagccagtaacgctagcatttgggaggcaaatgggggtggtggggtggagaaggagttcagtactagcctgggctatgtaattagttcagagctagcctgagcaacctaagatttttgagagagagagagagagagagagagagagagagagagagaacaaactcagggttgctgtgatcaacacctaccacagcaccgttaggagccacacaggagcagagctgcgtccagtctcagctctaactctctcgatggagcctgcaggtgtctctaactgtccacctctgtctcgtgcccccttcctctgccccgcctgcttcccctccagcagaaggcagacctggctgtggcagccttcaccatcaccgccgagagggagaaggtcatcgacttctccaagcccttcatgaccctggggatcagcatcctctacagggtgcacatggtatgtctccctgggagtcgggagtggctgtgacctagcacaggggggaggtggggactagggacggactaaagtggacctgcgggtgggtcaggtactatggcttctcagttcctggaggattggggtggggggcaagcacacagccggggcggggtggctgctctcaccaccctttgccctctagggccgcaagcctggctacttctccttcctggaccccttctcccctgccgtgtggctcttcatgcttcttgcctacctggctgtcagctgtgtcttgttcctggctgccaggtgagtagactggtgggggacggggggttggagaggcaggagcccagcctacaagcctccctgccctgactgtccctcttctgttggctgaacactgcagagccacaggtgccctgtctccatttctcagtcttccccctactccccaggggtctgacttgggcctctctccttcctctctcttctgtcctcttacctccactgcagtatccgttcctggggcgtgtcagcatctctgttccctgcaccaccaccccccttctcttctgcatgtgtccgtcactctttcccccgcctcttcccttctcatctcagtggctttactacctcttgcaccccctccttttcctcatccactcatctctccacaggctgagcccttatgagtggtacaacccacacccgtgtctccgggcgcgtccccatatcctggagaaccagtacacgctgggcaacagcctctggttccccgtgggtggcttcatgcagcagggctcggagatcatgccgcgggcactgtccacacgctgtgtcagcggagtctggtgagcctttttttatctaaattgggaggccttccattctggggatatgggcaactgtgttctccccagcatctttctgttcccgccatggctctgcagtgaagagctgaacctcaacaaagtggcccactgtctctatggccttggctaggtgtgtactctctccttgtctcagtctccctcgcccgaaataagatagaaaggcccatgtcacatttaaaagcacagcatttgaaaatgtctggggcaggagaattatgagtttgagatcagcctgagccttactatcaagttcaagaccacactgggctactaataagacagtgttctccctcactctccaaaattcccagggattggggcatgacttcatggcagagcatgcggctagtgtgtacaagcggctgagttcaatcctaagtacatgaggaaaggggcaggcccacggcttgggttcactgagttat

SEQ ID NO: 32237 - DNA, 1117 bp, Mus musculus
tgcctcctgtgtagccgggagtttggtaaggcgttgcagctgacccggcaccagcgttttgtgcaccggctagagcggcgccataagtgcagcatttgtggcaagatgttcaagaagaagtctcatgtgcggaaccatctgcgtacacacactggggagcggcccttcccctgccctgactgctctaagcctttcaactcaccagccaacctggcccgccaccggctcacacacacgggggagcggccctaccggtgtggggactgcggcaaggccttcacgcagagctccactctgaggcagcatcgcctggtgcatgcccagcacttcccctaccgctgccaggagtgcggagtccgttttcaccgcccttatcgcctgctcatgcaccgctaccaccacacaggcgagtacccctacaagtgccgtgagtgcccccgttccttcttgctacgccggctgctagaggtccaccagcttgtgatccatgctgggcgccagccctaccgctgctcatcctgtggggccgccttcccctcgtcactgcggctccgtgagcatcgctgcgcggccgctgctgcccaggccccacggcgctttgagtgtgggacctgtggcaagaaagtgggctctgctgctcgcctgcaggcacatgaagccgcccatgctgctgcgggtcctggagaggtcttagccaaggagcctcctgctccccgggcctcgagagccactcgcacaccagtcgccccctccccgacagccctcagtggtacaacctctgctgcccctgcagcccctgcccggcgtcggggtccggagtgcagtgagtgcaagaagctcttcagcacagagacgtcactacaggtccatcggcgcatccacacaggtgagcggccatacccctgtccagactgtggcaaggccttccgccagagtacccatctgaaagaccacagacgcctacacacaggcgagcggccctttgcgtgtgaagtgtgtggcaaggcctttgccatctccatgcgtctggcagaacatcgccgcatccacacgggtgagcgaccctactcctgtcctgactgtggcaagagctaccgttccttctccaatctctgga

SEQ ID NO: 32238 - DNA, 2223 bp, Mus musculus
aatgttaaaaaaaaaaaaaagaaaccaaatatcgttggctgggggccagccagggcaaggggctgggggctgggcggagccaggtttggttaggtgggggggcggggactgccagtccctcccacccccacctgccccttccactccagtcaccccagtctccgactccaggaaacaaaactatctcatcgtttttattttgtggtctgtacagagcctgtgtccgtgtgtctgtgtgtgagcgagagagttggacggctagggagtttcactggagtggggagggagaccccaggccaggctctgcaccagcttggacatcaggcagtggacccggggcctgggctgggggagaggtgagtggactagggggagaagagctttgaatttctcttctcccagccctgacccctgcttaagggaggaacagagagaggctggtctgccctcgacggtgggccttttgtgccaaaaataaataaataatgccagtaactaaaccacctctctgttcccttcttgggggtcagggtagggactagaagcgggaggaaggggttgggtgtgtgtataggggaggggaggtacggggtctccaagcccttcccctggggcgctccagccagggactagtcaagtcggggcccatgacctgttgacctggctgtttctgtcatccagcccattcccagggtgcctctctccccctcacccagggtaagaactgagtgagacaaatgagcacgattgagacacgcgggcccccaccggtctctgagtgggaaaggcaagtgcgagagataaaggcctccaagagaaaaaaaagaaacaaaccaaagatttaaccatttaaaaaaataaaaaataaaaaaaaaattaaaaaaaaaataaaaccacagacaactccgctacctttttatacgttggggaaaaaaaatgaaaaaaaaaaagttagaattaaaaactaaaaaaaaaaaaaaaaaaaaaaaaaaaaccaaaaacaaaaaaacaaaacaaaaacaaaaccagaaacaaaacaaaacaaacaaacaaacaaaaacccaaaaaaatttaaaaacaacaaaaaaagaaaacagaaacaagaaacccacaaaaacttcaaaccgcggttcttttgtgtggtttaaactttgacctcagcagtctccaaagcaagacgatgatgacaaaggcggaaaaaaaaaatgtatatttttaagtatttgtccttggtgttagctccttcctaaaaaacaaaaggagcaaaggaaaaaaacaaatccagagaagtgttgctggaatggagactacttactttgtctgtgaacccccccattcctctgcccccgccttctctagccctgctgcccttcccccaacctgtcctccaaggctaggggcttaatatttatttatttatgtaattgcagggtgccagtggcttctcctgaacagaggtcctttggatcatagccgggtaggggagggaggcaggcatctttggggttatggtcttttgatcagcttagctaccctggctccgggtattagcccaccatggccggccaccatcccttctcaaggccaaggccctagggcagagtgagcactgtccttgtaaagatctgactggctccaccctctcggtgtggctgtcctctacagactcacttgaatgcccaggtggagccctggtaagtagtgggccagggtgggggccctggagtgacctgccttccctccaggcccattgaggtagctcttttggttgtcagacccctgtgttggcagcccctcccctcccctccccgatcccttccctgtctcttcttgtggtagcgggttagtgtttccgtgtttttaacttcaatctgcttgttcattgtacaatgtgcttcttttaaggccccgtttttgtaacttgtgtcattcatctgaaccacaaaatcaaaaaaataaaaaactaaaaactgtacagagagaactgatgtctggtgtcccttggcctcccgagtcctgagaagttaaatcagggtggcggggggaggggaagactgctctgttaaaatacaggatcaagaagaacgctgcatggctctgtgtgcccagggtttgaaaggctgaagaaagaggactgactgccttgagcaccaagctcataagctacttggtaagtacaaggccaacataggcctaagaatgtcttcagtgaagccgggcact

SEQ ID NO: 32239 - DNA, 1136 bp, Mus musculus
cccagagccacctaccaaatggtcttttccacaaggtaaaagagaaaggacccgaacaaccttacaccaaatactcagtagcttcatccaaaggatgtacagagttttcagcgttgcgctcaacagaatgtgtgtcccttctacgtgtttcctccccccccagccccccagctctccccaacagggcagggggtctcgctttaacccctccccccgccacccccagtctggggagagttcagaggaaggcctgggaatgggcttttttgtcctctgcccctttctttctccctttgaagggtgggctaggccattttttgccgagttccagctctcaaaagcccctcctgagctcccccatcacctttctgctctggagtctacctcctccccagactgtgggaaggtggtcggttcaagcaaagggggatacagtgagggcaaccaagttgtctttcttcccatcctgtctgtcagtttccctgaaaaaaaaaatcatattccagtgcctatccgtgggatcttcacgttctttgacattaaccagaaaccaaaaagattaactcgcctcgctctgcccaccctacaccccctatgatactggcagatacctctcctgtccccttccctccccaccttccaatgcacacacgcacacaccccagtggtgggctcctccggatggcatctccatcagaaccacatggtggtgacatcactatgacctgtggttccccatgcaagtggctaccactcccacgagacctccacgagtattggctggaccctgtatttgcctagctctggacaaatctcaacagtggacagaggagatgctactgggagccaccatgccctcctaccatggaggccaacaaagttttgaaccaaaaaaaaaaaaccaaaccaaacaaacaaacacacacaaaacccaacaaaaaacaaaaacagaaaaccaaacaaacaataaattaaaactagaaaaaagaatttatagatatatatatagatatatatatatatgggaaagaagatgtggactcttcaagacaagaatgagccgcaagatggagccaagccctgcagggtgatccaggcctttggttgccggggcggatggaacgatggacgcttct

SEQ ID NO: 32240 - DNA, 2324 bp, Mus musculus
ctggggattgctcaccttgcccattcatctaaccaacctgggctctgcctgccgcacatacagatatcccactctcatcaccttcccctgctccctggagtgagacagacttgcctttgggccttttaacccagactatcacacatgggctttgtggccacatcaggtcaagggaagctgtttcatacagagctaggaccagaaccagccactttctcgtgaagggaagacgaggacgagggctgatgggaagatggttcacaaactgcgccaataaaactgccctggaaagggcacaggtgggcgtccaggctctccggtactttttgttcgtcagcaaggggaaagggctggagaagagcaagatgctagctcatctgaacaggcatctccattccttgggcctctttttccttaaccatcacaggaaataaggccctggcatcgacgcccagcctgttcacacatgcactgtagggttctgtatgctcatggaggggaaatctttctaagttttatgtgtgcttgtgcaccacgtgtgttctggcctcctcggaggccaaagaacagggtgttagatgccttggaactagagttagagccagtcaagtcactgtgaggctgctgggtcctccggaagaacagccagtgattctaaccactgagccgcttctccagccattttcaggtgttcgtaacgagcccgtacactgagtgtagtgcccatggatggccaagttgtgagatcgccctggaactcaagttcccagaagtcgtgagctgcctgacatggcagcttggaaccgaaccctggtcccctggaagaggactccaggatttttagccctctcagtgagaggaattgattatttccaaaactgttggagccctgggaatggggaactggaaaggagaggcagccaggggttctctgcctgcaattccttcccccgaggctcccaaccctccctctctgactttgggtttcagagtccaaagctaaagcactacttgccactatgtggcccaaggggaatgtgtgaggcctctcctgccttctcccctcagaaggcaaagactcgagtgtttctcacacgaaatcaagtcttccatccttagggcctaaggagcaaggactggagagatgggggtgggtgggtgggtagattccaagggctgccctcttctgcgtcaagaagtgttcttgcccatgcctaagtgctcttcctggacccctaatggttggtggacagggaagaaatggcagacgtaggggttgagttctgtccaggagtggaggtgggtcccaccggcctctgtgtgtcctcagaacctgctcttactgcctcagagcaaagttctactaggtggtctgatggcaggctgcattgtgtgaggtcagtaaagcagtgccctgaagggtgagcggttgcaggcaggctggaccagtgaggggaggcttgcttaagtagtcctttcctgtctggcccgggaagagcataggcttgcttttattagtttgttgagaactgggtcctactctgtatctctgaaacacataatgtggatcaggctgacctcagaggtccaactgcctctgccccagagctctgggatatgcccttaggccttcttaccacagtttagctctgaggctctcccagcgtgagttttaagtgtacctggaggtgaagctgccacactccttggcccaggactggctctgttcaagccttgaggtagctccccttttccctcagctacagtctgaggcttctggctgggcagatttcctgctccaggccagttctttccatgcctctctcagacagcctctcctgcctgttaacttccaccctacctacacttcaccctatcggctttcatcacgatgtgcaccagggggaagttaacctaggtaggaggaaagggacctgtgcaggtggagtgctcccataagtctgtcgtggcacaagcccaaggagttgcccgggcgcacctgcaaccttccacggtgcatgctctgtggatccctcctgggcttgtcagagagttttgggtaccaaagaggtctagtagactccccagaagtggcttacaccagcaccatgaaggcaacgcaagagcttcaaaagttcagagtcaggatttgagggagggggcaatatcttaccactgagataggaccctgttggggcttgacgacagtggcccatcactccacagaggaacagagctgagggcttgccctggaatgaggagttccccagaatgattccagtatgtgggggctggggggcaggggcaaaacggtccttaccaag

SEQ ID NO: 32241 - DNA, 2009 bp, Mus musculus
gtcataggggtaactgcagcagcatttcctcatgtgggggccaggcccagtgtcaggcatcctcaagcttcagaaattggggcctggcttcctaagtcttccatgtgactgcagcaggcattaaaattcagaaaccaagggtttacaacagttgagctgaggccatggggcagccagcagggacagtggcataatatgggtcaacagtgttgagtgggaagcagtgggcttgagttgagctctgccctgccttcccgtcctaggtgtacatgtaccagctcttccggagcttggcctacatccactcccaaggtgtgtgtcaccgtgacatcaagccccagaatttgcttgtggaccctgacactgctgtcctcaagctctgcgattttggcaggtaggtctgtcctgtagcctgtggggtgcctgaaggcatgaaagaacctccagcttgcttccatgcttaaccctgcctggctcttcccacagtgcaaagcagctggttcggggggagcccaatgtgtcctacatctgctctcggtactaccgtgctccagaactcatctttggagccacagattacacctcgtccatcggtcagtcaggggagggagtgatgggcatagtgattaggctctaccagttgtccttcactggtgttccaggctgaggaggctggagctgctgcaccttgttagagccgctaaccaagagaaagctgctagcagcttcccaggggctcaacaggggccacggcagggctgggatttcaagtctgacttggctacagagttcacctccacttagaaactcccagtcagcctccggtctcagtaggagggaaggggctgacagtaatcagaactgttcccataagggtatggcctgctcccagggcctgccttgttctgtttctgagcgtagcattcccttcttccaggcttaaggggaaggctgaaatgagagcatgtacaggaaagtagggtgaaggagtgtgtcagcctgaggggctggtgaggccctcagatgggaacgtgtaccagtgcaggtcacagtacacagtagggagggctgagcaggccacaggccaggtggtgagcagctagctcaggatagaaagctttcttgtggctcagagcacacaggtgccagtgggcagggtcaggccatgtgctagtctagagaagtaaagaaggcgtcaaagggttcattgggatcccttgtcaccgagggcgtgggggccataagcacacctagactgaagagcacagcctgagccagtgctgctgcggtgtgtgtggggatcaccatgaggagcagtgtgcttacctctacccttccccttcagatgtgtggtcggctggctgtgtacttgctgagctacttctcggccagcccatcttccctggggacagtggggtggaccagcttgtggagatcatcaaggtgagttcgagggcagggccagagccagggaaagcaggggtgggcccgaggaaaggggctttgtctcaaaccctcactttacaggtactaggaacgccaaccagggaacaaatccgagagatgaaccctaactatacggagttcaagttcccccagatcaaagctcacccttggacaaaggtaggggcagaaatgtgaacttgcacagcatggctgaagggtgggtccccttggagaccaactactctggggacctggcttaaaatcatggtttgcagagtggacagatggctcagtggttaagagcacatgttactcttacacaggatctgggttcaatttccagcactcacatggtggctcacaaccacctgtaagcctagttccagggggtccttactggcatgcatgtggttaacacagatgtgcacaggcaaaacattcacatacatcaagtaaacagattgaaaatcaattaccaagggggtagtctctgaagttatccagggaggcagtcaacattttgtgattgtgaagtttatagaattttaaaagttgagaactca

SEQ ID NO: 32242 - DNA, 1880 bp, Mus musculus
gtcatacagaggtgtcccaggcaaagaaatgtagctggagactctagtgtgctcctggttacttgatttctcggctgttgggtaccctttatgcatgagacccagccttgtgtcatggtgcctgggtcctgtggagggtggcttgatggcccgatggtgttttatgcccacagctattattacaacaagcgcattctacacaagaccaaggggaaacggttcacctacaagttcaacttcaacaaactggtgctggtcaattaccctttcatcgatatggggctggctggtgagtgtgtggcctgcgtgtcagaagagggtgaagaggtggggttttctgtgttcagaggagaccagagaacatgatgcctactctcccttcttttgtcagggggtgcagttccccaaagcgccccaccagtgccatcaggcggcagccatttccgcttccctccctcaacaccctctgaggtgctgtcccccactgaggatccccgatctccaccggcttgttcttcatcatcctcttctctcttctctgctgtggttgcccgacgcctgggccgaggctcagtcagtgactgtagtgatggcacctcagagctggaggagcctctgggagaggaccccagggcacgaccacctggccctccggagctgggtgccttccgagggccccccctggcccgcctcccgcatgaccctggtgtcttccgtgtctatcctcggccccggggtggtcctgaacccctgagtcccttccctgtgtcacctttggctgggcctggctcccttctaccccctcagctctccccagctctgcccatgactcccacccacctggcctacacaccctcacccacgctgagtcctatgtaccccagtggtggtgggggccctagtggctcagggggaggttcccacttctccttcagtcctgaggacatgaaacggtacctgcaggcccacacccaaagcgtctacaactaccacctcagtccccgcgccttcctgcactacccagggctggtggtgccccagcctcagcgccctgacaagtgcccactgccgcccatggcaccggagaccccgccggtcccctcctcagcctcgtcttcctcttcctcctcttcatccccgttcaagtttaagctgcagccacccccgctaggacgccggcagcgggcagctggagagaaggctctaggaggcactgacaagagcagtggtggcagtggctcgggtggactggctgagggggcaggtgcagtagctcccccaccgccaccaccccagattaaggtggagcccatctcagaaggagagtcggaggaggtggaggtgactgacatcagtgacgaagatgaggaagatggggaggtgttcaagactccccgtgccccgcctgcaccccccaagccagagcccggagaggcaccgggggtggcccagtgcatgccccttaaactgcgctttaagcggcgctggagtgaagactgtcgcctggaggggggcgggtgcctgtctgggggccctgaagatgagggtgaggacaagaaggtgcgtggggacgtgggccctggggagtctgggggaccccttaccccacgacgggtgagctctgacctccagcacgccacagcccaactctccctggagcaccgagattcctgagagctgtgggcacgggcccacccccacccacccaccaccccactccctgagcttttgctgccttaaccgccccgtccccgcctcccccccccccccccccccagtcccggaggtgaggacagctctctttagtctcttccctgcctcctccctttctcctcccccacattttgtataaaactgaattttttttttaatggtagggt

SEQ ID NO: 32243 - DNA, 1186 bp, Mus musculus
ttatgcattgggaaaggtggtttctgaaggaggaaaaggaccacttttggatttcagattgggggttgaggcttcggggagactgaatctcgcacagagtcttgcttgctttctgtttgaattggaccccgcccatttttaaccatataccttggtcttccttctatagtggctcccgggcccctgatctgcctccccccttccgtgccttcctcccctttccctcctcccacccctccattaccggctgcctagtgctgaattattgatggcccctgattacccgggggtttgggaaatgacaacaaccgcagcccccccaccccaggctgcccaccccctccagggaccaagtcagcccgccaccaacctccacccaaggttaatgctgggggcgggccagcaggtgggctgagagttagccaaggatgagaaggcagaagaggcaagaagatgacagtcctgagcctgcctgggctgtctgggctgggttccctccatccaggtcctaagggtggacttgaggagggcattattggctcagagggtccagtgctgtgggggttgggggggctctcagacagtctgggtttcactctcaagggaagacagaagcctctgtgtgtgcaagcgctgacctcatcgtcaaccagccaccccacccggcctggtccttttaagaaaaaaaaaatactctccagtcctgggtgggagtaggagcttctataacctgagagaaagatcatacatgtttctgaggggagggccacagaagcagaggggcactgctagctctgaatggaagttggggtacacatagggggctgtgtccccatcctgctggccacgtgtacccttttctgcccctcaccctccctcactggcagccctgcccgccatcctggcttggtgcctggccccctggcactggccccgggacccgccgccgttggtttcctgtttctcccggtgtcgctggagccgactccagcttcccctcctcccagctcctgtctaggcccctcacgcagatgcccatacggttactctcagatttgggtcttaatctggctgaggaaaagggctttcctgatggtggaagactgaggggtggggcaggacataaaaactccagtaggagccagagcccccaccttggcatcttgaccccaggcaactccctgtc

SEQ ID NO: 32244 - DNA, 1181 bp, Mus musculus
cccctgggaacctggggccttgctgaggaagcaccctgcaggcccagaggaggagcaggcagagcctgggcccgctttgcctccttgtccttcttccgtggagcccaagcaacctgaggatgctgaggtctccaacatcagctttggtagcaacctggggactcgctgcgaggagggggaggagaagcacccaccatccctgggcacccctgtcctgctcccactgcctccaccccagctcctgtcaccacccccgaagtccccagcctttggtggccctggccgccctagtgagcagccttcgccctgccaggaagggagccagggtggcagccgcagtagcagtgtggcctcactggagaagggagctgcaccagcagcccgtgctcgcacgccattgacagccgcccagcagaagtacaagaagggcgacgtggtctgcacgcccaatggcatccgaaagaagttcaatggcaagcagtggcgccggctgtgctctcgggatggctgcatgaaggagtcccagcggcgcgggtactgctcgcgccacttgtccatgagaaccaaagagatggagggcctggcagacagtgggccaggtgggactgggcggcctgcgggtgtggcagcccgggaaggaagcactgagtttgactggggcgatgagacttcgagggacagtgaggccagcagtgtggcagcccggggagactcccgcccacgtctagtggcgcctgctgacctgtcacgcttcgagtttgatgagtgtgaggcggctgtgatgttggtgtcacttggcagctcccgctcaggcacaccttccttctctccggtctctacacagtcgcccttctctccagccccctctccctcaccctcgccgctctttggcttccgccctgccaatttcagccccataaatgcctcacctgtcatccaacgcactgctgttcgcagccgccacctgagcgccagcacccctaaggcaggcgtgctgacaccaccagacctgggcccccacccaccgccacctgcccctcgtgagcgccattcctctggcatcctacccaccttccagaccaacctaacctttactgtgcccattagccctgggcggaggaagacagaactgctgccccatccagggacattgggggcctccggagcaggaggtgggggag

SEQ ID NO: 32245 - DNA, 1156 bp, Mus musculus
tctttctcctaatggttctgtatggcctactctctcagtgatgagtgtctctacctgttcatcatctagattctcctcctctcagtctctgaactgacttatctccagctcagatctctgctcttgcctggcctatagtgtaggcctcagccctccctgccttctggggtcatagcttaccctagcctgtgggcactttcacccacagattatccagctgactcctgtgcctgtgagcacacctagtggcctggtaccacccctgagcccagctacaatgccgggacccacatcacagcctcagaaggtcctgttgccctcttccacaaggtgagtccagttaagcctctttcctcactctaggccagaccaggggtggagtagggccagcccacctcacctcacttcactcctcccctttcctctcctgtggcagaatcacctatgtacagtcagcaggtgggcacactctgcctctaggcaccagttctgcatgcagtcagactggaacagtgacctcatatgggcccaccagctctgtagctctgggcttcacatctttggggcccagtggtcctgcctttgtacagcctctgctctcaggtgagaagtggccttgggatttggggtggggttgagatagctccagatcctaacttggttccctgccccttctgtcttcctcccagcaggccaagctcctttgctggctcctggccaggtgggcgtgtcacctgtgcctagtccccagttgcctcctgcctgtacagcctctggaggtcctgtcataacagcattttaccctggcagccctgcacccacttcagcacccctgggcccaccttcccaagctccgccaagcctggtctacactgtagccaccagtaccactccacctgctgctaccattctgcccaagggcccaccagcctctgccactgccactccagcccctactagtcctttccctagcgccacaggtaggtgtcagggcagctcaggggcagggtttgtgcaagctgggaaatgcagggaatgggcttgagtgggcctggctcagtagatgctttttttcctttaccggcaggctccatgacctacagcttagtggctcccaaagctcagcgacccagcccaaaagctccccagaaagtaa

SEQ ID NO: 32246 - DNA, 1064 bp, Mus musculus
acctggcactaaaggccctgagactgtaagtatctagctgactgtggaactctaatactggtctctcttcttgccacttggtcttttccttccaccatgtctgtgtgtatctcctacctgtctgctgtacccattccattctacttgagatctgtgttctgggtatcctggccttcaggggccaagggtttttgtctcatcttttctctctcttaatcttgttcctggctattggctcatgatctcccctaccccactcctctctctctcttaacactggcacatctaagctcagtgatcttgcctgtccccacctcaggccagcaaattccccagctcatcttcagactggcgagttcctgggctgggcctggagagtcgtggggagcctcctacccctcccagcccagctccagccacaggccccagtggaagcagcagtggcagcagcgagggcagtagtgggagggcagctggggacacacccgagcgcaaggaagtcactagttctggcaagaagatgaaggtgcggcccccacccctgaagaagacctttgactctgtggacaagtgagcaggggctgggatcttggcagagtgcctagggttggttgggagaaggggcagctacaggcagagacaaaagaggtgaccctgctggccccccagcagggtcctgtcagaagtggactttgaagagcggtttgctgagctgccggagtttagaccagaggaggtgctgccctcacccaccctgcagtctctggccacctcgcctcgggctatcctcggctcctaccgaaagaagaggaagaattccacgggtaggcagctctggctcctaaataggttgggggcaggcctgaggccacctctgctaaatctgagcctgcttgtttgactagacctagactcagcacctgaagatcccacctcacccaagcgcaagatgaggagacgttcgagctgcagctcagagcccaacacccccaagagtgccaagtgcgagggggacatcttcacctttgaccgcacaggtgccagtgtttaggagactgggcttt

SEQ ID NO: 32247 - DNA, 1235 bp, Mus musculus
tccccagcccaggccacagcagccttccaggcccgctacgcagacatcttcccatccaaggtgtgtctgcaattaaagatccgagaggtccgccagaagatcatgcaggcagccactcccacagagcagccccctggggctgaagcccccctccctggaccaccccctactggcatggctgctactcctgtccccactcccagccctgctgggggccctgaccccacctctccaggctcggactctggcactgcccaagttgccccgccactgcctccacccccagagcctgggcctggacagcctggctgggagggggctccccagccctcaccacctccctctggcccttccacagctgccacaggcaggtgaggggcccttgttaaagaccccaggacccacagtacccccccctcaggatatggacagtatatagatggcaggaattgggggccagacagtgggatagttaccgcctccccaggaagccatttgtcctttccagttcggcgcggaatgtggcctgttcccttgtatatatattccctccctgtgctgggggcagcaggggcagataccctccactgagctcttgtagataacctgaagtgtgtgaccttcagagcttttcacttgtactttatgcagaatggctcctgtgagggctgcaagctggagggtagtatgagccttgggccacagggagaagatgcctgtggagtagtggggagttcatgcacccccctttttccccagaggggctggactcaggttagtttggggtgggggggttcctgcactttgccacaggcatggggaggattctccccaccctctgccctcccaacttgggttgtactttctaagaaggtgattccccctaccattgtccccattcccagaacaaaacatgttgatcatgtgcaatatttcttactgtgccgagaagccgcaatgaccgagattaaagctgtttaacacacgtgtgggctgctggcttgtttaagtactacttaacacactcctatctagctccaggtggacatgggtcagttccacacggccccatcattacctgttagcaccaagggacttaactttgtgtggtcagacagccagagcagtctggggactgtctacctatccaataggcagcagcctgatcaagtacagactgagaccttgcactgtgagaagggcagttcatggctattgggccactgaatcagttt

SEQ ID NO: 32248 - DNA, 1144 bp, Mus musculus
aacagtggcagggaccgttcgcctgttgcccaagggaatgcaaggtaatttgaatgttgaaaaaaatctcagaaagttgccaggtgttcctgcattaaattaagctttatcgcttctagctaagacatttccacctctgaaagagcccactggcattatgtctttaatgagtaactctgcaaacaggctgctgccacctgcaagattcttagcatgtcctccctagtttcacatccttaaactgttttacagctggcagtttcctgggggttggggggtggtgaaggtggacagtttggtccagagatgctgatctgacaacttactattggtgtgcctcctcagggcctgcttccgagaggccagcaccccaacccacttcgagagaaaaaccgacaggtaaacgagctggttcgggcagcactggctggctacccccgagcccacttcttagatgcagaccctgggtttgtgcattctgatggcaccataagtcaccatgacatgtatgattacctacacctgagccgcctggggtacacacctgtctgccgggccctgcactccttgcttcttcgtctcttggcccaagatcagggccaaggcatccctctgccagagacagcatcctaagcatctttccttcccttgatattaaatgcttcttctcctcttcctgttttctgctttatggttaggcatgtctgagtaccagttgttactcaaggtgtttctatttgtacctacaagatattttggggttttttctttgtttttcgagacagggtttctctgtatagccctggctgtcctggaactcactctgtagaccaggctggcctcgaactcagaaatccgcctgcctctgcctcccaagtgctgggattaaaggagtgcgccaccactcctggcagatattttggttcttgaagtcagttgaatttcagtagtgtgctttgggcaaattctggttgaaaccagtttgccattattacccagttaggatcagtgtccgtcagtaatctctggaacagtatccaaacagtatcaaatatctcaccccacaagctgtcccctcaggaagttgtcccagctgatatatgctaacttcctggtgctctggattttttagatgttacatgca

SEQ ID NO: 32249 - DNA, 1196 bp, Mus musculus
acgagtgccgcttggtctcgcctgcccctcccccctgcgttgggcccccgtggccgcaaggggtcccggcgggaagcggcagacgagcccactttgcggcctccatcgggggaggggagcgaggattccttcctacgtgacggtttctagtctgcgaaaggaggcggcgtctgggctcggccttcgccctacgcgcgagcgagcgcggcaggacggtccattgtgttggcccgagaggtaggggtgggcgtggcggatccacgtcctcgcggagctttcccgggcggactccactctcatccccagggggctgcggtgctgaggatgagtggggaaggggagaacccggccagcaagcccacgcctgtgcaagacgtgcagggtgacgggcgctggatgtctctggtgagtgaccgcgcgtggtccccagggttaggggcttggggggcgtgtatgtctatagaactgcttcgtgacatcctcctcctcacctaggtgggcagcctggtttgggttgtttggggttgttccgcctgaggcagcggggtggggcggggcctggagcgtgcgtgcctttgactctttctggctttctctgcagcaccatcggtttgtagcggacagcaaagacaaggaacccgaagtagtctttatcggggactccttggttcagctaatgcaccaatgtgaggtgagggtccacccgtttcctccttcctcatccaggcatgcaccctcactggcacttcaagcccagaacctgataagacaagataaggggtacagaaatgcccgtggtagcaggaatctaagaaccccatgtacatgtctgctgagaatgaagtgtgtgccctgagtttgtcgggttgggtttgtctctgtcgagttaaattgaggcgttccttcaagattgtgtcaggtgagggcttttcattgtttgtttaaggtggggcacagcccctgttgggtttactcgaagttgtaatagctttacagaaagtgaaggttgattgtaatggtattctgcaaagactttatcagtaataaagtccctaagacgtttagctacaatggctttcccccccaccccacaatgaggttcagttgtattgccattagctctgtgtatacttaaagcagacaggatcttcataaaatgaacgtaacttctgtgaattttggttaaagtgaagcag

SEQ ID NO: 32250 - DNA, 1155 bp, Mus musculus
gatatgtttattctatttgatatgtatgactgtttgtctgtaattatgtatgtgtacacgtgcccacagaggtatacacatacagaaggaggcatcacatcccctagacttggagttacagatagttgtgggtgctagaaaccaaaccccggtcctctccaagagcaagaaatgttcttaatcactgagtcatctctccagcccccacctcttttcctgttcttttttctgttgtctgtacttctgtccctgtctttgctgtctgattctcctgtgtgtctctctctcttctctgtctttatctgctccctttttccctgtcctttctgaatgtccctcccgaccagtctttcagggggtctcttctttgtgcttcctgctttctacttctcagaacaccccatctttcttcaggtccagcctttgtggggtccccgatggaggagtctgtggcccatgcagtggcagcagttggtagccgcctgtacatctctggaggatttgggggagtagccttgggccgcctgctggcattgaccttgccccccgacccctgccgtctgctgccttcacctgaagcttgtaatcagtctggggcctgcacctggtgccatggtgcttgcctgtctggggaccaggcccacaggtaaccatagtgactgacagtccatggcacagtgcacactggtgtcctctgagggcgttagggagtgagctggacttggggggtcttgaagttggactgtcaggttctgcctcacacatggggaagagaatgattatcagaagtgggggtgctgggaggactccagtctgaaccctgcttgtacctcagtgtctccccttctggagaaactgggttggaacttgcttttccatgtatggtatagtttagaccagcaaagattgagagtggtgctgcacccaggatatctgtatgggaagacactgagaccagaagggcagctcagaaaaggcttctagtacctggctgggaccaggctctgaccaaatctgcagcctcctcgactgcaggagcacagatgcccctgaaaaccaactagtcccttggttaactcattcgtctgcccgggtgccatgatggaagcctacttaggggttctgtttgtcccaagataggcagcggagcgagtc

SEQ ID NO: 32251 - DNA, 1193 bp, Mus musculus
gaacaagatgggggcggttctgaggtgggactcagaggtggtgggaagggcccaggtgtctgggatagtcatgaagagatctcctgggtaaaggcctgtgtcctctggggtcagggctaacgtgtggacgtcccggggcctcctgggccttcctgtcttgcccccctgaggacgagtgtgcaaatgggcaccatgactgcaatgagacccagaactgccatgaccagccccacggctacgagtgcagctgcaagacaggctacaccatggacaagtgaggctcagtcggggtgacacaagtcatgtggaaggaaacagcccaggctcatgggcgggggcgcctatctgtgagacgggagggcagttggcagacccagtgtgtaggggaggggggtgagggacaaaatagctagaggagccaggaaagaatgagtctctggaggagcatagtgggggcggggccagcggcctccaggccagcagcctactgaaagagagtgggacagtgttggaaggctgggcccctgccctcatcactgctcgtccctgcagtgtgactggcgtctgccgccctgtgtgcgcccagggctgtgtgaacggatcctgtgtggagcctgatcactgccgctgtcactttggctttgttggccgcaactgctccacagagtgtcgctgcaaccgccacagtgagtgtgccggcgttggagcacaggaccactgcctgctgtgccggaaccacaccaaggtatgggacccgccacccagcccctcaggccctggccgaacccgagcccctgagtctgcttagaagaggccttttattgtttttttgaagtctattttggtggtcctgggatggaacccagggcatttgacatgctaggcaagtgctgtaccactgagtcacaccccagccctcgtgctgaggcatcatcttaaggttaattcccagtcccaagaagccatggcagggaaggggtgggagaaccctattctggggagatgtgaaaagactttgggggctgtgtagtagtggacagaatagctggggagcctgggtgtgtggacacctttgctacttgggacttaagggctagggcaagtgagtgaagggagggcctaagccgcagcccagccctgtgcccccagcccagccggcaggggcagaccaggtgcccagccctgtgccccca

SEQ ID NO: 32252 - DNA, 2925 bp, Mus musculus
tccatgagccaaagcgccgggccctgggtcctggccgcaccgtgctgtttggcgtccaacccaagttcaccaatgtggacattcgcctgacactagacgtgaccttcggcgctgtggacctctatgtctccacctcctatgacacttttgtggtccgagtggcccctgacacaggcgtccacactgtgcacatccagccacctccacctcccccacctcccccgcctcctgctgatggtgtacctcgggtggctgcggacctaggaggattggggactggaagtgggtcaggatctccggtggagccacgggtccgggaggtgtggccacggggcctgattacctacgtcacagtgacggaaccctcggcagtgctggtggtccgcagtgtgagggacaggctggtgatcacctatccccatgagcaccacgccctcaaatccagccgcttctacctgctgctgctgggtgtaggagaccccaacgggcctggtgccaacggttcagcagactcacagggcctgctcttcttccggcaagaccaggcccacattgacctgttcgtcttcttctctgtcttcttttcctgcttcttcctcttcctctcactctgtgtgctcctctggaaggccaagcaggctctggaccagcgacaagagcagcgccgccacctgcaggagatgaccaagatggccagccgcccctttgccaaggtcactgtctgcttccctccagaccctgcaggcccagcacctgcatggaagccagctgggctccctcctcctgccttccgccgctctgagcctttcctagcacccctgttgctgacaggagccgggggtccctggggacccatgggaggcgggtgctgcccaccagccctccctgccaccacagctggcctacgagctggacccatcacccttgagcccacagaagatggcatggctggtgtggccactctgctgctccagctgcctgggggtcctcatgctcccaatggggcctgccttgggtcagccctcgtcactctgcgtcataggctccatgagtactgtgggggcagcgggggtgctggaggcagtggacacgggggtggtggaggccggaagggactgttgagtcaggacaatctcactagcatgtccctttgacctgtcaagggccctcttccacagctaccatgttgcctgatggggccactctgaactagggatcccctggacagtcttcagaaaccactggctcccttttcccagggtccccccctttgttctgcatttagcaactatttattactttgtgcccagtacagttgtgggtacaaagcaaagcaggaggtgagaggaggttccctcatctggtggggattgagttcttgtggaaggagacatgtgcccacatgcacacacacatacacacagtgtggcactgaggtaaagttgatgaagcatttggagaaactgggctgagaaaggtgacagacggagggaagacctttgggaaacaaattcaagagtcgagggaactgtaaggctgaagggcccgaggctggaagcggtttgtcttatcacgagaaccagagacctggccactgcaacccagatcaagtgtcggctgagctgggttcttagtctcagggcagtgggcagcggttggacacttctgtggtggtaaatgaggggcttcagctctggggagaagagtgggctggtgggcacagaagacgctgcaggtggttaactgggcaggaggaaggtgagtggcaggatgtgacagtggtgcagatgttagagtagggaagaggacatatccagaacggccactttatgtcctgggccatgggtggacagtgaggttgttactaatctggggcaggctggggcaggctggggcttgtgggcttccaggtgtgactgcgggctcatacaggagggaatctagtgccctgtggtgagtttagcactggcaaaagcaggcagctactgagaggacaggacagtgcagctgcccgctgtaggagcagtgagctgctgccgggctagaccagggccaccagcggaacctggagatgtaggcttatttaaaggcagcctcagaggcaaattctttgcctgagatgcctcacatctcatcctggcaggtgtgggctgggagaccctggaggggccatcatttggctttttcttgagtctctgggactctgcacagaggccacctacacctggatctcctttttggacttaagagctctctcctcccccagtcctaggcagctgcctgagcttgggactcttgctttcccaagactccaacttctagccgctgttttggtcctggcgtgggggttggacccagcctctttcccttgctgcagttaccctgtctgatgtgatcctgctaatgtgtgcatgtcagcatgggtcacatctctatgataggagggcaactgaggcaaagaataaagtgtggagaagacttgtgcatcgtaacttcatctgtgcagaggagggagggatgggctctgggtgagtggaacatgtgtctttgtcctggccccacctccaagccgtgtatcctgagcctggctctgccccttcttggcaatggcagggttccacaacaggatctctcattccccagaagagagatggcggggacaatgggcagggacgtctttgagcctttctttgtccctgccacagtttggctcagggagaatcagacagtctgtgtcccagtgattgtcattagacaagaaacccccctggggcacagaacacagaaaccattgtttaaaccggaggaattgagcacggagaactggtggtgctggtgagggcagaagctgcagggccctggcagctgggtgtggatgagtatcctctgaagtaaactcagcattaaagccctggaatgccaaag

SEQ ID NO: 32253 - DNA, 1195 bp, Mus musculus
caactctgggcatcttgtgaactgggtaaacgtggatggctctatcccactcctcctatgacactaatgcaatgggtccagaccagactggggagggggagccaattcatgaactgatgatgggtcccctcccccccttcttccccctccacctgctagaaatcacaaagccttattcatgtgcactgatatctttcttcctcccctagatctggctccttctgacaactctcctaacaaggtgagcactgccacttttgctggctgtttgtgctacaaaatgtctctgaggaaacttgggatatctgtattgttttgatttctttgtttgttgagacaggatctcaccatgcagccttggcaacctttgaactatgtaaccaaagttggccttgaactgtggccatacacttgccttagcctttcatgtgctgggatgacaagtgtgtgctaccacaccaagctgagaaaagtattcttgaagagacacaactgtgaaatccagtatgggtctctactcctcaacactgcacagaaagacagactggtcaatgggtcccatgagtctactacaagagtgtgtgttggaattatctctgccctgtggttaatttctggctatgactcctagaattccatggctcttgtcaaggaactaactctgtgatcctcaagtttggtcacctagacaatgggcattctgcctacctcaaaaagaggacaaaagaatacagcaagttggcttgtgcacagcccggcccacgcagggcagcacatcatactctctcctccagtctagacctgctctgacctcaaagcagggcttccattctaatgggtctgagatcctcttccttcattttataacaattttaccaagatttcatcatttaagcctttcaacagagtacacacatagaccaaagagtgctttaagtcataaggacactttcacagtgggaactttcacaaacctgtcctcctccccagacacacattgctgtcacatttcctacagagggcaaaggcagtctgacagtgcacatcctcgcacacatctggctttcattctgctctgtagcccatctggatgtctgactgtgagtgacaggagccctctcccaccgctgcagcaaggtgaggctcaggcctgtggtgctgagtcactgatcaactctcatcctttcaggtggat

SEQ ID NO: 32254 - DNA, 1140 bp, Mus musculus
attcaaatagcagcaccgctaggccaacacgctatctgcttctaaccaccttgcgacaaagacgcataaatgagtaaggtggcaatttttagtctctaaaattgctccggtcgtctgcttctagttgctcctaattcaggcaactaaaaggacaacttaacttgaaccttcagggttcaggacccggagccctgagcaaaatgggccctctccaagtccctccccctgttccctgttgtccaatggctatgccagaattgggaggtggaggtgggcgggaccagattgttagtaaacgctgagccacgtgctagggccaactcgggcgtgccctagacgggcgcatgcgcaataggtacgcggccggtagaactgcgcgcgccgctaagcggaagctacggtgggagccgcagcgcgcgtggtcagcggctatggagggcgcaaagcgtgcagacgccaatttactcactgacaccggaacagagtccagcccccgaagtccagtctgcagtctccggcactttgcttgtgagcaaaacctgctgtcccggccggatggatctgcttcttttcttcaaggtacgagcctcaccaagtttaactcagcgcgcgccatcctcaccgaagaagggtttttgaagagcggttactgtgtagtatgtaaccaagtacgcccgcctccttgaacttatttctagatgttgagtatacccacctcccgtctcgagaagaaatgagttggccagcctggtaaatccctctcagaggagatcgagagcaagaccactctcataagagtgactatcccagaataggtatttcaccaaggcagatattacccttctctagatttctttctttcttttatctttctttcaagacttattttatttatataagagcactgtagctgtcttcagacacaccagaagagggcatcagatcccgttacagatggctgtgagccaccatgtggttgctgggaattcaactcaggacctttggaagagcagtcagtgctcataaccactgagccatctctccagctccccttgactagatttcttgggtttttgttgttgttgttgttgttgttgttttcactttgttgttgaactcactttgtagaccaggctggcc

SEQ ID NO: 32255 - DNA, 1635 bp, Mus musculus
ctctggctctctgggtccccctccccaggcctggcagccaagggcatcagaagccttccctgtgggtggaggttaggggaacccaggtggcaccagcctctgctgctcctttttggacactagctgggagtgccggcagaggcagggctgggtaccacagggccagcttgagtgtgggaggaacttgaagagggggactctcccctaccaaccccccctttccagccacagttttccttttcctcacttcctccacctccacctcccttccctctccctctccctctccctctccctcgcctgtttacactccccaaatacgcacaggctgttatcatgggtcttgagtcatcacacacagacacacagcctgccccagtgtccctgcccccagctggccacagggcccgccccacagagccccctgctgccctgggctaatgaaagccagatggctgcctgtgactcagccatggcctgtgggaacccagacgccctaccttcccatgccccacacccggcccctgcgtccccagcagacagaagcaacctgctcctgtggggatggaggccagcgtgtctgggcctgagaatccaaactgctgtggcactgaatggcaaatggctgcattctgctctggccatacctgaaggaacctaaaactgctttgtaaagccaaggtcctgaccctgggtcttggctctgccctctgtatcaagtaaactcacccagtggggtagaaggtgttctcttaaactgttgaaagatcctcaacagctcagcctgggccaggcctgactgacacctcctaacagacctggaaacaagactgttggtcgccacttgtctcaaaggatggaaagaacccagaagtagccatttgcatcttgagaccacctggtctcccatgcagaaccaagactggaacacacttggccagtgtgcctccatgtgtcctcattggacagcggtggagatccgaagacagacttcctcccatctcgggggactgtagaaggtgcaggtgttgtggtacacagtatggtggcaggtggtggactgttatacccctacccttacctccccagaggacgcagtgagtccccagctgggatcccaccacactggacaggagccaggagtgctcttttgggaagttgtggcttaggtatttttcacagttgaccagtgttctgtccgatcattaaacttatttaagatagaaactgccatccattcatctgttatgtaactttctaaaagagctgagctgcacagccattgagtcaggatctggagttagtcaaatggctcagatgagcctgcaaatgagagacagaggtggggccagccaccaggacagggattagatgaggagacaggaagaaaggtggagacagaggagggggaagaggcggcaaaagcacaccccgcttgctcgagcagcccccacggtggctggcgccactgcttctgatctggatcctggggatggggtgggcggagaggctgagtcagggagggagagcccctctttgggcatccggcccccacctccatgtctcctgtttgtcctgccctggacaggtctctgctggctgctgccatgcaccagtgacacccccacctctctg

SEQ ID NO: 32256 - DNA, 1388 bp, Mus musculus
gaggctactcgggcagcacacaggggggcacaagcacacagtagccggtgctggagccttcagaggctcgtgccggctgcttctaatagcacctgccttggcccctttttcccctctgagtcctgtggtgctggggacagagttatcccagggctgcctctctctagcccactttttccagaggagcttctctcttcatacaggccaggcattttcctctctggattccaacaggcaacagtgagcttttcttttatctttgtccctccacttcctcctcccctgccttcttagctaaagaagcctcccttgtgaggccacagtgactggggaggagccttgcctgtctgcccctccctactctgctttttagccccttggcttcccagactctcatgcagttggttgtaaattcttccaggagctgtttttctgtctacttttcaggatttaaaaaaaatttttttcaaaaactttaaaaaaaaaaaaagtttaagaagcaaattgcagagggaggaagcattgactttttttggtaattatgcttttttttttttttttttaatttttagaatttgtctgtttttactgtgggtcagccgttgatacttcatcaaataaccatttctttgctgagttcaggtaaccgaggaagagccacaccctcgaaacaacaaaatcacctttaacctaactttttatatgatgtctcagttccccgtaactttgcacacaagcgtctgttcagttggattgtaactgctttttgtacttggagagagtgtgactattgaacttgaaaccttttactccaggagtcgtggtagtttctggtgggcataagcgggtgagagggtgaagggaaggtgggggtggggccagcttccctttagaccctaaagttcctccaccaccaccaccaccaccacctccacctccaccaccacctccacctccattgctcttccaggtgccagacctgcaatgttttacagtggtccttttgattactctcacttcccgaatgttctaaccggaccttagcaaaccgcacttattacaagatgttttaccctgttttgttttgttttctttcaataaatgacatggcacctcttatcaggaaggaagcagggttgaaaccctgaagtgttactgcagttggcctttaattgggatgggaacctttgaaggggaaatgcctcgatcatttatttaaacaaagtgggtctgtacttcacataacccagatgctccttgtgcagggacagacaggtgagagctgtaagaatgagactatgctggcgcaggcccctctccgggtgtgttgcccaacctaccctaaggtccagcctggatgctgctctcagggtggccctgtaccgcca

SEQ ID NO: 32257 - DNA, 1201 bp, Mus musculus
ttataaaaagaatgctgtgtccagtgtccttttaagcttacattgacatacttgaacccctgggatgatctgaggtactgcatacaaagcacttaactctcatgtgcacttaaactctcatgtttgtatggtgcctgctatgcaagtgctttcttcagggaaagttcatttcccctgccacaagtattgaaactgcaaaggggagttgtatctgggaggccctgccatcacaaaaggctcttgggagcgacttgagctcctgttctagcaaccaagtcatctttatatctgtctatccatccatcctatctaggcaagatctcactggcctaggctgccctcagcctcactgtgtaacttaagctggcctcaactcatggcaatcttcctcagtgctgagattaagggcatggaccaccattccagctccatcactgttaattgcctgatacactaacttcctacattgcctcataacccaccagctttaagagaattgatcctgagcattcttgtgttctgtcgtcagatcaatgaggaaatctccgtgaagcatcttccatctacagagcccgacccccacgttgtccgtattggctggtccttggactcttgcagcactcagctaggtaagactgtcagccaggcagtcctcactaaagagtgatagcccctgactctggattctcaggactcctaagctgctcttaacagtattgattcaacacacacctactgggggtggggggtgggggggcaggtgcacctgttaattttgtgttactgcctggctttaggcagactaaattcaactgaaacctatcggaaacaactcttttgggttttttttcccccagagttaattcttcaacgttgtcttttaccagagagtccaaagttcaactgttccctttatttgaaaccatttctaccctcacaccatactgaaataaacgtgtaaaccctgctctttataattttctgtccagagtagaacctagaatgaaagtggaagaagcaggggctgccaggctcagtgactgtcttttgcacattgcttttggtttttatgcatgctcaaaagggatcatgttgtgaacttttatgtactctggtttcttttaatatataatgggccaaattttggaaataagtatggtttcttggccagtgcataattttccattgtgtagcaatttcc

SEQ ID NO: 32258 - DNA, 1170 bp, Mus musculus
gttggctttcgccagaatatccaggaggagagtcctagaaattcatttctcatgagcagctttttggcatttctgcctcacaagctgactccaccagagtgccctgacaaatacaattgctgatattctacaagaagaaagaaaactggagaagcaaaatggccgattacagaacggagacgtggacaacgaggataacaacagcacaccagaccctacgtgggtccacgagatttttcagggaacattaactaatgaaaccaggtgtcttacttgtgaaactataagcagcaaagatgaagattttctagacctttctgttgatcaaaacacatcagttactcactgcttaagagggttcagtaacagaaactctgtgcagtgaatataagtactactgtgaagagtgcagtagcaagcagaaagcacacaagcggatgaaagttaagaaacttcctatgatcctggctctgtacctgaagaggtttaagtatatggaccagcttcaccgatacacaaagctttcttactgcgtggtgtttcctttagaactctgtctgtttaacacttcaggagatgcaaccaaccctgacagaatgtatgacctggtcactgttgtggttcactgtggaagtggtcccaacagaggccattatattgcaatagttaagagtcatgatttctggttgttatttgatgaagacattgtagaaaaattgatgcccaagctattgaagaattctatggattgacatctgatatctccaagaactcggaatcgggtacatccttttctatcagtctcgggactgagaggagcaacagaggggaggagcttctgcaagtttctctggttgtttcagaaaggatcgaacagatattcaagaagagagagcacgcagacagacagacaggcagacaggcaggcagacagacagacgcaggacgttcagggcagtagctcactttgcatacaataaagcaaagactgtggattaacatgcccttccggttacagtagttgaatttttttgctcaggaatcattctgtctgtgcagttcacacaaggaagtgaaatcagagataccagctctcctgtaaagcagctgccagctgccaacacattttctgtagtaattacaccaatgatgatttgagtttttcgggag

SEQ ID NO: 32259 - DNA, 1188 bp, Mus musculus
tgtctgttccttgttccaaacaggaattaatttgtgtattgcagaatatttatatttggcccattgaataccatcattttaaaataaaattgataattactatcctaaagataagttgaagattgtttttatgcatgcttttgtactttctataaattcatgcatgcatgcatcccatttactgtatttaaaaacagcccttctatgggagaaaagtatatgtgaattggatcacatgcttattcttttgagtttcctcctgcttcagcacagttaattaaatcgtgtgccgtagatgatcttttaaaatgttgaataatcaagctttaatttgtatatttatcaatatatatctcagagcttacaattgcttaaaattgattcatccctcagatgctataaatcctcaaatttgcaattgtttatgcatatacaactcataagaaaaaatgctgttactttaagaaggctgtttttggacagttaagaatttgttctgggttgcctggaaaagattcccaggatttgtttttgtgttatagagatttacaaaaagctttagctgataaaggattacagatggcttctgaaaagatacaaactcgggatccttttaattattagggttttagacttgctaatcaagctgtttttccctagaagatagttattctcagagacaacttaaggattttgaatgattttcaaaaattgtcaggtgatattaattggctttgccactatttaaagcttactacatgggaattgaaacctttatttgatattcttaaagggagtcctgttccttcctcccctagatctttaacctcagaaggattgctggccttacaagtggaaaaagctactgaagagcaatttgtcacttatatagattactctttgcctttacatctgttaatttttaatacgattcatatgcctacaggattgttatgacaaaagtctcctctaatgtgaatacatttgagggtttctcctaaacataatatcttgcaatattatgaaacagtagctcagatgattatcctcggaagggagccagatattatttttcagccttacagcataggtcaagacacttggctgaagtagcacagtacagatttgttgcttgctcaaatagggtttaaaggaactatagacagccactaccctcaagataggttg

SEQ ID NO: 32260 - DNA, 1234 bp, Mus musculus
atttagtgcattcccatgcacactatttaaatcatacctttattttcaaaatttgaaatttaaatgtcaaagaatttaataaatactttatagtatcttaaaaggatctacttattggcttatagattgatcctaaaacagctaccttattaggaaagggaaaaacaggttctctccacagaacgctgcaaaagcatattggttaattcgtgtgacaagctggcaggtaagttgactcagtgtcctgattgaaatgactaagaaactaaattagattcatgttttagatccatccttgcttgccatttttccggtttagactagccttttaactttatggcaatagtacatcagagactgtatattctgacttagtgagattagtcatttaatagagtcataatgatttttctcttttcttcagtgtgaccagtcattctaactcaatcttagactggtcgaatattcagtccaatattagagattcctatattcttaattacctagcaaagttaattcagagcacatcccccacttccagagagtctctggccttctgagcttaagcgttgctaatttgcaactgaataaagtacctggacttccccaaagaggatgtgcattgctactttctcattgcctagatcttgtttttttttttttttttttttcaagcaggtcaatcaacatcctctggcctgacagaagcgggtgaacatcccccgcccccgagggcgtatatccacgcccctgagggcgtacattcccgccctcgagagcatacaggtggcaactgttatattcatttcaaggacattccagcaccgtggttttcggtctaagttaaaatttaggtttaccaagagggctaaaaaaggcagatatttctaatactaaaagagattggtttttattctgatagacaggcttagtcccttagctggcctctggttttccacccttgctgttactgcaaggtccccttagttcctcaggctgtgggaataacagagatgaggaggatgacttccagctcctattttagccaaaagccacaggtgtgggtcgtgacagcacccatgggaggaatcaggtcaatttccacccaagccaaggttaaaagcccactcatctacggatgagaaaatcatttgatcacctcagttaagcatggccttattaaacttaattaatgggggggggggagaggttagagactgtactgttggaaggg

SEQ ID NO: 32261 - DNA, 1209 bp, Mus musculus
aaaaggccctactgatggccagccttggcctttgcctgacctaaccaagcctttcactctatgtaaaagagagatcaggggaagccagaagagtccttactcagactttgggactttgaaaaaggccagtggcttacctatccaggaagttagaccctgttgccagcaggtggttttcttgcctgaaagctattgctgccatgtctctgtttgtcaagtatgctgataagctcactctgggacagcaaataactgtagtggcaccccacactcttgagagcattatctgaaagccccctgactgatggatgaggaccaacgttcctgcgacacattatcagagcttttttgttgactgaacgagtgatcttcgctcccccgctgtcctcaagtgaccctactgcccgagacttcacctactcatcactgcgctgacactctggcagaagaaactggtactcgaaatgatctgaaggatcagatcagccttggcctgagagtttgagctggtacacggatggcagtagcctcacggttgaaggtaagcagaagacggggacagcagtctggtggtggacagaaagcaagtgatccaggccagcagccttcctgagggacgtcggcccagaaagctgaacttgtggctttgatataagctctaaaaatggcaaaagaaaagtctacactgacagcagatatgcttttgccactgtacggagcaatatacagacaaagagggctattgacatctgcagagaaagatctaagatgctgtggctaaaggaaatcagatggcagatctaactgccatacaggtggcctaaggagcaatgatcctggcagtcaaggagcctaaagattattatgatgtcagagagaccagctttagatacacccctgagcactatcaagttatggacaaattaggacaggtaaaggaaaccctgtatgaaatagtagaaacagaaaaaggaaaactagtcttcccatgggaagaagaatgcaaatatgttaccaacttactttacttgacccacttgggggcaaaaaaaaatattaaaaggtgtggttaggtcctttgactactatgttacaggactctctgacttggcagaagaaatagtcaaaagctgcaaggcctgtgctatgaataatgcaggatactccatgtatatactcctgagaagaggctcaggggcgactggccta

SEQ ID NO: 32262 - DNA, 1207 bp, Mus musculus
gaggctagaaaaatagcccggaagccaacggcggtctacacagctacaaaatgagatcgacatgggattccctttgactcgccccagttggaactgcaacatggctaaaggtaggaaaagcttgaaaatctatcgccaggctccggtctccaaggtgcctcaagacgggcccactaatttggctaaggtaagaggtaatgcaggggccgattgaacctccctcggtgttccttgaaaggcttatggaagccttcaggcggttcactccctttgatcttaccttggaagcccagaaggcctcagtggccatggcctttcataaggcagtcagctcccgatatcagaaagaaacttcagagattaaaaggtgtattatgagagggagacagtcattcaatctagtaaaagaggcagagaaagtgtgtgtgtgagagagagagaggcgggaggcagaagaaagaaaaaacaggagggatcttagacaagagagaaagttgactaaaatcttggccacagtgataaaaaaaaaaagacaagatctagacaggaaacctggacaactgaagactgagcctcagctaaagaggctcagctgtgtcagactgaagtgacttatttgggatacacccttcgaggtggaaagcagtggctaaaagaagccagaaaaagactgtaactcagatccccaccccaactacaccaaggcaagtaagagaattcttgggtactgctggcttctacagactctagatacctgggttggcgactttagctgcccagttgtacccctaatcaaggaaggggaggtgtttgtgtggaccccatatcaccagaaagcctttaaagaggttaaaaaggccctactgatggccagcctatgcctgacctaaccaagcctttcactctttatgtgaaagagagagcaggggtcaccagaggagtccttactcagactttgggactttgaaaaaggccagggacttacctatccaagaagttacaccctgttgccagcgggtggttttcttgcttgaaagctattgctgccataatctgcttgtcaaggatgctgataagctcactctgggacagcaaataactgtagtggcatcccacactcttgaaagcattaccaacgctcctgtgacacatcagagctttttgttgtctaaatgagtgaccttcgcttcattccacctactgtccc

SEQ ID NO: 32263 - DNA, 1198 bp, Mus musculus
cagctgaggtggctctagaatggcagaaaagtcattctgactgcccaatttttcaggtacgccatcactgtctggtattttgatgccaaggaacgggcagcagccagagacaagtatcagctaggtacgtgctttcttcctttgtccttcctagtccctgtgtgctgccaggtccttagcctttcttacccccttgggtgctgagagtggttcccagggcctttgccacactaggccagcactgccgccagcccgctcccacaggtctttctcaccagtccctttgcccagttcttgcctactttcctggtatcccctacctgagacccattttttttttttttctgttaatgttctccccatcttcgcaggtttcttttggcttctttgtcccttcctagtgattcacaatttcttgtcttcctctcatcctcagcatcgggacagaaaggtgttcaagtaccagtatcacagccaactacacctacctaatggccagccccagagctgcgtggaccagcagcagctcctgcctcagtgcccgctcctttcctgccactgctgctgcttctggcttgcctctgtactgtgtggtgtggagggcactaagtatcactgaggagcaacaaggagagacctctgctgccccgtgagcgagcggtgctgggttttgacctgggcagtggccagtgtggctggcggtcatgactggtggctgtgtctggtccgttgagtgtagagctgagaagaggcaggatttggggttgaggtgagtcatggcctcttgctggaaaggtgtgttggggtgtgggtgtcatctcaccctcgtccccactcctccggcctggaatgtgaagtgactccccagcccctttggctgtggcagtgtatggactgggctgccactgtctgggcagagtagggtgccatgacgagcatgggtatggaggttctgccagccaagaaataaaagtttacctcagagctgcacacacttgtattcctctctgtaaagagatttacacatacagttagggcaggtaaggatatcagggccactgagatcaccagtgaagcccaagctcagcgggccaccaagcggagctggaaggctgggggcacattacccagaccagtacactgtgggttaaggttgatgttggcaggacttcccacagggagcagggagaacttctgc

SEQ ID NO: 32264 - DNA, 1107 bp, Mus musculus
gattaaaggggtgcaccaccactgcccggcaggatctcactttgtagctcaggttggtcttaaattcaccatcctactgcctgtacctctccagtcccgaatatcatgtgtgagtcaccgcctggcaagggccatggtagttaggtaccgaaatgctcctgtacagatgcaaacctgtacagggctgtgtttggagaatgagtcccccacataacctgcagagggacaacagagtcagacagtgcacggtctggaaaataaaaataaaaataaaagagtccaggcagacaaaggccaggaagacgtctagagaccagcttcggaccctccaggtcacaatgcccttctctttcagctcacctgttcttctggaccagccctgcccgaaggctggggctcagaaccaggccccaagaggccaggccccaatctgccccagtctcagaaaagttactccatcccccatcccccttcgctggcctggtggggcctggctgtggggcaagattgagccacaggggaaaggggaccccatacctgctgctgcttcctctgccttggctaactctagtccccctgagccccaaaccctacctgaagaactcccaaagcttgagaccagggccgtttggccccaacttcctgcctggccccgctgttgcaagtctgttatttattacctggaggcctgttccatcctgtcctggtcctccataaagcattgtttacacctgtgtttcggcctctgtcattctgagatgaggaaaccgaagtggtctctaatggaagctatgaataggcctctgcatgaggagcccctgtttgtgggtggtgggacttggtttgtgggacaagttggggtaggtacatcctggctcacgtactcattgaggacagagttcgtcattgtatacatgtccttgctttttcctacacacagcccccctttttgacacagggccttgttatagcctagactaacctggaatttgaggtctccctgcctcagcctcccatgagctgggattacaatgtacccatcccaggttgtgtacatgcttcatggtagtggcagtacacgatccatcaaaggtggtgtgtgcagcg

SEQ ID NO: 32265 - DNA, 1214 bp, Mus musculus
tctgttgtgtgctaagcccaggtgaggcctctggggagacagcagtaggtaaaacagaccaaaaccaaccaaacaaaaatttctgtttgtgtagtactacattgtcttgggagaagacagaccacagattaaatattcatgtaaatgacatagtagttgggggcagactgtggagaaaaacagtctgataaggaggataggatgaggaatgccctttgaaacagggcaccgaagaaggtgacatttgagcaaaaacgtagagcaggggagtcagagaaagcagatgaaaacagtgcagagaccctggcataggtcctgcgcggtgcggccagagtagggtctgtgtgtgcactagggtacagcatgaggtgggggactgagcagtcagtattgacagccctggggcagtctctcattataccttgtatctatagtagtcatagggaactaccaagcagggcagaagatggagaggctcagactttgtgcatcacaggcttcctctgtctggataggaggagactgtggagcaggaggcattgctgggtgccagtgaaggagctgctggggactgctgtgaggagggggtaggatactaggtatggcgttcaggtgataagtgcttgcctagcatgtgtgccagaagcacaggctcccatactgagcactgggtaggctggtggtaatggtggtagtgtgccttcaggaagtggccttaactatggagtgagttggaggccacccttttggggataggagaaataggcctacagccgggggtgggggtggggtgggggggtagaggtaggtgctgaaaagtggctggtttctctcgtccttgttctctttctccaggcttgctccctttagtggcagtcagtggcactgtctaaagctcagatctgaccatggctcctggggtccatggggctgggctgaagttgctgagcctggtgtgttgcttggccctctgcagggcctgggccctatcactggctccacagggccccttacacctttccctactcccttcactcttccagtcacagaaagttctttctgtttctttggctctttttttttttcaggccatgttttcttcccctttgccctggtaacctcctcccggaagctttgctggtttttccatgcatggtccagaccccagggcagacgtgcaggaccctgtagggtttggtcccctccccacctct

SEQ ID NO: 32266 - DNA, 1334 bp, Mus musculus
tggtacctgctggtggggtagaggctggcctctgtggccaggccctgctgctcagaccacaggagggaagccattagctggggctgggacacctgcattgaacttaactctatcaacattagaatgcttcagcttcttcccctaatgtgacattttcagtccagttagtttcatttgatgagagtatcttgaaggccgcctgcccggaaatctttcactagatcaccccatatatggagtcacaagcttgaccactgtccaaagtctaaactagttaccttcagaatcaagcattcctttgactaagggagacttggttttgtggagggtttgttttttaaagcatggtctctgccttgcaggtggtagcacatattctaaacccagcactcgaaggtgcagcagcggctctcaacctgtgggccatgcagccgtacttgtactactgtgtttcttccaccccttcaacctcctaatggtagacaggagagaaaaggatggaggggaaaggggccagcattatccttcaactacttgctgctgattggggcgtcaagttccttggggggaaatttgatctttgctgtcaggatatctaatgtcttcttcctcttttttcttttcccttaagatttatttatttattcatttcatgtatgtgagtaaactgtagctgtcttcagagataccagaagatggcattggatcccattacagatggttatgagccactatgtggttgctgggaattgaattcaggtcctctggaagagcagccagtgctcttaactgctgagccatcttttcagcctccctaaatttattccttttgttttgttttgttttgtttttttggtttttttttttttttttttttttgagacagggtttcgctgtgtagccctggctgccctggaactcactctgtagaccaggttggtctcaaactcagaaatctgcctgcctctgcctcccgagtgctgggattaaaggcacctaatttattcttgtttcttctttgttcacaactacttaacaaaccacaaccaacaacccctcaacacccaggaccctggacatttatttatataacatctgaaaagcccccagaattcccaaggtcacagtctcagaaactatttgcagatggcaaaatcatacccctgctacagcatgaagcaaatcccagctgctgtggacagcccatattccacacctgggattaaaatgaaaacatactcccataatatttctatgtttttcaaagaaaccaaaatttttgctacagagtcatgacccctttgggtgtcaaaagaccctttcacagggattgc

SEQ ID NO: 32267 - DNA, 1156 bp, Mus musculus
atcagaaaaaatatatatttactttatgattcataatagtagcaagattatagttataaagtaatgatgaaaataactttatggtttggggtcaccacaacatgaggttattattcaagggttgcagcattacaaaggttgagaaccactgagatagaggtagctgatctgtgagtttggaaccagcctggtctacatagcaacatctaagccagccagggctacatagtgagaacctgcctcaaaagcaaaacagcagtcttactatgtagccctagatggcctagaactccctatgcagtaggccaggttggcctttgcttcctgtgtcctgggattaaaggcctgttcctacatgcctagcctagaaggctcttggtagtaactcagaccctagtcgtggccctcccacctgaatgtgacatccactggtctttctttgggggaattgttaaagacactgtcagttcacagagcaggacttagcccagcttccttctccttggcacactcagactaccccgtctacctgaccgctgtgctggcctttcagatactgagactgaggtgccaacgacagccttgagctaaatgatgatcactctccttgagctggcaagatggcttaatgggtaaaggtgcttgtcaagccagatgacccagggccccgagcgacagaacaagaaccgatccccacaggctgccctctcacctccattcacattcacaaaattcaaatgtaataaaaagatgttttaaaccttactccccctaacttctccatcttagctccaatatcatttcctcttcaaagagctcctgggatgcctcccttccacacagtgaggaggagaggaatacgatgtttgtttgggttttttttttttttttttaaagacagattttgtcatgttcgttatgcagtccaggttaaccttgaacatgctacatcctgtccaaagctgcgatggtggtacaggcctgtaaccccagcatttggaacacagaagccagctaacagtccatgctcatcatcaactccatgacaagtgcagggccaacttgaactatgtaagactcttacataggcagtgcagtgtgtgcctcttctagtgtatcagctcttcaggactgtatggaaagtgacaggcacccg

SEQ ID NO: 32268 - DNA, 1180 bp, Mus musculus
ttctcactatgtagcccaggctagcctaaactcacttgaactcttgcctcagcctctcagttactgggatatccagcctgctctaccacaccccctcttttggtttttcttctctcctcttcttccttctttgtctttctctccctccctctctcagcctatctacctatcttaaatgtccttctctcaaattactccatgtgtctcccttctttgctttgggcccccaaatctctttacccattttcacttcctacaaaaaaaaaaaaaagtccctaaacttggagacttcatttaaacacacctgtgatcctagctacacaagagatggatgaaggaggactacaagttttgggccagcctgacacccccccccccatccccaaaacaaaacaaaaacaaaaaccctaaactaatacccagggaagagaatcaactaccccattacacagaaccctggggagactggagtcgggcctgtgtgagagggcccgggtgccctgatacatcctatcattgcctatagatgacaatctaggagtgtgctggcaggaagtgggacctgatctcgtctgcagtcgcccacgactagaccggcaggccacctacaccgagtgctgctgtctctatggtgaagcctggggtatggactgcgctctctgtcctgcccaggactcaggtactgcacagctctacactgcccccagaggacctcttggcatccttacatgtgctgcaacctctcccaaaatcttgatcacaattctacagacttctaagtgtcagcagctgaaatctcaaggccagagtcagcagcgtccgtagccccaaccccgtcagctctgaggtctctcatcttaattaaattcctggtttctagacccaccatacacaacctgtgagacactccacttcaaactctgggcccttagatcccaacagcagttgccctcgtgcactagtctgtcctgcaaactctctggtaatagctcctacagctgccaacaggcattaccttgggccctctccacaccaataccaagactccaacacagccccaaagatctctggtccctccttttagctctgtatgaacaagagcccaaaaccccagtcttgattcttcgccccccccccccatcccagagattcaagctgcttccaggcacctttgacccct

SEQ ID NO: 32269 - DNA, 2202 bp, Mus musculus
aatacatttctgcaccctcactgtttcctggccctaagtgtggcccatgaccctaaattctattgtgccattttatcttagccaaaacaaaacaagaaacacctacagttctgaccagttttattctggttcaccatccatctgcctcccttcttaaaatcttttccctggaatttggttgggtgcatgacccttgaccccaacactcacccctgacatcagtctgtaaccccttactccagctgacttgaacacattagttgagcagaatcatagtacctcaactcatctcttaccctacctagtttctgatccccagtgccaacctagagtctctttccctgatgccaggaaccctggtagagatcagatacccagatccacagaacttaatcctggagtactctgtcctttgtttaagaccctttccaatcattcccaccaacgcttttctccagtgaatcccttctgagcccctaacccactcttacagatgtggatgaatgcagttcgggcaccccttgtggtctccatggccagtgcacaaatactaaaggctccttccactgcagctgctcgacaggttaccgggcgccatctggtcaacctgggccttgtgcaggtaagctagctaaccagcaggagagactgggagtagtgcctggattcttgagcacagctcattagagatgtaaaatggactaagaaagattttcagagaaacatagtcttcaaggttgtaacttgggtgttggggctacaacattatgggtagggcttacttggagggggaccaacagtacaatcctgactcttgcgtaccttagacataaatgagtgtctggaaggcgacttctgcttcccccacggagagtgcctcaacactgatggctcctttacctgtacctgtgcccctggctaccggcctggacctcgtggagcatcttgtctgggtcagtccccaggccgtacctgagcgtggaaagagtgggctttcagcaggaaagggaggagcaagggaaagagggcagaaaaggaactctggatctttgagggtttggggaatctacatggatcactgaggggtagcttttttgaggcctggaggcggcaatcaaagaggaactggatgtgtcaggaagttggaagctgacagctggatagtgattgacaggggcctccgactggaggcggggcttacaagcaaaggtggggcctgaaacagattgggtgaggtcttcctttgaggctttgggacttggagggttgggacgggggaactgaaggggtgtggcctaggatattaagcagaggaggaggtgggcctgggtttcggatgccctgtcctgcagacgtggacgagtgcagcgaagaggatctttgccagagcggcatctgtaccaacactgacggctccttcgagtgcatctgtcctcctggacaccgcgctggccctgaccttgcctcctgccttggtgagaggcctcctccccccacaccttcctgtttcctcccccaccccttttcttatttatttctccctcctgaccctcctactccctctttgtctcacctgtttccttcatatgacctccctgcctattcctcagacattgacgagtgtcgtgaacggggacctgccctgtgcgggtctcagcgctgtgaaaattctcctggttcctaccgctgtgtgcgggactgcgatccaggttaccaccccggccctgagggcacctgtgatggtaagacagatcccctaaaacctgtgacaggttgtgggagcccgctcccctgggaatcaggagagagatgctctgtctccaaaacctggaaggagaggtcccacggctaacacttcccgttctcccctcagtgttttctggggtaagaaattagcccctgcttatgcacatgatttcttatgtgcaagggagctttcttatcaggagtcagggcaagctagaagccctccccttactgagccattttaatatatttagagggacggggtgcaggatgaatcagtattttctgtaacccatgaaacaaaactattatgggctgtatttcccttcctctgactcaggaaaatctcacttcctaagaacttaatcattaattataaaaagttcaataagcagcctgctagtgcagacatcgagggcacagcaaagaaggaccaaacaacacccctgccctcac

SEQ ID NO: 32270 - DNA, 2101 bp, Mus musculus
tcttctggtgtgtctgaagacagctacagtgtacttacatatataataaataagtaaatctgggcgcaggcgcgaccggggcggggggcgggctgcgaagagaatctcggcgatcctcagttgctgctgcatcctctgcccatcgccatggctgcctacaagctggtgctgatccggcatggcgagagcgcctggaacctggagaaccgcttcagcggctggtacgacgccgacctgagcccggcgggccacgaggaggcgaagcgcggcgggcaggcgttgcgagatgctggctatgaatttgacatctgcttcacctctgtgcagaagagagcaatccggaccctctggacagtcctggatgccattgaccagatgtggttgccagtggtcaggacttggcgcctcaatgagcgacactatggcggtctgacaggtctcaacaaagcagaaactgctgctaagcatggtgaggcccaggtaaagatctggagacgatcttatgatgtcccaccgcctcccatggagcctgatcaccccttctacagcaacatcagcaaggatcgcaggtacgcagaccttactgaagaccagctcccctcctgtgagagcctgaaggacactattgccagagcactgcccttctggaatgaagaaattgtcccccagatcaaagaggggaaaagggtcttgattgccgcccacggcaacagccttcggggcatcgttaagcatctggagggtctctcagaagaggccatcatggagctgaacctgcccacgggcatccctatcgtctatgaactggacaagaacttgaagcccatcaagcccatgcagttcctgggagacgaggagaccgtgcgcaaagccatggaagctgtggctgctcagggcaaggtgaagaagtgaaggcgaagaggcagactcctaccccgacaccctccctgcctgttcctgcctcctgcaccctccccagcacctgccacactgactatgtctttaggattttaagtttaagttgtagctgcagatgggggcctgtggctcccgttttcattgtagtattttatcccctgcacccactcccttcatagaatctagtcagaataacgcctttgggggtgcaggttctcggaccacatcgagggacagctccctgtaccaggagagttgagagatagtaactatagtttttcttaggtctttgtttactaagggtctgcttaggaagaattcagggaggaactgtgctgtggtgtgaccaatgaaaagctgcagtccagttttgtccctggaacctgtcctgcactcttcctgcagttaggtaactgggggcatagtcattccagtggagagtggaagtaacctcatggtgatttttaaccctaatttctctctgaccctaaaggagctgctggccctagaaggttgggatcaatcttgtcaagtctatgttacacttacttttacaaaaaaaagtatatatacatattatcagcacacaaaagcaactctgaggttgctagtgacatttgaaacagtcctgtgtggtcaccagaaaataagccattcctcatatcagtgggataaactccttgtacctcttgctgtgtttggatcccttggccttgttttgtagaggtgaagtacccctggatcatgtccgagtttttgtctttcactgtctgaatcatgttccagctgcttgaccctaccgtgtgggttcagagctcgtttgggcgtaacaactaagtctctttccagatcagtataataaaggagtgatgtgcaataaaaaaaaaaaaaaaaaaaataagtaaatctgaaagaaagaaagaaagaaagaaagaaaggaaggaaggaaggaaggaaggaaggaagaaagaaggaaagaacctacaagctgtcctctgactggtatgtgtatatgcacttgagtacaggtacacggcaacaaaacaaaaccccaaaatctcccacctgacctggatgtggtagttacataagatcctgtctcaaaggatagggtggtagagtgtgggtgtgtgcctatctcatacaaaaccctggattcaatccctggtattagggggaaaaa

SEQ ID NO: 32271 - DNA, 1154 bp, Mus musculus
tcggttccatcctcagggagctagatacatccatggatgagatggagccgcctctgaatccagcagcttcctcgagtccccagaatgagatcgtgtcccaggctgatcctgtattcttagaagctctgagctcaaggtacctgggagactctggcctggatgacttctttctggacattgatacatctgcggtggaaaaggacgttgcacttccacccccggagccgccgcacagcctcttctgtagcccaggatcctgggagtggaatgaactggaccacatcatggaaatcatcctgggatcctaaagctgatgggattcttccgggcgtcagcctcagtgcgctgggccttagatgggactcttgtatgtgtgcgtggcggaggcgctagacagagactgtgtggcctcctttcctcctatgtcaggattccacaaactgtcctgcatgtgtgcgtgtctggttgccacagccttccgtgaaggtgcgtcttcctcaattaatttatctcttccgaatgccttaaggagactctatttcagggagtctagattcctcgcttacacatttcttctgcctccagttcccactgtccttatgaccactagggtctcagggaagataaaactggacctgtcaaggggtgatggaggggctggtctccggacagactcaacctcttggcaggaccccagtaccagcagcctcctgattcataaccaggccggaccatgtgcaatagggcagaagtctaccagctccatgctgtgctacttaagaggaaagaggaggtagggtttgcagaggcgtatgtttgttggttggttggttggttggttggtttggggggattttttgagtgaaatttgttgttgttgttgttgttcttgtttttttgtttttgtttttttctaataaaagcattttggaaatattggaattgtaattaaatctgtaaacatctctggggtgatctggggaagagcctgctaagtttctccaatacttaacatcctttccttaacaaaagtagagcagccgggcggtggtggcgcatgcctttaatccaggcacttgggaggcagaggcagttggatttctgagttccaggccagcctggtctacagagtgagttccaggacagccaggact

SEQ ID NO: 32272 - DNA, 1185 bp, Mus musculus
acaccttccagatgtacagctcccgaaagtcccagagatgaagctcccgaaggtgcccgagatggccgtgcccgatgtacaccttccagatgtacagctcccgaaagttccagagatgaagctaccagagatgaagctcccgaaggtgccggagatggccgtgccggatgtacgactcccggaagttcagctgcccaaagtgtctgaggtgaagctcccaaagatgcctgagatggccgtgcctgatgtccacctcccggagctacaacttcccaaaatgtccgaggtgaagctcccaaagatgcccgagatggccgtgcccgatgttcgcctcccggaagttcagctgcccaaagtgtcagagatgaaactccctaagatgccagagatgaccatgcccgacattcgcctcccagaagttcagttgcccaaagtgcctgacattaaacttcctgaaatgaagcttccagaaataaaactccccaaagtgcctgacatggcagtgcctgatgtcccccttccagagctgcagctgcccaaagtgtcggacattcggctgcctgaaatgcaagtgtcacaggtcccagaggtgcagcttcccaagatgccagagatgaagttgtccaaggttcctgaggtacagaggaaatctgcaggggcggagcaggcaaaagggactgaatttagtttcaagttgcccaagatgaccatgcccaagttggggaaagtgggcaagcctggggaggcaagtattgaggttccagacaaactcatgacacttccctgtctgcagccagaggtgggcactgaggcatcccatgttggtgtcccttccctctctctcccctctgtggagcttgacttgcctggggccctgggcctggagggacaagtccaagaagctgtcccaggcaaagtggagaagccagagggccccagggtagcagtgggtgttggagaggtgggctttcgtgtgccctctgtggagattgtcactcctcagctgcccacagttgaagttgagaaagagcagctagagatggtggagatgaaagtcaaaccctcttccaagttctctctgcccaaattcggactttcagggcccaaagctgtcaagggagaggtggaggggcctgggcgagccaccaagctgaaggtttccaagtttaccatctcacttcccaa

SEQ ID NO: 32273 - DNA, 1113 bp, Mus musculus
aggtgtccaccactgggcaggtggttgcagagggccaggagagtgtgcagagggtgtccacactaggtatctctttgccccaggtggaattggccagctttggggaggcaggccctgagatcgtagccccttctgcagagggcacagcaggctctagggtccaggtgccacaggtgatgctggagctacctggaacccaggtggcagggggtgatctgttagtgggtgagggcatcttcaagatgcccacagtgacagtgccccagctagagctggatgtggggctgggccatgaagcccaggctggtgaagcagccaagagtgagggtgggataaagttgaagttgcccacactggggaccggaagcagaggagagggcgttgagccccagggccccgaggcccagcgcaccttccacctctcattgcccgatgtggaactcacgtcaccagtgagtagccacgctgagtaccaggtagttgagggtgatggggatggtgggcacaaactcaaggttcggctgcccctgtttggtctggcaaaggccaaggaagggatagaagttggagaaaaggctaagagtccaaagctcaggctaccccgagtgggcttcagccagagtgagtcggtctccggagaaggctctccaagtcctgaggaggaggaagaaggcagtggggaaggggcttccagtcgccggggtagggtaagggtccgcctgcctcgggtaggcttggcttccccttctaaagtctctaagggacaggagggtgatgcaacctccaagtccccagttggggagaagtcacccaaattccgttttcctagggtgtccttaagccccaaggcccggagtgggagtagggaccgggaagaaggtggattcagggtccgactgcccagtgtgggattttcagaaacagcagttccaggttccaccaggattgagggaacccaggctgctgccatctgaagccccaggacagctgtggattccccctcttgtctttccattccccagcctagccccccattttgtgtgtgacattactagcactaatcctcagagggcttgaaggtgggtaactgactcaggcaggagccagtggcct

SEQ ID NO: 32274 - DNA, 1210 bp, Mus musculus
tttggagataccattcacatgccatcctaccatcccaggacttctcagagacaccccacctgcaccttgagcccccacctcaccatcctcctctcccctgcagaaactgtttgtggtccctacggatgagtcccaggcccgaatcccctatgcccgtgtcaaccacaacaagtacatggtgactgaacgtgcctcatacattggtaagtgcccccagtaccatatcaaaggaaaggcctgggcactagggtctggccacccatcagaccctcactccaccccttgctcccaggaacctccaactggtctggaagctacttcacggagacagcaggcacctccctgctggtgacacagaacgggcatggtggcttgcgcagtcagctggaggctgttttcctgagagactgggaatccccatacagccacgatctcgacacctcagccaacagtgtgggcaatgcctgccgcctgctttgaggctcagcccgacggacaggtcaaagccttccaggcctccttggactcagctctgggtcctggttactgtccccatgcccttgcctctgtctatcccgtgtggctctgtactctccactatactcctgctgctacctccaccgccactggcctgacactctggcccctgtggacctagcagagctggggattgggccccaaagaagtgggggtgcatgctgggcccagacctttggcccacccccaaagggccaagattataagtaaataattgtctgtatagcctgtgcttaactgagtggtatgagatggtatgtttgttaggggggagggggtatggacttctgctggtgacagcatgcagtgcgcacgaaggctggcgtgggctgggcatgcagtgtgtgaccgcactggcaagcatgggctgagcatgcgtagaaccagcatgtttgtaccgagtatgctccacagagcagtgcgggtagaaccactgctgaatgccatttacggccgttggggatgggaatgggaggtgggtgggtgggggtgggggtgggggggaatgagggcggggccaagtggcagctggactaacatatctgaacaccggagcatgtgcgtatgtgaacaacacagcatgtgcgaagtctgaatttattcctaccagtgtgtttacacttaacatgtccagagcatgagcgagcgagcgcatggcctgtccatcacagac

SEQ ID NO: 32275 - DNA, 1149 bp, Mus musculus
cacagtactgactgagccatctccccagctggggacatgaacttttaagatggtctctttccttttatgtgtgtgtgtatttaccagcctgtccatactttgcaccatgtacatacctgacgcacttggagcccaggcatgttggagatggagttacaggtggttgtgccttgctcccagagtgctgggaactaaactgggtcttctacaggcgcaaaccatgtcctaagcaccgagtcatgtctccggcccccagaaacggattttttaaatcatagggagaagaagcttggcacctgggaggtggagacaggaaaattgtgaattcatggccatcttgactaattcaggagatctagcttcaccatgggacccaaccaaccaaccaacatggcgttaggagctgaaattgagtttagcagtggtgacttcaaggccctagacttctggtttagtatagcggaggccttccaaggagagactggttatgtctacttcacagcagtgcctcactccccattcatcacacattggactaacctgagttcaagtcctggccctgccttacatgctgtgtgttcccaggctgaccattctctttctatctctgactttatttcctctttttgctcattttccttcctcccaggatcatcatgggaagccactgaggtatgcttacctcagtccctggcacagagtgaacactcgtgagcacctgctccatgggcttcagaatcggagagaacttgcttttcaatctcagaaaggtcagttgctacatgtgacacttgacaagtccctgttccttgctgagtgagtcatgtgtgactttttaattgatgggaatggagctaataatggtcttccctgcgaggctgttgcaaggcatctttgtgatgctctggcctggcggctacttggtacttgatttgtgccatgtcctgacggtctcagagctctctattgtctgttggcgctagattcagagcttgctgtctagctaaggacagccttgagcttctttctgctcatgatgcctctgtctcccaggtgctgggactgtgggatgtgtacctggtgagtatggtgctgagactgtgggatgtgtacctggtgtgtatggtgctgagactgtgggatgtgtac

SEQ ID NO: 32276 - DNA, 1215 bp, Mus musculus
gttcaaatcccagtaaccacagggtggctcacaaccatctgtaatgggatctgatattctcttctggtgtgtctgaagacagctacagtgtactcatatacaataaataaaaaatcttaaaacaaacaaacaaaaaccaacccgtcttttagagggggagggggagggggaggcaaagaaacaaagattcaagggaagcagcttggagcttggttagcagagtttgcctggaattgcacaagcttccatccccagcactacataagctgcgcatggtggcagcacaacctgttaattccagcactggggaagaggaggcaggagagttaggagttcaaggtcaccttcagatacatagtgaggccagcctaagctctactagaccttgtctcaaaaaactcccattaaaggctgtctggactcagtctgcccagcaacctgaggacatgggtgttttagtattgaaccgtcagccaggtgagggcacatttcttatttctgccctgagggtctaaggcatcccaggtgctaggaacaggctagcacctgcctgtgctgagtgcccagaaagtacttggtagaggtatagtactacaaatgtacagataaggaaactgaggcactgagcattgacttgccaaagtcctgaaggcaggaaatggcacagtgggtgcttctgcatgaggctgtccctgctaaggccgacgggccggctcctgaacctggctgtcccctgctaaggcagacgggccggctcctgaacctggctgtcccctgctaaggccggtgggccggctcctgaacctggctgtcccctgctaaggccgatgggccggctcctgaacctggctgtcccctgctaaggccggtgggccggctcctgaacctggctgtcccctgctaaggccgatgggccggctcctgaacctggctgtcccctgctaaggccgatgggccggctcctgaacctggctgtcccctgctaaggccgatgggccggctcctgaacctggctgtcccctgctaaggccgatgggccggctcctgaacctggctgtcccctgctaaggccggtgggccggctcctgaacctggctgtcccctgctaaggccgatgggccggctcctgaacctggctgtcccctgctaaggccggtgggccggctcctgaacctggctgtccctgctaaggccgatgggccggctcctgaacct

SEQ ID NO: 32277 - DNA, 2632 bp, Mus musculus
gtttccccagcacttcatcctaggctgaggtacaagactgaggatagtgtctgaggctcatagactctctgctaagtaagtggccaaggaaggggctgggctggggctcagtggtagaaagagcactttccagctgtgttgtgtataaggccatgagttctatctgaggtgtgagagaatgaacagctaaaatgacttggggagcttgccagtgctccccctgcccttgccagtgcactcctgtctctgtcttcacagagccatggctcttcagcttccagggctcccatggtcagagctgtttccttcctgagtcccttggcatagtcaggtcttccttttggtgccctagtctctggtccccttcagtggtgctgtcaccattacataggatgtcactgaactgtcatctgacttcttagaggccagcccagagcaggtagcatgctgagggagtaagtgagtctgtcttttctctgccctctacagcccacaggagttttcagccgcttaggggccaccccagagatggatgaggatctggcctgggacagtgacaatgacagcagcagtagctctgtcctgcagtatgctggggtcctgaagaaactaggacgaggcccaaccaaggccagtgcccaaccagcactgactgtcaaagccaaggccacaagctctgcaaccaccacagctaccactccaaagctgcggcgcctggcacttccctctcgccctgggctggagaagaagccggattccctgcccaaagtcagcatccttcagagactgggcaaggctgccgttgtgtccgaggcacaggacagccaggtcacaagcaccaagagtaagtcctcagctgaggtcaagttcgccattaaaaggactctggtagggccccgggggagcagctccagcgagagccttggtgcccagatggaccatgcaggcactgtgagcgtgttcaaaagactgggccaaaggactttctagccacatgcagggtggggtgcagcagggaatggcaggccagctcctgctttcatcccttcagcctttcttgagggcacacctgccctcccacggagctctagaaggcacaaggcttggctctctccagcatttagctggttccaagcactcgggaacacagccatttttcctggtttttgatgttcccgcagcctgatggtgcctgctttgggacttcccttcttccctgccctctgtcctctgcacagtaactgtggccttggcatagttcccttttctacctcttccccaagccaagggacctgtttctttcatgcagtccaccctgatagcagcatctgttgtgaccctcctgttgtgaccgccccaccacaaaggtgtcacctggggggtctcccccaggcccgccctgcgccttccctccctcttctcccccttccccgcctgctgtgctgtctctctccctctcttccctcttttcatttctcttctgttttctgtccctgtggcaaggcccgaccgtccgctgcatcctgcctgaccctcctgcacctctggcctcccagcggccccctcgtcgacggtggcggcgaacctgtaaagactgttagctgccttccattcccaggctggagggacttccccagacctggcctgcagccggggcacctccgtttccctgccctgaccgtctttttctttgatgggtggtgggcaacagacatgggaaggggcgggtgctgaggaaaggtgactgctgttttaatatatttttgtgactttgagactgtttccttccttcctcctccttcagtggagtcacaggtctgtggctcacacggaccctgtggggcagtaggcactggtgaaagactgggactgaaggggatgatggcgacagttctcatggtgaggcctcctcctccccttcaaactgcagtgcctgtcactacggtgtcccatcaatgtcaccattctgccactctgcctgttggtagcttgcttttattttgagacaggatctcactctgtagccctggcttccctggaacttgctatgtagatcaggctggcctccaactctgaagagccccgcttccctctgcctcccaagccccaagtgctggattaaaggcgtgcaccacagccagctgcttgccttcttttgttttttgaaacccaaggtggctcaaacttgctgtatagttgaggaagacttagaacgtctctctttacaaataaatttattttgtgtgtataaatgttttgtgtctgtgtatgtattaggcacataagtgcatgatgctcatggagacttggaaaaagatgttggataccctgagactaaagttgaggacagttttgagacactttgtggattctgggaacaaatcttgtatcctctgtaagcatcaaatgcatttaaccattgagcccatgctttgagtttttaatcctctgatctaggccgtgagatttctcacattagaggcctgtgccacaatgtcagggctttatgtgtgccggagactaggtccaggcctatgtgagcattctgctagcttccaccgctcccacccccctttttgagacggtgttactatgtcacacaggttagcctcaaagtcaagattctcttgcc

SEQ ID NO: 32278 - DNA, 1706 bp, Mus musculus
ttggaggcacgccagcggaggacacatctagaagttcccctcactcccagcacctcagctgccttccatgctgtcctctgggcaatcttatctgctgccaccccacctggggcacaaaagcagtaatgtccagggacaggcagaagcctttggaagctgaggggtctgggtttgcttctatggagaatggatcttcaagggggatccaggagcaggagctgccttcctcttcctcccaagctactctcttgattctcaataaagcaggaggaatgttcgggggcagccctcctgcccacagcccagtgccttaccagggcttccttctagccagccttgcctcccgctcggcccctttggatggctccgttctctgcctggggcagagggaagccaaccttggctgttacacatctcacaccaagacagtattgggccccttggacttgactggggtctgaggggacagagatggggataggtgtctgatacacaatggggtggagtctgcctcatctccagggcacctgttctggagccttaaagtgaatgtttgagttagagttgtgtcagtgctgtgggtgcgggtgtgcacctgacctagcagtgagcatcccaggctcctgggatgctggtgcccacagctgtatgcagcacttgtgtgagtgggctcaggctcagccccagcctgagtgtttgatcccacggggtgcagtgagtgcaggcgatgtgcctgctgctctggccatgtctctccctcctcaatagctctgggtttttggaaatgagttctcctggttttgctctcccaccacacccccagaataggtggatttcagaaaggcagtagggtggggtggttgggatggttatgggggtcatctgttttttactttgtatgtgtgtatgtttatctgagagttttcgcccatccctgctggcctttccttactcctcgtatttgtacggtacaagcaataaagacactcatttcagaccagggcccagtccacatttccttagccaccccttctgtcctggtactggagtgccagagtagcatgcaccatttattacctgctctgccttattctgaggtccatggagccatggggatggaagagatggccgtgagaaagtgggtggtggatcccggctgcagagagcggcgctgcagaggaaaaggtggctgggtggtttctgttgggtagggatggctcggacccttagaagctgccagattgggggcagcagtgctgagcggctctaaacaggaagcacgagcgctgtggcagcagaggggtggttcattcacttggcctctgagccctaaacagcttctgtgtggaaccaggaagccttagtgtccccaaatgccatcataaaatctgtgacttaacagggcttgtgactcccagcaggaacacccggacatttgattacagctgcactggtctaggactgaaccccatgctgaacctgtgggttgtggggctcactggggtacttgctcctttcccatacccaggtgccaggcacacagggcctggtgcagatggatttgttccaggatttactagaagacggggcaccacaagcatggcgatctgagaactggaaagcgggctgtgggaaagcaaggccagtttagacacctgtcccaactgcagagaagactgcgtgcggcccaggttgggtgtcccgta

SEQ ID NO: 32279 - DNA, 1196 bp, Mus musculus
aacgtgcccccttctccctactccaccccgtcctacctcaaggtgcctctgcccgccgagccttctccttgtgttcaggcgccttgggagccgccggctgtcaccccttcccggccaggacacggagctcgtaggcgctgcgacctggcgctgctaagctgtgccacgctgctgagtgcggtgggcctgggcgccgacgtggccgaggcacgggccggggacggtgaggagcagcggcgctggctggacagtctcttcttcccgcgccccggccgcttccctcgcggtctcagcccaaccgggcgccccggaggtcgccgcgaagacacagccccaggcttgggtctggcaccctcggccaccctggtgtcattatcctctgtatcggattgtaactctacgcgctcattgctgcgctctgacagtgacgaggctgcccctgccgccccctccccgccgccttctccgctcgcgccctcacccagcaccaatcctctcgtggacgtggagttggagagcttcaagaaggacccccggcagtcacttacgcccacccacgtcactgccgcccacgctgtgagccgtggacacaggcggacgccatcagatggggctttgagacaacgggagcctctggagctcaccaaccacggtgagtggggcctgtccaagcaatctttcacagactactgacccgtgtttccttctgagccaccccagccgtcattgccgggccccttgtgggtcttggggatgcctgagataggataaattgggcaatgtcaatataatgtctgcgaggacagggtaggtgacatgatggcaagtggaagcattggtagccatcagcactgtcctctctgcttattagccagcagtatggtcaggagggcgtggtcgggaattacttgtgcccttcaggccctgggttctgggttacagccactgtagtcaggtttgaatctctcagccccagccatgcgctgtttcgatcactccagagatgcaggctaggagtagcagcacacactgtgaacccagtactcggggtcaggagtttatggtcagcctgggccacactcagagtttgagaccagcctgggctacatgagactctgtccctaagatggaaagatgaactggggtacagctcctttggtagaagaattgtctaacatgttgagtgtgatccccaa

SEQ ID NO: 32280 - DNA, 1193 bp, Mus musculus
catgtgctggtcaactgggctgtgcaggtggctcggggcatgaactatctacacaatgatgcccctgtgcccatcattcaccgggacctcaagtccatcaacagtaagtggtatcctctctcccaaaactcttccgctgaatcttatgaggccaagcccagatcgttggaaagggcaatggacagcagatggcactgcatggggcaagcagggccaggtgaagggggactttggttgtattaataagaaaagggaagctcagaaaggtctctttcattcagtaggtcaatgatggtgtatccatggcactatgacagtccctgtgttcattgccacttgcagagtctgtcctcatgatgcccacaacctgatcgtggcattggagtctaccaggcagagatggacagagctggcttagttgaagccagggcttcccaagcctgtcacaaaggttaacctttgtggtcttgtcattggcagagcgattgttctgtgcactttatgttgtttggtggccttagggctctatgcacaagaggtcattagtactctgcaaccctgctcccaactatcaaaaccagaaatgtctccaaacacttccttgtgtgccttgggataggggtgggatggggcaaatcaaaactgttctctagatgctgctggctctccagcagagtggagcagatgaaggcgttgggaagagagtggctgatagaaaacacttccaggctgctttgcccggcacaggttctacaaagctggctgactggttggttgagtcagcaatgggccaagcagatgggaagggtccctagaaatcgatcatatctagaccaaaagtatctcagggcatcaacaaatattagtgggcccgctattaagttaggccatctccaagcaacaagacaccatggtttctttccctgagagtcctcatcgatgagacatttctttctttctttctttctttctttctttctttctttctttctttctagatcattctggcatgtgctagatactcctaggtatacaactgggaagactttgcctccttgggctctcccatccttgctgagcctcatttcatatctttcatttttgtcttttaaattgatggcctcagccttgcatttggtattcacaaggccagagcatgtgcagggggctccacagcaaatgaggcctgcact

SEQ ID NO: 32281 - DNA, 1237 bp, Mus musculus
aacatatcacacagtaatatacaaatacacaggctacaaaatggttaagaaagggttaaagaagtttcaaagaggctacactgaagtccatacggtgtatattagaggctgatggagagtctggagagaccagaaaaccctgtgagaaactacaggtgttacagtgaaaaagagtaattcttctgtgtctgtaggcagcagcttctgccctggaggtcatctccagcctggggcgggggggcagggctgtgtcctgatcactttcctacagtgaatggtgttgctacggtggtactggctgtagtggtaggcatgagctagatggcccaaagaagaattttacagatgaggactgataggatttctgattcttgcacaaaagagcaagatcttctggatcttctgtgagaattctattggccaagtgatggtttagtccttctgaaacagtttccatgaattgactagtgacttcctctggtaggaggcatcccactggtatcttaagacctgtgtcctcttccagctgctggcttggaaaaagttatgcccaaacatcatccagatttgattttctgccgcaagcaggctggtgtgtctatcagaagactgtgtgaaaatgtgacagcaagtgtgtgatctgtgatttctatgtgcgtccctgcaccttgatttgcatatgtgatgatgtaagaccccctttcgggggcccctactctagtctcgggagagagagcacacccaaagaaacacgagaatccttcttgctgtaaacacatgaggtagtttaatgacagagctccaggtcgaaacgtatctcactcaggagacagtggatttgaccccgaggctcgaaagctaggggtttttatggggtaaagggcttaggggtgggggagaatatgtgcaggtcagggtgtcagagttctgtgagttgttaactcagttcagatagccctgttatgtcctcacattcttctttatcttttatggtaaagctgtccccaggaatgctttaacgacggggcatgcccgggtttgtttttctttgttctcagccccaggcatcctcttggctcacaaacaaccagcaatttctgagtactttatatgacttacaggtcttgaaatttcatctttctttcaatgagtataactgtggatcatatcagggccggtgtgtgatctgtggcggtcccagagtctctgatgcctactactgtaaagagtgaaccat

SEQ ID NO: 32282 - DNA, 1152 bp, Mus musculus
ctaggaagtctcctgacaaccttttcccagcattctaacagtctagattgactgtcccaggatgctgccaaacgtgactggaaacaaagttgttctatcctccctacagggtcaggacacagaatactgatagttaaactgtgaggggccctacatgaagaacctgactctgccattgttccattggcagcaacaacaaagccctggtggctctaatgtctaggagaaaaagctggatgcctacaattcagagtcctttgctttaaggattgaagctaggtgtggtgacttttgcctgtaattccagaatatgagaggatgaggtaggagaattaccaggcatttaaggcaagcccgggtttcatgtatgaaatccaggatatcttggaaaagaaaagcaaaataaatacacaagcctaaaggctcagggatctacagacaagagaaggcaggaagattgcaagagccaaagggtgtcttcaaggaaatactgacttccagacacaacagatgcacattatgaactctcaagagtccatgcagtgtgtgcaggttcaaggaagacagtctcaacaatggggggtggggggaaccatgggctcccacccctaaccagtgaactatctgtaattgacacctgctagcaaataaaaatcaggtgtctccaatgctgtctcactgggtgtatcaacacctcagggcccacacaaaataaacttggtggtatttttgtgacctttttgtttattttgcattgcttggtcaattttgattttgtcttattggtcttttgcttgtgcatttctgcacacacacaaaccccctcacacatacaaacagtgacaccacacacatgaaaaatggagaaaaaagagaagggaatgaacagcatggaatcaataagtgtcattgtcacaggtcatccagaacttcatggggtttaaagggagctcagcattgatgcagatggaaggcagcaacccaggctgtttaattactacaggcacacttaagattccttagactgaggtatgtctgacttgaggttttatattgctgtgacaagacaatgaccacagcaactcttaagtggggcttgcttacagttgggaggtttagcccattatcattgtgttgggaagcatggcagca

SEQ ID NO: 32283 - DNA, 1155 bp, Mus musculus
atattggggaattcatactggtgagaaattgtgaatgtaagaaatgtaagaaaatgtttagatttagttcagccttcagtgcacattggagaattctgaggtggaaatttctgggttttgggggggactcgattgtgtcatgtgatatcgttttgaaaactgtcttatgagaggatgttatgcagagaacagacacatggtgtttttctggaagcttcctggtaaaagggcatgtaatgtttggctggagaggaaatgtgatgtttggaaaagtataactcaacagagagtgaatgacactctggctttggtttgccttgccactctttgctggtctttgttggactttgctgacactggacttcactgatgatgctgtgacattggttcttgccttctttgatgatcattgcttattgtgactttgtagagagaaatgcaccaaagaacttgtattctaatggcttcttgctgcttctgaggactggggctaattagcagagccttttggttcctgctggatgggcctgccatccaagtggattgagctgctgctgctgattcatatgaactgagctgctgatatcctgacagtgaaaattgtaattgcccaaagaactatttctaaacaggtccacatctggctttgccctatttaccttttcctttttactacctctggtggctggtgaactagaagggaggttaaagtgtgtaaaaacccttattaaaatagattttgaaaattctaaggtggggctggcgagatggctcagtgggtaagagcactgactgctcttccgaaggtcctgagttcaaatcccagcaaccacatggtggctcaacaaccacccaagtaatgagatctaacgccttcgtctggtgtgtcagaagacagccacagtgtacttatgtataataacaaataaatctttgggctggagcgagcagggactgagtgagtggagttgactggagcaagcggggttgactggagcgagtagaggtcctaaaaattcaatcccaacaaccaaatgaaggctcacaaccatctgtacagctatagtgtactcacatacatttaaaaaaatctttaaaaaaagtaagaaaaatattctaagcttacagaattcatattggtatgaagccctatca

SEQ ID NO: 32284 - DNA, 1169 bp, Mus musculus
ttggaaaactcaaaactcatcattctgtggaaagagtagagaaactgcctccaagctgagctggttgggggttctgttgtggggaacactgatggaatgcagccaggatagaatggatttttcccttttgtccagtattgaccaaggagggaattttctctaagacttctttagatgaattagacagctgcttagaaggttgcctttttcacccagtttacactatctattaggaaaagaaagttataaaacttagatggatttaaaggcagaaataggcccagttcctggatgtggcctaaaaggaaacaacaacaaactgaaagacaagatcctttggataaactgaaagccatcatcctcttctctattgatgagactcggttagggtacagatacccagcaaaatgttggtgtcttgccctccttcagaagaatatctcttagctgaaagttgtgctcccaatcaaagatacatcttttagattgccaaccaaaaatcctgaaggcgagggcaaaatcacctcccaccccaggattagttcaacaccaacgtcagctaaacagttaagccactcctgaccagaatgaacaataccaagtagccctggaaagatgattgggaaattgcagtctgtcttgcctggcttatcaagacagacacacaacacaattctcctgtctgtgatgaaacctgggacttctggtcatcgactccagaatctgaaataaaaagaaaaaaaaattattaagagagtcctgcctctaccctgtggtctcaaccccatacattctcatgagtctgatttgcctagagaagtaggcagatattgccttggacctgaaagatgtgttctccagcctctcattgttagagctaagtcaattcatctttgctttggagtggacggaccaagaaggaggttatagagggtaacttagatggaccaggttgcctcagggatttgacaatttttccaaccctctttgatgagagtgttggaaacttgtgtttccaatcttaggtcaactaagtattaaccccttgctcttccaccaggggtttgcagggcccatactcttataatatataaagacctcctagcctctaaaactaacagaaattaaaagggccacggagggactcctgcaacagttatagaacttgg

SEQ ID NO: 32285 - DNA, 2668 bp, Mus musculus
gccaccagagatttcataatggtgagaaggtaaagagtgtggagaggcctttcatcttaagagccataaaataatttattcaggtcagaaatgtttgaatgcaaggaatgtgggaagtccttcaagcttgttttcactcttgtttggcatagggttattcatgctgctgtgaaacaatatgaatgtaatgagtgtgggaaaacctttaattgttcaaatctcatgcaacatcagaaaattgactctgatgagagactcatttagtgtaaggactgtgaaaaggccttcactgttctggctcagcttactaggcaccagaacattcatgctggaaagaagtcctttgaatgtgagtagtgctggtcagccttcagacttagtgccaacttattcaatctcagagaattcatactgatgtgcatccctatcattgcaaggaatgtggaaaagctttgttagtggtccaagtcttagaattcatgagagaactcacagttgtgattcacactcatgagagaccttatcagtgttaagaatgtataaaggcctttagtcaaaaatgaagctggttgggctctagagttcatattagtagaagccttatgaatataaagaatgtgaaaaggcctttagcaataattctaagctacctgtatattagaaaacttatactggtgagaaaccctatgaatataagaagtatgggaaaacatttagaattagttcatcctcccatgcacattggagaattcataccagtgtaaaaccttgtcactgtaaagaatgtggaaataacttcaattggagatcaagtcttcttcaacataaaagaatccatgctggtgtgaaaccttttgaatacaaggaatgtagaaacataacagaaatagcaaagctcttaaagctcttcagagaggacaggtagatctgaaaccctataaatgcaaaggctgtgaaagcccttattgtcaatgatgagcttacacaatatcagaaaatccatgatcatcaggagtcctgtgcatgtaaggaatgtggacaagcctttgtatgaaaatttcactgaagatcagagcactcatattcttaagtctatgactgaaaagattgtgggaagaactttaggatgccttttggtttggtcaacgtcatagtattcatatattcctagtgggacaaaccctttgaaaatgtgaatgtgggaagtctattcagaggaagtactctgttgagaatgtctttaaatgtcataaatacaggggagccagcattattttgatttactctcttgttagttgtataatcttaatttatcaatcattagtcagccaggacagtcaacttagggagggcagttattggaactaggtttacctgcgatgacttcattgtcaccattcacatcccactgctcttgtgatattagactggatgtttactttgtttttgtataatttgttaatggctagcacagcaccagccaaagctgtaacaacagagttataatagataataaaatccttgcgagtatttggtcagtactcatgttctgtaaagtggcctctacagtgttcttgctttcatcaacattactgcaactcttatgaaaagataattgtactttagatggtttaggaaagccacgtgcattcattcattgttaaattttaaataacttcattctgggtacatctaataaatgaaggaacattaaaggatttgaattgtgagtccattaaatatttgtgtagagattttaaaaatacagtcattgatgaataagtactttctaaggggttaaaccatttttaaaaattaaaactgattatttttgccctctgcccacatctgaagataaactacacatttgtgataagacaaggaagtctacaggatcctccatctcttagtcttgctgaggtcatttcaggtttggctagaatttccttgatggagaatctcatggaatattacccaactctgttctaggatatggaggtcaaaatgtctctgataatttatcctggcatatgttaaatggcctgtgtccagctacctgcttatcttggcttcttttaaacttcctgcttggacaaaagctccccctgcagctgttgagcaaggtaatagaatgtgggttttgctctaaatgcttggaggtatacttgggtcccaaataactgaatgtactcagagctggctggagttatttttcagttggccatatactgtctgagtggtgttctcataacaaccaaaatagccaaattgaaactacttagaaaaatacatgtatgaagttttctatgcttatgggaaacttgaaatagtcaagaactcacctctgtatcattacttagatttaaagttgttaacaatttctatgctgattgtatttctctttatatatagggtatttggggtttgtcttagggtttcattgctgtgaagaaatgccatgactgaggcaactcttaaacagaaaaattggagctggcttatagtttcagagattcagtctattatcatcatagtgcaaacatggcagtctccagacaaatatggtactgaaaggaggtttctacatcataatctgaaggcagccaggaggaggatctcctttgccctgggcagagcttaagcataggacctcatagaccacagtcac

SEQ ID NO: 32286 - DNA, 1183 bp, Mus musculus
tagcttttcggtttggggtctggaccaggtggaggatgatgtatgggggccccgtggcctaggtatgttcgtggccaagggaccagtggactcactgtgcttgggacgtgaacggtgaggcgttaagtattggttgtggtttggctgagtgacctttggctttaacgtgagttgggaatctgacatgaaagcttttgggggggggaggggaagaactgggtaatgagactctgaatgtgactctgactttaaaatccatgggacttttagaacctcttgaggggactgggatgctaaggttcggtatggagctgctgcaaaactttcatgatgagttttgtttaaggggcctactattagcaatctacataggggactgagcagctcctgtatctattgagagatagtgaatgatgtcaggtactggagacataggtgacttggtggcgaaataggaagaacgctttcgctgatttcacgagatgattctctgcttccaacaccaagttgtctttaccgtctacaggatgagattccagcactgtccgtgtctcggccgcagaccggcctgtcctttctgggacccgaacctgaagacctggaggacctgtacagccgctacaaggtgtgttcaaccctaagctggctcctgcatacctcccatcccccatcacatacgcccccccccccacctcccactgtggtacggcaaggctgcagccaaccctttgccctccctgtgcgtgcagaagctgcagcaggagctggagttcctggaagtgcaggaggagtatatcaaggacgagcagaagaacctgaagaaggaattcctccacgcccaggaggaggtgaagcggatccagagcatccccttggtcatcggtcagttcttggaagctgtggatcagaacacagccatcgtgggctccaccacaggtgagtggtgaggcaggctgggagcaaggcagggtgatagaatggccagagtactgaccgatccagaagtggatacatactttattttctgaatgtctctttctgcctctcaattcacgtgtgtgcgtgtagtttcaccatccaagtgtgatggtgtacgcctttaacctcagcacttgaggaggcggagggacaagaggatctttgtgtgtttgaggtcagcctggtctacctagtatgtttcccg

SEQ ID NO: 32287 - DNA, 1057 bp, Mus musculus
aactgcagtgacctttccaaatttggggataatgtgggcaaataaagttacttttctaaggtcacacaactaggaagtaggctcaggttgctgtgcatgtgtgcgtgcattcgtgtgtgtgtgtgtgtgtgtgtgtgtgtgtgtgtgtgtgtgtgtgtgtgtgtgtgtgtgagagagagagagagagagagagagagagagagagagagagagagagagagagatctagttgtcaattgaacaaggtgtatttgagcctggaggcatgagcagggctggttcctgcggaccctgtgaggactgtgggatgggcatgggtgttgtctatactgtggttgagcaccagtgcccagcgccaggctgactgactagctgatacctccttggtatttgcagggtactcttgagaagttcaggcaggtgaaagtctgtggcatcctcctcattggtcttctgccctcaccatcccccatgtaaccaaagagactctgagcacctattttccctccctactgagaatccctctggactccatctcactcagggtaaaagtccatcctttccatgaccactgggtgggtcttcaccatccaccctcatcacctgtctgaattagttgacgctccctctgctccagccgcaatgggctcagcctttgcacgtggtattctgtgcctggatcatttctctgtagacagcccagactcactgcctgactgctcttctgaattacacttctaacatccctgatcattcttcctttaactttttccttgtatcagttatattgtgtggcacatgttaaaatttatcttgtcaactgtctccccttctgggaggccttgaacttcttggaagcaagtatttgggtcactttatgctttatctcccactttgaagaatatgtaacaccccctcaggctcactgtcagatgagtactttcaagagtagatcctgattccagtctcctgggatgtcccacatccccttctatatagtgaacgttgctgaatactccagtggtgaacaatgtggaaacacaacagagaagaaagg

SEQ ID NO: 32288 - DNA, 1805 bp, Mus musculus
ttcttgttactgggaagccatgatgtcctagtgaactgttgctcctgttcgttgattcttcagatcacagtgccattttgtgagcactgttgggggatgccagtgctacagcagacaagtgccctgccattccaaagcctgcatcccagaggcaagaggaatgttagcaaagagccatggatactgagagtcggagggccggagacaggagagctctataaggggggcatctttgaggaaaacgttaaagaactaggccaaagggaaggaaaacatccccgctaggaaaagaaagctagagagaacagaaattggacaagagtgaagaggaccaggacaaagtccatgaggagatgtcataagggcttgactctggcactgaataacatggaaagcaacagcctctttgagcactgagctctgaggtgtgggcagaggttggaagcatcccagtggctagtccagctggtgttgatgcatgtggtttgttttgaccttagtggtagcagaagaggtggtcagttaggtgtgggatggaacagcagcctgagtgtaggaaggaggaacgatgctggcctatgaatgggaaagagcagcaggtataggcacatttgacaatggtcaccgtattgctactgtgaaatccctgagaggtcgccgaaggggaagacggagcccaggactggaaagccacattaacctctgtgtaggatgactagtgtggagctttctgggtctgaatagtgttgaattcagaactccctacctcttcttggttggtcctgagctttgaaagcaagagaagtccctcctgggagtagagcttgagtcagaacctgggacagcacctgactctctggctgctagactgaggctggcccctgcctcagcatctactgcttcctctttctgagcaggtggttagctgctcttggggaaaactcttgccccagctctgtgtggccttcctgtcttgctccctgctactcttccactcttggtcccacttcagctaaccagggttgaattgcaagggccaggagttcaggtctgcagtggctgatgtatatctactgcaaagggctctgtgaccccgagtctcagttacaatgtactgacagttggtcaaagatttgaacctgtttttttttttgttgttgttgttgtttctttttgtttggttattttttttggtttttttttgggggggggttgtttttggcaggggaggtcctcttatgtgtgtgaatctgagaagtggtaggcatgcctgtagaacatagtctagcaggctctgagctgagaaaggctcacagttaggtcaggagcatttcttcccacatgtgttcctgtgacccagatatagtgatggcaggcctggccagcctctgccttcaccaaacacacgagccagtgggaaggcaggctgtctgcagacagtggtcaaggctgagatgggcaaacagacttgagtgagtcatggtggcaagatctttaggttgcaaagggctatgggaacctggaggccatgcctggcccagtccgaggtatctgagataggagatgggagtgaggcgtacaggagtcagatggtggctggggaccactgaagcccagtcagtagggaggaaactgtcattcagtaattttaggtttgtagaaaagtgtcagagattgtgcagaaactgtccccagatgtaccccgctcccctggtgtcagtgtcagatgtaccccgctcccctggtgtcagtgtcttctaggacatacccaccaaagctaggacatccgcgcctgctcccgtttt

SEQ ID NO: 32289 - DNA, 1286 bp, Mus musculus
tccagcacaatagcctgctttctgttactatagcaaagtacctgagactaggtcatgtataaagagctcagttcagacttgaggtagatgccaccatgtctgaaaggggtcagcagtaagacaggcagccagacagtgaggaaaggccaggcttgcttttgtataatgctcatggggactaactggagtctcatagagagcacacccccagtgacatcgttacggtgaagatgaagcttccagtaaatgcccctctgagcactgttcacaccttccagggctaatatacagtaattggcagactcagaggacactggggctgtgacactgtcccctgcccctgagtgtcaccactgctggcactcctcaccagtggctctggcctgtgacattctaataagaattattgtatttttgttgttgttagtttatttctatagtggctgtgttggcatgaactcaaggtgtccatttcgtagctgtctgacccagtgttgctctgactgttttgtccaagctgctgctgccttccgggcaggctcctgcatcctccctgttttctctccttgtgttttctctgtgcccctgcaccgtgtcacagattcatgggcttttttccaggcagctctgatcccttctactggagaacagtgttagactcaggtctaggcatggggtgtgccactacttcctgtcctagctggtgctgcctagggtatcactcatctgtagcctcccacacgcacatctctgtatccctctgttcatgcctctgactcaggtcagcacctaggagccacacagattcctgcttccttgggaccttctagatggcaagcaaactcctttgtgtgcttttcgttcttgtctggtcatcttggcagaagctagcagcatgaccaggcctgcatgtgaagcacttctctctgcagccagactttgcctgccattctgctgaccccagagacagcatctagcaagtcccagtgtttcaccatttacttactgtctgggagctctcctcgctcgcctcaacttctagcagtctcacaatcacagtcttgtttcctacctgtgctggtatgtctcctcgtctcctcctactctcgaggcttgtgaaacaccctctgcccctggtagtccttgggctgtcagctctgtatgctgcctcaccctgccctctctcagagtgacccttgagtggccaccggctcacccagcctgtccacaggggcttgcatctcccttctgccactctgcctcacccattgccgtcctcccactcc

SEQ ID NO: 32290 - DNA, 1122 bp, Mus musculus
gggcacctgggcgctacacagtgagacctgtctgaaaaaaaaaagagagaaggcaaggctggggagcccagctttacctcagactcactgtagtttgaccttgacccctgactctcctgcttccacctcccagcctgctgggtctccaggcctgcgcctatgaccaggctcaagcctttttcagatagaaaggcaggcatcctgggcctctgggcgtgcctttaaccactttcttccttggagctctggtttttttttttgacttctccctttaggaagagcttcagtgccttccttcaccagcggctaaaactttcctttgtcttcagttgtcctgaagaaaaaggaattcttcatttcagggaagtttaaacacctaaaagcagaaagccctaatatactcctgtcctaatataaatcctgctgtcatctttaactgctgacttcacccctccccaacccctctgcttgctgtcctagcaaactcaagtatgtctaataaaggggctttttattttattttttcctttttgagactgtctcagtgtagccctggctgatctaaaacttcctctgtagaccaggctagtcttgaactcacagagcttccacctgcctctgcctcccaagtgctgagattaacagtgtgtcccaccaggcctggctactggaagggctttttaaggaaaggctcaccatgatgtgattctttgacccaagttactcatctgctggccagctgagtcccttcctagtcctcggttccctttctcctacttttctttgcatggtgtcgtgtcgccctggagatcttcctgtaaccttacactcagggcctgtctcctcgactctctgctgaaagtgatccttcttaaagatgggccaggttgtttggcagtcatgtcccctggagtaggacatttaatctgcccgtggcggcttgccacggttgtggcctcttcccttatttggcttcgtttctggatccctgtccactccggccaggtcaggcctcctggggtgcacctcgcttgctcgctctctcgcccgctgtaactttgtgcagagcacacagcatccatactagtcaaagggagcatgaatgatggccgttgcctgctg

SEQ ID NO: 32291 - DNA, 1116 bp, Mus musculus
cgcccagatgtgtctttctctccttcttctagtcttttggctcgattaaaagctctcaaaatagtaagaaaagaggtctgggaacagctaaaagaaacctatgttgctggtgacacacaggtgccgcactagtttgaagtaggagatgcagtcctggtgaggagacaccgagcagggaacctagagcagaggtggaagggaccctacttggtgctactgacaatgcccaccgcggtcaaagtggaaggaatccccacttgggtccacgcatcccatgtcaagagagcaccccctggagtcagccatgatgagtggactttggagaagactactaacccttttaagttgtgcctgcttcgtaggagcgatcccaaaggacttcaacccccacagtccttcctgttcaacaaatgtggggggtactcaatgaggggggtagggctgtatggacaatcgccgaggtacaccctctgtggacttggtggcctgatcttttctctgacatctgtaagttggctataggagcccctcctggatgggacttggaggggtactctgacattcagagggcacctttaacaccccctccatacgtagaaaaacattcgagagacccatggggtggttgctctaaccaaagggatagaagcatgcttcgaacccatcccttctatgtctgccccgggccccaccgaagtaagtccctcaatccaacaaggctgacttcttttgcaagagctagggttgcgagacttcaggtacagcccgctggaagccctcctcgagctgggactatattagagtaacagccaactattccctagcgtcttatataactggaggatttgacctagacgagtgtactcactggtgccatccgctctgtgtcaccttcactgaaccagggaaaagagctctgggatggacaaaagggtatacctgaggtcttaggatttacaaggaaagatatgatgaggatgattgttcactatcagattaaaaatagagaccccctacaatcctttaggcccccccaaccaagtccacacccctcacccatactattgctcagcctactctggtgattgcagacccccttaatatggccgctatcac

SEQ ID NO: 32292 - DNA, 1213 bp, Mus musculus
aacagaaccagcagccatacttcctgctcttggggaacaggacaaaaactgaccctgactgaagtatctgcaaggagtccaggtctctgtataggcaccccaccttccacccacaaacacctatgcggataaattcagtccgtgtccaggatggaagctaattactatcttgtaccttccccggttggctggtgggcttgcaatacaggacttactccctgtgtatcaactaaggtttttaattcatctcgtgatttttgtgtcatgatccagctgttaccccgcttatattatcaccctgcatccagtttagaagaaagctatgctggccggcggtcaaaaagagaaccaattactttgaccctggctgcattcatgggaataggtatggcagtaggagtggggacaggagtgtcagctttgatagaaggaagacagggaatttagtctttgaggaatgctgtcaatgaaaacctagtggcaatagagaagtccattgacgctttagaaaaatctttgacctccctgtctgaggtagttttgcagaacaggagaggtcttgatttgttgttcctaaaggaaggaggactgtgtgctgcccttaaagaagaatgctgcttctatgcagatcatacaggagtagttagaaactctatgcagaaactgagagaaagattagagcgaaggaaacaggaacaggatgctcagtagagcatgctcagtagagatgaggcttgctgagatttaacacggacacactaggtaggcagacagggaagaaaaaagggtggaaattgtcctctggatgctttggagtcatgatttggagtttgcttgtgttttgtgtgtatgtgcacacatagccactgatttaacaaggagtatttgtagggctgggcacacgcctttaatcccagaacttaggaggcagaggcaggcagatttctgagttcgaggccagcctggtctacaaagtgagttccaggacagtcaaggctatacagagaaaccctggtctcgaaaaaaaaaaacaaaaacaaaacaaacaaacaaaaatccaaggtgtatttgtttaaggagacatcttaattaggattttattactgtgaacagacaccaagaccaatgcaagttttataaaggacatttaattgggtgttggggtcggcctgtggctctcatgtccaggttccagcctgggaggcaaccggag

SEQ ID NO: 32293 - DNA, 1241 bp, Mus musculus
gtccagggcgggcggcctggcggcgatgccgtacatgcgcttccgccaccccctcagcgtcttgggcatcaattaccagcagttcctgcgccactacctggagaactacccgatcgcccccggccggatccaggagctggaggagcgccggcggcgcttcgtggaggcctgccgagccagggaggcagccttcgacatagagtacctgcgtaacccccagagggtggattttgacattttaacgtttaccatagccctgactgcatcagaggtgatcaatcctctaatagaagaactgggttgcgataagttcatccacagagagtgaagagtcggactgcggggagggcacggcaccaagacctccgcatccaagtgaaaccccatcctgcaacttggttttaagaaatcaaacggatcttgagaggcagcgcttcctcagagggaggaaaagcgtcagaaaattgggggtggggagggaaagcatcgtagactcctaccgtttcttgagtttatgatcagttgaaatttcttgtgttatggaaaaggtccatcctcgtggcttcgttaataagtaaaggacggttttgtaaaactgtaaagacttaaaattgccagtagtagagcccacgacgaagaagactcgaagagaaagctggttttaggacgaggtttctgtggagaacttgaccttgtcagagcaggcaaagtcttcacgtcagcgtcaacaagcgtgtatagtgtaagagggattttgtgtctcagacattgtgaatggcgaacaacataaatattgtatatagtatgtgataaatcgtgtttccaaacataccaattttctgggattttattttccatttttcaaaagttttttttttccgtcattgctttgtaattaatctattcctaagtcccaagactatgaaggattgagagtcttctgtccttctctccttgtccccatgcctcatgcagcctctgaaggcagtttccgtccttgtttccttttttatacacattttatttctcagcagagttgacagattttggtttggatattgtgatttcttatgaagataccgtgaagaaccttcccgaccagtatatttactccttagggctatattttgtggttatgctgttatgaaccaggaatatactggtggacggtgggctttttcccatcggtttctcctggcagtatggcgccacctctggtaggttggcgcctgcgcacacca

SEQ ID NO: 32294 - DNA, 1115 bp, Mus musculus
gttgcgtttgctctttccttagacttaaacggagcagttacagggcaaaagcattgctgtttgtcttaaggattccctgccctctttgtgcctctgtctacttccattcaccaaggaactctgggcctctttctccacaacagtcttggctttgggaaaaactcacactaagagcactgactgctattctgaaggtcctgagttcaagtcccagcaacaacatggtggctcacaaccatccataatgagatctgatgccttcttctggggtatctgaagacagctacagtgtacttacatataataaatattttaaaggggggggggcagtcggagatgggtgtgatggcacacccctgtaacctcaatgctaaatactctggaggctgagacaagctggtccagagcttaggccagggatggcaggcggcacatgacctcaatccctgcacacagcagcaagcagatctctatgagtttgaggccaacctggtgtacccaagttccagaaccaccttggttccatagtgagatcttcaaacgataaaaagtctagagcagcctgtgcaattgagcagagaactagaaaacgtgctcagtgggtaaacggtttgccaagaagcctggtggtcccgggaaccatgtgaagctgcaagggctggcccctccagaggtgtcagtcactctccacatgcgcattaccacacagtaaacctttaactcacccacccctctgaagtaggtcacggatggtttctcagccttgacggcatttgatgcttctgtcctgcagggatgtttgtagctgtacaggctcaacccttgctgcttcctgcctgatgcacaatggccttgccacacgagtatagttgacagctccagtctcagactcagaaagctagggcaggatggttgagtttggggctagcctgacacttcattgtgagacccccatctggggggaaaaatgttggccactgtgaatggtaaaagggacatgctgacatcagccttcactgggacacttgcagctctgggagcaccgggtcttcagagacttgtactctcccctattttgacagggagaggggttcaagacagggtcactgggtaac

SEQ ID NO: 32295 - DNA, 1398 bp, Mus musculus
gcttctggggttgtaagtggcttccgtgaggctgtgcttgggactgtcgtagaacctgtttctttggctagccaagcatcgaaacgtagtgaccaggcccctattagacgtgtgttgttaggttctcccttatgtcttggtgactcatggtataaattcaggctttgacaagggcctgtctgtaattcctggcttgaagtgagtcttgtagcctggtgcaggcttggggtatgaattgatcccaccagatagagcccatgctctctccagagacccctggcttaggtgtccatgtgaccagcttcccagtttctcagaagcctgaggttaccctccataacctgtatctgggagtctttgcaaggcacgtccttgagtgtctgtctgtctgtccactctgcggccagcagggtggggagctgatcctctcactcacttccaggacatctcctgtctgaatcgggacccagcccgagtagtagtcgtggactgcaagaaggaagctttccgcctccagcccttcaacggtgttgccctgcggccctgggatggcaactcagatgaccgggtcttgctggacctgtctgccttcctcaagagtgagacttaccttagtgtctggtccagaacccttgaccctgaagacaatggcagacacttgattttggcttgtcattagtataaaactgagcaattggggtggaagagatttatgagtatcctggagccttctggaactttctgagctatccaggcatttctcgtgggggttatttggtcatgtttggaggaaccctctcagcactgacaacattcaggatgtgctgaccctaccctgggtcatgctaaggcctgactaactagtaccccctttacctgttgtgcctacagccattgcactgaaccaagtggaggacgtccggacggtgctggagcactatgctctagaggatgacccactggaggcattcaaacagcggcagagccggcttgagcaggttaggctctagtccctactgggcactttggacttttgcaccgtcttcttggctttggcctctcggtggggctctcacacagcctgccttgcagggctgctctgagggctctgcagcatgggctagaggcagaaaatagtgagcacttaagataagtccatggccttgggtggtcctgagacctttcatggtagactgtgtgcgtagagcttgtgcacagggatctgtggacgcttggcctcgggcatgttagtcctgcacccctggggctaagagttgctctttccacgctctggatctaacgggtggactcgggttctatactgggcctgagtatgacggcaggcaggcttctgagttgacccttgtctttttctgtccctcatccccaggaggagca

SEQ ID NO: 32296 - DNA, 1794 bp, Mus musculus
aacccaccccatccccacaagcatatgggggaaccccgaatccccaaacacccggctacccagacccatcatccccccaggtcaatccacagtacaatccacagacaccagggacgccagccatgtgagtccatcagggctgagcccgaaaagccctgcacgcagctacccattgccccacctcctgaccctttctgccaagaataacacccttttcttctgtctacaggtacaacacagaccagttctccccctacgctgccccctctccacaggggtcttaccagcccagccccagcccccagagctaccaccaagtggcaccaagtccagcaggctatcagaacacccattccccagccagctatcacccgacaccgtcacctatggcctatcaggtataccatgtcacagaaggaccctgcttgggttggccaggcccagtgactattccagacactcactcctgtcttccttcaggctagtcccagcccaagccctgttggctacagtccaatgacccctggagcaccttctcctggaggttacaatccccacacaccgggctcaggcattgagcagaactctagcgactgggtgaccactgatatccaggtgaaggttcgagacacctatctggacacacaaatagtggggcagacaggcgtcatccgcagtgtcacggtaagtgtggccctaggaggtagacatgtgtacccctctaccccccagcctttgtagttatttttatctctgttgctgtggatggaaccctaggcctcacacatgctaggctagtgcctaccactgaactacatccccaacttattgttatagttttagatttaactttacaactataatgcatggtaagctgtgatggacaagcagatgtggaaggctggggtgtctgaggcagctggagggtgggcagtaagagcaggctgtccgtccttctgcagggaggcatgtgctccgtgtacctgaaggacagtgagaaggtggtcagcatctccagtgaacatctggagcccatcacgcccaccaagaacaacaaggtagagatggggccttgggaggataccggagggaatgacagggctgctgctgggcctgacactggctgtcgcctccaggtgaaggtgattctgggtgaggaccgagaggctaccggggtcctactgagcattgatggtgaggatggcatcatccgcatggacctagaggaccagcagatcaagattctaaacctccgcttcctagggaagctcctggaagcctgacgcccaagtgtgcagtgcagacatggagccagcagcccctctggccttgtttggcctagcatggaaccctgagtctggagcaagccagggcaatcactctgtatttccttttcctccttccctgatactctaggagtcagagcagagtctgaggaatgttcctgccttcttctgcagccccagcttgactttgtgttcaggtctttcaataaagagaagctgtttgaaaagtgtgtgtacgaagagttttcttggtcttaagtatagatatgaagttggggaaataaccagatcttaagtaagtttctccatctagaaaaataatgcttctggaactccaaagggctcttcagagtctgttgcggacaggagaaagatgattagggctggcctttgtcattcaggcctgtcacccaagctacttagacctggggaggacgatcacaggttcatgtcttatctgagcaagtctcactgagggcaacaagcccctttactgcagtgcttctta

SEQ ID NO: 32297 - DNA, 1382 bp, Mus musculus
taatggtagtgttgatgttaatgccactagacccccgtgcttagtctaatccaagtctgtcaggtgactaaaaaggacagtctgtcagtttatttgaacgattggtgtgtgtaccctgtgttgtgaattgggccaacaccagtgatggaggtggctctaggcctgccactcggggagcttctggatagactggtcctaggtattggacaaatttgatccaaagagaagatggaatgaccactgtgagaacagtggacctgtctgaccttgcttcctgtttggggaagttcatagttgcctgtcactccatgattccagctcctcggtgtctcaggccctcttctggtctctatgggcacatatacatgggactctgaggggcacagggatcctaggataggctgcctccttgattctggtgatggtgggaaccacacaaagggagatgatgaatgtccatggagagtggttaagtcagggtatgacttaactccctaaccccatattttcccatttctctagttactggagcctgttttgcttctgggcaaggagcgatttgctggtgtggatattcgggtccgtgtgaagggtggtggacatgtggcccaaatttatggtaagtctcaggatctaagcctatgggtgtgaggcagctcctggaaggactgggtcttcactaagctttttggtcattgtgtcttgcagccatccgacagtccatctcaaaggccctggtagcttattaccaaaaatgtgagtgagagctggtctttcatttcatggcgggtgggctatgtggtaggaccaaactaaaggtcttgtctattaatctccagatgtggatgaagcctccaagaaggagatcaaagatatcctcatccaatacgatcggaccctgcttgtagctgacccccgtcgctgcgaatccaaaaagtttggaggtcctggtgcccgtgcccgataccagaaatcctaccgataagcccatctcaaggatcggggtttacctttgtaataaacatcctaggattttaacgttcctgtttttgtgttggtctctttttgtagtattagtgtggttggacagtgcaagaaactcccttagtaagtggcactaaggagtaatggctgccttccagagcatttgagctctgtttttgtgtgtatacgcttgcttgcttatttatttatttatttttacttttttgtttgtttttttttttgtttttcgagacagggtttctctgtgtagccctgactgtcctggaactcactttgtagaccaggctggccttgaactcagaaatccatctgcctctgcctccggagtgctgggataaaaggtgtacgccaccatgcctggcccctatttttttttt

SEQ ID NO: 32298 - DNA, 1191 bp, Mus musculus
cacctccagctgcttgggaggctgaaatgaggaccccatgagcccaggagtttgggggcaacctaggctacaaagtcaagcaccttcctccagatagacctgaaatccatgtccccagtatccatctctgtccatttcctctcaggtatcttacacatcatcaactcctaccctacactcctgttcatccatccaactatattcttcatcccacctctgactcattccactctcccatctgaatatatccagtatctacatctgtatctccacccattatttgcccacacatccttccatctgtccatctacccatttcatctacacacctcattactaccaccatttctaatcatcagcacctcacacacccacactgccgtctctccttgatagggttcttccaggtaccataaaacctcaggacctgccgggcgtggtggcgcacaccttaatcccagcactcggcaagcagaggcagacggatttctgagttccaggacagccagggcaacacagagaaaccctgtctcgaaaaacaaaacaccacctcaggacctttccatgctgacaccagggcagattaagatggggttgtgggagctctgttcctcatttggttttcctgggaacacccaggcccccctttcccatgaatattctgactattgtgtccaacctccctacacacaccccacatccctcctcatttgggacctctgtaattcctcagtatactcttgcctcccacagaataattcaagtttgtagtggagacaaagggtattttttgttaaatcctacccccgcccagcagtgctctgcagggcagcataatttaaacaatttgtttgatgacagaatgccagctccttccttcactgtctataatcctcccaagaattctaaggcatccgtccccaggccagggtggtatttggtgtgagacattcctcgaagagctctggctttcctgtctttagccacttctcagaatgagcttagcattcagtaaacatatcctgtcacttctcagggacaccttaacccgtgactcaccagggagtcagtctaatcacacacacacaaggtccagtcctgacctacggggctcaggaatctgattgttagcccttggctaacagccagaggctgtgctttagagcaaacgagcttctggctttaagcttg

SEQ ID NO: 32299 - DNA, 1148 bp, Mus musculus
tatgaacgcctcgggctccgggatgagtgtcctggggctctgggggcagcggcaacgccgcatctggggcggggagagtcgggtcccagatgtggggcggggggcggccgcccaaggcttctcctcccctttgccgccgccgcggctcacatcctgttcccgcctgctggggggaggggccgccttccggcacgccctcccgtaaaggcttttaaaatccccgccccctactctgaataattgcaagcaagcggttccaacggcgagtcaccgcccacattccaagagcctagagccgggaggactttttaccttttacagcaagggcccaggaggcgtgagaatctggaatagtctcacactcttgttcttattggtcgatcggcgggctttatatttgcatatgcaatgttgggccgagccgttcaacaaagtcctgcgactacaactgactgaaggactttgtggcgcgagggtgcggccggagctccagtggcgcaatcggttagcgcgcggtacttatatgtcagtgctaggcgtaagcgatgccgaggttgtgagttcgatcctcacctggagcacttctttttttaactcatctacctcttttctggtgttctctcatcagtttagaagtcttcacattttataatttcaatcaaatgttttggcttgtttgagacagggtctcaccatgtaactctctggctggtctggaagtcattatgtagaccgggctggcctcgaactcacagagagcgcctgccactgcctctgcctctgcctctgcctccctagtactggtattaaagacgtgcgtcactgtacccggaaactacagaatttttgaagaatgaacatttctttgtgaattttttgcaatggtctgtggaacagtcccaaagttgcagtttctattctggtcgccagagggcaataacgtctcttattagatggcctgggcgtcagataaaatccaaatctcagatcccagggatggatggatgcttacaacacactctttatggatatttgtcttctacaggtttctgaacagattttttttttttttttttttttttttactgaccactcactaggaactgtatcctctgtctctgaggacttgactttttactaaggagact

SEQ ID NO: 32300 - DNA, 1172 bp, Mus musculus
tcgcgccaccatggatctctctgccatctacgaggtgagtacctgttagacagcatcccgggatccccgacgcaccaaacttaggcccgggacgcctccgtaccttctcagactagccctggctggctggaaatgagagagggagccagcgagcctagcgcctcggtccagataccggcgatccccttgggacgaaaagctggcacactgctgtcactcgcgtagggcggaagcggcatcacacctgtctagtgcccttcgctgcccatggcgcggtttggtggccaagcaggtgctaaggttgaggtagggggggagttgacagggtaagagttctagagagatctggcctcctgggtcagctttggccggctccttcaagttgtgaaacgagcgcccggtgggcggtcatatggggggggggggagtcctagaggcccaaagttggcgagcagcagtgtgctttgatttgggggggaaccctctctcgatcggggatactgggcttcctagatccttctggattaccttcagtcatgtggaaacactcaaatctctgtagtcaggttctccctggagtttgtgtgagccgggtggggctcaggccgagaacccacaaaccggactggcaagctcgtgaagtgctttacaacaggggcggggcgacgtcaccttaccttttctggtggcctaaccgaaccctgttcctctcagagcctccagtcgatgagccatgacctgtcatccgaccacggaggaaccgaatccctcggaggactttggaacataaactcggactccatcccgtctggggtcacctctcgcctgactggccgctccactagcctggtggagggccgaagctgtggctgggtacccccaccccctggttttgcacctttggctccccgcccaggccctgagctgtcaccctcacctacttcgcctactgcaactcccaccacctcctctcgatacaagaccgagctctgtcggacctactcagaaagcgggcgttgtcgctacggggccaagtgccagtttgctcacggcctgggtgaacttcgccaagccaatcgccaccccaagtacaaaacggaactctgccacaagttctacctccagggccgctgcccctatggctctcgatgccacttcatccacaaccccac

SEQ ID NO: 32301 - DNA, 1230 bp, Mus musculus
ctgtcttctcttcccgacctacgatctctccttcaacaaacagcccctcggcgctcgtccccggagcccgcccgcccgccagccagcccctcttgctccccgcgcagggcccatcacctggagactctccttcagttgcgggatgagcatcttgtagcgctgcacaggatcgaagtcctgctgctgctgctgcaggagcccgctctgggcagaacccaccaactgggtcggttgtggctgttgctggggacccggacccccggcagaacccgggcctgacacaccagacgcagaggaaaccgctgcagcctgtggctggggcgcagccattttcctccgctagaacgccggaaatgcgtcataaatgcgtctgctccggtagctcctcagctttttcagttggctgacctcctagttagccatgccttaccgacagattagccaatgggagaagaggatatgcatttttctccgccctcccaaatccgaggccatgagtggaatatcttttcgccaatcataagaggagttcccccacggctccgccccttcacccacagctcgccaatcactgtgaaggactgaccaaactctatttccctgaaggccttgcggccaggagcgacctgtctagtcttctgcgtcttggtagcagtcggagcgggagctgcaagtctgtgtccgacgctgtctgtgctcttacttcagtcacacccgagcccttctcgtcggcccacttcatcccctttccccgcggagcccggcgtctacgggagcctgtccttggatccggcgtctctcaaagtcggtacgccactcagcgtccgcctgcggccagcgaggacgcctaccgcgccgccgtcgcctggtcgcgatggcgcccaccatccagacccaggcccagagggaagatggccacaggtaggtctcctgtcacctgccgcttcattttgttttgtgagctgcaagctggggactaggccgaggggggctgcttgcgacatcactgattccctcaggtcggcccccgaggtcgcgcagcgctcacccccgatgaaggggcggtcccccctgggctctgcggtcgcttcctggtcccctgctattcaatttcggaattgcaccttgcgggagggagtcagacctcagtctccttcagtgaagcttctggattgctctcctcaggggattgagcatctggcttcatgctttatcaccatcatcaccatc

SEQ ID NO: 32302 - DNA, 2888 bp, Mus musculus
ctcccctcaccaccaccattctcttctctcccactcagactgcccggtacctgggcctgacctggagatcaatcctaccctggagtctctgtgtctgagcatgacagaacacgccttgggtggtgagcatttcctcttcccctgacctagctcccacctacccagcatctccagctctgaacacagcaacttggagccatcctgagggtcccaaggggaggccagactccagggagggcctgcctgggatgacatgctatgtgagtgcctttgctcaggcctcccaccagctcctgaccttcctcccttcctccctttcttaccacagatgggacagacaaaacctccaccatctgacgggacccacagcccagcgcacccataggctccctgggcggcgggcgggggccatcccccaacaggcttctcctcagcagcgagagggtgggctggcgcagctatacattctgatatttttctactcatcctcttaacttttgtttaacattggcacacgccttgctcactcccaggcccattgagggatctcagctgaggccagggacagagagggcagccagaggcaaggactggccagactgcctgccttttccctcccaaatcccccactagccccatcctacccctgcctccttcagactgctgacacctgtccttccccaagagagcagacttcctcagagacaaactgacagtcaccttgcgcaacctgcccttcagacacatgacagtgggggaatgagcagtgtggacagcctgctccaccagtatgtcactggaaaagagcccctctcccttacctcctacctttcatcattcctaccattcctgaagacaggcaccaccttcctcctttttttcttaccctgtttatcagaggttctctacaattaatttcttaggcctatttaagatacatatttatatagttcttaacggtttttctctgatcattccctgtcatttttagaatccctaggcctctctctgagccaggacagtggcagggggggcctgaactttatgaggagagggcagagccccctcctgcagaccctcttgcccttccccatcccagccccggctcccagatgcagaggttgaaggtgggcagccccaggccctcagtgaggtcaggaagtctgttgccttaatgtccctttccccccaccaacataacccttctctgttccccaggtctgtgcaagacttgagggtaggaaccagggaatggggggtgttgggtttttgttttcttgcctaccctctctgtcaaactttcccacccccattatgtcatgacctcatgtaagtggaacactatatcataacccagaggtgcagcccagcctgagtcacataaaccctctactccctgttcttgatgagggctggtgctggggcccaggtggagggagggaatttgggattcaggctgtggggaagccagggtcccctattccaaactcctctttcccctcaacctacaccctcattgggacattctcaagcttttcacacgaaaaggaaaaaaatgttatttttagatacattttatgaataacttttgttatgaatatggctggtaaccattgtgtatgttattaaagatacaaaatgttgggaaaaaacaaaaccaaaaaaaagaaaaaagaaaaaaaaaggaaaaaagaaagccttccctgcactatcagcccatccccccagaccttgcccctacctcctggtctgtggacctcccctgctttgagcccagggagggagaagaagccagggggtagagtggccctggggacctgcctgtggtccccaccacctctcccagtgccgggctgggcggggtgtcaggtgtatttatgtacctcttgcacactcatcaacctatgcaagtccccaccccggccctccaggtttctgtgcctttgatcattccccctcttaactcccaggcttctccggcccctcccactaacagtgggaagtggggtgaaaggccacctgtttggaataagcagggtgtccctctcatgggaccctcgcccccacaagccggtccagtcttgtcttgttcacttcccatcagggtgactgaccctgcctggcactggaaggtgatgagggataccctccccaagagggaggtgagagcttcccacccatctgacagcagagtgcaggacgcaggcggcctcgctctgacaggcaggaccctgaccctcccacccccatgcccctccatggtttcaccctaccctacccacttctgtccccagccccactggcagaatcagctttgagtaactgtacatttttctcgctgttggaaaagacttatttgttgaagtttcgattgttaatggtctgggcttattttggaaaacaaaaaaaacaaaaacaaaataaccaaaaagactcttcatttttcttatgatgcatttcctgggaatccatggggacttgattttgtacttcttgggggggggaaggggggcggcagcggcaagatgatgtgaaggggaacagagactttaggagatgaagtcaagagaagttaggtttattaacagcaaagattgaggggtagtgacaaaagctcacaaaacagacaactagaaaagtgcttccctgccctaaaaatggtgtctgtgctgatctcattagaaagccttgaggctcaatcactgtcactgtcagcctcactggaatcagaggctgctgcttcactgccatcttcctgagctgagtgctcactgccactggggaaggggctggcactccggctacgactcctgctctggctgcggctcctctggccaccaccatcactgccgctgtccgagtcattgtcactgcccctgtgggcctgc

SEQ ID NO: 32303 - DNA, 1279 bp, Mus musculus
agaagagtttggattttgaaggaagccaccaggatctaaaaacaggccgaatttccacatttgaaggttgttgtctagttgagtatggtggcacatgcctgtaattacagcacacaagaagatcactgggtttgaggtcaacctggcaacaaagtgagaaccagtctcaaaaaaccctacctctaaaaacagccagcatggctgctgtaatgcaaggggctataagcagcaagaatgaaagaatctagttaggcatgaaactaatcccagccacagctgctgggcttggatgagtgtgagtaaaagggtggggcacgttcataggccccgggcatcatgctgggaaggtgggtgttcaggcaggaggctgaacagtatctggtagacagctccccttgaagtccagtcccttggctctttcccctttgaggattataagattgatcgggccatggtctttttttttatgctcagataccctatcctgacctcttgcttttccttctctggccaggtctcccctgccaaatccaccctagcccactgaagcgctccatgtcactcatccctacgagcccacaggcccctggtgagtggccgagtccagaggagcttggggcccgggctgctttcaccacgcccgaccacgcacccctctcgccacagagcagtgtggcctcctctggcagtgagcagacggaggagcagggctccagccggaacactttccaggaggatggcagcgggatgaaaggtgcatccaggggacaatactagaaaccctgctctggggcttgggctaggccagaaggacagaaaattgcctgtagctgccacctcagggaggacacaggtttgaaaataatagataaccttcccagccagccagagctcagataattgatagatgagataaatcatggatcccatcctggcagctcagtagatcaatcgggtatcctgttagggaagggtgtctaaaatggcagcttctgactccagcccactgtagtttctaaggctactgctggcttatgcctgacttctgcccacaacctccctctgatcaccagcatccatttcttgacctatcctccatccttttccatagatgtgccctcatggctcaagagcctccgcttgcacaagtatgctgctctgttctcacagatgagctacgaagagatgatgaccctcactgagcagcacctagagtcgcaggtgaatctgagagagcactggggaggtggtgggccagcacagttgcctgctgttccta

SEQ ID NO: 32304 - DNA, 1146 bp, Mus musculus
gccttcgtgggacctactactgaactctggttttgattccatgacttgtaaagccacaccaggacatgtggagcacatgaggctcccaggaacccaggcccctcccctgggcgctgtctgcaggagagaggcggctgcccatcactggaaatctgcatcaggggccactgggacagagacgacactatgagaaaggttgtgtgtgtgtgtgtgtgtgtgtgtgtgtgtgtgtgtgacagagagagagagagagagagagagagagagtgtgtgtgagagagagagagtgtgtgtgagagagagagagcactcgtgcaccaagaaagtccagctcctctgtcctcagcctatctggtgcccagcccctgaccctgagccattgaagggtcaatcatgaatgtttgaagagtggccttttcccagagccccacaccctctttccacaggagaaacatggggcctccccttccccaacctctgcagcaaatgactactgcacccagacagcctccgttttctagaagtctatttatattgtcattttataacactagctgtgtctctgtctcagcctaggaacagatggtccctgacctatggggtggctggcccagggacagggccactttgaagaatcaggctcctgtcccccaccctgccgccagtccctcaagttagttttacaattaaagtattttcttgtttttggtgtgtgtgtgtatgtgtgtggtctatggaggctactgtccagctatgtagtaagggaagtttggggacttggcctggaaacccaggcatcgagggggaggtgctccaccccactccctgcatggggcaagtggccacgccccgtctctggaagcagcctgttggccagagtgctgagtgaggctgccaagtcccagtggcctggggttagtctttgctctttttattttttatttctttgagacagggtttcactacatagtttaggctggcctaaattaactgtgtagctcaggttggcttcagacttgccacactcccctgcctctgtctcctgaatgctgttgagattataagcagccgggcgtggtggcgcacgcctttaatcccagcactggggaggcagaggctggtggatttctgagttcaaggccagcc

SEQ ID NO: 32305 - DNA, 1196 bp, Mus musculus
agtgcttctaaccacgagccatctgtccccactgaatagtcttagacttggattcctatctagaatacggaaacctagtaggccctcttgtgtctctccaggcctagccctcgctccccagctctgggccgcccgttccatggccaccctgaaccagatgcaccgcttaggcccccggaaggaaccccctaagcgtctgggccccacagagggccggccccagctgaagggtgtggtgttgcgcacattcatccgaaagccgaagaagcccaactccgccaaccgcaagtgctgccgagtccgcctcagcacaggcaaagaggctgtctgcttcatccccggggagggccacaccctgcaggagcatcacgtggtcctcgtggagggtggtcgcacccaggacctgcctggggtcaaactcaaagttgtgaggggcaagtatgactgcggccacgtgcaaaagaagaaatgacagtaattcacagtggtctggcactcgatccttggaaacgggttcttcctactcccgggtcttgggctcaaatcttactgtgattcagcaagactgttgttaacctgcaagagtactgaaggtgaattggaaggcagtacccctgtgcgtccatgttcagtgtttgcaggttgacctcatgtgctgggatggggtttgtaataaatatatcttcaggttgtgatgttactcagtgtgcggtgtctgtccccgggtgtggtggcaaatgccaagctgtgcacctcagttccctcttcctaaacaggtcactgacagaggaagtgttctaggtgctgaacgttattaaccgtgtgctccacatggttagtgcacatatgtgtgtggaggtgatgtgggttcttttgtttgggggatgggtgtgtgcatgtgagtgcagatgcccttggaggccaccgttctgggtccccccagggttcggttgtgaactgcctgttgtgggtgctggaaaccaaacgggttttctctgagagcagtttgtgtttctaacctctgagccatctgccagcccctttagcatctgttttattgggcagattggaaggatttagagtaggcattagaggcggctcccccacagcctgtctggtgccaggcatctctacagggggtagagggcaggagaaaagttgttacctggcaggaggcaaggagcctctgaggaact

SEQ ID NO: 32306 - DNA, 1174 bp, Mus musculus
gggacggcagaggtggggctggcaggtgagcagttgcctgggggatgcagggaggacagctccctgcaggggacagacaacaaccctggggactaacatatccagtggtgtaggctgccagaaaccggtactctgactggggttctacttgaaatctcactgacttcctgtgggtaatggcagccctggctgaccccatcctgcctctttctcctcccaggatacttcatggaccactctgtagctttcagggaccttccagtcaggtgatgcccatttcctttaatgctagacccccattggtaggtagcatctaccctgcctgacccaatctcccatcttcctactaggatggtctgtgccagcacctgctaccgggcagagacagacactgggaaggagccttggggactgtaccgagtccatcacttcactaaggtgagtagtgtaggcctggctggcgtgcacaggtcccctccaccacccaggacctcctgacccagtatcctgtcctgttccaggtggagatgtttggggtgacaggccctgggctggagcagagctcgcagctgttggatgagttcctgtctctgcaggtggagatcttgacggagctgggcttgcacttccggtgcggagatgaaactgggtgggactggtaggggttgggggctgggagagtggggttgactgggctggcctaccacctgctcctatcccctaggtgaggcctctgggctgtatagtttctgtctgtgcattattttgttttatatacgagtgtcaagccaggcaatggtggcgcacgcttttaatcccagcacttgggaggcagaggcaggcggatttctgagttcaaggccaacctggtctacaaagtgagttctaggacagccagggctacacagagaaaccctgtctggaaaaaaaacaaaaacaaaaacaaaaaaagagtgtcaaaagcatgggaattaaagctgccacacacacacacacacacacacacacaaccaagctcccagtctttagagtttggtccaagagacctcattgtcctcccgggtaaagcaggggtgcagaagggaggcatcagttatcacaaggcccacttgttctacaggacagacagacagacagctttactgagggctgaggaaggccaccttttacccag

SEQ ID NO: 32307 - DNA, 1501 bp, Mus musculus
ctaagcctctagggggcagatggccacccactcaaggcttttggtgatcgcgtggcagtacattggggtccctcttttcactgtgtgaccttactttttcaggagaactacgatgacccccacaaaacccctgcctccccagttgttcacatcaggggcctgattgacggagtagtggaagctgaccttgtggaagccctgcaagaatttggacccatcaggtacttcttgatgctgggttagagctccttagcatccctgagtgtcactgctgtctggttctgagcagtgctggtcccagggtctgtggctgtatcctgtgacttgtcctcagagagttcactcttgccgtgtttcaagttttagttccttcttcccccatctcttccccacccctggggatctagtcagacctctttattctcctagtgacttcttactgtttgaccagaccagttgcttgctggtctagattccttcttccacaaagttgcccaggcaatgattgattagcactgtgatctgctcagcctggcagtctgttctgatttaggagaggggccaggagggtaactggcttagagtgttgggggtcagggttgagaagagcaagaatcatttcacaaagttgtctggttcccctcccaagagcactgaagcctgccttctctctgcagctatgtggtggtgatgccaaagaagaggcaggcactggtagagtttgaagacgtgctgggggcttgtaatgccgtaaactacgctgcagacaaccagatctacattgccggtcaccctgcatttgtcaattattctaccagccagaagatctctcgcccgggcgactctgatgactcccggagcgtaaacagcgtgcttctgtttaccatcctaaaccccatctactccataaccacggtgtgtgtgaagggaaggcgctcccacctcttctttcccctcttgcccgactccatcatccccagccagccaggccccttccttatcttgcctgtttttatctcttctaggatgttctttacaccatctgtaacccttgtggccctgtccagagaattgtcattttccggaagaacggagttcaggctatggtggaatatccttttctgggaaactggtgtttgtttctcagagtttagcatagagaatgtaaaagaccaggctatgaggcttatagaaacagctgatcagggtatgttctaatgagatactattttgtttaggagtgtgtgcaccccttgtgagagttgggcccagtgcttccttcatgcagctgtgcaagtgagacagctcagctctatccaccgtcctcttccttctttgaggtggatgggtccattctgttagagaggaacttagataaggagcagaaatcaagccgggcagtggtggcgcatgcctttaatcccagcacttgggaggcagaggcagtcctcttttttgagttctgagtttgaggccagcctggtctacagagtgcctggac

SEQ ID NO: 32308 - DNA, 2702 bp, Mus musculus
ggccagacctgctctgggttggttctggtcccctttcacctttgaggaaatggacgactagaaccagagcaggagttagcttgtagctgtcaggggagaggacctgcaactagacatgtgtgctaaatcgcacctttctccctaaggtgaaatttatgaaaagcaagccgggggccgccatggtggaaatggctgatggctatgctgtggaccgagccattactcacctcaacaacaacttcatgtttgggcagaagatgaatgtctggtgggtactgtcatcagaaaagatggacagaggtgtgatttcagttgtgattgagatcagggtgctgacataggcaggaatgggggtggggataggagccatgctcctcttcctctgaagccttgggagaaaggaggttagcttgagtgcagcagtgtgtgttaaaagcactcagcagtatcagataggcgtgaggccagctgagcctctggctgaccctagaggacagacaattcagcatagaacaaagacttcctttcttcctctcagtgtctccaagcaaccagccattatgcctggtcagtcatacgggctagaagatggatcctgcagctataaagacttcagcgagtcaaggaacaatcggttctccactccagagcaggcagctaagaaccgcatccagcaccctagcaatgtactgcacttcttcaatgctcccctcgaggtgactgaggagaacttctttgaggtgggtgttgtgaaaccgatctgtcatgacattggcttcagttgggctcatttgggacacagcaaaagaaagggagggggcagattcttctcgtcttggctgtggttagagcgagcagaggcatagagtgtgtcctggtgtagagctctgcacactgctttcacatcttggccaggcagtcatgattgtggggttgccacaaaggtgatgctttggaacctgggcagagacagcaagaggggcccatgggtgttggccagcaattcagcaacacctatctgctgtcatactgtgggtggccagagttgtggtttgaggaacagtctctcttcttgtgctgcctcatggaggtgtttctgtgagtcccaggctggtggggtacagtccacacaagaccacagttgtctggtctgctttaagtcttccatatggtttctgaattctcttactcgttactctcttgcaccagatctgcgatgaactgggagtgaagcggccaacctctgtcaaagtattttcaggcaaaagtgagtcagacaccacttccctccccgaccccactgcagctgtgggtggtggttgctgggaggagactaaccttgtgtggccctgcctaacccctctgctgtctcctgtttgattcaggcgagcggagctcctctgggctgctggagtgggactcgaagagcgatgccctggagaccttgggcttcctgaaccattaccagatgaaaaacccaagtgagtgtctgtgtgtcctgcagaatctccctagtggcttgatggcttgtctggctacatgccagagccatctttctaccctcaagataggaccctagagattgcctttgtcgcagacacaggcagatgggacttggtcaccaggagagcagtctgatgacatcctcctgggaggccagccaggctgccgggttccacccacctgatagcttgggagttgctctagcttaccgtgggtggtgatgagttagatcctggtaattgacctgcagaggagggcgtgtgggtgcagattgagatgactggtccgggagctccagagggttccagcctgactgacatctgtcctcttgtttccagatggcccgtacccatacactctgaagttgtgcttctccactgcacagcacgcctcctaattggatgctgggaaggaagactccatccgagcaggaaaatgttcctttcctttatgctgttggtttgtttggttttttttttttttttcttgtttttttttttctttttggttttgttttgatttatttttgcagttttttccttttaaatgctaggtcagtagaggcttaaccacaacagaaatgctggaactctggagggggggaggggaactggtatctcccaagattaaccttcactttttaaaatgactgtatgtgtgattttttttttttcctgttcatacatttgtgctgcccatgtatcttggcacatttcaataaaattgtttggaaaataaaactatttgctggggctccaagggtgggttgtctgctttcctctctcccacttagcattccaaagagtggtgggcccagccttaataagggcaggatgagcaatgagcaggaattagagaccagtgcattcttgaaggacactgcccaagctaggtcaggttctactagtgattgaaaggtggggatagttaaccctgttcttcaggtagtcctggccttacgtgtatcatatcaaatgcacaagctcatgcgagtacatggatacggttacactctggactggcagtggcgatgcacacctttaatccctgcactgaggcagaaatgggcagggctgaggtccaggacagccaggcatacacagagaaaacctttttgtcttgaaaacagtggagttggagcacaattgtgctgtcctgtagtccaagtgcttagctctctggagtaggagtagagcttg

SEQ ID NO: 32309 - DNA, 1879 bp, Mus musculus
ctttccccctccccacagggtgatgctgagttcaaccggatcatgagtgtggttgatcccaaccatagtggcctcgtgaccttccaagccttcattgacttcatgtcaagggagaccacagacacagacacagctgatcaggtcatcgcctccttcaaggtcctggcaggagacaaggtaagcacgacccacagaagcattggcggccggtagccaaaacttgagccagcactgggtactaggtcaagtgggtaagacacagtggctcagagtcctgtttatgcccctagaacttcatcactgctgaggaactgcggagagagctgccccccgaccaggccgagtactgcatcgcccgcatggcaccctaccaggggcctgatgctgctcctggcgcccttgactacaagtccttctccacagccctctatggggagagcgacctgtgaggcccttggccaccctgaacagagactcccttggcctcccggaggggctgaggagccctgcccccaccctgactctgtatctatgcaaagagctctttgtggtccttctagggggtcaggcagggaggggctaggcaggcctctctttctcagtcttgtaggggagggaggcttggcaatcagcatttctggtctgctaaatatatacgctgtgctgtgggttcttagccgattggaggggacaacggactcctgtgccccagagataccttcctatcccaggtcccctctgcccctgaggccccttcaaagcctctcacatctaggccaaagccccatgtgccttgtccaggaaccgcctgccctaagaagtccagcagagggcacccagctcccctggaccagattccagtggctcctcccaggagcagaggacctgccatagcccttctctgcctcaggagtggctgcggggcaatcagccccagcccacctggcctctgagtctcagattttctaaggaccaaaaccaacaaaacacaaagaatggaacagaaacaaacaaaaaaatcatttaaaaaaaaaaaaaggaaaaaaaaaacttaaaaaaaaaaagaaaactttaaaaacttaagaccttccagagaattactatttactttattaacttacggatttattatataaatatatatccatctagctgcatatctctgccacctctctcactctcataatgaagacatagctgattcaatgccctccccagtccctcctgattttcccctcgtggcggtgggcagaggtctctggggaccttctgaggtggaggcaggctgctggcctgcctgcctggtcgttaatgggtttctctccactcgcccccttgagtttattctgattgatttttattttcttggtttctggataaaccaccctctggggatgggagaataaaacatgtaatatttttaagaaggactctggtgtcatcttctccctgcatctctgttcatgccccaaggagctggcagtgcccaccagcccagtgcctgtgtgggggttgtgcccctctctaagcagggactgacatgaagaggcttcaaaaggaagggtggcagttctgtttgggatggctccagctcgtaatcccagcacttgtgaggccggccagggttacatagccaccacctttgtgacagtgagtcgggcagcagggtgacctccctcagcttcaaacctatgagaaggtagccacctccgaccactgaagagaaaagaaagatacccttgaggcagaggccctgggatggtgctagagccacactgtccctcgggccagctcacctgtttgtgggtcaggcagacgaccccctcgccgccatccaggtgttggcagcagtggcctgtgtgggagaggccagggtgag

SEQ ID NO: 32310 - DNA, 2297 bp, Mus musculus
tttcttctgacctacacacacagacactaaagtaaataaatgtagaattttagaaaagaacgcactatcccagggactaaagttcaggtctcaggacccacatctgccagctcattgcctgggaccccagttccaataggtccccttccgacctccatgagtacacggggtcaggtggctcagtaagtgaagtatttgttgtgcaagcatgaggatgcatttgtatccctagagcaaatgtagaaatctgcatggtggcacattgcctgtactctcagcctaggtgaggccgggacaagaggatcccatgatgtccaaggtcagggagagaccttgtcacaataaggtggagagggtaggcaccacacaagcctgacaacctgagttcattctcctgcgcccacaaaaagctggatcccctgtaaccctgacccctctaactccccaggagctcttaggccatgtgccctgaaatatgaagcccagaaaccataacactgaaagttgtcctctcctctccacaacacactagtcataataaagtaactatgaggtggggggtgggggtgcacaccttcagtcccagtcctcagagtgtgagggaaggaggactcttgagttccaggccagccagggttttccagtgaggctccgtctaaatggaaaggggaggtagcatcactgaggcagacgctgacatcggtctccaccctccctgagtgtgcttagccaacacagtagcatgcctgctccagtctgtcacctctaccccagggcctgagctccctggggtggagtctgtgcctaccacctgctgggtctcatctctgtctactccacagcgagctggactactatgactcccacaacgtcaacacacggtgccagaagatctgcgaccagtgggataacctgggctctctgacacacagtcgcagggaagccttggaggtgaggaggggtggctcaccaggagcctgatgccccttagtgatgttggcgacttctaggagggggtctttagaggccctcaggtatcgctcaccagctgacctgccttccctgtccccatacctctctgcacactacagaaaacagagaaacagctagagaccatcgaccagctacatttggagtatgccaagcgggctgcacccttcaacaactggatggagagtgccatggaggacctgcaggacatgttcatcgtccacaccatcgaggagatcgaggtccgccccaccacaccctcgagggggtgaccccaccctgcccccagaaaggcaggctgcattcttcactcccattcttccttctagggcctgatctcagcccatgaccagttcaagtccaccctgccagatgctgacagggagcgtgaggccatcctggccatccacaaggaggcccagaggatcgctgagagcaatcacatcaagctgtcgggcagcaatccctacaccactgttaccccccagatcatcaactccaagtgggagaaggtgggccaggctctctgacatgcaagggctgcactgtccaagtggggaagctgtcacctgacttgtgctgtggcacatcccacaggtgcagcagctggtgccaaagagggaccatgcactcctggaggagcagagcaagcagcaatccaatgagcaccttcgccgacagttcgccagccaagccaatatggtggggccgtggatccagaccaagatggaggtaaggctgccccaccccaaacactgaacccaggctatctgtcagctgagagagtcctctggattctcgagtcctagaggtccccatggtccctgtggccttggcagcagattccatagccttggtagatctgatctcagctcttaactggtcagcaccccagttggcctcataggactgcgctgatggaaatggtaatattaagctgatggaagcctggctaaagattggctagagctgattggaccttgactgtccaatctcggtccagtgctgacttgccgtccactcctgtgacatctctggtggtagcattcctacaagaaatgggttttcctcaccactctgtgttagacccctgtgggggctgtagtatatctatgaggacacccctgacaggcatgggatagtgtgtaaggcagccatagtgattctacctgccccactgctcatgtgctcagtgtgccaagtagtggacagccatgggcacggggattctgccaacagccagaggccttgccctccttttgttctttattttcttgtttctaagtagcaaagtagtgttttgtcat

SEQ ID NO: 32311 - DNA, 1159 bp, Mus musculus
tggaggcctgactgccatcctggctggcatttccctcagtaagtagcctgtcgtcccttaacttactagtaggctgcttgggcttttgctctgggcatgtaattagcccggctccaggactaataacagtgtttctcccttccttcaaagggtttggacagccccacccactgtgccaagaaagcgggtggggcgacaagactgggttaggaccaccacccaggagaactggctctaaaaagctggcgcaggcacagctcctgggcccagactccaggcttgtccctttcctgatccccataggcctggctaaaagcccaaggcttctctcagtcaccatgtccacaaatgggtgtctgtaacttttcggccttggtatcaacccttctatcctggttctcttaccagtaagagatactatttagagcatagtagttacactgtgatatctgtctcaggcccgtaaacaccaagtatcagtaagtctgtacagaactgcacaaaacataaatgggcttggagtttccccaagggcaaggaggaaggttccagtactaggctccatcctctgcggtaacaaatgtccattctgctgcacctcggcctgtcagacagctctttgactgttacggtgcctctgccacacctgtagggaaggaggccatgctgaagcaacgggactacgagacagccaccctgtcagacatcaaagctctgatccgaaaacatgaggcctttgaaagtgacctggctgcacaccaggaccgagtggagcagattgctgcaattgctcaggagctcaagtacgtgtgcccctatggcatcatcagcggcgagcttggttctgtccccagctctcaaccctggctcctcctaaacaccgggagagccttacagaatgaaggcttctgcccatgctgtcccagcaccaacaggcagaagggacctaggttctccagcacaggcatgacctcagattctaagggtgcctgtctccccagcctgccaccctgtgtggggagtgctgtacagtgagcctgttgttctgcctgctcctgtccctcctgctcagaatacagtcactgtaagggtttccaggcagccagtgtccctctcttcccctgcccagtcacataaatttgtgcacacagttagtaca

SEQ ID NO: 32312 - DNA, 1099 bp, Mus musculus
atccaagtgaggcaaacataggtaggcctttaccattgtgtcaggtacggtcaaggcctgagcaagagtctcaaggcctgtgagttcaggagtcacagtcccctgacagtatggaaagggaaccagtatgtcttctgggaagggacaatggacttggaccaccctcttcagtctgggcaaagaagactttgagcagaggcataagcagaaagtaggggatagcacagtgcttccaggagtggcccacgttcacagacctctgctgtggggcccccacggaaatcatgggaaatttgggtttgggagcaaggcagccctgagatcagggcttttgtaactctacatcccacttcccgtaagctgaagaggcagtctttcctggcagcgccctgagcacctccacagtagctaacgtggcttcctacgggcccacagcttctagagtggattcggcgcaccatcccctggctggaggaccgggtgcctcagaagaccatccaggaaatgcagcagaagctggaggacttccgagactataggcgtgtgcacaagccgcccaaggtgcaggagaagtgtcagctggagatcaacttcaacacactgcagaccaagctgcggctcagcaaccggcctgccttcatgccctccgagggcaggatggtctccgtgagttgactgccacccacagtttgggacccacagtagggcataaagcttggctgccatcgttgtaaatcagcctttggggcagggatggtgatgagtgcttcacatttcctgactatttcttctgaggttttacactcaaaattctctgcaccactacccagccataccacagtttgtgtggaccatttgaatagtactccaggctaacaagacacctttcaaggtctactcagcagcgtccatccattgatttgcccacctgcccactcacactgagattcattcagttagcccaaaactatcaatgcaaaggatccgagttgagtccccaggatccatgtcaggcagctcacaaccacctgtaactcctgtcccggggggattaagagccattttctggcccctgtagatacccacacacatctctctc

SEQ ID NO: 32313 - DNA, 1179 bp, Mus musculus
catagagatccacctgcctctgcctcttcaccatacccagccctttaaagttagctcctttaaagggccaggtgcacaagacaaatcacactacactgcagggtcactaggaggcagcattgtctagtggtgcagaagactgtgtgggtagtggcaagataattggaaaggaagtgactagtccttagtaggtgatagtatagccagtggactgacagaagacccccttaaccctgagtgcaggctgctcacataaagatggaattttaccatagtagtagtggatgacaagtttgaggtgagaaccagaggcctgggacagtctttggaggagtggttctgtgagctggatcattactaagctggccaatgcagaaaaggcctttgtggctaggaagctttgttcagaggcttagggacagtgccagcaggcttctagaatagtgctatctagactagagcatgctcctagtaaggtaggctgtgccttggggtgaggcaaagagttgggctctcaccaacagccttctttctctttccctttgttctgtgtgcagagattgtggatggcaatgcaaagatgaccctgggaatgatctggaccatcatcctcagatttgccatccaggacatctctgtggaaggtaagacatggcagagagtacctcttcactctcctcggatggaatgaattaagaacaagctctggttttgtctccattctcctccatgcttgcttggagcccatctttcccaccgcccttgctggccccggattacccccgagcagcagtgctctgtggcctctatttcatacaccagcccatactctctccttgaagtagaacagaacgactggcaccattgtacatcttagtgaccgagctacagagcaaactcaggatggagttgggcctggctttttcgttttcacctccacatacctgttttgggtgtgcattctgacgtgcataggccatccaagaacgttgccctttccacttagccactgtgtgtatgcatcacaaaatgagaaaagccatgaggccagtatctggaggggctcctgggtgttggatcaccatggtgaccaagatagatatattcatgtctccataggacttccaatgtgaagacagccaggttacccagaggagaagatggtacttgttggaaaca

SEQ ID NO: 32314 - DNA, 1168 bp, Mus musculus
ccctgtccactgttctgagggtagctgtgtgctctgccccagagtgctcattgctagctagggccaggcttagaaagtgtgtgggcagtacaagctagggggagagtctgccctgtcgctcagccagagcaaacagtttcaccgttttttaatggagccagctgtgagtcagaggtttcagtcgctccctgctggttcctcctagtcctgtaattactgactatagaatctgattttggcttttcttttttaaaattctccccagacaccattctattgttggtgtaggttttacatccttggagtctgagatagaccagatatgtgtgcattggtggggtgactcccaagcctagtgtgtacctcatagcatctctagaccagggatcagccaacacctcttcataggaggctggggcaagattggataattccgagttcctccagttgcctcttggccagggtttctggtcaaaagtctctcctaggttgattggattctttcactctcacttagtgctctctgagcccctgctgtgtgccagcctgaggggagtcattctggggcaacaccagttgaccttggactcaggcaaaagattgatgatgcaggtatggactcctgcattcccctaaggctctaagccctcttgagacagaccctctaaccccaggctcagaggacaggacaccagtgaaagcagtgtttgcaagacacctgtacttggcttctgtatcccctcagggtgagaccacagattgctaaactcatttttctataccctgggctttatgggcccaccctccaggtcagtctgcttctgtaagagaatgctgtgaactggaatcaaaatattccaaaaaaggaaaaggtcactgagtttcagttgcaaaggtgaaaccagtccagttaacagtcctcttgtagttggagagcccagtatctgggtgctgtgagtaccagcaaaaacatgctacctcctgccatctggaggaggaggaatgggatggcttgctctggtccccatgccctgatgtcctggtttgtagcacttgcgcgatatgggaagttccctgagtggcctggaacagaggtatggtgcctgcttagaccacggcccatcaacaccgtctgatttcagccccctcttgtctggatgagcaaggc

SEQ ID NO: 32315 - DNA, 1199 bp, Mus musculus
catcagatctcatggttgtgagccaccacgtggttgctgggaattgaactcagaacctctggaagagcagtcagtgctcttattcgctgatctccccagccctaaataaatgttttgtcttgtttttatttttaaaataaataaatagtattgttaagaaactaagggaacctgtgcctggaggcacaaattctatagtcctggtacttggaagagagtcgggagtattaggagtttacgtcatgatgagtccaagccagccagggctgcatgaaatcctgtctcaaaaaaaaaaaaaaaccaaagccaaaaccaaaaacctacagaaaaacccctatgtgactaggagaaagaggctagtgcgccccctggtggccaagtggagactgagccccagattgctggctttgccctagaggatctcttcttccgagtcctgctgctgtccaggcaggagttggcctagagcagttagcaaagggggcttggcctgctcagccccgattcctctgcctccaaagcccctagtgttagggttcaggccaccaacacctccgcccatgtcacctgcagacaaccagctgaaggtgtggatgagcaagtacggctggagcgctgacgagtcagggcaggtcttcatctgcagccaggaagagagcattaagcccaagaacatcgtggagaagattgactttgacagtaagtggcctggggccgcagactgtagggaagacagtgtcctggtgggagagcagtgctgggtgtgcaaagcacgaggcagagcctgtattcctggactgggaactgtctgccagattccaggttgctggcccagggagagactgtgagggatgctgagtagtctcccctgctggatgtgagccgtccatgttctctctctctctccccccctccctcccaccccccgccctggcattcctctagaccagactggcctcaaactctacctacctctccctcccgagtgctggaattaaagacttgtccactcagggctgtggctctcgatgagtcatttggtcccaccataaggtagttgctcttgttctaacttggaaactattagaactggcacagtgcctgcctcctcgtgtagagagagccaggcgcagagtgaaaggcagtgacagccgttcctgtcacattttgaataaacagtcttatcccaaaagaggaaa

SEQ ID NO: 32316 - DNA, 1638 bp, Mus musculus
ttgcccagctctcccgctcttgtttaagggagttttgctgagagtaaaaacctggaggggtgaaggatgagctgcaaagaggaaacttccaggcacaaagccgcacaaagggcctgaggtaggcaggtctagtgaggagacccttgtggctgaaggagatggaggcaatggaaagtgtacagatgacctgcctgggtgtgtgtgtacacatttaccttctatgatttggttgttggacttcccagccaggcagaggcaggtggatttttttagttcaaggccaacctggtttttcagggccagttccaggactgctagggctacacagagaaaccttgtcttaaaccagagacaggggcgggcaggtgggcaggcaggcaggcaggcagaggcacgatctcctgtacccggattgctcacacctgctgactcagaacttttgatccctcctgtctcagcctccacaacgtcagcactgactggttaatgctgagtgatggtgctagtgttaatactggggcatcctttcttccacagcaagccctggatgagaacatggaccttctggaaggcataactggctttgaagactctgtccgaaaatgtgagtcctgggagcctgggttcccgagggcttaaggcagtgtagcagggacttgggagaagggggattaaaaatgaggcagactgggccttgtgcaatagccaattttatttagagcataagtttatattctgaaagttaagcatggtcatacgagcacagttcccaaagttcaagccatatacagccccgaggataaagctgcgcttggaagtggttttttaataacagaagcagctgtgtgtaatctggagcaagcccttgctgtttactacacctgcgggggacacagaagagccctcagaattctcacacagctccgttcctggattacgtgccagcggcctcttgactgtctttgttttgattctcacagttatctgccacgtggtgggcatcacgtaccagcacatcgaccgctggctgctggccgagatgctcggagacctgactggtgaggcctggtgctgtttctgtcagtctgagaggaaaaggtggttggggcatggggcctcaggcagctcaggggaacccaccgcacctttccgaggttgttacctgccccagagtgtgggtgagggtttggtataggatgttgccttctgtatctccatgagttcaaggccaaccagggctatgtagtgagacactgcctcgaaaacaccctgaccaggtgtagtgctgtcctcctggaattccagttataggaagctggagcaagaagattgtctggaattccaggccagcctgggctatagcatgagcctctgcaccaaccagttaacagatgcacatgtcagacagtggtcctgatgctgaccttggcagtgaataggagagctcaggcccttttcatggatggagcgaagtggaagcatcagcaccttgtagttggtgttgccaagggtagcagggctgctttggagggatggcattcggcctctagaggaggccagtgtggccctcctgcagcaggggcctgcctgtcatgtgtgctgtgcctgcgtgccctggaagcatacacatctctggag

SEQ ID NO: 32317 - DNA, 1194 bp, Mus musculus
ctctgccgaagtcttgatctccagcgcgcactccatgagtaggagcttgtggggagccatataggatcaggggccttcactgtgggtaaatagtgagatgcggtcagagatgaggccgcaccctgaactcttttctctctccttctagaactacttgtcgaggaatttctacacactgcggttcctggccctcttcctggcctttgccatcaacttcatcttactgttttataaggtgtctatcctgtggccacaggccatggagcagggagaagggagggtggtgggggacattccagatttagccttcttaggagagttcagcctagacagctggtgctgatttggggtgccctgtggggctgagtggaggtggctgggcccatatgggacaggtgtctgagtgcattcaagagttagtgcaagacacagagctgcttccctgccagcctcggcacctgccgggcagtacccaggtgtggaagtcccctcagagcacccagcggtgcagcgacttcagagcggtgtgtggaggagaaagtgggcagctgatggaacagaggtagagagggcgaggagccggacctcctgaagctacagggagattcatgtccttgccaggggcttagataaggacacagaggctggctagacacagatggcggtgagccaatgtttaatctctccctgcctctgcctcctggtcctcaaaatgggatcaaaaccacatttgcatctgagacttctgaagacacacaggcctctgcacgttctaggccagctaggcctaccacagagtcagactttatctcaaacagtgagatgaatacaggagaatcaagagtttgaggtcattcttgcctatacagagagtttgaagtccgtctgggccacatgaggcccagttattcattcataaataaataaataaataaataaataaataaacatgaggcccagtcctaaggaaagaaagaaaaaaagaaagaaagaaagaaagaaagaaaggaagaaagaaagaaagcattgcaacagttcctggatctagaaagtgcccttgaggcctggtgtggtggcgtatatccatagtctccatacttgggaagctgtcacagaagataaatagtttgaggctagcctgggctatatagaaaatctcaggcaagcctattctatcaagatactatgttaaaa

SEQ ID NO: 32318 - DNA, 1181 bp, Mus musculus
ttggggctggtttacaggttcagaggttcagtccattatcatcaaggtgggagcatggaagcatctaggcaggcatggtacaggcagacttgagaattctacttcttcatctgaaggctgctagtggaagactcacttccaggcagctaggatgagggtcttaagcccacacacacagtgacacacctactccaacacctcctaatagtgccactccctgggccgagcatacacaaaccatcacgaggcctcttctcatcctggcccatattcctttcccagggacggatgccccagctgtggtcaactgtcttcacatattggcacgctctctagatgccaggtacggctttggggtacgccacccaacccagtccttctatactctctgagtgacattcgtctcaggaatggaaggagaggagcaaggaaggaggggagggaaggagcgggggaccctctgcttctacagctctgcaccccacctcctagaacggtgatgaaatcgggccctgagatcgtaaaggcgggtctgcgctccttcttcgagagtgcctccgaggacattgagaagatggtggagaacctgcggctaggaaaggtgtcgcaggcgcgcacgcaggtgaagggcgtgggccagaacctcacctacaccacggtggctctgctgcccgtcctcaccaccctcttccagcacatcgcccagcaccagttcggagacgatgtcatccgtaaggactcctgacactgagggcaaggggcacggggtggggtgtcagcttgaccggcactgtccatcctgaggttcgtggcagagtcacctggtgttggagcagatgctttcgtgcagtagccaaagcacagttagtaaactgtaggggaccgaaggtgttaactaaaatgtgaattcagaaaccacagtggtggtgcatacctgtaagtaatcccagcactcaagaagctgaggcaggaggatggctgcaagtttgaggctagcctggcctataatagtgagttccaggaccgcctgggctacagagtgaggtcttgacttacaaaaagcataagaaaagcaagggctgagtggtataacactgggctggtatccagcagtgaagggctggaagaaagactcactgagtagctctcctacagagttcacaatgaaaggctaaaagcac

SEQ ID NO: 32319 - DNA, 1240 bp, Mus musculus
gattgggatacgtttctctttgtgtgtgaatcccgtgtggccatgtgcgatttgtttgtattgggtgtttggctacgttcatgtgtggatgggtcccggtatgttttggtttgtttttatattgtctgtgaacacttcttaacccgagacataatcaagttttaggtagctgcttccctgccagcaccctgccccgcccccggatccagaggggtgggagaagatgggggaggtgaaggtggacctggccggcttgccctttgcggagcagtgggaacgggcagccgcgggagggtgctgggcctccctgcactagcccttgctgacagccgcccgcccgctgctcgcccgcccccacagccttggcgaggacttctaccgggaggccatcgagcactgtcgcagctacaacgcgcgcctgtgtgccgagcgcagcctgcgcctgcctttcctcgactcgcagaccggagtggcccagaacaactgctacatctggatggagaagacccaccgcgggcctggtactcgccgcgaggctggggtggggcggggcctgagtccggggacctcactttcacagcctctctcctccaggtttggccccgggacagatctacacttaccccgcccgctgttggaggaagaaacggagactcaacatcctggaggaccccaggctccggccctgcgagtacaagatcggtgggtggagctgtgtcccctgcgcctgctgtggccccaatcaaggccttcagccctccctgctccccggctgaacttcgtctttattatcctgagtgtccctccagcagactatctgtccccggatgtcttgagttactttctttgagtgactgagttgccagctgtacctgctatgtgggtcatggcaagcaggtgtttggaggacatggtgtcatctatgtctagatgtatcaaggctgattgcatgtgcttcccagggagctgggatacacctgtgtctgactgtgtttctttctgtgggtgctgagggctgtctcactgtgtatttgtaagagttagcaacagttctccagctgtgggttgagaccatgcacaacatatttacatttatgatgtataactataaaaaaattacagttatgaagtagcaacgaaataattttctggctgggggggtcaacacaacatgaggaactatattaaatttagggtcacacttttaggaaggttgagagccactcagggcgtctacttg

SEQ ID NO: 32320 - DNA, 1207 bp, Mus musculus
ctgcttacatcaccctgacctaggcccggctctgcttccccaggatctttgggtggtgctatctcctgcctcttggagctcctggcgctccccacccggtgtccccagtggaagggatggggtgaagcccagagtgggggggggcaaggtgttctccctctgcaagtggaatgttaccctgtgggtggctgggtccaacagggtccctcctgtcccccctcttcatcccttgacaaatgggcaccaggcttctgctctcctcaaagccatacccccgcctttgggcgggcatagaggggtagtggatgctagccagcagcacggaaagagcctttttctaaagaaaaagacaaaacgtggaaaaaaaagggaaaaaaattaatatatacaaagagtcctataaagcctggctgggtggagaggcactgttgagtgtctgctggggacctgactttaccagtttcctgaatggcgcctccccacctcatttctggagttgcaatggtctcaactcccatctgaggtgggtaccaccccttcctcagtacccaccgtggatactgcatgtgaactatggttttgaactcttcctcctcctccttgagagccccgccctgcgcccgcgtggtgcctgcctgccaggcctggggcgtgcagccggggaggcgggtggggtgaggcaggcaggcagccagccccctgcagtgagaagcacagattgcaatggactcagttttttttttttttttttttttttttcctttctcccttcccacccctttccttccctacccagccaggctgggctgcctcctgcccccctcgctagccatttgggggtggcaagggggtgtggttgtttctcgtggttgtgtgtgtttgttgttcgggtttttaaaaggggaaattgagactgcaagtgggggaggtggagggtctgggggagtctgcccccaatccaggagtaccccccttgccaccaagtctcctttattgcctgcctctgctgtgaattaacttgttctgtgtattaaactgggcctgacccctctgcccacaactgcttccatctctaacctcttttggggtgtcaccaacatgggaagccaaggggcctcactggggtagaagccactgtggctggcccccacctctttgcccctacaccatgcctccctgtggctttgtcccagctcctccctgtctt

SEQ ID NO: 32321 - DNA, 1942 bp, Mus musculus
ctctatccccagtgaactggctccaggtagcatggacatcaccctccgagtcccccttccacacagcagccaggagcactttcatagagtttaaattattttcctggggccccagaatggacaggacccattagcacccagatccactcctttgagaaaccccatttgtacagctaggactgtttatatgatcttttttatcagcttctctccaagcagccgcaggcccctctgccttggagctactgatctggccagccatgggatcctcctctaggacaactaggccattgccccctacgccagcggctttgaggaacctgaggacagggctgaggcagagccttcaccccctgtatggttgtctttccttttacaagtctccctggccacactccatcccccagtggacaccagccacgctcactgtgctccctggggagcactcacagtgcagcccccagcccccagagattctccaaaggcaataaggggcagctcagtggggcacgctgctcacccaggaaacacaaatccccctccccctttttttccttctttaaaaacaaacagaaaagaatatatatatatatatatatatttattttttcatgtagagttgtgccggaacacgtttgaatggccacagtctgtggatttccccaaaccctgtgggctggaggtcaatgtgaggactcagagggacgtgggggcagcaggcggcacagttggcagcgtagattggacccagagccataacgagatggcccagccctcagaccaggacccatcacttctctttgggcccactaccacacacaacaggcactctgctcccgatgggccaggctgaagggcagggcttgaggaaagggtatccagagctccctgtgacctgcctctgacccccggggaacccctggttgtgagggagcagcctgccatgccctccactcaccatggaatgatggtggcaaaccagaccacccagtgtcctgaaccctggccagctactgtgatgtctgtctcctgatcacctttctaaagggttctccagcccctcccccttcctctcctctcagaacccaacctggagccttcccccttccccccaaccccctcccttcatttctttctttaatgtgtcttctcatatcttcagaccattcgaatcatttgggggacctaatcatgtacattgacagttgtaaattttaatttttgcttttgttctattatttttgtaagaattcctgcaaaaaaaaattatttaatttgaggttgatactctgtgtaatgactggagatagcaggcttttttttccaggttgatttattccatttggatttttgttttaatcattctttattgtcttttcctccccctcttcccatccctgtcttgagatttctggcatgtttcaggaggtttcaaaggaaataaacgtttcatagaaatggctggtgtgttctcctgcagctgcctggaagccagtgctggctccctcctcctaagctcatatcacactcctgctgcacagcatacatttaccagccagccgctttcctaggcacctgaccatcaggatgtaaaatgtgctgaagttaaaacaagctaggtctgcaaggcgagcatggtaacccgagcccttaatcccagcgctcaggaggcaaggtgggaggagctctgtgttctaggccagcttgttggaagtaagttctaggagagttagggctgcactgtgaacctgtcttcaaagggaatgggggatgggcccctttcgccaggtgtgatggttcacacttgtaatcccagcgctctgaggcaggaggatcgccgagagttcaaggccagttgtgtttgtacacatcgggaatctcagaggtgaacgggtgtcaggagtgcaaggtcttccttagctacatagcaagtttgaggcca

SEQ ID NO: 32322 - DNA, 1130 bp, Mus musculus
catcgtcatggacaacctggggccagagcaggagcgcgacacgggggtgcgtgcgtgcggctggcggcccagggcaagcggggagggggcgatgctctctgccgtgcctccagcctttgctgtctgccggccctgttgtgggtggggaatgcaaggagggacagagccaggactcaagccagctggggaaggccctggtgaccatgagtctcatgtttttctcctagagcccaaaaagaaaatggtcctaccccctcttcagatcccagccacaagcagaaagagctcccagaaactacttaggctctcattccccaaagacagtaaggccgaagcggcaggctctatggtccctccattgccctgcctgcccctcatcgtcagtctggcagtctatggaaacctagacagctcttcactgggtattgtggcacacacctgtaacctgcaggagactgaaacaggagggtctcatgatctaggccagcctgggttacgtggtttcctgagaccatatctgaaaagaaaaggcatgtgcaaatgcaatgatgaaatgcttatataagcttactgttggaggataggctcagaagccatgggcataggtcaggggttgggagcccttggggaaatggatgctgggtggacaagaacttgccaaaaatcccctgaggcccaggaccacagcccagcgtgccaatcccttgtcctaccctgtcttgacagcagtccccccagaagagcctgcagcggacactgtcagatgagagcctgtgtagcgggcgccgggaacccagctttgccagccctgccagcctggagcccggcctgcccagcgatgtgctcttcaccagcacctgcaccttcccctccagcacactgcctgcccgccgccagcaccagcacgcccacccacccagcggggcacccagcaccactccagccactggcaatggcttcccagagaagaaatgtgagcctggacatctgggggctgcaggtccccctggggctaggaagttgggcacactgcaggtgggaggcacctggtggtcatatgtggccaggccttgtgagggagggaagggtgcacaagtgctccagggaacctcaaggagtgaatattgctg

SEQ ID NO: 32323 - DNA, 1179 bp, Mus musculus
acctacagaatggacagctcccctccagcaccccggcttcctcaggatccagagccttccatcgactgtccaggagaaggtccaaagatgtagaattccaggatgggtggccccggtcccctggccgggcctttctccctctacgacatcggagcagcagcgagatcaccctcagtgagtgtgatgtagaggaaccaggagacccacgggggacccggcacccaggggtgctgcccctcttccgagagtatggcagcacgtcctccatcgacgtgcagggtgtaccagagcagagtttctttgacatcctcaatgagttccgcagcgagcagccagaggctcggggctcccagaacctcagggagctcctgcaggtggatcctggcgccctctcagggggcagctgtggcaccaagggagacccccgcaatggccagcccaccaaagatagtctccagagtctacagcctctcaaagagaaggagaagagccggaagaaacccgtgcggggcctgggcagtggggacactgtagactcatccatcttcaggaaactgaggagcagtaagcccgagggggaagtggggcggcctctgggagagactgaggaaagtcgaagccccccagaagccagcagaccatgggtctgccagaagagctttgcccattttgatgtgcagagcatgctgtttgacctcaacgaggcagctgccaacagggtgtccgtggcccagaggcgcaacaccaccactggggcctcagcggcctcagcagcctcagccatggtgacgctcacagcatcacgagcccacagcctggggactctggacccagccttcaccagcacggaggatttgaactgcaaagagaacctggagcaggacctgggggacgacaatagcaatgacctgctacttagctgcccgcacttccgcaatgagatcggcggggagcgagagcgcaatgtcagcttctcccgggcctccgtgggttccccggggggcagcagcgaggcccacatggctgagcccaccctgagcacccaccgtacaaatgccagcatctcggtgctggaggtgcccaaggagcagcagaggacacagagccggcccaggcagtacagcatcgagcacgtggacctgggcgctcgctactaccaggactactttgtgggcaaag

SEQ ID NO: 32324 - DNA, 1244 bp, Mus musculus
agccatccagagagagactctgtctgccacccagagtccgtgaaaataggacactatttctcttggacactcttcctcgccgggcatgagagaagcactgcttaaaattatgacaagaaaatattttcccttccaggggtatgagagcagaaggcctgagcaagcaccgtggccttgttacaggatgagaaatggggccagatagatagtcccatggttaagaacatttgatgctcttgcagaggaccagagttgagtctccagcatccatgtcatgcagcttacaacacctgtaactccaacttcaggggatcatctgcgcatgcgtgcgcacacacacacacacacacacacacacacgctcatgctccacacgcacgtgcgcacctgtgtggtggtagggtgcagaatgaaagacttaggaggcctgtgtagtggcatactatgcagctataaaaataggctgaaacccgattggatggccttctgtgggcatggcatgccaccaagtataaaagtgggggggggaaagccgcttccttacttctcagctgggaagggcatgttgaacaatgaggcctgcgcaagctccagcctggctgtggctgggaactgctatctgcctcagaaagcaagtggagagttgtcttttgggaaggcagcgtggtcttctcccctgacacggcctcccacactgttggcagacattgctgggactagaggggtggggactgaagccacagagtctgggtcttcagtgtggtcagaagagaagactggttttaaccagaacactcttaggtgggtgtggttacccagaatccacctctgaaaactcagccctcgtgccaccagtcacagacgcagattcctttgtttgtatgtttttgttttactttgttttggttggggggtgggggggttgttttacccagggtctctctatgcagccctcatctagagcttgcccaggctagcctctaactacatatgatcgttattccttcacaaatgctgagattaaaagcatgtaccaccacttctggtttcctcggttataattatgtaacacctctttacccaagaaaagggaaaaatggaggaggatcaaggttttgtaaagattctagtgccattataccttggaatgctctgaatgtatggaaaaccgcagtgtagttaagttttagactacttgcccagaattccccagtgaggggctgggggcatggcccagtggtaga

SEQ ID NO: 32325 - DNA, 1177 bp, Mus musculus
ccgctgggttctagttttccttttcatatggacaccagttcatattggatcaggggcctgccctactcaggtgtgactcatgcttttattttatgtgtgtggctgttctgcctgtggaggtcagaagagcatgtatgatagtctggaactggagtgatagatggctgtggcctgccatgtaggtgctgggaatcaaacctgggtcctctggaatagcactgagagctcttaactgctgagacatctttccagccctttgtgctttaatttcttttcagtattattattacttttcttgtagtttgttttctgttctttgagacaagggttcactgtgtagccctggctgtcctaaaactgaatatttaaaccagactgggctgaacttacagagatcctcctgcctccatctctaaagacctcatgctaacttgcaaagagctctctctccagctacctagtttccgaatgaggtcacattctaaggaactgcaaagtgtaagacttataacaggaggggctgggggcgtggctcaatggtagagcccctgcctagaatcccccagtgagggctgaaggtggggctcagtggtagtatgcacagggctctcagttcctagtaccacacacacacaattaaaataactaaataaaacatttaatgtgagtgggtattacaaattaaaaccataacagaaaataataacaattagccagttgttgtcccgtatcaggtctgaggttctgataccttcaactttagtaggactcacagccctcattggcttgctgcttctgtttttggcccttccattctgttctccagaaacaaatgcagatccaggtgtggtggcacaccctgtcatcgtcctggcacttggaaggcaggaggacccactaatttaaagccagctgggttacatagcaagatactgtgtcaaaaacaaacataaaaccatgagtgaaggcgtggtttacacatgccccactcgtgagcccttcaggtctctcccatgtcttgccatcagaatcataaccaaactcatggcacaagaaagctgggagatgcctggctgaaccctgtaggtgccgcttcagttggcgctctgcgatgtcgtcgtaatacttcgttttgatctcttggcgggttctgatggcaaattggttgctctgtggt

SEQ ID NO: 32326 - DNA, 1201 bp, Mus musculus
aggctgaggcaggaaagacggtatcatcaccacggacagctcctggtgggcgggcagctcctgttgaggtggaaaggagatgtgccactgcagacaactcctgtgaaggctgccattttgacaggagccaccatttttgacagctccgaggttggggttggggtggggcatctcatcttgaccttaggatagaatggaaaggaggagccttccgcagctttgatagcttttgaggtgtgatgcttaggggctacagaaaggcctttaaaatgtgtggatactttacacaacaccagaaaattcatactagtaaaaaacgtttcaattgtaaaggatttgggaaggcttttattccgcttccatctttgctcaacaccagagaatccacactgataagaaacctcatataagtcattagcatgggaggtcctacagatatggctcaccccttaatgtacatcaaagaattggtgcgtctgtgaaaatctaagcatagagggaacacgaggaagctttgaatgtggcccaatttttttctttcatttcatgacttcatagaaatgcaacaaaaacttctggtgatgttatggcggcttcttgttacttcctcagactcgggccgatcggcagagtgatgtcagacgatacagtggagttttgctaagacagactcatgtgttgttttgctgaggcaagacacatgggtggacatgtggtgtttggaggtagtataaataggactagacagactgtgtggagcttgcatagctagcttggcaacactttattggtcttgagattttgctgatcttcactttgttgagagcagcatggcagagaacttctagtgtccctgctggtcctggtgcagattcagcagagacctggctgtctctgctgtgttgtgccaccgctgctgattagtgtttgctatcctgatgcaactgaactggactgttggtatatatcctgtcaatgcagattggagttgctccaaagaactatttataaacaggtccatttcccctgaatccaaataactttccttttctactacctatggtgggtggtgggttttaagacaggttaaagaatttaagaaaccttattaaaagtaggcttttttttttttttttgaaaaatggaatccagcaggtgatgcccaacgtgacttaggcataatgggtaactctgcttctaa

SEQ ID NO: 32327 - DNA, 1112 bp, Mus musculus
attggaacaaactcataatctgtcaccgtcaccaggtgactctcagtcatgtgaaaagtgcagtctgaaaatacagcttgcttcagtgtggaagaacaacagctctacacactaaagcctggcgtggttcatttgaatagatgttgtcaaattacacaccttcccccccccccccaaagagcaataaatcttagagttgacagcagaattacacattatatacaataatcaatgaatttaaagaagtttctaaaaaccatcaataaaatggataaccggactttaggagctttttccaaatctgatacatagactaggttttcgggggcctagagggacatttgaaagacacaagcacaaccgtcagagctaatgggaagtagagcattcccaggcagaagtatgtttgttcggttggctttggtgggttttattttaagacatggtctttcttaaacttgtggcaatcctcctgcttgaacctactgagtgctgggattagaagtgtgagctaccacactggcttgaacttggagccttgagcctgctcagcttggctctgccctagagccttttattcccggctctctttgttctgaggcaggcagggtcttggctaaatggcctaggcaggctttggtgcccttacattaagcctctcaaatagctggggctatagacctctgttaccaggtacagacagaaagtttgactgctataaaataaggtattctccagatttcaaaatcaggcagcaagcaaaggcagtgaacatggaatttgccagtgggaaattgtgtggtagaatggtcaacataaattgtatcagtaactccaataaccttttgaataggctgattgctgtagttgaaaggaagtgttttttaattttttaaacagattttttttcttcaaaggtttatttattatatgtaagcacactgtagctgtcttcagacacaccagaagaaggcatccgatttcattacagatgtttgtgagccaccatgtggtttctgggatgtgaactcaggacctcctgaagagcagtcagtgctcttaaccgctgaaccatctctccagcccccccccccccgaaaggaagctttttt

SEQ ID NO: 32328 - DNA, 1221 bp, Mus musculus
aaagattacatttggccaaatcccttgcagtactatctggttcccgacatggatgatgaagaaggagaggcagaagatgatgatgacgacgaggatgaggaggaggggttggaagatattgatgaagaaggagatgaggatgaaggtgaagaagatgatgatgagatgaaggggaggaaggagaggaggacgaaggtgaggatgattagcacagaagactgacagattccaaccttctttttttattttctttttattttttaattttctccagtccctgggagcaagttgcagtcctttcctccctgtccctctgtgctcagtcaccctgttttgaggtctcaacatcatggttctcaattaatttggggggaaatatcttgagcaaaatacaacaggaaaagaatctccgtttctgttctaaattcattttttatcctttcttgtctaaatttgtggattccacaccaccatgctctgtgggaaaaaagaaaagccctccagttcccttggctctgctggagggcgctaggcccctgtgtagtagtttatagaattttagcttttcttcttttctctgtatattgggctcagagattacactgcgtctctatgtgaatacagacagttagcatttaccaacatgtatctgtctactttcttttgtttaataaaaagaaaaaaaatgactgtcttagttagggttttcatttctgtgaagagacaccatgatcaaggcaactcttagaaaactcttataagaacaacatttaattggggctggcttacagattcagaggagcatgacaacttccagccaggcatggtccagaggagttgagagttctacatcatgatctgactgcatccaggagaaaacccacccctatagtgatacacttcctccaataaggccacacatactccaacaaggccacagctcctgatactgccacaccctgggccaaacatattcaaaccaccacacttggtcttatatagaccaggctggccttgaactcctgcttgttaaggcctaggtaaaatgttaagacccttggtaactgttacctggctagcctgtcattttctgcttttactaatattataaggaaactttcacatatgtttctgctgttattaggaaactttctaattctaaagctgattacatattctgttatctactgtgcccttggaaaccaatcacaatagaagcca

SEQ ID NO: 32329 - DNA, 1135 bp, Mus musculus
tttttacagggtatctatctgtatatgttgtttcataaaagaaactgggacactatatagaccgcagtgattcccagaatcacctgtataatgcaaggttttatatgcagaagatgatacaggaaaaaccgtgttctcacttcctggcttaattctttgctatctgtactatgtcagagcctttaacctgtttgcttggcagtgcccgttacaaagaactccttttcatctcccctccatttaagggatcatatccttaatttctatagctgatacttatgtttgtttgttttcagaaatcagggatgtttaatgatgttgcttttgacttctctaaggtaagagtggaaacacttcgcctctgctcagagggacttatacagagattatctttgtaaagtatagtaactcagtgtcagttgggaattcatttctgctctttgtatctcaatgcctacattttaaaaatatttattttatgtgtatgagtgtttttcctacacatatgtatgtatgtgtacagcatgcatgtagtgcctgtggagcccagaggggcatcagatcccctggagctggagttacagagggttgtgaaccaccatgtgggtgcaagagcagccaatgctattaacctctgaactctctctctttaaatttctatgttttaagttattcaaaagcatcagttgagcttagtgtctatcttagcactccagaggttgaagcaggaggattgcaagctccacaccagcctggactacataagatgagagaaagaaaatggagaggctgcctgctgggtttagacccgcactggccagtctcttgttcctacactgtagccctcagcatctcatcactctcatttaaaagctatcaaaaatttaagcagggatagcaaatcacaatctaatcaggtaataaaaatatcaaaactgtgacctccactatattcattttctgatttgttagagtctgagttagttattctggtgtatgtttggacatctttaattttaacaactatatgacatgatatttattccccactagagtttgacaatcactgggcttttttaaatcactattagaaattattaggaagagatttgtaatagatataagcatgggggtt

SEQ ID NO: 32330 - DNA, 1101 bp, Mus musculus
ttacagaactgatttgtcacagagtcccaaaacttacatgtttcactatctctaacttcaactcaagaatattacttatacatgataactaagcactcaagataaacctaggaaatgaaaaagacttgaatgtgtagttttgtgaactaatctgaaagtacaaaatagacaacttagaataaaaaacaacacatgatcttgtatcagagatcggtgttcgacccagttttcatctctttttcatcataaaacctaggcaagacaaaaacctcccatacacaaaaatttagtctccattgcagatcaacaagacgaaaatggtgtctgtatgactagaacactttaaaaaatccatcctctctgcttctttcccttcttaacactgtagacagtgaggcagagcacagacggcctcgtgaggggttgggagtggtctctgggtgttactgatggctgagtctgcaagcctgttgatttgtaaacagtcatggtaactctgctttgcctctgtgctttacttaaaagtaaagtagccctcagactggttgatgctctccgagatcactgaataataaaacttcccttaaggacaagaaagagtgttttatctggaaatggatgctgtagataacagaatctcaaggcttgaatgtaaggctctgggggctgggggtttactgagcatgaactacgaaactgaataatcttatttttcaggcagaacatttgatcagcctgcatccctgtgtctcctacagcagacctagtgccaatctaggctgcaatgttagagaaaatggtaggaatgatgcagaacatacacgttcaatagttctcattgcttcaagaaatgtctgggccgggcagtggtggcgcactcctttaatcccagcacttggaaggcagaggcaggcggatttctgagttcgaggccagtctggtctacacagtgagttccaggacagccaggactatgcagagaaaccctgtgtagggagccattctggacttcctgatcagcaggatggaagtcggctccaggtagtaaacaagcccatgtttggtggatggcccgcccttaatccctgattggctgagcaa

SEQ ID NO: 32331 - DNA, 2228 bp, Mus musculus
ttcctcttccaccgcctctgctgggtggtgggcaagaggagaggctgaacatttattaaaagtagtttgagggctggtgagatggctcagtgggtaagagcacccgactgctcttccaaaggtccggagttcaaatcccagcaaccacatggtggctcacaaccatctgtaacaagatctgacgccctcttctggagtgtctgaagacagctacagtgtacttacatataataaataaataaatctttaaaaaaaaagtagtttgcaaaaaattatgcttacagctgagcagtagtggcgcacacctttgatcccagcactcgggaggcagaggcaggtggatttctgagttcaaggccagcctggtctacagagtgagttccaggacagccagggctacacagagaaaccctgtctcagaaacaaacaaacaaacaaacaaaaaattatgcctacagatatcaaatactgtataaaagcattctatgaacaaagagtagagagttttcctctgggctgaaaaaaaaaaaaaagtcccgaaaaatgtggtcaaagttctaactagtgctctaacttatctgggacataacttcccaaagcccagcagccattcctccttcagtttctagggaaggacaaagccccatgagggaaggactatgtaggacaaaatgacatgctagcactgtcacccacaggagagtctcgaaggcaaggcctacttgttcctctatcgtcctcatagccttcctatgtgggagaactcacctgtcccacatagctgaagaaattggctgaagccaatcccagaagccctgacttatactcatgatgtgttgctggaaccaacaaaactgaagcctttcctatgaccaacaaggccatctccgatctggccctggccatccttctgatgttctacccttctgtcctttgtccagccctctccagacacacagctttccttactgtttctcagacactatggataccactttctgattggtgcttttgcttttccttctgcctggaactcacttctcccaggcatcaacatgactcacccttttctttactccttcctacccgtactgctgttgctacagagggactttgctgcaattctttttacctacacagagttctttctggttaccatgtttttcattagcctggtacttactgtagttttaaagatttttattaatgtttttattaattatgattttgctaattgctaattattaattaatccatgtgtctgtgtgcctggaccatgtgtgtgcccgtgcccacagaggccatcagtgggtatcagattccctgaagctggaggccatcagtgggtatcagattccctgaagctggaggccatcagtgggtatcagattccctgaagctggaggtccaggagatttgtgagacagtgatctgggtactggggaatgaacttaggtcctctggaaaagcagtaagggctcttccacagctgagccacgtctctaacctttatccccattcatttttattcttgccatttaccccctacatttcattcttgtctttccacactggattacaagacctaagacagtcagtgcttgtttggtttaccgggatattccagtgctaggacaatgccagaactattatgaatgctctgaaataaacacaagccatattgtacaacctgtaatgtacactgtgactacgcatgtcactcatgctaccacctcattttactgatatggtagctactactatcttcattttactgataagtaaaattgatgttcgagaagtttaagcaaccaattctaattgccttttttttttttaaatttccttcacattttagtgtgtgtgtgtgtgcttttgcttgcaggtagacctgtgcatcacatccatgaaatgcccccaaatggaagagtgttgtcaggtgccctgggactgctggagtttaggatgagttgctatgtaggtcctgggaatcaaacctggatcttctgtgagaactagtgctctagacactgagctatctctcaactgccagttctaactgctaagagtccaaaggaagtatgatttaaatgctggtctttctcaccccagttaacatggcaatgtggacgtgaggatctcacaagacctcacccttgggtaaagagctcctgagagagggagaataagttttcttcagatataaaaccccgacaggttatccaatc

SEQ ID NO: 32332 - DNA, 1099 bp, Mus musculus
atcaaacataatcaaacacatcagtctatgggggccaagcctactcaaactactacattcactctctggccctcataggcttgttcaaatgcatgattgtatgagggccatacctagccataatgtgaaatacatttatttcaatttcaaaagtccccatagtctatcacagtctcgatgctaaaagttcaaaatctcttctcagattatctaatcactttactgtaatcctctataaaaatcagagcagatcacatacctccaacatcacaggatatacattacaaaatgtcatagtgaggaaatactggaccaaagcaagaccaaaaactggctgggcaaactccaaactctgcatctccatgtctgatgtcaaagtgcgcttcagatctccaattcttcttatctttgttgactgcaacaaaattcttgggctggttccactccctgttagcaactttcttcagtagatatctcatgactctggcatctctaaaatcttagggtctccaatgtaacgtttgggatgcacacatgatttctgggctcctccaaagaacttgggtcacttctccagctctgccctttgtagcactctacgctctggttgactctactccactgctgttgctgttcttggtggtaatcccatggcatcttcaatatggtcttctgctgcaattaggtttcaccaatagcctctcataggctcttttcacggtgctgagtttcaagttctttgcacaaccccttcagtcctgggcaatcaactgtaactgaagctgcaccttcaccaatggccttccccggtttctcacagtgtcaagcctcagctgctcttcatgatcccttcttgccttcaaaatcagtaccaactgggtgacgactcttacacattaccaagtccagctgcagcatgagatacaaccttggctctttttggaacacagcttctttgtgctctcaaaacaaccaaccaaacaaacaaacccacttcccagaagacttcacctcagtgatgctggtctcttcttaatcatcactaatttcttagctccagccaaccagcatcaattgtcccagaaccccttttattcac

SEQ ID NO: 32333 - DNA, 1190 bp, Mus musculus
ctgaatctacttacggattcctagcggataccaaaaggtgggagctgggggaggggatgcccacgcaggccacccgagcgtgccttcaaagtaagaagtttcttcctcacttcagttgattttttttttttttttgtagacattcttgtcatagtaccagaaagctgtctgtctcactcgtcagaacctttatcgggataatgccaaccaacagcataaaccatttgaggctagttcaaaaaaaaaaaattgaagcatttatcttcaacatagctcctttcccagttgaaagtagtagaaaaacaaaaggcaatacttgttggaataattgactctcaatttaaaatgtaaggtcccgttgcgtttgggctgcagtcgaagagaaagaagaaaaggaactgtgcacacggtctctcaagccaggggccagcgtgagcaccagagcgctggtggatctcagcagagctttttgagtgtctagctcgattccttgttttctttttaaattattgtgtgtgggggtggtgggggtggtgatggttttgtggattgtgttgaaacacctctgtagaccaggctgggctcagactcatggcctctaaccttctgagtgctgggtttgcaggcatgtgctgccataataccagtttctggatttttaaacagaaaggcgtgtcttggcgatttctgtgccaggtgaaggccaggtacaggtaaaaagctcgcttctagctgttggcatgagttttgcatgggtcctataggaagaaggctgggtattcaaacctgcactgtaattcaggcactgcaggattaagactctggcttcggttttcatatacttcagctctgcagctattcgtttttcaaagcagacacagaaatgcccgtgacatcagcactgtgctgagccagcaacctgaagccctgaggtcatgctttcttccctgctttgtccagcactttatcagtctttctcacgatattctactcacaggcttgagtaaaacgggctaagatgttagatacatggttacccagaatcttgccttagaacaagtcagaacagccttaattaggaattccaatggtgctacttgcatgtcctctgacacatcattccatgggctccccatgtcctctgtgtcactggaaatggtcatagtgcctttaaagtacaccacaccaga

SEQ ID NO: 32334 - DNA, 4402 bp, Mus musculus
ggtgctagaattcatactcaaaagacccgttaggtccagaagtgatggaacacgtgttacaagaaagaaaccttataactccagaaattggagggggctacttgtttcagaatttatcataaggcttttgttgatgaaaaactcttaagttccatgaatgtaaaggaaggaggaatgcctctcagtggcctggagccaaacaagcaggcctcgggattcatagcagggacaagctgaggagggcagtgtgtgtgtccgagagattagcagttggaacctttccacacccacacccgggccagccctccgaggagagaagtcagtcgttatactgcataatctctgtgatacctcaggctgcacttctgctaaaacacagcacactcgccattcatcccactctacgctcatggaatgtttgctactttataaagccatttggactgcggagtgtggaaaggacatgctaactttttacatgtcctcatgattcagggcaggttatttaccaactattcttttcttctgtggggtagcagtgttagccccgtgtttctagttacgctttgaggttgtgtgtagattgtggaatagcatccagctagtatctaaagtgtgccaagtgcagcaggcatgctgttccacgcaatatgagcatctgaagccaaaggtaggagggaggatcacaagttgaggctagcttggagactctctagtaaaacaaacaaacaaacaaaaattataacaaatatagctgctttctttgttattttcataatagtgaacttttacataaactttaacagtcttaaagaggaaagccttatatgtccagtaactggagggacatcttgccttgtccctttgactgttacagaattcttatgaagaaagacttaaagctttcgttcttagtttacccttctgctggtcagaagcgtcagaactggaatgtggtgaggtcagtatgagaaggggctggaggaattgctaaagcctctgagtgaggagtggtgctacacacagcctgtaatcccagccctcgggaggggagcacaggacagggattcaagtccatcctggtctacctagttagttagggggtagcctggacaacatgtgttgcagtctcagaactttcataagcaaaagccatgccatggatctgtgcactagagaactggaaaacagtaaagctttagctaagacccaagcctccatagagagtgttaaatgcctatataaagacatctatatctaaaggtccaataggtgtggtagcgcataccttttatcccagcacttgggaggcagaggcaggcagatttctgagttcgaagccagctagggctatatagagaaaccctgtcttgaaaaaccaaaaaagaaatttgtacactgtgactgaaactatactctgagaaaaatgaccttcccttcatctttgtaaacagtgggggttggaaggtctaggactctgtatttattgtttatacagtactgttacagtgcctagtcctggtaattcccagtgagtattctaagtaacagaagagcaaataactactcagctccaacagaaaagaaactaacaaaattcaacttggcaaaactaaaccttggaataggtgagacgcacacagtgttgtacaggagatgaggctcttatgaaacaaggcttgaatgagcagagcataggttctacctgtcgacagatgttagccatgctcctgcagtgttatggccctgtgattggttctggctgtgcccttggtctcatgtgtgactgactgggcagtagaccatcatgggcttagtaacaagatccaggggcatggtcttcccggctgcagggagcacatctgtgccaccaggtggtgcctgctttctgaggctgagactgccatagaacacacattgtcaccgacattgtggtgtcatggaaccatgacctcgccttctcctggacctacagaataagaaatgcagacactgaaaattaatactcaactctttacagtatacataacactgagaaatttagcatttaaaaatatttttactcagatgtattcagcttcaggaacatattttatgtttgtattctgccttttatagtatatctgacaatgaaaagcattattttccaaattattttcttagccatattattgaaatatatattcaacttcaatttagtaagatgtagtatattttcttagagtatttgatagtgtgtttttatattctgcttttatagtgtatcttaaatcctagaaaagtattttcctgaatgaagttagagccaaggagaagctgcttaaggaactacactcgttcccctaacactgagccacttgacagctgagacaccttctacctcttcaatgtggaaaagggcggcagcatctaaagtcacgtcggttagttgccagtccacggccttagaggactttgtgattacagcagcgtgtagtatcagcagcccagtaattgagcggtgtggtgctttgtgcaaaggactttggttgaagtgctaatgagtgagtgagagaggactctgcagtcactggagactagcagagcctgctgtgaaggtccttgtccttcctcttggtctgctctctcctggagctcatctgccccgccctgcccatcatctcaatgaggagggaaagctgctaattactaaacaggctccggcagagcagttgtgacagaggtcaggcagcatgtgggcatgggtgcaacttgtgtggaggccaggccagcggtcaggctaaggggtcctgcctcaggagcctttggcttcagttttctgatgcagggtctcacaggagctgggatttaccaattaggctcagctaactggccagtgaaccccagggatccacttgcctgtctccgtagcactgaattaaacgcaggtgcacacatcacctggctttattttcgtgtgggttttgggggtgtttggaggtcaggccctcggcttgcacagcaggtgccttactgactggtccagcatcccactggccaaagactttttaaaaggcagaaatgataactgagttttaatctgcactggtatattaataaacctatatagaaattttaactattcttctaagaggagaacttgcacattttataggaattaaataaatagaagttttttagagggtgcttttagtactgatttcagacttggaaggatagctttttaatgttctgctcctatatacatatttgttagacttgacggtcctctgacgagtgtatgcatcaggatgcacctcaaaccaaaaatatcctacaggggtttatttagagaatgacatgtgtacactgttaagtgctgatagtggatgctgcaattccgctctctggttgagatgcacacgcaagcttagacatcttggtaacgggttgggtgaggaagagtgtattgagtgggattgtgcgcacacagggatgcaggctcctttcctcacgtggtaatgtcctaaggggggtgttctcgtcactactcaccgctctaacgatctcaccatagacaagccatgtgtgtgcagcctcttcttcccagcaaatgttagcttcaccatcagcaatgtgagttcgggacacaagcattacctcaggttgctgcctgtttctatagggcagctactttcctgccttagcatagtagaattaaaatgtacttggtgctttattgtttccatgtggagctcaccgccatctcagcaggaaccagtgtgtgtttctcaactgtgttagccagggctgaaaatgtgccttctgtttgcacttcctcgactgctagggaggtggagcatctccctggcctgcaggtcatttgagctttgtttctgtgaattgtacattgctatccgtctcactttgtagcacacctaggagatcatattacacatgggcaatttgttgtcttcatctagaatatgtcatttgccctttttctgtcaaaatacttagccagtgttgttttatgaagggccagaccgagtatttcaggttgggcttttatgcagcctttgctgcgtagaagcctcctgtatacgccagtggtcctcagccacttctgccacatccccaggaggcatttgccaatgtccacaggcatttttttgtcactttaaaatgactgctgcttatgtctagtgggcagaggccagagaggcttctcagtgtcctggggtgcacagcacagccccccaaaaatgatgtcacactccaaaatgtcattaggtttctggccagaacagaatgggataccactgtgtagcaataaaacattcacagagacaagcagctggccacatcgagcctgcaagtgtgccttcccacctggttttagtagcatttatctgtattatta

SEQ ID NO: 32335 - DNA, 1607 bp, Mus musculus
ccacattcattaaaactctttgaatgccttagatgaacgaacacttgagcagagtgtatggttagtaatgtatcaaaggatttgtcttacactaagttacacaaatgtaggagatgcttctgtagtgactcaaaccttaaaatacaaaggtatttaataggatagatcatagcattatatacttcccagacccccacaagaaacattattagtattctaattttaggagtccagtgattccaatcagaatggtcttctaaagtatatcaactatattgagataatatgagcaatataaaggtttgaaattaagaggcaaagatatttttgatatacgctttggtatatagataatttgtagaaattgtttttcagagaaggcgttttgggacagatctccctatgtacatagcccagggtgaccttaaactccctatgtagcccaagctggcctccagtttcttctgattcacttacccatctgcccagtgttgcagttccagacatcaccaggccaactcaaggtctttgttgataagattgtctaaacttgaggtcagaacagaatcttgaatctagaaacatgaatgaattcacagagcattggtaattgattgtggcagtatcccaggtcagtgggaaaatcgtggatgactgaaaaaaataatctcaggataattaactctttgcatgggaaaataataggcctctgatgtcatcactgatttagaaattacagtgtctttgcacaaagcaaagctttgtataagaattttctagggtagtttctgagaccctgaagtaggaaacaaattgtagattctggattcctcagctatttttctggagcatttatacttattcaaagagctggtatgcttatatagggaatcatgtaccagttgatctcttcatcacagcgtaaattatagtagcaaaaaatgggttcagatgtttgttgcttacaaagtagatgaagaaaatgtaatggtcatgctgtagaatatgctagcagctaagcacaacagatgaatctatgtgtcaacagcaaaagaaaaaaaatcatcagagtgaagaattgaaatggtagatacgttgtgattcctgcgtaaatttgaataaaaccaacttaccaactctggtactaagcatcgtttatgggaaactcttctctaaaaccagagttgggagtatatatatgtgttcagttcccaaaacctagttgttgctattatagtaacagtggagttccttgggaacgaagttttcacaaagcagggtaatccaatgctacttcagctttctagtcttcatagttacatatctactttccaatagagcagttccaaacaaatgtgacagatggatacttggctctacattgtagtaacacgtaatctttgttatcttgcttaggtagacatggatgagatgtacacgagatgcatattatcacaacggtcccattgtgcgtgtgtgcatcccaaggcccctcatggatatctgaagccttgtgtagtattaactctctctatcaggttttcctatgtacatacatccctaggctgatgtttataagcaccacaagagtcttcacgtcaaagaat

SEQ ID NO: 32336 - DNA, 1158 bp, Mus musculus
caacatttcctttgctcaacactggaaaacctgtaagactgttgaaattagaagtgggtggaaaaaacacagttttacccaaggcctatagatcctactactcacactcaaatgatggagtgtgtatgtgtgtgtgtgtgtgtgtgtgtgtgtgtgtgtgtgtgtgtgtgtttgagtttgtgtggtgagtttgtgtggggtgtgtgtaggagtgtgcctgtatgtagatgtctgagtatgagtgggtgtggtgtgtatccagagaacaaacctcagttctcagaagcagtccatcttgttttataaagaagggtttctcctgattgaagttcagcaagtgcctcggctgcctggcctgtgaaccctatatatctcctgtctccacctccctaccactagggataccagcttgcgacatcacacctgggttctcttatggcttctgggagggaactaaggtcttacacctacctgcatggcaagcactttaccagctgaactatctgcccagcccccatatatcccaactttgtataaagtgaaacgagatactaaagacatgcgatggttaatacagagggaaccagtctattgtggagtcccatgaaccaatgagaagacagatgaaatgataggatcccgtggcagggacacaaacactttgttttgcttttgaattttattgaggatagtctaagtggactttgatgcttttgtaactgttaacatgtaagccgctgcttgggagagttgatgcgcttttttaaatttcagcgtgagacgatgctgtggtttgaatctgaaatgtactgccaaaggtgcaacatatctagtgtatgaggtttactgggagagagcaaaaggccccctgagagtggggatatgagagtcagagatgacagaacgatcaagacagagatggagggagacagagccatcggtggcacctggtgcgcctgtgggtggtgagtgatgacataagctgttgctaggtcccggaggacagtgtactttgtttccggatcttctccctgctgtctttgcactccctttccactgtgtgatgagcagctcaagggtctgagaggtctgcccggaggcggtgcggcgacacctgaacctgtcagccaaagtccattcctcctccagagtgtttct

SEQ ID NO: 32337 - DNA, 1418 bp, Mus musculus
gggtggccgtgcttttgatcccagcactctggaggcagaagcagggagctctccataagtctgaggtcaaccaaagggtatttaatgagaccctatctaaaaacaaagcagaataaaacaacaacatcaacaagagggaaataattatattatcgttctagaagcacccaagcccttcctttctccccgcaggcgctttcaaatctcttgacaaaaatggcaccggacagatccaagtgaacatccaggaggtgagccggtttctcttgggggtggtgctcagctgtgaggtccagcccctaccatcctgtttgcccagcaggccttgggtgacgtgtctggttttccagggtccctttgctcatctgtgctttctttcctcttccagtggctgcagctgactatgtattcctgaatgggagtggcagacctgccccctcacagctcactatggagccaccttgaaccctgatcctgactgcagccgcattttcatggtcatgtcctgctacccagaggcctttcgtctccctgttctggtacccagcttcccaatcagcagccagagctcaacatgccacaccttgctgcaccctgagttacccctggctctgagacaagctagcttgttctactgaagggtcaccccaccctagcacacccaatccacgccatctgttaccttcatcctgtctgtgtgccaagcctagcactcctgctgcttccatgtcccaagggccctgtcttagttctgggaggatcacacctgtccctacacaccctgttacacactcacacagttacctcccaggcagccagatgaactccaggccatggcaggtccacacaccctagtgcctacgcctgctctgtgctccccctgcacagcggtcgggcccaggagaaaataaactctctctacttgctgcttccttcggactctgagtgctgagtccaggcaggagggaacatgagctctatagagtaacttggttatttttttaatgtgtatgtgtagaatgtgtgtgtatatacatgtactatgtgtgtgccaccctctgggactggaggtatgagggatcatgagtcaccactggggtgctgggaactgaaccccaatcctctgcaatagcagcaaagtacacacacacacatacactacactttctcacacacacacacacacacactcaaacaccatatactccccccacacttacatcacacacacataccgacacactctcatatacaccctcaacactacacactcacacatacatactctcacctacaaacacatcacacacacattctctttctcacattcagtctcaccatatacacacacaccatagaccctcacagatatacaccccccacatacacacactcatacaccacattcacacgtgctc

SEQ ID NO: 32338 - DNA, 1103 bp, Mus musculus
tctacacgagaatcccctgttttcccgctgcctcaagacagggtaaagcaggcaggcgctgtagccgaggctggccttgaactggtcctccagcctcagcctcccaatttctgggattacagtagagcgctaccacgcacgcccagctgtacccctgtcctcatgcctatatatatgcagtcaagcctgggccagggtactttctagaccctaggaggtttcacatctcctatcacctgtccagacccctagctagaggctctgtccccatctcgaggccttagtttcctccccaatctagttgccggaaatgcttgcttttttttttttttttttttttttttttgcgggaagggctgggctcctggcaaggccactacccgacccaccccttttactttacaggactcagctgcgatcatgttcttggtgaattcgttcttgaagggcggcggtggcggtgggggaggcgggggtctgggcgggggcctggggaatgtgctcggaggcctgatcagcggagctgctggcggcggcggcggtggcggtggaggcatgggactgggaggaggtggcggaggcggtggaactgccatgcgcatcctgggcggagtcattagcgccatcaggtaaggcggggcctgaaggggcggggcgggccaaataataaagactcacttagagtccgacctgagaattcttaattagtctgggctgatccataccggaaaactggccctaaggggattctagcgaggctggtgtcactttttagtaccaggattagtaaacctgcttctgtgggtcaacaaataggatgcagtttcttggggataggggctcttctgtgtttggggaaggtgcaattctataggattgtatccagccttcactgggggcgcagccagtggatctaaggctgtccatggcttaagatttgagcgaggtggagcttgctgttttaggagagatcagagtccccaaagaagaaatggtccagagaaggttgtgtggggtctggagctgattggtttagtgggtaaaaatcctttgctggggttagaacaggtggctggcacctatatcgttggtgatccaagcac

SEQ ID NO: 32339 - DNA, 1137 bp, Mus musculus
gtggacacagcctggccacaggggctgtgccaggttcactcatgcatccatccattccctcattacaatagccaatgagcatatgctggcctttgttctaggtcctgcgcctgcgcgtaggagacatagtagcaaacaagagaaggttgatttcctacactaggtgagaagcccagacaaaaattggagtgtcaggcttatcaccaggtgatataagctagtgagaaaaataggagaagggggtcagcagtgtagcttcagtttcagggtggcagcaaaaggctttagggaaaagattactttcagcagagccctgtggggaagaggagcctaggggcctgaaggccgtggtccagggccagcagtctttagcccagctacctgtcctctcttgggccatctagaaagacaaagtttcctagccatttattcctctctacccctagatgcatcaggtgtgatcgcagacagccctggacactgggacacagaagtccctaccccagaactcctaggcagtgtggaatcagtcttgcacaggctgcagactgccttccaagaagctcttgacctttaccgcatggtgagccaagggagcccagggcagggtgggacgatggagagggctccctgccactccctggatgtcctctaacgagcttgccgtcccttacagctggtctccagcagccagctgggtcctgagcagcagcaggcacagaccgagctggcctccaccttccactggatcctcaaccagctagaagccagcaactgtatggctgcagctaacttggccccaccccagacactgcctagcccagaccctctgtccctacctacactttgtcccctggccagcccaaacctgcaggccctgctggaacactactcagagttgctggtgcaagcagtgaggaggaaggcaaggggtgactgagaacctgaagcccctctaccaaagccccgctgccctggagaaatagatttgtaaaccaataaactgacagttgtttcctggaaccttccctgtctataaagcccttctcaatggatgcagagagaaagggcagagggcccctgcatggatgaagcagcctgcatagatgaaccagcctggagactcatttagctctg

SEQ ID NO: 32340 - DNA, 1204 bp, Mus musculus
gcagaggcagcttctcccggaagaaaatgctttagccccagaaaagaacatcttaaaactcttgtgaaagtgtggttttctaggcataaaaggggcgtgtgggctatagaggtggggcagcaggtaagaacacttgtagaggacctgggttccgttcccagcatcctatggcagctcacagctagttaactccagttgcagagtatgcaaagactgattctgtcctagacacagcacatgcatgcaggcaggcagaacactcacacatttgtttcaaaaggtctggaggcagcttattgagctccaacaagctcctagagactggggtcctccatctcctcattctgtcacgtaagatagctgtcatccttgtggccagatggaaaaaggccacccaagcaatctctcagtgcctagcatcgcctctaaccgcaaggaagctcctctttgacccggaaggtctgtgctgtgggaggcgctgagcacagagccgctgtaagctccttgcaatactgaccatagcctctcttcccacagtctctgctgaaggtggtctatgtagagaatgacatccagcacctgcaggacctgtctcacttcccagaccggggcagtgagaacggcactcccatggatatgaaagctggggttcgagtcatgcaggtcagtcctgacggccagcacttggcttcaggcgaccgcagtggaaatctgaggcaagtggcccttatagtggctggtgttcacctcctggacctagcatggggggctctcagggtactggggaagagtcctggtctcaggaccatggatataatccagttaccagcagcacccaggacttcaactgggaggggcttcctgaaggtccgaagtcatagtagctaccaggacctcagcagcttcgtggaatagcttcctcactggtcagggatttatggaacactttcccgggcattgggcacagaaaaaaagaggtcagtgggaggagccagctataagggcatgggtactgaggattcagtgcagtagagcagggaaggcccaggtggtctacccacctcaaaaggttgttcactacttttgtttggttgttttgttttggtttggttttggtttttttttttttttttttttttcggtttttcgagacagggtttctcggtatagccctggctgtcctggaactcactttgtagaccag

SEQ ID NO: 32341 - DNA, 2170 bp, Mus musculus
aaggccagctacagagaatggttttctctacagtagttagaaaccagtatatttaatatatgaaagtatcacacttctgatagtctgtagtttcttacttattgttttagcaaccatgatggagttctggcacataaattttattgttagattaaaaaaaaaaaaaaaccttttagctgggcatggcagtacagacctgtaatgtgagcactcaggaggcagaggcaggttaagctttgtgagttcgaggccagcctggtctacagagttccaggacaggcaggactgcacaaatagaccttgtctcaaagaaaaatttttttcttttcttttttctgtgctgggactcaaacccaaggccttgtacacactaggcaagcatcctgttattgggctttaggttcaacctgttaaaacttttttttttagtgtgacttgtttccctactcaagactgaatctgatgagagaacactgcttttgctcagtgttgtgtctgctctgtgtggcctgaagtgctggccttggaacttcagtgctttggtttgcactgcaaccgtgctgctctcctgtggcaggactgaccctctggcttacctgtaaataaggatgatttacatttatctgtaaattgtgatgctttcttctccacagattgtcaggatttaggactttcatccacagcatcctttgacatgtagtcagaggccaccttgtcaccaggcgctctccctcccctgtagtcccagcttcttcctcttgcagcagacaggggaatactatcaaaggtcaaatgctagttgctggtagccagcatagcatgacttcagaagcccagggcatgtgtggaatgcagcaagaactaagactcatggctgaggcagccgtaccatgttgggagctgctggagcaaatatttttctgacagcccttttctttgcaggtgacacttgagaaggtgcttggcatcacagcccagaacagcagcgggctaacctgtgaccctggcacaggccatgtggcctacttagcagggtaagcacatgtgtgggcttcagcagctggtcactggttagggatttggagttgaagtcactggtgtatctctctgggcctgggttttcccatctgtagaaggctgcttcctgtgagggctatggaggggactccacaggcccatctgtgtcaggagtagtacccagcaaggcagtgcttcgaaagccttttaatcaaatgtcaggtggtgacagttatgggaaactcaagtggctaaaacccaaacttaggtcaagctcaactgcatatgctcttcttagtgcctgtgcatctccctaggagtacactccattcgggtaggtgagagagctgaaggagtccagttaagtctggagatgcttgtctagcccagcactgcttaggcagtgaaaggagcctcttcctctcccccagcaaaacagggtcgggtagactcatagtaacatggtatcagttaatgaggccttgggaaacagattgagcacaggctgagctcttaaatccagctggcacacattcatctccactccgtttctgacctgtgacctgccgggtggcctgtgcaaagagcttcccctctctggcctgcggtcctctgaatcagatataaataaatgatatataaagcaccctggcctcacccgacagccgaggatttaaggcagttatagccataaggtctgtaggcctagggcctgcagaatagtccccacaaaggaattgcttggtttttgtttaacaatgtatcaatatttttacaagtgcccatgctttctcagcattagtatctagaggaaggggcgagcagaaagagaatcttctgcccagacgaagctttataaaagctggagatgcaactcagccgtagggtgcttgcctagcataatggaccttgggttccatcctcagtaccacaccaaaaccaaaagcttcctggcatgggagccaacctaggcttcatgatgagacgaaacccagcaacaaaaccgggggagccttattaacacggggtttttctttgggaagagagtcgtccctgggtccagtacttctcccaagcccccagtttagacttgtattcttttccctaggtgcgtggtggtggtcttgaaccccaaggagaacaagcagcagca

SEQ ID NO: 32342 - DNA, 1118 bp, Mus musculus
tctaagagccaagtgctttgaaggaaactccagaaagatccagaggcaatctccaaaactcagtgggtagagatgcttccaaccaactggaatatctttaatgggggtaccagattccaagactctgaatgaatcccttcaaacctccattgcactctgcaggtgggctcccgcatcctcgggggatggtccctgagcgactccctccatggcttcaacgctacgtggacaaagtgtctgacctcagcctttttgggggtctcccagctaaccatgtccttgtgaaccagtatctgcctggggagggcatcatggtaaccgcacatcctcatcccaagttcccctgctaagtacctcccccagatctccaggtcattaagaggaggctagccatcatgtttgcctgccctcactccacacactccacctaggcgcggtcctccctgtcccagcttgggaactccactttgacttagtggagtggcgtaggctccctggtgcccccttcctccccagcctcatgaagatggaccactgtactacccaactgtcagcaccatcagcctgggctcccatactgtcctcgatttctatgaacctcgacagccagacgatgatgtccctatggagcaggtgggtcctgagctgatgccccgggcatttgggggcattctagcgtctgacatcccatatgctccaggacagtctgatcctacctgtatttagagtattcgtgacacccagacatgctcccctgtcccttgttgggcatccctgctttctcccagatagccaacccatacccatccaatctgtttgtacggtgccccagctgccatgatacccagggataccgatacatacgtcgccatggtattggatggctaaggctatggatgacctgtgaccctccctcagaccacttgagctcaacacggtgttccaacaaagttttttttagaaactactgtttacttatttttgtgaacagatgtatgtagcccaggctggcctcacgtttgccatctttctgtcccatcctcccagtgccagcgttgtaagcgtgtgcccccgtgcctggctccaatgcatattcttgacatcctcaagatatccca

SEQ ID NO: 32343 - DNA, 1217 bp, Mus musculus
gcacccctcaacctccacatgtaactccagcctcctcccctcccccagcccccccttatctcattccacctcatttgcccccagctccggcagctgttgaagaggagccgcacggcacccccaggcttgtcctcttaggaccgaaacccagaacctggactgattttccagtccccaccgtcccgtgggacagtcagcgtatgctcatgtcgcagattcatgataatatatgtgtaatatcctgccattagggtcttacattaaaactccaaagtggcacgggggggaggtgagcagtctccaatatttggggtctgtgacacctcctccccctacaaggggctttctaggtgatttctgtgaaatcgagcccacttgattgtttctgtgaaacactctagagacctttaactttctcctacctggatcagtcatgatcaccccccccagactgtcgtaccctgaatccccattggagtttccatgggatttgaggcatctgagtacctttcggtcaggattcctccccaggacccacacccctgagatgttggaaaggccctctgagattaatgtgtcctgagtcctggctacatcatcatttagaacccaatgtctctgacgctagcattccccgtgattgttccccttggtctgtgtatccctgtagctaccaattaaactcaatttggcctcagactgtgtggtgtcattaaaaatggggagtgggggagcattggttcagtagagcggctctgaggggccacagtaggatgatagaaaggctaggagtcaaaggtcaaggtgcctgtcagatctgatgcctgggaaaggcacttttctgtttaggagatggccattccttcctgatactgtaatttcagacagccggtgcccaatccctgcagaaaacatgagaaggccagcagatcgttggtggtactcacctttgatcccagctctttggaggcagaggcaagcatgtctctgaatttgagtccagtgtggtctacatagtgagttccagggcagccagtgttatttacatagtgagaccctgtctcaaaaaacacattaaaagatgtgagaagacttcaaagccagggagtttatcaggccaggaatgtggctcagcagtagtatccttgcttagaattccccagtgaggggctgggggcatggctcagtggtagagcatttgcagggaggggctgggg

SEQ ID NO: 32344 - DNA, 1216 bp, Mus musculus
ccttcatcctgatctccggctgtcagcagttccaatccacgctctccactctcagcttggcactcgctgctatcttttttttcctcccctcaaaactggatcttagcttctcaattgttaaattttaaaagttttaaaatagtcctgactgacctggaacttgatatgaagagtaggaaagtcatgagcttgcagcaatcctcctgtctctgaactctaaagtttactgcctctgaagtgctgggattgcaagcctgtaaggccatatctggctttgcgtattttgttctgctgtttttgttttttcagacagtatctgactgaacagctctggctggcttggaacttacaaatgatccacttgtctctgtctcccacgagctgggattaaaggcatgcctcaccacaccccacttggatttttttaaattacatctaattattgtgtgtgttccctcatgtctgggccatggtgagcaggtggtcagaaaacaaaagaaaaacattttgtttgttttttgtggggtttaggtttcggagacagggtttctctgtgaagccctcactgtccaggaactagctctgtagaccaggctgtcctcgaactcacaagagattcgcttgcctctgcctccaaagtactgggattaaaggcgtgcactgtggccgccgcccagtctcacagaacaatttaaggaagctggatctcacccctccgccttgagggttcccgacactgaactcgggtttggcagtaatcttaccagttgaaccatcctaccaggttttagcttctatccagagccttgtcccagatctcagttctaacaattgtcctgtccaccaccctagtcctggcctcgaccctaaccttaacccctgaacttgtgccttaactttaccgactcttgacttcctgggtcgccccctctgaagaccctccagagttcctgggagagcaagtgcgggcagtgaccgtggtggagcagggccaggcactgctgcctgtgtccgtgtctgctaaccccgcccccgaggccttcaactggaccttccgaggctaccgcctcagcccaggtaggatgtgggcctggaggagggttcagattcaggaggctgggcgggacttccaggctcctgacccactccttccgcagctgggggtccccggcaccgcatcctgtctggaggggcactgcagctgtggaatgtaacc

SEQ ID NO: 32345 - DNA, 1148 bp, Mus musculus
ttcggttaggctggccagagagagctcaatagactgagttgggttcccacatcgtgtggctcacaactgcctgtaactccagttcctggggatccaagtccttcttttggcctttgtgggcacacacacacacacctgccatttatgtacacacattaaaacaagtgaataataattatcattaaatcttaataaaacagtggtctctagattcactgacagaccttgtctcaaggggactaagtagagaatgatagaagacagccagggtcatccttgggcaagaatacacacacatgcacgcacacacacacatacacacacactcatacacatgtgcacccacagtagactcacatgcacacacacatatatgcccacggatacatgcacacacacacacaacagactcacacactcatgcacacccatacatgagcacacatatataccagaacatgcacacagacacacacacatgcacgcatgtgcacacacacacacacacacacacaccatcaccagctcttgtgtgtgggtgctggagatccaaacgaaggtctttgtgctgtacacccagtgggcttctcctgagccatcgtcccagcactttcttaatcctaaaggattgctagctagtgcatgcccagactccctactgtctggaggctgagacaggacgatcacaagtctgaagtatgggctgcatagtgacatactcccacccccaaatgcaaacagcaacaactaaaaaaagagctatctatatccatgctctctctatgaggcaactgtatcagttagctttagctgtgtgacaaaccaccccataggtggaggcatatagcaacatacattatttcccgtgagtctgagtctgatgggaaagttctggcttgggctggttcaggtcatctctatggtcatcgtagtctgggactgagcttagatggcttcctgctcatatgtgtggcagccatcttgctcagggttgggacagtgtaagtactgctccttagagtgttcacatggagatggccatgaggtccaagaacagcaagaaaagtcatctctggttaccagagcttctcgagcttcgaattctgtcacattacctaccgtcccccgcaggcaaatggcgtgtctca

SEQ ID NO: 32346 - DNA, 1362 bp, Mus musculus
tcgaagccaactttcatcagcactttcgtcctggaaggtcggaggaggatcgaatcaggaatgaatatgaggagagtcagtggactggggaccgggacacaagaagctccacggtgagagaggggaacctggcagcctccagtctcagcttcaagctaatcactgccatctcctgggacctgagagtcaagggaaatgaccttgtttgttggttttgtgtgtttgtgtgtgtgtatgtgtgttcatgtatgtgcatatgcatgtgtgagacaggttagcacagcagaagtggacccacactactactccatgagggacttcagtccccagcttcccccaacactggaagaggtgtcatatcgccaaggtgagtcatgaccgcctttccttccaatctgtgctacttacttctttattgctgtgaccgaaatactcccagagaacaacctgaggagcctagattcccactgcctcgcttcagaaaggtctgtccgtgactgcttggccccactgcatgtgtggcagaggagagttgctcttatcacggcagacaggaaatggaaagagagccagacaggaaggggactagaggcaagagatccgccccccaggacacatcccagtgacctactagtgtaggtccagctaggcacacccgtttccagaacctcccagaatggcgccactagccatgaaaccccaacatatgagcttttggggtagacactttcccatccagtcctcatgtctaccaactccagccttcacaggtattgaagatgaggacatggccttccccggacacctgtatgacgaggtggagagagtctatggcccacctggggtctggggacccctctatgatgaagtacaaatggtaagaagagtcttagtaccaggctgtgtaggtcagaaacccacctcccactgtgtgtatctgttagaagaagccactgtgacaaagagacccctcagtgcagtggcagggaaaaattaaagcggcacacttcatccaggggtggcggtgcatgccagagaggaggaggaaggaagaggggagttcaaagccagccttgactatatagtgagacagtctccaccaagcaaaaaatgaagtctttctcgcataggtgtccaagaggagtcctgctgtgtcccagtgatttagaatgcagggttctccccctggatctccctgtcattctctggcacacacatcagcagggtctgcaggcacaggtcggtttacttaggggtggaggccaattggtggagaaaagctgttagacagacccagaaatggccatcagcccctctgcttccttctgactgatgggaacatggtcttgacactggggctgg

SEQ ID NO: 32347 - DNA, 1242 bp, Mus musculus
attgtggagtgtccctgaatcaatcctcactggctgtgcattccaataacgctagggtgtagggtgataaatagacaaggtgggaggagtggcagggtgtaggaaggaagcgggcagcagagcagctagggcgactgcagccgtgaggaaacggaggcagagagatgggaggggaggaggacagatctgtgggttctgggaagggactttcgacttttcctttgagggaagtgggtagtctagggaggtttttgaagaaggagtgagttggtaaaggtacaccccaaagtgcaaaaaaacaaacaaacaacaacaacaaagcttgagtggacatcctcagagatgcagtgagtggagagagggctgttcgtgttggcagctgcctttattcccagggcatggagaacagagacaaacggatctctgaagtcaaggccagtttgacctacttagcaaacaacatgccaacccaaggctatatagtgaagaactgggggtgggaggagagaaatatatatagtggagggagcctcactacaactatgcaggtaggacaagggtgggtttggaaacgccagactgagtacagaccccattttctggagtcaggattgaagactccttgagggttctgtgctggagaagatcaaagccacgttgtgttgtctgtctgtctttgtattttttctttcttttgcttattgtttgagagaggatctttcattgctgaggctgaccttgaaactcttgatcctcctacctcagcctccagagtgctgggatagcagacatatgctattatgcccagtaggcttggctttcttttaggaaggttcttttgtctgcattataaaaggaggtggatcagaaaagatgacagaggctaggcgctgggtgggaggaaaaggcgaggtagggaggggatatattgacagactcccacaagccaagtgagctgagactggggctgggaaaggagtgcccacagcgagtcaggagcctgtgggccagctagtcacgcctcatgggagaatccagggagtggagtgggtttcgaggagacctcagtgggaataccctaagggctgtccatggaaggtgtccagatcctagattcctgagtaggtgttggagagaaagagcagtggtagcagctgtgcccttggccccgcctaaggctctgtcaccctggttctgtctttagttggtctctccactgagtggcactaaagctgctttcca

SEQ ID NO: 32348 - DNA, 1197 bp, Mus musculus
gcctcccagcaccgtgtgctccccgagggagccacctgtgatgaagaagaggatgaggtgcagcttcggtccaccaggtgtgcagataagttagggtcctggacctggtcagaaagggtcctaaaggggagttgactggataccaacttatgtggtattttgtcccataccagacgtgccaccagcctggagcttcctatggccatgcgctttcgtcatctcaaaaagacatccaaagaggctgtgggagtctacaggttagtggggttgtggggtgccccttgggtggacagataggagccatgacgaggagctgactggtgtctgtcccccatccccgagttcactgtggtttgttctgtcccgcagatcagctatccatggacgaggtctgttttgtaaacgcaacatcgatgcgggagagatggtcattgagtactctggcattgtcattcgctctgtgctgactgacaagcgagagaagttctatgatgggaaggtaagtggcgtgaaggtttgaggtgagtggatgtgggctgaccttgacagagaactaattccttcgtcccgtgctgtagggtattgggtgctacatgttccgcatggatgactttgatgtggtggacgccaccatgcacggcaatgctgcccgattcatcaaccactcatgtgagcccaactgcttctctcgtgtcatccatgtggaaggccagaaacacattgtcatctttgccttgcgccgcatcctgcgaggtgaggagctcacctatgactacaagtttcctatcgaggatgccagcaacaagctgccctgcaactgtggcgccaagcgctgccgtcgctttcttaactgaggccatggctgcccggattcctcacgtgcccgctgccatctcaccctggcctgtggctccctagtctcagtatctcactcctaccttcctgtccatggtgaatgtgggcatgtagtggggcaggagtctgccttcacccctcctgcctacccagccattgcctccttcctccttccctggggacccaggatgtagatattgtacaaaggtttctaaatcccttcttttctatgcacttttttatttaagagggcggggtcccaggtgggaatccccccacaataaagtctgtcagcgtttggagaggtggtctttccgtgccttattactgtggttgttgtgt

SEQ ID NO: 32349 - DNA, 1133 bp, Mus musculus
gtgagcctgtagcacccccagtaaagcagccccctctaccccccatcattcccccaacagctcccacctcctggactctgcccccaggacccctgctcagtgtgttaccagtggtaggggtaggagtggtccggcctgccccacccccacctccacccccactaacactggtgtttagcagtgggccccccagcccaccacgccaggccattcgtgtcaagagggtatccaccttctctggccgatcccctccagttcctcccccaaacaaaactccccggctggatgaagatggagagtccttggaggatgcccatcatgtgccagggatcagtggcagtgggtgagtgcgtctctaaggctggggctggcaggctagggaggtaggcaggaggaggaggacacgtgggctttctgtgctgcttttcaggttcagtcgtgttcgcatgaaaacgcccacagtccgtggagttctggacctgaacaatcctggggagcagcctgaggaggaaagccctgggtgagtgaccgggtcccctccctgaggctctggacaccccctcccggtaatttttgcctcctgacaggtctttgttgacaggcgcccccaggaccggtgtcctttgctgccacttgcagaagctccttcccaggccctcgatggttcctcagacctactgtttgagtcccagtggcatcactattcaggtagagaccagcttttcctctcatcgcctccttgtgctgggcccggtggagactgacagaacctggattggttcactcgaaacacagtacacaccatgggctaattgggttcattttctaacactagaaaacaacaacaaaaaccctacataagctcagtgtgtagaaacccaaggctcggtgctaagagttacggactgttagggagctcctggcctcatgacagcagaattggggctagaaatcagtatctgggaggtggtggcacttggggagcagaggcaagtgagtctctgtaggtttgaagccagtctagagatggagttgcaggataaccagggccacatagagaaaccctgtctcaaaaacaccacaaaagaaatcagatttaataatgtatctttgtagctgcaggctgagccaga

SEQ ID NO: 32350 - DNA, 1205 bp, Mus musculus
tgcagctcaaggcccgaaggcgcctggacaaggtcagcacggcccgctccgagaaccccaagccctgtgtgaggcatggctcctgctctccaggagctacctggcaagtcagggtgatgggcacacctgagtgtcgtggtgtgtcctcaccagaggacaggtcctgagggatgaggcaggccttgcctttctggaaagccaagtgggatctgggcaaaaggcagggtatggcaggttgggggaggccagtgaggagaggagtctgcagaggggtggggttggcatcttttgacaaccccatgtccctccttaggatgctttagcccctggcccctttgcctcttttcccaatggctggactggaaagcagaagtctcctgacggtgtgcaccgggtccgagtagattttaaggtacagggttgagagcaacttagagcatgcagtggatgaaacttctttattgtaaccagagctttcaacgtggatctgacttgtgttcctggctgctttccaatcctgtgtcctctcttaccccaggaggattgcgacctagagaatgtgtggcttatgggtggtctcagtgtgctgacttctgtgccaggggggccaccgatggtgtgtctgctgtgtgctagcaaaggcctccatgaggttggtgctttgtccttttatttttcttaaaaaacaaaacaaaacagaaacaaaaaaacaagacagtcctggcctccaagtctccatttgccattcctgacctggagctctcaggcagggatcacctcccggctgtccgtccagcctcatgctgtctgtctgtcgtttccttacccctcctagctggttttttgccaagtctgctgcgatcctttccaccccttctgtctggaggaggctgagcggccctcacctcagcatcgtgacacctggtgctgcaggcgctgcaagttctgccatgtttgtgggcgcaaaggccgagggtccaaggtggggcactggcagccctgggcaggtagggcctggggaggggcgacctcatgcagtctcctgtacactccgttcccctccactgcctgcagcacctcctggaatgtgaacgctgtcgtcatgcttaccacccagcctgcctgggacccagctacccaacccgggccacgcgtagacggcgccactgggtgagagacgagccacgtcccttagtcctgcattc

SEQ ID NO: 32351 - DNA, 1139 bp, Mus musculus
ctgaagatgaatccatggaagctaagagagatcgagcctcggtatgcagtgagaggagggtcttctgaagaaggctggctgcagaaccacatggaaccatttcccacacctcttcctggtttttcctctctcagggccctgagtcacctttacaaggcccccgaatcaaacatgtctgccgtcacgctgctgtggccttgggtcaggctcgggccatggtgcctgaagatgtaccccgcctcagtgccctccctctccgggatcggcaggacctcgccactgagggtaggggacttgagtagtgggaggcttgaggacaaataaggtttgtgcatgagcaagagtaccagggagctgagcagaggaattggatggggcttagggggcagatgggttgcagtgctgctaggtcttggacagatctggttaggtccagaatacctagagtcagtgtggaaaagcagagggaaagtagggaaatgaggtaggatacctagtggctttgtggctctgtctcccctccatctgctgcaatagatacgtcatcagcatcagagactgagagtgtcccttcccgatcccagcgggaaaaggtggaatctgcagggcctgggggagactcggagcctacagggtctacaggggccctggcccacacaccacggcggtcactgccatcccaccatggcaagaagatgagaatggctcgttgtgggcactgtcggggttgcttgcgtgtgcaggactgtggctcttgtgtcaactgcttggataaacctaaatttgggggtcccaacactaagaagcagtgctgtgtgtaagtagctggagtgtagcctctggtcccacctggggttgtcagtcacctgagcctcttgtcccagccagagcagtgggatgggcatccttgtggagagcttcctctcttcccccagaccaccagtccctaccctggtgacgtgctgctcccctccccagataccggaagtgtgacaagatagaggctcggaagatggagcggctggcaaaaaaaggtaataaggcttggagagggtttcttcacaaaaccttacatagatagcggggtggcagaggccatgttttctttgctttccactcgtgcctttgcatttgacacg

SEQ ID NO: 32352 - DNA, 1226 bp, Mus musculus
ctcctcctcttgtcccagctacatgctctaggaagaggggcaggcctcccctgactcctagccagcgggcagagagggaagctgctcggtcaggaccagagggcaccctttctcccactccaaaccctagcaccaccacaggaagccctttggaagacagtcctactgtggtccccaaaagtaccacctttttaaagaatatacggcagtttattatgcctgtagtgagtgctcgctcctcccgtgttatcaagacaccccggcgatttatggatgaagatcctcccaaacctccaaaggtggaggcttctattgttcgacctcctgttgcaacctccccacctgctccccaggaaccagtaccagtctcctctccacctcgtgtcccaactcccccatctaccccagtcccactccctgagaagaggcggtctatcctaagggaacccacatttcgctggacctcactaacccgggagctgccgccacctccacctgctcctccaccagccccatctccaccacctgcccctgccactccctcccggaggcccttgctccttcgggcccctcagtttaccccaagtgaagcccacctgaagatctatgaatcggtgcttacccctcctcctcttggggctcttgaaacccctgagccagagctgcctcctgctgatgactctccagcagagcctgagcctagggcagtggggcggaccaatcacctcagcttgcctcgctttgtccctgtggtcaccagtcctgttaaggttgaggtgcccccccatggagctccagctctgagtgaaggccagcagcttcagctccagcagcccccgcaggccttgcagacccagctcctaccccaggcactaccaccacagcaaccacaagcgcagccacctccatcaccacaacacacaccaccactggaaaaggcccgtgttgcaagtctgggttccctgccactatctggggtggaggagaaaatgtttagccttcttaagagagctaaggtgcagttattcaagatcgatcaacagcaacagcagaaagtggcggcttcaatgccggtgagtgtgttactttgagcaagtccctgcactcagtctagataagtgtttagccggacatgcaggaccagtttcccttttacctcccaattgtttctaccctgaccctatcccttccctctcctattcccctgttcccactggtcttcactt

SEQ ID NO: 32353 - DNA, 1102 bp, Mus musculus
tggcagtcagcactcaggaggcagaggcagatggatctctgtgagttcatggacagtctggtctacagagcaagttccaggacaaccagggctaagagagaacccctatcttgaaaaaccaacacacacacacacacacacacacacacacactgttacactatgtgtgggtatctgtgggtatgtgcatgagaatgcagatacccaaggagacctgcaggaggtgtcaggtcacttggctctagattacatgcagctgtgagggtgcttggagccaaaccaggttctctgcaagaacagttaccggtgaccctgggtttcctgcctattcttccacgggctgtcaagttgtatagtgtagtgactttgtctttttgggtcacctgattccctgggacagtggtggtcacaggagacacctgtggtcgtctgttggtcacatgcactggtgggcaaagtgggaaaacaagtctgccctgtggtgttggcgcaggggaagttataccacttgtctcttacaggtctcagcctgggatgaccgcatagctgaaggcacatttcctgggaagatctgacctggctccgcccacctctcctctgttctttgtctttctccccggatagaaaagggggacctcagcatatgatggtccttaccctgggaccctgaatcatgatgcaactactaataaaaactcactggaaaagtttcacattgtgtgtattacacagctggacaagaaggccgggtacccggcccagaaggggcctcacggtggttatctttcttgtttttaaaatgaagggtagatttctttgtaaagatttattattgtgtgtgtgtgtgtgtgtgtgtgtgtgtgcacgcacttgtgtgagtgtgcctgaagggaccagaagagagttgggcttgagctcagggaaccaaaccccagtcctctgcaagaacagcaagtgtttggctgctttatgtgcatgtgtacagtgtggcagctcacaacgggtataactccaaccccaagatatctgatgccctcttccagcttctgcaagcactgcacacacatggaactaaacaagggtcctctggaggaacagccag

SEQ ID NO: 32354 - DNA, 1207 bp, Mus musculus
ttaggcaatcccacaatgcatttaggcatattctgagcaaagtttgagttcattggacctcagatgagtgtgtgacgccagaaaactagccggtgacaccagaaaatccttgcagtgtttttgctggtgatggatgaagcattatcactgggtgctgtgtgaccttggaaagtcatttagacaccctgtcccttgtgtagacaacagaggtagcaatatcttttagagtggccatggggtaggtatgtatagagtacacatagtatgtgctgtgcacacagtgagcgttaactggaatttaaggatgaagattggttttgccaaggagacctctgtccaaccctactgtggcttctgtactcagatatatgggttttccctgcccttcatctttctgtgtttgtgaagaagggggagataatggtttattcacattcagcctgttattctgctctggcctgacatccccacacccagcacctccagaatggttgccaacattcccactctgtttgcatccaggagtcaggatggctgaagacatcaagactaaaatcaagaactacaaaactgccccctttgacagccgcttccccaaccagaaccagactaagaactgttggcagaactacctgggtaagcagagtaccatagtgggcctgcctgggtctcccatgtacctccaacctcagaaaggaagttggggagcagggacatgtgcgttccagcctggtttccttcactctggacgtaccctctggagggcccgacccctcaaactagctctccaggtcataaactttggtctcaacaataaattttttgaagaatataattatacatgtatatatgaattacatatacatcttatgtgtgtgccacatacacacacaacatacaagtaaatacagtatgtaaacagttgattcaggggctggtgagatggctcagcaggtaagagcactgactgctcttccgaaggtcctgagttcaaatcccagcaaccacatggtggcttaacagccacccgtaatgatatctgacgccctcttctggtgcatctgaggacagctacagtgtacttgatatattaataaataaatctttaaaaaaaaagttgattcagacatagtcacaatccatggataaaaatgaatattgccagtactctgctctcagcttgctttgggcccggtcttaaacactg

SEQ ID NO: 32355 - DNA, 1156 bp, Mus musculus
aagttgaacaagggaagggcaaggaagagtgcaggagtcggttcacctggtccccgtgtttactcgagcctctacctgacccacaggaattcatgaaggccagtgtggatgtggcagacctgataggcctaaaccttgtcatgtctcggaatgcaggcaagggggagtacaagattatggttgctgccctgggctgggccactgctgaactcattatgtcccggtgtgtggagcaaactggagcccagacttccgggaatggacagctgggtcccacaggggtgctgaggggaggtgatcagaggctgggtgctgggggtgggggagtctgggtactagagactgcctccttttgccttcctcagatgcatccccctctgggtgggagcccgaggcattgaatttgactggaaatatatccagatgagcattgactccaacatcagtctggtatgcagtctagccctagcctacctttatgttgttagccatacttctcccaaaaacttggctccaacttcccagtcccttcctgcctccctgcaggtccactacatcgttgcatcagctcaggtctggatgataacacgctatgacctgtaccacaccttccggcctgctgttctcctcctgatgttccttagtgtctacaaggcctttgtcatggagtgagctgggtggggtatgaggctgggttcaaatgggggtgtgttttctctctccttttcctcattgtgatgtttccccacaggaccttcgtccacctcttctccttgggtagttggacagcactgctcgcccgggcagtagtaacaggactgctggccctcagcaccttggccctgtatgttgctgttgtcaatgtacactcctagcttgacatctcaggtgttggcgaaccttttcatttcctctctccagatttcagtgaagtaaacagtgtttggaaaggtttttgttatgtccatctctctctctcagaaaccgaatcctcggacttaggtctcacagagtctgtctggcttcagaaccagataaataagctggaatgttggccagtcttcctggtttccccatgagaacctgggggcttggtaatcattgaacaagctaaggaatgaacacactagagttcaggagggggctttggggtaga

SEQ ID NO: 32356 - DNA, 1161 bp, Mus musculus
gacaggatctatacaggaaacctgggaaacagaagaccgagcctcagctaaaaaggctcagctgtgtcagactcaagttatctatttgagatacaccattcgaggtggaaaacagtggctaaaagaagccagaaaaagactgtaattacaccaaggcaagtaagagaatttttgggtaccgctggcttctacagactctagatacctgggttggtgaccttagctgcccgttgtacccactaaccaaggaaggggaagtgtttgtgtggaccccagatcaccagaaagcttttagagaaatgaaaaaggccctactgatggccagcctttgcctgacctaaccaagcctttcactctttatgtggaagagagatcaggagtcaccagaggtgtccttactcagactttgggactttgaaaaaggccagtggcttacctatccaagaagttagaccctgttgccagtgggtggtttcttgcctgaaagctattgctgccatagctctgcttgtcaaggatgctgataagctcactctgggacagcaaatagctatagtggcaccccacactcttgaaagcattatctgaaagccccctgactgatggatgacgaccaacactcctgtgacacattatcagagcttttttttgactggacgagtgatctttgctccacctgctgtcctcaatctctctaccctactgcccaagactttacctactcatcactgcgctgacgttctggcagaagaaactggtacttgaaatgatctgaaggatcagatcagccttgtcctgagagtttgagctggtacacggatggcagtagccttgcggttgaaggactgagatggccaatgtgatagtcaagaagatcctagaagaagtcttcccaaggtaatggacttgcctttgttgcccaggtaaatcagggactggccaagatattgggaattgattagaagttacattgtgcatacaggctccaaagctcaggacaggtagaaaagatgaatagaattctaaaagagactggtgcagacttggtgctccttccccatgcccatcactgtcttaaatcatgtgtttaaacctacatgttgctgtaataataatctgtatgctaagttaaaaggcttgcaggtggtacagaaagaaggc

SEQ ID NO: 32357 - DNA, 1186 bp, Mus musculus
tcacagtagcacctttaacaacgtcaggaaatttatccatgctaagtatacaaccaatctttaaaaataaatttgcaaatatgtactctattttcacagccccagaaaaatcccttctgtttcttacaccattatctctctatctcccaattactaatctactttctgttttaaaatattttcctattctggacatttcatgcaaatgaaactgtgtgagacagagcctgctatgcctagcttgcttcacttagcacacattttagggttcatccatgtggtgtgcttgggtagttcacccctgattatgccattatcccgatgcatctgtctgttgaggggtcatttccgcctgtgagccaaggtcactaggtctgggatgaggatgacgcatgagccagtgtttgagaatgtgcgcgtgttcaagcctcttcaataaatattcatagcagaattattggtattgtgtaaatgtatgttcaactttttagttgaaccgaattgatttccaaagtgctatcccatggtgcgttcccctcagccatcaacaaacactgcgctgtccctccatctttgccggaacttggttccgactagtgttctgctgacagccattctggtgtgcgcttgttggtttggtgctctgttccataagtatgtgagcaaatgggtatgctatctttgaagataaacagagccagatgcaaaacatgttcccccaccctaccccaccgaagggatgcctaagaaggaaggggacctggagagccacctccctgtcatgagcgaaaggatggtagacataaaacagtggtaccctgagggcctgttgtggattatgcccccattgaaagataactgctgtcactattatctgcaccagcaccagcaccttcaccaccatcatcccagatcttttcctgcaccacaaggacccctgcaggaagagaggcagactctactttatatacttagcatgcttcgttttatttgggacagggtttcatttagcccaggttagcctcaaactgtgtgtagctaggagttgatggtgaccctgaactcctgatcttcctccctaacgtctgggttacaggtatgcaccaccacacacacctgctctctgtgctggggctggaactcagggcttcaggcaggatcggcaagtgctctaccaactgagccc

SEQ ID NO: 32358 - DNA, 1220 bp, Mus musculus
tgttgaccatgcagttataatttccagaatcttctggggagacggagccgaagctcaggtacctcccttcctgcacgagactcccattcttcttccagaagaagcggacctctgccgggttgctctctgcgaagtcgcattggaggaggacacgctgcccagcgcggatctctgatgcggggcttaccttcagtaccttcacgtctctgggggcgtctgcagggccacagcctcaggtgatgttttggttttcttcccttcttgatgtccccaaagtttcctgtccccttgattaggacaccctgtctccttggcgctgagccctgtgcgtcctccctcaaccctctcttttggcctgtggcccgagtccccatcccctcccctcactctcccacccacagatctcaatgtgacctcctcctgggcaccccatatcactcacagtggacattcaggatgacagggagggcccacgaacacttgtggttgcaggcagcacagctgacaggcatggaatcccatgtcactttctgaatcctcagcactccgggtttgagcacactcccagaaccttgagggttccatctgtaggaggtgacgtctggattgctggagttgtacctacagaccagggtcacactgtctccttccaggattggtgtgaagctctgaatcactgtggtcaccgccttgggagcatcttagggtagaatggagaggcaagcaaagatggagaggcaagcaaagaatgatttcttttctttccctttgcaagcaccagacaccacacgtgaggtcttacatgggctaggcaagagttctaccactgaatgaactatatcactagccctaacctatttctctttctttctttctttctttctttctttctttctttctttctttctttctttctttctttctttctttctctctctctctctctctctctctctctctctctctctttctttctttctttctttttttctttttctttttttttttccaagatagggtttctctgtgtagccctggctgtcctggaactcactttgtagaccaggctggcctcgaactcagaaatccacctgcctctgcctcccgagtgctgggattaaaggtgtgtgccaccacacccggctccctatttttcttttttaaccttttatttttgagtcacagtcttcttaatttgcacaggtcagccttgaacttga

SEQ ID NO: 32359 - DNA, 1833 bp, Mus musculus
tgcaggagaccttcaaggaggcagagcggctgcagatggacaatgagctcctcaggcagcaggtgggtacaggcctggaatccacgggggcccagtgtgccaaggcctaaccctggctcccgtgtcccccatggtgcctgcagatcgaggagctgaagaatgagaatgccctgcttcgagcccagctacagcagcacaacctggaaatggtgggcgagagtacccggcagtgatgcccgccggctcacccttcagctgctgtcggcctctgctgcccctcccccagcccttagcacagagagggagatgcccctccccaagctgcgtttttttatagtagatttttaacaaaaacaaggagacataatgcatttctgttgatacgttgcccactaccctcctccatgcgaaaacgatgcccacctgcccatctgtccatcagcctcccttctcggtcctcaccagcccatcacttatagtgggctcatcaggaggagcaggggaggaggacagaggccccgctgcccgctgcctccttggtctctagaggtattgagacagggtgctcatgggaaggagggagctttggggatgcgggccttccctggggcttggacctttgcagggaggccatgcccgccacccctcttgttctggatccctgctcccctctgggtgtgtgggtgtgtgtgtacgtttgggtgtgtgtgtatgcgcgtgtgtgcgtgtgtgtgttttaattttctttatggaaaatggacaaaaaatagagagagaggtatttaactgcaataaactggccagtgtggccccgccttgtctgtctgtgtgtccatgttgggcatggggttgggtagggttcctagggtctccctgatatctaagctacagttatactgtagctgtgtgacaatggctgggggcattaactgaggccctggggtgctgattaggggtgtgggagctgaggtcaaggacatacccctgctgttagaggggaggctggagtatccctgggctctggggctgaagccctccctctgtaccagccaatgatgagggctggccttgagccccccacccccaagagagggcagatggccagaaagccaggcttggcccggcagtctgtcgcctcaaattgtagctctggcgcctgtgctgtgacccttgtggcccttggctgatgatgaaacctgtcctgagaagccacagtgatggttggcggggtcggggaataccatcatgtccccaagagattggctcaccattcccaggatggaggcctgcgcgtcaggttccctttgctacactttgtaccttgcctcaatctaagtactcctgttggcccctggtgtcttgagaaccctgtctcgagctggagagatggctcatcagttaagagcacctgctgctcttccataggtcctgagttcaattcccagcaaccacatgatggctcacaaacctctgtaatgggatccgatgccctctttagtgtgtctgaagacatcgaccgtgtactcatataaattaagtaaataaaacttaaaaaaaaaaatgaaccctgtctttggccttaccacttccaaaagtcctctttgaggaagcatgtggaacacatgaacagcccaatgagcagcaacagaggggtagaagccttcccaggttctggacagaactgactggatgctccctgtgtaactcaggaatgccgtccagtagtttatctctggagtcaaagtttgataatatctcaggctgctcataccaaggggtccaggtaatagaaagagcaccacacaggctttagtagtactccaagaactagct

SEQ ID NO: 32360 - DNA, 1100 bp, Mus musculus
gctgtgtaaggtctggtcagagttttgcacaggcgttggatagggtcttttggagttacttttcattgcaaaactggaaaacttcttagaggaaagagtagagctaatgatggttgaatggtgtcagagacgagattctgtacagaatggcacacacagtaggctacgcccttgcctcaccgtatagtaaacaaacaccgataccagtaacaaagatggcatagcaggggtggctaaggatggcctatgtgtactcctccctaggctgtaattcaaaatccattcagcaatggtggcagcccggcggccgaagctgtcagcggggaggcacgatttgcttattttccagcatccagtgtgggcgataccacagctgtgtctgttcaaactacagaccagagcctacaggccggaggtaaggggaaggaagggttctgaggtaaagctagggaaaccatttaagcagttccagcttgacccattactgatgttcgctgcacattccctgcaggccagttctatgtcatgatgacaccccaggatgtgcttcagacaggcacacagaggacaattgcaccccggacacacccctattctccgtatgtgccagtcccattgttggagccagagggaagggagggtttcagggctggtcagcatacagcaggagtggggtatgggttttatgagcttctgcttcggaagtatcagtttaaatttttttcatctatttccaccctctcttcacggggatttgctttgaaagataactgtgaagagctaacccaatggtagcctagcattctgcgaagccctgggttcaatccccagtaccttaaaaacaaaggtgtttgtcaagtctgatagcttggtaaatgctgtcgtttccccttctgctttaggaaaattgatggaaccagaactcctcgagatgagagaagaagagctcagcacaatgaaggtaaggatggcggagtgctcctgggtgccttgagcccattgcctgacatgtccagatgctggagacgtgcatgctgagtggttaggtcagtgctgattggcggaggacggcaagatgttgggaaagatggagggcgtgc

SEQ ID NO: 32361 - DNA, 1102 bp, Mus musculus
tgccccttgccgcctccgccctgccccgccccgacgtgcgcatgcgccttcgggagcgcgcgagcgcgcaacccggctccccaacctccgggctcctatacgacctacttttacagtcttcaaaccctgtgccccggcgatctgagccccgcatccgtgttgccggccttccagccgggcctgcgttccaaccggtggtggtcccgtgtagagtccccgggcctatgtgtgtgtacgcgcccggccgtcaccaaagacagacagcgcgcgcgttccctagggcctgccctctcccgcgcgcgcgcgcgcgcccgcccgccccgggatcgcgccgtcgccgccaccgcgcgcgcgcagctccagtaaaggaggaaaaaaaaaaaaaaaaggaaaaagagaaggggggggggtgatagaaagcggcggcagctgcagccacaatccgccgccgccggaccgggctaggccgggcggcgggcgcgggagctggcgatctgggcaacagggcggccgccatccgggcagggccctgttgaaaaaaaaaaaaaaaaaaaaagctcaagtcgcggcggcggcggcggcgagcgctcagggaagcaggccccaggccgcgtgcggcgggccggcgggcggggggcagctgagctgtggcccggagcctcgcaccgcccggagccggcggcgggcggaggcggcaggaggaggcggcagctgcaggagtagcggcggcggcggcggcggcggcggcggcatctcctcctcacatgaccccactgtttgtccccgtgatcagcgcaagcggctcccgtgtctcctccgtcccctcctgccgcgcggcgtgagcgccgggctcgggcccccccggccgcccgccccctcccctccctcccctcccctcccccccgccccccccatggacatgctggacccgggtctggatcccgcttcctcggccaccgctgctgccgccgccaggtaagcgcgccgacagctcgcgcccctccgcgcgccctgggccccggcccctcgagccccgcgcgcaggggccgccatgatcccgagcggcctctgggcccggctcaaaatggaggccgcggggagg

SEQ ID NO: 32362 - DNA, 1160 bp, Mus musculus
gttgaccatatggcttgtggcagagatggtgtactgctacaagaagattgctgctgctacggaggctgctgcacaagagaacgcgtgagtggggctggtagggagggctggggccatttaggtgccatctgtcgttcagagtatctgtgtcagaggcaaatagtgtagttgctcgcagatgaggaaaacggaaacccagagaacaagagggtggcactgctgccaggcagcaaagccgcaactcgaacccaagccttctggttggcagagttacagcttgtcggtcctgggcctccacagattcctgaatgtcccataggtaccctgtagttagaggcctctcattcagactcggggcgggggggggggagcccagtccacagccctctctaatctcgggggcccgggggcctaaggcagggactctagtctatcccattctattcagggttgggcccggagggtcactgtctgcctttccttcccttgcacagctcagaatacctggccattacatccgagagcaaagaaaactgtacaggcgtccaggtggctgaatagcgctggtaaggttgatggaccgacgggtctgcgcatcgccagccaggagggctcagggacacactcttaagtctccacttcttaccctgcaggctctgggctccgcctcatggaagagccagcccctacgggtaccctcccgccctgcagtggggatcagcccctggtgggtaccctcccccggcagtggggatcagcccttcggtctccccagcctcacagttctgcagtggagccacgagggtgggagcgggcagggactgatcccacctcacccaccgcctcccacctaccctcccaccgccatgcatgatgggtgaagcaatatggccgccccaccctgcttttgctgcctgtttgggggagggggcggtgaggcgagggggcaggccccgccccttctttttgctgatttgcacataggccacttcccacacgcactgccaggccagccggccccacccctgcttgatggggtcaagaggggtcgggacagggacagtagtgggcaggaggttctgggcctcatctcccctccgcttcctccggctggacctggggttcccttcctgtgacacctcctagccctggcccacccg

SEQ ID NO: 32363 - DNA, 1169 bp, Mus musculus
acagggctgttctacctcagaatgctgaggcaggacaaccaaaagttcagtcccagtctagactactgagtttaaagccaatctgtacagcttagtgagagaccccgcctcaaaataaaaagtaaaagggggtctgggacgtggctcagtggtagagcccctgcctagaaccccccagtgaggggctggaggtgtggctcagtggtaaaatatccactaagcgtataccaggttctaggttcaattcccactcagcaaaaaaggaaaaaaaaattgcagagcaaagaagaacaagggcaatgtggacagggagaccggcatgaactaaagattatatgggggagacatatttgaagaaacttcctgggggagcagagatggcctagtgggtaaatatgcttcactaaacccagccacccatgttgtattcctgggatccacacggtagaggggaccaattgctgaagaagttcctgaaagagaaaatagaccacttgtactccaaagtagatctgtgtactgaagttagaatccttcccagaaaccgctgtgcctcccactgtaaaactggacagtcctgggcccaggcacacagtgtttttgagcagcgataaaatcaatcactcggagtgtttgacagaatcctgataagaagtcaacaaagatgtcctttaaagtccctgcctctcatccccgccgcccttatggctgtcggtgtttgcacagttaccagaatgttctgtttgcttaacgtccacctctggcaggatgttaactcgccagatccaagacttcaggtctctgttagtgctgggcgcagccagatcagggccattcattcagtcccacggtgtttataagcattaattatgggccctgtctctaggtgctaaggataccgacagcaaccaagacttcctccagttcacagtttagggcaggcaataaagaaactgtgtaaacaaatgaacagggtgagtggagatagtgtgggtgagtcaggaggagggagggagctctttagggctgagggacgatggaggaggagggctgaggatggagtccgttatgctgaagctgtgggtgggcttgttagatggaggggaccacagatgcagggtgtgaccctaggagcttagagaacaagaggaggctggaatgactgggac

SEQ ID NO: 32364 - DNA, 1180 bp, Mus musculus
gaatgcatgtctgggtcactgggtcccatgactaggtgccgtgtgaatagttttgttgtgggtttcgctgtttgttttgctcttcagtgtaaaactttctcgtggttgtgtataggacgctgatttatgtggacttactgtgtttctctgattctgggatgctgtgcgactgtagcatatttgtagcgagcgtgcatgtgtgtgtgtgtgtgtgtgtgtgtgtgtgtgtgtgtgtgtgtgtaaaacgttcctggcagttgtgtatgaatttgacacacttacaatgctgtggttgtttatgcttgtgacacttctgtacgtgtgaacggcagagagacaggtgggagagacttcgttcacctgcaggccagtttgcctgggaccctctgtgtccccagccatctttccctttcccacacacctgtgtgtgctcttgcccctctgtgctgaggccgatcctgaggcccaggacgcagagcatctgcacagtgaaaacgccattctcttccgagtctccgccccttaacggtcctcctctcgccactctgacccctcccttcactctctcaggactggctggctggctggctggctggctggctggctggctggctttggccaccctagggctctgctacccgcccttgagaacttcctctttgtctcttccaagagcaagagggatgaacttggcttgtctgtgccttcagcctgccattgagtggacctggggcttcagaatcaatcaggcccgaatcttagcccagaggtgagaagagaccacaggaacccccggggccttctgctctctagaaacgtgcagggtggcccagggtcctcagttctgctggtcgcttgctgttctcagacctgccagcctccttcctggccctgaacttgacgctttgagagagtccagcactgtctcccccacatttcgccagctctgttctttgtccccagcccttggcctcagtaagcctggcccagctaagccctttgcagtcagtctggctcacttaagaaaccctctctgctcctaattattctgtcagaattcaatgtgcatcagattttaagttgaggtttctgatgccggtgggggtggagatttacatttgagttttgtttctcttttgttttgtggcagtcctggtgatggactccaaggctttgtaca

SEQ ID NO: 32365 - DNA, 1183 bp, Mus musculus
atggggattgcattgaatctatagattgcttttggcaagatagccatttttacaatgttgatcctgccaatccatgagcatgggagatctttccaccttcggagatcttctttaatttctttcttcagagacttgaagtttttatcatacagatctttcacttctttagttagagtcactccgagatattttatattatttgtgactattgagaagggtgttgtttccctaatttctttctcagcctgtttattctttgtgtagagaaaggccattgacttgtttgagttaattttatatccagctacttcaccgaagctgtttatcaggtttaggagttctctggtggaatttttagggtcacttatatatactatcatatcatctgcaaaaagtgatattttgacttcctcctttccaatttgtatccccttgatctccttttgttgtcgaattgctctggctaatacttcaagtactatgttgaaaaggtagggataaagtgggcagccttgtctagtccctgattttagtgggattgcttccagcttctctccatttactttgatgttggctcctggtttgctgtagattgctttatcatgtttaggtatgggccttgaattcctgatctttccagaacttttatcatgaatgggtgttggatcttgtcaaatgctttttctgcatctaacgagatgatcatgtggtttttgtctttgagtttgtttatatagtggattacattgatggattttggtatattaaaccatccctgcatccctggaataaaacctacttggtcaggatggatgattgctttaatgtgttcttagattcggttagcgagaattttattgaggatttttgcatcgatattcataagagaaattggtctgaagttctctatctttgttggatctttctgtggtttaggtatcagagtaatagtggcttcataaaatgagttgggtagagtactttctacttctatcttgtgaaaaagtttgtgcagaactggaattagatcttctttgaaggtctgatagaactctgcactaaatctgtctggtcctgggctttttttggctgggagactatttataactgcttcaatttctttaggggatatgggactgtttagaaggtcaacttgatcctgattcaactttggtacctgtta

SEQ ID NO: 32366 - DNA, 1593 bp, Mus musculus
gagagagagagagagagagaaagtatccatgcctctgtgtagagaacagagtcagatctggagctggtgagagtctggattgttctatgagtaaaagccatgagctattgtgttcatggttgtggagcaagttcttagtgctgagctaaggttccagcaaccacctacccccacacaccttgttaaaaaccatagcttgtgaagctggacaatgtggtgccacctttaatcccagcactcaggaggcagaggcagaggtaagtggatctctgtgaattggaggtcagctaggctcctccaatacagtgaattccagtacagacaggtatagagagatcctgtttcaaaaacaaaaaacctgcaatagctcattaggctgagcccacagttactacccatccctgccctttccctgagactggacttggcgcagccgccatacctgccccaaccccattgtctctttggtgaggatgcccttcctcctgcttgctggggttcagagttgtgtttttcctttctcaggactgtgggctgcagctgagtggggaggagggacgccgctgctatcccctggaggggcacctgctctgccggcgatgccacctgaggcgccttgggcagggcccgctcccctcgcctgctgtgcatgtgactgagctctgagaagcagcggtcacagagaggagaggagtggcccacgctcctccccacccgcaggggccggacccccgcaacaaagaagcgatttctatttattcaccttctgtgcctcaagtcacttcccctgctggattccaggacactcgcacagtagactaccttcctccgaccggtctcagctcccatggcagggattggagggtcttggagctggtgggggacaggtgccttatttgtgtgcgaccacagagccagggagtatcaacatcctgggaaataccacgatttggccttgatgggtattttcagctgcagttctcctcctctctggatcctggcttggggtgcttttccagcatccacagtctcagaagacccaggagcagaggggggtggggctcatgagggggctcccttacagaccctgccagcgaacatctgtgcacactatatcaggctccactaccaaagcgtatgatttgacttaaattaagttttttcccttctggaggatgtttgcattttctttaaaagaatatagttttcttctaaaaacttggaccatggtggttatttctcattcacagcagacttgctcatggaaacacattcgtataccgtgtagttagtgttatgaaatataattggcagggagtggggtgggtggagtgcctggtgggctcatgccaagggccccctgagaaatcacgccatgtaacagatctggtataatggggtttattcaggggaagggaggggagtgagagcctagagaaggggtagaggcagaggagtgaagacatagacagatgggaacaaagccatgagggcagagaagggcagaaagggagcgactggtgggaactgttagctgtcgctagctgttaactgttgctttgttcattttcattttttctaaacattattaaa

SEQ ID NO: 32367 - DNA, 1201 bp, Mus musculus
ggtttagttcgttatcatcatgggggaagcgtggcagtgtccagggagacactgtgctggaggagccaagagttctacatcttgatccaaatgtactgggtggagcctgagcataggagccctcaaagtccacctacacagtgacacacttcctccaacaaggccacatctactccctgtggccacatattcaaaaacatgaatgaatctatggggccaccgagctactaagtcttaggatctgatttcaatccttaggacccacgtggaggaagagacaactgatttttacaagttgtcctctgacctacacaggcatgccatggcatacccacactcagacaaatagcacatatgccggaaaaaaaaaggtcaaagttcccaaagagacccattgaggatataccccccaaagacgcacaaatctcttcagtggatcaaccacttcctccatggacaagagactaagcctccttttttctttggtttttgaaatagggtctcattgtgtggcccttcttgtcttagaactcccttgtatctgcactgggacacacatcatgagtgtgctgttagtactctattgctgagctagatttccagcctttggattattttgatagcccaggctggactccaacccagtctcctacttcagcctcctggggtcacagtctgatatgtgctggggattttgtcctttgagacaccgatcttgctataaagcaatggctggcctggaacttgaaattttctttttttcaagacaggtttttttctgtgtagccctggctgtcctagaactcactctgtagaccaggctggcctcgaactcagaaatctgcctgcctctgcctcccaagtgctgggattaaaggtgtgcgctaccactgcccctgctcataaagatttatttattatatataagtacactgtctctgtcttcagacaccagaagagggcatcagatcccattacacatgattgtgagccaccatgtgattgctgggatttgaactcaggacctctggaagaacagtcagtgttcttaaccactgagccatctctccagccgtggaactcaaatttctgcttctgtttctgccactgaagtgctgggattacagatgtgctaccacacctgttagctgttgctttgttcattttttcctaataaaaaagagtttaaaggtgtgtgtgt

SEQ ID NO: 32368 - DNA, 1567 bp, Mus musculus
agggacaggtggtagaggtgtgggggaggggaccttcctgtatttgctgtacaccagcagttttgttgactcttctagtttcttctgaaatacttgtttctgtttaagagggggtgtcttctaggcaaggctgtcctccagtgtggctttgtagcctagagtgtcattgaacttcaggttcctcctgcctccatatccccagtgctgagactataggcatgcgcctccacatccaactttatcatttgggtttttcaaggcagatcctaggctgtagcttaggttgacctcagacttctgggtcctactgtgagctttgggatgctggttcacaggtgtgagccaccattgtggtttggaacgtttataacagcagcatagtactacacaggtgtttagagacgttccctttcatgctggtcagagatgagtactgagatccaagctgggctttgtccctggttgcagcatttcactctttaccttccagggagacggctccgtgggaaggccttctataacgtgggtgagaaagtgtactgccaggaggacttcctggtgagtctccactgtgctgcttgccaagctgggtgggagcagggcgggaacctccttcggactcacatgcagacctgaggccagcgacagtgagtgcccctttgtcacgtgacgtcctggatcctgtgtcccctctcagtactccgggttccagcaaacagctgacaagtgtagcgtgtgtggacacctcatcatggagatggtgagaacctcttctgtctcctggagtcccctacctctttcctgttccagactcagtagggccctgagccataaccccttgggggcagtgctgagtgtctcacctgcagtgaccttttgacgcctccccagattctgcaggcccttggcaagtcctaccacccaggctgcttccgctgctcagtgtgcaacgagtgcttggatggggttcccttcactgtggatgtggacaacaacatttactgcgttagagactatcatacgtgagtttcccctgctggagcagtgtgtcccgcagcatggccccccccccccccccccgcctctctggttctttttatttttatctcttttaagatttattcatttgttttatgtatatgagtatactttagatgtacacatggttgtgagctttcatgtggttgttgggaactgaactttaggacttctgcctaactctgtcaactctatccccactcactcagcccctgcttgctccggcccaaagatttatttattatcattaataagtacagtattgctgtcttcagacacaacagaagagggtgtcagatttcattacaggtggttgtgagctaccatgtggttgctggcctctctggttcttgctttttattttttcatctgcttttctgtgttttctcagctgttggggtaggtgtattagtgacttttcctatgtggtaacagagtccttcctagaacagtgtgaggaggagaggtttcagaagacagacagtccatcacgataggcaagacctggtgttgaaggcacggtgttggg

SEQ ID NO: 32369 - DNA, 1178 bp, Mus musculus
ctagactttgctagaatccttacactgtgttttgaaactgccagaattcccacgttggtgtcacatccatgtggcacaaagcaggcagcatcaggctgtgttcctttagcagagggccagggaggaatatggggagggaggatgtgggctcggggctcagcctgggggtggggggggaatctggaatgtgccctgaggcctcggggtggaccagagcctgggccaccgctgtcccgcccgcgtcctcgcgaagtctgcgcacccctcggccgggccgtcgccgcccccccccacattccagaggccgctgcgcagtctccttcctcacattcctgacggggcaaaggagtccctccgtccccccgccccctgcgcgcggtctcgaagcggagggggcgcggccccgagctgcgcgcgcattcctccgccgcgcgcctccgttcctccctccctccccgccacggccccgcgcgagagtgcggcccacgccgagcgaccgcgacccgggccccgccccgccccgcgcccaggggtcccggggcgggctgcgggccggcggacgatgcggcggcgctgccggagcggcggcggcgggcggcggaggcggaggtgacgcgccgcggcgggccgacggccatgcagcgctcgcggacggccgcggacgacgcggctctgctcctggccgggctgggcctgcgcgagtcggagccgaccgccggctccccagggcgcgtgcggcgcgggccgagggccgtggacgaggcggcgccagcgtcgggccgccgaggcaagggtggctgcggcggccccgaggccgcgcccgacgtcccgagccgccccgagcgaggcccgcgcgccagcctcgcgggctcggacggcggcagcgcgcgctcgagcggtatcagcctgggctatgaccagcgccacggccccggccccgggccgccgtcggggggcagcgcgcgctccagcgtgtccagcctgggttcccgtggctcagcgggcgcctgtgcagacctgctgccgcccggcgtcggcccggcgcccgcccgctctccggagcctgcccagttccccttcccgttgccgtcgctgccgctgcccccgggccgggagggcggcccgagtgcggccgagcggcggctggaggcgctcacgcgggaactggagcgcgcgct

SEQ ID NO: 32370 - DNA, 1415 bp, Mus musculus
ttcctctattagggtgcccctccccttttcagcggggactctctcaggaggcatgatgatgcatttgaattatatgctagtcattatttttttgttttgcttgaaaaaaataggcaaattgccctgggtcagtttggctccccagtaacaaccttctcctaagagtagatgtgcttggtacagcaaacaccagacagcttccctgagggtggccagggaggggggctgggattctgctgtgtgaggccttggtgagccattgacatctccctcacatcactgttctttgctttgttttccaaaataagcacaagagcaagatgatgtgctcatagttgattcagacgaagaaggcccttcaaatagcaccgactgcagcggggacgacaaggcccgcaagcggaagctggaagagaatgaggctgccagtaccaagaagtgccgcttggagcagatggaagatccagatgacgtcatagcgttagactgagcaggctcctgcccttggtctggtcggaaccaaaagttagatcctttgtgtggctttgatggttccgttcagcgttcatttgctgagactgttcgagactgttgctgtgttgaagtaggaatagaatttgcaaccctttgagcaaagctgggtgatgagctgaaagaacgcgggcgtgcatgttgccttccctgtaaatagccttagctatcatttcctagtggaaaacactgtggggtaggaacgctgcaacctgggtataaatattatgcctttatttttggctagagaaaagttatttttagcctagatctaaccattttcatactcttacctgaaagattcacagaagtgtcaagtgctatgcattgaaacttgttttttaaacattacctggcactgtgtatattaatgtaaaacaatgttaatttacccagattttcagtttgtactgcctggtatgtctgtgtaagaagccaatttttgtgtatttgttacagtttcaagttatttatatttgatgttttgtaaactcaaacaacaaatatactgtacttatggaccaaataaatgatgtctgcatacttgtcatctgcctctgttgccctagtgggtttgtgtctgccacaggctgagtgctagctctgggctgtggagctgtgaggttggtaaagtgcttgccatgcatgtatgggagtctgagtttggtctctagctcacaggttaaaaaaataagctgggcacgtcacgccagcactggagaggcaggcagggaagttctgaggctcacggccagcctagcctactctgtagtctccaggcccgtaagtgaccctgtcttacaaaacaagatagatgtcttctgagaaataccacccagggttggccttcggacacatacaggtaacagaagtcttccctcccc

SEQ ID NO: 32371 - DNA, 1141 bp, Mus musculus
tacttgtgaaaaaaagcagcaggaaaggacaaagtggtcaagtgtctgagaaatagcacagttggggtatgcgtttgtgtctgtctttctcaccctatgttttaactctcagcacagaactgcctttaaaaatgtgcatcctctgttcaccttgacaaataacatttgatgtacactttggaactcatgtatgagagtagggagttgtctataaagctagggaaagccagaaaccacataaccctatccccagaacaccaaggtcgggtcagatctttgggcagagcagctggaaaaaaaacatagagacttgctgggctgcaggacttatgcctcagtctcttagtgagcaagatgtaaagaaaactcagcctctatcacttgagttagagaagcattgctctggtcttttcttgagagtgttctggaagtcagaaccttccaggggtcacattgtgcattctgagctgtgaggatgtccctgctcctttactatgaaatgcacagctcagtctgtttatagtctctgtttctcttttagtgaagatcttggaaaggatgttgaatttgaagtagttggtgacagccctgaaaaagtggggccaaaacaagctgaagatgctgccaaaagcattgccaacggcagcgatgacggtgcccagccttccacctccacaggtaagtcacctccacgccagagacttgaacaagttggcactctgatggacactgaatgtaaaataccaaggctgagttagtttggaatttggaattaattgtataatggggctttcagttttatgagtcatgaagacctttatgacccctggggtattgggagtggttttctgaatctccaacagcaagctgtgggctaattcctggtccatggtctgtcccgcgtaagctgcctgcttaagctgcttatttgtaggccataaactgtgcatctggctctttgagcaggtgcttccagggtgggtatgggcttccaggaaggcaggtgcctaagtaaagcccacctgagaatgttcccagaggtccttctgacacctgggacctttcagatacccgatcttttgctgctccctgtttggaccagtatctcccctgcgttcccctctgttttgtgcaggaaact

SEQ ID NO: 32372 - DNA, 1177 bp, Mus musculus
ttctaagccctttattcttggtgtatactgtttgttgtctgctgattgtttcctgagcaggctatttgtgattgggacgcctggttactgttcaagctaagcctcatttctgttggttttcataattacagaacccttagctctccttagcctccctaggatctcttactatttatacatctaagatgttccctaaccccacccccaaaacaaaaagggcagcagtggagcacaagcctctgaacgcattgcttacatacagaatattattgagagactggagtttgtatcattgggcttccgactgacctgtggagtggttgtggggttgtggggcctgtgtagccagcagaactgagggtgctatacccctgctccaaatatttgatctttttctgtggtgttagaaattgttattctgcttacatatgctgggcctttaaacctgatttcatggcatagttttagtaaatcaacctaatttgatctgtttttatcaacttgggcactataagataatgggatttgtttatttcagctttttaaagatgatattagatatctgctgacaatggacaaactctggcgcaagaggaaacctccagttccactggactgggctgaagtgcagagtcaaggtaaagaatgtagctagttcctctcgtacctaccccgggagccagccgtcagctgaagtgctgtgtgtctgcatgagggagattgggtgtgactccactcctgcaagaactgctgcccccccccccccaccacccacagacaccccagcaggaccctgctctcataagctgcctgctgtctgtgctttgctttgttttgttttgttttttaactgccattggtaggacatcatggcttcattattcctgaaagtgtcctgatggctgtatgtacagatctgcttttgtacttgtgtgattgtgtgtgatttacttcagaggggctggtgagatggctcagtgggtaagagcacccgactgctcttccgaaggtccagagttcaaatcccagcaaccacatggtggttcacaaccatctgtaacaagatctgacactccctcttctggagtgtctgaagacagctacagtgtacttacatataataaataaataaatctttaaaaaaaaaaaagatttacttcagaaacacaatttaaaa

SEQ ID NO: 32373 - DNA, 1231 bp, Mus musculus
tattgagatatgagaatatttagggtattaacagatcaaaatcttttaattttgattgacatctttaaatacatggctagaaagctcttggttttttgtttttaagatttgtttattatatatacagcagcctgcctgcatttacacctccacaccagaagagggcatcagatctcatcacagatggttgtgagccacccgtggttgctttaaactgaactaaggacctctggaagaacagccagtgctcttaacctctgagccgtctcttcagccctccttatagtagggagtcctggttctgtcttagctatggctgtagtcacaataagaattttgtagtcactaatttaaattttttcttaacaacataaaacccagttgacctggtctacaaagtgagttccaggacagccagggctatacagagaaaccctgtcttgaaaaaaaaccaaaaaaaaaaaaaaaacaaaaaacaaaaacacccaaacccagttgaaattgaatgaagggatggagtgtctaccttatatcatggggtaaccgctttcccatgtcctaatgttatagggtgtgactgagtgttacgaatgtcaccctaagcctacccagaggacgttccctggctgtacgattcggaacacaccttcagaacctatccattgcatcgtatgggccaagtatttgttcaagtaagagttacatatttctggcatatttttcagaactgatcatggaaagtgaggccatttttacttaaatactcttaaaaagttgtgtttacagtggttaaatatggtgaagagacagcagtggctttcctgggtctcactcagacagcattcttagcatgctgtgggcgaaattttagatgtttagtctggtatcggacacaggcatgcaactaagtttgtgcgaatgtatatatttggaaatatgaaaacatacttataaataacccattggttaaacaagaaatcacaatggaagttaaaaatacttaacaggactgtggtgaaactcagtggcatagtacttgcctggtattcctgaggctgtggtttagatctctaaccctgttcaataaccatccacaaccaactctaatgtgtaatgtttgtggaacagctagccaagggtgccttgtaagtatcctggtgttaaattattcttcggcaaggaagcttgtccagctctgctaacacattttcttggaaggtttgggactttg

SEQ ID NO: 32374 - DNA, 1172 bp, Mus musculus
tgggtgtgttatttgcatgtatgtctgcgtaatgtgtgctgccccagtgctcaaagattccaaaagagaaggccagatcccctacactggatttacaggcagttttgagccaacttataggtgctgggaactgaactctgaattttctggctggaacaacaaccagtactcttaactgctaagccatctctctaaccccactttagatcttgtagaagtaccttgagtcatacccagggccatacacataccagacaggctgtactcacagcccagcacttgggaatcattcctagaagtctttttctagagtgaatttgcagtattaattcctcggttgcagttttgttgagtgttcctgtaatgaccaaggctgtagcccactgttgcagccctaacaggcagaagtggtcaagttacattcccatagtcacaatgagcatgtgctgtattgaaagcaagaaatgttcgtaattgtcatctgaacttggtgtcatcaggaactcttgctcaccactgtgttctttcagctgcacgaaaccacgtgaataggatgtgtctggccgctgatgtgcctctcattgagagcgggactgctgggtatctcggacaggtgaccactatcaagaaggtgaagagacactttgattttccacttacttgagacctggcaaggaaagaagctttgggtttgtatagaggacctaggtcagcatctcaggtgtagagatttcatgccagatgagacacgatgatgcttgggtctctgggttcatttagttcagcaaatccctaccctcaagaaagccaaggacaatctaaaggcaaaggaagagagcgattgactctgcatggatttgttaccttaatttatctgttaaaatccttagaccaagctgggcatgatggcagacaactttaatcccagcacttgggaggtagaggcagatggaacactgagttcaagggcagcctggtctacagagtaagcgccaagacagccagggctacgcagagaaaccctgtctcaaaaacaaaaaaaagagggaaaaccaaaactaacaacaacaagtccttagatggactgacataacaaattgtacaaaaattcttagtcatggactttgtgtcatgttgtagatgacagacaataaatcagacttctaaaagtt

SEQ ID NO: 32375 - DNA, 1176 bp, Mus musculus
gccattggactttccattgctctgcatgtaggtgagtgttcctgcgtctcctgcaggaggcagtattgcagcgtgaggttgatgtcatatccatgaataccttgcttagcccacaggctccctgcctctctgcttctgcctacaaacatttatcttttagtactgggagagagaactgtagggttgatattatgctcagggccagctctgaagagagaggctttccttggggcccctcctcctcccaggtcccacttttcctggttccagaagaaactaactaacttccgggaggacacagaggtggcacttcttttttttttttttttttttttttgcctgcgaggggcacctttgctgacgctgcttttgtgtcacaggttttgaccacttcgagcagctgctgtccggggctcactggatggtgagtgctgtgtggcctgagacatgtatgggtcccgccctgccctccctctctccctgccagctgctcagccgccactcaccttgctgttctttcaggaccagcacttcctcaagacgcccctggagaagaatgcccccgtcctgctggctctactgggcatctggtacatcaactgctacggctgtgagacccacgccttgctgccctatgaccagtacatgcaccgctttgctgcctatttccagcaggtaccggccgctgggccgtgctttgggaggtctagtggcaggtccagtgccccaccttgtgcttgtgagtgtggccatagttcatccctgcggctgggttcctggcacatcttgttaaccaagtcctactctatccatgctgccagctggattcacctctatgagaggtgccctgtgtgtcttcctctttggctctctcctgtcattgctgttcttgggtggtgatgtgagctggaactcgtggcccaggtatactttgttcaccaggatggacacgttcggtgaccagagagtttacagctatacctctccctatttgtaagcacatgcaacaagaattagcaccctttggggcccctgaccctgtgtccagccctattgtttggtctaggcatacctacctgctcagtctcccctctccttttccttgcatgtgtgtttgtatgtgtccatgtgagtgaatgccacacgggtgcaaggtgccctggaagccagaggagc

SEQ ID NO: 32376 - DNA, 1228 bp, Mus musculus
caatatgtgtgtctgggtcagtctggaggttggatagaggaggtggggtgccctaagcctgtccactacctgtcctcatcaggcaaggctcagggctgttgcagggacctggggatctgcagccccctagtctgcagtcactagtatatggtatttggccttcctttctctttggttcatagtctgagccatactagggatgcacatggtacaatacgagggcccagaggcttgggtcagactctgcctggaattgctagctagatgaaatctgaccttgttcctctcagccaaggtcagaagctagacttgtcagtcagggctgccaaccattcgattcccgttctaaaactaagtccgttagggaagatcatgtcacacctaacgaggcttgtgagatggttgctgtagcagagctcttcttaaccctggatccttacagatgagtctgcagatcattattgtccagaggtaccttgggccaccttcctcattctttcagtttcacctgtgtgaacttcctgtgttagctctctacaccccacaggccaggatgtcatcatcttgggactttctctgtcttcatttgtgcctggctctcagactgcagttctccaacctggtctctcagcttcgtccttcacattacacgctgtgctgtgcttcctcgaagcctgtcacctcaggcctccagaagatacatccaaacagctaacggatatgtggtctagcaactctcctttacagctagtggtgttgtagtcctgtgtcagcctgagagacttaagaaaggaagtcgctcctgttgtttcctgtgagtttttaatctcttgttgtaaaaggttactcctgccacaggactcttgtatatgccactctggagtgcttctctggatgacagtgtttattcagatccaaggtagacatgggtaggaagctctgggtctgtcagaggctgaggagacagggtaagcataggcacaaagctatggatctgtcagtagctaaggaggcagaatgggtgcaggtctgaggctctgagtctattagtatatgaggcgacttggtaggtaaagtattagtctctgtgtctaatctgggccaatgaggcagagtggccacaaatctgggtttgtcaatgaccaagaagacaatggtaggtacaggcctggggttctggatctgtcggcttatgacgaaacagggtaggtgaaggtatgagctctgg

SEQ ID NO: 32377 - DNA, 1221 bp, Mus musculus
atgccatgagataaagaggaagcctctctttctgtcatggagttaggaagccagcctgccttgggacagggagtttggggggccacttgaaataaacattggggaatctggagcaagaaagccctacttggctggtgagatggctcagtggttaagagcactgactgctcttctggaggtcatgagttcaattcccagcaaccatatggtggctcacaaccatctgtaatgagaaacaaatttttaaaaacccatgggctggagtgagcagggctagagcaagcagagccagagcaaaaggggttgcgggtggggcaagaaagcctgtttttcctagagtctgtttagacagcatgtggcagactaccaggataacatgtcacagattgtgacagggatctggttctgtgaccaccagaggctcctgacagggtctagcagttgtcatttgggtaaagggacacaagacacacgaggagtgacatttgtgagctgtgcgtttgggttaatcacatctgcttctgtgacagcgggtccggagtggtgactggaaagggtacactggcaaatccatcacggacatcatcaacatcggcatcgggggctctgacctggtaaggagcgcccagctcaccctgggatgggctgaaggttgggaacagtctctccctagaaccttgtcctctcttcctgcagggacccctcatggtgactgaagctctcaagccttactcgaaaggaggtccccgtgtctggtttgtctctaacattgatgggacccacattgccaaaacactggccagcttgtcccctgagacttccctctttataatcgcctccaaggtatggcgctgaggatggggaggatgggtggattgccctgggcaatggagtgtcaggaaggattctgagtgaatggggctttgtggatctggttagcacagctgcccttagatgctttccatgtctggcagcaagtgaggtttacctaataagagccggaacctgttcactttggattcttgtcataggcagtacccactttatgtgatctttgcctgtgtgtgtgtgtgtgtgtgtgtgtgtgtgtgtgtgtgtgtcccctcagggtctcatacaagctaggtaagacctctaccactgaactacatcctcagctctttatattgagacaggctctctttcagttattcggatagccttgaattcaaactgtggtcc

SEQ ID NO: 32378 - DNA, 1197 bp, Mus musculus
gcctctcagtctcagccatttgagtagggatttctaaccacccatgaggaggagcagccgctgctggctcgacaggcacgagagagctgtcccctcccacctgctcctagtgggctttggtcagacagggtgggtaaggctgagatttcctgggagccacggtgtaaaaatagagcggcggaggcaggatgcagaggccagagagacttgtgagcgactgcgaaatagaagggagggtggaagaaatcgtacatgtgatgcatcttcgtgccttgtcactgatgccaggaggcgagggacctgggatgaccacctgtggttcctcactggacgtccctgatacctctccctgggtgtttccttgtaagtttgagatgtggagcttgaagggggaagttctgcccaggatctgtctacatcttctttctgtggcgtggcttcctacactacttaacactgctacaggtcagcctttgtggccaggcactgccgctggggtgtgaccagcagcgtctccatctttctgcagcttgaacctcaacaccaaccatgggcatattctggtggactactccaagaaccttgtgaacaaggaggtgatgcagatgctggtggagctggtaatgttctgactggggagttgtgatctctgggttgggttgtgggtgggggctgcgctttgttttgggttctaggtcccggtgtggagttggtatcccagggatctccaggccccctgctgattgagcagactctttgaagatgctggaaaaggaatctgtctatgaagaacatctgtcagcctcaagggggggggggagtggggggggaggggggctggacttgtgataggtgatgaggatgggggatgggatacaagacctcagcagtggcttctctccctaggccaagtccagaggcgtggaggctgcacgggacaacatgttcagtggttccaagatcaactacaccgaggtaagcagttacacccgccgccccccccccctcttcctcctctttgccgaccgttatcagcatcgccctgtgtcttcacccttgctcttaagcaatgcttttgcctcacgaaggtgctaaaggcttttctttgggggcaagagaggttgcagagctttggggtgtgatttctctgagactggcagcctggacttggcaatcaaattggcacagttcctggtg

SEQ ID NO: 32379 - DNA, 1598 bp, Mus musculus
ttatttaaaattttcatatttcatctttgaaaatgtctaattgagaaaaatccatgatattttctggtatgaaagtttgacagtattaatttttttatattttcttaaatcattaaaccattttaatatatgttaactactaataaatggtttattctttctaactccatgtaagcttttccaatgaagattgtaataacacatttttgttctcatttttctacagataaatttatatttaaaaataccaaaaaaaaaaatccctatgtatacacaccacacacatacacacacacagacacacattcacttataagaaaattatagaggacctgtagggtgagcccagccacctgcgtttttagtactgtgtctccaggctgcctgaggcctcagctgttgtcattcgtgctgtgtgggggtgacatttctgcctgtagtgaagatccttctcagtgggttcggaatattcacctcaccatgtttacagagaactattttgtacatagagttttccaggcacgtactttgcaccagccctgcgtggctgttgtctgtgttagctgtcacagtgtgcacactaatctgttcagagttccttgtggctgtttgacttgtaaaaactgtgtatttccttcagtaatgtgtccacagtgctgtgtttccagttctagtcttctgcagtactctcattttcatagtgcctccctgaagacctcaccttgggccaaggtcactcctcggtgccacagcacaggtgacactgctaattgtcatctctggtctgtctttctctattaaggaagatatttgtctccacggctgtgtgaccgtgtgaatcagcttgtgtagtctccacatgggtgctgttcgaagcaccaccttgctctaaacactggtgattccaggtgctgcgcttggcagaggtgtcttgccaaagcgcatgtatgcgtgtgagtgtgtcctcagcacggccaagcatggctgccttgctcggcattagcaggacatcatgtgaatagttgtgaccttccaaaactggaactctacattttgtatcttacttttaaagctcctataagtaaaataacttggctttattaaaatatacatttaataatactctgtatcttttttaaattaattgcagcagatatgtggctctcagcagaactgtgcaggagctggattacctgccccaacagcctttctaaggaacaaacgtaggaatgaggattttctggccattttccctcagcaaacatctgtaatcccagcactcaggaggctgaggcaggaagccaggcataatggtacatgcctgtaatcctggcagtttggagatagaagattagttcaaggttcttgtggctacataattcaaggctagcctggactacataagaccctgtctgaaaacaaaactacggtgattgggttgtagttgagtggtagaacacttggtctgcaagccgaaggtccagagttgaatccccagtgccagtaagtaaagaactagcaggaagacggacactgagtgtgttcctgtttgatgaagtacccagtgcttctgtttacatcagtggtgatgatggtag

SEQ ID NO: 32380 - DNA, 2032 bp, Mus musculus
gtagtaaggtctccccgtattgcagagtggcgtgcctgcttgataggccagccactcctgcagcctctgctgactaggacatacagagagtaagcagagagttgaatgtggacattagagcagtgctgcccaagaaccagtaggacagtaggacagaaattttttctgtgaaataagaggaagggtgtattaaggtaacagaagtaaacttaagcagactaaggaagagccatggcttggaacatgaactaatacgtcttttcctttttagaaagacaacaaagttgctgcatagtctacaaacaagtctttgaaaataggtgactcctagctcttcatggtcctggaaagtgctttcagtctttgtgaagaatgaagaagtgaagttgctgtcttgcctgtcaccagcactgggttttgtctgttttctgcttcatttcaaagctacactgcagttgctttggggcaggaaggctcgtcttaaaacacaagtataagtgtatgtggagtagcagatggttgtgattccttgtttagagttgaactaaagccagctaaatggaactgctaagtattttttcatcactgaaaggattttcttatcactaattaattgtattcggcaattacttccaattgcctgcagataggccgtgatactgtgttttgagccacagaaggttttgtgcgtgtgtgtgtgtatgtatgtgtgtgtgcgcgcgcgcgtgtatgtgcgtgtctttttctttttggagatcctataatatgaggtagcttatttcgacacttaattagggtgctggatggtagagaattttgtcagtcaactatgtacacacaggtaaatactgtttcttaggcaaaggtaacttttttatatagttgtaaaattccattatattccattgccaaagaaacattaagaactttgtatagctgtataaaaagcaactaattttttaaagaataaacgttttaaagtcagcaaacatacgtgtccttgcagaagtcagtgtgctgaggagcagggatatgggtgggtctttccccttgctttccaggcttaaggtttttgatttcctttgtactgtttggactaaagtgaagatttgataactttattccattatctaaaaagcataaattattcatgcatagtgtatggacttcgttttgtagcaaatcacaggatttgttcaaataacagatcttttaagtgtatgaatgtaaataatcatagatgagagtgtacctcgctgtattttcaaataagtaacctttttaagacattaaaactcaatatatcagttgacccattcctcctgctatgcctggaattctgttgtggtaaccgctgactcctgttttatgtcaaaaagatggagttttcagaatcctctggcacctgtaaaacatcactaacatagtatgcgggcctgtggccttctaatgactctgtacacggttgttgctaactgtaaattactaataaatcttttttgatatttaaactatagtgaaaaagatctggccactttgtgtttttaataaaggccatggaataaagagatccaaagatttcaatatttttaactattttggtttttgttaactttctcactaaaacattcagtaatgataaaggcatgtgaaactgcactgtaggagaattggactgcttaaggatggctgattattttaaattttatatcttttgtatagagcaacaagaaaatatcttataatttggtttcattgttgagatccagagcttgacagctgtcgtttcctgtgcgcctgcatgtgaacaactaacccttttgtagggttcacagatcatgagattgaacacatgtttaggcatgttaagcatcagagcacgtgctgtgctcacaacacttgtaggctgagatgtcccagcccagttctctacgctcgtacaaggcgaacttgcactttttctcagccccctgggtcactgactggggcatgcattgtcccaataataactggcagcatggtggccccactg

SEQ ID NO: 32381 - DNA, 1099 bp, Mus musculus
aggcgtgtccacggaaggactgttgatgtgacctggggttgatgtgacctggttgatgtgacctgctgctcctgctgcaactgtgctgccagcctcccagccctcctgctcctcggcctggtatagcgtcctctgctgggccagtcactccagagcagctgtttctcctccacacttggcagacatatttttctacagtatttaaaacagtactaactgtctcgctgcacaggtcggcaaggctaaggaggaccatccatcgctgcttttacctggtgctcagttctcagtccaactgttcagcaagccttgcaaaggatgggctgccggcattcggggcccaggtgcctgctgagctgggtctgtggggacagatgtgaggtggcgggtgctacaggacgtggaacagagtcctctaggggcagggcagtggggaagagggcaatgggggctttgtgactctgtgacttttatctgagatactctgctgccacctgtgtcccagactgcacttggtgcacacctgacctgttaatgcccaggggcttccaatcccgactgactgtgctcacatctgggggttcttggagaagtctccgcccacccagtcagcatgggggccacagcttatctcaggaatgggcccttctaccaagggacccatctgtcagcatcactctctgggtccccagctcagggaaccaccctccaccctagcgccagtttccccattcatatgcacaccaagtgttaatgaaatgtcctaaactagcctgtctgtaagacccagacccaagcttacctagtgctcttaaccccagatttccaacaaggactggtcctgagaggtcctcacagatctgctcttctcccagacgacagggccaaaagatggataccctggccttgtcacatctcccttagctcctcccaagtggaggaaccgcaaagaactgacagatggggtgccctggccggcacccccttgtgtataacgcctgtagacttgtatatgactcctttaatattgtaaagatgctgatgtacaattgttctgtgtttgtgtgaacacaccgcgttcccggttcatgccataaag

SEQ ID NO: 32382 - DNA, 1204 bp, Mus musculus
atgtcttccaggctatcctaatctagaacactcccctgttgatctcacctgaggtgggtagttctgcacctacctgttgtcctttctgctggagaaagtatgttcctaaccggggaggacctgggctggatgggagcatttcttcacaaggaacagcatcaaggagagccacattcaggtatcatctctgtgtccccagaacctgactgcttcaaacccaaatgtccctctcctcaggagggttggccctggcattcccaaggtttctcaattctcacccatattagcacatttgatccaaatcctttgacatagaccaagcaagttggtccagctgtgttctgcatcctatgtccgtcttggtgtatgatgtcaccaattcagttgataagagtcctgaggaagtaaatgctgacatgcatggaggtgggcaagctaggaacagaagctgtaggtgggtacctccctccctagtattttgcttggtttactgggtactgtgccaggacctgggtaacccgcaactttatatggatgctggcagcagccgtgcgtgggtgaagcaaaccactctgacctcagactgcatccctggctgggctttgctggctggctttaggaatccagagccttcctagactctgtgcagatccagtccaccctctccgtgttgggcttgtcttttcttgacagacgctgccccaaggccatagctgagtcctgtcccttaatcctgtgcactctctcagaagaaaggggaggtacaaagagagcagaagacagccagtccctacccactggggccagaaacagcatgggagggggtcttgctttcccaatgactcctttattctaaaggaggacacctgcgttccccatggggcacagacaggcgagcagtgagcttctatcctgcaaagtgtggctgcggggcggccctaggcaggcagacagctcttccaaatctccatgaataattgaagacaccttaaaatgtgtggcggcagcctccaggaagcccttcccccaccgtgtgtggctgcaagtcttgctgctgctggtgggtgggctcctctccgccaggggcggctccagagccaggcagaggtcagagctggacaaagcggctgagccctgactcctgctgtctcctttcccacctcactattctctgcccatccttggagcatccagggcagggtag

SEQ ID NO: 32383 - DNA, 2847 bp, Mus musculus
aagaaaagctgaattctagccgggcggtggtggcacacgcctttaatcccagcacttaggagacagaggcaggcggatttctgagttcgttgccagcctggtctacaaagtgagtcctaggtcagccagggctatacagaaaaaccctgtctcgaaaaacaaaaacaaataaacaaaaaaaacaaaacaaacaaacaaaaagaaaagctgaattccatctgggttcctcagtttgtgattttattctaaattgtgtatggtaaattctggggctacaaaaaccagtcctaataatttggccctattttatagatgtataaacctgtgttagcattgtcagcattgttttttccaacatacatatttttaaaaatgactttaggtgaagtaaagaaaccccatctgtcatgttgaggaggtggttaaaatacaaagtgtgtttaggaaggaagaagtggtcttgggctttttttttttttcccttttgtttgttttaaagggcatagagtgcgattgaactttgaggggccttctgcttattagataagcatggtctctgtcctaaaaaacagcatctactgtgtactgacattttagtttctgtggacgcaagtaaatgcagcatttggtttgggggagaaaccattttttgtcagccaagttagtaaataaaatgccttggcttgatgatacagaccatgatttacaatactactaattcatttggtttctcctgtgtttgttcaaaataactgccaatggggccatgatttttaaaggtaaagtgttcgtgtgtgtgtgcttgtgtgaagaggcaccttttgttgtttgatctcaactgaacaattattagaaaaatgaatcaactttatgccatctctcaaaagactagtcaaagaaaacttgaaagtatgaggtttgaatctttaatttatttcctaaatttttaaatttttatttctttgaggaatctttttctagtttagtgggctgttcttccagacctcatgtgttattgcttccattagtatgcttttgtgttctgtataacttattttagagagaaaatgctgataaaactcaggatattgactcttgttgtgaaactgaaaagctgggtgtctgtagggtctgctcttatcagtgttgtatttagatcgtcttcttggtaactcatagtttgtgcacagctccagtgtcagtttgttagttcctgagacggtagctaaacatgggtcttgtgtgatcaaagtttgggttctgggaatcttgtttgaatgtggtcatttctggccctgtgttctactaggacttggtaaccccagtgtcgctcaggttgctccctagtatggcaggaagttgctgactgttcgggacagaagctttcagggccctggagctcagcagagctgaagacaggagccgacactgttctttgggagccaagaaatgagtggggttttaaaaattagggctcagtaccattttacctgggttggaataccatctactcctaaagattgagagatggtttggataactaacaaggactcacccatataatcctaatcttcatcagtggattgataattacgtaatgaatttaattggtgacacagttaggtcccacttgaacatgtatgaggctaggcagacttccggaaactcttacttctaaacaccagctttcacaaatggatgttcttgtggaatttgtggttaccagtgctaggactttaaaaagctgtagggaggtcagtgctcaaggtatcaaatcagaacatacaaatgaggtccatctttgctcttacctttgtaaaagagattgttagcacaagcaagtagttccatactgaacacaaatgtttggactcaaatgttcttactcaagtgggaatgatgtttaatttgatagatttctctgtaaagttgggggaaactaggtttggggaatgggtaaacttaaggctttggaaactgtagagtgacttttgaaagtcttgttaccgggggacctttagagtttgatctgccttgtggacaggttggtggcttaggaatcaaactgtagtgtgaattagccttgtctctgtctcctgggatggctgccctttgacgagttctgggcatagagggggaatcagagccaccctctctgtctagccctttgggtcacaggtgactttgggatctcagtaaggatttaactaaaatatgactgggtgtttgaaattgggtcatgaggccattcagtttttacggttctcaatttatgaaactagaaacatgtacagtttgataagaaaggatgcagctgcttttgtttcttaaccctctcacccctttccagggaagcttcgtgcctggacaacccatggagcttgtagagtgctcctgatgccttagaaataggaaaagacgcctgtttgtgtgacaggctggggaagattccattccacagctaatcagatctgcctcaggaaaaatactaacttgttctatctgttcctggccttcagtttgtgagattactctatttttttaaaatataattttatttctttcaacgaatttaaaaataaaaaacaccttttggaacaacgactttttcttcgtgggtttctttatcttggacatgagcaagaagttcatttgtaattggccccaaagagcctgcaaggtgcctcttgctgttgtcctgggctggagtgcatggacagcggggtactttgtgcaagtttggatttccctgagttgacagggaaggagttgtctctaaacttggaatgcagcttcagttgattgtagttgtttggtctaacttaaaactgcatcccagtgtagggg

SEQ ID NO: 32384 - DNA, 1177 bp, Mus musculus
tacccatagagatccatctgtctttgtctcctgataaatacttttaaaatttatttttactgatttttaaaaattcttcattttggtggtgatggccgaggcagaggcaggtggatctcaggttcaaggccagcctggtctacagaaggagttcctgtacagccagagttacacagagaaacctgtcttgaaagtcacacacacaaaaaaaccaaacaacaacaaaaacaaaaatgaaaacaaaaacaacaacaaaaaaccccaaacaacttcatatatgagtgcctctgcatgtgagtatttgcatgtgagtgtgggtgcccagcgagtccagatgggtttggatcctctggagctggagtgacaagtggtcgtgagccgctggacttggccgtagggaatagcatcaggtcccctgcaagagcagtgtgctatcacaacttctgagccatctctccaacctacagcttgatttttctccaacttggaagactagtgaggtcagttctctgagtacagctgacagaacgtctgtctcttcctagaacgatgtcagtgacaagcagtcggctgtgaagatgaagatgttcgggaagctcacccgagacacgtttgagtggcaccccgacaagcttctgtgtaagaggtttaacgtcccggacccttatccagggtgagttgggttagcttgtctttccacccactccgtgaaagctcatttaagagaaaaaaattattagatttatcttatgtatttttgcttgcatgtgtgtctatgcactacgtatttacctgctacccttagggcttagaagagctcctggaactggacttaagctaccgcatgcgtgctgggaactgaactggggtcctccgagagaacagcaagtgctcttaagcactgagccattttcccagcccccttagagttcatactatgctcctgtggtcccccttatcaagaggaagttgacgtctaactattgggagttgccagtttgcacatttactttaacttctgcttgtttatttgtatttttgttcatgtaagtctgtatgtatatatgaggactctaggtggaccacagagggcgtcggatgccctggagctgcagggacaggtggttgtgagccacatgacaggtgctgggaacccaacccagatccctgaaagagc

SEQ ID NO: 32385 - DNA, 1196 bp, Mus musculus
ctggcctttgggggcactaggcttgcacatgtgcacagacatatgcgagcaaaacctacatataaatctttgggttttattttattaaaaaggaggtttaggacaggtggtggtgggtcacacctttaatcccagcacttgggaggcagagaccgaaggatctctgagttcaaggccagcctcatctacagagtgagttctagaacaaccagggctacacagagaaaccctgtctcaaaccaacaaaaagcggggtgggggctagagatggctagatccccatctgttttcactgagctgttcattactgcctgtaattccaattccagaagatttgatgccctctcatggcttctcagggtaccttcatgcacgaacacacacatacacacatatacacacatttaaaaaaatgaatcttcgcacaaaaagtacatttcaattgttgctgccttgttaacctgaaatttctaaaaacgaattttcttgtctgttttttaggaaaagttagactcatttttgaggagggcctggcatcagcagatttttacctgtctagcaaatcttgcattctctatgtcactgaagcagatttggtggccggacatggctacagaaaaagactcgctcgctttagaaatgtaagtaccgaggtgctaaaatctagcatcccctctcttcaaccgtcccaagcgctgagtgatagctttctgaactgtgttaccagagctgtgttcttctcttttgaagtcctcacatcttcaagggatcataatagttgagaagacccagatgagtgaacagtatttcccagcagtccagaagtttactgtgctagaccttgggatggtgctgcttccagtggccagccagtcggaagcatcctgcctcattatccacttggtaagtaccagacttctcctttataatatcccagaagtccagaagatgctcaatttaccccagatccagacttaaccaaagctgcctttagtagccctggctgtcctggaactcactttgtagaccaggctggcctcgaactcagagatcctcctacccttgactcccaagtgctgggattaaagatgtgcacctaacttcaaaataaactttgacacaggctctcacgtagttgagattgcaggcgtgtgtcaccacacggggccttaggcagtgctgaaggttgagctcag

SEQ ID NO: 32386 - DNA, 1238 bp, Mus musculus
tactccaggagtgagccactgcagagttcaggctctctgtgccaggagcagggctgggcccacactggttcttggttttcttatctgtaaaataagatctgagcacatgaagcccaagatagtccagggtgttgtggggtggacacctggctttcacagtgactgtgagaaggattaaacctgtgccagtggtcagagactgcccagcttgggcagctaccaggaggacatcctttttgctgttatgactctcaggttgattggctggtatcagagtggccataatacaaagtggctcttgagacagcagaaagcatggtgtcttgctggaacaattcagctgggaggctgggcgtggccagtgtccatttgtacaaatgcaggtccccccagctggtgaagggctgtggtggcactgaacactgagtgcaagtggcaggctgtcccagaagacccaaggaaatgggacacagctctgtttacaccatttttttcaggtggtcagattttccaatacttaaacctctgagcaatatcttgtagcacatgggagactggctatgcaaacatcagctattgttttcctatattatattaaactgtgctgattgaggtagatttctgaaatgtgacatggaaatgcttgaggagtttgtgctctagaattgctcccatataatacgaacgtcttgtctttgcagtggatcatcaataaagcaccagtgtaatgttggccacagtttcttgttctgtgtcaaatgcaaaggaacattcacactttctagagagtaaaatgccagcaaaggcagcaagttagcatgagtgcgatgctggccccagtggagttgccttggacacagaccagctatgtacagcacagggtaaaaaatgggagtggtggcactgtgcaaaggaaaagcaggaggaaagcaagtttaaacctaccatgagcagcagcttatctgccgagtgggtttggtgagtttagaggttgcctgttctgttgtctgtggtaacaaacacagagccttgcctgtgctaggtaggtgctatagcctgagctaccgccagctccccttcattcagttaggcattgtgccttgctacttattagttagcaattctgcaatgggcatgctgttctgcagccttccctagccatccatcctatcgggtaatgggtaacatttcccggtaacttaggagtttctgtttcttgggtttttggttttttattt

SEQ ID NO: 32387 - DNA, 1182 bp, Mus musculus
taagtaggattgcagtgggagaaatgttaactatgtacttcttcaagttgtcctttaaactgttttacagattactgcagtttctaaatcctgatcctttgagagctgatgggacctcagacctgcaccaggtattacagactctaagaatagaagatgaaagcagagaaaccactagtggtattaacactcctttctcccttcaggctgccttaggtgggttttccccaagtcctggcttttggagaatgtagagagccactgctgtagtgcctgtgttttattaggggaacaaatgatctttaatttgggtggttgtgtatgttttccagtaagcatgtattcctaggtgtttacactatgatctacaagaaaacacagttttcttcttggtaaagtccttaatactcttctgcctactcaaggaaggcctggctgttgttgtctaacgtcttgttggttagttgcagaaggtgaagctgggcacactgcagcctggggtggtgctccggaacaggatcgagccctgcctaaccctggagaaatcacctctgtcggcagacctgaagaaggtgaacatgttcttaaagccagactcctgacgacatgccagccctttccaacacagagtgttgctttgttttgctttgtctgttctgttctaagagtgacggggatgaaatacagggctttgcgcgtcctgggcatgcattcatcactgaaccataccccaattccataggaggattttaaataaacacttctaaggctacattgcagaattcttgcttctaaaattctcttaaaatattttgtgatttatttctcatgtattcgaaacttcccagaagattaatttttttttatagaaaagcccattgtgcaactgttgatcctgttctgaagtaagttttcttttttcttttctttcctttttccctccctcccccctccttcctcctcctcctcctcctcttcttcttcctcttcttcttcttctttctctctctctctctctctctctctctctctctctctctctctctctctctctctctctctctctctccacaatttctctgtgtagtcctgactgttctggaactcactgtataccaggctggccttgaactcagaactgccagcctctgtctgcatcctgagtaatgggactaaaggtgt

SEQ ID NO: 32388 - DNA, 1147 bp, Mus musculus
cgtagcctagactggtctcaaacttaggatcctcctgcctctgactcccaaaagctgggatgacaggcctgtgctgtttcactctgctgccggtacagcctttcatccctttcgttctgacatctgttcaggacactttctgcctggagtgtggtttcccgggggcgtggctgtggtcttggttggtggagcagggctccgtcctcccgcttggggctcatggaggctgtgggcctgtttctctttgcagtgaacttggagaccatgtgtgccgatgatctcctctcggtcctgttatatctgctcgtgaagacagagatccctaactggtaacattttcctgttaaatattccttagctccttgggctcttttgagcaggattctctcctgcagcccggactgggccccaactcttgttcttcttgccttggcccctgagttctgggatttcaggagagctccattctggctggcatatatttgccgttaactgttctatgcattttgaattggggggtgaatctgggccaagctgcctttaggggtttacctctgaagggggcagtgttctctcctccatccttcaggggcagctttccttcagtggatagatggggaaactgaggcctggagagctgctatttcactttgtgaagaatgtggcgattttgttgctgtcaactgtgtaggaagcagccaccatctcataggaaaccataattcactttataacattagctaggtgtggtagcttgccccgttaatcccagcacgcaggaggcagagacacatggatctgagacctccaaccattagctgtctcagttactcttctagtgctgtgaagaggcgctatcaccaagacaacttagaaagtattgaactgggacttgcttatcttttcagagggttagtccataatcatcatggccgaagcgtactgacaggcaggcaaggtgctgggtcagtagctgagagcatgcatgatctgtaagctgcagacaagggagagagggagagggagaaggagagggaggggagtgaaggagagagagagagagagagagagcacttttgaaaccttgaaactcacttctattgacatgccttctttaaaaaggccaaacctaatccaacaaggccac

SEQ ID NO: 32389 - DNA, 1138 bp, Mus musculus
ctgagcctcacaagagggttttaagatggagaggggggtgggtgccagttccttctagtgactttttggcttccctttatgctctaagggcaattttgtagtttgttgaggcctaagggattggtagagaaggacactgaagctacaggcctcagattctcaccctacagaggcctgaaagggtctcatgttggatggcctccactttggcactgccttgtgccactggcaggtcgcggctttgccttgcctttccctgttgtatttttccacatcttctttctgtttcaggaggctgaatgacccgtcagttgtcactcctttctccagagatgacagaggtcaaacacccctccatgtggctgccctctgtggtatgtgaccctgggctggcttctgtgaggcaaaaggatggtggcccatgagctagtggaggcccagatgatgggatactgggaggggctgggttgtgggtgcatcccacagggcaggaaagatggacaactgcccctctgtttttgctggccaccatgctacctcacaggctggaagaggactcatgtggctctccatgcttggggctgctgctggccagtgagaacgggctggtatgtctgctaagacaatctcacagaattgtggtttggggttcacatatcactgtcctcaaagataatgttgagccaggtgtaatgatgcagactgtaatctcagccactcaggaagccgaggcaggaggatttgagctatagagtgagactccagctcaaaactagaggggctgaagtacaaatgtttccagcaccacgtgggtgctggaaatcgaacctgggtcctctggaagagcagccagtgcttttatccacggggccatctcagcagcccctggtccattgttactgagaacagatgtgggtgtgattcccttcatagggcatccatcccacagtgatttaagtctgcagagcctgactcatgtcagctcaggctcctgtacagctgagactgggtctcctgtgggtttcctgccagggctatccagagtgaggtagcattgtagttgggagcccctctgtttcctctaccaacaagaggtccttctgttctgcaggtcaggcatccctcattgacttcctgg

SEQ ID NO: 32390 - DNA, 1195 bp, Mus musculus
ttggtgaattttaggtgtcccttgactgggtggaggtgtctgtgagggttgacggaacttaccagataatgcttaacgtttcatttgctcctttctcaaagataaatgatgctgcgtgtgttctactgcagatccaatggtggctcccggacagcttcctggtagccacatagtaacagccctactgtgcttattaccccagtgtgtgtagtagggatgtgcaggctggggaatcctagtgcaggtcagagcttctaaatgaagagcagaattctttttcaaaacagtttccctgttgcccaggcttgaactcctgcactcaagccactgcctggcctcaggtgctgggacaggagccatgtgtcatgggaccctgacgtggtttcattgttgttttgttgttgcggagatacttaaggaggggattcggtcacacgaatatgacatttagatgggaacccgaaggataatcggcagagaaaacatttaaacaacttactgacttagccccttttaaattgtaggactcaaaaataatggagttgctgcaggtagtgccaggctgtgttgcgtctctagacagcgtcgaggaggcagaccacgagggttacgtgactgttgagatcaggagaaaatgtaagtgcttgcgaattctcaacctccctctgtgtatgttagggttctctagagtcacagaacttatggatagtctctatatagtctctatatagtaaaggaatttattgatgacttacagtctgcagtccaattcccaacaatggttcagtagtagctgtgaatggaagtctaaggatctaacacggcaaacaggcgagagagcaagagcgagactcccttcttccaatgtccttatattgtctccagcagaaggtgtagcccagattaaaggtttgttctaccacacctttaatcccagatgatcttgagctcggagatttaatcttaaacttctatctccaagcctccagataagggtcactggtgagccttccaatctggattgtagttcattccaaatatagtcaggttgacaaccaggaatagccactacactctgtttgggaattaatgggtaggtgatgctttctgtgtgtgtgtgtgtgtgtgtgtgtctgtgtgtctgtgtgtctgtgtgagtgtatatgtgtgtgtgtttgaaggcgtgtgtgtttgt

SEQ ID NO: 32391 - DNA, 1626 bp, Mus musculus
ccaaatgcaaaaaaaattcatgtttccatttttatcacccattgctattgtgcctactgggtctggttttcattttgctgttagtctaaccaataatagccttcagtgaattttctgtggctttaattttccacaattggttaaaaaatagtaatcacccaaaccccctaccatttcagcagggcggctggctcttcagaagatgcttccacgtcccttcagaccacatgatagcaagcatgagtgcaagccttcccccacccacggggaaatgtaataacccaaaggttcagagcctccgctctgtcgtgcgttcatatgagcccttgggcctgggccctgcatgtcctgatagcatttacagcaaggctctaccacgaagcaagattctgagtaacacaagcatgtatgtatggttgtcattgctggggagactcttacccggtcagggtcactgctcagaggagtatcctgaccactgctctaagctttggcatgggaaaccctgatttttgtctcttgctctgaccacctgcgcttctaagagcaaatggggaatactgctttaaaattactgtgttcagtaaacattagatggagagagaggtgccagttgtgacctttataaatatcattttgtcccttgctgtgatcacaggactctggcagatgccctcactggcctgtcagccatgtgcctgttcactttatctgtggcttgaccacacgcagcgatcgataccggctgaagcttctgccctggaccgctcagtcccctgttcgaggttaccatcggtggctttgtaattactgttcttttcctcacaaaacaaatgtgagcatcatgtttacatcgcatctctgcagcgtagttggcttgacaaagatgagcaggtgtctctggtctcagtttcataagcacttatttaatcaggttttcaattgtgcagcaaggtgctcaaagtaatagtctataaatatatttaatagaaacttgagtttgacattcatgggcgtaaagacatgtattttttttttaaagaaataagtattgtgtaacactatggctttgcttctgtagcccaagtagagaaacttctggaacgccatgtaaaaaagcaatgattgattctgacgctgattcattaaaactggatgattggcgtttggtgacattctgttgcccgcccacccatcacgctgcaaaccgtgtttgtggcagcacaggccgcctggttagaagagtgagtgcagcaagctctctggctggcacctcttaattttcagaagaactgtccaaaattagagtaatttattttgctttacaggagtttgccatgtattgacttaaatattgtattttggtaataaattttttttgttaaaaaaccacttgtttctaagtttccttagctgtctgcgtgtattcctgtcttgggtttgttgagttagaaacttgcatttaagccactgaaagcttcccgggagctggttggggtttactgttaggctctgttaagttgctgaggtagccctggcgcaccagggctgcgtttcacaagcatgggctctgggccttctcccctgttcaacagccctttagcttccacagcagacatggcgatg

SEQ ID NO: 32392 - DNA, 1144 bp, Mus musculus
tccttatagtaggatgtgaatatattttcagaatttcaaaaatttgagcagagaagtgtgatttttcgttatctacagttaaaatttggcataagaaatagtttatccagagttacatgaaatcatgttggcttcacagactgatgctttccagtagctcgaggtgactccacaggccccaaggatggctgtttctttaaacaaagaatcatgtctctttagttctagaatctcaagggtttctttaaacaaagagtcatgtctctttagttctagaattgcaagggattcaagggacattagttctagaatctcaaggaggctgggtgacaggataaggtgttaaagtcttacccaaggaacagggtctttatctgtctctaggagaccgtttcaaaaaggaattctgagctgtttaagtctattagggacagttgggtgcattgataggaacctcccaacttagaagatatttaaacatttcagtcagacaccagagttgacattatcccataacccatgctctctgctgtgcactgtctctagatatggaagaaagcagcagcattgccatgttggtgcaagagattggagaaccggaggctgtgttaactgctgaaggagtcctcagcccttcctcagaagttgaccaacaaagaaaagctaaagcagatccattggtccacgttatccagaagctaagcaagatagtggggcatgagaagtcacaaaaatgtctactgattgggaaaaagcgcccacgtccaagtgagacagcaaactctcttgaaaagctagagaactgtgagattccagctaaagccactgagtcccctgctgctggggttaggaaaaccgagatgtcacaggcaagttccactcttgcttcaaatgatgggaaggctatgtcctaccagtgtagcctttgtaagttcctgtcaccatccttttctgtgctgaaagagcacgtcaagcagcatgggcagcagcatgacgtgatgctcatgtgctcggagtgccacgccacctccaggagccagcaggagctcgaagcgcacgtggtgagtgagcacgagaacagtgccagtagccaggcccggtccagcccctccggtcagggagccacagaaagaaagagtgagac

SEQ ID NO: 32393 - DNA, 1237 bp, Mus musculus
tctgtgatttcgtccctttgataatgagataggactgggtgggggaggggagtcgaggaagagtgtggtataggagcttacacatccggtggagtccaggctctccgtcctcttccgtctccactgggagctgtactgccctgccggtgtgcgacatgggaacaggatgcccctgctaaagctttgacatcggcctccttagtctgctgcgtgtcagtgacgcttgggaatggcggctgtctatctagactcaggtcacatgtcagctgcctctctctctctctctctgtctctgtctctgtctctctctctctctcagatgctgtgaagtccaggtttcaaataaggtagcaattatatcctatgacttagtgctgatcaacaatacctctctatctaattgccagcctgctataatcatgttgcctattcttactttcgccagagacagaaagcccaaattttataaataccctgttattgtcatccttccattaaacaatagggactatgaccctgcccttgctttcgagcgcctctagccccaggcagtttctggattaataaatctacacattttctttcaggtaagtaacaccccatgtcctagtcgctctgtctggactccacacccctacccccccgtctgtccgtgctcctttgtggtttatctgcagcttgttaactgtgcaaagtcaacagaagaacttaaacacatacatgtttttgagtaaataattcctacgggcataggtatgtgtacgcacacagcacaccagcctacagtctgtatagagtcagagaggctgagaacattgccctccaccccacatgtttgccaatagtaatggatgcaaatacttagaaacctgagtgggagaggagatttcactcctagtcacaaaccccagtgggtggtgagtccacaggtcaatgaaaacctgactgggacaatgctgtgccctgccacctcacctgagctcgcagggctgggcacatggtagcctcgccagcattcctttcttgtgtctgattgtcatgtattttgtaacactttagaagaatacagaaaagtgcagtaattatctttctccatagtatttaagcagaaatattgctagtgtaatattgtgtcaggtcgtcgtattaaccaggaacaggtgacagtaaaatcccagccaacagcactctgacacccacaacttaaaaacggcgatcgaagcgaaatgtgtaaatg

SEQ ID NO: 32394 - DNA, 1229 bp, Mus musculus
tctacaaggaagcagcgatcgctttgggataattttccttcctgtcccgaaatagccgcgtgtctgcttgtctcggggagtcagccgagacactcccccacccccttgttactggctaagctgcaaatgtgattttgatcccagagtgaactttccagctagcctatattacaaattaatcgaattccaccagtgcccacatttttaaacttttagaaaaaaaatatttaataggaactaagcaaaaagaagaaatcaaaccagctgctgacacagctgtttcttctcttgtttaattcagttcaatataaaggtaccatatgctgcttaaaatgatgataggaaagatgaaataatttaagagaataacaagaaaatacatgaattgtcagcattctgtcagattcaaagaatgaaatagacaggtgtagtattgacatgtttaactttgtgtggtgttagcagttttggtgtgaacaacttctgacatgtgctgaagtgatgtgagaacacttctcatccactgcagacatcggcgaggaggccgggagagccggtggcgtccagcagcaggcgctgcttcgagacaggaacctgggctcggccatgaaggactgcccgtactgtgggaagactttccggacttcccatcaccttaaggtccacctgaggatacacacaggtgagagagatcgaggtgtgttcgggtgtctagagggtaccgctcagagctgaggaagccccagaattcagctgtgtctctggcccaagtccacagctgtgtgagtccctaacactgtgccactcccgtgtttcattgctgtgacaaataatgagagtgctgcagttgagagagagagagagagagagatttgctctggcttgtgcatttagttcaaggtcagttggctccattgcttttagttcagtggcaaaatataaacagaccaaccattataagacgaccccccccccccagatgaccaggcagactggcctctggcccagcacggattccaggcccattcttggggctggacagatagagtcatcctcctccgttgcatggaggttaggtagtccactacggtgctgcctcaagagaaacctagagacgttcgttctcagccaacagagagaaatggccactgggccaccctggccatctctcttgccttagatcactagtttcacgcagtgaggacaatcttttagaactttgccttgct

SEQ ID NO: 32395 - DNA, 3067 bp, Mus musculus
gaggccgtggctaccgaggccggcgggagcagtttggacgaactccaagagaaccaccccaagaagcctttgccctcaggagtgtctgaggtgtgtgtctgtgtctctgtggcatatctcacaggcttgctctttacacttcaaagttctcagcttgtgtttaagttctgaggaggggagacggtccaaatactaggtagtttttaagaagtgactctctggtcttcatttttcttgatatataaagacacatcaagacattgtggtgatatgtatgtcatttagtctcatttcagttgaacatagttggctttgattagatgaagttccacaaacacttagccacaatgaaagagcttttttggtttgggtgacacatctgacttgtaccattggattgattgtcctagaattttaaagctattttgattcacgttagtcttagcacctctagttttttagtttttacgggggcaaagtgcaataaagatcttgaataaataacctccccccccaaagaaatgatgtcagcattggtgaaacgaagcttctgactgtcagacagcaaggaagcaagggagcctgggcagaagcccgcctcttgtgcccgtgtcgcttctgtgttcactgatgttttctagagagctggaggtgtcaaccataaaaaactccttgaatttgatggtgtacttaagaaaaataatattacctggtttctttgaaccattagtattttgatgtttattatccaaaattcttgttaccttagtttaaaaaaaaaggtcttggaaatgaagggtaaagatttttgtgtgcgtcttagttatatttaacaccatatacacatttgtcttacaggctttttctggaactgtaatagaaaaagaatttttatcaccctccctagcaccatactcagccattgctcaccatgccctccccaccattccagagcgaaaagaagttccatcagaagtatcagaggaacccacaaagagggtgtcaaagttcagagctgcccgattgcagcagagaagctagagggctccgcctgcagctccagctgcgctttaggacatgcggcggattcggccatggagttgggacggcgtcctgcttggctgggcagagctctctcacctttatcagtggcattgggaaagtcaaagtaaatgtttgaatgctgtaatgttctgctggcttcgttaattctgtgactactgtctaattggccttaggatgcaggaatagcgttttgagttacttttcaaagaatcctgtcatatattgtttgtgtgttttcaactaaacacaggcagtttcgtaccagctgtgatgttgtgctttccatatggaccatgttaaagacacttttaaaatctcaaatagattcaacaattatattacttgcttttacattttaaaggcactttaaaaaaatctacatttcttgtaggtttcacagctgtatggttctttgaaaaattcttcctttgaatgtcatactgtaatctttaaggcaaaaagctacacaaaccctttgggaaaatttgactagaagaagaatattttgtacaacttttttttttttggaagtaaaatttttatgaaacttggtttctaaaatgttgtgaacttcctggtttagattgtgtataaaatgtctttgatttgtgtataggccacaccacagattttcaaagttttcaagtcccacgagcacctcctctccccatacacacagttgtcattggcaccattctttggggggaaaaagtttgtctagatgctttaacactttgttaaagcacaggccttttgtttgtttgtttgtttgttttacatttcaatcttcctcacattttcattcttcaaggatgctttcctaccagtaaaaaaaaagaaagaaagaaatattatattatatttacttgtagccaaactccttaaagagacattcagtctcaggttgaccattacagtgcaagtgttgatcattagcttgatgcatgctaaaatgtagcttttaaaaagcattccgcatcagtactaaaataagccatcaaccccagtccaccctctattcacggctaaatagttagaggttatttatagcttctttaatgaattcttgcttaaacaaagtgaaattatgtcctagaaaagtcgcagctgtaactagagcagtgccactgtcagagttttatgaaatacatgctttaatggtaaaatggtatgctagggtccatgctagttaatggataatgcagaacaggggactgaattggaaaggctgcctaaaaatataatagctcggtttttctagccgttgttgatcatctgtacacatattttgtacttaaaaaccacttttctttccaatcacctactctcaaccagactatcccatcacaccgactctaggcacaccctgctccttctccctatgagaggcgtcctgtgctaacctcctcctgatgcaagcctccttgtggaactgttggatcttcagatgtgtaacttaagtgtgctgttattaaacactttctatgttcatgaacttattttgagcctgctttatctatttgtgtacttctttcaaattggtctgcctcacagaacgtgttcaacgacatgtttgtgctttctgctgaagacccacatgaaatagtgtcactcagtttcagagtcagtcttaacacagttttaaactgtaacttgaaactacactttgatttgtttgaaggtaaactttatttttctgaggcatgttgtcaccctggttggaattgaacttgaagtcctcctaatcctggggtcaggggctgagaccgctggcttgcatccagctaagttctctcagctctacttttgctcttaaacactagaatgttacagtctcatcttgtgcttttttcttctgttccagccttagaatgagctgctccaaggagctctcattcctaagacagtggtgcctagaaaccaacagcttcttatgagggtttattgcccccgagctgtgcttggcctattcatcaggcagaactatgcgtgtatatacact

SEQ ID NO: 32396 - DNA, 1166 bp, Mus musculus
gtgtgtgtgtgtgtgtgtgtgtgtgtgtgtgtatgtgtgtgtgtgtgtgtgtgtgtgtgtgtgtgagaacaggtgttcatgttttttgttttgttttttgagacagggtttctctgtgtggccctggctgtcctggaacttgtgctgctctgtagataaagctggccttgaacacagatcttcctgccttctgagacctgggattaaaaatgagaaccatcatgcctaccaaatttcttagattgcattcatgctacatctggccaatgttcagagataaaaatctacgtgtgtcctgtgagctcttatgttttgagtagctacagtctgctgagatgtgtaagagcggttatttctattgtctgtatttttttaatcttatccatattttctttcatcatctagtaaacctgatactgtgattgcaaatggagaagacagagtgtcttctgaggaggaaaaggaaggtgcagacacaggtgtgaatgtggtgtctccagtgacagactcctctgccgccagcagctgtaaaaggcgtgctggaaatgcaggactccctaatggtcaagtcaatagtctgaactattcagtgaatggctcaaattcttaccacagcaacaaagatgatgatgaagaagaagaagatgacgatgatgatgatgatgaagatgacgataatgaaagtgaccatgctatttcagcagataattctattccaacaatatatttctctcatactgttgaacctaaaagggtttgtatacttctaactttgtagtcattaaatgtcatccatgctgtattttagaaagaacattaacattgactaggattgtcaatgctatcaaacaggaaaagcacctttttctcttatccaaccgcttcaccttaaaagaaaaacaataattagtaagcgatggtagtcagtctgccattctcagaaggcccactaatgtactcttgactgcagtgactgtggttgacctgccctcattccagggctctcttttggtttgctttcagatctgaaaatggcttcaagacaaggttattttggggcaaggggaaccaggttgttctttttatgtaggtgtcaaatgagtactgttatcctgaacagcaaggaaaagttgggttgagggataaaaactgggtaattatgggtt

SEQ ID NO: 32397 - DNA, 1234 bp, Mus musculus
gaaaagcagatagttttgcgttcatatttgatctatctcctgccaccacatgacagttgcaaataaaataaagcaatttaaaagagagtattgttcatatataaaattataatagaactttccagagattagcctctatcaattcctcctggagtaagcatccttggcggtgccttagggtttgaagtatcccatggcaggacgttttatatcactctcataactggattctcttgagtttgggtggcgagtggatgttactcgggtggagttccgcatggtagccagggtgcattgtgactttgtgcttgtgtgatgttgaggttctagacggctacggtgacggctctttgaacagggtgactgagtgggttcaggaagctgagcagcacttgtgaagggccctatctttctcaacacttttcccaaaagacggggtctcatgtagactaacagtcatggcatttcctttttaaacaggaaaacaacgaattgctcacaaacctcattccaaaccaaaaacttcagatatttttgaagcagattttgaaaatggtgtaaaacccaagaatacatttgatgctgatgaactgtgggctcgacttgaagagctggagagacaagaagaactgctgggtgaacttgaaaggtgcttaatggcagattagctttccaagggaatatgtatctttcctcatttataagatggtgtgtactcattgaagaaattgcagaaaactgtagaaggatcagcatgcccttatataaacatttttgtaggatatttccttctgtgtaaatacttacactgaaaatcacaatctccatgatactcagatctcgcatattatacacacacacacacacacacacacacacacacacaattatacttgatagtcagtgattgcattaatgctaacaacaacaacaacaacaacaaaaaagaacttaaaagtgaccaaagtttgttttttgaggaactggggattgaactaatgcctctatcctgtaagacaagcattctacagtgccatggccaccactcctaaataacaaattttaaatgatataattttatactgttttcaggataatgctctatgctccagtgacttgttaaaaagaaaaaaaaatggctttgaatttaaatttgatactgaaaatgtttgtccttgtatttcatttacaaactttctgtttattgagcaggcaatttataatgtcgtctggt

SEQ ID NO: 32398 - DNA, 1150 bp, Mus musculus
gaggcatataaagtttgcaataccaaggggcctctcttcccaatgatggccgagtaggccatcttctgctacatatgcagctagagacacgagccctgggggtactggttagttcatattgttccacctatagggttgcagactccttacactctcccttttttgaagacagggtcttacctggtatcccgaggtggagtgggacttgccatggaacccagactgctctcagagtcccagttatcctcctgcctcagcttcccaagtactaagatttcaagtataagctgccccatccagtatcactgaaataacaattcccatgaatacctgaaagtgttttcctacaaccttcatatatgtgtatgtatgaaatttattttgtctgaaatactgatctacatatttgcagaaatacttattcacaatgatggcttcattcttctgtgtttggtaaattgggaagctaatttttcagagttcctatttaatggactatatttgtggtactattttgtatagaaccttctttgttttttttattccacccccccccccccgccccttcatcccttgagtgaagcagagaatagtcataaaattatcttgccatatcatgtgcttttgccactggattgggcagttactaccccaagggatgatggggaggaagggtgggcacagtgagtacacatcccttactttgtctgtagccttttctttctttctttctttctttctttctttctttctttctttctttctttctttctttctttctttctttctttctttctttctttctttctttctctctctctctctctctctctctctccccctccctccctccctccctcccttccttccttcctttttccctctccctctcctccttctctcttcctctccctctccctctccctctccctctccctctccctctccctctccctctccctctccctctccctctccctctctttctctttctctttctctttctctttctctttctctttctctttctctttctctttctctttctctttctctttctctttctctttctctttctctttctctttctctttctctttctctttctctttctctttctctttctttctcttcctcttcttttcccttt

SEQ ID NO: 32399 - DNA, 1102 bp, Mus musculus
tttaaagaatcctaggaaaacgtcttcatccttagaaatgccacagattgtacatgtaagattcacaaagtttaccatagaaggtgtgtgttagccaaacacttgggattgtgagtgaccaatcataagagggaaaggagccctaataagagggtaaggaagccagggagtgatgcaggcatcagagggagaggagagggggatctctcccagtcccgggttagagaactgtgctaaaattaaggctaatccttattcccttttacttgatctgagctaaagttaacattgaagtattttaagaagtgctgtggtctttaactggacttagagagttggtgatagtttcactctgggtacatgtctaaagtggaattgatttatttttatttcatatgcatttttttggcctgtatttatgtctgtttgatggcattacaaactataattacagacagttgtgaactgccttgtgggtgctggaattagaacccaggtcttttgggagagcagccagtagtcttaactgctgaggcatctccagtgcactggtgactgagcaacttatttgcaagatatgtcttggaactggcagtccagcgagagaagctgacctaatgaatttagacagcctggagagttactcccagactgctctcataccttacttaacccgagtaggaaggctctgtggttgtgggcagcataagcagtgttagaagtgaagtaaagacttcctgagagaaggatctgaggttagacttgcaggtaactgcaggtgcaccctgttggtccaactctgccctgctactttactgtgcttggagagtgaatgggttgatgcccccttgtggtccattatcaaaataaatagcacaaacacaaataagcacaggagcgctcagctcacttactcactgcatgttaaaccttcattcctttataagtaacatctaaaaagtaatttctgaggagaaccatattttgttttgttttgcacagtttcatggccttacactttataacacataattttgaccctttataacagaatgtgtgagtgctgtgctgaggaggacgtggagaagtggcatagtgactg

SEQ ID NO: 32400 - DNA, 1064 bp, Mus musculus
tgtgtgtgtgtgtgtgtgtgtgtgtgtgtgtgtgtttgtgtgtgtttggattttatgtggattctaggcattcacgcccaggtcctcatggttatatggcaagtgcttttacccattgaaccaacattccagtcatgtctgggttttaaaacaggatctgaggaggcagttccccaatctccaggcctgttctgtgtcttagaatagcctgggactcatgctcctgcctcagcatatcactgccacccaggtctagaactattcctttttaagggtaagtaatattttattgcattcaagtgtattaaaattgttttatacaatagttatctgtaagtggacacattgccttcattttgaaggctatgaataatgctactgtagacatgcatgtgtgcaaaatttatgctgtttgctttgagtgctttgggtgtagtcaggttaaaacgctaggtcataaagtacgtgtttagtgtttgagggactgctgcatgactgtctacctctgcatgactctacatccttcccttccagcagagttctcagtggctccagctcctctgtacaaagaatgctcgttatttcccattttgtgttttaaatgatggccagcctgatatgtgtgaagtggtatctcactgtcattgctgtttctctgccagttccctcctttttgtctgttgttggattaaccaaacataacattattgttacttctgcccattaacgtctttatgataaattattgaactacatgtgtactatactgtgtgtatcttaatactcagcgtgctgcgcatttacactacgcttgtaccacccaggttcagcatgcattcatttactcagccgtttgtcttttctttctttccccctccttctcctcctcattgattgattgctttactgattgagattgggtttcactatatagttctgactggcctagaactctgaagagatccacctgcctctgccttctgagtgctggcattaaaggtgcaaggcttccttggctcccaccacatcttgattattgtcagtacattttgatggtgtgtatt

SEQ ID NO: 32401 - DNA, 2395 bp, Mus musculus
taatctgaaagtgctaggaacggtttcttctaatagcatcttccttctgttcccttttaggaaatctaccctccaaagttgcaccagtttgcttatgttacagatggcgcttgctccggggatgaaattcttaccatggaattgatgatgatgaaggcaggttacacattaatatcgtgtgtgtgtgtgtgtgtgtgtgtgtgtgtgtgacagagagacagagagagactgtctttcccttgcaaggtgtggtgtgcccaccaccaccgtgggtcttatccagttagccatgtggcagggactatggctgagcttttcacaactgtcacttctttcctttaggcccttaagtggcgtctaagccctctgaccattgtgtcctggctgaatgtctatgtccaagtggcctatgtcaacgacacgggtgaggtgctgatgcctcagtacccacagcaggtcttcgtgcagatcgcagaggtatgtggaccttctgcttgcccactgtgtgtttgtgtggcacaccacagctcaggggcttctagaagcttcatgtggcatcttgtcttagtgctcctgtcttccttagcttctagacctgtgcgtcctggatgttggctgcttagaatttccttatggtgtcctcgctgcttctgctttgtatcatttctcctcactggagttgatgcagaaggtctcaggtatgttgggctttcctgtgagttcacagacaaggtgtcttcaaggtacaagccagctatcagctgcggactgagcctctgacttctttactggcaggttatcagtggtgcgacatagagaagtgtgtcaaatggatggttccgttcgccatggttatccgggagatgggaagttccaagctcaagcacttccggggagtccccatggaagactcccacaacatccagacccacaccaacagcttggatttgctggtcagtaatctccttgctccctcccatcagacaagtacttaaccaactctgcctaaggaaaagccagttctaactccattaagaatgtttctagtccatagagtctgtgtctcagtatgcgaatactatagacattaggtgagagggggttgtttactgagaccagttcttactagatatagcccaggctgaccttgaactcagaagtctgactcccctcaagtggtaggatttgccaccaagcctaactataatttttgctatttctccctcttgcctccatattaaaaacatacagcaagaaaaacgacactttgtttaactttgacaactttccctcttattcttatgtaggacaaagcccaagcaaagaaagccatattgtcagaacagaataggatttctcctcctccgagtgtggtcctgacacccccacccagcagtaagaagcagagcagcgagcaggagacagaatgaccaaacctgccattgcctccaaagacagtggtgtggaagcagctgcctggagctccctgtgctgccttggaggtcaggagcccctgcagatgctgtgctctatggagaggtgcatctcttccggagcagcaggggtctgcaagatgccttggatggaagtgcttttattgaatgctaggtgttttaactatagggtcaagtacaccagccacctccagaacaccactgagtgctccagaagctgctaaggagggtgctacttgacccactggactcttcacacagatgacacaagcttgaagttaaggaggccacgccatggcggttgctggcctctgctcgggtgttgtaggttgctgttgataggctgtgaccagtggttgtgagcaagtgtgggatgcagagcccacagcctggcctaggctgcccttctccactgtcagccaacagcatgtcctgccttcatgaactcttattttgtaagtgctgctatgtctatcaatttttaataaagataatactatctttgaagcagctgttcttaactctgtctagtatcagaaactaggagttgccttttagagttggtctaccaagttctcttgtttttttttccgagacagggtttctctgtgtagccctggctgtcctggaactcactctgtagaccaggctggcctcaaactcagaaatccgcctgcctctgcctcctaagtgctgggattaaaggcatgcgccaccactgcctggccagtttccttattcttgagacagtctcacaatgcaacccaggctggcctagagcttgctatatagcctgggcttccatgaggctctcacccacaatgccctacacaggcagcagttcacactgtaattgtcagctgtctcgtggaggcattccacacccagggagtttcactcgtgtcatctgtcctctccagagtattacaggtcatagagct

SEQ ID NO: 32402 - DNA, 1180 bp, Mus musculus
cccgggtgggggtggggcgaggccgggtcacccggtcccctgaggtatcagctcggggtgccccggccggggtggctgtgagagacgggtcaggggtaggtgtagaaagggacactgaggcagccccggccccgaggacggtgatggagcggggggtcctcttgaagggcggctgggcctccatccccaacctcaggttcggacccagggtcgcaggctgctggcggcgcctgcgggtgacaagccacccgggcccatcggccattttcccggccggcctccgggcccaggaggctcccgccgccgccgcccgcgcgggaggggggaggggtgcccgggacgaactggaagactcaggtcccctctgcgggccgtgctcaccacgatgcttgcttgttgtcctcccaggtctgagttccaagcccaagtcctgagccatgccaagggagaggtgagtggcctccctgctgcgggagggtaagggtgagtagcggtgggggaggggcggcctgagtttttggggagcagcaccccatgacaccatgcccttgcagagactcgacggaccacagcaacatgaaagaagaaggtggctccgacctttcagtccgctccagaaaaaggaaggcaaatgtggccgtggtgagtacaaaggatacaggttgggaaggggacagcccacccccccttccatcttacctgggtaccaaatttggttcttcttacctactagtgaaaagaattagttgagagagaggtttcctttagttgaatgtcgttcatgacctaacaaacatttccccctttttctcttgtgttttttgtctttgggtcgcaccatgtggacccatggtggaccgggatttttttttttttttttttttttttagtttttgcaagacccagatgaagaaattgccaagattgacaagactgtgaaaagcgaggatagcagtcaggtaggtctgctgcctacagggtattctgcctcctgggttccaggttttctttcttccaactttcccaaaacagagctgcaggccacatggctgaacctctgaagcttgtcaatgtggcctggtctcagttgggcctggggttgtgggaggggtttgtgtttcctgaatggcacctttaaggttacaggtactgatacctggaggaaccagagtgagtgtat

SEQ ID NO: 32403 - DNA, 1213 bp, Mus musculus
tgctgccggctaactgccatccagtgtgcccagcagtttcagacctgactctggagggaatttggagacagtgtagacagcagctctgctctgtattctttttgacaaaaccagaacagtagaagtagccaatcgtaagacctgaagacattttgaatgtcccactggactaacctttcttttgatgtgtgtttttagtttagaagtgctatattccacaagggttaagtcaatgaggttggaagacacctatcttttttttttaattcaaaaagcacaatcagtctttcctttgaaaatccatataaagtacaacttttagcgtgattattttcctaaatacaaagacaaataatttacttattttatgttaattacgggcatgaagcaaaaggtttctttggggaacatgcagttttgtagtgctggggttggttcatgtcctctggcaccctggcttgttgaaaggtggctttagctgtgtgctgtgtacctgcttacgtggcctgctgtcctctgtgtgattaggagggtttctgctggccctgcagcttgcttccctgcggattagttctttgctcatgctatagccttcatgtgggtgctacctagagcaggcgtgaactgctgggtggtgattgtgagttcagacaataaaaaaatgtatttttttcaatactgtataaaaatagtattctgattacctccccctcaataaaaaaaaaaaagtccagaaaaaaaaaataaccacttggaccgaaatcacaatttttaaattgtgcatcttaactataagaatctctgtttacaagtaatgataacttgaagccttacaatgctccattatgccatcacagagcttcattgtgctaccagaatattgcatcatgacatcatagtgcccatgtgtgccatcataagacaaattatggtatgttaatgctcaattttgatatattaatgcccccatggaacattacaattctccagtatgctaacaaaatattctaatgtgacatcacaaaggagaattctgataatttaatttttttatgttagcaatacttcaatatgccatccaaatgttacttataatgtcagtgtccacttgtaccatcagagtatgaattatgacactacaaagttccatttttacataaaataccctactgggacatcacattacccacactgtgccaacataatgtggcaa

SEQ ID NO: 32404 - DNA, 1219 bp, Mus musculus
ctacagcgatgatgacactcaggagcacaaggcccaggcattgctgcgtgtgctatcgcgcttcgcgccgcccaacatgcaagctgcagaggcagtgtcccacattcagagcagcggcccgcgtcgccacggagcctccagtgctgtcagctccaacaacgcaggcgctgctgtccgcaccacctctgaaaccagccacgatgacaagaacccacctcctgggagccctcccgctggatcaggagttcctgaggccgccgctgccgctgcctccgcgacccacacagccaccacaactgctgctgcagctgctgcttcttcatcagcatcaccaccatcagggcaggctgtccttctgcgccagaggcacggctccggtaagggcaggccccaaaggggttttgcatgcccggtggagagggaggttagcagccagtacatcagcagcgctagatagctttattgtaacagcagttgtgtgcgccagaagcatcttttctgctgtgcctttctggtgttctctgagctttttcccagtcttgactcttaaagggtttgagcatcctatcaagtatattcataactcagcgggctgctctgcttgacactgaggctgggttgtgaggttgtgtggttgctctctcggacagcattgagaactgtactctcagatccccaagtttggacagatattccccaggtggggtattcctcttgaaagaagcagtgaaaacaagctgttgtccctctttgccgattggtgactttgaattgtcttgtaagttgcaggaaggttggctaggtagcctttgctaagtggcttctaggtgtggctttacacaagctgtaaattttgtatgcacatcagagttccagttctccatggttccagagggaatggagccctgtatcacacttatgaaggcacaaggaggctgatacccgttttcctaggactagggatgcaaagagttgaggtgaggggttgtcagaatagaagaccagaaaagtgagctgctgctctggtaacaagaccctgggggtgttaacatagcagtaatgagggtttcaggaggcccagaaaaagcagaaacttctgtgccaaatagcccttctctcaacatggctcccctcttcaatccaactcagaggaacactatcttcagtgctcactcctagtatctgattttaaataattcaccccctgcctggaaccccc

SEQ ID NO: 32405 - DNA, 1175 bp, Mus musculus
catttcacctctgcaactgtgtgcttcactgagataagagggaaggcaattgatggagacctatcctttagacttcctctcccataatgtctggctgttagctcaattgccttcagagaaagtatctgatggtggcaggttaaatctttcaaataaggagtataggagaacataatcaggagtcatttcattggtatatatttttgttaactgaccaggtattttgttttactctatgtctatagattatctagtttctggttcttggttacccaagcattgttgaatatagattctttcttgtggagtaagtcttaagtcaaatcaaaagttcattgcctactcccacatgttcattgtctccattgcgctagcacattatgtagggacaacaggttgtaggccaagggttttttggttgctggtttccatgtttctctttcagtttcctatgcatccggagtcccacagcattgcaagggcactagaatgtatttgtgaaggctccatgttgccatcgacccaactactcgatattcagtgagtatgtggatgttatcttcagccatagggccttctctgctgatatacagcactctttttttctaagcaacaacctggttttgttgatctacatgggacatacggccaaaacctcagcagaattttatgaattttgccactggaagccttaccaggacaagaaatgcgataagactttatacccccattactagaaggccttattgggatgcccttcatagatttgaggaagtttcccttgagtgagttcccatatcacacccataatagcctctctgtacctgtgttcactgcctacactctcttcatccaccccatatcccataccatgtcaatcatcattttcattcccatccacccttttatacctttagaatgtactctgttattgtataaccaagagacacatgtgttcctccatctggatccctcttctttacccaggttctcaggatctactgattttagtacatgcaatccacaggtgaatttataggtttttgttatctcactcaggatgatttttttctagttccattcattttcctgcatattgcataatatttatttttgtaatagcagagtatgactccattgtgttagcatgactgtccatgttgttgtaaggatca

SEQ ID NO: 32406 - DNA, 1153 bp, Mus musculus
gatcatttatccaggggaatagatttgactagtgtcaccaacatcttcaggcattattatatccctgtttattatgccctgatgacctggaagaaatatacgattgactgcatcagaagtatctgaagccttggcactttaaagaaatttcagagtcccaaatctctacagaatgaagaagagtgaaaagaaagatcaggagagaaactgacaagtcttaaaaagtggctgagcacttgaccaatgccacaagacagtttatctcaaatgtggtaaaaagacagcaatgggagcaagcccacaaggaaactttgtacattgtatgcctgctggagttgatgtcccgcataaggagagaaagaaatacgcaggggtgaagactggcttgttagatcaggatcgtattctgcttctctgaagcctgtaaaattctgttaggaggacacctggactcccaagactcaacaggagtcagtcactctaagactggagcaatcatgtctttgcaaagagctgtgtgaggtatggatgaactatgagggcaagagctttggattggaaagccaaaggaccaaatgactagagggcaacgctcagggtgtacctgaggacaagctggctcctactgtgctctctgcattcacttagctgtcatgggtcagcccctccaggtcttccactctttccttattcttggcaactacaatgtagctgtcagtaagagcactgtgctccttccctggcagaccccacccattcattaatccttgtaacctgcttccctggaagactaaggatattctaaagagatatttcttttcctttggctaacaattagtgaaccggtgggctgcatgaaattcaaatttcctgggtaatcacattctgggtaagattgagtcctccatcgaagaaggcttttgctgaagaaacatttgcacattgcaggagtcagaggagctaagaatggggtatggtttgagggatggctggaaaattcttatactgcttggatggattacttagcatctatctctttccttccacctaaatatgtcattacccccagtgattgaatagtttgcttctatctttgtcactattccagtttagttgcactcaataaatttgtttctaattttatgacaaattt

SEQ ID NO: 32407 - DNA, 1893 bp, Mus musculus
taagcctttagattcctcaacaccattgttacaggaatgaatgcttacacaagaaaaatattcacgagcaaaaatttgtttaatgatttgtttaattttaattatgtgatgccagtgtatttttatatggctttgtgcagatacatgatggttccaagaaccctttgggtcatcttggagcaggaagtacaggaaggcagaaaaccctgatccttagtcatagaaagaaacttgtctgaaatgtttgtttggccatggcctttaaatatttgaaagcatttatctattatgttgagatgaggtaataataaaaacattcatacatgagaaaaatcctgttcctacaaacaacttggtaaggattttggcatcacattcaatcaccagaaaaatgattgctgcacctctttttcaaaatagccttgaagcaagtaaataattcaccatgttcatacacatctgatggttctcatctccacatgtggtttatgttttgacaattttgttttttgagacggtttctctgtgtagcctaaagtgtatttgatggttcttatattgcttctgtggctactgttgtcttctcttgtgtttttacttggcagatgtctttttgcttcaatgtatataatataatgtctgtcaactaagtggttcattgtctatttaaaaattggactgtgtgtactcttacatttcaagtaagggtgtctgtgaatgggtggggggctcttgttcttgatattgtttatcatattttcacaaattccctagagatgatgtttgttcatcaagcctggcttggatatcagtaattagttagggctgcatagaactctagattttcatgtgtcactcttctgagtacaaatccaaaaccagaagatttacccacaatatatcccgttttgtcacacagtttaacaacattaatgttaaaatgcttaatagaagagaatataagaaaaaatgaatacattatgtgtgtaaacaaagtaacgttttcacctatctgatagagatgtaagaaagtagaataatctgcaatcaaatgtagattcacaacatagcatgatgtgctataaatatgcatatattatttggtgttccatgcctcttcatttcccccttagttatccattgaacgcatcatttagaactatggacttttaagagaattacctagaaatgccagataatgtaacaggaataagatttattttaaaaatctgctggcatacacacacacacacacacacacacacacacgtgcagtgtgcttataaattgttaggaggccatggtggctatgtggagactgcaagacaacttagtgaggtggacttttggccatctttatatgataatcacaatcagcttgccagttttgcactcatagatgtttcctgctgagccatctcactggtactcaaataagattatttgaaatattacatcagtaagttattgtcttcagattataaacgtattgcactctaaggatggaggaaaacagaacaacttactacatacacactatggaacgggagtatacacacaaacagacccaagattttaaattggtaaaatagtagagtagaaaagataacccaataaaggagaatgtatggagtgattcaccaatttaagttattattgagtgtcaggaaacattcctattcatcaggacagtgatagtttctttttaaatattattttattcttttattcaaaggtaagtcatttaaacaaacaaaaaacgtttctcagctgggcttacaagtgctttcgtgtaatccaggaacttgggagatactgacatgtcaatctgtttgagttttaggccaacttggtccatgcagagttctaccatagccatggctctataggcta

SEQ ID NO: 32408 - DNA, 1134 bp, Mus musculus
attagaccagattatcaaattaatttgtacacataaaaaatattcatcagtataatgagtgtgataaaagttttacatgttctaattattattgcaggcaccaaacaagtcatgcaggagagaaacactgtgaatatacacaatatgataacgtcttcacatatcacagtcatcttcacaagcatgaacaaattcaaactcaagagaaaccctctgaaggctttcaacatattgaagctcttgcatgtcatagtagtcttcaaatacataaaagaacagatactggaaagaaaccctacaaatgtaatcaatgtgataaagtcttttcacaacagagacatctccgaacacatgaaagaactcatactggaaagaaaccctatgaatgtgatcaatgtggtaaagcctttgcatatcagtctgctttggtcttgcataaaagaacacatactggagagaaaccctatgaatgtgatcaatgtggtaaagcctttgcacatcactttactgtggtcttgcataaaagaacacatactggagagaaaccctatgaatgtgatcaatgtggtaaagcctttgcatatcagtctgctttggtcttgcataaaagaacacatactggagagaaaccttatgaatgtaatcagtgtggaaaaacctttgcacaaataaatcatctccgaacacataaagtagtacatactggagagaaaccctacaaatgtaatcaatgtgataaagccttttcacaacagagtcatctccgaatacatgaaagaacacatactggagagaaaccttataaatgtaatcagtgtggtaaatcatttgtatctcacagtcatcttcaaagtcatggaagaattcacactggagagaaaccttacaaatgtaatcaatgtgataaagcctttgcacaacacaatagtctccaaatacataaaagaacacatactggagagaaaccctacaaatgcaatcaatgtgataaagcctttgcacaaagcagtagtctccaatatcataaaagaacacatactggagagaaaccctatgaatgtgatcaatgtggtaaagcctttacacatccatctactgtggtcttgcataaaagaacacatactggagagaaac

SEQ ID NO: 32409 - DNA, 1177 bp, Mus musculus
actttctccacctaacccccctcacacacacatcatttggtaaaaaaagaaaagagaaccagagggtgagactccacacattggttacattaagcagaagaatagttaaagtgacctagtgatcccatgtctgtctctagtgcacagatttaaggttaagtttagaaatcaagctttatgtattaaagtagtgctgcaggttgtggtggcacacgactgtcctgtaatcttagcactctacactcggaggctgcaggatgactgcattatggaggctgggctgggcatgaagtaggctaggagtcagcagtgtagaagtaagagccaaagtgtagaagacatgcataatgctttttagaaaaagcagatttgtgtgtgtgtttcattttcaaggtttgtttttattttacatatatgaatgagtatttgactggttgtatataggtacaccaagtgtgtgcctaatgcccagagaagccagaagagatctgagaccctggaatgtggaggaggttgtgagccccatgtgggtactgaacctgggacctctgcaaggtcaccaagtgctcataatctctgagccatcgtttatgactttttttttttttgttctcttactacaacaattttgccaagcatatgacgagatagacagcatttagttcaagcctggtagggcacaagtttgtcagattctatattgcttgccagcctcctggagaacatggccactcagagacatgtgtctttgacatgtattgtccttgattttaaacgttgttgagggttagtcttatgcactgtgtattcagatgctgatttctgtgcccagagatctgcttataccccagccataggcaatgtcatgaggcaagggtacaagagaagaaggccatgaggtagaggaagaaggagattgttgctatgaggtcaggcatgaggaggcttcacgaacaagggggttctccatgtgcaccgctagctacaccaaggagcccaggagagactaaatgtaagtaactcggagtgtgtggctgggaagtagagtagctaggtagcatcaaggcttaaaagttttgctcagctattctgattaaagcttaatgactaaatcagtagatctgtgtctcaattagttgggagcaaggcaggttaggaaaactgccacttttaaatt

SEQ ID NO: 32410 - DNA, 1177 bp, Mus musculus
aagttatacaaagttacaagggcaaggtcacataaattattgctgtatatagtcacaccaggaaggtcatattagtataagttatatacagtcaagagggccaggtcacattaggtcaagctgtacgccagtgcttctcaacttttctaatgctgatacaggttaatacaattccatgtgctcatgcagggtatctgcatgctggcagacacatctagaggcagagcaatagtgtctcaattcctacgcccatcagaaatagtgtttcccaatggtcttaggtagagaactgctgttctagaactttcaggtgagctgttaaatttttagaattagatctgtccagttgttttatgtaggcatgtagtgctatgaactttctcagcattgcttttgttgtctttcataagtttcagtatgttgtgttttcatgttcattgaattctagagtctttaattttcttcctatatttgtgtcttgtcttgtctgtctttttctttttttctttgtttttctctctcttctttctctcctcttccctcccctcccctcttccttccttccttccttctttctttctctctctctctctctctctctctctctctctctctctctcctttttatttttattttttcatacaatgcttcccaaccatggtttccactctctttactgctcccagtttcctccccccattccattcatcctgcttccctttagaaaagaacatgcctcccaggtacatcagctgaacatggcccgagaagatacaataggactaggcagcccagtagtaggaaaagagtcccaatagcagacaaacgattcagaccccctcgccccctccaacacacataatacacacctactgttaggagtcccacaagagcaccaagctaaacaaccatacatatatgcagagaacctagtgtagactgggcaggcccaataatcgcctcttcatctccatgagcccctattagcccaggttagttgattctgtggccctgttctcctggtgtcctcaatccctttggctctgacaattcctcctccctcttttccacagggttccttgagtattgcctaacttttggctgtgggtgtctgcctctgcttccatcagctgttggagaaaaccactttggtgaaatttgagctaggcactgatc

SEQ ID NO: 32411 - DNA, 1157 bp, Mus musculus
ggagataacagagatgggtggtcaccaggtcctccaactccctaaagataggactaacgtgggtcctattattattgttgtcttctctttgttcttttcattattctgataattctaaatattaaccctttaaatactgtcacctgtgtgcagccacttgtttctccgtctcttctttcttgatcattattcctttccaggaatgcatggcctgaaatatttacaagccttctggtatcagaggtgaatgtgatgctcactgctgcagagaaggatgtgggtgattgttcatcactgaggagatgctcctgctccgaaccattcatctgagggcctgagggtttttctagacaagtcaaaatgtcctccgtcccatatcatagctttagaaaaatgtgtattgattactgataacagaacaaatgttgtagttaccttaatttcattcacttggtaatgactaaatcagtggacataagaggaaatgttaattttcatttcagggtcggttaactttcaaagacgtggccatagaattctcccaggaggagtgggaatgcctggactctgctcagcggacgttgtatagagatgtcatgttagagatctacagcattctggtctctgtgggtgagaatagttttcttttgggatttctacttcattctacagtgtctatcaaatgtgtttactatttgtatctgtccattgtctgagtctcagctctcagtctgtcctagacagtactgattgtcttgtttatataaacatttgaaaccagtctaccttgtgtttacatttagtaaaatccttcaatttagtagcacatactctgtgtatctgactgtaaaagttgatttctccagttgtggtttttcatgtggtaattaaaaagatttatttatttattctatgtatatgaggacactgtagctgtcttcagacacaccagaagagggcattggatccctattacatatggttgtgagcctccatgtggttgctgggaattgaactcaggacctctggaagaacagtcagtgctctgaactgctcaaacatctctccagctctttttgtggtaatttaaaggagaataaatatatacaaaaacttaagtattcatttcaggaaagtctaaaatatgtgtcaggaag

SEQ ID NO: 32412 - DNA, 1924 bp, Mus musculus
gcaagtcctttacccagcactcacatcttcaaagacactgcagaatccatacaggagagaaaccttaaaaatgcaaagaatgtggcaagtcttttgctgagggctcatctcttcaaaaacatcacagaatccagtcataagagaacctttacagatgtaaagaatgttcaaaatctattacctgatttgcaaatcttaaaaatcatcctggaatccatactggaaaaagtcttttcaaatgtaaagaatgttttgaatacattaccaaagactgtaaatttagaacacattataaaattcacgtatgagacaaaagcaagggtaattactgacatacttgttcacccaagaaaaatgttctttaaaatatgaagtatagatagaagcctttaaccaatatttaacccttcctcaatatcagagagtcacactaggaagctctacactggtatgaatttgaaaacattttacctagaaatacatcgtatattcactctggtggtttgcctgaaagtggcctgcacagatatataggaagtgacattattagagggtgtggccttgttggagtatgtgtggtttaattggaagaagtcactgggggtggactttaaggtttcagatgcttaagcaaggcccatccattgtcattcttcctgcctcctctcgaaccatgtgtagaattctcagctacctcttcaacaccatatctgcctgtgtgccaccatgcttcccaaatggagataattgacaaaacctaaaactgtaagtgtgttccttaaatattttcctttataggagttactatggttatgatgtctctcacagcaatagaaaccctaaataaatatgatatccactaagcaattttttgaaaataggttacatatgtactaatgtttcatacagaattattctgaaatcaactactaataatggtatagaattcatgttacatttgactaaacttgtaataatttaaaacataaagacttgtaactaatatttctcataaccatctaaaatcaaaattgttgcacatttatgtacttcagtggaacaggatatttatatttgtatggtatagcttcgatgtaaagatattataggatattataggatttgagctttaagtatatgttatagattatgtataatattaaattaactttctgtctcaattactagtaaataaattagagcttgtgtttgtttactgctaccttggggtaatgaatttctattttatactggaaaggtatcattaatgttagccattctatgagtgatatttttaacaaaaacatgtcgcaaaaatacaatgggtaattgggagcattttagggatgtgcagtgaggtaaatgtgggatgtaaaggtgaataccacagcacaaaggatctggtaatggaaataggaacgaggcttcctgagggaagcaaatacagaaggaagaggaaggacggtaacttaataaaaaggtgcctgaaacagtcatggtgcataagtgatgtgataggggaaacaggaaaggaggtttcctaagggaaggggaagggaggcgaatatggatggatggacggtaccatgtaaggatgtctaactatttgccttgaaaccaaacttcatataattctgtttataaagctacatatatagttatgtatcttacttgagctgagaaccctctctccaagaactgaagaccacttaatgaaaatcctaatagcagtcctgagaagttcttttgaattgtttactagggctatctaagagactcccaaaacctacagcccattgctgcattacttatctggccagagaagtagaaaggatgtacccattgctaaagacacagaccatgcacttcaaaaaacagggcccagagattcttgagctggcactgtgctgaatgctcccaccct

SEQ ID NO: 32413 - DNA, 1527 bp, Mus musculus
tgcacagattgtggcaagtcctttacccagagctcacatcttcaaagccactgcagaatccatacaggagagaaaccttacaaatgcaaagaatgtggcaaatcttttgctaaggactcatctctccaaaaacatcacagaatccattcatgagagagtctttacagatgtaaagaatgttcaaaatccattacttggttctcaaatcttatagatcatcctggaatccatactggaaacaaacgttacaaatgcaaagaatgtttgaagtccattaccacaggctgtaaatttagaacacattataaaatttaagcatgagacaaaagcaagggtaattactgatacactgttcacccaagaagtatgttttgttttggttttgttttgtttttatgaagaatggatggaagtctttaaccactcactgttcaactcttcaatattggagtcacatcaggtatccctatactggtttgaatttgaaaaaaaatttccagtgtggtggtttgaatatgcttggctgagggagtacacaactaggaggtgtagccttgtttgaataggtgtggccttgctggaggaagtgtgtctctgttggggtaggatttgagaccctctttctagtcatctgggagccagtcttctactgtttgcctcctgaacaaaatgtagaactctcagctcctcctgtgccgtacctgcctggaccctgctgtactttctctcttgattatgctctgagtctctgaacctgtaagccagctttgattaaatattgttcttttaagagttgccttggtcatgttatcttttcacagcaatggaaaccttaagacaccccaaaatgcatcttatattcactctggtggtttgactgaaaatagcatacacagacatatagggagtgacattagatggtgtggtcttgttggagtaggtgtggttttgttggaagaagtatgtcattggattgggccttgaggtttcagatgctcaagtgaaacccactgtcattctttcttcctggtgcctgctgatccaaaggtagaaatctcagctatctctggagcaccatgtctacctgcatgccactatgtttcccaccatgaagacaatttgcaaaaactctgcatctgcaagtcagccaaaataaaatatttttctttataggagttactgtagttatgatgtctctccacagcaaaagaaaccctaactaatatattcactaagcaatttctttgaaaatagactatgccaggcggtggtggcacatgcctttaatcccagcacttgggaggcagaggcaggcggatttctgagttcaaggccagcctgatccacaaagtgaattccaggacagccagggctatacagagaaaccctgtctcgaaaaacaaaacaaaacaaaaccaaaaaacaacaaaaaaaaggaaaatgaactacatatgtactaatgtttcatacagaattattctgaaatcaactactaataatggtatagaattcatgttatatttgact

SEQ ID NO: 32414 - DNA, 1279 bp, Mus musculus
aatatggtgtcgtctttgcttgttacagtggtctgtagatacacacacaccaatcataatgcagaagagcaaccgtccaaacatcattgacgtgatgaaccatttttataaattatctttgaatacatcaaagaacacatactgaagagaaaacctatgagtgtaagtgatagtgtaacaccttttcacattaaggtaaaaaaatatatgctctggaaaaaccctccaaaagcagtctgtgtgatgaagccgttttacatcaccgtcatctacaaaagcatgcaaagagttattctgaagagaaaccttatgaatgcattttaaattttaaagcctttggaaatttctgtagcctttgtgatcatgaaagtattcatagaggagtgaatctctgtgaatgcaagcaatgtggtaaaccctttgcttatacatcacagttctcaccaaatgcagaaaacaacacatactggctagaaaccttatgaatatatttaatattgtgaagccttcacatttctgtaatcatcatctgactatttatactggaatgaaggcctgtgaatgcgagcaatgtggcaaaatcttttatctgcttccttgcaaaacgtttatttaggagccctgagtggtttgacacctgacaacatggaggtggttgtcagggaacccaagactgaaagagaagtcactctaaggctgtggaaatcaggtatttacagagagccctggagtatggatgaactgtcagggagggagccttaagtgtggaagccagaggatcaaaaggccaaatagcggtgcttgtggagacccagaagacaagcaagctcctgttttactttctgtatccactcagctgttttggctcagcccccttccaggtcttccattctttttggaaactctaagtagctgtcaaagtcagaaccccacggtccaccagttgtcagtaccacttgttccttaaaatgaggatttctgatgctgtcattgctctaagttatgtggttgatagaattaatgatattctaaagagctaagatctaaagatctccctttgggtaatatgtagtgaaaccatgtaccctttgaaatttgaatttcccctaaatgcaatctgggaaagactggttcctccagatgagaatgtccttgttgaataagagaggaagcaacaatttggatgggtttacagatgggaaacattcatatacattggttagattccttaattgtgcatatatcttgcctgctatctgctcacattaggaccccaagg

SEQ ID NO: 32415 - DNA, 1099 bp, Mus musculus
tctcagtcatcttcaaaagcttgaaagaaaccaaactagagacagacactctgaagtctttcaacatagtaaagtgcttgcgtgtcaaagtactctccaaataaataaaagaacagacactgcacagaaaccctacaaatgtaatgaatgtgataaatcctatttaaagctcaagtatctacgagtacatgaaagaacacatactggagagaaaccttaccaatgcaatcaatgtggtaaagcctttttacttgccagctatcttagaattcatgaaagaacacatactggagagaaaccttaccagtgtaatcaatgtgataaagcctttacacaaaggagtcaccttcaaagccataaagtagtacatactggagtgagatcctacatatgtaatcagtgtaataaagcctatccacaccagagttatctccgaaaacatgaaagaacacatactggagagaaaccttatttatgtaatctgtgtgataaagcttattcacaactgaatcttctccgaatacatgaaagaacacatactggagagaaaccttatatatgtaaccagtgtaataaaacctttgcacagctcaagtatcttcgagaacatgaaagaacacattctggagagaaaccttacaaatgtgatcaatgtggtaaagcctttttacatcccagctgtcttcgggtacatgaaagaacacatactggagagaaaccttatatatgtaaccagtgtaataaagccttttcacaacagagttgtctccgaatacacaaaagaacacatactggagagaagccctataaatgtcatcagtgtgataaagcctattcgcaacagagttgtctccaaatgcatgaaagaacacatacaggtgagaaaccctataaatgtaatcaatgtggtaaagcctttgcacaggtcaagtatcttcaagcacatgaaagaacacatactggagagaaaccttacaaatgtgatcaatgtggtaaggcctttacacaaagcactcatcttaaaacccataaagtaatgcatactggagggagactctaaatatataatcagtttgatgaagactattcacagtggagt

SEQ ID NO: 32416 - DNA, 1156 bp, Mus musculus
ttgctgacaaagtttctgacatcgctagctgatcaccaaaagtaatgaacataactgttactttggtagccaacaatcatagttgtgtaacccttccccactaaaaaaagagaaagagagagagaaaaaaaacccaccaacaaaactgtactgtaagcaatctgggttgactctccctgagaggctgagcaatgctatgtgaatctgaataaaaacctcttgccattgcagagatctattgtcaacctgcgtctctgggggtcgcgttctcaacatttgggcccctggggtcctagcacaaccactttgccttatcccatcagtgcactctcaccctacttatctggaaaaaggtcggtcctggaacagcaacatgggcccggaatcactaagctgtgtcccttcatcacacactaaccttaagggaggtgcttatgtcactccagactcgctggccaatcaaggcctcaagtctgacctgccagtcagaattggaggcgggtgcttccgggcgccatgttgctggttcaatgctgtagctgaggaggctggtgtggtttgtttgtcctgctctgtgtgctactgctgggtgctgtgaggggaattcaggcgagctctgacctcgcgacatggtgagtatatggcagctgcttccaatgggaaggggcaggcgattgaacaactggagcgagtatggtgaggcctccctgggactgggtgctagctgcgcacctcagctacacagggccacatgtgaggttgtttgtggtcttggctgctctgaataattctgctctggggcttcatctgtgcgaatatttaagcatgagcttgtgcgttgaaaccttcttggcaagatggcaaacacagaaatgcctagtttctccagtatcttctacaattttgtttgtttggttggttggtttttcaagacagtgtttctctgtattgccctggctctcctggaaatcactcagtttggctagcctcaaactcagaaatccgcctgcctctgcctcccaagtgctaggattaaaggcgtgcgccaccactgcctggctttaaacacacacacacacacacacacaaaacttttttttttaatctcatacaatttttacactttcttttaagattgtgatgcaagatatatttg

SEQ ID NO: 32417 - DNA, 1507 bp, Mus musculus
tgtagtcttcatcctcatggaaggattcatacagtagagaaaccatatgaacaaaagaaatgtggtaatgcttttgctcatcacagttatctcttattatagaaaaaaggagatattagagaaagatcctacaagtatgatagaagtaatgaagccattgcacaacacagttatctctgactacattaaaggatagataatgatgacaaacactataaatgtaataaatggggtaagcccattatataacatggtcaactttgaatacagaaaaagacatactaggcaggaaccctatgaatataagcaatgtagtaaacacatgaaaccattcatactggagagaaacagtattgaaggtattaaatatggtgaagtctttgcttgtaacagtggtctttagatacacacacacaaatcataatgtggaagagcaaccatccaaatataattgatgtgataaaccatttttataagttatctttgaatacatcaaagaacacatactgaagagaaaaaatatgaatgtaagcaatagtgtggcgccttttcgtattaaggtaaaagaatatatgctctggaaaaacccttcaaaaccagtctgtgagatgaagccattttacatcacagtcatcttcaaaagcatgcaaagagtcgttctggagagaaaccttatgaatgtattttaaattgtaaagcctttggaaatttctgtagccttcatgatcgtgaaagtattcatagaggagtgaatctctgtgaatgcaaacaatgtggtaaaccctttgcttacacatcacagttctcaccaaatgcagaaaacaacacatactggcaagaaaccttatgagtatatttaatattgtgaagcctttgcacatttctgtcatcatcatgactatttatactgaagacaaggcctgtgaatgcgagcaacgtggcaaactctgcttccttgcaaaatgtttatttaggagccctgtctcgaaatccctccccaaattttttttctttggatcgtatagaatccattctcctcattgatgatatccaacattgcttttctttatattgttttctggaagtacatcattttgatggtgctggaaagaaccaagatgtccttcaacaaagaaatggatgtagaaaatgtggcatatttacacaatggagtactactcaactattaaaaacaataaattaatcagattctttggcaaatggataaaagtagaaactattatcctgagtgaggtaacccaatcagaaaagaagatacatggaatggactcactgataagtgaatattagccgaaaagttctgaatacccaagatagaattcacagaccgtatgaagctcaaggagaaggaagaccaaagtgtgggtgcttctgtccttcttagaaaggggaacaaaatatttatgggagtaaattgaggttcaaagtgtagagcagagattgaaggaaagtgatccagagactgccatatctggggatccatcct

SEQ ID NO: 32418 - DNA, 1302 bp, Mus musculus
aaccctacaaatgtaatgaatgtgataaagctttttcacagcccaggtatcttcgaatacatgaaagaacacatacgggagagaaaccttaccaatgtaatcagtgtgacaaaccctttgcataaggcaataatctcaaagtacatacaagaatgcatattggaaagatccctatgaatgtaatcagtgtggtaaagcctttgcatatgactaatcttttgggatgcatcaaagaacagatactggagagaaacgttaccaacataatcatagtcttaaagcctttgcagaaagcagtcatcttcaaacccataaagtactacatactggagagactctacaaatgtaatcagtgtgataatgcctcttcacaacagagaggtctccaaatacataaaaggaaacatctgtagagaaaccttagaaatgtagtcaatgtgatgacgcctattcacaacacaatggtcttacctacaataactcatactggagagaaaccctatgaatgtaagggatttagtaaagcctttgcacattacaatatgctccaataacataaaaacgaccatactaaagaaactctatgaatataatcacagggtgaagcatttgaacatcacagtagtctctagaaacaaaaaaggaaccatctaggaaagaacccctataaagttctttaacatggtaagggctttgcacaaatctgtagtcttcatcatcatggaaggattcatacagtagagaaaccatatgaacaaaagaaatgtggtaaagcttttgctcatcacagttatctcttattatagaaaaaaggagatattagagaaagatcctacaagtatgatagaagtgatgaagccattgcacaacacagttatctctgactacattaaaggaaagataatgatgacaaacactatgaatgtaataaggggggggggggtaagcccattatataacatggtcaactttgaatacagaaaaagacatactatgtaaagggctgcaatatatgtgccgccactagatggtgctaaacctctttgtgcgcagctgcgagagcatagcaagccaaagtcaccagtctgtctcccggggcttttgcccagcccctgggggctttaacctatccccagggtgcatgaggatcatgggtgttgctaccagtcctagtttagacacgtcaccaaaagtatttaagccacacactttctgagccttctttgtctacctcactatgttatgaagtaaaagttaaccacggaagaacctggcgtgtcctgtgtttatttcctgcgggac

SEQ ID NO: 32419 - DNA, 3186 bp, Mus musculus
aagggggagtgggtgggcaagggagtgggagtgggtggatatgggggacttttggtatagcattggaaatgtaaatgagctaaatacctaataaaaaatgggaaaaaaaagacatactaggcaggaaccctatgaatatacgcaatgtagtaaacacatgaaatcattcattctggagagaaacagtattgaaggtatgaaatatgatgaagtctttgcttgtaacagtggtctgtagatacacacacactaatcataatgcataagaccaaccatccaaatataattgacgtgataaaccattttataagttttatatctttgaatacatcaaagagcacatactgaaaagaaaacctatgagtataagcaatagtgtggcgccttttcatattaaggtaaaagaataaatgctctggaaaaaccctccaaaagcagtctgtgtgatcaagccattttacatcacaatcatcttcaaaagcatgcaaagagtcattgtggagagaagccttatgaatgtattttaaattgtaaagcctttggaaatttctgtagccttcatgatcatgaaagtatacatagaggagtgaatctctgtgaatgtaagcaatgtggtaaaccctttgcttacacatcacagttgtgaccaaatgcagaaaacaacacatactggcaagaaaccttatgaacatatttaatattgtttagcctttgcacatttctgtaatcattgtcatgactatttatattggagagagggcctgtgaatgcgagcgacatggcaatctctttattcaccagatgcagagaacatatacagtagagaaaccttatgaatgggctaactgtggtaaagcctttgcacatcacaataatccctgaatacatataagaacacattctggagaaaagcccaatgaatgaatgtaatcaatatcataagaaatttgcatgtggcagtagtctttgaatatattaaagaacagatactggagagaaaacatacgactacttggggaaatgtgaaagaactcataatgtagagaatctgaatataaaggatttggtaagatcattatgttcagctacacaagattattctggagaaaagtaatctgacaaatgtcaaccatctactaagcacagtgttcctttttattttacatgcacctgcaaactcatctggacaaaactactatggatttaaatgataaacaaaaaaccctttagatttttcttctcttgaatttcacaaaactctggtataaaatttttgggtgtgtattgatgacttttttgtttctgagataaaacataatatctaatacaacttacaaagaagtttagtttagcttatggttccataagtgtcattaaatcagttgtgagacatggcagctaaaggaggaagctcagctatcacatcttcaacttgcagcatgtagcaaggagtgggaactagagctgtcatacagatgtaaactctcaagccctcctccactgacatatttcctccaccagggcattatttgttaaatgatacaatggtttcaaatgatacaatcaacataaaaggattgatttctctgattgcaaacatacctctgtatgtatttatagctctgtaaatatttgaaagtgtttatgtattatgttgacatcaggtaataaaacattcatacatgagagaaagtctattcccacaaacaatttagtcaagattttgacatcacattcagtccccataaaaatattgatacacttctttttccttttttattttttgttgtgttttgttttttgagacaggctttctctgtgtagccctggctcttctggaactgactttgtagacctggctggcctcgaactcagaaatctgcctgcctctgcctcccaagtgctgggattaaaggtgtgcgccaccatctcccagctacacctctttttcttaatggccttcaagcaagtaaataattcaacatgttcatgcaagtctgatgcttcatatgaggtttatattttgagagttttgaacttggtgtttaagtgtgctgtatgtgtgataaatgccattatttaaacgtgatttggcttagagactattaatgactacttctatttctttaggggatatgggactgtttagattgttaacttgatcctgatttaactttggtacctggtatctgtctagaaatttgtccatttcgtccaggttttccagttttgttgagtataaccttttgtagaagcatctgatggtgttttggatctcttcaggatctgttgttatgtctcccttttcatttctgattttgttaattaggatgctgtccctgtgccctctaatgagtctggctaagggtttaagcttgtagaaccactttggaaatcagtctggcggttcctcagaaaattggacatagtactactagaggatcccacaatacctctcctgggcatatatccagaagatgtcccaactgctaagaaggacacatgctccactatgttcatagtagccttatttacaatatccagaagctggaaagaaccaagatgcccctcaacagaggaatagatacaaaaaaaaatgggtacatttacacaatggagtactattcagctattaaaaggtatgaatttatgaaattcctaggcaaatggttggacctggagggcatcatcctgagtgaggtaacccaatcacaaaagaactcaaatgatatgtactcactgataagtggatattagcccagaaacttggtatacccgagatacaagatacaatttgcaaaacacatgaaactgaagaggaatgaagaccaaagtgtggacactttgcgccttcttagaattggaaacaatcacccatgaaaggagttacagagacaaagtctggagctgagacaaaaggatggaccatctagagacagccatatccagggatccatcccataattagcctccaaacgatgacaccattgcatacactagcaagcgtttgctgaaaggaccctgatatagctgtctcttgtgagactaggctggggcctagcaaacacagaagtggatgctcacagtcagctattggatggatcacagggcccccaatggaggagctaaagaaagtatctaaggagctaaagagatctgcaaccttgtaggtgcaacaacattatg

SEQ ID NO: 32420 - DNA, 1119 bp, Mus musculus
agaggtgttgtattctgtttgtcaaaggccttgtttttttttttttttttttttttttttttttttaggatctaatgagatgatcatatcatgtttgcattttagtttgttaatatagtgaatcatactgatggattttcatatattgaaccattcctgcatctctgggttgaagtctactttatggttgtgaataatggttttgatgtggtcttgggtcttattgagtatttttccatgtatattcataagcaaaaatggtctgatgttctgtttctttgttaattttttgtatggtttagctagcagagtgaaccatacaaagtgaattcataaaatgaattaaggtagcgttctgtctgtttctgttttgtgaaatagtttgaggattattggtattagctactctttgaaggtctggtaaaattgtccactaataatctctcatcattcaactccttttatagaccagttttctgtttttttcttaaaagatttattcatttattatatatatatatatgagtatactgtagctgtcttcagacacaccagatcccattacagatggttgtaagtcaccatgtggttgctgggaattgaactcaggacctctgggagtgcagttgatgctcttaaccactgagccatctctctagcccaatagtcaaaatttccaaacaccttgagtattctgtaacaaaaattttcaaacttataaaacacaaaaattcacattcactgtaagaccagcctcattatttttttttcaagtttttatccagtgggtatccttgtctagaagaaggtgttgggcctcttggtgatgaagctgctacaacatgtggtggagaaatgagattttgatctaagagttgtggaactgcttgacagctggacagctacacttgccagcggcaatttcttccaccttcatgatctggatggagtgtgctggggcagagtgttgtgcacccatgtttggtcactgtgtgactgcgccagccatggtcaggtcctggtactcttggtatatgttgtgtgtgccactggggaagtcatagggcagccagatgccaaacctcttcacacacaggggtgacttctcaaacatctgcc

SEQ ID NO: 32421 - DNA, 1330 bp, Mus musculus
aagtacccatcaaatgcatacctcctgttccttgtgactatgagcaatatagttttctttcatcatttgaatctctttaactcagcaaaggactggtgttaaagtgtccttatgctacagttactgaaaaccagactcacacagataagtagctttacaacggagttaagtgtaactgctcatcttactcatccaagccaggcattgtaacactggcctatgatcattgtccttagaaaatggagggaggaatctcaaagtcatgcaaggtgaaaatggttaattgggtgtggtgagagtcccatggatccaactggagattttgattgcctcatatcagccgctcagctagatttcaacttaacccaatttctgctgttgtttctctccatgtggcactgaacgcatatattggctattcctggttgtcaacttgactatatctggaatgaactacaatccagaattggatggcttaccagtgaccctaatctggaggcttggtagataagtttctgacctggatcttgatatggacatcttgatgcattgtggctatggattccagaagattaagacagggtgatctctgagttcaaggtcatctgggattaaaggtgtggtggtacacatctttaatctgggttacaccttttgctggagactatataaggacattggaagaaggaaggctggctctctctcctttgcctgcttcccgtgtgagactgagcaactgctagatccttggacttccattctacagctgctactgaccattgttgggagttggactgcaggctgtaagtgataaattccttcacgatatagagactatcaataagttctgtgactctcgagagcgctgactacactgctgttcatccctgtgcctttcatgtccatacttccatcctgctacatccgtgcctgttagtgcttctatccagctctagccaccaggtctttattatacaaaaagccatgctcttcactcatccacttggcagtggggtcttacttgatcttccccagggtggcttgtctttctttgcggggcaggtgaggaaaggacaaatgaacaaacatttgcatatcctgctagcctggcacaactaacatggcaattaacaattgagaatacagggacatacggtaaatgtgtggttatcccacactcaagtataatagctgtgctcagcctggaagtagttgtccacgtttcttcgttcagggtttatttttaaattctaagtgagttaccatggcattctgcagttccacttaccacattctgaggtgagaccttgggactatgatgatgagccca

SEQ ID NO: 32422 - DNA, 1195 bp, Mus musculus
aaggtattaaatatgttgatgtctttgcttgttgccttggtctgtagataaacacacaaaaatcataatgcagaagagcaaccctccaaatataattgacgtgataaaacatttttataagttatctttgaatacattaacacatactgaagagaaaaacctatgaatgtaagcaatagtgtggcaccttttcatattaaggtaaaagaatatatgctctggaaaaaccctccaaaagcagtctgtgagatgaagccattttacatcacagtcatcttcaaaatcatgcaaagagttgttctggagagaaaccttatgaatgtattttaaatcgtaaagcctttggaaatttctatagccttcatgatcatgaaagtattcatagaggagtgaaactgaatgcaagcaatgtggtaaaccctttgcttacacatcacagttctcaccaaatgcagaaaacaacacatactggtgagaaaccttatgagtatatttaatattgtgaagcctttgcacatttctgtaatcatcatcataactatttatactggagagaaggcctgtgaattcgagtaatgtggcaaacttttttatctgcttccttgtaaaacgtttatttaggatccctgagtggtttgacacctgataacatggaggtggttgtcagggaaaccaagactgaaagagaagtcactctaaggctggggaaatcaggtatttacagagagtcctggagtatggatgaactgtcagggagggagccttaagggtggaagccagaggatctaaaggccaaatagtggtgcttgtggagacccagaagacaagctagctcctgttgtactttctgtatccaccaagctgttttggctcagctcccttccaggtcttccattcttcttggaaactctaagtagctgtcaaagccagaacctcatagtccaccagttgtcagtacccagttgttccttaaactgaggagtccagacgctgtcattgctctaagttatttggtcgatagaaataatgatattctaaagagcatttatagatctccctttgggtaatatgtagtgaaaccatgtaccctttgaaatttgaatttcccctaaactcaatctgggaaagactggttcctccagatgagaatgtccttgttgaataagaaaggaagcaacaattcgcatgggtttac

SEQ ID NO: 32423 - DNA, 1128 bp, Mus musculus
tgatacctgacactcattcagagttttgatggggtttccaggggcagaatagagcatcaacaactaggcacaatgtgattgacggaacagtggaccctttaaactgattggtctttagggaatgaggtgacaaggagttcccttgtctgaggctgggcaacagtccatcctgtggaatgtgtctccacccacaggggggtttccacacattggtctgagcaatgctaattagcctctctctccttgagaggcaagcatttcatgacctttccaaagttcctgagctgaccttttcatttcgtctccatgtttcctcctgtgagtgttttgttcacgaagcatccacaggttggtcttccttcttcttaggcttcattttgtctgtgaattgaatcttgatattctgtacaatttggctaatatgcacttatcagtgagtacatatcatgtttgtgcctttgtgactgagtcacctcactcaggaagatattctcaagttccatccatttgcctgaatatttcatgaatgcattgtttttaataactgagtagtacaccattgtgtaaatataccacatactatgtatctatccctctgttgagggacatctgtgttgattacagcttctggctattataaatatggctgctatgaacatagtgaaggatgtatccttattacatgttggagcatcttctgggtatatggtatagctgggtcctcaggtaatactatgcccaattttctgaggatacatgagattgatttccgaagtggttttaccagattgcaatcccaaaatcaatggaagaatgttcctctttgtccacatcctctctagcatatgcgctaaactgtgttgcttttatttttgttttttgtttgtttgtttggttggttggttttttttgttgttgttgggtttttttgtttttttttttgttttttggctatttggtttttctagacaggtcttttctgtttagccctggctgtcctagaactcactctgtagaccaggttggcctagaactcagaaatctgtctgcctctgtctcccaaatggtcggattaaaggagtgcaccaccacttctctgctctttttttttttgtaagattatatttg

SEQ ID NO: 32424 - DNA, 1765 bp, Mus musculus
cttagggctaggacatcattatattctgttttaagtgtttattttatgtatatgggtgttttcatgcatgtgtctgagcacaatatctacagagtccatgagatgccttgggaatgctgttacaggagatgattagctaccaggtaatttctgtgaatagaaactgtgtcttctataacaacaaccagggctcttacctggtatcctatttttctggcagcttttttctgtgttttaactttattacattttaataaaaatatgttacatcactttctaccgtccttgtcctttctccatcttgtccaaattcttccttgttaagtatctatggatagggatgcacagctataaaaataaaacctggctctttccgttcccagcgcagccatgactcgtggtcccaagaaacacctgaagcgcgtagctgctccaaaacattggatactggataagctgactggcgtgtttgctcctggtccatccactggtcctcacaagctgagggaatgcctgcctctcatcattttcctaaggaacagacttaagtatgccctgaatggagatgaagtaaaaaagatttgcgtgcagcgattcattaagattgatgggaaagtcaggaccgatataacctaccctgctgggtttatggatgtcatcagcattgacaagaacagagagaacttccgtctgatctatgacaccaagggtcgctttgctgttcatcatattacactggaggaggcccagtacaagttgtgcaaagtgagaaagatctttgtgggtacaaaaggaatcccgcatctggtgacccatgatggtcgtactattcggtaccctgatcccctcatcaaggtgaatgataccattcagattgatttggagacaggcaaagtaactgacttcatcaagtttgacactgggaacctgtgtatggtgactggaggtgctaacttgggaagaattggtgtaatcaccaacagagagagacatcccggctcttttgatgtggttcatgtgaaagatgccagtggcaacagctttgccactcggctgtccaacatttttgttattggcaagggtaacaaaccatggatctctcttccccgaggaaaaggagtccgcctcaccattgctgaagagagagacaagaggctagcggccaaacagaacagtgggtgaaatgctaggaaagtgtttgtacaagcctttccaggcaacatacatgctagattaaacagcatggtgaaactactaaataaataaataaataaataaataaataaataaatattaaaaaataaaacctgatcaatccatttctgttgggtgtgtgtatatagttctatggctgaaaacttttgttggatatgcaattaagtatctcattgccacctgaggctaactttttccaattgcacaattccactctttaatgagctagaggagtctgataatgaagcaacctaggctgacatggactaaaatatggagaacagaaaatatggcacgagaagaagcaaagaactgagatgtccctcaacagaaaaatggatacagaaaaatgtggtatatttacacaatggagtactactcaactattaaaaacaatggatctatgaaattcttggacaaatggatgtatctggaggatatcatccttagtgaggtaacccaatcacaaaagaattcattagatatgcactcactgataagtggatattagcccagaaacagaacacccaagatacaatttgcaaaacac

SEQ ID NO: 32425 - DNA, 3042 bp, Mus musculus
accatactgaagaaactctataaatgtaatcacagggtgaagcatttgaacatcacagtagtctctggaaacaaaaaaggaaccatctaggaaagaactcctataaagttctttaacatggtaaggtctttgcacatatctgtagtcttcatcctcatggaaggattcatacagtagagaaaccatatgaacaaaagaaatgtagtaatgcttttgctcatcacagttatctcttattatagaaaaaaggagatattagagaaagatcctacaagtatgatagaagtgatgaagccattgcacaacacagttatctctgactacattaaaggaaatataatgatgacaaacactatgaatgtaaaaaggggggggggtaagcccattatataacatggtcaactttgaatatagaaaagtacatactagacaggaaccctatgaatatcagcaatgtagtaaacacatgaaaccattcatactggagagaaacagtattgaaggtattaaatatggtgaagtctttgtaacagtggtctgtagatacacacacacaagtcttcatgcagaagaacatccctccaaatataattgatgtgataaaccatttttatgttatctttgaatacatcaaagaacacatactgaagagaaaacctatgagtgtaagcaatagtgtaatatcttttcatattaaggtaaaagaataaatgctctggaaaaaccctcctaaagcagtctgtgagatgaagccattttacatcacagtcatcttcaaaagcatgcaaagagtcgttctcgagagaaaccttatgaatgtattttaaaatgtaaagcctttggaaatttctatagccttcatgatcatgaaactattcatagaggagtgaatctctgtgaatgcaagcaatgtggtaaaccctttgcttacacattacagttctcacaaaatgcagaaaacaacacatactggcgagaaaccttatgaatatatttaatattgtgaagcctttgcacatttctgtagtcatcatcatgactatttatactggagagaaggcctgtgaatgtgagcaacgtggcaatctttttattcaccagatgcaaagaaaacatacagtagagaaaccttatgaatgggctcactgtggtaaagcctatgcacatcacaataatccctgaatacatataagaacacattctggagaaaagcccaatgaatgaatgtaatcaatgacataagaaatttgcatgtggcagtagtctttgaatatattaaagaacagatactagagagaaaacatacgactgtttggggaaatgtgaaagaactcataatgtagagaatctgaatataaaggatttggtaagatcattacgttcagctacacaagattattctggagaaaagtagtccgacaaatgtcaaccatctactaagcacagtgttcctttttattttacatgcacctgcaaactcagctggacaaaactactatggatttaaatgacaaacaaaaaaccctttagatttttcttctcttgaatttcacaaaactctggtataaaatttttgggtgtgtattgatgacttttttgtttctgagataaaacataatatctaatacaacttacaaagaagtttagtttggcttatggttccacaccaccatagtgtcattaaatcagttgtgagacatggcagctaagggaggaagctcagctatcacattttcaacttgcaccatgtagcaaggagtgggaactagagctgtcatacagatgtaaactctaaagcccacctccactgacatatttcctccaccagggcattatttgttaaatgatacaatggtttcaaatgatacaatcaacatagaaggattgatttctctgattgcaaacatacctctgtatgtatttatagccctgtaaatatttgaaagtgtttatgtattatgttgacatcaggtaataaaacattcatacatgagagaaatcctattcccacaaacaatttagttaagattttgacatcacattcaatccccataaaattattgctacacctctttttccttttttattttttgttttgttttgttttttgagacaggctttctctgtgtagccctggctcttctggaactgactttgtagaccaggctggcctcgaactcagaaatctgcctgcctctgcctcccaagtgctgggattaaaggcgtgcgccaccatctcccggctacacctctttttcttaatagccttcaagcaagtaaataattcaccatgttcatgcaagtctgatgcttcatatgaggtttatattttgagagttctgaacttggtgttgaagtgtgctgtatgtgtgacaaatgccattatttaaacgtgttttggcttagagactattaatgactacttctatttctttaggggatatgggactgtttagatcgttaacttgatcctgatttaactttggtacctggtatctgtctagaaatttgtccatttcatccaggttttccagttttgttgagtatagccttttatagaagcatctgatggtgttttggatttcttcaggatctgttgttatgtctcccttttcatttctgattttgttaattaggatgctgtccctgtgccctctaatgagtctggctaagggtttaagcttgtacaaccactctggaaatcagtctggcggttcctcagaaaattggacatagtactaccggaggatcccgcaatacctctcctgggcatatatccagaagatgtcccaaccggtaagaaggacacatgctccactatgttcatagcagccttatttataatagccagaagctggaaagaacccagatgcccctcaacagaggaatggatacaaaaaatgtggtacatttacacaatggagtactactcagctattaaaaggaatgaatttatgaaattcctaggcaaatggttggacctggagggcatcatcctgagtgaggtaacccaatcacaaaagaactcaaatgatatgtact

SEQ ID NO: 32426 - DNA, 1181 bp, Mus musculus
atatatgggtcaagatgcctggctttattgtttcagggccgggaatggatttttttttttttgcacatgacaagcatgtgttgttgttttgtgcttcagttacatcttgaataataaaatttgccagagagtattattctaattcccaggatggcacttaattgtgacattaatactgcctgatccttctaattcttttgattttaagagtgagacatttttctacatgttgtctttttttgaaatgtttgaatgactatgaatacatatgcacctctgtgtgcttggtcctcactatagtcaaaatatggcctcaggactcctgaactcagagtcatgaatagttctgagcttccatgataattcctacaattgactcctatatctaagaccaggaagacatattaagcccatgccatctctactacactatgttgtttatttatgaaaagcatttattttgctaatgtttccatttgttcattataactttatttatttatttatttatttatttatttattatatgcaactacactgtagctgtctttagaaacaccaaaaaagggcatcacctctctttaaggatggttgtgagccaaaatgtggttgctgtgatttgaactcaggacctttggaagagcaatctatgctcttaaccactgagctatttctccagccctttaagttacatcttatttatgtcacagtgtaaactgcggaatttcaggatcttggaatatgaagacagaagaattacagtatctatttaatttaattctgagattctttctatttttcttctctgggtttttattttgttgttttaaacgttgttgggtgattttattttgttggttttttgtttttgttgttgtttgatagatttttttttcttgagacagggtttctctgtatagccctggcattcctagaactcactctgtagaccaggctgtcctcgaactcagaaatcagcctgcctctgcctcccaattgctgggattaaaagggtgatgcaccaagcctggtttatttgatagatttttgcagcagagacaaggtcataatgagtagtgctgcctttctggaacttgtttaatagacaagattggcatacaagtcaatgagatacacattcctgtatttcatgacatttcaattaaaggcatgagcaaata

SEQ ID NO: 32427 - DNA, 1120 bp, Mus musculus
tatttcttaactgatataactgtttgaatcttatcaccattagagctatacagtagcactgccattccatgtacattcacaccaatcagatattgcaaattgtacacacattgaatctgtgtatgtccaaaatcttctactgagcaaatagttcatggttaagcagctgttattcatatccttgtcttaaatctgataagtttagtgagaggggaagttcatgagcattaaggatgttgtgctggagaaaccttactccctaccatacgaggaacaaaaagtcaaactgtgtgaatgtaaggtggaaaccctttatttgttattcttttaataggtatatcatatgtcatactggatacaggccatatgagcagaaggattttgaaagaaacagagtatctctctttcctagaactatttattagatcatagacggttgcagtaaatctccaacccaaacaggccccaacaatgaaaatacaactcagttaatatgaacacatgctgggtgcctagactgggtagatctattgctattcactctaccatcttctatatccatgaaaaaacctgagaacttgcagtttctccaggccatgtgccttctgctctgcttttcttcttccttctcctctttgtcctctccctcttccattttctcctccttctctctccctaccttccctttaatgtgcccaatcatcacctctctttattttacaaattaaggtgggaagtaggtttacaggaagtcacatgagggctgactcattccatgttcacaaccactctcaggagaatgtaattaacatcaaatataattagccaagggctatccacaacagtacatgataggccccactttgaggagactttctgaatgtgattcaagtttatagtcacttagattttcagcttcatttggaataaaaccataaaattatactacagaaaatcctatgagcattaagaatatggaatttttgattgtccttcacttttcaaatatgatatgactcacagtgcaataaaatttgtgaacacaattatgaaggtaaatctgtgaattcatgcagttttgttcaagtatctgaaaaacttgatgtatctaaagtctggt

SEQ ID NO: 32428 - DNA, 1785 bp, Mus musculus
ggtgatcacattggtgggtatactatttggggaggtttgcttcatcgaataaatattgaattcccaggttgggggcactctttataaatatgtcccagtgcatttgcccagtgaagtcaactcagaattgagaaggccattgggcgtgactgtgtatttggttggtcaaacatcttttaatgccattccctctactaggaaatcactgcccttatctcttttttatttgaatgaacacttttttaaaatatatttttaattatgtattttcctcatttacatttccaatgctatcccaaaagtcccacataccctccccccccccactcccctacccacccactcccactttttggccctggcattccccagtactggggcatataaagtttgcaagtccaatgggcctctctttccagtgatggccgactaggccatcttttgatacatatgcagctagagtcaagagctccggggaactggttagttcataatgttgttgcacctgcagggttgcagatctctttagttccttgggtactttctctagctcctctattgggggccctgtgatccatccaatagctgactgtgagcatccacttatgtgtttgccaggccctggcatagtcttccaagagacaactatatcagggtcctttcagcaaaatcttgctagtgtatgcaatggtgtcagcgtttggaagctgattatggggtggatgcctggatatggcagtctctagatgatccattcttttgtcacagcttcaaactttgtctctgtaactccttccatgggtgttttgttcccaattccaagaaggggcacagtgtccacactttggtcttcattcgtcttgagtttcgtgcgtttagcaaattgtatcttatatcttgggtatactaagttttgggctaatatccacttatcagtgagtacatattgtgtgagttcctttgtgattgtgttacctcactcaggatgatgccctccaggtccatccatttgcctagaaatttcataaattcattctttttaatagctgaacagtactccattgtgtaaatgtaccacattttgtgtatccattcctctattgaggggcatctgggttctttccagcttctggctattataattaaggcggctatgaacatagtggagcacgtgtccttcgtaccggttgggacatcttctggatatatgcccaagagaggtattgctggatcctccggtagtactatgtccaattttctaaggaacctccagactgatttccagagtggtggtaaaagcttgcaatcccaccaacaatggaggagtgttcctctttctccacatcctcgccagcatctgctgtcacctgaatttttgatcttagccattctgactgatgtgaggtggaatctcagggttgttttgatttccatttccctgatgattaaggatgttgaacattttttcaggtgcttctctgccattcggtattcctcaggtgagaattcttttttcagttctgagccccattttttaatggggatatttgattttctggagtccaccttcttgagttctttatatatattggatattagtcccgtatctgatttaggataggtaaagatcctttctcaatctgttggtggtctttttgtcttattgacggtgtcttttgccttacagaagctttgcagtttcatgaggtcccatttgtcaattctcgatcttacaacgccaggcattgctgttctattcaggaatttttcccctgtgcccatatc

SEQ ID NO: 32429 - DNA, 1158 bp, Mus musculus
atgaccatgaacttacagtgaccagagtcagaatgcagtcaattgaatgtaaaatcttcctatctgtgatgatgcctttgcacatcatttgtccttaataactgtttgcagggaagtctttgaagcttgtgtaagaggaaagtttctagatgaaagtcctccttgaggataggattggagtgttcatagacccatttcctgttctttgtgtccactggtttgttgttaaaagtgaccagtcagcttctttctcatgctgtcatcatattgactctatccataaatcaaatatgatagtgtagaagcaattcccattcagacctacctgattttgctatgtctagtttttatagttttaattttgttgggttttttttttttttttttttttttttttttttttttttgaagacaggatttctctgtgaaatcctggatgtcctagaagagttatgtagactagaatggacttacatttagagatctacctatgtgactcttctcggcagagattaaatatgggtcaagatgcctggcttttattgtttcagggccgggaatggattttttttttcacatgacaagaatgtatggttgttttgtgtttcagttacatcttgaataataaaatttgccagagagtattattctaattcccaggatggcacttaattgtgacattaatactgcctgatccttctaattcttttgattttaagagtgagacatttttcctacatgttgtcttttttttgaaattttgaatgactatgaatacatatgcacctctgtgtgcttggtcctcactatagtcaaaatatggcctcagaactcctgaactcggagtcatgaaatagttctgagcttccatgataagtcctgcaattgactcctatatctaagaccagcaagacatattaagcccgtgccatctctcctacactatgttgtttatttatgaaaaacatttactttgctaatgtttccatttgttcattataactttatttatttattatatgcacctacactgtagctgcctttagaaacaacaaaagagggcatcacctctcttgaaggatggttgtgagccaaaatgtggtttctgtgatttgaactcaggacctttggaagagcgatcagtgctcataactactg

SEQ ID NO: 32430 - DNA, 1117 bp, Mus musculus
tgccagggatcagttcatgtgtgctcaaagagatatttagttctttatttcttttttcttttttttcgagacagggtttctctgtatcgccctggctatcctggaactcactatgtagaccaggctggcctcgaactcagaaatccgcctgcctctgcctcccaaatgctgggattaaaggcgtgcgccaccagcgcctggcacaagatatttctttctttctttcttcctttcttccttccttccttccttccttcctttctttctttcttccttccttccttttttttttttttttttttttttttggcttttcaagaccaaaaaaaggggggggtttcaagtttttctcttctatccctggctgtcctggaactcactttgtagagcaggctggcctcgaactcagaaatcagcctgcctctgcctccccagtgcctgggattaaaggtgtgggcccggctaagatatttcttaattaatgttctcattgtgagtgtagtgatttctccctgggaaagcatatcaattctagaacaactgcatcttcagccttttaggtttctgagacatgggattgtttgattgtgtttccctggatttctttaagggatgtattcattgccactttaaggacctgtatcatcttcatatagttggttttaaggactttttcttgtgctttcagctatgttgaaatattcaggatctgttgggataggatagtttggctctgttgctcacctgtttccctgggttttaatgattatctgcctatgcttgtgtctaggcatctgggtttggggtgattatcggtctaggttttgatttctgggttcatcttgcaagggagttttgttcctgggcttctggttgccctttgtatttccagagtgtgttggctggatgatggctattttattggcctgcttgcctggtgtgttcaagtgggaatgcttgctggtgttggaggcttgatgaagatgaggccagggagatatgatcttagctatccataggatatcatctattcatatatgaagagggtggtgaagttgaccctgctgttctggtccattgcttaggacaactgtgaagattgagtttgggataactg

SEQ ID NO: 32431 - DNA, 1101 bp, Mus musculus
gatgacttacagtttttagtccaactccccaccaatggtcagctgtgatagggaagtccaagaatctcatagttcctcagcactttataggcctactttttcagctggttttctgtagaagtcggttccaacaaaagtgctggcaagtaaatgtaagcaggtgaagaagagccaatcttccttcttccaatgtcctcatgtaggcctccagcagaaggtgtgtcccagattaaaggtgtgtaccaccatgcctggatctggggcttgctttgtcccaggctgaccttgaactcagggatctccttgcctcagtctcttgggattacaggcatgggctggcttttgatggctgctgtgccgcaagatctccatgtcaagatccaggtcagaaacttgtatctcccagcctcaagatcaagatcacaggtgtgccttccaattctggattgtagttcattccagatacagtcaagttgacaaacagacacagccattacagggtggaaaggtgggattgtctgtggtgtctgcctgaggcatggacagtaggagaggaagctgcatcactagggccaaccatgagtattgggtcccaaggtaacagagactggggaagatctggaggcatcctaccttgtcccatacccaacatcttaatactgagacatcaggttcccagggatcatgtatttacttcttcattcattaggtttctattattgatcaaacaatatctttgtttgtttgtttgtttgtttatgggataaaaaatactatgtggcctgggaaggtcactcagtgagtgttcttcttggagttgacctgaattcagatagcaactctcaagtgaggaggctcacaaacacctgctatgccaaatccacaggatccgacaacttctctggtaagtcacctgtacacacatggaaagcattctctgtcattcacacaaatacaaacagaaaattgaggatacacttgttttcaaaagagcaaaacaagctctttagctgaataatttgttatctttcatttagttttgaaaagtgtgcatttcctcactctggtgtagacttacatccaatcatcatcaatcatagg

SEQ ID NO: 32432 - DNA, 1728 bp, Mus musculus
cacctgcaaacacatctgaacaaaagctaacccttttagattttacacttcaattacacaaaaaactcatccaggtgtaaaaactttatgggtgtgtattagtgccttttctgttgctgtgataaaacagaatgtctgaggcaacttataaagcagtataatttgccttatggttcacactgtcaaagtagcattacaagtttcagacattgcaattaaaaggggaagctcagagctcacatcttcagcttgcagcatgtagcacgggagtgggaactagaaatggcaggtggatgtaaactctcaagcctacccccattgaaataattccttcaccagagcagcctttcctaaatctacccaaattatatgataatcttagaagaactgacttctctaactgcaaatatacagtctttccattacatgaccaaacctgcgggaaacaggtgcggccgcatgggccaagatgtttactgccttgcccgagcatgcgcagtgaggctgcaggcgtgagcaggctgtactgttcctcgtgatctggacctgtcagcctatcggtgactgacctgagctcgtgcctggagcgtgtgtgaattctgattggatgaggtgggtggagctagatgaggtcagtcggccagagtataggagttttgttgttgttggccttgccgaagaaggagagagttgtaagagagaaagctgcaagaaggacgaggaagaagaagctgctggggaagagagctgtaggggaaaaagcccgaagtaaagaagttgctgcgagaacccgccttggtgtccgtgtcattcctgtctccaccgggaagaaaggacggcgacacaaaccatgataaggaaaaactgttggtagccctttggatccctaaacagctttattgcaggaatgagtgcttacacgagaaaaacatgtgtgagtgaaaaaggtatttgtttaatgatttgttttaattttagttatgtgatgtcagtatatctgtatgtagctttgtgctttttacatgctggtaccagatgatgttagcctttggatcttctgtgaatgggtgggggctcttgttcctgatattgtttgtcatattttcacaaattccctagaggtgttgtttattattcaacctggcttggatgtcagtaattagttagggctacatagaactcttgattatcatgtgtcaccctgctgagtacaactctaagaatagaagatttacccgcaccccccccccatgtatcctgttttgtcaacacactcatacaatgttaatgttgaaatgcttaacaagtccaatcacaaccacaattgctctgaaacatagttatctaagacacaaaataacaaaaactgaaaggtctcaaaatgatagtattaatacaaactagcacagctaatatgacgtacagtaagatgtatcctcaagaaattaaaaactgggactggagaggtggctcagtggttaagagcactgactgctcttccaaaggtcctgagttcaattcccagcaaccacatggtgcctcacaatcatctgtaataagatctgatgcccttttctggtgtgtctgaagacagctagctacagtgtactcatactcataaaataaataaatctttaaaaaagaaagaaagaaagaaagaaagaaagaaagcaagcaagcttttacagaggacctgggttcagttcccatcacatgcacaggccctca

SEQ ID NO: 32433 - DNA, 1203 bp, Mus musculus
aagtttccactgcaccagatttccataccaccctctaaaatgttcctcaatgttctagctgtctctccacattcccttcctcaaccacatctctctccccagatcctcccacttcccccatctgccccttctcaaaccataaaatctattttacttccccctcccagggacatccatgtgtcccaccctcagtcccttcctctatattttaattctctgggtctatgcattataggttggctatcacttacttaatgccacatagaagtggatacgtactatagagaaatttttaatccagcaacatggctactctgacaaaagatcacatccagaaactgttttgtaggtctgtgtgatctgacaacattcttgcattgattcaccttgcaattctttggtggtcatctttaggctttgcagatactggtcttcactgacaacgctcttgcattggtttgcattgctttctttgctaatcattgcttctcatggcttcctagaaaggaaaatcaccaaagaacttctgattgtatgctgcctgcttcttgctgcttctgcagacttgtgcctactggtggatcttcatggtttcttctagatcgagccactgctactgattcatgtttggtgtttgctaaattgcctggactgccactgctgattcatgattggtgttttgatagtaaactggactgctgacaacaaagattcgaatagctcaaaagaactatttctaaacaggtccctgtttcttattaacctttctattacgccacctctcgtgagagatagcctagaagtgaggctgactcattaaaaaaacatagttaaaataggttttgaaaaaaaaatttatgcctacatccagttctcatgagaacagatagtaaagagaggtgacttaaaaagtagtgaggagagaatgttgaagtcagtttgattgagttcagttgagttctgaacagttcagttcatggagttcagaggcagttttgccaagcaaagtaattcaatgagaaactgagagaagccagtttgaatcagacagctaggaaagatatttgagctagaacatctgagtggaaagagccagctagagttcagaaagagttagtaggagtgaacatatttagcaataagcctccaaaatgacaattgcatctggcaaataaaagatacttttacaacataccacattta

SEQ ID NO: 32434 - DNA, 1097 bp, Mus musculus
tgcagaaaagccaaatttcccatgagaggttgcagagccagcaagagaggctggacttaggttaaggctggtcagattgcttcagtccgtcagaacgttttcttatcaccccttgctaggtaggctttaggcctctgctcagctctgaacctctgagacctagtgctttccgtgctggtggaaggcatggtcagaaggcattgagcatgctccatatattatcatatatagctcagaagtgctatgtcagaaaaccttttgaggaaaataatgttttgctgggcatagtggcacacacctttaaccccagcacttgggaggcagaggcaggaggatctctgagttcaaggctatcctggtctacatagggagttccaggacaaccaggacagcatggagactctaagaaaatagaagtaaatgaataataatactattttagtttattctttgagaatttaacatgttttgatcatatcttttcttgtcccctaactccttctagatctttcccaaccccctactcacctgtcttcatgttctttctctaagataaaatgaagtaaaataaaataaagcacagagtccattttgtattggttgaccacacttggccatggggcctgccctgaggtatgtggttgatatacctagtgttgctccattgaagaaaacggattttccttttctgagtagttatcagtttcaaatagcttcttgactaggggtgggattttgttgtccatttcctattgtccatgctgggctgtcatctggcttgagctgggacagttcttgtgcctactattcacagtctcttgtgagcttatcagtcctgttgtgtctggaaagtaatgtttccttggaggcatccaccactctggtcctcacagtctttgtatcccctcttctgaatagatcactaaggggaagggtgtgttatacatatcccatttaaataagtaaatactgaaaatacatttacgcggtggaacaccattcagctgcttggagaaatgaagctatgaaacttgaaggtaagagaatggagctagaaacagtcattctgagtgaggtaacccagaaagacaagcatt

SEQ ID NO: 32435 - DNA, 1099 bp, Mus musculus
ttactggcttgctcagcttgctttcttatagaacccaagactaccagtccagagatgatgccactcaccagggtgccaccccaccttgaacactaattgacaaaatgccttacagttgaatctcacggaggcatttcctcaactgaaactcctttctctgtgatttaactccagcttgtgtcaagttgtcacacaaaaccagccagtgcacaactcaacatgagttctgattgtaaagcaggaattatgactggcagctatgttgggttgtagtactaagactgtgctgtgacacaagctcagtgttttatgactgagtctggttcttacatctccagaatcagtcatgaaggcatcctatagcacttgtgctaaatctaaacaccagcactaccaccccaattaacaacaggctcatggtttactcagctatccccctattcctactataatccatcatggatgtgtctgtctacaactttcctatgacagtagcaacttgctgagggcaatgatgaaaactcacctgtatatgagtcctacaagaacccaggactaagctccaacttctccaaaccatcgcatcttagagcagcattcaatgtggaaaatgaagcagagctcaagaagcagatcttgatgggcaccacgattccatctgctagggatcaggtcttcttttagaaatgtgaatgaggctgaagtaaactgctaactgaaccctggatccttcctcttaaagtcaggatttggagtgtgtgtgtgcgtgtgtgcatatatctccagatcttcctttatctgataccaactcaggtgtcagtctcaagtccaacaattacaaagataggaatgcctcactctttatgtttaacatttgtgtctcatagttcatccccagaacaaaaccaaggtattttgtcctgtattcagtaggtagaaacttatctcttcaatatcaagaattgtccacccatcatgaacaacatgaccatcattctccatggattgatccagctacattttgcatttaaaagatatgatttgcatttaaaagatcgatctaaaagatatgcaatgcaaatacaagttgattgcacat

SEQ ID NO: 32436 - DNA, 1165 bp, Mus musculus
gttcgctccgtcagctaaagactactgatatatctatcaaccaggttccctccatgatctcagggctactactgatgtggtatcccccttttctgtttctgcgtgtgtctgtaagctactccttacaatagcaaccccctcacaggattagatgactgagaacagagagtgtatttacacgccattctgcataaatgcgggggtagaaggtggtgggcactctcaggagacagataagccaggcagaagggacagatttggggagcacttgaaaggtgccctgcaaggatcctaagtgggtcgttaggaggtcaagcctggaggcacctctgagcctgatgattctagggcttgctgggcagggcgtgaggagaagtgaggagagactggtgtgaacctaatccgggcgagaggaaggggagaaacaaaggctgaggaggatagttcaaggggcagtgctcagccaggagagttaggggagtcttgagggctgcttgctgggttcagtgatcagaaagaactctttgggccagaggaaaggagtgttcctgggatacttgagagcattctggaaaggagccacggggcctcccaagcatcattcacggacctgtcaaaaaggtaactgggctggatctgcaggttgttatatgcaaattgtcgtgaaggaggggaggccaaggcagagaccagtgacccagacaagcaggctgtgccagtgttctgagttgtgcaggataatcaaacaatgagggtcaccttagaatgtaatcgggctccaaggcagcaaggaggtccagcctcaatgaactgaacgtcaggctctttctttttatttagcgtttactttaggttgtgtctcctttaggacaggtacttctgggcagcagaaaaacttttaaaataaaataagaattaggttgcatagttaaataatatgtgaagatttaggtggaggtagtctttttttttcttcacaaaagttgttttttttgggggggggggttaaaaagtttctcaaaccaaaactcctcatcaaaggaaacatcacacccctgaaactttggtccctcttgtggactgtttgctgtactcaataatgcaagacatcgcatatgtatcaggactgtcttgtaccaagtcatgccaaggccctaaagctcct

SEQ ID NO: 32437 - DNA, 1211 bp, Mus musculus
gatgtagaggagatgcacgcagcttctgtgtgcctagaagaggccactatgccttccaggggaagcaatcaggacctcatgcggggttccagtatcttacctcccctactaaaatccaaacatctggagccctctgcttccgagtagcaagctcttccgggatctggtcagctctggaagttgtctatgattgagactgtagcaagagtgactgcaaaactgtgctccatttcctaaaacagacacaattccattctgtctatcctttgcatggcttccccctctgtctccctgaaaccctgtcgtcgggtttttattttcttggtataggaagaagctgcccttcccgtgggctcccctgtgtcagggccactcagtaggacgccatctccacagcctccccacaacacagactatccgtgtgatccacttctttctcccctcagctctgaaatgcagatatcctggataaccagcttcccttttgggtatcttgtgtggtcccctcccctcttctctcccgtcaaccctgcagtgtagactccccagatgactcccttctctctcctccacagtgtagacctctcagacgacccagttctctttcaagatgcccgccccgacgtgcttctcctgtcacaagacccgtgctgccctccgtcgcccacgttctgggcaggcgctgtgcggctcctgcttctgtgctgcctttgaggctgaggtgctacatacagtgcttgccgggcacctgctgccgccgggcgctgtagtggccgtgggtgcctctggtggcaaggactccacagtgctggcacacgtgctgcgtgagcttgcgccccgcctgggcatcaccctgcacctggtggcggtggatgagggcatcggcggctaccgggacgccgcgctggaggcagtgcgcagtcaggcggcgcgctgggagctgccgctcaccatcgtggcctacgaagatctcttcgggggctggacgatggacgccgtggcccgcagcaccgcaggctccggccgcagtcgctcctgctgcaccttctgcggggtgctgcggaggcgcgcgctggaggagggtgcgcgccttgtgggagctacacatattgtgacaggtgagcactggtgtgcagcaggaacggtgtgggtgtggaagagtagtgtgccaggaagtgcaagatagtggggtgggctggggtctccactcc

SEQ ID NO: 32438 - DNA, 1207 bp, Mus musculus
ggcagagcgcctagctctggctccggcagcaaagccccctcctccaggcacctgctcccgctgcggagccctggccagccacaagctctgccaggcctgtgccctcctggatggcctcaaccgaggcctgccgcgcctggccatcggcaagggccgccgtgtgctgcaagttgagcctccacagcctgggaacccaagcctagtcaccagtgaccctgtggccccagcaggaccctgcacctgcaagcaaccgaaagataaagccaacccatgcggcaatggaggggaccgggcaggagccacctgtgtatcgcagtgtgacctgagccccgggaatggagaggaccgggcaggagccacctgtgtatcgcagagggacctgagccttgggaatggaggggaccgggcaggagccacctgtgtatcgcagtgtgacctgagccccgtggcggagtgacctgagctctgcactctacattgccctgtgtccggggaagtgattgtaccccactgccctgcaactgtggagtaatctatacactgtgaagtgatttcccttcagtgcacggcaccttgggactgacctgtttccgtgtggagtggctgtaccctgcagagtcgcttgagccctgcagattatttaaagtgtccagtgccctgcaacctgagccccgtgtcctacctgtaccccatggaaggatgggccctgtagagcaacatgaaccttgaagtatagggcgctctaggcacagctaccagctctaagagagaagggaccaacacccatgcattcccgcacacctctgtgggctcagagagccctggccctccttttctgttttcccaagtcaggtaaacaaagtcacatgcgtactaggaatattcacaatcgtcactatacccgtctcatccaggcacagctctcgcacctacgggaactggagaaagtttgttctgaaccagttgggaccttccatgggcgggtatgtgaattgaggttgcctgggaaactgccgtgggagcagttacacaaacgtttacagccctaggacaatagaaagtcattaatcaagacattggtcaagtatgtcggtgtgaactgcaggtagacaggttatagcaaagctgaaatcccttctgtcagtctgaggaactatctgatgactttcttagcttgtgggtctttggaagccagtggtctgctgag

SEQ ID NO: 32439 - DNA, 1196 bp, Mus musculus
ttacctagctgagaagagaaggaagcagcatacaaaacccacaactgtcctgactctttcttctgtcacctcggggaaactgccaactgcgtcagtacatccgcttatgtgaccaataggatttcacgcatgttgagcaagttaactggatggatctttcccctacgtgcgtgagaactgaaacatcccggtgccattctgaccctccattgtactagacaaggaagtcaagatgaagtcagctcccttgcccagggttgcacaaagccatgtagccacatggagatctgaacctacctgaagggctcttcccaactgtagttgggaaatattcaagtggacggtacagccggctaagtggtgagattaaccccagataagaggaaggacgcctattccattgtccagggaaggaagagggaaagggcgaggttctctgtggggcgtgggtcaggtggcaggaagcagaggacgtgcctgtctaatggctcggttgggttttttttgtttttgttttgtttagtttactgagagaactcacccagatcatcttcaggagcacacatgctcaggtgatgggggaagggcactgttttggcaagtggccagaacaaggaagccaggaaagcacctgccttgatgctgagccagtggagttgaggatggtcagggattaggtccgggtgaaggagaagcaaaggcgggaaggcttggtggtgagacctgccgtgggatggccaggtgtctggggaatagaacaacagctatgggtgtgctgtctgcagcaccctccaccagaagcgtgcctcagagggggcagttcttcctggaggagataagaggctcagctgggctatggaaaagggagtgggggtagtgggaggcactctgcagccattggaagattattgatctgtaaagttggtagtacttccaggctcttgaccttttgttgacaggtgctgggttaggcagtctgtaaagaacatatcttgacccccacatcttctctgggggttcactgtcacaaaatgacaatgaacaatgtcacaagtatgtgacaatgtctcaagtatccaggttggtcttaaactctctatgaagcttgcaattctgctcttcctgcctccacaagtacgatttcttttggaggtgggagtgggattcttccctgtgttaggtctcgattccctgca

SEQ ID NO: 32440 - DNA, 1176 bp, Mus musculus
gattgatccccaggctttgccgggccaggcgagtgctttaccctcaaatcatgtccccagctccttacacaaggattctaggcaaagtctctcccactgagccaatacctcctgcccctcactggtggattttaggtagctctactgctgagatctatccacagaccttttatttatttatttttaagttactatcactgtgtgtgtgatgtgtgtgtgtgtgtgtacagcatgcatgtggagaagaccacttcatgaagatgtttctctccttctccctttacggaggttctaggatttggattcaggaaatcaggcttgtgtggcaagcgcttcttctacctgctgagccatcttgtgaacaccacaggactcttttaagtacattctacttctagacagtcgttactaggtttagattgactggactcttgaacacactctgaagccacccccggctttgaatttacaatactgttgcttcagcctctccacacctgatcacaacaaggactggctcgtgtgtgtgtgtgtgtgtgtgtgtgtgtgtgtgtgtgtgtgtttcactcactcactcattctttttttttttaacagagggtcttacatagcctaggttggtctcagtttccagctatatatgtagccaacaatggtcttgaacgcctgatctttctacttccacctcccatgtgatgaggggtgcatgccactgtgctataaatttcaggcttcataaggaattttaacatgggtttaaagtaatttttatgtgtataggtgttttgcctgcatgtatatgtgtgtgtgtgtgtgtgtgtgtgtgtgtgtgtgtgtgcgcacgcgcgcgtgtgcgtgtgcgtgtgtgcgtgcatgcatgcatgcagtggccatagtggtcagaagagggcattagttccctggaactggagttacagatggctgtggtctgccatgtgggtgctgggaaccaaacttgggtcctctgaaagagcagtggactgcttttacccactgagctatctctctggcctcttgatataatatttttaatatgataccttacacttattctgactattcatgggtacagtagtggcatggatgttgcaagggtagctaatggctttgtggctggattgaaggcctgttccacaggaggaactgtgtacaacc

SEQ ID NO: 32441 - DNA, 1431 bp, Mus musculus
agggtggaagccacttagggacatgttcactataccctggaaattccaaacagtcctagggctgagccatgagaccaagaccagtctctgtctcatttgccccacattcccaaggacacagcaacctcagtctacagcatgcaggtcagtgtagacaattgaggggtaactgtggcacgtgcctataatcccaacattccaggtggctgaggcgggaggatcctgagttaacatccagactggactacatacaaaaataagtgagtaagattgggggcggggagtatagaatgtatcgaaaatcttctaccttgggaggtagaagcaactttgcccacataaactgtcttaagcaaggaaacagggaagtgttacccctaagggtcctgggttctctaaaaccaagtgtcagccattctcttgggtggatttctgagcactgggctatactgtcccccttgggactttgcatggccctaggaccttagaaagggagggtattaatattaccaggacccctctgatgttcagcactgggctctgaccatcctgaggacatggtgcccccagggacctttgacaccctggggtctgaggggccctggcgacaaagggagtggatggggaagctgtggtctttgtgagtctcaccagcctttctcctctccctcctgccaacagacagaggcagttccttcagacaaccaggcttccctccaggtaagcagagagctgcctaaagtgctaggacaaacagctcagtttagactctgtgctgtcagtgtgtatgcttgcggacccccttgatgtccagcactgggctctgaccatcctgaagacatggtgcccccagggacctttgacaccctggggtctgaggggtcctgactacaaggaggaatgaataggggggtgccatggtcttcgtgtcccttgccaacctctgtcccctctccttcctgcctataggtggtttctacaaacatcctacttcccttcaggtaagagcagaaagactgtctggagtagaagtctaatgctaatcacatgaacttggtttacacaattagaccagattgctaagagacatctctgtcatgccgctcttgggaacccccatgatgtatatagcactgggctctgaccaccatggtgatatgttgtgcctccaggacctttgacatccaggagtctgaggggtttccattctagggggatgctgggtgggagtgtagccctttgtcacctaccagcttgccctgtgtctttgcagcctctgcgacagcattgcttctagccctcttgctattcttaccttgagactgtgagggccatggctgagagagtgctggtgcccacccagataggccggggggaccgctactacacatacacggagttgttggctatctcacggcgtttcaagcagaa

SEQ ID NO: 32442 - DNA, 1431 bp, Mus musculus; identical to SEQ ID NO: 32441

SEQ ID NO: 32443 - DNA, 1431 bp, Mus musculus; identical to SEQ ID NO: 32441

SEQ ID NO: 32444 - DNA, 1189 bp, Mus musculus
ctgtctgtaacccaggtgactaggaagcagcttggggagcgcccaagtggacattcccatcctatagcacttaatgccaagctcggtggccccaaagagaagtgtgcatgttcctagccacaccatccatatggaaagtgagccacaggtggctattggttgtgaatctagggtgcttatggccctagaattaatccccctgagttgaagcttaaggccatgctaagatgtgtggccacatcagggtccccacccctctgcctccacatggaccccaaagcactacatacaggccatcttgaattttttactttttcaatgcaacacttacatagtattttaggtataggccgtacttccatggccttttactggatgtttgacactttagggccagtctccctagtgtaaaggcttaacattgcaaacttttctaatgcagcatttttactttatattttattttgagcttatgtgacactttggttttggggagaggagaacccccttttgtaaagattttgctttggggaccttgtccccgttttcttttaaccatgcccttcccttttgaagcaccttccagccgggtctggtctccctggctgcacagatggcccctggccaatgcagatctggatttagtggaggggtgaggtgggcagccctggaacttctgccttcgtgagtttctattaaatggctggttcattgccctctgtagggtgtgctgtttgattcggttccggcgtgggtagaatctgggtgatgagctgggtccagagcaggtgaggcacaggcgcacttgcccacctttggcctgtttccagaggatactccagcggtctggtgaggaaaggtgggctggtgggggccagtcacagccactggctggccttatcccctacctcagagcctgcaattgatcagaccctctagttcaagctgttcttggattccagggtatgctccttagcttccttaggctcttaggtcttgatgtacctcccccagataggaaacctctcaagacagggctggggggctctggggaatgatgaacacaaggcaatgggcatggggctccaggtgatggcagtgacacagtggctgctggtaggctgttccttagtaggagttaagccctccctcaagtgtcacctggggggctggcaggctccctcaagtg

SEQ ID NO: 32445 - DNA, 1164 bp, Mus musculus
ggaaagagagcagaaataggggcttggggtgggcatggactttggaagcaatatacaaggctgtgtacgagtccagggagggagctctgggagctgagaggacaggagaagaggccgtttctgcggatgtcaggaagaggaggcccaccaggtatgtctcaggtcccaaggaagtggagaaggctgggaacagttggctgtggccttggacctgccccaggaggaagctaggagtcactgaaggctcatgagctgtgcgatgtgccagagcagcttcaggaagctgaatcagactgtacttgcagaccgtgggaggggtggagctgggagccttaaaatgggagtggggcgtgcatctggtctcccaaggacactagagcttggaaaagcactcaatccctgtccccaccctgatgctctgccttacttccatccaaggacgcctgtccctccagaagtgccttgtccctccactctcccctgcctctcacaacttctgtgtatgcagctccagcgggacaccccgagatgggccggctgggggaactgggggctcagggggccctgggggctccctgggcagcagaggcagacgtaggaagctctattcagcggtacccggtcgctccttcatggcggtgaagtcctaccaggcgcaaggcgagggggagatctctctgagtaaaggcgaaaagatcaaaggtgacagagtggggctgggtgggggcagggtgaggggaagctcaaagaccgcctgtgccctctgcactctggggactttaaagagccctgagaggccccttttggcttggaggagagagaggcactatatgggacagtgtgaagaagagaggagatgagcatggattgtcccatgtgtgaatgaatgtttgaatgcatgtgggcacatgtgtgtgctggtgtttgtgcatgtgtgtagtgtgtatggggaggccggaggttgacatcaggtgtcttcctcagtcagcctccacattttcttttttgtgagagagagggtctctcactgaaccttcactgactcaaccaggctggctacctgaaccaagcaagctccaagaacctacctttctctgcttccctgctgggggttacagattctcacagctgaatctgacctttcacatgggttctagggattca

SEQ ID NO: 32446 - DNA, 1203 bp, Mus musculus
gtaggtgctgcgaatccaaacccagatctcgcacttgggcagagaggtctcgcctcagtccccattcataacctcctgtctctggacctccacttcctgttgttagagcaggactgatatgttgtcaatctcccagggtaccctgaggtactagttatattgtcacatctcaacgaatgtttgctactgtattcttctacctgtcatttgccttcattgccatcaactgcaacaaagaacagagtagatttatcccgcttgccaaacactgagtgaaagcctcgtacaagttaaggtggcttcccaaggatagatagcaaaatttttcctgcattgtctctaagcttttgggggtcttgtccttcagaaatgccctatgacggagaagcaacatgagctagagagaacaaaacctggacacagtcttcaggacctgctacccacagaatgtgacagccacagactgtaaaacaaccattataaactgggaccatagcagaagcacagaattcaaactcagttgtactgagaaagtagtcagggcaacactgacttggccccacatgacccatgacctctctcttcactctttccagatatttccgtgagcctgctgtcagtcatcgtgacattctgtggcatcgtcctcttgggtgtctccctcttcgtgtcctggaagttgtgctgggtgccctggagggacaaaggaggctcagcagtgggtggtggccccctgcgcaaagacttagcccctggggttgggctggcaggcctggtaggaggtggtgggcaccacctaggagccagcctcggtggtcatcccctgctgggtggcccacaccatcatgggcacacagcccaccatccaccatttgcggagctgctggaaccaggtggtcttgggggctctgagccgccagaaccttcctacctggacatggactcatatccagaggctgctgtggcctctgtggtagctgctggagtcaaaccaagccagacatcccctgagctgccttctgagggtggaacaggttctgggctgctcctgctgcctcccagtggtgggggcttacccagtgcccagtctcatcagcaggtcacaagtctagcacccaccacaaggtgagaaagggtatcgggcttggggcttcactatgaaactctgcttgtctgtctcattcttatctgtggctcttctga

SEQ ID NO: 32447 - DNA, 1474 bp, Mus musculus
ccctggccctgcctgtagtgactaggggacccagcccctcccctctgtggccctggccctgggccatcctcatcacttacctcccttcctctctgcctgtctctgtgtccacctgtcctgcctgcagtggatgtacatcattccagttgtgctgttcctcatgatgtcgggagcgccggacgctgggggccagggcggcggtgggggcgggggcagcagccggtgagcagctgtgccacctagagccccccccagagccagcccaagaaggagttcctgtccccacatttccctattgcatgaatatggaaggctgtcccttcagtgagccctctggccttcctgtaagcccctctttctgtccctgagcctctctctcatcctgttgactgagagcttgggtggacctccctgtagccagctcactgcaactgtgtcccaccatgtggcactgtgctcctctgtctgctaaacacccaccagcctgccccaccccaccccaccatacactttgggaacttgccaagctctctccagcctctgtgcctttgccctgcaggccccgtgcgcccctcactgtcactctccagccctttgccaaggatctgtggcccagaggcctctgctcttagtggctaggtcagcctccagcccactgtccaggtggcatgctgtcttctttgcccccctctctggtgccccagaataccatggtgacctaccactatcctttctgcctttggatgtcatagcctggatctgtcaccaggagaggattgtgggcctccacgttagtctgtgaatgcacacttcgagtgacttgtgtgcaggttttgagagccggttttgcactagctgctcgacagctgctggcatggccgtgctcttgcacatgcgccgctgtgggcatggggattgctgtgcagcctcagctgtgttgtgtggctgctgattaaactgtcccctaaacagccactcttcagctcacttcctgccttctgtgcttgtgaatagtcctgagttgccgctgtggtttgcctggtttatgtttgaatggctttcttagggtatgttacagaggggtgcctgagcagattaaagttgctgtgagcaaggacgccttccgaactctgggaggaggctggttcctgaccctcctaacacatttcttggttcattcccggcacagctacgcgcttgctggcccatcaacctcaggggctcatttcatatccctcatcctcacacgaggattgcactgggaccttgtgtgttggtacagtcggtatcaattgggatcccagcattccggttgctgcctggaagtagccacaaagtagtgacttttttttttttttttttgttttttcaagacagggtttctctgtatagctctggctgtcctggaactcactttgtagaccaggctggcttcgaactcagaaatctacctgcctctgcctcccgagtgctg

SEQ ID NO: 32448 - DNA, 1173 bp, Mus musculus
gtagtgcctgtggacatcctccctcccccctctctctctcagggaccctgatggggcagtagcccatgccaaggacgtcatctcggacctgctgtgcaaccgcatagacatctcccagctggtcatcaccaaagagttgacccgcgcagcagcagactatgctggcaagcaggctcacgtggagctggctgagaggtgggcagccacacagcttcctgcagctggctccactccaccctccccaaacctcatccaacccccttatccgcaggatgaggaagcgcgaccccggcagtgcgcccagcctgggtgaccgagtcccctatgtgatcattggtgctgctaagggtgtggccgcctacatgaagtcggaggtcaggcccacctgggctgggcccctcccagaatttcacttctgctttcctggggcggccatgcccctgggccatacttagtgtagtgcctccctgggcagagttggctgctgcgccctccccacctgggttgccaactctatttgtctttgtcatctccaagcctggatgcttctgacccctgcaccctatccatggcccttctcccatggggaaactaactcttggcgatctgagggtccccacccagacccgagtcacagttccaggcccacccctttatcagagcctgcagatacagtgtgtagctctctagcccctagcccatgcccctctgcagccattggtgaccctggcctgcccacaggaccccctgtttgtgctggagcacagcctgcccatcgacactcagtactacctggagcagcagctggccaagccgctcttgcgcatctttgagcccatcctgggtgagggccgtgcagagtctgtgctgctgcgtaagtggaccgcccaggagggagtgtgagcggggaaaggggccgaggcggaggcagggacaaggccattcagcttccctcctctaggcggtgaccacacacgatgcaagactgtgctcaccagcaaggtgggcggcctcttggccttcaccaagcgccgcaactgttgcattggctgccgctccgtaatcgaccatcaaggtgagaccgagttacagcccttatacccactggtcgggccctgccacaggactccattctgcctgcactccagcggagggtcctcgcctgccccgggg

SEQ ID NO: 32449 - DNA, 1185 bp, Mus musculus
tggcacagacatcagggtgtagtgatgtcatcctgcacttccacccgtttgtgaagctgtgcggctggggcgagaggcctgtaagaagactggggacctggtctagctcaatggcacagccgcttcttacaagcttccagtgaggggctgggtgtgacccagtgacagagcctctgcttgctctgtatgagaccctggctgcattcctggggggtggggtggggtggctctttgtcctctgagaacgtacactttggggctgcagtcctgtctgataggccgatgcttgaaagtagcaggagtgggtcctccccgacccagcggatccagcttctgtgtcctcatcctccctggttttgcccctaacagagtgtcactgggttcgggcggcagatgattgagaaaaccaagcagcttgtggagtccaagtacaccgtggaaaatggctacgatgccaacgccaaggtcagggcctgcccgctctccagggtccccgggcttcctaccatggcagctcctgggttgagaagaggcatccctcacgcatgtaccctggcaggtagtctacggtgacacggactctgtgatgtgccggtttggcgtctcctctgtggctgaagcaatgtctctggggcgggaggctgcaaactgggtatccagtcacttcccatcacccatccggctggagttcgagaaggtgcgtgcatcctctgtactcagctcagtggagacattaggggtcttatcaattagtgatggtctcctatgacagtacagtagtgtgggggtccccaggctgggagtcttgcagtgttctgggttgtagctgaggcccctgttgtgcaaaccagtggtacattttggatctgtctgcatgtacgtggctccagttctcgccagaagctcaaacatgacacccctggcttctcatccagggttatctcagctcagggctcacttggtcctgtctcttcccatggctgcaagactttacagtgtcacctgtctggatttcataatttcggggccagccttaggcctatggcattatgtcaagtgggtttctggggtgctggagagtgctgggccttcttgggattcattccttgcctgttgtgtttcctggtctcgggattcggggcggaggaatgtgcacaggccatggaggaatgtgcacaggctccg

SEQ ID NO: 32450 - DNA, 1179 bp, Mus musculus
accggaggagggacagcccttgctccccacaacccagggtcttcaagctccgcctttatgtccgacccaagggccttggaatccccagggagagggtaggacacacaaggtccgtaggatggtgacttctttccttagaacaaggactggaaaaccctttaccgatgtaatccccactgccacctgtcgctgtcatcgcgaccggtcgcctcccacgcttgttgtggctgtggccgcctccagcgggacgctaacagggagagaactacaaaatccgtgatgctccgcggtgtgcggatctttgattacaggcagtggggggccagaggcttcatggggattgttgttccctctctcgcaccctgcaaaatgggatgccctcttccctctcctttcttccttaaatccagaggtcaaacattcattttccctccccgaaagttacccaaatggtatatccttccatggaaagttgatttttttttttaatttgtttaattggaaagaagcatagctgctgtggcccggtgagcttgtaccctaaccagggcgtcttttgaagaactgcgcctgcgtagtccttctttctgcccggtctgttgaacgagactgagcacgcgccagtcccacgcgcgggccgacgtttttgtccccacggtcaaagacagccacatagggccccaaaaagacgtccccaaggatccagaggggtcccgcaggcttggggatatccaaggcttggaagcccaacaggcagaggccaacatcgctctgaagaatctgcaagatgacaacacaggatactgtgtatcacggggctccgggtttgattgtcccatctacacccagaagaggacaaggaatatttctagctggtcaggatgccatcagcctgtgatgccagtgctccagagacaaaggcaggagggtggggagttcaagaccagccaaggctatacacgtaaactccatttaaaaggaaggaagaaatgaaatgaaatgaaatgaaatgaaatgaaatgaaatgaaatgaaatgaaatgaagtgaagtgaagtgaagtgaagtgaaagagaagttatgaaatggctcagccggtaaaggtgcttgctgctaagtctgccgatctgagttcaatcctcagagctgctcgtagtaagaaaaaagttgattcctttaat

SEQ ID NO: 32451 - DNA, 1099 bp, Mus musculus
acaaaaacctctaggaacacgtaggaaaaggaagacaggttaatcagccgcagccccgaggagctcagcttgggggtgggggggttctgccagctgctcttgggcttggaggacgccagctggtgcattccacccacgcccgcctccagggatctgctccctctattcgctgcatggacttggccctccaggcccagaaccctctacccactgcagtctccactctatcccaagaggtgagactagtaccctagacttaaggagacagaacctggcaccctgcactcccacaccccacggactccggcgccccccactcctcacctccatcactccatccatcccccactggcctggactgcaccacagagtttttccactcttcccttgcacctccgctcacttccagccttcggggttctgacagtcctcaagaccctgacattgcctagacacccctatatccccaaccccagacggccccaactccctgacatcacactcctctgtcccctggcgcctctggcgcaagaccttcccggacaagctccgtctgtctgattacagagagctcccatcccattccagtattactgtctaggcagccccctcctcaccgccctctccccccccaccccatggtgccaaaacacactttcttcatggccaccagagtttcccagagcgtgggactcccgttccctcttcgtgtgctgaagtttgcaaagtgcacagacgaccaagtgttttaaacttgtgtgctctttgcaggctcacacccggctggtgcgtcctggcagcgcagcagttgggtgttgccactgaaagcaagtctaagacaggatgggacccaatgctaaaagcgcttgcttaatgtgctaaggtcccagggttcaaactccagcaacccctcttcccctactggtgggcaaagaggacatacccacctcggctaggatctcagcctgcccttcccagcttccttgcccactacgtgccacattctcggatggaaaactttctcaaatctcgtcttggctccaggatgctacctcccccaagcccagagaccacactggtcccagaatccttagcgaac

SEQ ID NO: 32452 - DNA, 1578 bp, Mus musculus
aggagctggaacagatggaagacttcttccttgatgccccacttctcccaccgccctccccaccaccacctccaccaccagcagcagcaccctctctgcccctgcccttgcccttgcccacctttgacctccctcagcctcctaccctggataccttggacctgctggctgtttactgccgcagtgaggccgggccgggggattcaggcttgtcaaccctgcctgtcccacagcagcctcctcctctggcccctctgccttcacccgcccgcccagccccttatcctagtcctgccagcacacgaggggaccgcaagcaaaagaagagagaccagaataagtcagctgctctcaggtaccgccagaggaagcgggcagagggcgaggccctggagggcgagtgccaggggctggaggcccggaaccgggagctgagggagagggctgagtcagtggagcgggagatccagtacgtgaaggacctgctaattgaggtgtataaggcccgaagccagaggacccgcagcacctagggtacaggtccaggctggagagggaggtctcgtgtacgtctgtctccagcgtcacactacccctccattccactttcctatccagtccatctctaggcttcccctctgcctaacccactgtgggctatttggcagagtcagtttctgtaccccttcagtgcaactgagaaagcaaggccctcagggaactggaggaggagccagcctgatccctggcctctggagtcttaaagcaagtgtgtttttgcaggtagtcctagttgggtgtagggggaggctgccaggcctggcatgaacataaagcaggaagccactctgggtgatggcagatgagaacctagtcagggagggagggttttaaggaggggacttggaacacaagtgagaagccagtcaagaaaagggagccaggacctcagaatttatactggcctaggggacaggaaggggtgattgtagttggtaactaggggtcattttagctctgtgagagaatcagtgttttgtgagggtgtgggggaagggttgcatctagtggaggctgatcctctaggggttatgggcacaaataaaatgcagattttcctgtggcctgtgtgtcttatctttgagaggagacgctggggagagtgagcctcggggtagtcttaagacaactgagaataaagcaaaggactggggctgaagctcgacagtacacatgtgcctagcataagagaaagaagttgggtgtggtggctcatgactgcagtctcagcatttgggaggctgaggaggaaggattgcccaggccagcctgggctaaagactgaccccatctcaaacaaaacaatgaagccaaacaaaaggtaactagtaacatttgttcattgtcaagtacacccacttggcaagaacatgacaggtgaccagcctatcagtaaagttagagccatgttgacactaaggctggttgtatttacattggcagcaaaagacaagccaaaggtaatatagcatatacataccaagaagaataccatcaaacacagtgtgatcattgcag

SEQ ID NO: 32453 - DNA, 1095 bp, Mus musculus
ttggcagcctttacccactgctcagtcattgtattttcttttagaaaaaaaccctgacttcacctcttttactctccctaccccagattcttagccatatgatcgttctgtgtgtcccacctccaaggtttctgtttccagccatccctgccgacctctaaggttttgcccttgctctgactttcttgcagtccttgctctcttgctgaccccactagataattatttcttgatcctgtccaaaataggacatttatattccatttagtaaaagagtccctcttgtccttcaccggggatgatgcgtgaaccctgttttctaccccatgttcatgtacatggctggcattccatgtgaaagtcagtcagtgtgtcatatttgtagcagctgagagactgaatggttggagatagagctcaagaatgctcgtctgtttttaacaccagaaccttagtctctgtccaagcaccacatggattgggcttgacttgcctgtattctcaggatttgggagatgggagaaaagaaatcatgagttcagggtcatactgactggcctcaatgtgttttaaaaagaaaaagtccagaggccaggcttgatatctcacctacttaggaggctaagacaggagtattgaaagtcaaggtcagggctggagctgctttgagatggctctggtggtgatctctaaactcaaccctcctgagttccatcctcaggacccacttggtagaaggacaaaagcaactctagacggttgtcctctgacctccaccacctgtagtgacaggtctacatactgagtaaggggaggaaaaaagctcaaggcttgccttgactagaaagtgagttcttggctgtctagagaacttaacaaagatcctgattttaaaaaaatatgtaatgggctggggttggaggttggtggcagagtgttggccagaatactgctttccagactctggtgtccatccctggtactgtaaaagattcagagcaggtggggaatactgattttgaaagttacaagtccttgagataattccccttggaatgggcactctttttttttttttagattttatttatgtaa

SEQ ID NO: 32454 - DNA, 1095 bp, Mus musculus; identical to SEQ ID NO: 32453

SEQ ID NO: 32455 - DNA, 1123 bp, Mus musculus
ccatctctccagccccacttacttatttcgaaacagggtcttaagccgggcagtggtggcacttgggaggcagaggcaggtggatttctaagttcgaggccagcctggtctacagagtgagttccaggacagccagggctatagagaaaccctgtcttgggggaaaaaaaaaaagaaaggaaggaaggaaggaagaaagaaagaaagaagctggcctcagactttttgatcctcctgcctcctaagtgctggaattacatgtgtatatcactaagacaggcttccttatcttttttttttttttttttttatttatttatttattttattaatgtaagtacactgtagctgtcttcagacactccagaagagggagtcagatcttgttacagatggttgtgagccaccatgtggttgctgggatttgaactcctgaccttcggaagagcagtcgggtgctcttacccactgagccatctcaccagccccccttccttatctttttgaggctgactgacagtccatggatggatgtttgtttggcccttcattgtttttgatgaactgatggtcattggttgggatgtttttatcctatttgggctggtgttaccgttctggggtggggtactggggtctgggctcttcattgaaagaaactgacttctaggcacttccagatttgctgcctggaaagtgcctaggcacttccagtggctgccacaccctacagcaccaattcatctcttctctggccaccctaatgggtgtgtagtggagcctctttgtgatccagcttggattttctggacgatggtggtgataagcctccccaaggagcagtcctttcttaaaatgatactgtgacctgaggccaccaccccttcccaccctgagtaggtagcttctccatatgtccttaacaatgggcctctagtagattccctggacccttccctaacaatctcttggggaagcctgacactacctcctggggcttctggtactatcataagcagagcttgatgttgtctggtgtattgtcctgtgtaattcacttgtgtctgcctctgttggcactaaagaacaggtagttagctggaggagttggtttattttgctt

SEQ ID NO: 32456 - DNA, 1438 bp, Mus musculus
tgatgctcagctcaagcgcatggcacaggacctcaaggatatcatcgagcacctgaacatggctggtggccctgcagacaccagtgacccattgcaacagatctgcaagatcctcaatgcacacatggactctcttcagtgggtggaccagagctctgccctgctgcagaggagggtggaggaggctagccgtgtatgtgagggccggcgcaaggaacaggagcgcagtctgcgcattgcctttgactagccacgcgtgagtggggggaggggctccttgggttgcagggctgctgcctttcccgtggttggttgttgagaaaaatgctctttgttttgattccctgttatcagaagtgttttgcaaaggcatgatgttcatggatataacctgtgtgctctggagaccaatgtgaaggtcactgaactctcggccagcatttaaagaacaagggcaagtggtgaatccagcgctcccttgcaagcttcagctctccttgtggcagaactcatccttcagccactccagtactactgtgagggtggataggtgctccagacgagagactcacctggggtggagacaggcttctgtgcgtctctaattcctgtcaagcccgtgtcctccagaggctctggcacatagagtggagtcaccaaagcaccacttttgcactggctacctctcactcctatcttgtgcgcttctgtggcagggactgactgctgatacgtctttgaggccaaagtggatgcagatttgcttctgaatatcccagtgtcaaacctatcttagatccacagtggtgaagctggcagtcatgtctattttatttctctgcactctattgtagcctttgtggtccctgatcaaaatgtttgttgcttttctaaataaaggaagatttgtgaaaccagacttgctgtgagtatgggtagtgggtccaagctttggcaggatagggcaggacacagctggtgtggtggtggtactcctatgccgcccgggttggaagcgctggctgagccatagggcccagtctctaccttcatggggtgggcaggctgcaggtgtgagaagagtcctgtctaccattgtgcctaagtggtaagtcatccattaccctaatacgtgcaggtgtcattgtgatgtcatcagcagtgggaaatgaacactgaggggtgatttccagatgctggtctcacttaggcccggcacttggctataggactgggggaccttgaaccagcagtggggccacttgggtcatgttgggtcatgttggcacaggagaaagctgggggtgggatgagcggctagatagagaggtagtcgctcagtggctaagaacacaggttggctgctcttccaaggacaggaccctattttgattcaatgcacccacgtggtagcttacaaccaccctgtaattcagtc

SEQ ID NO: 32457 - DNA, 1112 bp, Mus musculus
gtttggtccccagcaaactaggcgtggtggtgtgcatgtgtgacttgagcactcaagaactggatgcatgagaatcgggactccaaagttacctttatacacatagtgagtttgggtccaacttgagtacttgatcctggctcccagagtattaagaaaccaaactaaataaccacaaaccaacttgactctaatgttcatagccaaaacagatggagactcgaaggctttgggtagttcctgtgtggaacaggatggggccagaaagcaagctaggactgggaaagatcccaggggagacaggtgtgggaattgggggagctcagctgggacggccgcgtgccgtggaggggagttgcattgcagtagttgcccctcaggatgaggagtgatggttgcggcatcctgagcccctctatcctgctctggcccacagggctcggatggcgtctgggcggccagaggaactgtgggaagccgtcgtgggggccgccgagcgctttcaggcccgcactggcacagagctggtattactgactgcagcgccaccgccgccgccccgccctggaccctgtgcctatgccgcccatggccgcggagccctggcagaggcggcccgacgctgcctccacgacatcgcacaggcgcacagggctgccactgccacccgacctcctggtcccccaccagcaccacagccgcccagccctgctcctagtccaccacctcggccagccctggccagggaggatgaggaggaagatgaggacgagcccactgaaacagagacatctggggagcggctgggcggtagcgataatggaggtgagctaatagggctggcactgcagtggggttgctggttaactggacacttgtccagggtgttctgtgggtccttggcgctgcattccttccaagcctcacacaagagccaaccacttgatgggagtaataacacaataatgttgtgcaaatgtagcacaccagggttgggagattgcctttgagagcttcttgtctggccaagcaactggtgagaagtgcgggtgtttctggaaaggggtaggggctgccatcccagccaagggagacacaagtttcccaagagt

SEQ ID NO: 32458 - DNA, 1160 bp, Mus musculus
ctctacagccctcctcgcccgacctagaccgaatagcggccagcatgcgcgcgctggtgctgcgggaggctgaggacacccaggtcttcggggatcttccgcggccgcggctcaataccagcgacttccagaagctgaagcggaaatattaagcgaacagaaagccttggcctgcgagaggccactgcctctcggcccagcaagagaacaattctttccgggattggctggctcaggttgggcggggccggttctaaacgctccaagggtcaactctgtttcttgcctagcaaacgaagctttgcccgcacagccttgactcgcggccccagggcggagcccagctgcgggagctgccgctgctcagccagtgtcgggaagagttgcccgccagccttccagagttcccctacccgattggtcccggcctcctgggagtgtggccaagccctccctaacccagaattggcccgaggcctttaatttcttacactactagggctgttaatcaattgtttttgtttttgttgttttctttgcctgagtcctgacaattgtatcccggttccccaggggacagtctgggtccctctctggtctgacgctccctataggttccaccgcacgacagcctgtccatcaaaacttgtcctgtacccaggacagtaccagcttcctgtcccccgaccctaacaggtgccttaaaaggccctctcccacccaaggtgggggggccaggggggcctcactttccggccctagacttgggtgcgggagagtgggatgggggtagggaggggcgctctgagattaaagttttacctctgactagtgagttcgtgttgtgtgtgagtgtgatgctatgaagcgttcatgacaattaaatgaagttcagggttcgacacccagtcttgggggcgtaactgtgggagcggtagaaaggcaaaccagggaatctccatttcccaacatccaaagatgagaaagggggctagaggggctagaggactgtcaccttcacactattaatattaatatggattgcctcccttttgttactttgctttttgggatgatttcactttgtagcccagcctttctcttcagtttttgtgctgggatttccaatctgccccatcataccgagctttagcgtattt

SEQ ID NO: 32459 - DNA, 1230 bp, Mus musculus
gtgagtgtaggtgtgcaccagtgagcctggcttccgtggcttttttggaagagcagttgggatgtcctggaatgtgtatggcagagccaggccccctctcccttatattggcctcattctgaatgtgtgagactaactggcctttccccttctgcttcgttcaccagcctttccagagcccagggtagaaagctctgtcagaagtagggcagagtaggtgagtgtagataccagccatttccatgaaatcagacctgtgtacagatggtgacagtcattgcttccatctgggtgcatgaccactactaacacaggcatgttgtggtgctgggtgctttcatctattcctcaggacacttttatgtacctagtttgcactggaggctaaaagtcccagcgtgcccactagggtccattgaagctaggagtggaggctggagaagtatattcccaggggtcccagatctcacaggaggaaggaggagttaggtgtaggccagttgcagtggcccagagcctctagctgctgggcttgcgctcctcaagatgcctcagttgtgccaccgctgtccctggcttccttgactatggagccacagctggcggtgcagaccaagcgtgtggcggcacaagtggacggtggcgcacaggtgcagcaagtactcaacattgagtgtctgcgagacttcctgacgccgccactgttgtcggtgcgcttccggtaagtgcgagcagcaccgtgtgggctgtagggcagtgaggcagtgtcttcagggatggggcccagctgagctgctcctcatctgctcaggtacggtggcaccgcccagtccctcactctgaagctcccagtgaccatcaacaaattcttccagcccacagagatggcggcccaagactttttccagcgctggaagcagctgagcctgtgaggggcggggctgaggggcggggcagggctgagggcggggcctcagatgcctgacagtgctttcaaccttccagccccctgcaggaggcacagaaaatcttcaaagccaaccacccgatggatgctgaagttactaaggccaaggtgagacagacgggcgtttatcaggtgctgggaccagttctcacccctgagagtttagcctgcagtaggctggaggcttctcagctctgcttccctaatacccatgtcgttgcagcttctggggtttggctctgctcttctggacaatgtggatc

SEQ ID NO: 32460 - DNA, 1193 bp, Mus musculus
tgatcagcacatggtgaggtgcccggccgccccaccctcaagtgcctgaagcccatgtcttgccttctgccctgacattccaacccagacctcctgtccccagtgtgtatgccctgcccagtttccaagaaaccttcttccttcctcgataactccttggctgcctgggactgtcctcatctctgatgcagtaccttaacaagatttgcctatttctgagcctagagagcccatagcaaggccagtggactgactgccttgcaaagactgaccccaccctagactcccattagcccaccctgctcctgactcctgagctgacttaccctgatgccagggctttcccagtgacacccagcatgaagtccctcacgcctgagctccttgcagggagtggtcacagctgctgtcagcctcatcacctgtctctgcaagaagaatccggatgacttcaagacctgtatctccctggctgtgtctcgcttaagccgggtgagtgtgctgtcacactggccgtgggagggtctggctcccctgtgtctgtgatatctgtctctcctcccttccctaaaaggcaagccagcctgtgcttagaagccaggactctgcattggcttcctcgggctgtgtgcccccaggcaaatggcttcacttctctttgcttcttttcctgtgtggttcaggggctggtgtcagtgcggtctgcagcatggttgctgtggtaaggtgctgacagctcccctgcctgctcttcttcctcctgtttgtctacacatccctcctttgcctcccaccacctccacccttgtccccagagcgccgccccgagccttctgtgtgcctggctctctatgtctgagtcagaccttagggccgccctgtcctgctgagagggagtgtgacggggacggtgactcagtcatagactgccaacaagggctgtgtgtcagcatcatgggcacctcgcggaggtcctagtccagtttgggagacaggagagctcctggggatggcaatccaaatggagactcagaatgaaaaaaatgaaagtgctgtccgggaggccataagtgtctcagtcctcggggagaaggaacacctatgcctaccattcaagcccctagttaccacacatctgaatgcattaggtgccaggcccaacagggtacagagatgaggtcactgtcagccgc

SEQ ID NO: 32461 - DNA, 1195 bp, Mus musculus
cacaattatccggattacgtttcctctggaggtggatttgggcctgtgagtgaactggactgggtccagcctctgggcagctggagggtgggggacggtgccctgcgggcgtgaagggtaggctgggctattggcttgcttcactctccctgctccaggcccatgaccatgggtatggtatctcctacatcttcatgggggaaaacgcaatcaccttccatatctccagcaagaaatcaagcacagaaacagtaagaggaacttaagtgccttctttctctctctttaaactctgggattgagcccttcagatcccagaggtccctgatgtagcctcctccctcagaactgcctcccgggcctcctccctcagacttgtctcccgggcctcccctagcgccttatctgcttctctgcaggactctcaccggctggggcagcacatcgaaaatgccctgttggatgtagcctccctgttccgggttggacagcatttcaagcgccagttcaggggggagaattcggattatagatacaactttctctcctgtaagactgtggaccccaatacccctacatcctccaccaacttgtgagcccctcagcagggagctggtctccctcaggatggaaggtgttgctcccagggcttggctggcgcagacaggggtatcggggattcccacacccacctggtaataaagatgtgagttgggtgcagtatccactgtgcttttctgcggggcatgggtggagtggggggtggggcacccctttcaccccaccttgacttcccagttgtcatcaccttaaccacagcccgcactaccacctgagcaggctccatcccaaactccctggccagacctgatcagtcagcttctcacaatcaggcacctcattcctgtcacccaacaccaaaggtccgtcagaccatctccacactgaggtctggacagcaattctatcctgcgaggagaaaggatcgaggcagggtgtcctgtagttcaggcaggctgctctggaacttcctatgtagccacactcttgattctcctgtgtctgcttggatgatggactataccactgtatcctactattgaaaatcaactcagaggtaggaggatgctgagttccaggctagcctgggctacatagcaaggtccaatctcaaagtgtgcttgtgtgtgaaccg

SEQ ID NO: 32462 - DNA, 2215 bp, Mus musculus
gggctgggcgggggccgagatcatcagtgaggtttctgtgtgatgagcagcgtcgggcatgcctgaggcttatcacagccatagagctactcgggaacagggcagaaagctctaaagttgaagaaagttagtggtaaccctcaaaaaggaagagttgaaatggggccatagagagccttgagtcactctgggagggtggggcatggcccagtggtcgggtgcctatggtattctggttctgggttctaccactagtcctgttaagaacaagggggagtgctggacactgaagaactgttccaccaggctctgctgtcagtcattgagtgactgagtctgatccctgtgtaactcaggaaacacaggcaagatgcaggatcactagccctcaaagccttgctggtggtgaccttgtggggggtgcaatggcaggtttagcatggcgacacccaggcaaagtctggaactgaccatgcccacctttcaggtcctgagtccccgtacacacactggaagcagactgtgttctacatggaggactacctaacagtgaagactggcgaggagatctttggcaccattggaatgaggcccaatgccaaaaacaatgtgaggcctgatggagagtaaacatgatacggagggtgtgcagaaaagtcaggttctgggtagagttgaacagtgccagcttgggtagcatagcgggtacccgaggaagccccatgtggctgctgggttcagtgataaccttgttcagcacccttcctgtgggcactgaaatcacctggctcctgttacaggttagagtggcaagtgccagagcgcagtgtgatgctaggaacacctaaccctggccctcttgatccatgggtggagggggcttcaggatgcttgcaggggccctgaagtggtgctggcactccagcgctgctggtgctggttccctcggtggcagaaacttagactgtggctggggagcatggggtgcatatggccgatagtgctgtcagtaggtcagggtgcagggtgtgcagtgtgctggctggcagacgttgccaacactcttgcctggcccttggctgatggctctgtctcccacctgagctctgtttccctcttttccctgcagcgtgacttggactttaccatcgacctggacttcaagggtcagctgtgtgagctctcttgttccaccgactaccggatgcgctgaggaggtgccaggctggccctcctgcagaagggggctcggggggatgggcttgggggatgggggggtacatcgtgactgtgtttttcataacttatgtttttatatggttgcgtttatgccaataaatcctcagctgaccatgccacttctcgccctggggctggggtagttctactgttttgcctatcactccctgaggactgtccatttctgctctagggatgtggacctcaagctaggtaggattcctggctccatcatggctggattcccagaccttcctgagattcttttgttgttttggttttggttttggtttttcaagacagggtttctctgtgtagccctggctgccctggaactcactgtagaccaggctggcctggaacctggaactcagaaatctgcctgcctctgcctcccaagtgctgggattaaaggcgtgcgccaccacgcccagctcttcctgagattctttggagcagaggttgaggagtcctcagtgcgggtcagacccctgagcccctgagcccccaccccagagtctgccttccatctcccgctcttcctgtgctgttcctgttttcgggggggatgagggggttgagacagggtttctctgtgtagccttggctctcctggagctcgctatgatccatgctaacctgcagcagaggttcacctgcctctgccttctgagtactgtgactaaaggcctgcaccgtggtactgggccatttgtgtttgtttgcgtgggctttttttgttttggtttttggttttctgagacaaggtttctctgtgtagccctggctgtcctggagctcactctagaccaggctggcctcaaactcagaaattcgcctgcctctgcctcccaagtgctgggattaaaggcctgcaccaccaccacctggctgtttgcgtggttttgtttttttgttttttttcaagatggggtttctgtgtggtccttgctgtcctggaacttgttttatggtc

SEQ ID NO: 32463 - DNA, 1134 bp, Mus musculus
aagaagtaaatatccttttgtgagacccccacccagcccacttccacataagcttacttgctatacatctggctccccaagaggtctaaccgtcctcttgcttccaaccagtttcctctgctgtgccccctaaccccttaggacagagcccttcctggccccagctggcttccccagaaccatggctgcttccttaactccatctccagccctcctcccctgcccttccatgtgtctgccctggctctgccctctctccctccctccccagctgtgggctgagctagagacaggccatagagcctggagagatggtaggcgaggcggctgctccctggatggtgctctgggtgggtcctggaagtggaaacatgacctggggaagaaagatgctggagggggctggagggttgtcctggtatgatgaggggctttttgcaggttgaggagactctggggaacccacctttgaccctttgccactccccctcttctaggtttcctgtggccaagcagaaagtagtgagaagcccaacgctgaggacatgacatccaaagactactactttgactcctatgcccactttggcatccacgaggtgagtagagactgaccctacagccagtatggactgaaggaccacaagaccagacagggctctgagtgtctcagcacgttcactgctccctttctgcccctggtccacttttgaagactgaattcttccatctctccagaagccagtgcaagtgcttcctgccccagtgtaccacagacctagggatgaggtccggccctgtctgtctctggcgccctctagtgactggcagtggggctgcgtccatggctcatgctgcactacaaccctttttgataaaggagacaggacttggtgcaaatcaaatgacattctaaagaatcctcgtcttttttccatggggctttaaaaacaacaacaacaaaaaaactactagaggctgggattggggcaaagtggcggagtagttgcttagcacgtgctggatagtggcctccatccccagcatcataaatggggaaaaaattggaaaatttgcataaaataattgagcttttggaggcctagggacgtaccccagttattaaagggcttg

SEQ ID NO: 32464 - DNA, 1103 bp, Mus musculus
ggaggtcctgtatgactctgagggtctgagtgctgacgagcggggtggcaagagtgacaaggaccggaggcgttcaggggctgcatcctcatcttcatcctcaagggagaaagggtctcgacggaaggccctcgatggggaccggggccgagacagggataggtcatccaagaagacgcggccacctaaggactcgacgcctggctccgggccactgcccaaagcccccccaagcagtggctcctcgtcctcctcgtcctcctgctcctctcgcaaggtaaaactgcagtccaaggtggctgtgctcatccgagagggcgtcagcagcaccacccctgccaaggattcctcgtcttcaggcctgggctccattggggtcaagttcagccgtgaccgtgagagccgctcaccattcctcaagccggatgagcgggctcctgcagaggtggccaaggtggccccgggtagcaacaagcccaaaaagaccaaggccaaggccaaggctggggccaagaaagccaaggggaccaagggaaagacgaagccttcgaagacgaggaagaaggttcgcagcggaggcagtagcacggccagcggtgggcctggctcactgaagaagtccaaggccgacagctgcagtcaggcagcaagtgccaaggggacagaggaaacatcatggtcaggggaggagcggaccaccaaggcccccagtaccccaccacctaaggtggccccacctccacccgcactcaccccggactcccagactgtggatagcagctgcaagacccctgaagtctccttcctaccagaggaagccagtgaggacactggggtccgagtaggggcagaggaggaggaggaagaggaggaagaagaggaagaggaggaggagcagcaacctgccactaccacagccaccagcaccgctgcagctgccccaagcactgcccccagtgcagggtctacagccggagactctggcgcagaggatgggccagctgctaggatctcccagctgccaacgctacccccacccatgccctggaacctgcctgctggtgtggactgtactaccagtggtgtcctggcctgtgagtctt

SEQ ID NO: 32465 - DNA, 1149 bp, Mus musculus
tatgtcctgggacaaatcaccctcctagaggtacctgagagccctcatcctagtctgtctagccccgctcaccaactgggagtaccctaaattccaaacagttgctccattcagaccccaagcactccccgaggctctaatctcctgatcattgcccagactttgattctaagactcagctgggaccactctgtcctaaaacaggcaccctgtaacccctgcttgaagaggatttcccttcagacctgagatttcagaaagatcctgctacatgaccatcctgggaaaacaccaatatctggcataccccattctgctaaatgcagccccccatcctacccccaaggaaaaccaaccatttctccatcctaagttccccactcaaactccttaccctcaaccctgaaaactctaagtagctcccatgtcatctccagatttaaaaagaaaagcatagaactcaggtttttcacagcctccagagacctgttacttggaaggttctaggtcccataaatagacctctcctacatcaggaaccaaccctccaggctgttctcacccttgggcatctatttactttggggtcctaatcatccccccacacacaccaaacctcatcctctccattccttgcaccccttttagcctcagcccttagcaagcactctagagaggaagccaccttcagcctcagcagccaagttcagaaaatccagcccagccccggaaacctccacccagttcccacggggagcctccccacatcagggcaacactaggaaagtgagggcccacttgctgttgtagaagttcctgggtgatggacattcacagactaggagcctccggcaatgccgttgagaaacctacagtgggaagaaagagtccaaatttgagcccctagcaccaagggccaaacctggagatggccagaggcctggttggaagtagcaggacacagtcaggaagggagaggcggggataagggtggggctgcctctctgaagcaggattggaacctagaccttcccaggggaggagacactggaggctgcttatggaggagggagcaagaggagggaaggaatggggggagggggggagaggaagggaagagagagacagcaagatcggcagctactttgc

SEQ ID NO: 32466 - DNA, 1343 bp, Mus musculus
actgcgtaactctggctagtctggaactcacagaactctacctgcctctgcctccaagtgttgggattaaaggtggtcaccaaggtggtcttggaagttctctgtcttgattcaacattttggtagctaactttgtttctatgggttttcatcggccacactgagttaggccctgaacagtcgctcttatcactctgctcttgggatcctgagtatatctttccagcctggagaagctaagccactttgtcctctgagctcagtcactgaggcatccttaacaaggcctcccctgtgccctcctagctagggatctgcaccatgatttcttgccattggaagcagtgtctactgcacaggaacctcagaatgattctgtcccatctctccgcagagcgggcagttccaggacggctgctgaagacacgggccatgcgggagatgtacaggagctatgtggagatgctggtgagcacagccctggacccagacatgatccaggccctggaggacacgcatggtgagctggaccagggaggatgcctggacctcagaggagggatatggagttatgggtgggtgctgccttcctgaagctgaggattgggcctgggaggtggagggttagggtctcgggagagcgagaggcttctggattggtctaaggatggtcactggcacttagtcctttgagaggaaagctagagcctgcaaaggaactctggcgttggactcggtgatcccggggagtagggggttgggggaaccctgttcgtggcagctgctgtctgctgacacccctgctcttgcagatgaactctatcttccacccatgcggaagattgacggcctcctcaatgagcacaagaaaaaggtcctgaagcggctgtcactgagcccagctctgcaggtgcttgggggcctgagtggggatattgcatggggctcagatcaggtgtggagacccggctgtgggctgtcagcaactggaggttacttgagtatcttccctagagcaaggattactgcaaggtcattactgtcctggggcttggtctggagatgatgagggctaagctggagaggcccctggcttcccaacagccccccgggggacgttaatagagcatgcctgggcctgaggcttttgtctaaccaccctatcacctgtctcctgtccctgtgagacagaactgtcaaatcccagggctcactcctgcctgtcagttccctctggaatgacccgtcgtactggatggtgcatcccagggccaccctgagaatcttgaggtccagtgctgacacggtgccaaggattctagatttaatgtcgtgggacaggg

SEQ ID NO: 32467 - DNA, 1802 bp, Mus musculus
cccagctcctcccttctgtgctcagccatgcccccagcccctcacctagcgcccccaaagtcggcgtccacctccttgagccagccacccgggatggggcgccccagccgccgcccccacccccaccacctatgcctctgcagcttgaagcccacctccgcggccacggcctggagcccacagccccaagccctcgcttacgacccgaggagagtctggagcctcctggagccatgcaagaactgctcggggctctggaaccattgccgtcagggcctggggaccctggtgtgggaccacctaactcggagggcaaagatcctgcaggcgcctacagaagccccagccctcaagggaccaaggcaccgcggtttgtacccctcacgtctatctgcttccccgactcattgcttcaggacgaggagcgcagcttttttcccaccatggaggagatgtttggtggaggggcagccgatgactatggcaaggccggacagaccgaagatgatggagaccccaagactggtgctggtccaccccctggtcccactgcttatgatccctatggaccctactgtggaggccgggcatcaggaactggaccagagactccaggcctgggtctggatcacaacaaacctcctgagcttccctccacagtcaatgcagagccactgggcctgatccagagcgggccacaccagtcagcaccgccgccgccgccgccaccaccgccaccaccacctgtctctgagcccaagggtggcctcacctcgcccatcttctgttcaaccaagccaaagaagctgctgaagacatcctcatttcacctgctgcggcgccgagacccccccttccagacgcccaagaagctgtatgcacaggaatatgagttcgaggctgatgaggacaaagccgatgtgcccgcagatatccgcctaaacccaaggcgcctgcccgatctggtgtctagttgtcgctccagaccagccctctcaccactgggagatatagacttttgcccacccaaccctggtcctgacggcccgcgtcgccgtggccgcaagcccaccaaggcaaagcgcgatggccctccccgacccagggggaggcccaggattcgtccactggagggccctgccatggcggggccagcctccataaccactgatggggccaagaaacctcggggccggggcaggggcagaggcaggaaggctgaggaaatgggaggtacccggttggagcccctgaagccacttaaggtgagggggactgggtgtgggaggggttgggatggactctgtgagactggaggtgtcagatgccctaggcatcaagagttgtggttgtctcattaaaaagcaccagagtcacctagaattccggtgtttccatgagataaaatgttgtgatgttcatgtgcagacagggtggcaggactcaagttctaaagtcttgtgcatggagggatggactggcattcagagcctgtgggcctgagtactggggaagatctgtgtctgggagggactgttggcctggcctcctgtctcaagtagtcagttgggctgaaatctgagactccacaaatttgttgcaggaatttggaggtggtctaaagtgaggtggggggggaggggtgcagcactccggggtggatccctggagggtgggcccctggaccgtgacactttgctatccccgtgtctagatcaagctgtctgtgcccaaagctggtgagggtctgggagcaccttccaatgatgtcatctcgggtgtagaccacaacagcctggact

SEQ ID NO: 32468 - DNA, 1134 bp, Mus musculus
cctcttcttggctgattcgttcacttatccattgtcaggcctctctggactttttgacactggcctccaccacgcgggctcagcagggcccgacgcctccgtcatgaacctcatctcggccctggagtctcggggcccccagcctggcccttccgcctcctctctcctttcccagttccgaagcccttcctggcagacaggtaagtgctatttccagcgggctggagaagggctgtctcgtggtccgctctgaccaatggtcttcttcatccctagccatgcacacaccgggccccacggaactcttcatctctggtgccctcccaggttccagcaccttcccgtcttcctctgccctgtctgcctaccagcacccggcttccttcggcagccgccccttcccagtgccctcatccctcagcctccaggatccacccttcagtcctcctgctaatgggctcttgtcccctcatgatgtgctccacttgaagccttcccaggcacctacagtgccctcgtcattgggtttcgagcgcctggcagggggtggtgtcttggggcctgctggcctcggccctgctcagactcccccttaccgtcctggtcccccagatccacctccacctccccgccacctcccgactcagttcaatctgctggcttcctcttctgctgccactgctgccgagccctcgtccccccagctctacaacttctcgggtgctgcccccggtccaccgccggagcgggccctgccccgacaggacacggtcatcaaacactatcagcggccggccagtgcccagcccccaccgcccccaccaccagcccattccctgcagcactatctgagctgcggaggcagctatccctcaatgggccaccgggccagcttggcttgcagccctttgggaggtggggaaccttctccgggtgctggagaacctagcaagggtgggcctagtggagccacagctggagcagctggccgggctacaggcccggagactgctgggggaggtgcggctgggggtgggggagggtaccgccccatcatccagtcccccggttacaagacgagtaagggaggttatggaccagccacggggggtgccaccaggccaccgccacctc

SEQ ID NO: 32469 - DNA, 1156 bp, Mus musculus
ttcgaaccgggaaggccttgggaagatgggaagggttggcgaagcaaggcctggacttgccccccatctttggattcccggcgtgctgacccctccccccgggcgcccctggctctgcaactgcaaaggtgggaggaaaagagaatcagctcgcagacctggggggctgcaccccctcccaggtcctattgttccggggctgcaggaggccgggccactcggtccctcccccctccaagaaattccccgcgcagagtgggcaaggggccccgcccccttcttaaactagaattctgtgtgtttgggggggtcctgagattagggacacgcccccttctgctccccaccttgctcaaagctgtgaatcctggttgatggcgcgctgtttgccctctggtgcaaggccacggatttgggccctttctggaacagagtcgtgtctcttccccgtttgtgtttgtgtgtgtgagcgtgggccctgtgcacgcgtggctagccgcgtgttcacccgtgaacctgcctcttgtagtttaatctgtgtcctcactcttcacctgcccttcaccctcctccccctccacacttagctttccccagcgtgtataaatttttagagtgggacttcacactcgggaccttttcttttgcacgggtgaattgaactcctgtttgtacacgcatctggcttcacttaggccggtgcatttgaacctcagcccctagggatgcaacgaattcgtgtcaggacttgtacctgggactttccctgtgtcctgtcccctccccaccttctccccttgccatttgggacacaagctacctcctgctcctggcctggctggattcctttcctaattcagggtccgtgtcgtttcagcgggtcttgggttgtccgtgcgtccttgcagtgttggacctttcgttctgttgtggcatgggaggacttcaagggaggaccacacctttcacgttgactatttgcttcccctgactttctccgtccccagtgtgtcctcgcatgcccgtgtttgcaaacgtgggactcttaagtgctccagaatgacattttttaaccccctcccccgccatgggatgactggattccctagtgttatctctgggttctttggagtaacacctccattcagttgagaag

SEQ ID NO: 32470 - DNA, 1273 bp, Mus musculus
agagcgcgacatcatcgtgctgcagcgggtgagttgccattcgctcaccgcagccctcaccgcagcccgcaccccatcctagcctgcactgcaaactgtcccctggtgtcatacccacctgtcttccacccggcccccttttgcccacccctcacgtttttcctccctatacactgttggctcttctatggcactgttttctttctaatgccccatcctcctccgcccttgggctcctcccctttgtcaaagacactcccactgtccagactcttcgatgttctgaatgccctccatttcctgccctgggacttatttctctgccccccccccccccaacagaacccccactgctgctgggagcccagcctgtgaggcacctccagcttgttcttttctctcctctctagggcggcaccggctttgcgggctccggagtgaagctacaggcagaaatgtctcggccagtgatgcaggcctgagccgtggcctaataaacgtggatgtgaacatctggatgcctggcgcctcattgtaggcccggcgacagaaggagtgggcctgcggtgtgggcctgggctcctgggatttactcagtcacttaggaccaggcagaaaccccggcgtgaacctgtgggtctcctccagcctcaggcaggacttggaagagggtgccctgaacaagaagtgcaagtctcgtgatagcactcccaggccagctacctcccgagacccctagacatggacctgcccccaccaagtgcccctcccccagcgatccctacagacccattacacactgcacactgcttcacatgcacgtaccctcctcctcttctttccctgaacacctgagaatatctctcaagagccaacttcccttccccagcccccttaaacttgctcaaagagacgcagaccaccctcatccctgcctccaagtaaaaatagctttcttttctctttgtactggcaaatgcacacactaagcaagtgttgagttccttaatgtatatctaagggaggggtttgtgcacatgagtccaatgcctgcataggccgtactaacctgtcagacccctggctctggggtcaggcagccttgagtagcctagtctagatgctgggggccaggcttgggtcctctgccaagagcagcaagcactctaaaccactgagccatcttcaccccgtgtttccatcccatcacagaagagaactgctgcaaaattgaggctactttgtgctgtataagactgcctcagaataagag

SEQ ID NO: 32471 - DNA, 1195 bp, Mus musculus
ctactgcctgcacgcaggtgggtccggaaacagagagagaaacggaaagagacctagagacagatccggagaaacagatgggggccgaggcctagaggagagaagccaggcagaggaggggccctagggacagcctggtggggatgtcccccgtgggccctgcctcctgctgaccactctgcccacaggatggccggctgagcaaagctgagatcttgagcaactggaacatgtttgtgggcagccaggccaccaactacggtgaggacctgacaaggcaccatgatgagctctgatccccatgtctctcagacttccgaccacatgaccacatgggggacaaccgcggggccactgcagccagccccgcccccaggacacagactcagctctggtgttcctggttcttgggccctcagtcaccttctctccctgagacccctgtcaccaaccctgggaccccccaacctgcccaggatactcaggcactcaaagataagtgacacccactgatagcatcccagcactgacgcggggccacatcctgacctaaccgcaatttgaactctgaatgtcaacagcacaagctaacctgtcctgcctaggagcaataaaagctgttgctggggtcccctgctctgtctgtctgtctgtctgtctatctgtgggtggggggaaggatactgtgaggagatggaggagcatgctggcgctgagtgcggagggcctcaagagggcgtagtccagcggtgatgtcccctccacagggtcacatacattacgattcataacagcaaaatcaccgttaggcaatagcaacaaaaatgattttatggttggtggagatccgtcaaaacaagaggaactgtgttaaaggttgaggagcactgctctcgggcatctgggcatgcgagatgggtgttagtggacgtttgagggcgttcccagaggccgagaataaagccagcagcctgggggccgcaggaaagccaggcaggaaatgcagcccgcccctaagtgctccagggtggggaagcacaaaaccacagctggagaaacaaccacagctctcagtgaaacaccccgcggtgagggttctgaaaatggaatagccaggaatgaggagggaaagcgcctctgtgtcagctgcattgagccacacggagagtgatatacacccgtaatacagcaacgc

SEQ ID NO: 32472 - DNA, 1203 bp, Mus musculus
cccaccccctttcttctttgctgtctatctaccctgtcaacctacctgtctgtcagtgtctctctgtgtgtctgtgtgttttttctggcaagatcttggggtgggcagcagggtgggagacaggggccaaaggcaaaggctctcatcacagagtgtgtaggcagggttggggccacctcaagtgctggcacatggaagaaatcagagcaggcttacagctgggagtgggctgctgccaaaccttgtgtgttaggcaaccatgccatgaccaagccacacccacagcccacaaatcctggggtgtcttaaagtcacattcagcgtgcaggcctttccagggctgcgagtctactccaaaaatgctccaaacgagtaaacatagaagctgttttgggaggcaggcctaatgacgtttgccccgggaggcttccaaccagatacagcaggaacttcaagagaggctggacagaggcccaaggggtgtgcttaggagctagtgggtggagttggatgccctcagagttctccagtcctaactgtgtacagacaggatgtaagagaagaactggaggctctaagcagaggatccatcggctgcaggcagagggaagagggcctctgtgaggaacaggctgagcgtcagaggaggaggcccaggcctggttctctaggtatgagggaccagcaccccaagaggaaagagggttggggcctggagctccaggtctgagggaggagtgttatgacctgagggggagagaggaggctggggtctgaggaaggagagcaggaccccgggcacctgagtctgagggatgaagccggagcctagggttttgggtttgaggaaagatcttggaactggactcctggatctgagggaggtggaactggactcctggcttgggtttgagggctcctgaggctgaaatctgagcccctgggaatgagggaggaggagaaggcctggatcctctggtctgagggaggagaaaaaggaaataacagaagtctgagacaaattttggtctgtctagctctgtaattaattaactaaagtggatcaaatgagaaggtgaaagttcacagaggaacactcctgtctgtcgtcttggactgggtctccatcccaccatccagcgtcctggtctacgaagagtccacagggaccttgtgaagaatcaacaaggcggggtccagagg

SEQ ID NO: 32473 - DNA, 1781 bp, Mus musculus
caggttttttccccttgatggagactgaggcccggacctcgtgcgctctacggcagggctgcggtcccgacctcgctgtagttttcagtgtgagcgcagctctggcctcgatgagcttaggcttgtcttaaacttgccatcctgcctcaacctcaaccgggatgacagatccggcccaccaggctcggctacgtggacataagcttgaatcccgaatgagtggatttgtatgttttggaggtccagtctggctgaaaagctctttttgatctcagccgtgagttctgcaggctgtggaggtgttagatgggacgcagtgtgtgagctaaactagacttggggtggttggagagccctgaccagccggttttggcgattggggcaaataaggttgaaggtaggaaggaagaaatattgtctctgatttccttgaactttacctgcaacctcaccaaattctcatccctacagacggagcgtgcttaccaaaagcagcctacgatctttcaaaacaagaagcgggttctgctgggagaaaccggcaaggaaaaactccctcggtactacaagaatatcggtctaggcttcaagacgcctaaagaggtacaggaccctccagcagatgagatccctgctgccctgcacgtgtgggagcacagccaccccgcccccttcacagtggcttcccatgggcccctgggaattgtagtatgggccctgaggcgtcatccttggttctgtttaggaagtggtaatctaaaccccactttcttaactttgcaggctattgagggtacctacatagacaagaaatgccccttcactggtaacgtctccatccgaggtcggatcctgtctggtgagtgggatgttggaagggtggttctaggttcctgcgtccaggggcgctggcaagtgatgtctgttctcacgatggtcttcagatgtcctctagggcactgctgagacagccagttgacaaagctgatgccataaatggagcttcttgggagccccgttcaactgactcctacctgctaacacctttctgttactctcccaggtgtcgtgacgaagatgaagatgcagaggaccattgtcatccgccgggactatctccattacatccgaaagtacaatcgctttgagaagcgtcacaagaacatgtctgtgcacctgtccccctgtttcaggtgactctggtagcttgggataatgactctagacaagacagtcactggctaggctggaggtgtcccatgggcagagcagtgtggggtccaggagtgtgtagactgctgtgtgaacgtctgggaactagaagttgtagtttgttagtcttagcaactgcgtagatggtgactggttgggtggagcaagggtggcccccacccctttggcctgtctggatgaaggaattgctggggaggcccctcctgaagactccttgtctgaccccacagggatgtacagatcggagacattgtcacagttggagagtgcaggcccctgagcaagactgtgcgattcaatgtgctcaaggtcaccaaggctgctggcaccaagaagcagtttcagaagttctaaggggactctggccaatgccctagaacaaataaagttattttccaacgtacagaacaggcttggagtctcatgtgtcctgggacagagcaaagattgccagggctttcctgagctggaggtatctgctgcatttatgagcctctaaatcttggtaaccaagtagaacacccagggtcagctacctggtgcaggca

SEQ ID NO: 32474 - DNA, 1781 bp, Mus musculus; identical to SEQ ID NO: 32473

SEQ ID NO: 32475 - DNA, 2345 bp, Mus musculus
atttacctttgcctgggagtccatgatgagcaacactcaccatctttcgtttgagtctcacgactgtgagatcaacccatgcaccgctctgagactcgccagcccctgctttcttgggacccctggcctaaaaatacttttggagcaagagatctgccttccaagaggctttgctgactaatctccaactccctgttaactctaggccggaaggtggtggtcgtacgctgtgaaggcatcaacatttctggaaacttctacagaaacaagtgtgagttagggctggggcagtggtcttcaggcgggctgttgccttgctcctggacaagcaggctatctgctctgctcttgggtccaagggtgcctcacatacttttgtcctgacagtaaagtatctggcctttctccggaagcggatgaataccaacccctcccgaggcccctaccacttccgagcccccagccgcattttctggcgcactgtgcgaggtgagttggtgatgtggtgacatgtaggacagggtaggctctggcagcttgtgatgagacatctcccactcatgttcgagttgctcgactatgagatgactctacatgcactaccatctgaggctgttctagcccttgccctggggtcagacggggttctcagcacctctgatgaggcccgctgttacccccacaggcatgctgccccacaagaccaagagaggccaggctgccctggagcgcctcaaggtgttggatgggatccctccaccctatgacaaggtgagccttgcaagcctagccttacagcctctgcgtccagcgtctgtgatgttctgctattacctacattgtttgagcctcatgaaaaccccactggctgagacgcctaccctgctggccttcttgctaggtgttcccaacaggtctctgagcatctctttctctcaacagaaaaagcggatggtggtccctgctgctctcaaggttgttcggctgaagcctaccagaaaggtaagctctaggttacaggttaggcttgtgagcctcaagactggcacatgatgttcttattctcacgatggtcttcggatgccacagttagggcagtgccgataatgccaaaggctaagctgatgccaggagggctcccgtgctggggatgagtccttgaaatagggtccctaggccctccggctcacccttgtgctgctggggcacattccatgtccttacagccttgtgcctctgcagtttgcttacctggggcgtctggcgcatgaggtcgggtggaagtaccaggcagtgacagccactctggaggagaaacggaaggaaaaggccaagatgcactatcggaagaagaagcagatcttggtgaggacggacactgagatccaggattaggggggcgcaggtgagaagcaaccgctctgacatgtgtcttttcacaccacagaggttacggaaacaggcagaaaagaatgtggagaagaaaatctgcaagttcacagaggtcctcaagaccaacggactcctggtgtgaacccaataaagactgtttgcctcatgcctgcctggcctgcccttcctccgccgccaactagggaagtggggaccaaaggttccttaggcactgctcctgtgggtagaggggacattagagagctgacagcgcaccacctgcatgagtttttattaaagtgcaaaccatgggatgaatcagttgagcttcagtgttgaaaatgagtagcagggctgccccacccacctgaccaagtaccctattctgcagctatgaaaatgagatctgcacatgagctggggttcacaagtgcacacttggagcactgccttgctccttcccagcagaccacaaagcagtatttttctggaggattttatgtgctaataaattatttgacttaagtgtgtacgatgtgtgctgtgcagagaggggcagagggcaccagcaggtcatctgcatggggggcccctttgggtgaatccttgctcacgggataggctttgttgctcaaaagttgcagatatacatcttgggtcctgtcctagatggtgttactgtaagtcagcaccaagatacaagagctggtacctggactgtaggaggtcaggccatgacacaaaggctgggactaaaggcatttaccacgcctgagtcttctggttctttaaacatcaaatccttccgggggctggcgagatggctcagtggttaagagcacagactgctcttacgaaggatccgagttcaaatcccagcaaccaaatggtgcctaacaactatccataatgaaatctgatgccctcttctggagtatctgagaacagctaca

SEQ ID NO: 32476 - DNA, 2345 bp, Mus musculus; identical to SEQ ID NO: 32475

SEQ ID NO: 32477 - DNA, 2345 bp, Mus musculus; identical to SEQ ID NO: 32475

SEQ ID NO: 32478 - DNA, 2345 bp, Mus musculus; identical to SEQ ID NO: 32475

SEQ ID NO: 32479 - DNA, 2345 bp, Mus musculus; identical to SEQ ID NO: 32475

SEQ ID NO: 32480 - DNA, 2345 bp, Mus musculus; identical to SEQ ID NO: 32475

SEQ ID NO: 32481 - DNA, 1172 bp, Mus musculus
atggtctcgggtgactcggcaaagggtctgtcttcagctgtgagtgggcaggatagggacagggaaggagggcggtcccgagaagggaggtaggggaggaggaggaggagaagaaaagaaggggggcaagatggccagagagctataccccagctcccaggaagtagaaacaggaagataggcactcaaggtcgtccccagcctctggaacatagtgagtccatgccagaacagagtaacaacagaaagtgtcagggtggtggagttggtagctgagggcacaggcacacaggaggcctctctggagaatgggccctgcagaggactaggggcatccagagacccccagagggaaaaaggaagaaagtactgagccccctcttgacactggctggtgcatgggggagggacaccctggggacatcagtctctagtcctgagaaggagttagagtcatcagtgcccatggcatatctggctttccgtgggtgctgagagggggtccacggagagtttggaagcttgtatccccaggggtcatctacatcagtctggacctcaggtagtgggtaccttgctggagctgggtcagaagcccagagagggctctggtgcagagtccaggagaccaaatcttgatgttctgcagacagacttgcagagagagccagtgcgtgctctagaaggaagcagagctccatgcttgcggtaaggatcaggttaacagacctcctctgccccggtggtgtagttctgactgcaagagtcacatccccctcctccatctagtctgtggctgtctcagaacccttgacctgccctcagtacatcctgatcctggcaattccaaaaaggagtgggcagagggaccctagggagtccaggggctctgggaggcaccccaaggatcaggctgggtttatagttgtcacccttcagggagccagaggtgctgggaaaatactgataggggccttgagggttcccaggcctggaagaccccacaggctccagatcagtataaggctccaataaacaggctgatgtaagcctccatgggtcctgggagtccagctctgagactgatgggggtgtattttgaggccttactcaggctttgagtaagaatggaaagcgctggatgtctggtctcagcgccttcagcttcctgt

SEQ ID NO: 32482 - DNA, 1148 bp, Mus musculus
tctgcaagttcagggagtttttagtggtcttttcgctccaggaccaagacctgcatcaccatacagccagcccgtctagttcctgtgtatacagaggatgatcttcctggggaactagtgaagttttcctgaaaggacatgtatgaggctttgagggtcatgtaggagtttgttctgtgcagcattgtacattccaggctcagaaatgaaacttccaaggaaattaatgataaattatggtgggggctggtcaggttacagagggaggattctgggtaccaggtcaactctagagctatatgagagatgaaaaactgttggctaagctagaccagagatttgacgaggttgacagagaaggaatgggcagcttgctggctgtggcccaaggcgtggctgcgagcgggccggtgggtgtgcgggcctaggtccagcccacagcccctcaccctgtgctgtctccgcagttccagaggcatctgtttgtccacatcagtcagcagtgtcccagccctggagcaccacccctagagagtgtggacgtgcggcagatctacgacaaattccctgagaagaagggcggcctccgcgagctgtatgaccgagggccaccacatgccttcttcctcgtcaagttctgggtgagcgttcctgaggaatgaacgaccctctccgccaggtctgaggagggtcttgggtctgcctgcgctacccttgaaaaccaacaactatgtgggagagcatgtaggaggcatgtcactgcttctgaggacctgctctgtgacagaaggagttgagtgcagatcgtggggacgtggaggacagagcatcttcagtctttctcaggcccttctggtttggtgtccagttgcatgactggcactgaagatctcggggtggaggagggtatggtcctccaaaggacgtccacacgggatttcagtcagcttggtctccctggctgtctggttctaaagcttcccgagccttctatcatggtgcacgcctgtcaccctcatcccaatgcgcagcagtctgagccaggagaacccagagttcaaggacagctgaccctacttaacaaaataaagggactgaagagctggttctgtggttaagagctgctcttccagaggacccaggttcaa

SEQ ID NO: 32483 - DNA, 2354 bp, Mus musculus
tccaggctagcctgggctacatgagaccctgtctcaaaccactaaacataaacaagccattaaaagtcacaactcgggcttatttcaagggttgaaaggtatagagatggattctgcaggatgacaaagactcttaagggtatggtaggagctgtgtaattagccagtaggtatgttatacttcagggcctgtgaggtcttgaagcctcaagctcagcgtggagatgctattgagggagtttggaggtcactggggtttcagaccatgacagaggagaaggggggggggggtaccttgtttgcaggttcagaggcctagggtctctggtcattaaagttgaggttgcttgagggactctggccaagggagttgacagtggcctctcagaggctaagggtgaagcttcggtcctagggtggccgtgatctctctcagctactgtgtttcccactcccagacggaacgggcccagctggaggacgggcgctttgtgtaccgtctgctgcgctctcccatgtgtgagtacctggttaatttcctgcacaagctccgtcagctgcctgaacgctacatgatgaacagtgtcctggagaacttcaccatcctccaggtgatacgctggggcaggcagaccctcagctcctggggactccaaagatgagattgcttcatccagaacatggtgggggtgggggcgggaggacaggaccgagctgtcctatgtggagagcccatcttccctagggcagctgagatacctcggcttctaagcatctggcttctctgagaagttcagagaagggagttcctttgatttgggggttgtgctaatatgatctgctgaccctctctctctgcctggtggcatggtggggaacccttttctcgggaatgtgatatgatggggaggccccttcctaccatctctcagcttaggggtaacctcattgcccaaggaacctgagccgcaggacattcttcttggggtacatagcatggcaggtttctctttcttgataactagggtgggcagggcagtccatgtcctgtaccccatccccaccctacaatgtaagcctgttctggcaggttgtgacaaacagggacactcaggaactgctgctgtgtactgcctacgtctttgaagtctccaccagtgaacgaggagcccagtaccacatctaccgcctggtcagggactgatggagcccccgccgctggtgtttttcacaacacccccttcctgggaagggcccttttgctctctctgtaagagagatttggagaggggcccatgatttttaaaaaggcctaatctcagaagcatgagccacgggggctggctcctcttagaaaggaaccggaagcctggttattgagctgagtgagctgggtttgagtttagatccccaacacgaggacctcagagacaacatttgacaggacacaccactcctgagcatcagggattggggacaggagtgagctcacaggtacagcacgggcctccgttctacagggcccctccttgctcttctggaaagggagctgggctatgtggggtgtcttactgactgccttgtaaccttcctgcttcccacgtgtctcatatctgcctctccccccacaccctttctctgggaactgtgacgtcacaacccgaagataatgttttcccagcttggggtagggtgaagtgggacctgaaaaaaaattttaatataaggagatatttatacacagtgttagggatgtaatcttatctcagctaggcagtggggtgggacttcttaatctcccccaccccatttaagtgagccttggaccaccctgccaccttcctttccccaagagtgatggtttatgtttgaaggagaataaagctatttttaccaaaaaaaaaaaaaaaaagccaaaaacccaaaggggatttatttgaggtgtcatgtgggaggtggcagacagatggtgtggggaggagggagccaggaagggaaggaagctgggcacaaaagtccctggccatgtggggaaagtgaaggctgtcgatagggcagacagctgggtccccaggggatgaggcctgaggcatgggctccaagcctgtgaccaaccaggaaggaaacatttcctgactgcatggaggtgcgtgggtgccgatgggtgggctggggcctagcggtaccgggccagccggtcatagacgtgatccagatttctacacaggaatattgagagcgtcatgaagccgagctgggaaaaaaggagatacttcagggttggagaaagggtggtactcaaagggagaggcaaagaatgggcatacataacatctgtgcgtgattggcagcgt

SEQ ID NO: 32484 - DNA, 1717 bp, Mus musculus
tgatgtgttccagacctacacgtggcgtggcgtcagaaggcaggccttgggagggtaaggccaggataaaagaccgagactgaaagggcagtcccttatatgtaggcgtgacctactcaggggcatagtatgccagcagatcctaagctggactgggctactagaaaggtagttatggaaggggcggagtcctctgagggtgagaggcatgatctaaataagggtggcacctggaacgctggcccagggcaaggcttggataagacctgggtggatatctaggcattgggtacctaaaaagggatccaagggttcccttggcttaagggtgagttgcagaagcaacgcagccactacacgtcttctgcatccccagggctgcgcgcagagcctccagaagtggctgcacaacaatatcatctccatagtgggaatctgtctgggagtcggtcttcttgaggtgacttgaccccgtccccatgagtgatttgtctattgtagatgtttccccattgccgaggtaacgcgcatacttagcggaggcgttatttatcaagcaatagcatggggtggggcggaggcctggcttctctaaactctgaatggctgtactcgcagtgctgcctcctcccctctcccgcaggtgagcgggatggcgctgtgtctgcagctacagcgccgagctctcgctagagagcacgtgctgccgctgtcaggagccgagggttcgaaccctaccccagggctgaactctgaaggcagcagcgggcgctggggcggtctaagcagcggcagcggacgcagcagcaccccgtggggcagctggggcatggcgggtgcctgcccgacatggggggccaaggctccacaaggcaagctacccatggcgctggggccctggtccttgtgggatgcagaggaggagccacttgagaccgagagtgtgggtgctgaggaggtcgaggcacagacggaggctgttgcggagcctccagaataaaggaccctagctaggcttgccttgagctttctcttttgcagactgctgctgagctttcgctctcaacgctgccaatcacgcacagatgttatgtatgcccattctttgcctctccctttgagtaccaccctttctccaaccctgaagtatctccttttttcccagctcggcttcatgacgctctcaatattcctgtgtagaaatctggatcacgtctatgaccggctggcccggtaccgctaggccccagcccacccatcggcacccacgcacctccatgcagtcaggaaatgtttccttcctggttggtcacaggcttggagcccatgcctcaggcctcatcccctggggacccagctgtctgccctatcgacagccttcactttccccacatggccagggacttttgtgcccagcttccttcccttcctggctccctcctccccacaccatctgtctgccacctcccacatgacacctcaaataaatcccctttgggtttttggctttttttttttttttttggtaaaaatagctttattctccttcaaacataaaccatcactcttggggaaaggaaggtggcagggtggtccaaggctcacttaaatggggtgggggagattaagaagtcccaccccactgcctagctgagataagattacatccctaacactgtgtataaatatctccttatattaaaattttttttcaggt

SEQ ID NO: 32485 - DNA, 1450 bp, Mus musculus
gcacacaggcctggttcagctgccagcatggccgaaagagaaggtaaagaagcctgtgcatgaagattctacacaagggaaatgaaatggattgtgtctaacaccacaagaaaaagagaagcaaatgccatgcagtagaaatcccagcacttgggaggccgaggcagcaggattgccaagaggaagggatggaaggagaagagaagagagaaaaagaaaaggcgacaaagattgtatatggaaagcgcatgcatggaactgtctgacacaggggaccccagtgtggggggcggggataaggaaaagataattcactttccatcacttttttttttttttttttgaggcagggtctcattagatatagctctgcctgtcctagaactccctgtgtagacctggaactcattgggctctgcctgcctctgcctgccaatcactgagattaaaagtgtgccccacgcttctcgctgagcgccgccaacatggtgttcaggcgttacgtggaggttggccgggtggcctacatttccttcgggccccatgctggaaagctggtcgcaattgtagatgtcattgatcagaacagggctttagtggatggaccctgtactcgggtgaggaggcaggccatgcccttcaaatgcatgcagctcactgacttcatcctcaagttcccacacagtgcccgccagaagtatgtccgaaaagcttgggagaaggcggatatcaatacgaaatgggcagccacaagatgggccaagaaaattgatgccagagaaaggaaagccaagatgacagactttgatcgtttcaaggtcatgaaggcaaagaaaatgaggaacagaataatcaagactgaagtaaagaaacttcaaagagctgctatcctgaaagcttctcctaagaaagcagctgtggccaaagctgccattgcggctgcagctgctgctgctgctaaagctaaagtcccagccaagaaggccacaggaccaggcaagaaggctgcaggccagaaggctcctgctcagaaggctgcaggccagaaggtggcacctcctgctaaaggtcagaagggtcagaagaccccagcccagaaagcacctgctccaaaggcggctggcaagaaagcgtgaggctacacagaataataaaagttctttttgacggtggtaaaaaaaaaaaaaaaaaaaaaaaaagtgtgccccacaaaccaaaaaaaaaaaaaaaaaaaaaaaaaaaaaaaatggctgggcagtggtggcacacacctttaatgccagcacttgagaggcagaggcagacgcatttccgagttcaaagccagcctggtctacagagtgagttccaggacagccagggctacacagagaaaccctgtcttaaaaaagccaaaaaacaaacaaacaaacaaacaaaacccaaacaacaaaaaccaaaaaccaaaatc

SEQ ID NO: 32486 - DNA, 1284 bp, Mus musculus
attgggcatctggtttcttgggatagggcagtcacaaggggtgccctgccacacagtgctaacctcatataggccgggcccctccccgcttccacacagagaccgggaccgggaccgcgagcgggagcgcagagaaagaagccgagaacgagacaaggagagagaaaggagacgctcccgctctcgggaccggaggaggcgctcccggagtcgagacaaggatgagcggcgacggtccagggagcgtagcaaggacaaggaccgagaccgaaagcgacgaagcagtcggagccgggagcgagcacgcagggaacgggagcgaaaagaggagcttcgaggtggaggaggtggtggcggtggtggcagtggtggtggtggcggcggcgacatggctgaaccctctgaagctggtgatggagctcctgatgatgggcctcctggagagcttggccctgaaggccctgatggcccagaggagaagggccgggatcgagaccgggagaggcgacgtagtcaccggagtgagagggaacgtcgtcgggaccgagaccgtgatcgggatcgagagcacaagcgtggggagcggggcagtgagcggggcagggatgaggcccggggtgggggtggcagcggtcaggacaatgggctggaagggctaggtagtgatggtcgagacatgtacatggaggcagagggtggtgatgggtacatggccccagagaatggatatctgatggaggcagcgcccgaatgaagaggcctgtagtggacatgctcctaatcttgctgtctgccttcctagccttttccaccttggcttgcctctgagggtagatttttttttttaatccggtcccttggatttaaaaataaaattaattttctgttgatagtgggcatgtgatgtcttactgcacttgctgtctttccaaaaggccacttcctactgctcaactccctttggtatactgcacgtgttataacctgaagtagaggctgttctcccaggcactgtagctgctttacaagtgagagggaagccctggctctcataacaggctgcatctttaagtgagagaacagcaggcaaagaggcaggatgccagccatcagcagttggtacccacacatttctggatggaaggcagctgggagagctttgagtatggtgggccctgaggaagctggggccagcctggcacagtcctgaagaaaggctgaaggtagtcccattgagggctgaatgatagtactccaatctgctgcttaaggcttataagtctt

SEQ ID NO: 32487 - DNA, 1142 bp, Mus musculus
tgcctgcctctgcctcccgagtgctgggattaaaggcgtgcgccaccactgcgcagctgtttcctgttttttttgtttgtttgttttgttttgttttttttaagcaacccaaattacagaactcttactatagacattttcttgtattgataatggcctagctcattgttagactgtgatccagcagctggaagtctgggtcctgctttgcagtagtccaacctgttatctatacctagtttaacagcctagcatgtggctgacctcttcgctttgcctgtgctcctgtgtgaaacacagccccacctcactaaaccttcaggtggatggtgcaggaaaccaccacaggcagatgggattctgagacatgaccctccttgccaagtcactggggcaagtggctcattagtagatccctgtctgaaagataagactgtcacctgctcccttgtgctattggttgggtgaaaatcacctttatagaccacgtattgaatctgcaagtttgaagtattcgtggcacatcagaatctggggaggtgtggtagtgctttctttgaacagttggggaggtactgatggcctctaacagttcgttggagcgtgctatagtgtgatgagcagggcagggtctgagttggtgctttgagactgacagggaagtagaaggtacagagacaaggaaggtgagctcactcctcagaaggtaaatgttacatggctaaggtggggagcacgaggcagctgagaaggctggaaatgtagtgtaccctgggaatctaggtgtggcaggtgttccaacttctgggtttgttttgtttcgtctcaccacgtagtggctgacctgaagctcactgtgggccaggctgcctctgctccaaagtatgagattaaaggggtacaatcccaaacctagcttctttcagcttttctatgagttcacactttggactttatgctcaaagtacaaattggtagtggactagcctaaataaaacctcaagcctcaggtaagatggacagcttgggagtcaagaaggttcttgttggggtgtcctcagctctagcactttgtaaaagtcttgtggataacatggctatcctacaaccagtggacatggaagtgattggcaggagattat

SEQ ID NO: 32488 - DNA, 1181 bp, Mus musculus
acccacctatatccctgccagttcctgaaggtctttccactcctgttcatttctgttctgatgtctctttcctcacactgacctcccctataaaaacacacagaaaaacaaaaacaaaaaaacaaaaaaataatctggtgtggtctggatgtggtggggcccagtgggcctcctgcctcagcatggtgtctagggtgcatgcctgggtgtggaggagcctagccagcctcctgcccagcatggtgtctagggtgcatgcctgggtgtggaggagccctccccacagcagaggccagcattcagctaacctccagtttctttgcagcaatttggccgccctggcaggagggggctgctccatcatgtgaaagctgggggaggccagagtaaatgttttacccccccaatagcacttgggggtgccaaaaaggaatcaagcaccggatggagcaggcccttcagggtggggagagggcggtctggctgttggttgcctggctgactggtgggagtgtgagtgtatgtgtgcagatggggtttgaggggcagggatgctgttgtatggagccttgtctgactagaggaccttctggggaattccccctcccccacatctgttgcagccgcttacaagcacgcagatggcaagaagatagatggcaggagggtcctcgtggatgtggagaggggccggactgtgaagggctggaggccccggcgcctaggtgagtgcagtattccttctgggtgcctgggcctgtgattagagattattcttccttcagtctccccaacccatacgcctgttcctctccatttccagcttgtcttctcatcatcttcatggctttggacactggtgcacacagacacctacacatgagcacccaagcataccctggtctttcctgcatgagtgattgaccagcagcagttcttgtgcagtgtgggtaacttcagcactgacctcagccaccttatgcccatatacttggtatcatgggctgggttggagggtatcactggctctagctttgctcttgctctcactgagtggcttcttcattcactctctagctgagtcaccagcccaattcctggcttcacatctgaagcaagaaagcagcagcctgtgctctgaccttgcatctgaccctcctggcctttctggtggttgtggg

SEQ ID NO: 32489 - DNA, 1169 bp, Mus musculus
cagctaactgctgagccatctctttagcttcccctgtgtgcccctccccccttattttaaaattttcagcattgcattctgtagttcaggctgtcctcaaaatcttagcattcgcctttttcccacttaaactttttctatctcttctatgatctcttttatttgacacttgcagctatattctaaggattaaatgaatgagagagccaggacagctaataagatggtcacagaatgtgtagcactggggtatagcttccagtaaccccacaccccattaggattgcttaatagattcttggtctttttctgaagacttaatacttggtgtccaaacggaacagggttttgatagttctctgtaccagttgatcttggtcatttgcttttagcactagcccagggtccctgctttagactatagggtatggaagagaaaatgtatccttaactgtcttccttcctttttgagacagggtttcactatgtaggccaagctgagttctgcccccttagtacataggccatcacaccccacctatcctagactctggttcctagtctgaggtctgagactgtttgctatcaggcttctccctgtgctttggtttcagtcagtttgccacaagctagctcaagtcatccctccagagagattgcatgaattcagttactgctcagttcaccttgcactgcatatggctagccaaagtatatagttctaaagtggcttttaggtttgtcacagccatcggtttgacgtcatttttatcagagcagcctgttgtcgtcatctgtcaatcaatctagaaaaagccattgaactttagtgaaaccagacctgaaacatgtactcacgcttactaagtcactgagcttttctggggtgggggtggggcactaggttccatcttcatgtattcagtctcttcccatcactcttctacccaaaattgtgagcactgtctactttaaagattttcttctccttgtacaggggaccctcacaatgatcccaatgctcagggcgatgccttcaagactctgttcgtggctagagtggtgagtactcagttcctgtcctgagtggttcaagggctttagaacagtgtgcttctcatataactccgctttatgtcttgtagaactatgacacaacagaatctaag

SEQ ID NO: 32490 - DNA, 1180 bp, Mus musculus
tagattctgtgagctctggagtcatgcagacaggatgtgatcactctgggtcctgatggaaaaagggttagggtataaaagatagacagaggcagagactcagataaagggacagagacacccccacacacacacacaacacacaattctctgtgttgtgcagggttataggactggaatcattttagggccatgcaaagctgagatgtgtgaccccatgtgtctccgaacagttgagtctgatgacttctacggtctcatgggacttgtgttactgtgagtcctgtggaacttttggttgaatttgactgtatgtgagggccattttaaacagtagatcagggtcacagcacagataaaactaactacaagggagcaagcatgggcacgtggatgtgtgtggcccgttgaacaagtttactcagggttatgcattgtagagctggtagtgtctgtatctctgggtccccctgcccgaagcacctagaaagacgatgggaactagtaacctgcctgtcttgctcatgtgggacccatatttctatgttgtcccatgctgtagtacaaagattcagaggctggttggagccacaaggaaagaaaacacagtagggcaagagtaggtacttgggaaaagatgtggcaggggacagagatctagaagaaagaaagatggagagaaggagcaggaggagcaggggagggggaaagagggaagggaaggagggagagacagagcaggtaaagaggaagagatgtgggggggggggggagaaggacctggagcccaagggtcatcctctctattctctgagtcataacagactctaagccatggcgtcagcatcccttagagccaaggaaggtcaccacactcctggaggtgctctgtgtttcctaggacagaaacccaaggctgtagtgtgctgtggcttccctcaaggttacccagcacgtcataggaccaaggctggtgccaggtggcctgcctgtgacacccccacaacttctggtgtgcaggtattgcctgaggccactggtcctgtgtcctttgtttttatcccttaaaacagggtccctctttgtagtgttggctgtcctggaactcactacgtagaccagcctggccttgaattcacagagctcttcctgtctctgcttcacaagtgctgggattaaa

SEQ ID NO: 32491 - DNA, 1200 bp, Mus musculus
aaagacaagtgcagaggctccacctagtcacagcctgtgttcggggttgggttccagcatccagtcaggccagaccatgtccctatgagaccccagagtggccacatccctcccccaggacagctgttcctaataatagacccccccctcccagcaaaagggcagacaacagctgggagggggaggggtgctccagtgaggccctggccagacgaagccaggttgggacagagttagatcaatggcctggagccatacctgtggtctccggaggagaatggctaatggggactgaaatagaacatcgagttttaggaaggtggcaattggtaggaaagtacagtcctggctgatagacacgtgacacaggtgacaaaacaggccaatggggagaggagaaaggtagtgggaggggttacagagggccacagatgaggccgtgggtgaggggaacgtgagacagctgagctcagttaccaggctggggatgtaagccggcgaggaatgcgggccaggtcttctgagcctccctttgcctctccctcaggtgtattttgggcgttggctgatcgaggggggacccctagtggtgctcctggatgtaggagcctcagcttgggccctggagcgctggaagggtgagctttgggacacctgcaacatcggggtaccctggtacgaccgcgaggccaatgacgctgtcctgttcggcttcctcaccacctggttcctgggtgaggtaggcggtactacagaccccacctcagccttcctacccagacttgaaaccatcatcatcatcatcaccgcttgggccagagagtgggcttcccctgggaattctgggaattgtccatccactcttttaatccaaggatcgtctctgaaaagagtctagctgcttttctcagagaccagaagtgtcaacctcagtttcatttcctctatatccaggtgtaaacacactgcgacattgtttccagggagtcctgccagaagagggttgggtcccaggaattctgggagttgctgtctactttaatatccattaccgttaagcactcagggtaacttttgatacttaccaaccttgagttggtttcagaaccagaaatctgggctttccccaccccaaacccattctagaatttttaagagaagtttttaggagacttaattgggatgccttaggacaaaaaa

SEQ ID NO: 32492 - DNA, 1050 bp, Mus musculus
gaaccaccgaatcctcacggagcctgtttcctgctctctgaaacccacccgttcactgcccaccaggctctgaatatctaccacgaggcaggcactgttctaagccctgggaacagcagatgcatgtttaagaaatgaggaagagctgaaaatgtagctcatggtagggcgttcagcactcacaagccccggcacggcataaagtgggtgtgatggtccatttctcttaattctaatacttggggagtggaggctggagggtcaaaaggtcaaggtcatactgggcagcatactgagccaggaggcagttagagagagagagaagagactggtgtggttgggtcggcatgtccctgggaggatcgtaagtcatgagacagtagggtgacagtctttccgaacttgtgtgccagggtgttcctctcagaatattattcctcctgtttataagacagggcctagcagtgctctgtccaagactcattctaaccctaataatagctgacatttctggaaggctctctgtgtgctgggctttccctgacctctcggactcctctgcaaccacctgaggttgactctatttttacactcatctacaagaggagtcactgacgttggagaggaaaggccaccattcccagccacctcaaggaactcaagcagtctccaggtccccatcttccagtttgaggtcccccggggtgtggattctgaacccagacggaagtttctctggtgcccacaatgcctgacagaacatagtggctgtgatgtgacattgtttctctccgttccagggacacagccaatacagtcaaggagaaatttgggaggaagctctacgaatcccttttagtgtgagtgtcagcccctagctcttctcccatgattgccctgacccatcccgtcacttcattctgaaatgcctccccctccccttgcagggggagcctcccggacatgaacaagatgctggacaaggaggacttcactatgatgaagagagccatctttgccactcaggtatggtctttacccctgagcaaa

SEQ ID NO: 32493 - DNA, 1194 bp, Mus musculus
acatttcctcacaagatgtggagtgcctctgtttagctgggatttttttgttggtttggtttagctttgcttgtgatagttaaaagtcgggctccagtcaggagtatgctgacctctgctggtagcttcttcagagccctgtgaccgccctccctcccctgacccctccctcatgtctcctgtctacagcggcagtctttcccaccagtgtgcacccacaacatgctggacgactcctcagaccccatcttgaccaccatccgccgaattggccttttcaacagcagtgccgaccgtgtgaaggtcagggctggcccgaggttggtggggtgtggctggggaaagggttcttggatatcatgcttctcctctacctagtctgtcaattgtactgtttagaaagaaccctggcttctgaagccaaatgaattcagtttaagtctttagcttgttgtggacttgctgtgtgtttctagagaaatgtaccctctctgggctactctaggtggctagaagtagctcagcccttctcctctgtcgacaggtgatttttcacccagaattcctttcttccacaagccctctcctccccgtggattatgaggaatttgtccgcggctgtcaccttggggtcttcccctcctactatgagccctggggctacacaccaggtgagtacaggaggtgaggggtggcggattgctgggtcctgttcagttctggcatgaacctgcaacacggttcctctgtttcaagatgatggtagtgacccatcctgtatccatgtgtcacatgtttgtctcacagaaggctacagagctcagactagatgactgatgttcatttccggtcgtcgacactgataacctcagctccaatttgctgatgttggagttgcacatgaaccaggccttccccggtgtctctcagacttgctatgtagcccagactggtcttgaactcctgatcttgtttccagattcggagtgctacaccactgtgatctgtttgtgcagtgcgggctgtagaagctggggctctgtgcctgccaggcaagccctctaccctctgagcttctcctcctggtccctagtgctgctcaacctcttcctctcctcacctctcttcagccctgagcttcgagttagaattgcttgtgtgtaattctccttcaccgagaggatcctgtggggc

SEQ ID NO: 32494 - DNA, 1427 bp, Mus musculus
gcccacaccagagtgaggatgaggaagagccacgggatggacccctgggggaagacagtgagcgttatgatgaggaagaggaggctgccaaggaccgccgcaacatccgggcacctgagtggccacgcagggcctcctgttcctcctccacaggtggcagcaagagaagcaactcggtggacactgggccctccagctcactcagcacacccactgagcccctgagtcctaccagttccctgggtgaggagcgcaactaagctcccacccccatcccattccctgcctgtccagtgctcctctcgcagagggcctatgcagatgggagggtgcctgaaccccactccagactcttgagtgggacccctacccagtgtggtccatagcctaacctctgtttcagacactccagcccttgagctccaatcttggagttcccgcactccacgccgccgtgcctttcttggattgcaggatgcattctttgtgcactgatctggagtctccaggcttagactgggtcccagaggccaggcatctgccattgtttttcaatgccagaggttttaggacacctggtttattggcttccaggctgtggcttcttcgtttgatcctataatcatacagagtatgctttgctcaggcctgcctctgggaccacctcatgttggattctgtgtggcttcccgaatcagccaagttcagagttaggacatttcagggattaacataattgaaaatcagcctgcaaggtagctcagtagctctgtcgacagattgcttgtctagcatgcccgaagccctgggatctaactctagaacctcataaacctggtgcggtgatacacatctgtaatcccagcactcggtaggtagaggtagacggatcaagagttaaaggccatcatcctctgctacatagggagttcaaggccaaactgggcaacatgagacactgtctcaaaagcaaagtaaaggtggtggaatgctcacggtcctccatttcaacccacgactgcgatgctgggacatgctgcaaggttggcctccctgggtgtgttcttcaaaggagcatgcggagttggaccagacacctttctgccttttttctggaccagaccttcttttccttggtccagtgtcccctctagggaatgcctccattgagggcagaatgtctgtcaaccccacaagtgctcagcccactgtgaaaccactgggttctgggtcccagtggctgaatcaggagtcttttgtcactgtgctgcaccccggtcccctttcctgatacaaaaccgagcccaccggcttcttgaagccccacatgtacctcgaggcctttctgcctgcaagcttcagtgaatgggcgggcccctcctcacgtgtgctgtgtctggcccagtgcctttggtttgcatttggga

SEQ ID NO: 32495 - DNA, 2736 bp, Mus musculus
catgttctcaggccccaaaattctcttttgtgagacacccagaaaaggacctcgaagtcatcccctccccagggtctcagtgacccggagcccagaaccctgcgacccctccaggttgcgcctccggatccggaccaccgcccctcccccaagcctccatttcacaaggcctcgcgctccagtcccgtgacttcatctcatgggactgggtgggtggggagcgaggttcccctcagctccggattggtcaagtatacttttccgtctccgcctcacgccaccgccgattggttagtctcgggcctggggcacccctccctccggagggtcaacatgctataaaaggagcgctccttgcccgggacttagagcagcgccttggaggtcccgtggatctgtgtcttgcttcaacagtgtttgaacggaacagacccggggattcccactgtactcgcttccagccgcctttacaagtctctccagtcgcagcctccgggaccatctcctcgctgccttcagctcctaggaccagtctgcaccgtctcttcgcggttagctcctactccggatcagccatgacctctcagattcgtcagaattattccaccgaggtggaagctgccgtgaaccgcctggtcaacttgcacctgcgggcctcctacacctacctctctctggtgagcagctcggggttgccttctgaacggggggggggggggggggtccatcacacccaccctcctgcgcatgcgcgggccttctttgttccatgcagggcagagactgtgctccgacctctccctctccctgcgcgctgtgtacatagtagttttgtctgactggaactcgctgggcagaccgggctgccctcgaaatctcacacgtactgcctctacctcttgagtgttgcgattgaagtttacagtgtgagccgagccaccgcgttccgttaactcgtatttgtaacctcccgcagggcttcttttttgatcgggatgacgtggctctggagggcgtaggccacttcttccgcgaattggccgaggagaagcgcgagggcgcggagcgtctcctcgagtttcagaacgatcgcgggggccgtgcactcttccaggatgtgcaggtaagaagcgggggtattgggcactaccgagcatgtgcgtttacttgccatccccatagtttgggcatccggatagacgtcttggaagggagtggtggcaggactagtgtagacaataggagtatgtagagcaactaaacccaccaggatgtcagaaactggaaaatgggggtaattacagaatacagatgaggactgctgggctggggagaggcggtgtctctctagctagcatggaaatcacaatgtagaccaggttgcctcctatcaagagatcctcctgtcttctcgcccagtctctcagtggtgggattaaagacagtatcccattatttttccccactgtgcccacttttcctgtgcagtcagttttatattggctgggtgaaggatgtaatctaggcttgatattcttgtgtgcagaagccatctcaagatgaatggggtaaaacccaggaggccatggaagctgccttggccatggagaagaacctgaatcaggccctcttggatctgcatgccctgggttctgcccgcgcggaccctcatgtaagtaccttgctaatcatttcttcccttctctgacaaaacctagactgttgtgtgttggctttcagctcccaataatttaatcctcctgcctcccgagtgcagattgcagaagcaccacacacagtactgaggacacacctacctacctacctacctgcccttgagggcaggattttttttttttaaagcttcctgctcacacctgtctcttagaactcggtgtctgatgtctcttccttcctttacagctctgtgacttcctggaaagccactatctggataaggaggtgaaactcatcaagaagatgggcaaccatctgaccaacctccgcagggtggcggggccacaaccagcgcagactggcgcgccccaggggtctctgggcgagtatctctttgagcgcctcactctcaagcacgactaggaggcctctgtaccttccaaggggctcccccctctgctctgcaccagcccgccctgggacctccacctgaatgaacctctcaagccactaggcagctttgtaaccgccctggagcctctgtcaagtcttggaccaagtaaaaataaagctttttgagacagcagctggtgttttttctatatatgtgggaggggtgcacgagaaagaagaggttggctgtatgtactcctgttttttgtgggaacccacatgtgataacttacagcgatctctgtgtggtagtatctgccttttcatgtggcaaatccaggtcgtaggagtctgtagcctgtagcagtttgccagtccttggtttatgttactgtgcagggaagtgaaaaggcttaaacatccaagttcagaaatgagttaaacatacaagtagaaggccaggaggtgagcaagctgagccctgggtgctggctgagcgagggtggggagccagggtgtcttgctggattccgaactagatgctgggcccatcaaaaagaggatgtgaaacttgggaccattgcccaaatgggaactaaaccattgcaaaggggttagaaacatgggaagttggtggggtggggggtggaacaccggacaatactg

SEQ ID NO: 32496 - DNA, 1167 bp, Mus musculus
gctagaagcttgcaggcctagggtcaactatcaaaagtgtgctcttctaaatttaaattgttccccaagattttctacattaacaaaaaaaaaaaaatctttttttttttttttttttttttcaagacagggtttctctgtatagccctggctgtcctggaactcaccacccggctaacaaaaacatcttaacctaactatactaactacatctctaaattctttctgaggccgaatcctttttttttttttttttttttttaatttatttattattatatgtaagtacactgtagctgtcttcagacacaccagaagagggagtcagatcttgttaaaggtggttgtgagccaccatgtggttgctgggatttgaactctggaccttcggaagagcagtcgggtgctcttacccgctgagccatctcaccagcccagaggccgaatccttaatctgctccaacagcaatgctcaaaagagatcaatcattattattgtaagaaccaatgatacttgctgaggtgatctttatgtgcgcttgcgctgtgcaaagattgtctctgtattattcaaatgctggtttctgagtaggcaggccagattttggtattgttaatcatcacctgttgtagtgttttgtaaacacttccttcaacactgcctgatttaataaagaactgagcgtggtggctcttgtctttaatcccagcactcgggaggcagaggcaggcggatttctgagtttgaggccagcctggtctacacagtgagttccaggacagccagggttacacagagaaaccctgtcttgggaaaaaaaagaaaagaaaaaaagaactgaatggcctatagctgagacaggagaagaaaggcaaggtttctggggagagttaagaactcggggaaagaatctgaggcaggagatttgccagtgagacacagaagaagccagaggagaaataacaagccacgttacagaacatagattttttttttttaaagattcatttattttatgtatgtgagtacactgtagctgtcttcagacacaccagaagagggcatcagatcccattacagatggttgtgagccaccatgtggttgctgggatttgaactcagaacctctggaagaacagtcagtgctcctaaccactgagccatct

SEQ ID NO: 32497 - DNA, 1157 bp, Mus musculus
gggccgagtagtcacttattatcttcctttagattcaaaaattgtgggccccaacagagctggtggtgaatggagagaggaaggagttccctccgcctgtccttgggaaggactacaattttgtaaatgggtcatgcatgctctatgaagccaaccacgtgcgtgagtgcctgcgtaaaggtgaggaggggcggagggctgcactggggctacatctgaggggactgttgtgttctagcctgccctgaaacgcaagtagctatttagaactacatctcccaggattcagagagatagccaccttctcaaactaccctgcccatgccgcaaagacttctgggaattaatagtcctcttgctgtctgatgcgtgcgttttagacaagtcttcctgtggtcactcttcccaggtcttaaggagagtcctgtagttcctctggcagagagtgagctcttggctgagatccttgaggaggcgaggaaggccattggagtcaccttcccccaggataaacgctgatacagctcctgcgacagatgtgtgtggcaagcaaccttccctcctgcttggacctctgtaacctgactctcattgctttggagttgttgttgttgttgttgttgttgctgctgctgctgctgcaaatcagcacgtgttctctccctttctgggtgttgggagccagctttgatgagtcagggtgtggagtcaggggagtctacagacaccaaagcttctttctaggacaaacaggttctctctttactttagggggaaacacacgcacacgcacacgcacacgcacacacacacacacacacttgatggatgaagctaggctccaacaactttatttttcccccatatcccccagcaaactctttgaagaagtataaaaattacaatgtggttacattctatctttaagtggatgaataaatgaagtacaatgagttcaagtaaaaacaacaactacaaagcccagcaggcccccagcacccttacacaattaagcaatttatatattacatgcagaaaacagattattaacatgaatccacatacattcctgtctaagcaacttgttatagactaacaaactgtgggtaaaaaaggtatttttttctcagccagttctttgactggcaagctgcaat

SEQ ID NO: 32498 - DNA, 1188 bp, Mus musculus
agggcatcagatttcattatggatggttgtgagccaccatgtggttgctgggatttgaactctggaccttcagaagagcagtcagtgctcttacccattgagccatctctccagccccctcttttttttttttaaacacacacacacacacacacacacagagagagagagagagagagagagagagagagagagagagagagagaaagagaggtgaggggggaggaatgtgcttttgttttaatcccggtgtggcgtgtggggctgctgcagactgtccacagcagctgactatgaactgcctcatgttctggcagggatgtgattttgccagctgtagatagtttctgtgattttgtgacatttggggttctggggacttttcagagggtctataaatgcttaggccaagagccagctggggtggattgttggtgcgttgcgatgattttggcttgttaagtagtgatgggcaaggaagaagcaagaagacatcagctaccctgacggtgtagatcaatcttgcttcagggaccttgatgcctctaatcagcagaaactcgtctagcgtatcatactcccttccccctccatcctttccccctctcctatctagtgttaggggcttgaaagaatggaagaaaaggggtggagaagggtggaagaaaggaaaccccacaacatagcaaagacaaactataaagctgtcccgtccctgactcagaaattcacagctcttgaatcgctccacctgctggaggccacgtgtacaaacatctgattttgtgaacagctgaggttccaaaccttatgccagccaagcctagaacactctagctgtgtgtgtgatctttccagttgtttccagccaggcctagaacattccagttgtatgtgtgatctagctttctagatgtttccagacactatgtgtgtctcaccagaggtcagcttttcctggatttctggaatgccagagttagaaataaatcctgattttggtctgaaggtgtggctcaatggaagactttgatagcatatatggtaccctgcacttgaaatgtagctgccaaagaaaggaagtcctgctgggcctagaggtgaaggggaatgacaagtcctaggccatcctgggctccagagggatttcaagggcagtctgaactactcaaccagaccctcaaaaat

SEQ ID NO: 32499 - DNA, 1461 bp, Mus musculus
aggcccctaagacagaagcaggggattcgtgactgagtctcaggctgaggaaggaggcctgagaatcctgtttcccgtgttgaggaattttatctaacatcattctcctgtttcctctgcagatgacgctcctgtcccagctccagcaggtgaccagaaagatgtgcctgcttctgagaagaaggtcccagagcagccccctgagctgccacagctggattcccagcatttataactcctcagagaccccagccctcaggttcccacagacagtgtggaagccagatgaagtggccttgcagcctccctggggaccaacgccctcatggcctcctgggagcagaacaggggctaccctgttcctcagatgtgcttctgctggtctaccattctctgctctcagcctctgggtccaggttctgcctccctctctcgctccctccctccactgtcagggattaactacaggagctgaagttgcaggagagctcgctcacctcacctggagtgcacactccaggcctgcccacctgcctactttgctcttctctgttccaggctcagcctctctgcttcctgtacctagtgtcactggatcacaggaccttggcttagtgtctctgactctgccttctgtggagccaatgatctcaattccttttggtggctagaggccaccaggatgtggggtgttcttcaagtagctatcagctctgcctgggactcctggcctttaccaccaccccatcagcctaccctaactcccaggctcaatacctaccccatggccccaggaggtacccagatatggctacacccctagctgaggtccaaccctgctcagggctcctgaaaattggttcaccaacttccctggcttcaggccacactgctgtgtcctgctctgtgccccagttccatccaaatatagcccggcacaaataaacattagtgtatctgtgtgaatatcctgccctcttccaagccctgcctgcacgcacgccacctgctcacctccctggtatcctagggcacatgactttccctgccaggagacttgccaggcggctttctgtgtgctcttgccacaagggcctcgctgcttcatttttgccatgggaacagaaaacctaaacctgagcttgaaaaaaaaaagtttactatcttaaataattaaaaatatatattattaagggtctgtggctcagttggcataatgtgtgcctagcatgacggaggccctgtatcccacagtccacgtaactggggtacagggataaatgcccgtaatcctagtgcttgggaggtagaggcaggaagatcaggagttcattgtcatcctaggctgtgttataagttcaaagccaacctagactatatgaagccctgtgcccaaagacaaaaacaacaaaaaaatgaccaaacaccaggcagggaggctgagagatgtgggtgggtcct

SEQ ID NO: 32500 - DNA, 1109 bp, Mus musculus
aaaagggtatgccaccatgcccagccagaatgcatgctgataagaacaggtcctgctggcctacaggccatggccaccattgtcctctgctgagagacctcacgccctcccacaatcccttctctagcttctcccttagggccagactcatgcagccctgtcgctaacatatctcttctcatccctagacatcaacagtgatggtgtcctagatgagcaagaactggaagctctctttaccaaggaggtgagtgtaatggaagctttgtgagcgagacatacttcagcctcttacgccctaacctatcctctgctttcctgtcagtgagggtgcaggaaaaactgtaagtcccagcagcccctagagacaaagaagccatgaatagtgaagcaggcgccactggtcctctggggggggggtaagtcccccaagagtggcggtgttctgcgcccctcagcgtgtcacgcttctcccttcaccctgcagctggagaaggtgtatgacccgaagaatgaggaggatgacatgagagagatggaggaagaacggcttcgcatgcgggagcacgtgatgaagaatgtgagagacgccatgcggagggtgggcagtggacaacaggctcagcacagtcactaaccttggtctggctccccaggtggacaccaaccaggaccggcttgtgaccctggaggagttcctggcatccacccagaggaaggagttcggggacactggggaggggtggaaggtgaggacacgggaaaccctcagaccttagtgtctcccgggtccagcctttccttcagcacctctggctctctcctgcccttccttctggttccgaattctgccattccctatctagacccctgttcttctttctgtagtctttagcaaacactctgtttccagtcaggtagcacacacatgcaccccagcctccgcccctctcccgctcagtgaggctgagcttgccctaactgatcgcctgaccctgtcctgtgccctgcagacagtggaaatgtccccagcctacacagaggaggagctgaagcgttttgaagaggagctggctgcccgggaagctgagctgaatgccagggcccag

SEQ ID NO: 32501 - DNA, 1121 bp, Mus musculus
tattcacaatcaagcatacactcatgcatagtacttgtgtggtgttcagtgcaacttgaggaattcggttctctcttcccgccatgtggggtggagctcgggtcatcaggcttggcagtaagtaagagcacagctgaaccatctcagcagtccctcctctgaacctcagtttacccctccccaggcacagccctctccctcctgttgtgtgtgtgtgtgtgtacttgcatgtatgtctgatcaccccttgcatgtctggtgccttcagagagcagaagaaggagttggatcccctggaactggagttacggacagttctgagctaccacgtgggtgctgggaattgaacctagttctctggaaaagcagccggtgcggtgcggtgcggtgcggtgcggtgcggtgcggtgcggtgcagtgcggtgctcataaccgcaagccgtctctccagccttccttaacacagagctcaccctcagtccttgctttttctgctgtgcgctcaggctgtgctctccacatctccgtgcctcagtttccatctctgatatgagaaccattcccctttctgttggggatgctgtagtcagtccataaaggaggtcaaactgtcccttaggatgttcccagagcctgggcagtgcctgccttgctgaaggctgatggccccagggccttgatggtgaaaaggacaacccaggtgcactttaccagactctgtggtgtggcactctgggaaatcttcatcagcccaacagctgtactatagaacagccagtccccatggcaacgaaggctcagggaacacctagggccctcttgaattccctccaaagatggatgtgaagaggacagtcccttggccactgggctcccatcttagctgcttcacatcacaataaagactcagagttgccagaagctcacccttaacttacccttgtcctcctttccttaggctgatgtttattcaacacccgcaacgaaccacattccgttatggggagtggtgtctaagcagggaaattcaccttccacagtgaggagaacagatactggctggggggctggggagctggggcctggctcaacggtagagcacctacccacaattccccttg

SEQ ID NO: 32502 - DNA, 1110 bp, Mus musculus
gattcccctacacactggggcgtctatcgaacctttataggtccaaggacctcttcttccattgatgcatggcatggtcatcctctgctacatatgcagctagagccatgtgtactccttggttgatggctcagtccctaggagctctggggggtctggttggttgatgttgttcttcctatggggttgcaaaccctttcaactcctttgtagccgccagcagccacaggttcctgggttcctgcaaggaaagatgtggttggatgggaaaggcggtgagagaaataacaagccaagacaaagttctctgatcaaagcctaatgtttacttatgagtctgagcttatgggtgtgggggacccatcccccaccattccaggatctgctcaggaaaacaggttcagcctctcagcaggtagtgccatcttggaggaagaagcagatgtggtaggacaatagactttacctaggtcagaagactccaccctaagtaagctagctactgtggcaaactaggtttgccactgttgactgctcaaggctggggggagggcacactccttcagtcccattacagatagatggttgtgagccaccatcttgctgggaattgaactcaggacctctggaagaacagtcagtgtgcttaaccgctgagccacctctccagccctctaactctctttattatattttcatttatttaatatttgtttgtctctgtgtatctctttatgtagtttttttttttttttttttttttgggttttttgagacagggtttctctgtgtagccctggctgtcctggaactcactttgtagaccaggctggcctcgaactgcctgcctctgcctctgcctcctgagtgctgggattaaaggcatgcgccaccatgcccggcttctttatgtagttctgagaacagcttagtggcattagctttctccctccaccttgtggatcctggggattagactcaggctgtccgggttggcagcaggtgactttaatgctgagccatcttgccaggcccttctagagttcatttgagccagcatcttggcttagctaggttagcactgagttcatggcagtccacctatcttag

SEQ ID NO: 32503 - DNA, 1154 bp, Mus musculus
gggagggacatccttagaacttctgatttttctattttctgagtgctagagttacaggcatgtactaccaattctctctctctctctctctctgtgtgtgtgtgcatgtgcacacacttgagtgagtttgtctcactttctagcctaggctggctttgaactcagggcagagctctggcttatgtttcttgtttgctgagatgccaggtgtgaacccacatgcttacggatgggttgggggtggtggtggagggactgctcctaattctctcccttttttctttccccagcccctgggccgcatgggccagccagccgaggtggcggctgcagccgttttcctggcctctgaagccaccttctgtacagggcttgagcttctcgtgaccgggggtgcagaactggggtatggacgcaaggctagtaaaagcagcctcggggaagtccccactctcccacctaatgtacactaactatgtcttgcccatccatttctccctcccttcctttcttgtagtactggagattaaacctggatctcttgtgtgctaggcagaggctctatcactgagtcacactccagtgccccactggaggattctaggcaggggctctcccacttaactttcaggtcccaaagaaactcaggataagctagctgctggcagcgaggccctctcagtacctgctacttcccttgcccctgctcctaacctctctagcccagggactttgcgcccctccccgcagcttgattcctataaaaacctgccattttggatgaatgtgctgttcgcccttggctcctttcttggtccacttgccctctctcttctctctctctcctttcactttctctgcccctccctccctgatctcatggaccagtttagtctggactctacccgatgcctctggctatactctcccttatagctacaataaaagccatccccccagttataccttggagtggtcgtgtcctcttttcattcatgaagcacaacaccagcccctcaccaccacaccggggcattccaggcagtgctgctccactaagtcacacctccagtacttccctggggattctaagccagtgctccacttctgagtcaagccccacctcttactaggggctctaccatggagctaca

SEQ ID NO: 32504 - DNA, 1139 bp, Mus musculus
cctcacctccgacacacagcccaccgggtcctccgcgagccaccgagaagcggtcggcgtgcggccagagagtcaccacgcgactcgtccagcaagctccgatcatgtctctgattctccggtccctttacccctggagagtgttagagcagggacggggaaaggccagagaggctccgggtcccagccctttcctcaggctgacttctctttggttctggaagcctcggtttactcggtcctcccacataccatcgagaaacccaaattgtggtagagctccgcgtcgcgctcatgtgacgtcacccgtgcaccacagagacgccagttccggatagagtgtcccgcattgcgtcacgagtgcgtctcgcaggccgctctttccccgcccactccggcgcggttccgtctttccggacctggccgagcaggaggcgccatcatggtaagctcgctgagcggtctccccgagtggcccatccgctgccatcctcagcaagtcccgctcgtagcgcgacggaggggtgcaggcggtgccaaggggaactgcgggacaggctagggccttcgatcagaacttgccggagccggtggccggtcccgggagcctcccgaggctcgtcgtcttccttacaaagtttggctccatgagccaggctgattgcagctcccagtgagtccagtccggcctcgagcccacggccgctccctcgcaccaatctttcgagtgctgcgtttccaagcgggaccgctgctcccagtgtccctgtttcttaacttgccattgggaagttgagtgctacgatgagcggagccactacacgttgccgggtttggggacaagcgtacgtcagtccttcccggaacactgctcctagtgtgtttggtgtgtagtaatcctgtccctgccttgtatgttgggaagacgtttatgaagagccttgaaggtgcaatgaaaccgctgttagtatcagtaactacttcaggatgctaacagcttggaaaacgagtgggggataaaattaacccgagcacttggtctttctagggttgatttgaaggacgtagtgtaaggctttgtcacaaacacgtctccacgtctagaatgtactgttggcttctttttgactgtttttcag

SEQ ID NO: 32505 - DNA, 1208 bp, Mus musculus
gggagaggggggagcctggacacagtgccccaaccccccacatcaccaggagttgagcgggatgggagagctgtggaagggtcctggcttgggggtggcgcaggcagtcccatgctcaatcttttcctttcccttgcagctgtacaggtttctggccagacggaccaactccaccttcaatcaggttgtgctgaagaggttgttcatgagccgaaccaaccggccacctctgtccctgtcccgcatggttagtagtcagccagagggcgcttcacatgtttgggggcggtggggtaaggccagcagaggatgcgggcctctgtgctttggtctttttctacctggggatttctctgacctgggtcacttctggggttggaaagaaagatttcaacaatcagtcatagctggcaagctcttggggccctgtcactggggggaggtcggcctcagccagtggaggtcttggctgtttggtcttcccggtgacagcttggcacagaaagacttaacatgcttgcccccatcagatccgaaagatgaagcttcctggccgcgagaacaagactgccgtggttgtggggacggtcacagatgatgtgcggattctggaagttcccaagctgaaggtaagtgaccagcatgggccaaagggacatgtctccagtcaattagggggctttgctatgtgccagtggcaccctgccatgggagctgtaatcaaagctgctcttcgttgtgtcccctcaccactgcagaatgatgctttggagtctgtttgccctgaaagcattgaggatgcttgccatccactggggagactttagtggcagttgtttatcagggtctgctaccgggggtgggccgtgacagtccccacagcctctggtgtgtgccttctcaggtgtgtgcactgcgggtgagcagccgggcccggagtcgcatcctcaaggctgggggtaagatcctcacctttgaccagctggccctggagtctcccaagggccggggcactgtgctcctgtctggtcctcggaagggccgagaggtgtaccgacattttggcaaggccccaggaaccccacacagccataccaagtgagtatcagagctttggcttcaggtagttgttacccatagtggccactaggatgtcaagttcacttgggtggggggtggtcacaaatctgggctagccagggcctctg

SEQ ID NO: 32506 - DNA, 1095 bp, Mus musculus
tgaggtgcaaagctcactggagctcataaggtagcctcaaagaaattgttcattttgtttggcctttgtccctcatttctctttctctgttggatagaacccttgttacttgtatgagtcatggctttttgtagttctggctgacctcaaattctccatgcttctatacacctcatgagttctgcaccacacaccagggcctgtggatacagttatgtgcaccacataccagggcctgggtgttttttccttctggttcttggtattggtagttacctacaaggattcaggagctaaactgctagcattcaaaccctagcttgagtagctgtggtcttaagcagtttatatcgtaagattatattgtctatctcaaaactgttctttttttaagatttatttattattatatgtaagtacactgtagctgatttcagacacaccagatctcattacaggtggttgttgtgagccaccatgtggttgctgggatttgaactcgggaccttcggaagagcagtcagtgctcttacctgctgagccagccctcaaaactgttctttgtgctagaggcaggcatggttcagtggtagagcactgcctgacattcaggagtccctttgtgttccacaccggtatcatctcaaaagcaaacaccccccccctccccgacacacacacacacatacacacacacaccacgaatgtgtaaatccacaaacagtttgcagcagtgtcagccaccaatttggcatatgtcataaaaacattaacttgagccgggcagtggtggtgcacacctttaaatcccagcacttaggaggcagaggcaggcggatttctgagtttgaggccaacctggtctacagagtgagttccaggacagccagagctacacagagaaaccctgtcaacaattacttggacttcaaaccctctgatacagttgtacctataccaagtttcctatggcaggcaggatattcttaaatgttgccctatcctttttgttagctgaggatgcagaagacagtgttgtggccggtgggtcctccaattcctggtacccctgacattcctgcccattttttgttg

SEQ ID NO: 32507 - DNA, 1341 bp, Mus musculus
tcctgtcaccttgttaggaggctgatttgtatgaaagcttccagcagcccaaggataagtcatcttacctctgtcctttccccgtgtttctttcctgggccctggctttgtatgggtatgggaggggcttctgagacagagtctggtactcacactgaggtctgactcctacactctcttgtagtctggctcccctgtggccaccttcaagcaacatatggcccccgtgacctctgttgaatggcaccctcaggacagtggggtcttcgcagcctcaggtgctgacaaccagatcacacaatgggacctggcagttgaacgggacccagagtcgggggagacagagacagaccctgggctggcggcactcccccagcagttgctgttcgtgcaccaaggtgagactgacctgaaggagctacactggcacccacagtgcccgggggtcctgatcagcaccgccctgtcaggcttcaccgtcttccgcaccatcagtgtttgaggtggccaacacttggcctcaagacttggctccacatgggaactggatcggttaacttggcaaggatcattaggcctgtagactgcacctcaggaaggaagacttgttcaactggcctacgtggaacagaaggaacggactctactgacctggtatctctaaggatttggattgacccttggccctgccttacaccaaagactaggtgcaggcaaagatccttgcctgtcccagatacggcctcaggatgagatttttgtcagtgttgactcctggcttgaccccaaggacctctgaccagggacctaattctggctgttgatcaacttcaggaactttaagggttttgccatagctgggccaagtctgggtctgtgtcactccagtggaatttaattctctctctgccttctggccagttagatttggttgagatccaagtagggagccatctggggtgccctcctgtgctgaccactactgtactggaggagggtctggggcttctgctgtaataaaggaccacaataaggccccagacaccaagctacaagtcctctgagcttctttgctgtgagaaacctaatggtggtagggaggggtttggtatagagctgtcccctgcagcccttcacccatgcgactctcaccctctgggctttcccatgttgtctggctccgaatgagtaactctgtttctttctggacccctggctcagtaaggcatcatcctaggggagctgagaacccacacttcctcccctttatcacttactcagtatttcctgctgagttccctaagccatccgtgcccttcagatgcctctatttcccatgtt

SEQ ID NO: 32508 - DNA, 1217 bp, Mus musculus
tctacctgcccggcagagggccgccactgagcgagggagaggagctggtaatggatgaagaggcctacgtgctgtaccatcgtgcgcaaactggtaggcagagggacctgactctcgggtccagggaaatgaaaggcctgtcttggggtctgggggacgaagggtctggagtctgaggattgtgaccctgcagactgccggcctttggaggaggtggaggccgagttcccagtctctcgttcctactcagcaactctaatctccccgcccatccctaggcgccccttgtctcagctttgacatagttcgagatcacttgggcgacaaccggacagagctccctctcagtctttacctgtgtgcgggaacccaggcggagagcgcccagagcaataggtgagacccaggacctttgcaagacatccacaaggccccacgcattagggctctctgctaatgccagacctaaaagtctgggaccccagcctccctcctccttcaacatcccggcactcagtttctaacccgtatttgcttccccagactgatgatgcttcggatgcacaatctccatggcaccaggccgtcaccctcagagggcagtgatgacgatgaggaagatgaagatgaagaggatgaggaggagcagaaacctcagctggaactggccatggttcctcactacggtggcatcaaccgagttcgggtacagtctttccaggggcttgttaaggattctctgcagcacacccctccccctagatccaaatgtctctcagtacctcctccagcccctcagcttctctccctcccccctcattttcagacattttcactctatgagctgataaacagataataaaggctgaaacagctcctgattgtggtgaaacgcaagggtgttactgagctgttgcttaggaactgaggcaggatagaatgagttcaaaggcagcttagtggtagagcgctcacctcaagttcaataaatagagcactttatgatcaggtagatgagcaaaaaagggagacggtatacaaggagcatgtagagcaaaagccaacccgtagctggacctgtctctgttggacctgtatctgttacattattcccagaaggtttagcctgtagacagaaagctctgggcccatgaacataacatactagtgggaaagggaacaagagaaagcttgtagtttgttacaagatgctgagt

SEQ ID NO: 32509 - DNA, 1567 bp, Mus musculus
tgtctagtcaaccctgctagtctgtctgcccctttctgtagtgattcaggtttctagtcagcactactgaaaacaaagcatgcttgtggccgcctctgctcaggccttgtgtcatgattcttgttccacccctggttgatgtagacccaacctagtagttcaggatgcagagttctggggcttccctctcctcgtacagctcccagcggcccttgctcggggtgggaggtgctcctctgtagagtggtaggtaaggcctaccttgtctctctctccacagtcctgaaggggaagaagctgagcttgccggcataaccctggcctcaccagccttctctgaggcagggcaggaggcagaggaaggctgctggagcccgagagccttccatccagagctgactttgtaaagagctcgcctctcctggctccccacccctccagctgggttttggggtctatggacgaccctgctcctggggagctcaggacctgagctgtttgtagccttttgccttttagagaagaaaaacaaaaaacaaatctttccactatttagtttttgattctgatgacttttttctcttctacctggccctgattttttataaactgtgttttgagtgttctctggatcagggccaggggaggtcgacccccttctccaaaatcccaccccagccccatggttgccaaacactacgtctgccaatatctgcctgcccaccttggctgtgacaacgatgctccttacatgttcctggattggtggtaagaaggaggaaagttaaggagggtctcctaatttttcatgattttttttcttccccagaatttgttagctttttgtgtgtggggtgggggaggggagggttgtcctgtttttgataaattaggggaagctatgggcttaggcaagggaaagaggctggctgacccaggtggtgacccagactacactctaacaccatgtttttgtacagaatttgatggctgattctttgttctcttgaaataaaccaagaaacctgtccttctctttgctgttccctgcccgctttggttagtaccgagccagttctacttttgcatcatggaccttctggggataatcagcaatctgaaaggagcaggaagatgagaaatggggctcccaggactctccagggatccctgaggccttgaggttctgcagggacgaggttgggagaatcagattcattgtttggtatagaaacttacctgatggctatccagacctaaccagctcagaggaccttgaagaccaatgcatatcctagcccgtggatgggacagcccccatccttcccgcaactgtcattcacaaaaaattgttttatgtgtatgagtattttgcctgcaagcatgtatgtgtactatttgtgtgcctggtgcccacagaggccaggagtggctgtctgatcccctggaactcaaattaagacagttgtgagctgttatataggtgctgggaattgaactcaggtccgctgcaagagcagtcaatgagtgcatgcactcaatggctgggctaccaatccagacatac

SEQ ID NO: 32510 - DNA, 1224 bp, Mus musculus
ttggactgttcccaccacctgaattgccacaactggacccaatggtcctaggcactccagaggccacgcaggctgcgctgggtagcagctacccctcaccctgaccacttactaccaggccctgcgctgacagggtcccaagctccgcctcctccgtggcaaactgtcagttgtggcaactgcatctccttcctggactttcagttgttgacaggctattatttctgctaggccattaattttgctatgctatagacgtaagagtagccaatcggggctgctggcagttgctaggcagcctcctgaggccaaccaatcaaagccgtttatttcaacttgttattttatttcttagacccgcctctggcgggaacctcaccaaggtcgctggaggaggcgggacttggggaggctcacacagctgctggattgcagctgccagccttggccacattgagatgggccaggctgtgaaagctgcatgggggcggggaggagggacgggggtgggagtgggggaagctgctttattttctatttaacctgcgcagaactgctcgccacaggcacctgagccatttgcccctggcacacagtgggtgacagacactgggcacctcagccacaggcagccggtcagaatgtctggaggaacctcttcagaccccacgtaagatgagccatctgttctgcagctcatctgctctggttggaggcactggaaacttcatgccccaaagaagaattgcaggattccaccccaagatcactccagcccaggccccagcaggctccgtggcccgctctgcctcgctgcagcaatccccttagtctgggtctccctgtctgtgcaccctcttccaaaggaataaatcatgcttaataactctggagtagtgtggctgcaggtcaaggggggttgggaatcacagtcctggaaagagggtgtggctgggtctgagactcgacccttagaagcaagcactcatgcctgagcagagttttgcctgcgagagtctggatcccaaacaggaagggcaggagggcagattgatcaccacgcaatggcgggcagccagaaagtaggtgcctgggaaatctagctggtaccccttgcctgagagtagaggaaggtgtcatattggctgtagaggtggcctttgttggtgagggaagggttaggttctacaatggaggggagaaccttttgcaataggaaacagc

SEQ ID NO: 32511 - DNA, 1139 bp, Mus musculus
ggaggagctttagtagcccagtaattcttgccactgtactcttactaccattttctctacctaattcttcatcccaatgcactgctctgttcctaaaagtatgggctcagctattctagcttaagcacgtgtgaggctgtacgagaattccacctgctctattgtaaatgcacagcactttacacgatggcagcagcacatcggcttttgaaggattccctatgtcgttttcatgatagatgcatgagcactgctctaacagtccatccacattcatccacccacagtctatccttctgtgctcctgtctagaacgtcagtgagcaccaagagtctacatcctcgagtcctgcagtagtattacactggagtccatttctgtaatacaagttgcacttggaaatccatgactgtggctacagaggaacatgcaagaatactcctgttttactgagtccatgtgtgctcagttggatttccacatgtgctgcactagtatctgttgtagcctgtgctccatatcagggacatccatgtgttctgataggctgttaggacgtgtacatatgactccttgagtgcacccctctgctcctgaacaagagccttggtgtccaggtgcagtgctgcattctgataaatctatgatcacttctgctgcaggcatttgtggtgcattagtggcataactgtgcttgcagttgtatggtaaatcccatttgcacggtgtgctgcacagtgtgctgctccatctcccttcagccctgtaatactatacaatgtgtgctgctgtcctcgttcaggcttgcgtggagttgtgcctgtccagccatctgctgtgttgtaagtgcacatcatcttacattgcagtgtgagtccgttggctttggccaagacaccattgtgtagagatttagtgctagatgcctgtgtgctgctccactagtacattcatgtgcagaggggtactaatatgtcctcatgcctgtctaataatcccacgagtgtggatgtctaagacccataggttctgctgtagtatcatatctgtgtgcttttcaggtgtagtactgtgtgccactgaattcatttatccacgagtacaaccttacaagaacatgtgtaagcacttctctaat

SEQ ID NO: 32512 - DNA, 1201 bp, Mus musculus
tgaaatttgccaaaacaacaacaaaagtcagacaatttacaaaaagtgtagcggcccatgaatatcttgtaacctggcatcttctgcctagatggatttccttatttgtggtgacagtggccactgatgtcagtttttctttggcagcgacctgccctgaacattgcttcctgcttaggtatttttatgtaaagtgtattttctttttagacagggtactgagctgaggaagcggggcctccagggcttgacgctcgggctaagcactcagaaacttgtagggtttgcgatggcggtcaagtgaggtcctccggtctctctacagatacctgcggtgacaggctggctttgaactcttaatccttgtacttcagccttcagagtactaggattaaagtgcacaattctgtgtttagtacatgtgtactcctctgcagctagctagcaggtccccagttgctcagtgctgcaggcccctagttgcccggcaccgtgaggccccagccccatgtgttggctttgcagtaagcatcatgcatgaggactggtgctggaggaacaagagtctggaagtggaagtgctggaggacgacgtgtctgcggtggagttcaggcagaccggttacatgctgcgctgcgcactctcacacgccatcactctggtatgtgctgcttctgagggacctcagagagagtgcccagcggggcgggcaagacagctcagcctcagagagagggcccagcggggcaggcaagacggctcagcctcagagagagtgcccagcggggcgggcaagacggctcagcctcagagagagtgcccagcggggcgggcaagacggctcagcctcaaatcctgcaagttaccctctggtctacacacacacacacacacacacacacacacacacacacagagagagagagagagaatgagagagagagagagagagagagggagagagagagagagagagagaagtaaatggcttatagcaattgctggagcctggcacagcaagagtgtaatgacagttaagccaagttcccttttctaccctgggttcccacctgccagggaaggcatcctcagcctgcagtgttacaggtcctcctcagcccgtgggcagctgggcagctcggtgtggtgcggtgcggctgcgtggtcttgtctcttcctgccgcgttgggatcacagtgc

SEQ ID NO: 32513 - DNA, 1212 bp, Mus musculus
atggctttagcttggggctgttccctgtgaatctagggtataacgccctctcctggagctccctactaccctggagggctgctgcatggcgcctctttgtgtaaactgtgggggctgtcatggagcttgaggctgctgtccactgtgtccatccacatgctatttataatgcttactcctgatctgtgagataaagtgagcaccgcaggcctcccacggtcacggccagaggccagagttagatgcagacctctgtcttctccacgaccactgtagaggcactacttttctagaacttgccagcttaggagccagttaagtcagctttgtttcctgtcagcggcagctcccacggctcatcacaccgtctttcgtcagaaccgccttgtaggaacttgtgtgtttcctgaagctggtcctcaaggactgtagtcacccaggcccactatgctcataaagaagtcccgtggccctgacagaacccagaagatgcaggcccagagccaccagagacctgtggctcttacagcctgagagttggtgatcaggggtggatgcacagactcaggggaaaatgtgaagtgccgtgcatggctgccacgtgtcccctgctttgcctgaactgtctgtcctcctccacccacagaactatgtggtgctgctggacaccacgctccccagatcccagtacgactacgtcctgccgcaagtctctttcactgcagtgggctaccacaagcacatcactctggttttcagtcccacggtaagtacgagtgggaagttaaaaaaaatccttagatggaggccgtgatcacagcatctcctcctgccacatcactttcccatgttggagctccgtggacacctttcttcctctgtgcactgacgcctgctgttgggcaactagttgtgagcaagcagaatggtttaggtcactggcttggtgtttgaggaggagggacaccgtttccctttaacctgtggcattacattccttcatgaggaggaacatttagcaatgcagaggacacgggagtgtggaagtgtcagcaggcatgaataaacaggaagcaggtgacaagatggccgtggggaaagaccctggtcagtttatcagcccctgtagtaggccccttcactgctgccatcaaaaaccagtgcgttccacattcaggagatcatttcagttgcctctggaagcttgtgtgt

SEQ ID NO: 32514 - DNA, 1389 bp, Mus musculus
tcatgggaagtcggggggcaggagataggctatgggagggtgcccggtgtcatggaagttgtagaaggttaaggttggaggagacgaggcaaattcctacatcttcttccagtgatgtcatttccaatcctcagggaggtgttgcctgtagagagtcacagcctctgtaaaacctctctgccagccttctgcaggcccggggctcccataaggggatgcacggcgccttccaggtgttcatggtctctctcattccagctcattcctttgctgctgcagctgacgagtcgtcttcagggagtcagagcccttggccaggcggcctctgacagcagcggcccagaagacatgaagagacaaaccaagaaacagaagaccagacgcacgtgaggaagaaggaggccccgtctcctgcagatgacacagccagggctgccgcctgcctggggacaaaggcacatgctcactcacttcaggcaggccctgggccctgtcacccttgtgttggtgtcctgcctgtctgtcctctcctgtgtagccctgtggtgcaatgcgacgaatggaccctcctgtcaccctgctgaacacaatttattttctgagttgaagataatttattattattatttttgtcagagaagtatttaagctgagctggtggcgtgagaacataatctaatcttccacattcgtttgcaagaagagtccaggaaacatggcgttggtctgctgtgccttctggactttccccaaaccgccccctgcactcgaggcccgtgccagaagctgcagcaacatctgtccctcccagaagggtctgtcaacagctggatgaataaagtcagccactcgtttgtgttgtaacttggcatagtgtggggtgcatacagagcgggtgggcattcagccccagcgacagaggctgtggggactgccctgtgtggcacagccaacctgtggctgagctcagctcactgtggtccctggatgtacgtcctgtatcttagagaagccagaagaactctgttgtgctgggctttaaaagtatttcacttcttggggaggggtgtctgtccgtctgtgtatatctgtgtcaactggccacttgacacgcatgtgggtttgcttgctgcacaggggaggtgagcctcatgagcctctggaacagatgagacataatctatacggtgtgtggatatgggtatccattctaactctccaagtgacagcacagtgaacaccccccttaagtactaatggggcgtttaattgacactctataaaggctgaaagcctgtgggagacaactagatgtcagtgggctctgtccctctgcaaaggtagccataggactttgtgtattccaggtggccgccaggtgggcgtcgg

SEQ ID NO: 32515 - DNA, 1132 bp, Mus musculus
caggggaactgacatcctcttctggcctctgtaggcaccagacacacatatggtgaaacacttgcacacataaagtaaaaataaatgtctgggaaggttttcgaagggaacactccatcatttgagacgtttgcagacatagcaaccaatgtctgtatgcagacctgattcagatcctgatgtacaatcctcacacagccgccattttgagatggtcagggaagccttttccctcgcagcttatcaccaaggaggatgtcgtcttggttgactgcagctttctgctgggctgcattggtctcagtggtcacagctgctgctttataaagccagctgtctctttacattaggaatgctggctatggagtggtccaaaggatcaggccttgatgttggtgttagctggtggcgccatggtgtgcacatctgcataggattttgtctgtgcacttccagtggggtttaggatgtggatttgtagacccacgaggccattttactgaaataaggcgctgtactgtcttgtagtcacaaatagccatgtatttgaccatggagaatctggatttgccttggtggggtagaaagacactaccctgagtgtggactgaacaccagtgttttctctactacttattccccatgtgactttggctggatcccagcctcttttctgagcctcggtttccccatctagtgaataggtgtggattcatggtcttcaaggttcctttcaggttagctgagagcttggcagcactccagaggtgtggctgtgggctagtgcctgggacctttaaaggaagttttcctactacattggaattttctctcgtggtcttagatagtctcaaagactggatttgtgattgttcgatggtaatctctgtggctggtcatgggcctcctgaggcagccaagctcccgggtgggactcacattggctgagatggttgggaatttcccacagcacgagtgtcaagtggcagtctggtctaacgctgacatacattttctctgttcccttctgctctgctgggaagcgactggcagtgtgttccagtgggggactggcttggcatcttctggtcgacgcctgtgccctgggcagaatctcccactgtttttgaca

SEQ ID NO: 32516 - DNA, 1180 bp, Mus musculus
cttatatcttgggtatcctaggtttggggctaatatccacttatcagtgaatacatattgcacacacacacttatacacacacactcatgcatgcacacatacacacacaagacatatatacacacatacacacacatgcccacatgtccctgtgcacacacatgcacaacacatataaatatacacacagatacacaacacatatctacacacacacttatacacacacactcatgcatgcacacatatacacacaagacatatatatacacatatatacacacatgcccacatgtccctgtgcacacacacatacacataagcacatacatacacaccacatatagacacacatatacaacatacatacatatacacatacatgcatacatatccctgtgtgtgcaaatacacaaacatacacagaagcacacacacatctctcacctagcaataaatataaaagcattatgtgtgagtatgttgggtgtgggggggtgtcaagctgcactgagttcatccaggagtcacagaatagtttgtagacgaatgattctgagactaagtttgctcttttctttggacagtgcctgagagagaaggttgtttgtgtcgctgctggactgaggcatgccttagccactacaggtaatcactcagcctttattctcaagtgagcccatctgagcaatggagcgtcaggaggagactttgtagggagcactgggaagggtcctgccctgctgtagctccaactgaaagcagagagcatgaagtacaagtctctggggggcttttagccagtgggaggaagggagcgagctgcctggttcttcttgttgtagacgtggaattgtcataatttcatcctcccatttactcctcacagccaaggagcaaaagtgtgagctaaagtctttttgaactccatgcagagtttgtggaagcacttgtgagtgaggcagggagagctagagacagaccatcagtgtagatgtcgcagtgagctgtgccgtcttcccgctggattccaacgtttgttgattaaaaagcttcaagtgagctgacttctgtacgtgagtgggcagagggaccagcagcgtgtatgggggtgtggggcaggtggcactgagtaagtagggctctggcctggcttgaagggtcctagggtctaggaaa

SEQ ID NO: 32517 - DNA, 1222 bp, Mus musculus
atattttcttccattccaggttgctggttcattctgttgatcccttcctccctcccctcccctcccccctccccccaacactgggcattgaacccgaggcctcatctgtgcatggccaacattctaattccctgagtcatgatgccccacccactctgctggcttcagcctgcgtcgtttgatcactgcatcagtgttgtgaatcctcttaagtgtacagagtttttaatttgctattaagaacgcatgaggacaactgaatttgtatgtttctttcttgggatttcagagcgctgatacaaggcatgcttgagaagtgtgaccgcttcctctggtcgcagcaggcctagttggggatctactttgaccaagtggaatcctgctctcgaccctgcagaggtctttggcacagaagggaagaggacaccccaaaacatgctgctgcagctgctgatgtctcatcaccgcctggccagcccttggcttttgtggctctgtgacctcagagtttctcaaggaagcagtgggctgaccttcactggaagcagcctggaggtgctccctgctgggtcggattctttgtgtacaccatgaatcagggaattggtttctactgatgcagatctgtagggagcagaagctttggtacaggaagacataactaatattgtaaactggagttcaatactttttcttactgagttaggacctggaacaatgacatcattcctgttggcttatgtaataaatactgaagatccaaactagagttttaaataagactgcccatatctgagttgagctcagtttcaagtatttttccagtatgtatttgatattctctaatctaagcctatacgtactgactaatcctggaaatatattatctgtaagttttggagagtgggtgacccaaacgctcacgccctctcttttattttttttatcgggttatgcactttttccttcattcctttctctttttttgtcttaatttataaccctcgctagcctggaacatgtaggtataccaggctgtctcgactttaaatatctactgcctctgcctcctgaatgttagaattaagggtttgtgccatcacatatactttaaaattttattttaaaaagccatagcaagagaaagccacgcactaacataaatgataacaaatgattatattagccaagccatgtaactggattgtcatttatgaagctt

SEQ ID NO: 32518 - DNA, 1144 bp, Mus musculus
atgtctttgggctgagagggaggcagggtgcagcacactgttagtctcagcattctggagggagaggcaggcagatctcttgagagttcaaggccagcctggtctacattgtgatttcaagacagccaggaccacacagagaagccctgtaacctagtctcatggggccaggggagtatttaacagttctgtaagtattataaagctaatatttataaattaaaatttaaattttactcttgcagaattacaagtaactaatgctgtttcgttcttctttttttttaagatttatttatgtaatgtatgtaaaggagagggcatcggatcccattacagatggtttcgagccaccatgtggttgctgggaattgaactcaggatctctggaagagcagtcggtgctcttaactgctgagccatctctccagcccctttagttcttacccaaatgttattccacatttgattttatagagaatcagctgttgggaaggaatttttctttttctttttctttttttttaaatccctttgagccaatgtttcactatatgtaaccctggctgtcatgaaactcactaaatagaacagactgactaggaacttgcagccatagttttgcctccacctcttatatgctgaccattttattcagtctgcagatgcacacaaaacagcagcttacctgggaagtcataggacgtgtcagaaacagttctctgttgtcatcttatgggacccagggattaaattgaggtcgtcaagtcactcaatgcaaaaatacatatttattgtaggtaatcagggaagaaaacaatcaacttgttgtctgtccttctagtcatacatacatgcagaacatacatgtcataggtagttagctctgatgtcaacccggacagaaacctggttctatttattggatgctttataaaaacctgtaatgtcctcctgtattatctgccattgcttcctcctcaagatagcttccccctctttctctttctctctttctttctctgaaacagcgtcttacagtgtcacacactggctttgaactctgatcctcctgccttacactcctaagttctatgattacagacattagatagcacaccatttggattcctttactaaaagt

SEQ ID NO: 32519 - DNA, 1205 bp, Mus musculus
ttagctacactgtgcgtatacagactcagttttgtatggactgtgtttctaaaacagctcattttaaagcgtaaatgcctctgaatgtagttgcaaagtttaggaattttactcatgatcttgaagtgagtaactatgagtaattttattggtataatatatttaaaaaataatactttggccaggtggtgggggtgcacgcctttgatcccagcactcaggaggcagaggcaggtgaatttctgagttcgaggccagcctggtctacagagtgagttccaggacagccagggctacacagagaaaccctgtctcaaaaaaaaaaaattaaaaagtaaaaaataaataaataaaataataataatgctttgactaattggacatgaattatgtagtaaagatgttaatagactcctgatccatggtcaacagggacaaaatcatgtgttttgagtttcccatcatgcaaatgtcttgtctgtgttttgtagtggatatcttgacctacgtggcttggaaaatcagtggctttcccaaaaaccgagtaattggaagtggttgcaatctggattcagcgcggttccgttacctgatgggagagaggctgggggttcacgcgctgagctgtcacggctgggtcctgggagaacatggcgactccagtggtaagtctttaataccagtttcttcgctctttgaaaacaaaaacctagcataaaaatggctctaggcatttttctttcttcttttttttaaaaaaagatttattttatgtatgtgagtacattgttgctatcttcagacacaccagaagagggcaccagatcccccttaaagatggttgtgagccaccatgtggctgcagtccgtgctcctggccactgagccacttctccaggctccaggcatttcttttctaccagcccagcctttgtcttccgaggatggggatttcaggcgtgagtgagccaccatcacgcctattgactcgttcattcatcttcatgccaaggacttgggaacctcatgtgtgctagcacacagtccaccgagccttgccttcagcccctggacatgttgagcactttgagcatgttgtcttaggacaactttagtcacttgtttcgttcagcagtttactcttgacttgaaatgcctgcccctgctgggattagggagatcgggggtgggggaaaccctgttag

SEQ ID NO: 32520 - DNA, 1421 bp, Mus musculus
tggacaactctgcaatagaatagcattgacactcaacttgttttataagccaagccgtggtaaaactttgaatcccagacctcgggtgatagaggcaggtagatctatctaaaagaagaagtctttatacttgtaaaggtctaaatcccaaggaatattaggaggtatggacaaaatagatgtaatctctgtcattctgtgtccagggtctctatggaatcaatgaggatgtcttcctcagtgtcccatgtatcctgggacaaaatggaatctcggatgttgtgaaggtgacactgactcctgaggaagaggcccgcctgaagaagagcgcagacaccctctggggaatccagaaggagctgcagttctaaagtcttccccgtgtcctagcacttcactgtccaggctgcagcagggcttctaggcagaccacacccttctcgtctgagctgtggttagtacagtggtgttgagatggtgtggggaaacatctcactccccacagctctgccctgctgccaagtggtacttgtgtagtggtgacctggttagtgtgacagtcccactgtctctgagacacactgccaactgcaggcttcgattacccctgtgagcctgctgcattgctgccctgcaccaaacatgcctaggccgacgagttcccagttaagtcgtataacctggctccagtgtgtacgtccatgatgcatatcttgtgcataaatgttgtacaggatattttatatattatatgtgtctgtagtgtgcattgcaatattatgtgagatgtaagatctgcatatggatgatggaaccaaccacccaagtgtcatgccaaataaaaccttgaacagtgatggctctgctcttttattaagatgaagttgggtagctggtcagtttgatttcagggtcagaggcatgtggatggatctcctgcctttcagcgagcctggttacctagttccaggacagctggagctatgtagtgacacctgtatcaagattaaaaaagaaagttaagttggtggcgtggggactggagagatttagagcactgactcctctcccagaggtccaattcctagcaatcatctggtggctgacctatgccgtccgatgccctcttctggctgaagacaactacagtgtactcaagaagctgattgagctgaaagactgagttgctaagacacagggtccccaggacactcctctcagcactggggaggtagagacctagatagagcttgttggctccttagaattggtactcaggaaatccagatctgacaagggcacactatgaccacatgcagttcttggaattgcagctcaggttttgtccattatggtgggaagcatgcaggttctgaaggcagctggaagaactaacggggccttgggtattgaaaccccgc

SEQ ID NO: 32521 - DNA, 1185 bp, Mus musculus
cagagaaaccctgtctcgaaaaaccaaaaaaaaaaaaaaaaaaaaaagtaggcttgggctggggctacacctccgggaatggctcatccctaatgtgtgcaaagccctggattccatcctcagcactgcaaaggtaaagccaggccctgcaatatagtagagtttttaaaagttataatgtgcaattggtttcaaaggttgctgtatatatttaggattgctagatgctgtctggcatcatgactggatcaacgcgtttctgaaatgttaacattttcctccttcctagcacgtccgcctcctgtcccgtaaacagttccagctaagggcactaatgcaaaaggcaaggaagactgcgggccttagtgacctctactgacatgtgctgtcagctggagaccgacctctccgtaaagcattcttttcttcttctttttctcatcagtagaacccacaataagttattgcagtttatcattcaagtgttaaatattttgaatcaataatatattttctgtttcctttgggtaaaaactggcttttattaatgcactttctaccctctgtaagcgtctgtgctgtgctgggactgactgggctaaataaaatttgttgcataatttttctctttcttggacttgagataagatgcacaaaagaagcctggcttctcattaataaacaaggcacagtgttcatcttaagttgcagttcagtattctgtaggttaaagataagttccctttagtgtagaatgtcatgcagagaaatgtatatattggaggatatgtttatttcattctagaaccaactgaaccatggttcaaaacttttttaatcaagaattcaattcccgccatttgcattaggcagctcacaactgtattctagctttggggatccaatattgtcttctggtctctgtggccactacactcatatgtacatagacatagatacatactttaaaaaaaaaaaaaaacttgggaaaatgtagtaagactgtttcaaataaacaaacactgagcatgctgggtgatttaaaggaagtactctttgcaaacgtattttaattgttgaggaaaaaatgtgttaaaatgtcaggtgatctctaattgatttcttcaaagctttcctcagattccaccgtcactgccaactctgaccttgtgacagccacactag

SEQ ID NO: 32522 - DNA, 1231 bp, Mus musculus
taaaatgagcatcataatagccaaccatttcagtttaagaatgtagtgccgatgtaatgcagagcctgcagccaccacctgcaatgcgttgtagctctgaaaatcaaatccttcccatagatgggaggaatttctcctatgggaatttcttgtttcatgattgtccatggggagagactttattttggactgtgtctggcagtccagttggcagtaccatgtatctctttcacaattactttcattttggggaattttcgtcattccttcccacattccaccaatatattattggaagtattagtccgatgctccaaataccgtctgaggttgagttgtagatgtgtcatagcaaataatcgtgtacaaatcagtataaagttatgcatggactgttctgttttcaggctgaagttgataaaaacatagaacttttgaaaaagaaggatgaagaactaagttctgctctggagaaaatggaaaatcaatctgaaaataatgatattgatgaagttatcattcccacagccccactgtataaacagattctaaatctgtatgcagaggaaaatgctattgaagacactatcttttaccttggagaagctttgcggcggggagtcatagacctggatgtgttcctgaaagtaagtacccttccttcagctgccagggctttgggatctgctgcagattcagtcacaccacctacatttgagcttattgcccacccccattttgttttgtttttagtcccataatggtcttagagttggataattttagattagttttcccagatcagatagttctagaaagaagtgggtaccctttttaatgcaggttatctctggcttgctaatagtgtacagcccgaagtcttagtaagctttgcttattgcccaaggagaatatggttttaggaataataaccagatactcagtatatttgacctcattcctggtgagaacactcaggtgagtggctaaaccttgtgccttggatctaatgtaagcagtgtgagtggccgagcgtacactagtgatcacaaagaaggttctaccactgccttctggctgggtggcaaggcatatgaaaagatgaatacggagacaggaaaagtaaactgttctgagacgctgagtagggttaacgttagtaccgtttctcctcagcccttctcttgttgttctcttagtaaagggacagtttgaaaacttgtaccaagca

SEQ ID NO: 32523 - DNA, 1196 bp, Mus musculus
ttacaagacggtgataaatatgaattagtaaaagggaacatgaaacagtttgaagtaaagtgacgttaggtcttgaaaacagttgtaagagtagaagtgtctcggtaaaatcctcctcttcaagttctacagagacaaatggtagtcacagcctagggaggagtcccagggccaataagacctttaggctctatttcctgcttccttcctcagcttcagctgcctggtgctgtgccaggcgtccgtcccccactggccagatggtcgcttgcagtggttcatgagctctcattgcatctgctgcttccttttcacgaccatgcattcacttagctagttcctgcttacctccagcaagcactcagcactaggtaagttcatgcatgtgttgtaagcattagcacacggtcgtacccccatgtctgtgctatcatcatcgccatgctagttacattacatgcctgtgtttcacaacacaatcatctcctgcagcccggaatgctttgtccatcttggattgaacaaatgatcctcacaccaccttggtgtaaccaaaaaatcaatcacttattctctatcaagttggattattggcaggacatttgcttaagagctactctttttttattattattatatattttctttatttacatttcaaatgttatcccctttcctagtttcccctcagaaaatccccatccctttccccctccccctgctccccaacccacctggcattcccctatactggggcatagagccttcacaggaccaagggcctctcctcccattgatgactgactaggccatcctctgctctctatatagctagagccacaagttccaccatgtgttttctttgattggtggtatagttccaaggagctctgggggtactagttagttcatattgatgttccttctatggggcttcagtccccttcagaagagctacaattttttaagtgtgctattaaaatcatatataaagcaaagattactgcagtagtatttcagcagtctgagggttggatctcagagtgtgttatctcttttggcacagatttgttttatataatagcaaaaatcaattctaaaagcagtatttttattttattaattttttatcagacaggatctcatatacccaggatatcattaaacttgctatatggatgaaaatgacctttgaa

SEQ ID NO: 32524 - DNA, 1152 bp, Mus musculus
tcagtgggaatttgggtccacagatggagctaggtttcagctttaaggttctggccactcacctcttaccttcgcagaggtcctctgagagtgtgggtttgcagatactcagtgaatgcttgtggtttgggtggacacttgtcaggatcagcgcaagagatgctgagctgtcctttcttcttttcttcacagcctcggattcacacagaacctggcagatttctttcagtgtggctgctttggcttagtgaagccctgcatcatagattggacatcccagtacaccatggttttccacccagccaaagagaaagtccttcgctctgtatgaaaaaaaaagcacctcaaaatgcactctgacttgtttttgtttatgctggtgctcttattgctgaaagtgaagtgagatattcagctaccacggtcaaaggataagggatacagtcttcagcaagagtggaccttccgtcagacccagaaagatggcctgttactgagcaatttggcaagcagcttttaaaaacatatgaaaatattttccccaagaacatgagttacttttgaaaaaaacctaatagtcactgattatggataaaataaagtattttcaaatactatattggctttttaaaaatagtactctttaaacttgtaatttttgataagttatttgtctttgttgtatctataaatatgtaaagaatatttaaatagatgtatctgttttgctttcacacttaataaaaacatttttttatacttgagacttagtttctaatgcttcacatctttagagtcttggaaagatgggagagagacatagtgaagttaattatcagtcggtcagtgattgtatctactgatttcctgttccagagagaatgctgcatccacctaactcttgctgtagattgcacggctctcccagttacttttctcactgattcctccctgttcttgtcacaggggaaagctaagcttctcctcatggcctgtccaccccagaatgatgctgttctgtgtaccagtgtcactctgggccactggtcagttcttcaagggtctctccttcctccatattctaggtcttcacagatggaaagtgcatttcatgtatctgtgagttattccacagtgacttgttgagctatt

SEQ ID NO: 32525 - DNA, 1198 bp, Mus musculus
ccaggctccctgaaaagatgaaaatcactaaggaagacgcctcatgtcaacctctggcctccagtgcctggatgtgtcacacgcatccacacaagaatacttaggagcaatgtggttccatgatgttccataaatcttctctttcagtgaacccaggaagaaagtgaaagtaaacctagcaagatctgggcactacaaaccactggctcccctggaccctacagtgaacactgagctagaactgcttacaccgtcccttatccagcccctgggcgtggtccccctgatccctagcccattgtcatctgcagtgcctgtgatcctacctcaggccccttcgggcccatcctatgccatctacttacaacctgcccaagcccaaatgttgacaccaccccctggcctgagcccaaccgtctgccccacccagccctctaatgctactggatccaaagaccctacagacgcccctgctgagaagacggccacagacgccgccacaaccggaagcttgcagccagcaccagaaaggcatggtgctaagcatcgaagcaaggagacgaccggagatcggggtacaaagaggatgatcaccgcggaggacagtggtcccagttctgtaaagaaacctaaagaggacctgaaagcgcttgagaacgtccccacccccacggtgagtatagcctcaggtgcgatggtgctttttaagttgtagcaatcccgaggctgactccacaagaagaattcggtggcttgtgaagtttaccaaagcaaaaaactgtctctcagaagacaaagaatgatcccttagcatcccctatccaaatgaggtcccaggcagctaatcctcacatggatgacagcagggacatttttaaaccttgagaggaaaagctgactgtctctctttttaaagcgtcacaagtggctgtccctaagtccttttctccgttcccattactggaacacaaacacctgtcatgagagtcataaatagtttctaagcagttgtcaccacaactgcagggatacacaggcctccctcctgtaactcatgccttctgagtcattccccagtgtctgcttgaagtcatgtacctggcatctgttggctgggagagaatttgcccaccccatcttttccttcctcaaatttcccacgttttccttgtaagccgaaccgtcaagctgatcttat

SEQ ID NO: 32526 - DNA, 2207 bp, Mus musculus
atgggtcatcaatcgcactctttctcattccactctccactcagcttgacccagcaggcacataatggcctcctgcccatgtgccagaagctgggccagatctggtggttgcccacatctggtagtgggaactcgagggttggatctggaaacgaagagtaattctatggagggcagtccctggagttgagccagggagcccccgcgcggggcaagccgcagcagtgaagagaccggagaactgatgagtactcctggggtggatggcagtgatggctgctgagtgcttgcgtggtgcaggcgtgtcgttgcacttgctctttggagcacagactggcaaacttttcaaaagaatcagattcaaatatttgaggtcttatgggccaaagatttctgtcacaactgttcagcgttgctttagtggcatgaaaagtggccagagaccacaaaaggatgtggctgtgtcccacgaactttcctaacagaaacaggtgcccagctggcattagtccaggccacagcttgccagcaccacctaataatgtgtttgatattgtccccctcttatggatggtgaggctgagtgtggcggcctgaaagagaatggctcatgcttgaatgcttggcccctagttaggaaaactaggtttgggaaggattaagagatgtggccttggggctggagagatggctcagcgcttaaagagcactgactgctcttccagaggtcctgagttcaattcccagcaactgcatggtggctcacaaccatatgtaatggtatctgatgtcctcttctgatatgtctgaagacagctacatatatcagctacatatataaacatacactgcctcccactctttgagggttgaggtcattctgggaagagtatatgcatgtatgtatgcatatatgtgtgcagaggtgtatatgcacacttggaaagaaggtggcttaatcctggcttccaggtggaatgtgtaaacagcctgcctactttaaagtatgatagctacctagggagggacaaagtgggtcacttattagagtcctgacccgagttctgcttctcactcagctgagtccttgggcacatggctttatatttctgtatgttcctgtggtccctcccacatggctggtgagatgcctctgggttttgagagattcctatgggcgctgcccttgactgggaagtgtgcaggtcagctttccaccactatgacaaaatacttgagagaaatcaacgtagaagaaggacttatctggggtccagctcaaggtttcagttctggtaaataaacagaaggaagcccagaaaggttgggcaacttactgcgtgggtgatttacccaatggtattcagataacaaggtggagctagccttgggtcttgatctttctttaaatttgaattatttcagcctaactaactagagaaatgagcctataggatgtcatggggggggatggataacctaacatatagactttattcagagaaacagtgttgaagaatgtgttggggaatctagaaaactcagtttgggctccccttattggctctgcagcttactgtggcattgaatgcagtatttatccttctacgcttctgttttctctgctgacaagtgaccactgcaatgacgaggatcagatgagtccatatatttagcatggttaggggaggcttcaagtgtagcagaccttgcattgccctggctgatgttggttacactccagttctgggttaggaacctgccttcagctgggcatcttggtacactcctgcactcccagcacttgagagacagaagcaggtgggtctctgtgagctcaaggcaatcttggcctgcatagtgagttccatgacacccagggctatttagggaaaccctgtctcaaagatttaaaaaaaaaaaaaaacttgccttcaaatgcgttggctgattcagtatcatcatagctaagaaacatacatgcaggtttcatctcacagataagaaatattctgccgggcgtggtgatgcacacctttaatcccagcactcgggaggcagaggcaggcagatttctgagttcgaggccagcctggtctacaaagtgagttccagaacagccagggctatacagagaaaccctgtctcgaaaaaccaagaagaaagaaaggaagggaagggaagggaagggaggggaggagagggga

SEQ ID NO: 32527 - DNA, 1177 bp, Mus musculus
ctctttctcggtggccctacttcaccgccttgaggtcagtgtagcctctggccattggcagctgatgttaaaaatgctacataaaaggttggatgttcagcttctgtatggaataaatatttcattccttgccacagctttttatgcatgcctcgaggcaaatgcattttaatatctaaaaagtaccatctggaatttaaaattcttcccactctgttcaaatttcttctcatataggaagtattttgcagaagtcctgatgggggctggttcttacactctcgccccacacgcaaagcctgaattcgagttaaggagccgtgggtttgaaaagatggctgggtagaggagagaaagcattcggatgcagtggtggctactttggcatgctttgtgcggctcgaggctcagaatgtggacttggcaaatcgagctagaccatagtacctctgctagtgccagagagtggtctagtatccacagccttgcccggatcacaggctcagtcttgagaaggacactcattctttcagcggtattcttttcgagcagatcctcctggcccttgccagccagctggccaaccagccagccagttctgacttgcttggtacatctactgcaaccccgtggggagtcttgactgatctgtggtttaggagtcattttaatggaccttcgggagttaaactcaggtagggctgaagaagcccgtggaacgtggaaaagaaaggttgccaagaatcctcattttatttaaactgtctgtgcaaaggtgttcttgcacattggttcttaaacctccaatacacgttaagcaaggaccttaagttttatttatgaaaacaaacaagcaggttgactacgctaagtcacttccattttagacaagggagggccggttgcgtccaaaattcggttttcctaaacacatttaaaacgtcatggcagtttcaaccacgccatcgatttgacaaggtttgcctttccccacatttatgcctctggtgacgagaacctctctattgtcttgcagagatcaggaatgggaacctcaaggccattctaggcctcttcttcagcctctcccgatacaagcagcagcagcagcagcagcagcaacagcctgagaagcagcccctctcctcatctcctctgccacctgccgggtctcagg

SEQ ID NO: 32528 - DNA, 1091 bp, Mus musculus
gcgccacccagggacacccatacatcacatgtctctgttttccacatggtgctcgccttcccgagaggtattctgtctattccagtgcacccctccccctgttcccggcccatcatccctcccacccacccccacccccacccccatgatctgtgagagcaagtgaagatgcaagaatgtgagtgagcagatggggctagcaacacagaaaagcgcgcctgtttccttcgtctgtctaaatggtcaggtttctgtccgcaaacactgtgtactgtacaagtagttctttggagaactatcaacccctgcctgtgtctgcctttcttcctggttgattgtgaaggccccttttccccaacccccactcccttgaccagaattagtcctttggtgaaagcaagaactaagtagagtttgcctcctccctcagcctgggttttcagtgtccactgtcacagttctgggccctcgacacctccttccggggttgtgtgggcatccatatcctttcagatagaggaggactagttctcctcctgtgggtgagccatggacctcgcctttccttcttgtctctgagagctgagaaccccacagcatcaccttgggcaccccagaccccagttgcaggaggagttgacgatgccccctcaccaaaagctggcactttcctcagatccaatgtgacacagcttagccagggaggggcggccacccttcccagaaacccggccagccgtgcctccgtcccgatgagccttgcctgacctcttcggtgctgaccgcccccatgcaatgccttactggttttgtgctgaccgtgtccattcacatgagtgttgtgcctgcctggggttgtgtgtgtgtgtgtgtgtgtgtgtgtgtgtgtgtgtgtgtgtgtgtgtgtgtgtgtgtcttccccatcgaagtaaacagggctataagtcatctatccatgaagagaacacaagttgccgacctctcatctcagagagtcatctatgtggatgtatgattgggggggggggagggggagggagggagggagagagagagagagagagagagagagagagagatgttttttaggc

SEQ ID NO: 32529 - DNA, 1211 bp, Mus musculus
tgctgtaagcccagacccagcctgcctttgctactagtgtggatgtgagtgtgtcttctgttgttttgtttgtaataaaagtttcaaaccacgtgtctagcctgtgaccagggccaaaccctgagccttccagtgcccctgaagggtagcccttctcagtcttgtctcccagcaacggccgtacactctcatactgtgaatttgggaggtaggaaaatcgaacccctcctcaacatagttttctcagtcaccttaggagtacaccgcaccaacattgcttaaaactgtttccttagcaacaccctctccccactctccacgcccagatgtctctcccagcccacccaggatcgcaacagcagcctgtgtacccattgctgcctgacttggttctgtagccccagagtgcctcctggctcagccaccttcccgaaacactgggaagtggggctgtctgaaaggcacatttccgactgggtcatgattttccttttaagttgctcgaccttggacaaaatgactttgtacccatttagaactctgtctgcaatgcttccattttgcctttttctatagataggctacttttgaaatcctatgcaatgccgctgctgaggtaccagggggagccaaaagttttcttcccaggaggccaagaattctacagaagtccttttaacttaaggttgggggtggggtgggagtgtgacaagggcaagactcacccagatcttcctctgaccttggggacattttaaattttattgtttaatgctcgactttaaaattctgtgtgctcaaattccaaccctggcaaatctacttcaaaagcaaaaacagtccaactttgcggatatcgaatgggaggtttgctgttttgacctgcttgtctcgagccgagcggtttatgaaacatgttctataagatgtacattttttttttcattgtaacatagaaattgtaaatattcgatgaaactgctgcattttgatgacttttttctagccatttttaaagagaaaactaggaattgagtattttgtgtacggtatgttccccaccacaccaccaccacccctccatccctctcccccctctatttaattctcatttgtcatcaggtttttgggtttgagaacaatccgctggagatctgccccatgtcatagagaataaagctgatgattgtaccagtcttaaattattcatg

SEQ ID NO: 32530 - DNA, 1100 bp, Mus musculus
aacactatgctgggttcagagggaggggaaagaggctcaactagggaacttttgtgacttgagagaaaccaaatatatcagagagagctttattacccagaagcctctgggtaaatttggggtattcagtgttgtctaaaacggttgtggtgtaacgccagagggagggagctcctcttgggacttgctgaggagtccccctgaggaatctgccaaaggacaggtttagggaccctggggaagggggtagaggcagagggagggggacagagaaggacagaaagagagaggaagaggaggaaaggccagccagggtcacaagggaagagagagagggagagagtaaatggagaaagagagagggaaggtgaggagaggaatggaggggaagggagggggtaggctgttgctaggtaactgttgggtggagcctggaggaagtgctaacattcagtattttgacctcctctgagactgttccaggagactctatgcttgtctcttcaggttgttcgcctctgctgaggaaacgttttcacactgtaagttggagcatcaatttaatattgatagtatggtccataaacatggtgagtatctcttagcataaaggcaggtttgcttgtgaagtttagattgaccctttttccagaccctttctttcctttgtgtgtagttccccccagctgatgttagctgtcttcctcagttgtgctctactgtgtgcattgaggcaggacctctcacttgaacctggagctcgctgacccagctgctctagctagcagctttcttgaatgatccctggcttctgcctctcaagcattaacagtacaaaaggctgccacctctgcctggtgttttatgtggtgctgagaatcgcaatcatggccttatgccttctgtgtaagtgctctcacccattttgccacagttctgacaatctgagtttgtatcccagaactcacacagaggtggaagaagacagccagtattctttgacctccacttgtgcagggtagcacacttacatatacacatcacactctccctcccccatatagcgtaccccccacatgcatgataataaataaattctt

SEQ ID NO: 32531 - DNA, 1192 bp, Mus musculus
tgcacatcacatctaagtaagattttttttttacttttaccctttcacatactgccctccatgctcattcttgatgcacccagcaggataacctgtgagtgtcactatatgactttgaattggtcatttagcttttttgaaatttactttccctgtgtctgaaataggaataactaattgcacctcaggttgttttgagcatgagatatgatgtactgtgtgcacacttgaaagctaatgtaaactctagacttccttctggtgtggttcagtgtatgcatgcatacatatgttcaatttagccagctaagcaaaagcatactccatgagatcaaatcaatggacctggatagcaagcatgcaaaaagtgcttttaacaagttcctcacttgaccatggtaggcacttaggcctgtttctttccaacctgtttggccccgctgtgttgctgtgacgaggcctgataatgatgtctgttcaccctttagatgtagaagatctttatgagcctgtgtctactccattctcataccccaatggactcagtgaaagcgcatctgttgttgagaagttgaagcacatggaagcgcgggcgctgtctgctgaggctgccttggctcgggcgcgtgaggatctgcagaagatgaagtgagtcctttttccaaccaatccctgttgtatgtaggtggctcaggatagataatagttcctggtaaggacaccgggatgttagacactcagtgtggattcctcctctaggagtattaaagacatgcaacattcatgctgtaccgtagaatgtttatgtacgtgtagaagcttcattattgctttgcacatgtggctgttctcatgtccttctaaaggtatttcctgcctttcactttccttatttctagttggtttctccactttcattgtcctagtttttcagaaatggaagggttattatttttttaggttttagaaaaatacaacattgaaatgttttttaaaaaaccaaaatgtgacagtagtgtagaatttaacaaagaaccagatagccggggacagtttttttccccactcacaggtattctcttggagtccctcatttcctgggggacttgttaggttagatgttagtgtgcaggtggccgcagacctacacatgtgtagtcatagcatgtgttcctcccagtgtctgcctgct

SEQ ID NO: 32532 - DNA, 1230 bp, Mus musculus
gaatgtgggcagccaccctgttgtaactcagaactcttagtgtgtcctgtgaacctctctgctgaatgaatgctcatgctactccctgatttaaactacccactgaattcaggtagtgctgtctgtgtgcacaacaatgaaagctctctagatagtgcatgctttgggaagtggactttgaggtggtctatcaggtgcataccaggctgtgtggcaacatcttgtggctctgcctagtggatgccagtagtgttttccaccctgacctccactgtgtgactgagagagacaaagtctatcaaggctgctactcccaattagctgtgcaacattccagggaactgcaggactgatgaagtttctctttcattagggaagaaagagtatactaaaaagtagggtgtaggtgcagattctgtacttgctaccatgagaaccatttgggtcctcttcatccccaagtttccagggtttactttatatatacaatgacagagctacacaacagcagaaggtacttgctgaaagagctgccagctactctgattggtctcttgtggtcccattcctgacattcatcttttcttttctgtacagggctattttcttctttttgagtcgatgttggattctgtcctttatgctaagagtaaatacttggcaaaagggggatcgggtaagtgcaacatttcaattttaatctgacctcaagatggtacaaccaaatgagcctttgaatatcgagcacactgtgtatggctgagtcttagtagagaacaaagatgttcccattagaaggagccttggtcacttaagatacggggagtccaaggtcatagtttcttaggacatcttctattaaaagtaagtttgtttaataaaaaacataaggactatgtttttaatagtagtgggaagtttttagtattcaaattaaaatgtatcagaagcatcatttcagtttttaaccttttgtcatttactctgttttccttgcttaattttagccaaaggccaatagcctgtgttatgctgagttggagactatttgctttaatggcaaattttccttacctcactaacttatgagcgtctctactctgtgatttagtgtttagaaaggttttaaatacctcccacctgtaagtttactataagatccctatcaacttggagccttttttctgtgtctgtgttttttcccatatctcgttctggtttcatcctggt

SEQ ID NO: 32533 - DNA, 1200 bp, Mus musculus
ctaaataagccagccttaaaaacaacaacaataaaacatggcaataaatcatttggtttttatcagttttttaaatctctattcatttcttttggcgaatcattaatgttcaaaggacaatgatttagttagttatcctaactacttcaggctagctgtgtataagagacaggggactaaaaatgtttgagagctctataaaatgagtgagaattctaaaaaacctagctatgcctcagccatcctcgtaaaaagactgcagcctgatagggcacagtgtgatcagcatggtgagtggtggactcaaggtgtatctgctcaaaaccacccagcaaatctgtattgcattctgtagaccaggcaccaggaatatactagtgaacaaggcaagtgtccaggaatacacttatgaaagcagctagctacatttgtgaaggtaccataggtatttgagacacagagatttgttatagaagctcattttagcctcatggctctctagggtagtctgtgtctgaaaacctccgctctgtgattctgtttggcagaagtatcagcagcatttccatcctctcttagtgtctaagatgtaatgaacttaaagggtaagtattggatttgctttggactcagtgtgaattagccctcaaagatcaataaaactccacattctttgcaaaagcaacagagcacacaattggcctaatggtgatttatttcaataatcaatgtcttgtttttaggactttgtaagtttaatttaatgccagttttgaaaacagattaagtctacttaatccattatcaaggagaacggaacagtagcatttaagttttaaagaaacagaggtggaattgggctgcagagatgtcttggtggttaatagcatgtgctggtcttgccaaggatctaggtttggttcccagcagtcacatacagcagctcattccccactgtaactccagctgaggggatctgtgcccttttctggtttgcacaggcatcaggcacatgtgctgaaatgactgaggtaaggccatcctagtctgactccattttgtgtttgcttagacagttctcagccctctacctcctgccccctacagtcatgtctgtcatggcagcacatttaaggtctccatggccttgagtattgttcagatgttttaaccaaaataattggcaaggtatgtctaaaa

SEQ ID NO: 32534 - DNA, 1163 bp, Mus musculus
gcaggtggatctctgagttcacagctagcctgttctacatagagaagtccaggccagtcagcctatacagagagaccctgcattcagttttaaaagaaaaaagaaagaaaggaaaaaataaatgtgaataaggtatttctccaactaagaatgtataaaataagatttcatccagaatccatttgactaagaacaaaatccactaggtttttgttttatttacaaactagttctaaaaataactgcaaatagcttggtgggagactggcctcccagatagagggtttagttacagaaaacttcctttcaatgtgtggtgtttctttacctctgaaaatagtgtacagttttgttaacacaacttacacaacaattttgtgttaaaaatcctgatctgcttcatgtttaaatttgaaaatatgcttgtgatcaggctttttatacatacagtgagctcgctcaagctctgacataaacagtaagctttctcgggctcttacacacacagtgaacttcctcaggctcttacacacacagtaagcttcctcaggctcttgcacacacagtgaacttgctcaggctcttacacacacagtgagcttcctcaggctcttgcacacacagtgagcttcctcaggctcttgcacacacagtgaacttgctcaggctcttgcacacacagtgagcttcctcaggctgtttctctctatcccccaagagcttgctgcacagtcctagcagcatcagttatttatatctgcctgacactgactaattactcttatctagcccactgtgccagccactgctttggcactttagataggcatggacaattgaagggggctcagcagtatgaattatgtgtttaccactgtgacccttcacactatttaattaacttcagtatgtgcatatagcaccctaatctttgaaattactgctatggaagagaggtcttttgttttatcttcaaacatgagaacagcagccatgtctgcttcttatctaaggcacttcacgtttaatgtgtctaccagtgttgtgagtactggttattatttgaaactgtaaataaagtcagttattttaacaattctatcaggtactttttactggctttatgtttttgagacagtctcaatctctgtggtccagcatct

SEQ ID NO: 32535 - DNA, 1200 bp, Mus musculus
tctgaagcacatccagctgtctgtctttaaagcggaatagggcagtgaccgggatgggcaggctccatgggactgtagcacagctgatcctggccctgcaactactgggtagtaagcctagataaagcagagctcagcggaggatcccgccctcctccctcctcctgcttctgctcctagagatcctagtcacagaagcctgcctggccaggttagctgaggagacttcctctcctgctagactgagagtcatttgaattggcttacttttggaacagtaataatcctgtttttttttaatatagatatacgtttcttactataaattttgtttttaataatgagcagcacaaagcagtgttttactgtagatttcctttctagaggaacaatttttagttacactttttgctgaaatatcaggatatctcaagactagagagccagtggacaaacatcctgtttgcagaggctgtgctgcggtcccctctacccacctgcagctctctctcagctgggcctcttcagtgttcttcagccatggcctagcattgtggggaagtctaacttcaggatgtagcctatgtgtgacagactgctctccaggatggggtagatgttgcctctctaaaatgctgccttttcagatcaggtttgcaccaaggtcatgtatccgtctgctaattctagaaaatcatgttattcgggtcgaaagaatgaaaaatatccaataaatatgcaactattgaaagcttctgcatcacactgaatgttttcatgaagttgtagcatttaacaagtcaaggaacgagttgatttcaagaaaattgtggcttcagcaggccagccaggcatgttttttgcccaaactagacatcagtaggagatcaggctagctctgcagtaggtcagttcccattcagctgcagatctcagtgtgggcgtggcctcttccctagccccttcatggagttgctggtttatgttactacagttcaggtgttcaggtcactgcctcggtaagtggatggagctgacagtattggctcccacctaacacaagaggggagtgaagattacaacatgaaggaactgtactttcattgaaggggagctaacctaccagattatgtattttgttttgcagtattggaatttaactctgggctaactgagctatgccccagccttcctttcttt

SEQ ID NO: 32536 - DNA, 1245 bp, Mus musculus
cctgccccttaaggtggaaggaccggggtctcaagtgcaattgtgtgtataaggtcagtctcagggctctgtcgcccctctttctgatggaagaagtgtaacagaacctctaagagcttttaaccagagaaatgtcgagacatgtcagtcatccagcactgtcatggagcccagcctaagtcatttgcaaagactgaaactagctcttagatctcatcagtgcttgctgtcttcttgtaaggagaccagtttgtggtgagaagcatggtcagtggttgcctggtgcatactcagtgcaccctgttttggttcactgccctttgggctgctaaattcttcatttgaattgcctatagttgctcttgcatccccatgtctgagtttggtaattgctcacggagctaatgctacctcccagcccccatctacagaaggctcccagctccttgtctgctttggattttgtgtgggctcccaggtttatgagaataacaggttaactcgatagtattcagggaccctgttttctcagttgagacaggtaaaacctgagtgaagtaaattgaggtaaggtttataatctgtgtagaaaagctacttgggaaaggaataaatgtatttttagtggcagccatgagagaacagctccctcctaggactcatgactggtcacggcagagaaggcaggcacagcaagacagaggttacaaggactttgctttttaaaatcgaaaacatggagcgaatgaagcaactggaggtccatctgtgcaggaggagggttgactaaaaggtaatttttaaatttgtctactttaaccatggctaaacatttactgccctgcttaaagggatttaggaaactgctactttgtagctgattatcttagtttagaaagttccaagagaatcagcagacaccctggtagacaagagtcaagcatagtaacacactcctgtgatcctactgatcaaaactaaggcaggaagattgcaagtttaaggccagcctgggccatagaatggtacagtttgacacagccccaaggctggtgttgatctttggtaccagctggtagtgctattttgcaaaactgtagagacttcaggtgggactggatctggaagtaggcctctgaagccaagactttgcagatcttgtccagggcccctttcttgggagcaggcccttgcagaggctccctgcaagcacatgggacctaaagactatttatggaccctttg

SEQ ID NO: 32537 - DNA, 1127 bp, Mus musculus
agcctacctccatcttaggcttatagtaaagacaaactaggattattttgtttttgattaaagccctgtttctcaaggattgggctaagctcaacttgtaaccttaactacaaatggttctatattgcatggtccaggaaatgacaaccgtgtctttatttcaaaaagttataataaccatatgacaaccctacatttgtttcaaatggttgctataattgtttcaaatggtagtcagaaaaggtagttaccttgtttggctacctgtttttatgactactctgttatgactaccttgcaatcatgtcttcattttaggaggtcattatgactaacttgttatagttatgttctggtcctgtaaccctgcctattttgcatgccaaatctcccattagaaaaccttgcaccactgagctacaaaatccttgtcttcctcatattcaatgctgaattcttgaaccccatcttaggaggaggcagcccatatacatgggaaaaaaagcttgctttaactagttggtctatggtctttctcctcactttgggattaaaaaaaggagaaatgatgtgattatattttaagtaaaatatgtttaaaatgggcatttataaattataatcacaacagtaaatttgcaagaaaagaaaggaacccatggaaacgaaacctttgctttatggtgaaaatagatgctggttaactgtggctgaaaaatcaatgtgcttatcaagagatgagcatcattgagtgggaatcttctgagaaatctttagtattccctcaaggtcagcacactgaaggtaaagtcaagaggagggcaaggctatatctctagctggcagctaaagttggtgattttggtggcatgagaactgcaggattgaaggggtcatggagcatagctgaaccctggtacactgtggcagtgttggaatctcccagaagaaaggccatctgggaaggtgtagtctcagtttccatgtagaacaaagactggagggatcatggagagaagttgaggcttgtcactatgagaagacaggaaaggccattggtgaagacacagcttcacctacagtggggacactagcatattgctgatgacaagaccatgggacaacca

SEQ ID NO: 32538 - DNA, 1229 bp, Mus musculus
acccaacctcccactcctcaggtacctctaactattacccccgcgattcctacaagacagaggatgtttaacctagtgagaggagccttttatgcccttaacagaactgatccaagcgctactgaggactgctggctatgcctgtccttgggtccgccttattatgaaggaattgccttcaatggagatttcaacagaaccagcagccatacttcctgctcttggggtacaggacaaaaactgaccctgactgaagtatccgcgaggaatccaggtctctgtataggtaccccaccttccactcacaaacacctatgcggacaaattcagtccgtgtccagaacggaagctaattactatcttgtaccttccccggttagatggtgggcttgcaatacaggacttactccctgtgtatcaactaaggtttttaattcatctcatgatttttgtgtcatgatccagctgttaccccgcatatattatcaccctgcatccagtttagaagaaagctatgctggccggcggtcaaaaagaaaaccaattactttaaccctggctgcattcatgggaataggtatggcagtaggagtggggacgggagtgtcagctttgatagaaggaagacagagaattcagtctttgagggatgctgtcaatgaagacctagcggcaatagagaagtccattgacgctttagaaaaatctttgacctccctgtctgaggtagttttacagaacaggagaggtcttgatttgttgttcctaaaggaaggaggactgtgtgctgcccttaaagaagagtgctgcttctatgcagatcatacaggaatagttaaagactctatgcagaaactgagagaaagattagagcgaagaaaacgggaacgggatgctcaacgggggtggtttgagtcgtggtttgaatcacgaccatcttggataacttctttaatttccgctgtagccggaccaatccttatgatatgcttagctttagttttcggcccttgtataataaatagaggaatggctttcatccagagtaaaattgatacagtaaaactcatggttcttcaaaggcaatatcaacctatagttcaggtagatgaagagttaggggacaccaatctctaaaattctatgattagaattagtctaaacagaagaagaggggaatgaaaggaaataaaactgtaattcatgtaatgtatgttaaatagcccaaa

SEQ ID NO: 32539 - DNA, 1203 bp, Mus musculus
tgtatattaatagtcaatgccatatctctgagctcgcaattgcttaaattgttcatccctcagatactattaattctcaaatttacaattgcttatgcatatttctagataataaataaataaataatgctcatgtgactcttaataactttgcaagccttctagttacaactgctccttaagaaaattgattaagagtgcaattagtcactgcccctttacagccatgtatttaaaatattttgtcaactagttattaattcaaaagtttaggtattgtaaaattttaaaactttaacttcttaaaagacaaaaaagagaaaaattgtatccccgtgcatactatttagtgcattcccatgcacactattgaagtcttacctttattttcaaaatctaatattttaatgtcaaagagtttaataaatgctttatagtatcttaaagggatctacttattggcttatagattaatcctaaaacagctaccttattagaaaagggaaaaacaggttttctccacagaacgctgcagaagcatattagtaaattcgtgtgacgagctggtaggtaagttgactcatgttctgattgaattgactaaaaaactaaattaaattcatgttttagatccatccttacttgtcatttttccagtttagactagcttctagccttttaactttatggcaatagtactattcagagactgtatattcagacttagtaaaattagtcatttaatagagtcataatgatttttctcttttcttcagtgtgaccagccattctaactcaatctcagactggtctaatattcagtccaatgttagagattcctatattctaaattacctagcaaagttaattcagagcacatcccccacttcccctagatccctaacctcagaaggattgctggccttacagctagtagaaaaagctattaaagagcaattggtcacttaatacattggtaaaatagaaggaccccctgactaacgaatggaagggtccagatccagttctaatttggggtagggactcagtttgtgttttttcacgagatgaagatagagcgcagtggctgccagataaattaatttgttagatgaacacagattctaaatcttctaaagtatcaccttgaggactaaaattcctcttttgcttaaaagtcagcttgaggactcaggctccgaa

SEQ ID NO: 32540 - DNA, 1162 bp, Mus musculus
taggcaggtctcttgggttgaaggccagcctggtctgtatgagaaagtatagcccatgtagaaagggctacatagtgagaccctttttaaaaaggaaagagatcacaagtctatgacctggagtgtctaaagtggtcacagtgtgtaacagacttgtacgagctaggggtgggacattttcagtataaatgtatttaatgctctgaacttacatattaagtggctaagatagttgtgaacatgtgaagtcagaggctgagggaagagggcatgagtctgaggtgttgctaggctgcatgggaagacctatcaaacacaagagactaggctgaattgtgttagaagaacaaatccagttagaggctgcttggtaaggtactgctttgttccagtggctggtgggactcttgtcttctttccatttaaatgttgaagttcagaacatagacggatttgacttttttcatttatgcagtatttatcctattagtagccaaaggagaataaaataattctctcattctttcttgcttatttgggagtagaggtgggaacgcatgtgccacagcatgcctgtggaggtcggaggacttgaagaacttggtaggatcaaagtcaggttatcaggttaacaggcttggcagcactatctccactaagccaagtagccagccccattttctcattcttggttgacatcttacaatggtactgtgtagccagtgcagccatatgcctctgccttggctgtgtcaggttcaaaatctgatcttcattcaaggagatgtcttagtttgcatttgctttcagttgctgataaatacattgaccaaaagcaactagaggaaaaaggggattatttggcttaaacttaaacacttgaacttacaagtccatcattgagggaaactaaagtaggaatttaaggcaggaacctaacggcacgaactgaaacagacagcatggaggaatgctgcttgatgtcttattctttgtagcttgctcagcttactttattaaacaacctaaggccacatgcctagggtgacaccacccagagggactggaaccttccacatcaatcattagtcaagaaaatgtcccacagacttgcttatgggcaatctgatggaagcctcttcttaagtgaggttccctcttc

SEQ ID NO: 32541 - DNA, 1148 bp, Mus musculus
tggagtagtagctgagagcccacatctgatggcacagccactaggcagaggtaaaactctggaaatgacataggtctttagaaacctcacctcagagcctttcccccaatgatacacttcttctaacaaagctatgcacagtccttctcaaacacttccaccaactggggaccaagtatttaatcttgtgaacctggggctatcatcattcaaactaccgcagattataatatacttacatcaattccctcttccaagtcctctttccaaagcctcccaaatacttgctctttcaaattcaagttcatttcctttttctttactctctctttctctctctttaaatatataataaattttgtatttttcagggctaaccgtttggtactggatagccaatttttgtgttcttccctgggaagacgatttcttccgttctcagcctttcttagttgtgtaggggtcaggcctccctcataagcgttccccttttcatgttagcttatctatttgtgtcatccctgttcaggtcacatttaggcagccatgttgatgagactttgtgggtatgcttctctgacatttataggagacacaatctcactgcaaactctctgttcttttataatcattatgactacttttccacaatcctgagccttagtgcaggaattatgttatagatatatcatttgggactaagctctataactctgtgttctgattggttctgtttttctgtaatggtctcttgtctgttgcaaagagaagttttctctctctttaaagattcatttatttattttatgtatgagtgttctatctgcatgtacgtttgcatgccagaagagggcatcagatcacattatagatggttgtgagccaccttgtggtcgctgggaattgaactcaggatctctggaagagcagacaatgctctttaaccaccaaggtatctctccagccctgagacattttcttgacaaggggtgagaactgcacttacctgtgagaatttagttagggaatatatgagtttaataaaaactggcagttacaggttttcctctgagatccatgacttcattagttctgggtagttggctaggtttccagtacctggcataattcccctcctgttgagtggg

SEQ ID NO: 32542 - DNA, 1208 bp, Mus musculus
taagaaaaaatttcctctgtatgaagataagatatatcaataaatatgtagataaatatattgatgacctagattcatgtattgttatatttaattcttctgttcttttcctaacagcaaaattatattatggactatcagttaagattggaaatagttaaaacaacacaaagccaaaatttataaaataatccaaacttattacagaccactcttttgccataatttgaagaaacataattaggttagtgctaaatttaaataatatatgtatttttgatcaattattagataatcagataccagttttgtaatgaaaaataagttgtcaaaagtagttacctgcttccttctataggagaactaggaactgtcaaattaggaacaggactagtactgaagtattttctttcttttatgaggagggaaatgacttgtatatgagctctcatgatcattttgtgaaaacctcaccttattttatatcatttaggtttgaggattgcgtcaccttgtctcctgtacaagcagtttctctgttcggtgatcaatgtcactcacaggaacttaagtaactaacgaaatgagcctggggcgtggaaaatatgatttttatattggtctgggattggctatgacctccagcattttcattggagggagtttcattttgaaaaaaaaaggccttctgcgacttgccaggaaaggctcaatgagagcaggtaagttatgtcctttaggtatcaaaaagtacatatatactcatacattcaggttctttgagtatagacacactgtcttcattctttgtgattatatttgaatatttgcattgctcaagagatttctaaatatttaatagataatcagataccagttttgtaatgaaaaaaataagttgtcaaaagtagttaactgcttccttttatagttactgtcaaaataggaatgggaccagtgccaaaggagtttccaaggtttaagtttcattatatctgtgcaggaggaaatttgatccatgaatagaaccaggcttttattaaagactgggatattttatacgtgatagaacttgtgacttctgctttagatgtttttcttgatgatgtgaaattgaacaaaggaaagaacggtcttgcctgatttgcgttttccagtaattgacctgaatggtgtgtgttgtttcctccaaatttacagatgtgtta

SEQ ID NO: 32543 - DNA, 1104 bp, Mus musculus
tacagggtgtatctttttatgttgtgtatatatatctgtgtgtctgtatcttattctgtatgaataagactagggatatgaacttaaaaatcatacagtgtttttgaatacggttctgaataaggaacggagaaaaagacttcatactgcagctctagctttggactgtgttactaacaaatcagaggtgacaagacatggtatatattttaatagcatagtcaaatcaagtaaattgagcttcatattaaaggatgttacttgtcagaagttaatattgaaggatttatgttcttctgtagctgagagcagatgtccttacagccataggtttaatggtgtaactgtgcccatcttctctctagggaagaaggtgattgatgtggctgcaggctccacgcactgccttgctctgacagaagacagtgaggtgcacagctgggggagcaatgatcagtgccagcactttgacactttgcgtgtgaccaagccagaaccgactgcactcccaggactggacagcaaacacatagttggaatcgcttgtgggcctgcccaggtactgactacatagtgagctttggtgtcatgtacagttttattttattttctaaatgcttactcctagtatgtagaaatacccgggtttgtgtgtcatccttctatcttgcagtcgttccacaacaaattactacatttagttctttcagccttttcttctgtacattgtagagacagcatattcttcttctctcttcctcctaccctctatctttagctctttagtgttggttgtcagttgcttcttttttttgggacatactctaaatggatgctgaaatttgttcaaaaaatttttttttctgacattatgtaagttaagtagttttcatattggaacgttccagttatcaaatattgactaatctctgcattactgctataactattggtcatggtgttttatccttctaatgtttataagttttacttgataatatattgttatttgtgtgtgtgtgtgtgtgtgcactcctcagggttactggcatccagctttctttgtgctcttgcttgatttctatgaggctaaagccgggcgtg

SEQ ID NO: 32544 - DNA, 1163 bp, Mus musculus
gcagggactgaagctactcctccaagctgtgtttgggcatcttattctaatcaggggcaatttatactcattttagtattccttcctgtgttctctgctcaaaggatctccatatgccatccttcagcaggcgccgaaagcagacttgcaaaggcagtgtagtgatgtggtacattttgacttttagaacagatgacatttatatttgaagtactgctctggagggaaaaaaatgagttttgctttcaaacgtttttatagaactctacctttttgagcacgatctgctctcattttgtgtcattgatgttctggtagggctttattagatctttggcatctgatcagtttggaatgagagtgtccttgctgcctgcagatccatctcatacatttggtgggtaacttctgtatgatctatgcttctggtaattatttcatgtaaagttctttcctttgctttttaacagaaatccttcattttttactttctcttcccttacttagaaacattgcttctcagactgtagccagactgaaagatgttgctcgccgcatttcctcatgtctggactttgagcagcagagttgtgaaagatcggcttcactggatctgttgctgcgctttcaacgcctgctcattagtaaactttacccaggagagaagattggtccaatctcagatacttccagtaagttattttaagacatgaagatgtcttatacatttggagcttttaaattttgtttttgttttgtttggtatgctctgactgtgtatccagatgtggttcttaaattatactaaatgtacaaattctgaaagctacgtttttagtctacttttttgagcatatatatatatatatatatatgctaatcactttaaaaatatgaatttataaaaattcatttttacatatgtgactcctttccctgcatgtatatatatggagcacatgtatgtttggtactcacagaggtcagaagagggcttcaggtttcctggcactggagttatggttgtaagctgccatgtgggtgctctttccagtggtggagcatcattattttacttaattgtctaagcatttcagttttcaaggttatcaggcatgtaaccaaattcattatccctctagttctatgatacaaaaaagagc

SEQ ID NO: 32545 - DNA, 1165 bp, Mus musculus
ttgtaattcttttttacctcattatctgatacattcagacagaggtttatttactttgttttgtctggttcttctagttgggaaaggctagctgaaaaatttaatttaccattagtggacatgtaaatactttacagatttgacatttagctctgcattcatataagcatttttatttttattttataatttggggtttatagagattgatccaggggcattctgccaggcaagcactctcccacagaactgttccttaagatcctaaacacagttctaataagagtgttttctacccagacattaatcccagcacttgggaggcagagacaggcaggcttttttaaaagccacttttgatattaaccagctcttttaatttaaagggacttaaaaaatagtatagctagaagctccttgctatgtaattctcttagtttctcaaacatggaggctctgactagtcgcacaagtgtgactctgtttgattacatgccatagggcagtctgcagtgttttgtggccgttctggaaagcagctgaaacgatgtcacagcagtcagcctggaatgctcctggacagctggtcccgaatggtgaaaagcctgaacgtttcatcctctgtaaaccaggcttctcgtctcattgatggcagtgagccctgctggcagtcatctgggtcacaaggaaaggtaatgtttggtgggatgtgtcaggaaatactctgatttggaaggtggatcgtagacctttgcagtgaactgaggaacctgcagctttcctaatactctctcaaaattcactttatatttcagttcataaataattttcaagttacagagtagtatgttgtgtattgctagattttaaacagaatgaacaacaaattttattaaatggccaattgataaaaggttcactgttttttgttatatttttatatatgaagtattagttcttattatacttctggctagaaatttttctaacttacagataagttttagggattacactaaaactgtgtgtgctgacagggcagatatgagacaggatggagaaggtgggggcattatcttattctaactatagtatttctgtgacttagtataaaatgactgtctctagccagaagtctataaatatattatatatggggcttaga

SEQ ID NO: 32546 - DNA, 1121 bp, Mus musculus
aaacctttgacagccttcccctgcatgaatgttgcaggtggccggcatgctacagccttaaccgtggatgggaaggtgttttcatggggtgaaggtgatgatgggaaacttggacacttcagcagaatgtaagatttctttcttcaatctcacccattaacagggaactattaagtagtaataatagtgtattttcagttattttgcagaaaattaatgttataatttatttattaaaataaatattaaattttttaaaacctggattagatatgttgtgattttacatactcttttaaggtttgatagttagagtgatgtatacatatattttttgttgaccaaagatgggccacctctgtgaaaagacgtttgatgaggagtgtttactcttaccttaggaactgtgacaagccaaggctcatagaggctctgaaaaccaagcgtatcagggacatagcctgcgggagttctcatagtgcagccctgacatccagtggggaactgtacacttggggccttggagagtatggccgattgggacatggggataatacaacacagctgaagcccaaaatggtgagtatacacatttttattgcttttaaataatatatagcaaagataagccttaagtctaggtttttaaagacttgaacgttattgactttgttttctcagttcccatgcttcattctgttttaaatttgtcattgagtaggtaaaagtccttcttggtcaccgagtaatccaggttgcgtgtggaagcagagatgcacagacactggctctgaccgatgaaggtaagagctggttgtgatggtaggtttctggccgggtatgaatgttacgaactatttacccgaggtatttattttttaaacctaggtttggtgttttcttggggtgatggtgattttggaaaattgggccgaggaggaagtgaaggctgtaatattccccagaacattgagagactaaatggccagggggtgtgccagattgagtgtggagctcagttttccttggcactcaccaagtcaggagtggtgtggacgtggtacgtgaacttcctcagtgttattgccaaatgtggagtgtgtggcaagccttgtgcacag

SEQ ID NO: 32547 - DNA, 1193 bp, Mus musculus
tctacattttcttaatacttttatttctagccaaatatatgggttctgtaaagataatgtgaacacagtaaaataaatgcagggttttacttattctcaccacagtctcttacgaatattccctaccaacaggtcttggataaatacaaccctcctgatcacttcctcccagaatcctacacatgcttctttctgctcaagctgcccaggtattcctgtaagcaggtgcttgaggaaaagctgaagtatgccatccacttttgcaaatccatagacacagatgactatgctcgcatagctctcactggagagcccgctgccgatgacagcagtgaggactcagataatgaggacgccgactcttttgcttcagactctacacaagactacttgacaggacactaagatggaaacgccatcaggaaaagatgtggctgaacaagcaggaagagtcctgctgtgtaaattgtaaatgtcgagtgcacttgatgaagaataccactccttaaaatgtgtggaagagagagagagagactgactgactcagagaactgtgtggtaggacaacagcaagatgagcctgtgcatgaagaactcacggggcacttccccacaatgctgcattaccgataggacctagtgtttactacagtgtaaatgtttatatggacacagaacagcatcactaaataaagcctttctacttgtgggtgcaatagattccttctttttcctttgcagtgtcatcttgattgtatattgaaaatactgtgtaatgatgaaatcatattataaatatttcaactaattttactctgaatttgtttattaaaagctttttgaacattaaattattatttcttcaatgcatttagaagttagaacagaaaacaaaaatgccagtcaggcctcttctccccaggtgtaccattttagcatatgcattatgtgattggaattgaggcattttagtggacaatatcataatttctatcatggaaagtgtatttaatgtctgtgtcatgtatatgccaaaattttaatcccctataaataaaacatgtgtcacaaaactgtaggctgaatttcttaaccaattagactagcacatgtggatctgctacaaccaaaccatactctgtgacaaagcactgaggcatttattaagatagctgctctcaggacccgagggg

SEQ ID NO: 32548 - DNA, 1151 bp, Mus musculus
acccaccacacacatgcacatacaccccaacccaactgcacatactcatatacacacactcacaagaaaggaggaggatttgtggtggggggatggttctataagtaagaaattggctgtgcaagcagaaggctgcattcttaccctagcactcatgtaaaagccagaactgcttctatacacctgtaactccagagctggtgagggcagaagtgagaagggaggggcactggagacaggaaggtccctctgtccattgatccttggctcagtcgacagctagcctagctacttgatgagctctgagttccagaagaggctgtttcagaagctaaagttgagagaagtaaaggaagtcattttgtgtcaacctctgatcttcacacatacgtgtgtgtttgtgtatagaggtaacatcctccctccctttcccctttttcctctcagggttcttgttttagaaagagaacgctcatctgcatatctatctatctatctatctatctatctgtctgtctgtctgtctgtctatctatctatctatctatctatctatctatctatctatctatctactatctatctgtctatctcatcttcctacctgttatatatccagcatctatctttctacctgttatctatctatccagaatatatctatcttcatatctgtgtctactttgtagcatttatctgcctatctctgtttatctatccagcatctatctgtgcaactatcttttccctatggtttgtcttacttaccattatattatattgcatgagtttattttatgattgataactcatgcccacacttgagaactcatcttataaaatgaaagtttaattgcatggataattttcaccacatcctaaggaagttaacccatagaggccattggaggtttaacttgcaagaacacttctgctgtggaaaaagttagctgttggaacatttaggtcacagagtgttttgtgagaacttggacaaatcctttctttatggcttttttttttattattacttttcttttttctctgaacaaatacctgagaagaagcaacttaggaagagaagggttcatgcctgtttagacctagccatttgtgatggagagatcttggaggcagggctatgagccaca

SEQ ID NO: 32549 - DNA, 1103 bp, Mus musculus
ttaaagtgaattgtaaaatgggctttgttaaagagagagagagagagagagagagagagagagagagagagagagagagagagagatcctataaattctagagtgctttatcatagaatactgttctttcccttcagcttgctaagatgaaaactgcaaaggcgcaggctttggacaagttttgacagtatagagtatgtgatttgcaatgacagcggttctttaatgtttcataatcaaggacgattacagaaacctaaaccttggtatatgttccaccactccaagaggaccaagagctcaaggcccatatgtgccacacagaaaggacctcttttcaaataaaacaagacagataaggtgattaaagatctagagagatctcattattcctgaatgttagttccaattatctggtgatggtatgggatgggagtgaggttgaaaatgtgccacatgccagcattttaacaaatgtcttaaagaatatatgattataccttaatgacattcggaggtaaatgaactttggaaaaggtaactggttcctgatgttctgacttctaatgagctgttaggaaaagtgtaggatattatttcccttcatccctggggcagagttccagggagctccttttcaggggtttgtgttgcatgtgggctccagtttctcacatttctgacagttctgtaatatttatgagctgagcagttcacgaaaccactttcttgaaaaaaaattcgcttttgtctaacacactttaaaattgtttcttgagcttaatagaaccattagtctttaaatgagcctgtcctcttcataaaggtggcttatctgcatctaatgcaaaaatacttttaaaaaaatttgtcaaaaaaggaactgaaattataattatgctatttctttgattttctctcctctatacaaactctttcatgcacctttatttgctctgtctcaaatttgtggattctatttctttagttgttggtatacacacacacacacacacatatgttcttatggcagactatttggtattggacagccaggtgggaaagaggtctttcctggtcaacccaatttttcccacccccag

SEQ ID NO: 32550 - DNA, 1276 bp, Mus musculus
ttctcaccaattcaataaacctttagttttctcaatagtactgtctttccaaaacgaaatgcttcgcagagggcccatggtgttgacgccttgatgacagccctttattagtcatttccagatatgtctgtgacaattcagtagcccttctctatcagtcccagcagaaaaaagactcaccagagtggaattatctttaattgaatgaaagtcactcctgctcaccaatcccgggacagttgagtggttgtgttgccaatgccgtgacaccctcactgcccctgaatctcaaatgaactaaagagtatatcataataatgttcccactaggctttaagtgacatgtccatctgcagtattgtgtgttttgatgccaacacggggacatcttcagttgttcccatcaaaagcagttctcttgttttgaaacacggagttgacaatttcaccaatgagatcatctcagaggggtcaggcacattgtagctgtaggtgtttgaaccacggaaacacattctgaaaagatgtgtccattgttgaatctccttgcttaaaagcataagcctactataattcatattttaaccctccacctaaaaataaaaagagttcatatttctggccattttctgtaagccaactgaaccaatggtaaaatattttgttacttttggaatgaactctgacttcatgtcagtgtgaactttccatcacagtaacattgactctttgggcaaagaactgccctggtggagtaaatttcccaggacactggtgagtgtaccttggactgattacctcttctactgcattgaaaggtgccatgttttcctgaatgactaaatccccctcaccttgtaagtgacctcccagagtggctcatgcaccatagctctcctagggacggcccacaaacatgtcattcgtgactcatttttctacttcccaagtcagtagatgtgttcaaggtaagtacaggattgttctcgtaggaataggcggttgctgtcctgattggtattcccgtcgatttcatttcattgtaaagattaaacttaaacccggttttgcttaagcacattgatgtaattttttggtattatttgacatgaaaaaaaaaacagcaaaattgagtgacagatacaatatgaaacttgttgaatgaattcaaatttattaaaaaaggactaactgataaatgtgaagactgattttttttctcttcctttccatctgttaatgaatacttttttaatccaaccttgtttaagtacac

SEQ ID NO: 32551 - DNA, 1176 bp, Mus musculus
cctgagttcacaatcctcctgcctcaaccttttaagtactgggatcacatacatgctaccctatcccacaatgcagttaaatatttatgtaccaaaataacccattttaaagcagcaaaaccagatgctatggtgcgttcattttggggggatgttgtctcattattaaattatattcaacaactttttaattacaaggagctgcttaaaattggatacaataatacaaaggatattaagtacaagatattaagttctctaggcattgcttttggctgcatcctgtcagatttgctgtgctgcattttgcattcatttcaaagtatccaaatttattttggtggcttctctttgattcattggttatttaacaatgcccatatatttatgcttccctcaaagttgctattgctgttaccatcgtttataaatgtattccaataaattccacatggtgtggaatttgcctcttatacttattgaggctgctttactgttcaccatgccttgggagctgcattgtgttgcatttgcacatgagaaaaatgtgagtttactgctgttgggcagagtagtctatagccgtatcaggccgactggcttatgattttgttcattctgtttaagttcttgccacatgatgatgatgatggtagtggtggtgactaatttttgttgttagtggaggcatgaaaacttcagttattgttgaatccctatgctgttgattttgccatttgtttctggtgttttggagtttatttgatgcatctggtgtgtaattacggtgacctctctatagagtgcccctttatcattacagagtttcttttgtctctactctctgtgttcgctttcaaatagccggtctagataactttctcgatgccatatacatttttttatttgtttttgaacgtcatctgtcttttatactgaacatgtttgatgttttaaaacaagccgttcttgctctttatcagagtttgacccgtttacactaactgtctgtaccaagaatgtggaatttaagtgcattcattatgtcatacatttctgttcctttgtttctcctttcttgctttattttgctaaacatatgtttcctagaataccattctaaccacttggttttgttttgttttgttttgtttttctatcttttgaggcataact

SEQ ID NO: 32552 - DNA, 1987 bp, Mus musculus
caccttcctgctgcacctgggtattgaaaccaaaacctgggtgagagccaggggcaaggccacacaccacaaggggctggtattatgagacatgtccttcccagcaggtgttttgcacatatagaaggctacaatgctgccctacctatgtcataaaaaggaaaataacacacactcaaagttgctggcctagctttgagtgacccaccaccaactgtcctgagcagctgtttatctacctgccttcttgtctccttcgctgctctgcttttgcctagccctctcctcttgccctcatgctcctgtcccaggctgctccactaaggcccactggccagcaatggcaagaatcttcgctaagacctggaaggcacacccttaaccgtccctgataaactcatgttgctcacactgttgctactcttaatgtgaagtaaatgccctttctctctggttccttttagacctggctcaactggttagcctgtggcttcagtacctttttgtttttctccgtggctctgatttacaacacttcctgtgccacatgctaccctccatctaacccttactggaccatgcagacattactgggtgaccctctgttctacttgacttgtctcatcgcacctattgctgcattgttgcccaggtgagtagctgagttggtaaagccaagtgataaggaagtgtagaatatacacagcccctggccttgctgtgcttgaacctcggtgagtctcatgaagctcagccatggcccggtttagaatctgattggttttttgtgtgtgtgtcttctttctagattgtttttcaaagccctccaggggagtcttttccccacccaactccagctaggacgccagttggccaagaaacccctcaacaaattcagtgatcccaaagagacttttgctcagggacagccacctggacactcagaaaccgagctttcagaaaggaagaccatgggaccttttgagactctccctagagactgtgcctctcaagcttcccagttcacacagcagctgacctgttccccagaagccagcggggaacccagtgcagtggatacaaacatgccattaagagagaacaccttgctggaaggacttggctctcaggcctcagggtcctccatgcccagaggggctatttcagaagtatgtcctggggattctaagagacaatccaccagtgctagtcagactgcccgtttgtcgtcactcttccatctgcccagctttggctccctaaattggatctcctcgctgtcactggccagtgggctgggaagtgtcttgcaattgtctggaagtagtttacagatggataagcaggatggtgagtttctatccaacccaccacagccagagcaggacctgcacagcttccagggacaagtcacgggctacttatagtatcacctccgaagggccacagccaaatgtggtgacaaagaaatccttgaaatggcctttttattattatgtaacaaatgttaattttatttatgtttattatttgcacagaagagttctagaaagatgtattttttaaatgtttccaagacatatataggaagccagaggtaccaaaaagaaagtttattttttaaaagttctaagtagagtatacttaagaaaaataagaacacatatctttatctatctatatataaagtttaaagaagagtgacacttgaaaagtgtgtctagatttattttttcatctcatttttgtaaggaaaagcaatgtgcattgtttcttcaacacacatgaccctcactttctgccagcagacataaacatacagttagtccggtgaagcctggggtagctgtggcgggtgtggacacaggacagggaggaaagaagacagacggaagggcatgtgacctttgaggcaaatacctccattgtcttccaatgttactaacagtgaacagaaagtgaaaccttgaggaaaacccatgtgacg
